United States Patent 7,468,248 (METHODS AND SYSTEMS FOR INFERRING BOVINE TRAITS) - sequence listing, part 14

SEQ ID NO: 46367 - DNA, 2897 bp, Bovine  19866880931468
atccccttgagaaggaaatggcaactcattccagtattcttccctgggaaatgccatggacagtaaagcctgatggggcatagtccatggggttgcaaaagagttggatatgacttagcaaattaacaacgaacaacaacattcaataaacaattatgttcaggtcagttcagttcagtcactctgttgtgtctgactctttgtgaccccatggactgtagcacgccaggcctccctgtccaccaccaactcccagagcttactcaaactcatgtccattgagtcagtgatgtcatccaaccatctcatcctttgttgtccccttcgcctcccgccttcaatctttcccagcatcagggtcttttccaatgagtcagctcttcacatcaggtggccaaagtattggagtttcagcttcagcattagtccttccaaagaatattcaggactgatttcctttaggatggactttaggatgcagtccaagtgactctcaagagtcttctccaacaccacagttcaaaagaatccattctttggcactcagctttctttctagtccaactctcacatccatacatgactactggaaaaaccatagccttgactagatggacctttgttggcaattatgtactctacttcaatccacagattatgctgaagacacagtttttagatggtctcaaattaagagtctgttcaacataaacaataatattggaaattttttttttaataaaagacctgatttgggtctttgttctgcttgagttttattagttgattaaaataaacaaatcttaacaaatgttcttagtaacatgctctgctattaattaatacagtctttgtaagaggactcccacacttttcaagagattgtaatcaaagaaatactggtttcacagaagagattgagtgctcatcaaggctttggtgtcaactagtatctcctcttcccggttaatcagtctcatttggttcacagaaacttttttattctcatcccattgtatcacttttcttggtgcttctgtggcaaaggttattcaaattcaagcacaccagctccctgagtaggtgatactcaacaaccaggacccttcctactagccactttcctacagctgtcatctttccaacatctcacatggaaactgatcagtgaggggtcagctagttcaaaggcagttgacaagcctgacaaagatgccctcctcccaaatgaccaacaccgtgtgagatctcactacagagtcttcttcagttcaatgccacctttgatgtccctcatacaaaggggtccctcaaaccacttttgctgaatgaatcactaaaacaaaagaaaaaaaggcggggggagtctgaaaagcaaggtgaaaaacttgacatacgctacatccccaaggatcattacatccttcatttaagtacttgctgagtgcaaactacaggtcagacagtagtagcccactgcctgatatacagagacaaatactatacagcccccatcttccaaaaatacattaaattaaaatctttcttatctgtgttttcaagaaagttgacaacttatcatgcttaattcctgtgccacttaatacgcagcactgcattgcacttatgctcaaaatctttatttaaaaaaaaacaaagcagtgttgaggatatcactgtcactttccaggaatgccaggtcctttctgtttgtcagctctctcactttagtggtttaaacaagaagatgtgattgaaaagtaaaaacacaactgagctatttcataccgaggaaagtaaacgtgctggtttaaagaacatttttttagtctcataacaaaatccaaacaagctaataatcaaatgcaagttctttgtttcaataatcccccctttaaaaagtgaatctttatagaccagactatataagttaaccaacatgaaactttccaactcaatttattctttaaaaaaatgttctgttggaggatagttgcttcacagtgtgttagtttctgctgtatggtgaagtgaatcagccacaagcacacatacagcccctcttccgtggatatgcctctcatttaggtcaccacagagcattacgtagaattctgtgttatccagtcagttctcattagatatctgttttatagatagtactgaatatacgccaatcccaacatcccaatccaccccacctccttcccccattggtatccacacatttgttctcctaacttcatcttaccttaaatcaagattctctccaaaatcaaaccaaaaaacaaaaacaaaaaacaaaaaaaaaacctggatatttaatcaactggtttcagaaatacataaaggaaagtaattaagatacactcatgataatgaatgcataataataaaattgtggtcacttattttcagttgccttttcttttcacatcctgaatatttcacagataaaaaagcaatcataaacacgatttggtttgaatctgtgactatacatttttagagcaattttagttatcactcatgtaatatatgcaaatctggagttgaatacagcctcaggtgttaaaattcttattctcagccttaaggaaagtattaatgaaccacagttctgattcccaaagcaaagtaaaatatctcactgctgtagtgatctagaaaccagtagttctatttgagtattttcaaaattccaaaggagcctgtaaaaatggatatcgttctgaaagcaatgatccagcaccatcttcggtggtaaatttttctccctgggatttttgccaacctggaaaaagatcaataccacattcaatagataaataatccacatatgggaaagtcacctaatgctataccgagctctcagactcctcctcatcactccactc

SEQ ID NO: 46368 - DNA, 980 bp, Bovine  19866881023825
ttatgtgaagaacatatatccagatttctttaactgatatggatgaacctaatagagaataaggggaaagagcaacaaccccccaaaaagactagtgcagcaaatattgatccattatacacttgctggttattgtaataacctttgaacattccccaaaaggaaagcatgacatggataatgtatgtgcctactgcaagtaatcttccaagcatgaatggctgaaggattataatttcttttcaccagatcatcataggtgtcccagaggtcatacaaataaccagcatcctttcatcctaaacactaccaagccaaggttgagatatgagcctattaaaatctggtttaaaaaagaattttattttgcccgtgatttcataaattaattgcagactgccttttaaagccttctgcggaagacaaagagaccttcaaatcctttctctgagaattaaagctttcatttaaggattccagatgggctgtattttaagcataaaagttcaaatacttttaaccaccgacagatgaaaggaattttacccagttatgttgcacaattgccacccagtagttcttcaatcctggccaaattgagcatcaatttaaattagatttaatcgtgggacccttgacaatcacaatcaacacaagatattagggagtttaggaaatgggtctattaaatgacaattaaagctgtcagccttccagagcttattttcagttaatttgatccctagtagacagccacattcaactgctgtaaacaaagaggtctgtttgaaagtgcaagctgagatgggagcctggttccttagaaccttggttgatggcgtgtttcacttccaggttcaggtagcctccatctgttactcagagtaagtgacttcaaaataactccctgtgcaactactgaagccctcctgaaagtcctgagagagtgtggggagtggctggcttttcctttttgtgta

SEQ ID NO: 46369 - DNA, 814 bp, Bovine  19866881028855
aaactgaaaatttttacagcatatgtgtaagggactgtatattggtgaaattgaaggaggtgttattggagtacagtttgaaccatactatataacttagagatgaaactttatctattgactatttgaaagtgtaatgcttctataatgaacaaggaatattaatagattagtttaataagacaataatttctatttttatatttgtccatgattctttgataatcataccttcattgtgttttaatctgtgaaagccatacttgaccttagttactgtcacattttctttaactgatactttcctattttttatcattatcttgtaggcaattgcattgcctcctattgcaaagtggccttatcagaatggcttcaccctaaatacttggtttcgtatggatccattaaataacattaatgttgataaggataaaccttatctttattggtaagtgatatatttaattttagtacttttgtcttaagcatttcaatttttaaaaatatgtaacagagtgtcaaggcaacatagtatgtagaataagtaaataaatatgttaaacctatgaagatacagttatgtcagtttattttattcattttttgccgttgattctaggctatctgccctattttttttcccccttaattccattttaagaatcaagtgttacagaccttctgtctcgagtctgcacatatcaattgaatgttctgagtgaagatgctgatcgagaagagaaaatgaaaaacaaactactctcagatatctttaactttgccttttcacttacatgggttctgggagcat

SEQ ID NO: 46370 - DNA, 696 bp, Bovine  19866881036860
cagatatgagacttcatctgtcttctagtaagacagacattaaagagacttgcaaaaatgtaaaataatgctgtgctaatcagttgctattttatttttcataaaaacctatgtgttgataaagactggaatgaattattaaaaatgaataaaatacatttcaaatttttctcaatttctgtttctaatatatatagtccagttttcccagatgatgctagtggtaaagaacctgcctgccaatgcagaagacataagagacacaggttggaaccctaggtctggaggatccctggtagtaggaaatggcaacccactccagtattcttgcctggaaaattccatggacagaggagcctggcaagttccaatccatgaggtcgcaaagagtcagatatgactgagcacagatgcacacaagaatatacaatccacaccagtaaagcactttgaagttcacaatagttttttagggaatgaaggggtcctaagaccaggacgtttaagagccactcttctagtctgtctcatgctttgttgtcatctttatttgtgtgtttggttcacttgcctacacatttgtctaccagattgtattgttagattattaatataaccatttcttcaacttaacaaggccatttggatcctggatctttatgagttaagaagattcaccatttctctttccctcat

SEQ ID NO: 46371 - DNA, 2308 bp, Bovine  19866881042263
ttacaaacaatgagatctttgaaagtgaaagtgaaagtcctcagtgtgtctgactctgcgaccccagggctatacagtccttggaattctccaggccagaatactggagtgggtagtccttcccttttccaggggatcttcctaacccagggatcaaacccaggtctcccacattgcaggctggattctttaccagctgagccacaagggaagccttagaaatcatttaggaacccaagaacattgggtttccttgccttcatcttcccacattggtctttttctaaagaaaagaaaaaatatatagctgcagttgtacaagtgaacacttccactggaaagaatacaatgatatagcccattgaggggaagcatcagaaattctaaggacttcacatgctaaacacaattattcattccttgtatggttccctcccaactattttcttcctattcacatagtcactcattatttttaatatttattttatttatttatttggctgccctgggtcttagctgcagcatttgggatctaattccccaaccaaggactgaacccgtgccctctgcattgggagcatggagtcttggccactggaccaccagggaagtcccaccaatcattactgacgatgcaaactttgtaaccataccccaaactaagaatcaccttccactgcaacctgttaatcagttacctcatgaccactctgggagtaaatcttgttatttcccttaaatacttcccttcatgacttttcctcaccatcattcatcaaaatacttacagctccaataaactcttttcttctgaatgtaaatcaaacatgatcaaatttttttttttttttacaaaaatgccctcaattgttctctatcatgaatctattctgcatgtaactttgtttggattccctccaaagaaaagtcaggggaaaaatcttgagtacaagtaacttacttaggaagtgattccaggaagcagagtgtagctaaggggatgtgagccaaggaagagggaaaagccagatgcttgagggagaaagccctcagtgtggttgggaaccatgcaccaaagttgggtaaggaatgttgacggggctcctactatggtgcccgcagtggcagatgcctgaattccaccagatgctcagctgtgcacatagtagggaactgtgcttcccgagtgaacattcaaatattctctcccttttatgctcatcataaaattatgatccttatttgtatcctttcccaaagtcgacctttaacccaatcattcatatatacatcttttcacctgtacgaaaagcttcctgtctccactctgcaaacacttgttttgaacccaattatctcagtgcacttctctctcttatgcactgtcaaggcaatttacttcaaatgagcaaatagctccagctcatggcccttgctttcgaatcttgaaaaagaaactaggatatctttttcaaccagagggatacatcaagggttttttcacaagtttaaaaaatgtttaatttttcagattcacagtgttattttctacatcattatttacataagtaaaaatgaaacatgtccctttgtatgctagcctcttttccaatcagcaaatttgagggcaagaaattttatcacagcaaattctgttgattttatatctagagcacaattggcactttgtgaaagagaataaaggtcatatagaaacagaaagaatcaagcattatcccaaaatgtgaaccatcatcttaaaactcattttatcttccatattagacaatatatatcaaacattcttctttccaccacatcatctccttcttataacccaggatggtttattaaccccagttttgggcaactgtaccaatgtattgatccccaaaagatttttccacccaatggtgactttttcaattaactgtcattaccaagaattttgaggtgtagacatgtgctagggattcggagacatcatttctcacctttgtcatggatgaagtaccacattttctaaaacagaatcaacagccttaaggtttctgatgtgcacatacaactgtgtctcctgtctgattcatatttgtaatgaacctgctttgggactgctggcaataaaagggacataatccttaagtaggtttcagagaagctcgattaatttatgtgacaggactcaatcttgtgcaaaggtttaatgagaacctcaagttgtataaagtgtgcctggcatctgcctatccctctgtcaggaagagcagagggataccttatgtaagaacatatatccagattt

SEQ ID NO: 46372 - DNA, 1872 bp, Bovine  19866881061171
acaaatcattatagtttaaaaagtaagttatacttttgtaaataaatagttttaagttcttttgcttttaactgtagaatttggaaagttggtcaagtgattatagaatagtcattgtttgcttgccaataaatatgaaacatttgactgattaactttcccaaaaaaaatctttagttttttttttattattatttaaataatccatagagtcttaattgttggttttttctgttactattattatgctttatggtattacttacaatgaaggcagatatccttaaatattttgtcattgcaaaataaaacattggattttttttatgactttttaaaaatagagctatgacaagtgctttctcggatcttcagaaactgctgatgcaaatagggtattctgtggtcaacttggtgccgtgtatgtgttcagtgaagccctcaaccctgcacagatatttgcaattcatcagttaggacctggatataaggtaggaagatcatcttattataaattctgtggaaagttataggtgtgaaaggtgaaataccatacacaatatagtatataatgataggttttcttaaatgtggtttaaaagtcatttcggtattttggaactgagtcattattttgtttcattttgtttcaaaggtgttgttttctctttttaactattttccccttcccttcctgaacatttttttattctttagaatgttttctaatgatgaagccagagcttttgttgacataattcttaaataacttttgtaaaaccatattgcttaacatgatatttgaaatctcaaattataaaatatatgaattatattatgaacaaatgaaatgttagagataacccaaatagaatagttaatgattttgaaggaaaatgatgtaaaaaattacatgtagctgaaactactcagtgttagcgtctatttttttgtttgttctttgctgttgcatggaagtgggcagagtagtgcatattgtacttttgcaagactatttagtgtgatttaccatattttcttgtttttttgactttaaaaacaaagatttatttaagcaagatattgctttcacatatatgaattcattcttaatgggcagtacacctggctggggaaatatataagttttgtgtaagtcacttttggaattgtgatatcccaaactgtatggagttgagagagaatactacagtataattcaaagtgtttataattctgatgatctttcatggaagaattgtttttcctttttaaaacttggtgtttaaataatcagtgtgaagattgtgctatgggaaagggagtactaaacattaaaaatatttttccttttgccttcgcatttttgcattaatatttctgtttaaaattttatgttctatattggacatgtaagtgacagtttgaatttacccttatgaaaagatgtttctgctcccagtgattttaataaccataataatattgaatgacaatagtgctctcatttctctgtcaaagtgacagtacttgctgccatcttttgtccattttatttgttttgctatccacagaagtgaatttgtgcttgttacagccactttttctttcatgagtactctgctgggtttgagtcctagttatgccatgtgttgaatttgcatggaaatgtttctataattcaaatttttgagttaatatgccacttgccttcctttcatacttcttttccttattccatataaatatttgaagttggtttcttcaggcattaacagaatgatattaagtcaggtgacaaaccagtgaaatatgaataaagtagaaaataaaatacagctatgaaagccataaatccagtgggttgctata

SEQ ID NO: 46373 - DNA, 1137 bp, Bovine  19866881073430
aatttatgaggaactagagttttttcctgagttgcattttattctcatattaccagtgaagtagctgaggctcagagaaactagtagatctaaaaccacatagccaataagccagtcaaaggttaaaccaggatttaaacccaaatctaagtctatgctctcacagggagaccttaagaaggccactagtgtttacaacactttatgaataattcgatgaccacctaatctgatgagggaaggggttattatttctactttaaatttttaaaaattgagatttgtatacagttaataatcagagctgaaatgagaaaatctgaaaacctctagtatagcattccaaaaagttcatttgaatataaaatatgatcatgtgcacaattacgtatttaaacttggcagtatagaaaaactggagaagaaaatggcaacccactccagtattcttgcctagagaatcccagggacagaggatcctggtgggctgccatctatggggtcacacagagtcagacatgactgaagtgacagcagcagcagtatagaaaaataaaattcagaattcatgagccttgttatattttactagtctttgtaatttactgttagaggcaaggacatgtaactaaagcaagcctctatggtcaataaatgtagacaatatttttaagatttattaaaatttgtatttgttcaaaatcaagtttctttcgggccttatccaatttgacccaggacctataggcttctactaatttgcatgattgcctcatacagtattaaaatacttccaagctcttcaaattattcactttaatagctttctataagcagttaaaatgaatagtaacatggctttgttttccagatgtcatttcatgtgcgtgaataattctaccaggctttagtgattacatcaatacatgatagcaaagaacaaacaccaaatttaacttggaacaattttaacaaatcccgtatttgtttttcctattaagcatttactgttgggtttcccaggtggcacagtggttaaaagtccacctgacaatgcaggagaccgcaagagatgtcattttaacccctgggtcagaaagatccccggagaaggcaacagcaatccactcaagcatt

SEQ ID NO: 46374 - DNA, 1927 bp, Bovine  19866881076619
tgttattatttttttttcctagagcttgaattgttttaattatggatgttttaaaaatgtttgttattaatccctttctataaatgatttaaaagcctgcctctcttctctgtgcacttagttaaaagctttttatccttaatgtaggctccctagaaggaaatgtttgagaaaagaaccgtgtgtaggagatgccaagaagctattactggttaagtaatctgatacttaatatgattaagagctatcatcttaccaatcaccacacatctttatcagttagtaagaaaatgcattattttcaatatggaaaaaaagatgagagggaagttatgtgcttttccccaaatcaaagcaaactgaatattagaacagagtcaggcttccctgatttataatctggtcctctgggactttacttctataggaaaagtcttgaatttggcccatgtttgaactaaacagcaaagagatcattttaatgattttagaatttggggctggataatacttatttttaattttaatattagcaaaagtgaagaatatctgaaactattacaaaggagtagtgctagacactggagaaggcaatggcaccccactctagtactcttgcctggaaaatcccatgggcagaggagcctggcaggctgcagtccatggggttgtgaagagtcggacatgacttccctttcactttcacttttccctttcatgcattggagaaggaaatgggaacccactccactgttcttgcctggagaatcccagggacggaggagcctggtgggctaccgtctctggggtcgcacagagtcggacacgagtgaagcaattttgcagcagcagtagcagtgctagacacaattgccaagttttgtacttgtgcacatccccaggaattcagttaaaagcatttcaaacttaatgtaatctatagaagaaaatgctggaaagaattgtgtataggagatgccataaagttattggtaaggaatagctccaagaaaattgaaagtaggcttttagaggtagtagagtttgaaagaagcagtgagtgtatttactctctgttagttgaaagcagtcaatgctagactctgagattccctgagggatttgatttttctgcttagtgagagtaaataggactaagaggacaactgtactactttgctaattcttaagggaaagatgtttaactctaaattgtgaaggtagaacaggcattgagataagcattcagtgttgctgcctctcctgcagcgtggaggacagattgaattccagtgactagggtaggtcactcagaataattcagtattcattcattagtcaatcatgtgtttattccttcaacagattccatgctaagtgctgacggtatcaaataagacacaggctcgtactcggaggatgagtttctgccgttgcaaagattatatggaaaggggaggtaagggtgttaaaagagaacacctatttgaaatcttgtagcaacctctgtggcctctggttgtatagatagaatttttggcatattagaagggaattctggactcttttgaccaatccaaggggaactttaggtactctcatggtacaaaagagacctccaagttaaagatgttgaatcaggtaagcagagaacattatcagtagttatgtgactggaattcccacttcaactggaataacttctttgagagagcagaatatacatggagtgacaactccagcagacttctgactcatgggagagctagtactaaaatatttctcctattaaaccagcaagtgataaagagggacacttattctagtacattggggaatattaggtggttataaatatctacagataatatataatatttatttcatttttagtcctagttaaaaaaaaaaatcctcctaggacttc

SEQ ID NO: 46375 - DNA, 1897 bp, Bovine  19866881156634
tcaggctaacaaaaaagttatttaagtctattttttgtgtgtgtgtgccttactttcttaacactcttgaatcatttacttcagaaaataaatcctgatatagttatattctgtcttgcagttagaaatcttgttcacattgaaacactacttagaaagtacttgaaaaattgggtagaatacaagaggatttaattttggctagataaagacaatttttttctagttcaacatgtggcaaattataatgggtatcccaggaatagtggctcaggaagctctttcacagctctggttctaaggatatatatatacactccttgtcctgttgagtgcaccactgactttttatgagtttaagtagtaatttagataacaaattttttcatagacatctgaaagtaagacttctgtgaattgctggaattacacaaaggcagaagttatttatagatggagaaactcacactttaacatgcttattccaaagatgtatcttgagaatttcctaggcaagttagtgcaccaatagtaaaaattatacatttataatttaatttttaccagcctagcaactagttcaagcatatgtgtagatgaaaatttccatccattttgccaaatcacacttcatcaatctgaaaaatctgtcttggccacacccaccctatttggtgccagttctcttcactactatgttcttcttcactactgtcttctcaaagcctgaaatttcctctcccatcaaactaggaaaacttggaaatctcttggctagagatattcttacagatccttaacgaaattctgatagattgtaatgatgagaagaatccatcttatttttcttttaaatcatgctctctttatactcttcttttcttactttctgtggaattggcaatgccaccatgaaaaccaatctgttcatcatcatccgagaatatctgttttctactgagactagtttctctttaaatgatgcatgcatttttctttgcagaagactgcaaaatcctgggtctgcttccctaaagtgtctctatcttggagcaggacctcagactgtatcagaagtaacgttctccacagtgagagaataacattctcttagtgcatatatatatatatatatatactgtacatatgttcaattgctcagtcgtgtccaactctttatgaccccatggactgtaacccgccaggctcctccatccatgggatttttcaggcaagaatactgaagtagattgccatttccttctccagaggattttccagatccacagataaacctgtgtcttctgcattggcaggcagattctttaccagtgagccacctgggaatatatgtgtgtgtgtggtgtgtgtacatatatgtatatgcatatatatataaaatttcttttttatatactcttattcccatttttagagaaaaagtactaagaagcacagtgtaaaaaagcacagtgataacacaggaaagaaatttgtatttatttagtatctaatatatgcaaagccttgataagcacttcacatatgttatttaatcgtcataagaaatcatcatacaggtattgtttctatttttactaatgagtaggtggattttcaaggtcataagctgctaaacaatctcttttttatagtcctatgtaactaacaagtgatcaattaacattaattataaatcagtggattcttttttaatgagctcttgctcattaaatttggaaatcacttttcattttttcatatatgcctcaggatgcatcacaggcatttatgaatgagtaatttccacctccatatgaggaatgtggtaactttccaaaaatatctacatacccagagtagcttcccaccacctcctaagagtaaggttaggtct

SEQ ID NO: 46376 - DNA, 1208 bp, Bovine  19866881199172
tgtattaggtaagcatataaatacttcttaaaataacctaaaatcacatcatctaaggtaaaaatggtattagaaaactgttaaaaaaaaaacaaaaaactttaaatgttttcttttaaattaacagaagaacagtacctgctaacctactaacatattttgagatttcatctctttaaaaaaggcaagtactgacctcctattggctgctggttaaaattaaaatgtccaagaaaacagtatttctattagcgttttgaaaagaatttggttataccaaggaagtgacagtcccccaaacttatactgactttcttgtggtgatttgtttgaagggtacacagaagtacaaagaaatgtttggtacttaaacagtaataaatataacaaagaaaagtcagatattttcctatctttcacttgacacccaagcaagaaaaaaaaaaaaaaaaaaaaagaaaaagataaaaaacaaacaaaacccaacagctttaacttttctgtacatttaagaggtacatataccatagacattacctaattcctgtctcagggcactgctgctgcagctttctttcagtttcccaatagatcaaataaaaataattgcttagctgaaaattctgactgcatgggtgttatcaaatctccttataagcatatttttatattcctgtgactccacatcaaatacaatagtcaactgattgctcctgatttaagccttgccttccaaaacccaacctgacattttgtcaaaggctaaatattgcagaggaaactgtttaaaaagctgtgctgcagcaaaaactgcatttacaaggcattaaaaaaaaaatgaactaatcttaaatgaactagtcttattatccgaaatctatgattctcctctctttagttcttccccatgtctttccctgacatcttgaagattcttagcctctccgtagatagatatcgccaaacattaagtcatacacagttctgcagtaactctttcttatcatgtaagaaaccaaagcctaggactgaatttaacacctttcctctggtctttagccacatgccacgctctctgaaggcaaccatagaaaccaacctgtatgattaggtgcccccacattttaacacctcatgtgcacaaaaaaatgactacgaggtcagtgtattcagggccgtattacaaagaaagaaaggctacctaaaaa

SEQ ID NO: 46377 - DNA, 798 bp, Bovine  19866881200754
cacgacagatacgatcgctgctccagaacatcacagaccaggggatgaaaggtgtgtgcaacacagtgacttagaagatgctgacttcaatagcagtgcctcagtagtcgtatttcctttaaagcacccattaccttttcaagtcagtgttagtaaatgaccttgtaactgtttgaggatcacaaagcatgtggaaatgctctcattaaaactagatggagaccatggatgcttttagtccaaggagttttacaaatgaagctaagagaggtgtaaaatgtatactgttctaaatagcccaaaaatgatttgttgtaaccttcttaatcaacagacctataattagggaataaatgtgccctctttgtgactcagtccccaagtgaaatacgtttggcaagaatatcttttcagaaattgctttggttcaggaagtgcttgtcacgctttatatgctaggataggttcttttaacatttaacaatgaatgattatttcagaggtatgaaggatgaacttaatcagttctttattctgtaagtgggaaatcaaattcattacattttgatcagaagaaatcttatttttacatactttcagaatataaattttaatatcctccagaaacacatttcagtgtcaggaagttttttccatcttgtctaaatcttctagctattcttagcaaagatgaaggacagttggctacaatcctttgtataatagaccaagattatagctatatatttattcactctttcattcaacatgtttttattgagcatctactaaaactaa

SEQ ID NO: 46378 - DNA, 1555 bp, Bovine  19866881215825
ttcaaacacttaatgtccagtcaaaggtattactcaagaagtttcccttggtttaacatcaaggaaagcatcaggcttttcctgacacatacatgggccaatggctttacactctgggccttgcagatattaatagctgtcttttgtcctgtttagggccatacactctgtaggttctggtgtgggccctctcacctgaaatcgtcgtaagaaagcatgagtctctattcttggtggtcacctgtggttcctttctcagctcgaggcatcattaggatccctaccccatctcccaacaacctctttctgcaggtggctccttgcaccttctggtaactctgtcagttgggacaggacccaggtactcacaccaacaccctgtgtccttcaaggcccacgtctgacctggcatagaaatgtggccatggtacccagtggcagggtggtgtgttgccccgcttcccaaacccttgttggatttcctgtgcaggaatcagaccacacctatagttgtcttcagcttcctccagtgagaacaggtggctggttcctgcactgtgaagtttcaggggagacaggccaagtgctccaggatgataaagagctgtgtgcccctgagaaatactcttcctcttcctgcattgaggaggagaatgaggctttggtaaaagaatgatgagaaatcaccctttttccagcatacttctctgttcctcacatacatgagtaaaaatatcctaagcgagaaataaaggcaataggaggtggttacttaggcagcaaatttgagggaggtcagggagcttctggaggaagggtggctatgatgacccccacaggaaggagccttggagaagctggaggagggagcagaaagtgggtgctgtcacttcctcccattactcattgattcctttgcctcacataacttggggtggggattcagtgcttctggcttcctgccctactatgtgctgtgacatcccttaagatgtgggatgctcatgtcccaaagtggcatccaataatgaggagacaggtgtggggctggagatgggctgagatgctcattctcagaaagtcctcctcatgcctgtaaattatgcttctccataactgttaattaaagggaagtaggtaattttgtgagtggaaaaaccactctcaaatgcaaaaaaaaaaaaaaaaatcgcttataagattccaagaatttaagcttgcgagtcagaaatttcacacccaaaatgaaattggcgagaagcccagaactcgccattttcactttaggtactaaaattctcacgcggatatacttaaagagtaaccagggtattaaaatgtcctttgggcttaagatttatatacatatgattcactggcatggttatttacttagcaaataaattcagagttgggttttgttattttggaaatgtctaagaatcacacatttatttatttctaagacagtttatgatcagaaagcattgagattcttacaaagaaagatgtatataattaatgatctcttggcacgctttcacatcttgcatat

SEQ ID NO: 46379 - DNA, 915 bp, Bovine  19866881314168
ttttatctttttttagacagctacaaaatattctcttgtatgaaagaaccctaatttatctaatgtgtcttcagtttaacaatcacctcagataaatgaacaagaagactttcatattttttttctttctctttcttactttttcatgtgttgaggcttggcttgtcctgacacttgcatcacccctctgctctactatgcctcagcaaacaatttatatgacatgtggtttacttttccacattcccacaatctcaaattctgtttgcaagcttactttgacaatgaatcgaggatttgggatctttgtgataatctgttgaaaactaagttgaggttcgtcagtccaggagtcttgagccgctgtgtcatttaagtcattttcattctgtcagtcctgcccaagaggaattcaatattttcccatgacagtctctgtctggataaataatctaatccacacagttgttaataaaattgcttatttattgtattgatgaactttgtcagagtcaaaatataaatatcagtaagtgaatgctcaagttatgaaaaagcactgtaacctattcttcaagttaagcaaaacacattaagtatatgcagtgttactggtaataggctaggtatggaggtgcaaagacctcctatgtggtgttaatggtaaagaacccacctgccagtgcagaagacataagagatatgtgttcagtccctgggtagggaagatccactggaggagggaagaattcatgcctggagaatcccatggacagaggagcctcgtgggctacaatccatatggtctcaaagagtcagacaagactgaagcaacttagcacacacccatgcatagagaaacaaagataaatggagtatggtttttgccctcaaagggctgcattgatttcagca

SEQ ID NO: 46380 - DNA, 4001 bp, Bovine  19866881460935
aaaactcgaagtataataaagtaatttttaaagaaataatatattcacatccttaactaagcatatactcaaacacctcacctgggtataaccacagcaggtcatgagatttcattctttaagcagccacatcccagaccagcagtaagcaggtagtctgtaattcttgcaactgctgttaagaaaaaaaaaaaattaataaataaactcaaaaagaaactaaaggaggaaacagtttcttttgatttattgagcagtcttccaagtgccattcagattagaatttgtattagcaggggttttaaatcacccaaggccaagggttatctggaaatctcattctagaataaggcaaagagaagctctctaattttacaactggaatatacaaactctggccatcatacctgggtcaggattctggaaggtgagcccatgggtgagggaggtgggtttgaggcctcgaaataacaacttataggagaccaagataactttctagcaaaatcagaattttaaaagtctaaatcaagcatcagattaaaggcttggtcacagaggtgaaaactgtacaagacgttgggatggccttccaaccagtaagatgggagccggccagacatattgggggaagacctgaggccccctgacctgcctcatcataatgtccactacttgactgtatgggggtgaagaaagcaaggacagagcagatataaacagaggaaacgcttccgagcagaagttgtacagcgtgcacttttaagaaaaaagtgtttctgaattaagatatggagtaggcactagtgggcgaaggttaggatgccccaagagataagagtgaatgctaaattcctctcaactttgctcaacagatttcagttcccaaagtgccaaattattttgtttcactaaacttaatcccaaacgcaaagcttcagttcattaaaatagcaacacctaacgttctctgcagctaattcagttggtttcaaaacttcagcagagcccttttaatagttttaagcaaattacacatcaaaactgctattggggctgcctagcaacaaagctaattgcataacataaactcactgcaagttcttagtaaaacagatttttattcaaatataaaagtttttctccacagaaatatttttaaaggtataatgtggaaataacatataaaatattcctttagactatcatatatatgaaaaacatatgaaaaacttatatatgtacaaaatcagtgtacctctggaaactgcatatttatcacaactaatgcattaataaatctgtttattttcttccaccctctgagtgaaagtgttagttgctcagtcatgtctaactcttcggaccccatgaactgtagccttccagtctcctctgtccatggaattctccaggcaagaatactggagccagttgtcattcccttctccaggggatcttcccaacctagggattgaatccgagtctcctgtaccgtaggcagattctttaccaactgagctaccatggaagcctcaaccaccccctgcatgttgtaatatgttccctcatttataaactagagataatttcttctgaaaccatgaagatgtctttatgtcattatccatggaagtaactgtcctgctggttagcactaccatcctattcatggcactgagtttgatagaaagccttaaaattagccatgccagactttcctctgtctgacttgttcttatagggatgaagaatatagtctgagttattttggaaaagcatttgtttacatgctaaaaagatctacaacagaaatcaagaagaatattcatagccaatgtcactggactattttttacacaagaactaggtaaatcctacaatctcattaatcttacaatcactaatattaatagataatcctgtggtagtgattacgcctccataaatatcaaatatattttaatggcatgttcatcatgaaaacattaaaataaaaaccaaaattttattatagatttctataggaatggttcaactgtgactagttcttatagggaaactttaaggactaggcattttttcctctaatctacaatcatccctccagtccacaagtttttgaaatttgatgataaattactaatgccctattaagttactgtgctgaacattcattagtgttcaataaatactgattatagttcttttcctcctcagcatatatcaatatctagcatttttatttcatttcttatcattcccttgaaaaataatgattgcaaattaatttattttattccacagagcttcaaatacttaaaaaccactttactacaaaatctgattttttttttaagcaagctttagaatgtaatatattggttttcctgtatacttcataataacctgtggatttgttcattctgcctataatcatttaattatttgtttaagccagtatgaaagctgctcactatggtgttttaatttattgcctcaatctgtactaaagatttacaagataacctcatcctttcaatctgtcatgactgataaaagctttaaataatctattagagaaaagcaatgccacacacctgagtaatgtttcacattttagagccaattttgatatgcagaattccgaagacaaggtgttaatcatccctgtgacatttcagaaatccccagtggctgacaacgtttggtgcttagtaaagtgaacaaggcattactaagacaatcatcaaaaaactgcctcgaccgtgaaggaccaatctgatcaagaacagatacaccacttctggtgaaaattctaaggaaccattttcaactgtaatagtgggggtaataactgggcttagggagaaaattggaactggcttaatatttcagagccataccattcagtagtgcttagagaaacacagctacagcattcaaaagctatagaattgaaaactgaaaggacaaaagtgtctctaccattctctaaagttgaaactaaacaaaatatgaaacacaaagtcaaaacagatataagcctgcacaaatgggacaaaaaattgactttgttaattccctgaagaataatgagaaaggagatctttgtaatcaagagagaattattttgttttctgtttgttttttgtttttggtcattgacatgttttttcctgcaaacactgcggtgtttcttcctgttatgtttcttcctaggtgcatatgatttaaggacactgaagtgagaggaagcagggtattataacagttattataacagttaccctagagagggctctagggtaagagccttcttattctagatttgggtttaaaacctggttccatcatttctttccataagatttttgggcaagtgtatgcttaagatcttcttctgtagaataagaataaataacagcactgtaccataatcttgctatgaaaattgagagaaagtacataaaaatttttaacatggtagctgctccatcactgatgctcagaaaaaaatggtagctattataattaatagcactttgaacatgtacatgctcaacagagactgattggatggatagatggatgcattgctgaaataagagagttgcagacagtaggcaaacagctcagtaggtatagacataaacaccttgtttaccagcatttaactgtctggaaagactgaataccagaaatgctgaactagaaaatcaccagtccagcaaatcaatgcaagagaactgggataaccaagcaggtcaatcctttcagttctgggttattcgttaaaactttcaattcacacaatgttttgaaaagtcatttcatagaaatccctccactcctaggagtttcctcttagcctcttaatgttggaaatttcaaatctaaaaatctatgagactgataatgatatatgtctcatgttcatcacaaagcactgacaggtaggtattatcatctctatttcttaagaaatttagggtcataag

SEQ ID NO: 46381 - DNA, 3499 bp, Bovine  19866881584834
tgattctgatactgtgacataggttaagaaaatttgaaattacatgaacttttagggtctatgacaacaatgtataatttttctaaatatgatatagctgactgatattatgttcctttcaactgctacattgtactttgattaagggctttagtctagctggctttttaaataattttattagaatatgttgattgcagattatctttataatataaataacacttagtaaataattatttttaacctcataatagatgattctttctcagcctttatatagatttacatttaaattagaatagaatgtatatttttaatgtaagcacttgaggcattttaaatttattttaatgctttgttaatattctgtactaggttcagctttctctatacacctatttgtctgctgaatttattggaactgctaccatttacaccaccatacgcagagtaggaacagtattacagcttatgcatacactaaaatattactactgggtcattaatcctgctgatagtagtggcattacacccaaaggtttaggtaagtacagtattacctatgtaagttgggccatggtgatgaaattgggaaagaaattagatgaagaaatattgggaaaactttgatttgagggggaaaagggaatttattaagttaataaaagtagggaactgtatccatgtaagacagatgttataatttatcagtgtatagtaatatattataatttaaaaaaaataattttttcccaaatctgacattagtaagcaatttgaaattgccacaatctgaaattttatattctctactgttgaaactgtacagaattactactaatttatattataattgcaatgtatactaatttaaattttccataatatcacaatactaatttcattgagcttacttactttaataataacaatgatggaggtttttggtttatttttttgatttctgttttattctagatggtccccggccatcacaaaaagaaattatatcactgcgggcatttatgttacttttcttgaaacagcttatactaaaggtaaacagttttacataatgcataattgcagtatattaagtgaaaagaatttttgccagagtttaaatcaatattgtaaaatcagtaataactaccttcaattcatgaattactttcagtattctataaatcttagtattaactcttgttgaacttcactttgcattaaactttgtgttaaatattctctgaaagtctccatactgagggatgtaacaaaaacagacaaggaatatgtgcatgaaaattgagcatgaagattttattctagaaaatcatctgtggtttctgtttgagaagtcatatgttacatattttatcatagtaggatttttaaaagattaagatatatagaaaataatggcaaaatacacagtaattgatattgtaaagtcttattataatttgcatcattttaagaaaagaatatgggattagaaaatagtgattgaatatacttagatgaagaaaatataatatttttgatagtgaattcaatcaaatattagcaattttagacgaatatacttttctaagtatttacttatttaacttgatttgatatagcctatgggttatgaagtatctgagtattataattaaagcatcattacttttaagtagtttatattttattttaaaatgattaatttgatgtatgtctttaattaaagttttaattttaaatttaaattaaatatatatatattttaaattaggatcgaggggtcaaggaagatgaacttcagagtatattaaattacctgcttacaatgcatgaggtaggatatggtttgggtcttccattttaacaattttattcaatgcattaaaaaacatttattattgaataaatattgatgatccttattatgcaggatgaaaatattcatgatgtgttacagttactagtggctttaatgtcagaacacccagcatcaatgataccagcctttgatcaaagaaatggaataaggtatgaatataatataagtatcattagtagagtttaatttagtacacgtatgcttcccagaataatcctattcagttaacttttgggtatatatagaaaaatcttacacataagaagggaatagatggagaaagctgttattaatcctcctaatactcaggaaactgatgaaatgtatagaaaatgggtctcaagtctcaaaaaagagtaattatattgttactgtagtaaaggcatttcaagaagttgaaagagcaaattttttgacaaaaagatgagagcacatggtatatttcagctaaagaaagctctagaaaattctaagtttgggctcaagaggtagagagtggccaggttgaaagatccattaaatggtaagaactttaaattttttctgttggtcatgaaaactaaagaattttgaatatagaaatgatttgcagatttctatttttccaaggagcaatgtggagaatgagttggaaagggataaaactaatgtagcaagaccagtagagaaattattttattcgtaagtattagggataatgagccaggacaatggcagtgtgatgggaagatggggatgaaatgtttttgaattagaatccaaaaccgaagaatttgaaaactttagttatgttgattgtaaagtaattgtgtagatatgaataaaacagtttcttggttagtattcttaagtacgttaaacctataacctagcctcttagggattctctcattttttctggaatctgagttatttgtataaataagaattctaggtaatgccacatgtaactcagtgagctttcacaggttttaaaaagagtttggaaagaatatattaataactgtcaaaagactatattattagtgcttcttttacttggtcatttatatcagcaaataacaactttataatcttgaaggatttccttttcaagttagagaagccatcactttatttctatgtggatatccatcttgtgacatcactcttcccattgagtttacaacccatggggttgctaatctatttgaataataaaattatacatttcattagtaacaactacaagtatattttactgtgagattgaactctatgaaattgctgaaacttagtgattttactgaatagtagcaatttcatatggtacaatcatgtttctcatagttgataccagctggacatgtcacattgtttgttaccagtatgttaaaaacaatcacaaagatgaaaaatttgctactttagtttttcattttaaaaagaatgtggagaatgtaggttcttgtttaaaatattgaaaaaatagatatattaggtataaaattttaaaatctataccctagaaaataggaactaaagggtaacagttatgtctggggaaatttttgattaattataattcatacatactaagaagtgaacacaaagattgcacttaatttaata

SEQ ID NO: 46382 - DNA, 1020 bp, Bovine  19866881986300
cccttatgtatggtaaacttatttgcaatgctttttctttctttattttgtgtccttttatgtttaatatataaaaatgcacattatattgtaagttcttaaaaaatagggataccactccccaaatcctctctaccaatatctgacattacccacatagaataaattgttgcaaggaatggtgtaagaataagacagtcacccatggccagatttcttaaagggacaactatattttgaggaatttcttgaaagaattgcactgcactctcttaactgaacagttttaaactattctactcaattgtgtataagatgttctttaagccaaatctaatcagtctacaaattgtgttttatttatttagtcttcataggatccaaaacactgtatttggaaatttttacacacacacacaaacacacatatacacattttatatatatatatatataaaaatacacacaccacacacacacacacatgaattgaagtttaggcaaggagctcacattaaaagactttatcttgagctccaaacccactgcatatctccccttcatgtctctggaacacctcaaattaaacacggtcataaagtgatattaagacagtatcttctctgtgaatcttttcctggaatcccctcctgagcacacaggaagtgatctgtcattggttcgttgttaactttttttttttttttaattgttttgtgtcttaatatttgtttttttttttaaattttattttatttttaaactttacaatattgtattagttttgcccaacatcgaaatgaatctgccacaggtagggtatggggagggaggagggaggagggttcaggatggggagcacgggtatacctgtggcgttgttaacttttttatgaattcctctgttgctcccctgtcctcttttgtctgtgttgtttttgaacagagggactttgtctatttgacccccatgctcattcactcagttactatttctttagtgtttaatcagttcagacg

SEQ ID NO: 46383 - DNA, 1158 bp, Bovine  19866880190399
gaaagttatgaccaacctagacagcatattgaaaagcagagacattaccttgtcaacaaaggtccgtctagtcaaggctatggtttttccagtagtcagtcatgtatggatgtgagagttggactataaagaaagctgaacacagaagaattgatgcttttgaactatggtgttggagaagactcttgagagtcccttggactcaaggagatccaaccagttcatcctaaaggagataagtcctgggtgttcattggaaggactgatgttgaagctgaaagtccaatactttggccacctgatgcaaagagctgactcatttgaaaagaccctaatgctgggaaagattgagggcaggaggaaaaggggatgacagaggatgagatggttggatggcatcactgactcaatggacatgggtttgggtagattctgggagttgatgatggacagggaggcctggcatgctgcagttcatggggtcacaaagagttgggcacaaccgagcgactgaactggaactggatgcgaagaactgactcattggaaaagaccctgatgttgggaaagattgaaagcaggaggagaaggggacagcagaggataaggtggttggatggcatcaccgactcaatggacatgagtttgagtaaactccaggagttggtgatggacagggaggccgggcacgctgcagtccatggggtcacaaagagtagcacactgctgagtggctgaactgaactgaatttcatataattagtgcggctgacaacatttgttttattagattttctatttctctgttctattttgaaatttagaaggttttcagaaaaggactcctcttgtatcacttaagctatgtttcaccacccccactccagtagcaaagaactggctgaaaacacaagccaggaatgtacctggcattgcctctgcccaggtataagtgattggctgcatgccaaagaactgctttctttctttgaaggaaatatgggggaaggttttacctctggggcccacctcacagccctccgcttacaatagtctcaggggagcgaagagttttaagtccaggctcagtttgtatttaaggaatttcctgcaccagccactgggggcggatcggcctcactgtaccacctgccccaa

SEQ ID NO: 46384 - DNA, 4011 bp, Bovine  19866880367844
ggagaaggcatggcaccccactccagtactcttgcctggaaaatcccatggacggaggagcctggtgggctgcagtccatggtgttgctaagagtcagacacgactgagcgacttcactttcactttccactttcatgcattggagaaggaaatggcaacccactccagtgttcttgcctggagaatcctatggacggagaagcctggtaggctgcagtccatggggtcgcacagagtcggatatgactgaagcgacttgacagcagtgacttaaagcaacacaaatttcttatagttcggtagaagtctgatgggggtctccctagggtaaaatcaaggaatcagctgggctttgtccccttcttggaggctgtaggggagaaatgtgtttgtgtgtgcgtgcatgtacactcacgtgctgagttgtgtctgactctttgcaaccccatgggctgtagctcgccagactcctctgttcatgaaacagaggcaagcatactggagtgggttgccgtctccttttccaggggatcatcccaacccagggatcgaacccacatctcctgtgtctcctgctttggcaggcagattctttagggagaaacattcccttgcctttttgggtttctagaggccacccacctacctgactcctgttacctcctccatcttcaagctggcagtgatggccttatcccattgcatcactctgactccctttcctgccttccctctttcaattataagaatccttataatcacattggcccaaccagataatccagggatatctctcaatttcacaatcagctgattcacaacctaattacatcagaaaccttaattccactttgcttgtgtaaccctacacagtcctagggtctagggattaggacctggacatctttagggcggccgttattctgcctaccacaatggagcaatctgtataggggctgcaggttagctaacagcatcgcatcagtgggaatttcctgatttggacaactgtactgtcatcatgtaagaaagtttcctgtctttaggaaatacacactgaagtatttatgggtaaagggatatcatgcctgcaacttaaaagcgttctctttttctccctctctttccacagagagcaagagtgagagcagtgaaaaagcaaatgtaatacattaacattggtagaatctgaataaagagtattggagaattttttgactcttcttgaaaatttttctctaagtctgaaattctgtaataagggcaaaaatttttagtgtagtctttatgagtaaatttccttatttctaattaatacttaaatttgtgtcatattatgaataatattttcattctgatgcatcttttaaaaatctcttttgaaacattagggtcattttagcaagttgtctaatgacttatttgccattaactatgaataaattatgtatcgagcagtcttgagtatataatgaaggtaaaatccattattttggacttatactcctgttgccgtagagcctggatattattgttgagtattttcattctctgtcttaaaattcagcattactttaaaaatggagtcttgaaaaggtatttaaaagtagacaaaagactgttaagagtatctgtccaatattaatttcttagctttgataagtgtagcgtggctatatcagatgttattaataacattaggaaggtaggggagggtaaagttaggtggctcatgatacatacatatatatccctgagcctctgtggggtgggggggagaaagggagggacaaatcaagagcagagaggtgtgagctgtaaggtgtgtaaagctcaggttgcttgaggataatcaagttccaagtattaattctgccactgactggttccttaatattgtgcaaattactcatatatttaagtcctgccttgatcgctccaaaaaagggatctgaggaagcttttaataaaatgcctgtatatgatagaggctcttaaaaggaaaatggatcaaaatcatgagagaaaatgaggcaacagctaacacagtggctagggtgatggggcagcaaaccatggattttttccaatggtcaaatggagaccctcatcatatgaggggcaaatcaaagaaatcaattatgaaagtgccctttaaaacatggtatgcaatgtgagttagtttgatagaactagtattgcctgagccctcagatacctaaagagggcagacagcctgtctgaaaacttcatagcaaaaactcatctctctggccaggtctgtgcctctgtatcagcccaaccgagacatcacagagcgcagactgtctgagccaagagggatcagcaagttgtaacacaaacttctctgaccatgctaaacgtgtaatcacccaaatcacagctgtttctcctgagactttatcttggacgctggctcagcagcccaggaacgtgtaatccacatcaggacggcacaccttctccagacatttctgctcccggctggacttgggcttactctgcactaatctcagcttggaaaccatgctcatgagaaaagaaaggtccttgaagaagtgagtgggattagtgaacagaaattcagaaaatcaggctcattcacatcctagaaaccagggactgactattgagcatgaaatcacactagaaattgtgaacacaagttgtcatggcacaaaatttgatgatgattgcctttagttaccaagatgacacaggatcttggtattaaggcagacaccatggcatgggtcccaaacatctcaatctgaggctcaagtagaattttctgttatttgttgctgttcggccacccagtcatatccaactctttgcgatcccatggactgcagcaggccaggcctccctatctctcaccatctccctgagtttgcccaagttcatgtccattgcatcagtgatgccatccagccattttatcctgactccctcttctccttctgttactagtcatggtgggaaaggatcataggggtatggaagggggaccctcaaaggtatgaccaggggcctttcacagagaaccacttacactgtcgtggacaaattcacagggaaaatgctgtaacagagggttacattctgatttgatcaagggcctgaagctcaattttttatagaaataaatagaaactatactgaactcatcataagcagtccctctgtggcctatgttataaggctttctagggtaagaagcaaacaataaaacaccagctggtcagttgaaatttactgggaccattcccaggagttacaggaaaagaaaagaatcaatattataacttgggccaggactagagatatctacagaagggcctgtgggtaaaactcaaagacacacatacatggcattgggaatgaccagcgtgaggctgggagcacagaggcccaggccttgtggaccagatcacaccagccggttgcagactgtccatcccaaagtggtctgtgctatgccatctggtgaaagacagtggtttctgttatttttctgcaaatccatccttaggtaggagtgttgagggaacagaatgctactggatggagaagagggcagagagagagggagatgatggaaagaaagagagtatccataaatgtctctctctgctcacagcagggaagaagtgacgagtgggagaggaggacgagaaaggtcgatttgatcgcacctgtacaacaccatgagtgactactgtccacctcctatccctgaggatgtgaaggtgaataaccaagaccctcttagaggagagagcggggaggggaaggtgggtgagacgcacctgactaataaatgcacacccaagggccataccaggagccagtactaggtcaaggtgggtggtggacacaagggaagcctggcctgtttcaacagatgaggtaacaccttgaccttagtctttcctgtactggggaggggaaagaaagaacattctgggcagagaagagttaaaaca

SEQ ID NO: 46385 - DNA, 870 bp, Bovine  19866880462983
ctaggctttcccttttgccctattcctaacctccaactgcatgcagcagagtgttcttgaagtataaactgaatttctcagcttaaaactctttagtatactcccattggattttgaataaaatctaaatttctaactctggtctacatggtgcaacataagcagtctctaacgatctctccagtcttatcacaaaccattccctcttcattcagcaggatccagataccctcgagcttcgaggccactgtaccccacgttccttcttcctggaacagcctacccatcacttctcctttagcttgatctttcttatccttaagatctcaccttaagtgagtttccacagaggctttatagaaagtagttctccctagttattctctgcattctttcttgtacttatctcagttagtattcctttaatttttattatgtgtctcccagtcggcacttgagcccttgagaacaagggctggatctatctggttcgccatattttctctagagctgagagcttaggaagtgcccattcaacatctgctgaatgaatgaacgcatgcactgttgacagctgaccttatccttcaccagccggtaacaagctggacattcctggcagccaggccaagaccgattgtagaaatagttctcttcacactggtcacagcgattccccacaaagccttctctgcattcacagcgaccatcgtctttgcactggagggaaagagacccctcaggatgacagtcacaggctgcagaataaagggaaaagggtacataataaggaaaaaaacggaagactgcattttctttaagctcagagtgatatcgataagccagcgtactatcattagaagtagatgc

SEQ ID NO: 46386 - DNA, 1105 bp, Bovine  19866880497505
caactagaatggcctgccctctttcctagacaacaatgaagacatagtaacactttccaaattttctattttcaagctctgtgcagaccaacacccttctctggcacttgtcatgataaccctaccctcttaacatcaacaatagtttcagatccctgactttacagaggatttctttctttataatcaatgggaagatgcttaggtccactggtaaaccattctttatatattaggctgaattccttctgcaggttttctagataaaatttttatttcagtcactataattaatttttaattaatttttccttggagtatcctgttctttgctttttcttttattggagtattctgttctttcaccaaactcatctgtttgggaattcctcagtggactgatggtcccctgaaatccaccatcagtagataaatataggctctcagttttatcagtcaacacaaaggccttgggtgtctttatgctaatacaataggccacatattccaggcttttcagtaagtttatcctctctaatccctccccagcagttccaggtcattatccccgtagataagaaaactaagacccagagagtcccaacccacctaatgtcacaggtcaagctaatatccagttaatataaagactagagttccaaatagcactccctctgctccatcccacctcctggcagagtttgggctgagccacctgaggacattcttgagggattaccttgtctccttggtgaccaaaggagtgagcacatcagtaagatgtgctcagagatggccaataattcaaggccctgacttggaatgtctgcaggtggttcctctcaggaactgtctttcctggcaagggtaggctgctatctcaggggacgcttggtcagacgggacagtggcagcttggtcaccttcatgagaatttcctcctattgtgcacctacaggagggaactatgcagcggagtgactaaagaaagatgctaaagttggaactggggacaatccaagttggcagccgctgaatcatgaggagattctatgctgccacttgttcctccaccaagcaaagtgactcagttgtttaaatcttg

SEQ ID NO: 46387 - DNA, 1969 bp, Bovine  19866880502546
gtcttggtgggaaacttagaaatttgcctttgactgaagcaggaacctgcactgggatctgaccacctggacacccagttctaccctactgggccatgactttgtcaataggacagaagccccaattgtcttctggagatgctactgccctggacactaagtgataagattttcatgttttctaaccccattcttctatcctgacttcctagtcttctaaattgacatctacaggaaaaacaccacacgtaccaggagccacaaaatagacagggtctgatcgtcgtgcggagctaaacacatcttgatgggcgctgtgaccactggagctttgcaggaaatccatttctctggacagccttccagccatcaacatctggaacataagtaaaaccactcttcattagaacaaaccttatcatctgttgagttaaacaaggcaagacttgattgctactcactagcaatgagtgagtaacaagtgggttttctttatatttccacattcgtgcaccatcctcagaattccctatgcacctctctacttggctttcaccttcacctactcctgtttacacctgctttaacttcttgtctttgaatctgactcttggaataagagaacatgttttcatctgcctgtaatttgcatttttatttcatttacataaacacggtctggccttagtgaggttagagggtccagtatgtccagagagaaactcagagttgagatcatattaatctcccatatttttagagtgctttgtagcttggtaactaatttcacataaattaactcgtttggcatacatgaaagaaataatattagtgaatgtgaattccattccaagacttgtgttaagcccctcaatccaatgattcttttgtggttttaaagtacattaataggaaatgcagggagttgaaaatctgttctctttttagttatttttataagtcattcataagctggtctgagtataacttttccaagacacgaggctctttcttattgcctgacaaaataacgtacatttaaagctagaagagagtcatcctgttaaaggtgactcaaggaccccatcctgcggacagaagtctacaagcacaaagccctgtacagcagtaaataaaagcaaaacacctagaaaacagaatgctttaccttgatggaaggtagatgtgattttatggacactgtagtctccggagctttggcagctggctgaatgcccatagcaaaaacactgggtgcagccctcagggtttctcccatccaggtgatagtaacctggtcggcacctgcaggggcattttggaaattgggacaatattataggctatttctcatccccacagagaatacggtgactgatcatttctactttctctcccacccagcccattaattcccaaaggtgagaaatactcagttgcacataccactctcactcccaaacctccagatggacaatcacaggcccccattaagaaagcaagaagaatattcactttctcttgctctagtagagcagcaacaaattgggcgtgatggtctggaaacggtgatttttcccatccttggtaaggaattcagtgggcaagatggggaggggtcaggtagggctgtgtagagttggcccagtcctagagcaagtgtttaaaggggataatagggtggggaagtgggggccatcaaaagacaggcaaatgcccctggattgggaaaatcccctggagaagagaaaggctacccaaactagtattctggcctggagaattccatgcactgtatagtccatggggtcacaaagagttggacatgactgagcaactttcattttcacttcacttccattgtgcaaaatcagaaaggcaggctagctgtgaactgtagatgctacataaaacagcagtaaataaatatcttttttttcctctatagatcaagggtttaaatactcat

SEQ ID NO: 46388 - DNA, 1851 bp, Bovine  19866880555491
cacggagcactgagctgggccccctgtgttactcagcagcctcccacaagctagccgtgtcatgcatggcagtgtacgtacgtcgatgctactctctcaattcatcccaccctctttttcccctgctgtgtccacaagtctaagttgatcaactggcatatgtttcctggctttgattctttctacacaagttattgtattttactgtcttggagagggaccatgtagtcagtaggaaaagcagtgaggtaatgtgactgtggttttctcacccctttgctaactgtatgccttgttgctgctgctgctgctaagtcacttcagtcatgtccaactctgtgtgaccccatagacggcagcccaccaggctcccccatccctgggattctccaagcaagaacactggagtgggttgccatttccttctccaatgcatgaaagtgaaaattgaaagtgaagtcgctcagtcgtttccgaccctcagtgaccccatggactgcagcctaccaggctcctctgtccatgggattttccaggcaagagtactggagtggggtgccattgccttctccaatatgccttgttagcttgtcttaaatcagttccccagctataggagttctgatgtttcttattcttcatgcctcagaaactcataagactaaatgtgacagaaggctgtgggcattcgccaatagatttggtcagttggtatccttatgcagaagcatcagttatgtgtctctggatataagagctctgactctgatatacagctaccaaggaagggtaactgatctgcctggtagccaatctgacagtgaggacagaggcagatggctcctaccctccctgctccttgcgcctccctgtaaaagctgtgatctctctgaaaccttcctggtttcaatgctgaatattactgagcatgtagtgatgtataataatgattagcatttattatagcacttactgtagtgtgccatagtatgccaagtgttgttctaagccctttagatatattaaatatattaacacatttaactctcccaataactgtaaggtagacacttctattatctccattttacagatgaggaatcagaggcccagaaaagaaaaaatcactggccccaagttacactatttctagccactaaactgggattcaaaacatgaaaagtctagttctagagtttgttttctttaagatgcccattgtgaaagaaaaagtcttagattcagctcttgagaagcttttattcaagaaaagctgtgataaagttgaagcctgtcaaagatgcaagtgctaaacacagagatctgtccagctatttacactacagacggctaaaagattcctgacattgtgaccgtgagtgggagttgttattggagttccaagtttggatatggtgaaatcaccatctcttctcctttctaattatacatggaggcttcacagagattagccttgatgagctctctgtgttgttctatctgccaggtgtttggcatggagtaagcagtgattcttaatcaggggtgtgcctccctgtctcacgtgaaaccttctgaaaacagatgccttcggctctgcacttggctggttacgtctgtgttggtgatgctgaggtgcagtcccaggagagaactgaatgtgggcgtggcacctttgggtcattatacgtaatacaccactctaaaacttaatggttttaaacagccacgatttcttgtttctcatgattctgtgtcggcctgaggtcactccctggccagtcagctgggatgggaagctgggtttatcctctccctgtcatcttatctccctcaaggaggctagactag

SEQ ID NO: 46389 - DNA, 1437 bp, Bovine  19866880572229
ctccaactacagaacctgtgctcgagaacatgggaatggcaactactgagcccatgtgccgcagctactgaggcccgcacgccacagagcccacgccctgcacgagagaaggcaccatgataagcctgcctgcatgctgcaactagagaagtcccgtgcactgaaactagagcagagcccatgcagcaatgagggctgccaaccgaaaaaaaaagaaaatccctcttatcactctgacataacaactatggacatctgtctgcatcttaatcatatctacacaaatgggtcaagaacagggtatgtaagaaagctagtaactagtgccctctaaagctctctctgaagaagtctaatgagaagagtgcaggttcttcttcacaggtatcagttacaatgattcatgactgggaaatccgcctgcaatgcaggagctgcaggagacttgggttccatcccggggtcaggaagctctcctggaggagggcatggtgacccacttcagcattcttgcctggagaaccccatggagagaggagcctgatgggctacagtccatgggtctcaaagagtcagacacgacttaagtgactgaatggcaacaaatgactggaaaggtggcacaccatccacacggcctcaggatcatgaggagagccaaagagcagagcaaagcttcccgctgtctctgtggttccacacttcttcacgtggtcttcagttgcttcagctgcgtccaccctcgtgatggcctgctggtcccccaccttactcactcctcccttatgtttgagagcgattctcgtctgaagagtgtacccttagctgaagacgtatttgaaaggtggaaagacaactctttacatacatctgctaattcaggaagcccaaataatttgaaaatagtcctcgacagtcattaatcaagtacttaatcaagtactgagacaacaccagggggtcgggtaaactccagcccgcaggcccgggcctatttctgtaaatagttacactggaccacggctccgctccgttcacttgtttacagactgtccccggctgccttccaggtccaagagcagagcagctgtaatggatactgtgaggtctgcaaagggtaacacatttactatttggagctttacagaaaaagtctgccagcctctgtaccacaccaaagtatcccaatctgagacaaaaatatatgtgtattacaccatcgggtgtgtgtgtgttcagtcgtgtctgactctttgaggctccacagacagtagcccgacaggctcctcttgtccatggaattttccagggaagagttctggagcgggttgccatttcctcctccaggggatctttccgacccagggatcaaattcattatctcttgcatctcctgcactggcaggtgatatactcacccacactggattattctca

SEQ ID NO: 46390 - DNA, 908 bp, Bovine  19866880575388
taaaggcagggatggtgattccaggagaaggtgtgagaacttttttgatttctgactttgggccatgcatctcacttagataggaattttcttgacatccctgcctcctgatcttcccatcttgatgcctctccaggtccctactactgtggtgtgggagcggacaaggcctacggcagggatattgtggaggctcactacagggcctgcttgtacgccgggcatcaagatcgggggcacgaatgccgaggtcatgcctgcacaggtaaaggtctctagcccaccacctgccccacctagaggcatgtgggggcttttgctaggaagggctattgtggtgcccactccttaacccaaagccctcaaggtggcttggagtagagatgagcaagaagcaagtgtcggcttctgggttggggtgagcagctggttttgccaaggcccatcttctcgttctctctagtgggaattccagataggaccctgtgaaggaatcgacatgggcgatcatctctgggtggcccgtttcatcttgcatcgtgtgtgtgaagacttcggagtgatcgccacctttgatcctaagcccattcctggaaactggaatggtgctggctgccacaccaactttagcaccaaggccatgcgagaggagaatggtctgaagtgagtgccgcctccagccggggccatttcactctgcaagaatacctgccaggggtttgatatattggggatgagtaagctgccttcccagttggggcctttagctcttggttcaaaaactgtcttctgatcctgtcattttgttcctatttggaaagttcccccaaaatactcttcaagtaggattcaaggatggtgatggggaaagttacacagatgaatgcttttaaaatcttagtaagaat

SEQ ID NO: 46391 - DNA, 886 bp, Bovine  19866880642984
ccttctgaaggagatcgtcctgggtgttcattggaaggactgatgctgaagctgaaactctaatactttggccacctcatgcacagagttgagtcattggaaaagactctgatgctgggagggactgggggcaggaagagaggggacgacagaggatgagatggctggatggcaccaccaactcgatgcacatgagtttgggtgaactccgggagttggtgatggacagggaggcctggtgtgctgcgattcatggggtcacaaagagtcggacaggactgagtgactgaactgaactgaatgtgttgattggacaaggttttggaaaacctagttactttgtttccaggataatgaggtctaacaacattactaatgcccttgtaaataagtggctgcattcactcctacaccaaagcttctatggctttcaaggttatttaatggcttacttacctaccacccacagcaaaatcagagattgcataataataggatttgagaactttggggtcattaaacacttcatctccaaaagtgttcaggcgattgagagttactctgatgtcagtggcagttacccattcctgtcagaaaataaaaacacagaaaagacggtaaaggcactgaattattgtaagagacatgtatgtgacaaaatcttctaaacagtttatgtgtcatttaacttatgtcttcttctggcattaaatctattaactactcaaagacttcctttaatatccttatatttttctccttgaatcttcccttcttgggatctaagttgttacttcaccactcagaatcccccaaggcagaaataatattaatttcgtcacaaggctgtagaaaggcttaaatgaaatacgcttttcaatactca

SEQ ID NO: 46392 - DNA, 1178 bp, Bovine  19866880658094
aaaatactgcttcagaggtatagcatatacctccatttactcaaaaactttgattgatgactttctgtacattttgtggaatatagaggacctgaattcaggatgtttgtgttttcatcctccgcttgtagatgaggatgggtggcgtgcagaacaaagggatggctctgaagcatcatttgagtggtcctctgagaggcaggatattgccgtcatctcagacagctactttcctcggtacttcattgcccctggtaagtaaggctaggaagccgtgtggtgtggtgtgtgatggtgtttattcctgacctcacgttcttgctcaccattgtgtctgccttccagcaaagttcttgggcaagcaggtgttgagttatggtcagaatttctccttctccttccgcgtggacaggcgagacactcgcctctcggcagaagacctggtgcttgaaggagctggcatgagagtgtctgtgcccttgattgctcagggcaattcctatccaagtgagaccactgtcaaatatgtcttcaggtaagacagttcggtttataaaatctgacttgaccagaattataaaagtggcttctttatctaagcgcctcaggcctcaaggtgtgtattaaagaaaaactttggggttctcgatgtgactttgtaaaagggaactttcccccttgattacctgtaccttttccagtggtatggtcaaaccaacagactaatctctgacgtggttagaccagcagagcagtgcattgtgggtggcatggatgactaagaaatactttctcagcacccagaattgtccttacagaggttaatgtgccccttcctttttctctaggctccatgaagcgacagattacccttggaggcctactcttacccctttcgaatttcagaaactcctgaacaatttgacctctatcaagattcgtgggacatacagtgagagaagtaagttatgatgtaattaagacaatcaatcaaaatgatgattaggaaaaaggatccataatcaaaaggttatctctaaagtcctgattataaacctgatcctaaagaagtgatataataaacttcctcatcatacatgaattgtgtagtaaaaagtaatgcattttgaaacgtctcttgaggacctggagaaaattagacaaaaattagtaaatga

SEQ ID NO: 46393 - DNA, 1486 bp, Bovine  19866880667993
aattatctagcattactcagaagaaaatttccatttttgatctcttccccaaaatgcaagaagagctattttttttatgaaacaatatcggaaaattataacgagaaaaaaatgggacattgctagtccaagcaccagtgataaaacgcttgttgccacctgtgatgactttaaagactgtgtctactgaaggcaaggccttagcaaatgtcatacctgctgcagtagatcttaagccagtgtggggtaggagtggagggtacacagagtcaaaaactgtcaggctgcttctaagtgttcatttatattgtccaaatcctggacagtgaatatgtgtggtaatgaattctaaggatgttagatcaggaggcaggaacataattttagattgggctgaatttatcacttggcatgtatccataagagatgctggattcagtgagctaattcaagcagctgagaatagttctaaatgttggctttgatttaatgtattctatgctgagttaagctgagataacagaaattccttggtattatatgaaacagtgattctcagcccagtttgacctcatgccccctttttataataattttttgtaataccccctttgttctgaaatgaaattcatagttaatataatctacttatacatattattttcttaaatcaatatagtattctaactgtaacataaagaaggaaagggaaggtattactatttcagtgtgtaaatgcttaaacacaactcctaccgggagacacagcagcaaactagccagtcatatgtctacatctatgtgtggaatcgccatagtaaagtagctacaaatataggctgacatagatgtgttgttttgaaggtaaaagatcataggtagtcttgtggttagtgacataatttttccaaaataatgaaacgagtattggtgaagttctgaacaaaacaaaatagctatagcttcatttacatgattcctgctttccagaaaatttagtgtatattaaaacctcatacatgaaaaaaaaaattcacaaacgagcctagtttttgaatggctttcacgtgaaggtcgatttttgtgaatgtactgtagtgaccgtatttgacacaattacacagtgaaacccaagattctggactcctgatcacctagcctgaaagtcaacatttttttaagccttttattttatattggagcatagctgattaacaatattgtgttaatttcaaatgtacagcaaaatgatttagttacatatatctattctttttcacgttcttttcccatttgagctgttatataatattgaacagagttccctatgctatacagtaggtccttgttggttactaattttaaatataccagtgtgtacatgtacacactaaaaatcaatatttagatttaaatatactacctgcttctccctctatcttcactgctaggatcaaaaaaagaaagtatcagcatttaatgatca

SEQ ID NO: 46394 - DNA, 1596 bp, Bovine  19866880711332
tgggtcatttcaagtagtttactccagtgaacaaagtaattatgaccatctggtgtgtatagtctcttggtgcattcatgcaagagtttcttgtttccaataactgagaagtgaaatttctgagttctaggatctaatcccacttctggtccttcagctaacctgaaaggccttcatcaagattaccaaagccgccacagtggcagatgggtaattttccgttctcattgtgcttgggccctcagcggtttccaactcagcttttccttccctggatgctctgcctgggtcagcatagcacagtcggctgacatttctcatattccaacggttgcgccttcctggtctatatttccagctcctcttaatccactctacccctgcctctcaacacagagttccttggaatccttcctgagccctttcttttttcactctctacccatatttctctaggtgaacgcatccatttctatgactttaaatgccagttatttgttttagacactgatttttttggtcctcagctttcctctctgaactctagttgtatgattaactgttcagatgactcagagtcttctcaaatttagcatgtttgaagtgaacgtataaatttttctccatatatcctagtctacgcagactccctcatcctagtaaacaggatactagtctttcagttgctacagccagaaacctgggtctgactcctgatgcttccctgtccttcatccccacccatctaatccatcactatgaactgtggactctacctctaaatatatcctgaatctgaacctgcttctctacctttattgccactgccctacctgaaccactttcatcttcagctgtgcttctgcaataccataactgatcataaacactgctgttcttataatccttcagtttattcttcctaccgcagctggtccagatgcttcagtcacacaggcctctgtcagttttttttacaacatgctaagacttgccttgtagggtctttgcacttacattgcctctacaagccttgttcctcttggatttcccatgaatgacttcttttgatcactggggtctcagtttaaaagtccccaactcagaatggcttcgaaaagaacacaaataacaagtgttggtgaggatgtggagagaagggaaccctcatatgctgttgatgggaatataaatcggcacagccactgtggaaacgggtatggaggtttctcaaaaaactaaaaacagaactaccatatgacccagcaaacacactcctgggtatacatccaggaaaaacaaaaacactaacttgaaaagatacatatacctgcaatgttcatagcagcgttatttacaattgccaagacatggaaacagcccaggtgtccatcagcagataaagcagatgtggtgtatctctagtggaatactactcattcataaaaaaagaatgaaaaggtaccatttgcagatacatagatagacttggaaggcattattctaggtgatataaatcagacagagaaagacaaatactggtatgatctcagttatatgtagcatctataaaacacaacaaagtaatgaatataa

SEQ ID NO: 46395 - DNA, 1847 bp, Bovine  19866880737071
aatataaggcaagtgttctaaaggtgctccatgtatggtcgcttgtgtaacccgaccacaacccagagagatggctcttgttgccactgtcagtgaggcattcgagctgaggttcaagaccagtgggtgactggctgcatcctatccaatgtcaccacaccctccatgacaactctgatcggacagccccaatatgagacctcccaacccatctaccagaacaacaacatgcccagcaagcccactgcagccaagatcctggggaaggtgggagaaagcctgagctggatctgctgtgttcatccgccagtggagcgtttcagttttgtggatgacaatgccaacctgggcatggtgatgcggtacaaggagataggttcctgggaggtaggatggggtacatgggcagtttccccctcagagcttcttaatctcattcaaaagatacggaagttgagttcattgccagccagcgattcttttcttgcctgcaacaccatgcccacagaagatcccctaccttccttagcagaggggtccaatgcttggagccatgtctgtgatctcccccacagccttgggtgtacactaaggccctgactgtgtgaaggcagtaaaggccccaggctagagcaggtggagggtggttacatggagctgtcaggatgggaagctgtcaggggatttctgactcccctaggagtcctgagcagccctaggaaacaagccaggaagcccattttcccaaggttccagagtagctagagacagaagtgtctgaagctggaaaaacacagacagacaatgagaatggagctggagctgctacaggtcccaggtaacaaggagggtcagtgacagtttggaagtccccaaaggactcagcatggatgagaatatccatctttgggtctctctctcctacaaacccaaattcaactctgcaggagagctgaaggtccagccctcgttcttttgactctggagccaactaatgccattttggagaaggaaacagcaaaccactccagtactcttgcctggagaatcccatggacagaggagcctggtgggctacaatccatgggtttgcaaagagtcggacacaactgagcgactaacatatacacactgccgtttctcaggtttccaatttccaaccttgaaccaatagggatggttgaggaggaagggaggcagggggccagggtgtcatctccatggtgctaggatcgggggcagctgggtgtccagcgggcatgctcaatcttcaacttccagctgcaaagatactccaggcccccctcctagggatgaaggggcagggctgcactgggttctcccaggaggcctagcagatgtgacatcatttctaggaacttctctgggtcttgtcctctgatccctggtagtgatgcacctgagttgactcatactgacctcctgaaccatttgaaaattttcagaaattttaccagttggttgttaaactcagtcaaaaaaattaaattatactaagtagcagttaaatgggcttcctgggtagctcatctggtaaagaaaccgcctgcaatgcaggagaccccctcaattcctgggtctggtagttcccctggagaagagataggctacccactccagtattcttgggcttccctgatggctcagacaataaagaatctacctgcaatgcaggagacctgggttctgtccctgggttgagaagatcccctggaggagggcatggcaacccatttcagtattcttacctggagaatctccacggacagaggaacctggccggctgcagtccatggggtcccaaagaatcggatgtgactgaagtg

SEQ ID NO: 46396 - DNA, 1834 bp, Bovine  19866880887301
tttcacccatggaaagtgatgggataaatttaacttctttcccaagtaccaatactttcaacaaatgtaatggccctagatttagcaaacacaggtatgaagagtaacaataagctaaaccaacttcttaaatttcactgctagctactggcaggagttgtgaaccatgaagtctaccaagcgaagtactcttagcaatatagatcacttcagcctccaataaaagaatgaaatacgagactcagagttctgtaaattttcatgaatatgactgagcctactaaccattaagctctgttcaattctgccaagtggttactacacagacaccactagtctctaagcaatatgaagtgtacataacaaagaggcatccgaattccaattagattctaactccttagtgtggtattcacggcagtggatggggctccagtgaataatgcagcagtccccaacctctctggcaccaggaatcgatttttgtggaagacacttttcccacagactggggtggtagtggcatagtttgggaagattcaagtgcattacatttactgtgcactgaatttctgttattacgacatcagctccacctcagatcaccaggcactggatcccagagggtgggcacccctgacttaatgcatctgcctctgcaagtataatcaatttaacttcacaaatcataagcctaggatatactactcttcaaaagacagtgctataaaacacattgtttatgccattgaattttgccatatttcacaaatagattagcagctgaattccactacatttcaattctaagaattcaggtgagttcacatctgaaaatccataccagtcgtctacaagcacaagctgtccatcagactgaactttcttggaggcaaagagaagcagctgcaagggggtgactaaggtcatgcctttagcagagatggcccgggttcgaatctgaaggtaaagaggcaagaggagaaagttaacattccaactgtcagtcaactaccatatactaataaatggactaaaactcatgttcccactacacattaataaagtaatctggatttcaaatgtaaaagttttctaaacctctcttttcttaccttttcaccaaatacaaagaagggagatgggtacttcatgtcttggctgctaaaaggacaattaacagatgacttgtggataagtgcgttacgcccttcagtggtgagaatctttctcttttccttatggtaacacacattggggtatacaccaaaggccaggagagagataacaacatccagattattgtctggtccagtgttagtaaacacttgtgtcagtaaacactctgttaagagaaaggagattaaaaaaaaataatcaagtatctggctaattctaacactgaatttaccaaaattaaatgacaattgtaagaattaactcctccctcattctctttttcaaataacccatttaactgtctctgttcttagcatttttgcactcagattaatgcaaggagaaattctgctgagtcttcaccattttagtaaaattaaaacgtctgttttcttttgtagacacaatgtaagcttgaagtacttaaaaacaaataccccaattaaccatctcctctcagattagagatagactggtatgaccagtattccacctgctgctcttaaaaagctgttccttctgcagaagatgaaatgatgaccaagagcaacacactagaaaaacactgatgttttcaccccaacaatgctttatgcccagcccatcacaggaaagtatcacggtaagagtaggataaacttgtccccaaaagctg

SEQ ID NO: 46397 - DNA, 1149 bp, Bovine  19866880902513
ttagagacggaattctctcccaaaagaagattttcgtcgggtcctcatacgttttcagggtgattgtgggacaccctccacgtcttcataacctaatatatgtaggtgctacctaaccctccatgcacacgtgtctgctcaaatacagcctgaaagaaagtttatttttatactgagtggcaatggtagctggacctttctggttattactagaggaaaatctagtgacaaatccagcaacctaggtttccccccaatttttcacaagtttcccaaaataaaattttctttacattttaaggaagacactttctgccaagaaggataggtgtggtctattttcatgtcccttttttgctgctcaaaattctcacgtgaaagaatatgttttgtaacagttcaactgcacgcaaatttccagctgggagtaatgtgggcaaatgacgaacgctttcacaataaaagtctgctcaagatgatagttttggagaacagagaccgttcgtttctgttatttcttctattgaaagtactgttgagccaattggaataacttttgtttacagtctagctgtgaaatactgcgctggggctgacagctcccacggagagaaacagcattgggaaaacacctgcctgccttcccattcatctggaaggacactgtgttaaatttgcagtttattttgaggaaaatattagtattaatatcatgtaactatagttcatggaataattacaacattcatcatatttgactcttaagcttattcctttagtcagaagtcctggatttaaaaaaaaaaattatccctaactatagattttactccagagaaggcaatggcaacccactccagtactcttgcctggaaaatccatggatggaggagcctggtaggctgcagtccatggggccgctaagagtcggacacgactgagcgacttccctttcacttttcactttcatgcattggagaaggaaatggcgacccactccagtgttcttgcctggagaatcccagggacggggcagcctgtgtgacggggtcacacagagtcggacacgactgaagcgacttagcagcagcagcatagattttactcatcaaagaaaaacaaattacactagcatttattgacaaagtt

SEQ ID NO: 46398 - DNA, 837 bp, Bovine  19866880915446
tgcttctgatagagagaagtcctcacattgatcagtgctggaaaaagagccattctttccttcttttatgacataaggaagcccatgtttgttggggaggcacgtatacagacgtacagtcacccacagacacaaaaaaagactcagcttctggctttgggtgtggctcaaatattacatcatatacctgggaattatattagaacacatctcagtatgattcagtaatctatttggtctaatttgtgactagagtattctagaatctatggtgttatttctacactggtctataatagattgctaaatcttgtagtggcaaatttctctaggagaaaaaaaaagtcaaaatagttcagccactaagaacttaaatgggaaaaaatgttcctaggatggcctcagcatcttgatttcatgctcctgactttcccataaacactgatcacaaatcaacattcttcctcagcttcttgggtcagtggagttaaaccagtggctcccccagttcggaacactcagaatttaaacctacatgggaatattcctacatgggaatacactccaatgcatttctatatgccaatttattatacatacttgaatataagatgaatataaggccacatttaagtcttttcaaaatctctgttatacagcactttctcaattgttttatttttaaaataaagtattatttggggaagacatgttaacctgaaatgacctcaaccaatgtttcagataatttttaaataagaaagaggccaagctatcaaacacaattctcctaatagttcatctcacaattgcgagcaccgaaagttatcctaagta

SEQ ID NO: 46399 - DNA, 1290 bp, Bovine  19866880939103
caagtatttaacaggagaagaccaagttggacaacttgtgaatttgtatggaaaggttctaccaatgacaaatgacataaagataaggttcaatgggcagccgaaactgtgaagtggaattcacagaaactggagagatagcttcaccgtaacagtgaaagtcccttcctcatgtcaatgaaaactgaaaccacagaggatgtagagattacctagcagaaacaaatcctaaggcaagagtcaggagaattgagttgaaacattagggcaacacctgtacacaagaaacagtgaacgaagaaatcagcagtggaaatttagaaatattgatctataacaactgctggtcactcatgctctgtcttgctgaaatgactgccaatgaatccataatggaagaagttttccttggaaaagaaaaaagccccctttaaaatactccttctcttcttccattggggttgtcaaatgattagaccaagcttaggatgggtacattaagttaatctctaggaaacaagcagagtaaccaatttatccactctgctcttcagtcacagtccaaagccctgaagtctggcagaggcccttccccattccctaactggagcagaatccagggtcaccgtctctctctctctgccaatgatgctttcttgttttccagaaacttgacagaagtcctcctaaacacacagcacttggagttcttcagggagttcctcagagaacggagggctgaaaccccattgcagttcctggtcgccatacagaagatcagcgttgagacaaatgaaaagatttataattctctctttgaaaacgtaatcaagactttcttccacggcaaaaactctcctggtatgcattctcctctcctgaaatcgtttcctttaccctttagaatcttaggtttggggaagagactgctgtctccctgagaaagcagaacagagcagcggccacatggggcagtattgagacaaagctgaagacggtgaaagcagagaataataataaatccacttttaaaaattgaagtatagttaatttccattagatttgtctcagatatagggcatagtgattcaatatttttatagagtataatccacttaaagttattataaattactatattatatattattatgtattatattatataaagttaatataagactatattccctgtgctatataatacatccttggtgggtcgtggtgaagtcacaaagtcatgtccgactcttgcaaccccatgaacaccagcccaccaggctcctctgt

SEQ ID NO: 46400 - DNA, 3329 bp, Bovine  19866880947375
gttattttaggacacatctattgagtactccctattaagaaggaatattatactgttctcttcctcttctaattttaatgcaattattgttagttcttctgttggtttgctttgttggatcttcataaagataatccttacatctttccttgttcagacaactttagacactatttcctgataccctgccatattagatgaggattttggcacatctacccttctgctttttcttcctcttctttagctttgttaagtttcagtgtttggatttcactgatactctttgtattgaccagtgttaacccttacatgaaacttcttttacctgtgcttgctagggtgagtctctattcttcaggatctaaagagttcagatggaaatgctttggatcgtattaatattatgtatataattaaatatattgtcttatgtactttgaagttatccagagcatttccccatatctttatattataaattatcatccttcatgactgaagactattctaatatattagaaatgcactgaaaaaaaaaaaaaaaaagaagtgcactgaagccttgactttggtatttagccaaacatgctattcacctttggttcaggtttattctccgaagccctgatatgtgtatgtctgtatcagtatcatttctgatgtctgtgagcttgagtgtgagtagtgattgtgtaatcacttatttaccatcataaaatatcagcataacagtatctgtaaaatgaacacatcatattattcagatttgctattaatgttgaaataccgagatattgaaacattcaaataaaggtaatttttagtttagatgtaacttggagtaaaaaatgtttttatgcattttactcacttaaatgtctcagtcaaacgaagtgtaaacatatatttttgcaagagtaaaattctggaaaaactaacatgactgtgagaactataattttatatataaaaacactcctaaggaatttcaaatagtgaaagaatgtcagtgttataataatgggatatattagctgaattcctttagagaaaactatatgccttcagaagctacaagtacttataacattaaataaattaaaacacaaagtggagaaatgtagaatatatgtcagaattcccatttttatagaattatttggtattctaagattagaactattcaacaaaataacctgtaagaactgtatttagctttttagtatatatttttattggaggataattgctttacaatgctgttctggcctccactgtttagcattgagtttttagttgtttaattccatttaggtcatgagtttctcaagtaaaggttctatttggaaattgctcacattttatgaggatgaataaaaagcagaatgtcaattttattgccttgaaatgtcaggaagagaaaaacttcaaatcataaaaaacagaattcatcataaatgatcttcaatccaatacttataatctactgttctacatactctctctatattaactcacttaattctctcactgatcctgtgaagtatgggtattattagcccattctacagatgaagaaactaaagctctgagagattaactcatttatccagggtcacacagctaggaagtggtaaagcagaactcaggcactttgacttgaattcattctcttaaccaaaggtgtcatttcttaaatgagagatacctgaaaattgcttagatggggtttctggcacatagtaagcatcccataaaagttaactcttaccatcagttgctgggatgggatgggaaatactggagcaagagagagggaagagccaatgggatattcgtcttttactgtctcaacctctagaagaaggtacctggtcccagggatccaagaagccagcttcagccaggagggtccaagataacgaactcctgtattagaagactcaggcctggctgtagggcccctggagttcaaggacctgctgcaatgcacagactgttgtggctgggctccttccccagatttcttctcattttgtaagggtgaccatgcagatggctgcaagagtttctttaacattgagtgcattactttctggctttgctgggaaggattgcagctgaatggaaatttcagtggaggagcaccttagcattggccttgggggttgtcatagactttgctctacccctaggtgaagatagggttacttctggtgaatactggcaagcattctgcagagaaagctttaaaatacaaagctattttctttaaaacaaaggtttagaaacctaagggtttttctaggattggcattgaatgtacaggcacaaatgaaattctttcctaagggcaatctgtgccagcttactgcaattaacaaagaagtacaaactgcaagctacggagaagccactgagtaggagtcccaggcccagatgttaaagattcagagaaaagtcaagcagtgctaatagcagttgtggaagccgagacagctatttcacttgtgcctgctgctgccgctaagtcacttcagtcgtgtccgactctgtgtgaccctagagacagcatcccaccaggctcctctgtccgcaggattctttaggcaagaatgctggattgggttgccatttccttctccttacttgtgcctaagtgttcacaatttattaactagtttctctgttgtgcaacctttaaaaggtgtgcaaatcttagttattcatgaattgttaacattaacgttctattagtttagtggggttgtgtgttgtttatttttcaagctcagttaatgtgtctttcttttggctgggcctaaggaaagcctggctgattgagtcacatgatctcaaccttgggcatcactgtgtagccgaggctaccagagttgtagacagatagactagttgaaaatacactacttctagaatcccaagaataccagccatacaagctcaaccctacaacatggtgctgtgtatcagcaagttcatttttttgtccttctcctgactcctagggttcaggggctcccacagctaccctggcccttcttactgctcctcctcatttgaggggctcttggatcccagacccagcattcatctgcattcatatcaccatgtccccgcttgtgtgttctttctcgggactctgccggatgactagcttattttgctagttttgaagatgtgggaagatttagatgttcttcttggtctaagaagtgtacaaagaagtgttaagacacatctagtctgagtccagagaagttagcaacagccctgtaggggagtgtagtgagcatctgttatgtttt

SEQ ID NO: 46401 - DNA, 1507 bp, Bovine  19866880965252
ctggaagcccatgctcagtcatcggcgtgatggtcgcagcaacaagaccttggagcttcttctttggggaggccatcgagttgcttaaatgtctggaaaacatataatgtccttcctgtcttcaagaaatgtcaattaatgataaaactctggggcaaagtccattcctacacagtttagaactgtgaaaaatgcgttacaagtgtacaaacacagagcaaatgagaggaatgtaaaatgtgagagctttacactataaaggaggaaactatattttaaagacaggagagagggagacaagagagtaatgttctaggaaaataccattggaaaggactcccgacttatctatacagatgaccaaggcagtttgaaacctcagagagcagggatgaaaaacagaagaagaaagaatatgaatcaaattcagcaaggtcaaagacattactcaagttgaaatatggtcaggagaaaagggacagtcttatgtcttttcataacttcatatggttgaacaagaatctccccttagaccagtatttaagccttaaaaggcttcagtgtgagctacataattatctttagatttacctaactatcctttcatattctagttttaatcagtttttccctgtttccctggctttaggaaatcacatcacaaatactacattcacctcttccccactagaccaagctcccccagcacaggaaatagattcatttatctttgctttccctgaactcagtgctctgttggacaccttgtgttcaattaaaaagtgatggatatgtgagtgattgggcttccctggtagctcagatggtaaagagtctgcctgcagtgcgggagaccagggttcaatccctgggtcaggaagatcccctggagaaggcaatggcaactcactccagtattcttgcctggaaaatcccatggatggaggagcctggtaggctacagtccatggggtcgcaaagagtcagacacaactgagtgacttcactttcttctttctatgtgagtgattgaatgaggtatccagattgtagctggatgatgactcccacagagatctctgctgagacaatgaacctagcacacactcattaggggtaaaaggatccctcactacctggcagagaatgtacctgctcataaccagcataaaaaagctaagaagttgcccaaaacaggcaatgagaggcatcaagcatcctggttaaaagcctagattccacaggaggctacttgcttcatctcctacctctgtcatttaactagttatagaagcactattaatttttgagctggaggacatgaaaatttgaagccacacatgcaaagtctaacaattgaagaagaaaataaaacataatcagacagtatttggtggcaattttacaaaagatgtttggcttggtgaaaagttagtgatgtctataattaacaagagagagtatataatacttctgaggtcacttttaaaaacccaatgccagattc

SEQ ID NO: 46402 - DNA, 754 bp, Bovine  19866880977984
taacaaacatgatgtcactaatgttatcatcctccccacgggtagccagagactggtttgtacagaatgaagcccgcctgtaccagccaggaacccatcatctgaaacagaaaggtctcgatcacagcgaagttgaaacgtgtctggagcccacagcttggcggtgaacaccagcatcagcagcaacaccaccaagatgagcagagagtgaacatgcatctccacccccacggagtcctggacatgcgacaccaacagcagcaggagcacataaaaggtcagcaccaagatccctttctctaggggcacacagcgttggggcagcaagtttttgctcatgatgtctatacagccgttgagggtgaggaggatgaacatggtgaggtgctgccactgtttggcgtacatgaatcttggtggcaggtccctgttcatcagcgtcaatcctctctcaacacagctgatctcatacgccatcaagccaaagccggccagcatcttcagcaaacctctgtgggacattttccacagcctggcccatctccccttattcttgggaggcaaagaaggatccgggaaagagtcgctgagtatcacagctttggagaccactaccgctcgatacagtccgtatgcgagtaggaacaaccctggatacacgtgaccgataaaggttcccattgagtcacaaatcgatctaatgaaagtgagaagagtaaaacacaggcacgtccttctagggccacctcaaggt

SEQ ID NO: 46403 - DNA, 1505 bp, Bovine  19866880991221
ctcaaaggagttgagtgatttgcatggggtcacacagtaaataatacaaaaaatgtactaagtctagaatatctgccatgagaaacccacttgcaaagggccatgggcttgggagctagcattaggtctgactaacagatgaatgaattcatgaaataacaaaaatgaatgtatgtctaaagggtgaggaacttatgaattagctagtttaagaccatctcagccagatttggtaacaacttgtccactgagcttctaaagggtataggtttcaattcctggttccctaaattccaagtcaattgccagaaggatcctactgaccttttatcattaacttctcccctcttgaccctttttctcttgttaaggaaattctagggtggtatttaccacctcttcaaaaagaatcaaaggaaaacaaagcacataataatttcaaaagggcaaaggctttttcttttttaaaaagacctctctcccccacctctccccaccagcacacatactccaagtgctgtttggcgaaggtattctatgactcagattgcttttttcccaggggctttccaggagcaagcatgagggggagtgagtgtaaaaatacaggaggagataaagcttgggggtagtgagaattttttcccatcatgatgtgaacgattgccctcctgggagctcaagggagatgggagactcaagctggggagggaggctaggtggggagggaagaccaggggtcagagtcgagtgcgcctccccatcctgccccataccagctgtgctcaggccataaccctgctactcacatctgcctcgttccacagtcctgggatgcagaaggactccagaaggtcactgccacacagcagcaagatccgtagctctgaggaggggggacaaagttagcaaagggagagggaagcgttcaaatatcagccttcttccttttaccagcacagaagcgtcccatccctggggctccagagcccagttccagcaggcagcacgctgtgtgctgccctgaatcctctgctcagccctcccccaggctcatttacagaccactctcactccctgcaggaggaacctctctcctgcggaatggagcagacagagagtaactgtcctggtttgctgggactgaaggatttccagggtgggtttcatgctaaaccaggatgtctggtcacccacagtctaaggcagctacacgccttgtgtgaggtctaagaggctctcttttttgctctatgtcaaaccaaagtgcccgtggagtgtgacttctctgctgctgggcatcctctggggtttgtcttccatcacaagcgtgacgtgatgggggcaggggacatggagtgcaccctcaattcaccagctggctcagctcatcagacgtcttccctgtacatgggccactgtcctcagcaaacggcttgagaagcgaggctgcccccacctttccaactcccaggcacgtttccagcttatcactagtttttctt

SEQ ID NO: 46404 - DNA, 2365 bp, Bovine  19866881042387
cttgcaacagtgcacttcaaatgacccccacacgtggccccccccaactctactgttcttgcttagcccctcagtgcacagtgtaatgcacagcataagaccacgtgaaacatttttgtttcccttaagagtgcccactgtggatgctatacagttattcaagtataaaaattcatttacgatataaaaactcattttgcagaatttctttatggaacaagatacaaactacatcataaaaacatcaattttattaattttctttgtacttgttcactattactaatcaaaaactatcatatttgtcttgattgttctcatccagtagagttggttttattgttatttctcttgagtctttccagacctcagattcggtctctgatgatgaaaatgtgttgtgtccctaaatactgggaaaaaatcgacaatgttttgagagtcatcccagaaggcctcctacatgtcacgttctgaactaaaacatctgcagacgaaggcgcctaaggagatcacttttgaaagagcattgcttagcttgatgtgcaattataggagatcatttgcccgcatatataaaggaaaataagttctaatattgagtgagattagacagaacttctagaattatttttgctactcaacgtagcttataccatatcccttaaggggtttgtctcttaacagtatggagagttggatcccaatcacatggtagtatttcattatttttgagaccaatatttaagaaatgatacagtactaagcagactattatagctcaggaatttttttctgatacaatattacattgatttagttcaaacaagagtggtgaggaaagcaaacccacaaagattagctagaaccccattaaagttttttttattcctgtgtgcctgtgcattagttgctaagttgtgtccaactctttgtgaccccatggacagaggagcctggcaggctacctcctctgtccatgggattctccaggtaagaatactaaagtgggttgccacttccttctccaggggatcttcctgacccagagatcaaaccctggtctcctgcattggcaggcaaattctttaccgctgagccaccagggaagcccgtgagattcagttcagcttctgtttaatatttggctaaagatgtttgatcattgtaggactcttgcctcaagaaatggaaatggccttactcctcatcattaaagtaattctttcaccagggaactgacttcttgttggctttaggtctactgtaggcctagtatcaactccatactcttaaccctcccgtagtaaatccgagtagtgttcatatgtatgttacacgattctgatgactctcccttttctgtaggtggagccttacaaagtgaacctttctcaagatttggagcatcagctgcagaacattgttcaagagttaaatcttgagatcgtgcccatagtaagcatacagatacttaagttcttcacctttgtgttgaccttcttcagtcagacaagcaactgatatttttggttttgttttttttaatagcctgaagatccctctgtgcctgttgcactcaaccttggcaaactggctcagtttgagccatctcagcggcaaaacccagtgggtgtggttccttggtcaccgccacaatccaactggaatccttggactagcagcaacattgatgaggggcctctggcttatgtgagtgcaacactgttgttgagatcagacttctgtgttttatttttgaacatatttcattaggatgtctagttttaaagaaatgaattcagcttcatttttttgaagctgaattacgcttttgtgtgactgttgctttcccattttataggctactcccgaacaaattagcatggacctcaagaatgagttaatgtatcagctggaacaggatcgtgatttgcaagcagtaagtgaagtatttaaacatatggtgcttaagagcttcaagacagtgaataatatatttttgccctttctaggaaggcaaattaaagatactaatctaactgataatcctagttacctctgaggataggagtagtgagttaagggcctgttgttcttaatgtaaatgaagagatggagtataataactttccatgtgtgtgtgtttttgtgttttctgagtaaagcgacttaaaatgtttagaagaaaggtaatgtatatgtaatgtccaggataaaaatgaggaaaataaggatgcggataaggccaaaagatattgttcagaaatttaatggaaagaggctattcaattagaggtgtgtgtgtgtgtgtgtatatgtatatacacttttatcaaaaagtattttcgaagtattaagccag

SEQ ID NO: 46405 - DNA, 1043 bp, Bovine  19866881118329
tgatgtactctgcatagaagttaaataaacagggtgacaatatacacccttgatgaactccttttcctatttggaaccagtctattgttccatgtccagttctaactgttgcttcctgacctgcatacaaatttctcaagaggcaaatcaggtggtctggtattcccatctctttcagaattttccacagtttattgtgatccacacagtcaaaggctttggcatagtcaataaagcagaaatagatcctcaaaaactaaaatcctgcctgtgttccccaacagtaatatccaaaaatgctacatagttttaagcaaattgaagggtcaaaattgctttgctttacacactaaataaatgagaaatcatcatacaactgttacatgaacagagagaattcttatctgaacactagaacatcaaacacttttggaaggtaatttcaaaataggtgcaaactactgttagaggttacagatattttcctttattgaaacatcagataaatgtatctcaatttgtatatcctaccattttatttgaatttgttaccagaaaagacaagatttgcaagtgaaatttcaagccaagaactgggcatatgacttattaacccaaacctcatgctcgctaactcaataccagccctaattcaggctagtaggtcacaagcatgcctgaaatccttgagccaagagaaaaggaatgaagccaacatttactcccactcgtccaagctgaggcaaaaaaatccactctgccgaacatcagagttctaaactgcaaggaactgagtgatgtgtaagatttaatggaatcacacaaagaaagtggttaattataataccaaagaaataaggaaataaacaggcaatgaaatgtaagttccataaataaaacccatactttaaaaccaatattttttaagacatgaaaaagatgtctaattgttcaagacatgataaggaaaaaagacaccagttttatgggtagctatctcttggtctgtgacatctgtacactatttgagatctgactatttt

SEQ ID NO: 46406 - DNA, 2222 bp, Bovine  19866881123025
tgtttttctctttggactttaagaacttggagtgtttgacccttagcatgtttccacttatctggtgttttaggaaagctctaaaaaggattagaaacagcactaaatagaagcaggcaaatttaaaaatgtaatgcctgttgtttgtttaaaaatgtgcagacaggcctgttttatgctagatcccacatctgtattatagggtgaacttgaaattactttgctgtggaaagaaggaaaacagggagatacatctggagaagtctcccttgacttgtcagggtggaatcactgagcagtaatgtgctgtggaaagaaggaaaacagggagatctatctggagaaggctcccttgacttatccgggtggaatcactgagcagtaatgtgctacatggctgcattgcaattctaatccgcctacatgcgtaagtcaatggggtctttgttccacatttgtggaagaatgcatgagccaagtcttggtgggagttcagtttagttccactgttttgtagattgggctaattttcaaagggatccaggcatttacttttgcaagtgagagaaacaagggcagaaaatccattcttggtactgaagaaattattctaaaacattgtgtcatttgccccttgtggacagggtgtttgattatttgtttacagcctggagattgaacctcttcatcttttgtggacctagaaatggagagttattttttcctcattcaaggatggaagcaactatttgagagccctttgttaagtcattagaaaagttttaaccttaaaaatggaaccttaatttctgttatcctttgcagattattcagtataaactcaccctgggactataggattaaacagagcacagaatattggcaaaagtatggtataggttcagagaattacttaatgtctttaaagaactgaggtgagttggaaaccagctgctattcatgtttctgacgtcatttgtccttgtgaaatcagttcctatggtattttaacattctctagaatgttgctataagcaaagaaagtattcaaaagatctgtgaggcaggcatctttagaaatgtggatttctaagcacatggactgtagaatcaagcttttcggatctgaatgttaaattcatcctgttgaacccttattttatggatgagcaaatagatgtgtgattgctcctactccccagtacagtacttctctaatgttacatttaattatttgtgtcttcccttatttatcatatggaattcctttagggaaaggactgagtcttattccatccttgcctaacagactgcctagcagaaagttttagcatatctttgcaaaatgaatgaatctgtgaatgaatgaaccaaacaacaagccaggcttacctgagtcactgatttctcctgttggcttgctgcttatttcataagtcagacatttctctccctttaaaaggcaatgacaaaaacatccctcaaagtaaagggatagcaggggacaagacaagagtcctgtcctcaaaagcttactctcttgtgtgtgtgcgtgtgtgtgtctattggggggcatataaagaagatgtgcaaaaaataaatgagacaattccaggtactgataccccaatgagaaaagtgccttgaacatgagacaagaagtgagtttcccaataaatatccagatgtcttctctttagtatagtctaacccccagcactgggcatgagtccatctgcccacagagaggaaatccttgctgctaccctgaaggcttgtcacagacttgtggctaaaggagttcttctggaaccagagctgctaaaaagaaccactttggagggatcagttcaagaagggttggtggcttctggtcttcttagggataccatgttgatgaatggaattttgccctttagctttaggaaaaggttttttttttaaatcatgttaaaagctgccatatacaaaaactttaaaaatattgttcagttttttaagtaattggaaggtcttgaaagtttatcatcttaaactgtacgtcagtatctagagaacatttcattgtggaattctgacctgttatgtacaggagatgggtcagcctatactggacaaatacttaactgagcaactgttttgtgccaaggacagtgaccaagagattatagaatagggttttccatttaggttacaacttcctaatgtcataaaatgaattt

SEQ ID NO: 46407 - DNA, 649 bp, Bovine  19866881155143
gtgcagggacatgcccattcttcccggacagtgggtgctaagctgccaatatcctgtttttgttctttctcctcctctgaaacctcctttcttgtccaaggggacgcagtatctccctgcagatcccttcgggggctctgtgattatggttgattgctgcctagaccgtgtcactttctgttcgtttcattcatgtcttctttgctgttgtgttcagcggatcgccggcacagcagtctggctgcccacagcatctgttctgtttccagacagcgtgcaggtcccctgtgctgctggtgactaacgctggtaacacattccgatgcaggagaactcacaatcacagtgggttcaagggagatcaaaatacatcggaggtcactgatctttttggtttttttttcagctttattgagatgtagtgacagataacattgtaatatgtttaaagtgcccagtgggatgatttgatacatgtatgcattctgaaaggactcctactggcgagttaattaacacatccactggcaggtcaccaacttctagtttcaaatattttcccacatttttattattgcatttaatattggaagaatatcatcaagttttggtcacattctggattggtttcttagacatagtcttaaaa

SEQ ID NO: 46408 - DNA, 811 bp, Bovine  19866881176693
caggggcgtctggggagttccgtgctggctgtgagcaggctgagatgtctagccctcagccgtggcacctgctggatccccatcagcgtggttttgtggagggacttttgaccgctcaacctccctttgttcttgtctgtgttctgagacttcctgaaaattctgtgggttaccccacactccctctaatgattttttttcctctttaagtcagagacagtccatttccatccttagctatggaaacttgaccaggacatctttccaactgccttacttaaagtgggtccctctttgctttctacttctttattgcattcatcacggctcgtcatcattttactgattggtgctggctcatcatctcttttcctcctccagatgtaagttgcctgagggcttcctctgccgtcccctggggcccgtccactgccaggctcctggaagctgctcagcatagcatcctggtgatgcccgcagacgccagggtcagcctgcctgggtttgaactgtggcactgccggtgtgagatttcagacctctgtgtgtctcagcttccccgacagtaaagcacggacaataccagttcctgtgtatacaattgctgtgaggattaaatgaggacatatacgagaagatggcccggcataccgtgttcatgggtgaacttaggagaaatccaaggaacaatacagcttttcagggtctgatggtctgtgtctcattgctttaaccttcactgtcaggggagggccctttccctagggttaggctgagagtttaccaggttgaaatctggggtctggaacta

SEQ ID NO: 46409 - DNA, 930 bp, Bovine  19866881208001
gcaacccgcggcttcatccggacgggcggcgacgagcagcaggcgttgtgcacagatgagttcagcgacatctctcctctcactgggggcaacgtggccttttccaccctggaaggaaggcccagcgcctacaacttcgacaacagccctgtgctgcaggtaggcaccggagctcggcggggtggccgctgggttgttccccatgcggggcgtgggaagatcatcatggggaggggggccggcccgcgtgcccgcttttggaggaagggtcaggacagacagctggactttattctgctccccagtgtactcttaataagtgaaggaaagtagtttcgttcctgcttcccccttgatgtttgttcttgtgtttgcgtgcacatgtatcctggcatgtaaactttacagatatttttaaatgctgagcaattttaacttgcatctctgtacttgcagtggaaatattttgctcctctaccttcctttggaaggagggtatttgaatgaatttgctgggtgttttttttttgtatccggtcttacctctttgatttgacaaaataaaaaaaaaaggcttttaatgttggcaagagggaacaactgaaataagatgtttaagaactctaccttcctttgctatttttaaaacagtttttatttctcttgggctgtgcggggtctttgttgctgcctgggctcttctctagtttgatgagcgggggctactctcgcttgtggtgtgcatgctccccactgcagtgccttctgtcgttcctgggcaggggctctagggcgcgtgggcttcggtggttgcagcacatgggctcaggagttgcagttcctaggtctggaccacaggttcagtggttgtggtgcatgggcttagttgctacctggcatgtgggatcttccgggatgaggaatcaaacc

SEQ ID NO: 46410 - DNA, 1628 bp, Bovine  19866881238597
taaaggaaagctattttatcatgatccttgcgatcgattcaccaagacagactctgcctcatttcattcctagaaatctacttctatccctgttattttctttagctcatctcactctccctataaacgtgctttccaccccaaacactgaatgccgcgagagtcagccctgtttcttctcaagggtcatgaatgaaatggggcttgaccacagagcccagtaaagaaaaagtggaccaaaggaacaaaagacagctggtctttctcggctctgtccacgtggatcttcagaatgaactctatccataaacttcatatccctgatgatgcgtgcttccccggggaatccagctccctcatttcctttgtatcatttcctggcttctgaatgccttgcctagacaaaggtacttctgtctttctctccctagcactagtgcaatcttgagcactttctcggtctttgccttccacaaagcaatcctttcttggattcagatttcctctaagccattgccatttccagcagttcctttctaagggaaacctagctacagccttcctcaccatcacatcctccccccaggactagcatacacaaggctgtatacagggagcacctgggacagacgtaagttaagagagagatgccaggtaaagactgaaagctgcatcttatctggtcagtatcatggggaacaaaaggagcagagattatgtggtgtgatgacctaatggtcagggaaacattagccttttgtcaggctttacgcttgctgtgtgaccttggacgaatcatttaatccagtggatctctgcttcctcatcttttaaaagaaaccttggctcaattaatctctaaagatcttctcagattccatgattcttaactgaacactgagagccaagaacagtatcttacttttgtcctttggagattatttccataattcaagaggataagccctccccctgcaaccatgctattttctgttgaatttattttcctggaggctgctgaaggatgctacagatgtttctggcatcagatcccacccaatacctcccgggccagggctggtactagatatcgacaaaattatcctacagtttggggaccatttctcaaagaatcaaacacccaagagccaagagactggatgagagacacagagcagaagagagtaatttcctttcggttctccaggcaggacctgaacagctagaacagagtctgtcaaaactgtttccagagcgccagaggcaggtgggaaactggggacaaaaggggtggatgagtttagtggctcttgacaatccctccagatgtctgttctgagaatcgtggtcctgccaggcaggcttcctcaggctacgattgtggcttctgggttcagcatgagtcgtaaccctaaacccacaaaaaaggctgaggctctgcttctcaagaaggaactgacctcagacaccatctctgttaccaaactagagtgggtgagaatcactagttcccacggggaaatgggaatcactttctcctaggtcatcctggatttacgttacgacagagacatttcccagccaaacaggcaataaataattccaattagcaaagatctctagcttga

SEQ ID NO: 46411 - DNA, 817 bp, Bovine  19866881264913
taaagtaagtgaagcacctaactcaatgtctcccaaactaaaataaatgaagcacctaactcaatgtctcccaaactaaagtaaataaagcacctaactcaatgtctcccaaactaaaataaatgaagcacctaactcaatgtctcccaaactaaagtaaatgaagcacctaactcaatgtctcccaaactaaagtaaatgaagcacctaactcaatgtctcacacatagtaagtgctcacaaaagcagtttatgcctgaatcttctaggtctccttcaagccttgcaaagttgacatggaaacacatacaggctcttactatcaacaggattgatttatttcatgttcccaaacttccaaaataatagcactgggttttcaaagtatctcattaaaataaaaacacctgtcccaattcctatatcacgagctactcttaggaattgtgaacaaatgggcctaaaggatagatgaagaagagcttcttgtttcaaatgtgtccccaaaaagcacttcaggacttaggtagtactgtctatatgcattagaggactcaggaacatattctaaaatgactgagagagcttgcttccttttgagaatgcttaaaaaatatagacacttgcatttttaaatagcactatattattgttatccaatcactgtatttaataataattaaattattatctaagacatgtttcaaaacaataactcaaatgttatagtatgactaattcactgcatggcttgtacatatttaaaaaaaataaaattaagagaacaaacccaatatcattaatggtctgtacagat

SEQ ID NO: 46412 - DNA, 2071 bp, Bovine  19866881267534
ctgcagcctattattgagcaatctgcttgagttgaaagtgaggctcagagagattaggtaccaataacacggtcccataggcaccaagtggcagagataagacgtctattatactggtgttttcaaactggtctgtagaaccctggaagtctaaagacattctcaagtagctttcagtaaatttgtgtttgcatttaagccacaatctgttaaccatgagcatatgctagaccacctgagtgaccatctgacgactgaggactggcatgcagtttcactacctgtgtttgtgctcattgagaactttactacttgctgagaacaagtagtaaactttaattgggatggattttggggaaaaaagggcagattgaggatttttttcagcagtaatttcaagaatctcgatctgtacaaagattttcccatcttttctagctctaaggtcatggatcagctgttccgctgataggtttaccctctctctttggggtgggatgggcacagatgcgtgacacaaggcttggggaataagcagaaggaaatgactttatggtatcaggtcaacaagaaatcaggatggaatccaactgccagtcagtcaaccacaagcaacaaattggagaaattaaaaatactagcatggagtcaaatctcttagatgaaggattactgggttagcacctgtctaagatctccagaggctacaaatatctctgaatgggtgtgaaggaactgccagcttgccaaaggattagtgcctgtgattggaaatgaaaggacagttaaagatccttgagaatttttcaaagcaagtcatgggtgaggacgggaagagataatgcgggacagagattctgcagaagacctgccctggtggattttcctgcagcagagagaagtgaagttttctctaacccctctgtctttcagtgcaatgcagtaattttcaaatgtgggtcaggggatgggtcacatcagacttgcttatagtgctggttaaaaatacagttttctgggactgaatcaaagtctcagaatttcacagaatgggactggttagtcgtagcattccagaaagttttaaagcatgttaaaaccctgcttaagaaggataacccgttaacgctctacccattagcctgattgattttcttatggacagcaagagtgacgtgggttctatcatgagtcagggttgaagatagtggaggactgctcacgttaagaaaaagacgctaaaagaaagggtggggaactatttcaatctcttgggcttgcccattttttccctacttctaaggcctttgcagacggtcctccctatcttttccaaacctgacccttatatcctgttggctttgctttcaagctcaggaaacttttttctccttcagccctttttgggtgtgtttggattttgcctaaacacggtctgccacacctgccctatgttatttttagggtctcctttgcctacgtgccctgaggaagtgagatactccgtaaattctttcttctcatgaatatttgattggcagccttaaaatttttctttgtgtttaaattataaactcactgcaagcacaaggcacctttcaccatcttttaaactccatgtcaatatgtgttcttgtagagctataattgcctattatttcatagctttccaaattaatattcattaaacaaaagctgaaaatagtgttaaatctatgtaaaatttttgatgtgcaaaatttgcttatcagtatgttaatgttattttatcagagtttgatttctgtggtaaggaaggacattatatttcttaagaatgctgctttttgaagccattcatattatagactaatgcacattttcacagaataatgaattattatgtgactgagggagttaacgaaatgtaaatgagaaacaatttcaccgtactgtctttggagacacaatgtgatttttaaataaaaatggaagcttcccacttttgccggtaatcagaattaacataacgagtgaaagggagagacccggacagaggtggaagcagagctgccttctgatgtggaagaaa

SEQ ID NO: 46413 - DNA, 816 bp, Bovine  19866881270413
tgtgaccccctgacgccttaccagtgctcagtaatcacgcacctcctgatcaaaatgatccagccagtctaaacaactgccagaaaggatatttccagctcatccctggctaggctcacactgatggtgaagatgtccttcagcacgctttcccaattccagcattacctgtcaacctggcgttcctgctctggggcaggcgttaagaacactgtgctgtggttgaggaccaccaggactgcagtggaagagggctccaggtacctctttctcatggctgtgtgtggaggaaagcaggtggatgtgaatgtcagagaatagacacgctgcaaacacaaggcgaagaacagaccaacggggagcaaatccaatccaaagaaaggcagatgaaagagaaggaggtatacagacgcactgtgccagtgaagaggaaaaatggagtgaagaagtgagcagacagtgtcattccagaaacaggacaagggtatttacataaactccttactctataatcatgataaacaacaacaaaaaaaacacattcacacaaaaatataaatttgaaataattaatagcaccagtgtgtcagataatagtttctttcccccgctacgcaaagtacaaagttgcatagtgttaaaggctatatatgaatcttgaaggcaggctggcaggaggaggaaggggtttgtggcagagaatcatcacgctgcgatcttggaagaaaatcacagagctgaggaccagaagttgagaagcccactaggaaactccatgtaagggccttccgtctacacttggaggggaaggtctag

SEQ ID NO: 46414 - DNA, 3098 bp, Bovine  19866881370700
ataatttttgttatctctattttaaagaggagaaaactgaggcaaagaaatgtggaagttgcttgagctcacagagcaatcaaggggcaggggtgagatttgaaaaaataagaattaacttgacaatactttgcaactcagtatctttttcttaaagtcagggaataggtagcttgtcccaagtagacaggggaaggccagtgagtattatccagggccaaagcctggtcatcccatggtatgtcatacagtctttggccctttggagtaacttgccgttcaccaggagcgaaggaaatgcagtccttggatcctaaaggcgattagatgtgaggtgccacctagatgtggagactgtaattagagagaggaaaggtctttgtcttcaactggctcagatgggtgtaagccaggtgtacattctgaccccagtggcaagggtgtgcatgtgtgtgtgtgtgtgtgtgtgtgtgtgcaggtgcacttgtacatattcatagttcagattcctgaatcttttgcttcactaagcactccagcctggtctttggtgagcaaagagagaacagctgaggagggcaaaattggttcgagtggcaatgatgagatcctaggtttttccactaaaacataagatccataaaattaggaaagtgagagtagacaatatcctataaggaataaaaaaaaaaaacccaacttatacataaaagcacatgtgcagaagtaggaagaaaatcaggaaaaagaagagcctctcaaaccaaagaaagaaagatgaggagaaggagggcggttaggtcactcttcctttctgggtcacaggatgctggccggcccgagtgttccgcacaggggagtcctctttccactgtgctctgtttgcagagagctgcttttagggggagctgtgcgtcagccagcagatgctggaagcaccgtgtcccctttggatgttcagaggtcgtcacttcaggacatgcagctctgggctgtgggctgaaaaccgctggtggccatgagccttgttctctgcctgagccccagttgactccccggagttggcagtctgtggttctttcttttctttttaatatttatttggctgtgccaggtcttagttatagcaggtgggatctttgatctttgatgtggcaggtggggtctagttccctgaccaaggatcgaacctgggcccccagcagtgggaacatggagtttgagccactggaccaccagggaagtccccagtctgtgattctgcagcgtctgagtgccctgatgcagaagaacacgacgggtctctgtctggagccagtctggtggtaggagagatggagttgtgctaacacatgtggagctaaaattaccctgcccttatttctgcagctgaaagacacatactgtgaaagtcatgggcattatgctgtcagtccatggatggcttcaaggcccttgtctgaaccctgatttcatcccagggtgggggagcccaggcacgcctccgtggagacggcagctctttggctcagggctgacagctgacacgtcagtctctcctgcatgcctctccttgtaggacactgtggggcccaggccagggtttcctttccaccacctcctgggaggtggtgtgggcagaaactctgtagtcaggttgcattgtttagggaagaggctggagtgaagacacacaaacgacagaaataaagtgctcagtaaatttaatgtgcttgaaatcaacccccagtgaccccccacccctcgccccggtccatggaaaaattgtcttccatgaaacccatccctggtgccagaaggactggggatccatgctccaagccatgtggggttgtcatgttcttttcttgttcttaccaatacttagttttagaacgggatctgaaacaaattctcactgagatgtaaatgacagacagtctaaagtgttacctctgcaggggaatttggctttggaaataaaatactcccacattaattttaagagtagagaaggcatttctggggatatcaggttttcctacctaggtggttaattacctgcttgatcttggtgttcaaatctccacctgctcagcttagcaggtggcattggttagcaccagttataaagaggaatcagagtcttgataagatgtacttttgaaaagtttctcagggaccctggggcactgaatctcctgtcctctctccctccctcgctcccaaaactcttcagttataggagaagctataaagcaggtgtctgcttttcccttgctaagtgatgctttacaagaggcatttctgggaaactcacgcaggaactagaagggtttgccagtcctcctagatacggccttttttagaagagacttcactctctatatctctggtccttttatttatattgtcacttgcttgtttacgatgcaaacattgactcttaccttagtatttattccatgaatactaggggataatttctaaggctttggcttcaagtctatccacataaatgcagaatgtcctaaagtagacttttttttttaattgtgatacaaagtacgaatatacctaatatatatgtcgtttcacataacaacccttacttccactacgtgtaaaagatgttgtttgacctctgaaccgagctcagtggtttcctaggtcacctgcagtgaggaggcacctggctggcacgtgtacaagtgagcctctgtgctgggtgcctcagaccttgctgctgatcatggccgggtaagcctgggaagaggtgccttctgagagtccctcgctcatccctaacagggggctgccgtctctcccacaacagaccacggacagccagggtgctctcccaggagtgggggcagcgaggatgggtctgggattcccactcagcaagtgacatgcacacacaatcacgttaccagttcctctggccatcatggaaacagcagcaagcgggtagaaaggaatatgttttcctaggagaatctgggtggagggctagtgttatggagtcacagttttgtcccgctttgcgcgtgggtccaccatggctcctgcccctcactgctttccccacgtcggca

SEQ ID NO: 46415 - DNA, 1790 bp, Bovine  19866881375992
ttgctataatcaattatcacgaacttctaggcttaaagaaacacgaatttattaccggatagtctggaagtcctaaaattaaggtgtgttcttcctggaagctctgagggagatctgctactttgccttttccagcttccagaggctgtctgcactcctggccccatggtcccttcctgcatcttcaaatctctttctgctctctgtttctgttgtcacatctcctctgagtctgaccctgctgccttccctctgtgatttcattggattcacttggataatccaggataatctccctatctcaagattcttaattcaagtcacatctgcagaatcccttttgccacaatagggtaacatattttcaggctccggggattaggacatgaacatctttggaaggccctgatttagcattgcacacagaccatcgccatttgctggggaccgaatggtcttcccaatgatagaacttttagtgctaaaatcaggaaagttttgggcaaaactgggcagccagttgcccttagctaagcgcaccttggttccagaaggtatttctgctaactcttggggaagtggaaagggaagatgaacatagataagctgtaaaggtaacagcatttagcagtaatgatctttaggacaaaagcaacctttaacctttaagaaatctcaccctgcaccccctcagcaggaccacatccttaaaacaagatgttctccacttggttgtttttgggctgcactggatcttagttgtggcgtgtgggatccagctccccggccaggaatgaacctgggcccctgcattgggagcgtggagccccagcccctggatcaccagggaagtcccctccggtagatctacctgataaaggcaaagctatttcctcaacaaactccactgcaaagcctggattatccttgaataggaagcctgtttggcgaacttacattcaaaaaggttaatggttcctacagtgtggagtaacagacttctagttaaaaatagagcctgattccatgcaaatgacagagacttgtcacctggatatgaagccacagcgggttttctacatcatgtgtcctcttcctgccttttttccttccccctcaccttccagtctacccaccctcccccgccccagtccacccacccagttatatttagtgttacagtctgtgggtttctgaaataattctctcatgtgtttatgagtctcactgaaggggaggccggttcatgccatatttttatgtatatatttagctctctgcttctgaggaaataaatagaaatgagtctttttcaataataggtgaattccaagaagcttgtagcccgatttgagaagggtgatggatggcgatctgggaggggagggggtggtttccagtggaaaggatttgaatggagagccctagggtggcacatggcacttggggagtatgagagggtcaccctgcatggtccgtcagaagtgacagttgaagtgaagatcatgaatcatttcccagctgtgaagacagaggaacagaaatcctcccaagccagaggcagtggagccagtaagatgaatgggaaagagggtgcccgtgctactctacttctccccgacgaccagttcagggacgcaaaagccagacgaatggatggaaagccagggactagaggaaagccaggcatgcagaggcatctgggaagcactggtgacgttcctcggtcagtgcaacctgacgcatgctcagtgggggtgggggcagcggtggagtgaccgaggtcacca

SEQ ID NO: 46416 - DNA, 868 bp, Bovine  19866881405743
atgggatgggactcagaagggtgggactgtgcatgagcttgtattgaaccttttgaggggtctctctgtgttactgggatagagaagaaagctgagggcaagtcctttgtttttaaagtagccttaacctttgactcttgcttttgctcctgttatttcagacctaatgaaaaggttaagtctcagttagacaagatagaaagtcagaactattttgccccaaaggatattttatggaagatttttgcaaactatttggaagactcactgttgtcttggtaacaagcagcaccctttacactggcccctgctaaaccttgttagatggcttgcatggatttgccacttattgaagtcctcttaattgctcttttgggggcatcgacctgactattcactgactgatgtttctgaggcaccgaggaatgagccaactcactctgagttggttctggcctgtggtgcagcctgggcaggacctgcacttgaattcatggaatgtgatgattcaagggcccttaatcagttgctccaatagcctgatgctgggacaccctgtgatttgtaagagcaagtggacatgacatgctcactgttgagggagagagaatggctgtagccagtgttttgaaatgcaaggaaatcgatggctgcacagtgagcctggctgagatgagagctgggggcacaggatatgcaggagaggagatatttctggggccttggatgttctggccttaaaaggctcctcggagataggctgtgcatgtgttgtccacccccgccgaaggtaataccatccccgtagacgtttgctggatgagatttctgtgaacaatgaccggggtcagagatgaaaacccatttg

SEQ ID NO: 46417 - DNA, 1052 bp, Bovine  19866881462475
caggtggaaaaattacaaccccccaagaggctaaaaaaaaggcgatgggatttcagtctgcctttctgctggttttagcacaagggaccgttattggaaaaaacaaccaagtcaaataccattatgacaaaatcctgcgtgacaaagggatttccaagccattcaggagggttttgtgtgattaggcctacgattcctgctcaccccaagaggctgcacgtagagattcgtccctgctagagtgaaggacagggatctgggacacgctttgttctgttcacctgccttccttcttcctctctattagctccatcccctttgctctcataagctgaattcctctagggagtcctgcatctcagcttcaaatatccccctgagctgacagacgaatggcttctgtgcacagtagttaaagagcacaggattttggaagaagcaaagatttagggactcctagctagagatcaagggagagagaccctttctccttgcaagtcctaattaattaattggctctttatgaaaagttgtgagggaatagttcagacaagcagcatcgaaaggaattttcagcaacctattttctagactgaaaataatattatataatcatcaggctaaccgaactgcactatttcctagcacactcctggtaacgaatttttcttttgaaagttcaaatgacatgaacctctttgcaccctcttggcaggagtggacaaagaggcctgtccctagggaggctccccagaaggacctgcttactgactctgtctcgggttggaggacagaagggctgctttataatctgatgactaacagccgtgaaatgtagttatgacttttttttgtcacgtggaccccaagaagtgggctgctgcccagatcagagtaagcagttgtatgatacatcttagacttcaggccctacgtccacgcaccaccttcatcaccaccatcatcgccatcaccgttatcatcttggtgttctgcccagttcaaccaaacacatttagaaaccctcgagcattttataaaacagaaaaaga

SEQ ID NO: 46418 - DNA, 1012 bp, Bovine  19866881467547
gttgatggatcgatatgggaattaagggagagggaggaaccaaagatacctccctgctttctggcttcagcatctggcagtgtcattggtgcagggagggagcaggtggggagtggtggtggctcagatttgggaatggctacgaagaatctactgttgtatgcatctcaagtttgagatgtttgtgagacacagtcaagggagagatgtcaagcagataattagatttctgagattagagctcagaggcaaagtctgctaagtgatagatatttgagaggtgtcagcagacagatggtttttaaaattgtgagtgtgcttggtggtttagttgctaagttgtgtccaactctgtgcaaccccatggactgtagcccaccaggctcctctgtccatgggactttccaggcaagaatactggagtgggttgccatttccttccccaggggatcttcccaacccagagatcaaaggtgatcttctgcattgcaggcgtattctttactgactgagccaccagggaaggtaaatggagtataacccttaaaaacttgattcactatattgtatatctgtaactcatgtaatattgtacatcaacaatctttcaattttaaaaattggcaattttttccactgtctctgctaggcaatgccatgtaattggctttctgttctcaagtgatcatccagtagacctgtcattaactgaccacattatctggatgaactgagcttcataaagaaaaccatcggctgcgctaataagagctcagtgctgcagcctagaatcatggggcttcaattcctgctccacagttgtatgatcttagacaaggaacctaatcaatggaagcctctgtttgtcatctaaaaagtgggggaataacagcctataaaaccttgggatttttgaaaagattaaatgagacaatccacataacaatatgccaggcatacagctataggcagtaaactttactgattcctatttatcattagtttcagatag

SEQ ID NO: 46419 - DNA, 1679 bp, Bovine  19866881648692
gtaggctgtgagctcttcaagacacagactttcttataaagctcacagtgctcaaagctttgtacaaagtgcttagtacatgtatgattattaatgcttgtgttgtgattttaaataagagaattactcaattattatgcctaccatctaaataaagtaggtatatagactatgagcaggatacgcccttggaagaggttctctgttccatgaggtatgggtctgggtacataatctcctatttctgtttttgttttttaatgagctcacaaactgagatggtgcatggagtcatgaagagagtactaatctagaagcaggaaacctgatcactatctcccctggatttcagattcttcatctgtaacatgagtgtgattggtaaaatgacttccgaggtcttcaaggtgccttcattttgcctcacaaagctgattaaacaccagtggcatttgaaaatttaggagagagagcaaagcaatcaatgggcaggggaactgagaagcagcccttaagattgaagacactcaagtcaggcttcaaagacagtggtcctcgtccagtggacaacaaatataccagatttggcaaggccaagtgttcacacaggaggaaacggacacgagccagaatacgaggagccgtaagcgtcagataattctctcgggaaagctgactagtctcaagatcagacttttaccattgaagcttattattgatctaagcatttttcaaacaatacacaggcttgagatgggggaaaaaaaagttggtaggtcaaagtcagcattaaaaaaataattagaatggaaatatcagagtaagtcttgtcttaggacacctgtgtccacagtcctgaatacgtggcaatataaaatattccttctaaagggttacaattaaaaatatagaagaaaactcacctattaaaaattgacaaagaaactaagttttttgagtctttaagcaaattttccaagttttttaatttaatgcattgcaaaaccctaacaagagatctgatttacagcactctggtaccataaattcaaacaaataaattcagaaagggctgatctttatccttcctggacaggaagcagaagtacagagagctccagccaacacgaggaagaacactgtacattgtgtaagtgccttgtgtcatttacctgtgtttgcataaggaaacccacatgctcgcaagacaataaatccttaggtttccagtcactaagcccctcaagaacttttatgtagcttctttgagaaagaaagaaaatgcaaatgcagaaaaggtttctacttaatccaaataatttaatgaataattatgaatgaataagaacatctctgtcctcaaactgcttataatccacgaagggagataagacaaacacccaaaaagacatgggctgtgctcaaggtgagggagagggaggaacatgagtaggaaaaataagaaattaaagatgttaaggcaaagaaagcaactgaaattagcatttttggtataaacagagtatcggctggcacagtttgggagagacagtattagaagtggaaatcagggtacctctgaaggaggcaggaacagcaaagaaaaggcatgagagctgcataaaaatggacaggcagctagtcagacgcctgtaaggaaattgtggtagttaaggcta

SEQ ID NO: 46420 - DNA, 1390 bp, Bovine  19866881844208
aaatttctaacccttgtttgtatatgttgttacaggagctttattgcagaaatgaccatttatatcaagcagataggcagaagtaagtgttcctgctttcctgatattctgagtcttgtatagcttagtagtattcattataaagtcttgagccacatgtattattaatttgacagagtccatgctataaggtaccatttagggtgtcttagaatattagtgataagcaggcccagcttcccagttttacatgttgaaagattgtgctagcattgtatttcaaagggtaagaggtggtaggctgctgaggaatgtgccagtgtcaattaatctttccattgatacagaaaagatatagctccttcaggtaaaacttagtgacatttagaaaggagttaatcagatgataggatttgaggtctaaaggtgaatgtgagcatttaagtgtcacagagtcaagaaagaaagttgagaaagttactcttaaggcatttaaggaaccaactggggttattcataaaggaagtaaaaagacaagcatgagcatgtattctttattcttagtaagtttaaaagcaggcagtgtgtcatgcttgaaagtaaacaatagctctgtgtacctgattttgtctctaacaagtttaatgatttcaatgaaatcatacctgtgttgctgggactcagtttacctcactacaagttgagagaagtgggaaaagattctttccagcttgagaattacacacttatgtgtagtggataattcttatgacttaagtgtagtgtatcaaaaacttagaaaatcaagtctttgaaagaagcactaggagatgatgttgaatttttttaatcctagacttaagaatactttgagtggataggagttctaagctttttggaacacagctacagtgatttgtttacatcagggaatagcaaacttagtagaagtccagataaatattttaagcttggtgggtcaaatatataacacattattatttctgtcttatatttatgaactctttacaaacatgataacatttctggttcctgggcccatagtcaaactctagttgaagtgttcttagtaaatggcttcactcttgagagacagaattgagtaactgtgacagagattatatggccttaaagcctgaaatattttttgacccttaatagaagaaaattgcttgactctggtctgggcactttggacccatttttattcctttgatttgctttttaatcctttatttttcagaagttaaattcttcccgttttaatgctatatgatgttaataatgacagcttcgttaaaatagtttatttgcttttaatgtaaagatttgtatgtggtatgtgtcttagtgtgtgcctcaaccagga

SEQ ID NO: 46421 - DNA, 765 bp, Bovine  19866881878407
tttcttgttttaaaagaaaataaaatagagaaatccttatattggtttagctcaaaggtttatccagcctaacagtgcatgtgacaggctcaaaaggaacatcgtatggaagggccaagtttttattataccagcacgtttccctttaattttcattccactcctatctcttacagtcttatcttttaactcaatctccccatgttatgaaatatcacttgtttatacagaaactgacaacctgaggctaaaggacatctcttatttttgctttgaacttagtttaacttttaatatatttatgggttttttcaacattagatcatgaaagacatctccactgttaaagtgcttccaactccatcttcaaatgtacttgtgatttaattaattcactgcaatctaacttgtttcaacacttctcttaaaataaagagtcaccaatgattctttagttgccaaataacaaaatccaattgtactgtctttctcaatctgttaactattcctcttccttaaaattctttttttctcttgagtctcagatcatggtccttaaataaccatgtttccaggattgcttcttttctcttcttacattttttgtcatatttccaagtttaaaaatgattgcccatattttgacaactctgattctaaatctccagtcccaactaagacccatccatatttctaactacttataagacattttcatttggatattcatgcaggcacctcaaaatcaacacagccaagctgctg

SEQ ID NO: 46422 - DNA, 822 bp, Bovine  19866880422303
tttttttttttagtttgaagaagaatttcttgaaacaagagaacaatatgagaagttgcagaagggtgagcctagatttattcaatgttatcttacgggaaaaataaaatatgttcccagaaatattcatttcagcacagaactctagaatgacaaccattagaaaaggcaaacagcatgattgctaatactaactcttcactttgcccccagtgtagagctaaaggtgtcatctgctctgcctccttagcctcataaaaaggtatcgagtaggttatgactctggcctcaacttagcaacagcctgggttgatccagtgccaactggttcaataatccccaccccaccagagaaggcttcaaggattcttcacaatgatccagtgggccagaggagagggaaaaaaagggcaggtgaattagatctaaaatattccctggttctcgtggttcatattcactttttcttagtggttttagcagattaacagagataattttaccaggtcacaactgtagaatcaaaactatagaaaagatccaaatttgattacattcagaagttcttaatccctacaattccccgattttctcccactaagagagaagactgatatttctccagtcctacttctcacagccataatgttattttttttatctaaggaaacccagggtccctatcgttgctgataagcagtcatgaaattaccacagattattttttaagaaagactttcagcgaatcatcagcagacctgccatttacaaactgcatggctttggtcaagacctttcatttctcttcatcctggcttcttg

SEQ ID NO: 46423 - DNA, 2179 bp, Bovine  19866880471052
ctcttcccctcttcctcttcatttctgccccattttactctaaataaggacagtcacatagtagtggttaaatacctatgcattgaataaataaatggatgttgttgtataaactcctccatgatcaatctggcaggaaatgccagggatttccctggcactcctagtattccctagaaatgcaggaaatcctagggaaccctccatccctcgctgggtctgtgaggctgttgaggacagcctcctgggcattgctgccatctgtgagcagtcccaagagagcactggactgggagtcaggaggcccccttctgctggcttagctgtcctctctgggtccgagcaagtcactttgccccactggcctccacagtgcattgtccgtaatatgaacaaactgaactaaatgatctcaaaggtcctctccctgtgttcttgatctgagattttcttcaattcttccgaagaggatcatcagctcctagaagcagggatcatttctaacggctgtttgcatcattcataaacagcaacacagagctcagctttagatgtttattcagttttggacaaatgtagaactgtctcaggaaatggaggtttagtagtctctccgctaaaaatagtattgatatttctgaagtacgagcttgcccaaagaaactcagtaaaatgggcagaacagatactgttacagatcagaaaacaggctcggagaagttaaagatgtgtctaaagtcctccatcacccccaaaagacagggacactggctccctggaaagctgccagtggtgcctgtgctagctctctgccaccacgttcccacgtctcattaggtcaattattggaagctggggagattaactgtggcctttgccagtgcactagtgaaatctgactcctattctgggtaaaattccttattctcattaatgtacaggtgtttatgaaaatttaaaggctattcattccttcaagaccccatgaaaaagtacatctttaaataaattatttatacaggcagttcactcagaaagaagaaaaatttgattttactgaaccttgattgttgacagtattcagtgttatacttatgttatgatatttcatcttttcaaaatcctgctcgatggatattacagctattttagagaaaaggaaactggagctcagataagtcatttatttaaagtcacagggctcgaagggccaaagctaacatatgggcctgggacctgggttcttgctgtcacatccatcccattgccatgcagacctagagtgatacctgttgtactttttaaagaattcagactccatccctgaatcagagtatctggagggtggggtgagtatttttaacaaccacctcttccaggtgattctgatacacctgaaactttgaaaaccaaaaacactgatactataatacagtcagagcaaatgtagaaagccttaaataaccatgattaaccaacgtgcaaaaacccatgtacctatcaagcaaatctcacattttccattaaacaaatggtaggcatttcctcaacaaccggggtcttaaactcacccctttggatgaaaactaagaattactcaacaaaattagaagtggatcctcctgtaggctgaccaaaaccatagagggagagtctcttaacctaatctcttcgctcaaaccacagacggacgcctgcttttcggccaggtgcctctggttgaaattgatggaatggagctgacacagacaagagccatcctcagctaccttgctgccaagtacaacttgcatgggaaggacctgaaggagacagtcaggtaccagagtgcccgtgccaatacttggttcttctccaagctctgtcttcctatacggagactcagatcagatgcagcctttcagcctggagggagaggaggagacaaggggagatgcttgtgctaccccgtatgtcttgggtatgctctgaacacctgctcctggacgccccttctactcttcacaatggtctgcatttgacattctcatattctctccccactcctaacaaagtgtgttttcataaaatgatctcataaactactctgcacaatggtggcaatgactgactcagaaaacaaatattgagcattgtatcaatgacctattactgcaaataatgctgtataacatgtcac

SEQ ID NO: 46424 - DNA, 655 bp, Bovine  19866880491547
tgaaactgtgccaggtggactctttgctgtgcaggagtcaagtctgacacaggcagagctgcacagactcaggggtccgctggccgggctctgccgggcgtggtcaccttcctctgctcttttgtaggaaaacgctgtcccaactgcgacgggcccctgaagctcattccctgccggggccacgggggctttcccgtcaccaacttctggaggcacgacggacgcttcatatttttccaggttggatttacgttagcgattccgtttctctttacttcaagaactgttcacagagcacgagggagacttgcctccgggagaggcacaagtggaggggagtctgcaccctccctgggggaaccctctgggcaaatgaacgtctgtaccctgaaccttgagagaggatccaagggcagagcccaggttccaagggggcgacatgctgtcggcaacatgagcccccgtgcactggccttccgcagaccagtaaacgtggacacattgcgttactcccctaagccccagtttttggtaaaatgtggtattaaggggtcctctccagggaggtggtagaaacaatggaccctgagagctggactgtttggatctgagtccttcctaaacctgcctctgaaaagaaaatgctctgaatgta

SEQ ID NO: 46425 - DNA, 1436 bp, Bovine  19866880588544
ctacctaacgtcatacaaaacagagggcccaatgctgtctactccccagtagtcagcacagccgacttgttcctcggtgacgtggatacttggtgaggatgagcctgaatagcagcccaagcgctctgataagacagaagacaaggaggagctccaaaatacaaagtaattctagatctagagccaaggggaattccctgatctatcttaatctgttggctctttgtctgcagttcctgttagaaactggataaaaacaccaggggccattttgtctataaacgcaaaagccacgcgaaatcaatgtctgataactaatgcactaacacttggagagagaaaattttcactcactgagttacgacagttgtacctgtaatattccacttggtgccacgctctatagaaaccatcaagagactgctccccttgacgaatataggtggttttactgatatacacgcctacagaaagaaacagattttttaaaaagaacttaataaaaaacttttaccatcatgtaacatgtttccagctttatttttattgaggtttcctctaaatatgctgacagtactcaggtctggtatagaaaaatgaagacttatgtatttatcaaaatcagcacaacagatctctgttgctctaaagagttcaactcaccatcaaatcgaacacggggcctttccaaaaacatctctctccaggatgtgtacggaacaagtttaatacagcttctgccccaaactttcaagcaggccaaacgccatatttcagggtctctagggaataaaagcacatcaatatatttaacaggtaagccctatctgcactcagacaagaggagcatttctgccaacaggcatcttctattcagcaacttcggctgtgcaccagccaggcactgtgccgagcactgggacagacggatgggcagggcagaggccctgcttttttacagggaaaacaaacgaaaaacaagaaaatgagagaaaagttttaggcagtgtgctcagtgtgagaagaaacaaagctgggtaaaggaccaggaccaggtgggtgggaaacagactctcttttccgggcaggtgtctacagtgacaaggaagggcatcctggcagacgccacagcaggtgaggcccaagggctggagcgtggccagcatgctcaacaaggggcaagaaggatgatgtggctgcagcaaagtgacctggtgaagtgcagactgcatctgtggagaggtggttggggacaggtgaggtggaaattttgcaggtggcggtggctgtttgagcgaagaggaggccactagaaggttctaagtaccactgatggttttaaaagatgactctgctggtctatggagaatgagctcaagtgtaagagtggaagttcagagaccacacgggatgccaatgccataatccagagcagg

SEQ ID NO: 46426 - DNA, 995 bp, Bovine  19866880941048
tttgaatttacatctattaggaaccaatgcaatcataagattgaagtctacctttctaatccacagtaaaatacataaaaacacccaaattttgtatttcttcttaacaaatccatttacttggcatttctgtttcctttttttcccccctgtttttaagcagattttcttgaaagaacaacactgaaataaatccttgtggaacagatagagtcggttaacaagtgaagtaattatatgtcattattccacatgctggggggttgtaaatgatttaaaagtttgtttgttttcacatttgtttccaaggacttgaccaagcacagaagctctatatatttatatcagcaactagggtgaatttattctaatagatatttattctaagaacagggatctttctgtttcatactgcacatgaatattaaataaactacctgctggcaactacacaatattttagtctctaattgtaaaagtacactgtattttaatacctatttttaaacagatatcaatttttatggagctgtacatgagttgttgatggataaatcacccaagcatggttaaagacagcctaatctccagctggtaccagatccatttaattgtatcatctgacctcacctcacctgagcctgcattaaactcataatacagttcaagtgtaaaaatgatatactgtttgttcgccctgtttatagaggggcaaacatacagttaaattcatatgtttaaaattagtgtagtcatttgaaaaggttgagttagatcaaactgcctctcagcattttctctttttttttatttcaatgactaggcctccatcaccagatgtgagcggctgttaagaaagttgtagcagcttttcttggacacccagaagactgctcccctccatcaaacacagagagctttcaagcatcatttaataatggaacagtgcatttttttttaatgtgttagcaagcaataggacagaaacttaaggg

SEQ ID NO: 46427 - DNA, 1332 bp, Bovine  19866881042535
tgcacattggaatcccctggagggctttcgaaactaccagagctcagcccctacccttgaccttctcttagaaatgggacttgggcatcaacatctgttaaaaatttcccaagtgattctacagtttacacagggtaggaatgactaggcatttgcccccttgtgagcatagcaagctcttatacccaccaacctttggcagagttttttttccatctgtaagtcctttctctcccttttctgtataataaaactttgctcattgttcaaacctcaatactgcttttgctctgaagggttgtcagatctctcccccctcccaagaattggctgctctctctactgtgggctcatagtgtttcctgcaacttccatgtatgtgacagctgtgagtcatttaaaggaaggacctttcccttatccataatgtaccccagaagccttgcatagtgcttggcatctcgatatgaatacaattagacactgtcaacctgacttcagtgcccgaagagactaggccgatccattttacaacagtatgtgattactcgaaataaaattaaaaagcatctgctatggtgtgttgagggtcaaatcttgccagagtaattgagttttgttctatgataacgtgactgatggtagcaaggaggaatcatagggtgactgtatactgaatgaatgacccactctatcatgattttgataaagctcttaattttttccagagagctttctcaatggtaatctaggaagacattttcccaattatacaattttagtagatgaggaagtaactatcaaagaaaggcttctatgattaataatagatatgaattattattatcatagtataatgcccattgtcccccccgccaaaaaaaagggaaagcccacatgctactggaatgtagatggttattaaattttggtcaccatagttcatcaaggagatggaaaaatgtgtgaggattcagagatgaatgccaaagataattaaaggagtggaaaaatgggtcctatgaggaaaggttgtgtaattacagcaagaggaggctgagagatatacatctgattactaatttgatgatcatacacattttcatgagatagtttttttatgtccacaaaaaatgcagcatgaggaaattagaatagtcaggtttaagttggacattaagaagaatattctaactaactagattactaaatgcagatctgatcatgttattttcttgtttaaaaaaaatgacttcccactgtctctaggtcaaagcctactttaaaaaaaaaataaagcatgtaatttattagttagctgatttttgacag

SEQ ID NO: 46428 - DNA, 1696 bp, Bovine  19866881044975
aattcggggtatttttagcttttctgatactattcctaaaaagtaaacattctctcttggttccttgttactgaacctttttattttcatagcccctgtgtattctttagaaaactgggttcaccagacagcgtccttctgtggcctgaacacacttgtgaatttcatcaccagaagtgcatttctgagcaccctctaaccttcttgagccatctagagtcttggctctttcttctttgaaccattggaaagctgctttccccccataccttaatcccttccaactgtcagctctcagctcttgcaaattctaatatcacatgggccctgtcctcaagtaactctgtccgtcacttctgctcagccaagtcattgactcagattacaattggtctgctttttcatcctctgggtaatggatttatcagtgagacaagctgagaaggggccaggtacaacacaacagaggctggcagggggtccaggagtggttgaagtccacagcaccacatgcttcctttgggtgtgctttataatctaagtcaaattggcctgaaggaggacaggttggaaaaacaggagccagaaggcatgtcagccacatggcagaactgttgttgatggtacactgtctgtaccagctactggtggagttaataaggcaaatcacattaacttcctatttttttttgcaaatcacttaaactttctgagatttaattttctcgtttatagaatgaaaccagtaacacctatctcatggagccttcatgagattaatatcacataaaaacaaacaaaagcatctgcaaactgtcaagtgctataaaatgctaattacagttattttcctagctctcttcctctgtcatctataaaatgagtgatatggatcttacaagatattttcaaactacctttcaacaaccagtactgccttataaacacactgttacatatcaccctaactcagaatatatttgaaaacatttgccaaagacaggtggatatatctgttttcatttccacatagtattgatatatgatgtgaactgtacagcaattttcaaaggaactatgttgtttaaacctttactgctttagacataaagagtttcaaactattttgaattcttacaccttatatagttcacgattagtggtattcagtactatttttcacccatattacctaataaaatagttcccataatctatataggaatcattcacaattagacatgaacttcatgaggaatgcatcagaagaaaatggaaggaaacctgactagctgttggccgtttcttgggatcccactgtagcatgtctctcaggagctgaactgcttcgctgctggcatttggaatgagggtcttcaagttattgggcacacactggggccagcggaagttcatcgcatttgacagttggtagccttcaggccagtcagtctgaaaggaaaagatagagagtgttccccagccaactgctgaaataggactttatgttccggcacatgtgcccataacagaagggtgacttgtcattaccacatccctactcactatggtggaccatcccagaggtaggtgtaaatttgtgaccagggttataaaggagcggaggagggctaaggatcacattacgggacttctgcatgggtaagagttgtggccatgagagcacagaagggag

SEQ ID NO: 46429 - DNA, 640 bp, Bovine  19866881105565
atcacggtcctgcatgtgtatcaccacgccagcatgctcaacatctggtggttcgtgatgaactgggtcccctgcggccactgtgagtctgaacgtctttggggacaggtgtgagcagagaggctgagttgaaactaaggctctgaggggaaagatgccgtttctgcaggtttctgggtcaggcctttgaccgtggtgtccagattccctttaatgacagtctgcgtggcctgtgcactcagcaagccgacagatccttcttctggtttggggcacaccctgtgctaatgtggcaggatgagggaaagaccagattccagtctggggcacttgaacaaatctgggcagaattttctgttccaggttgtttatccttgtttctgtacacatttggaaggtgtttgactggcagggacagaccaggaagatggaaacgtgccaaggagtgggcttcagggaacaagctttcgctgcagtacctcaaggtgtctgcacatcctctgacatagtgaccctcacattcctggagcatgtttagctgggcagcttctgggacaagcaccaacatttgaagtaaattctctaagaaggatatggaaagcttgtggtctggaagtgtcccgtagttccctatgatgag

SEQ ID NO: 46430 - DNA, 1660 bp, Bovine  19866881480416
tctgtactttcatttcattttaataactagaatctagcttccccgatggctcagtggtaaagaacctgcctgccagaagcaggtttgatccctggatctggaagatcccctggagaaggaaaggaaatagcaacccactccaggattcttgcctgggaaatcccatggacagaggaacctggcagggtacaatttatggggtcacaaaacagttggacacaactcagagactgcacaacacccaccaccataatgagaaccaaaaaatattacatacacacacacaaacacagagccaattaatcaacagacattgaaggaaggcctaagagttgtgggtcaatcttctaaaacattagtttatttacctggaggtgagggaaggcagacaggatattaggaattttctcttctagagccaaaatggtctggagtagaattatgtctgcaagactcagctgattaccaacaagaaacctttgtccatgaccccgtaaaacctgcagggtataaatgttttacatcggttacaatggtcgacatggagaaactaatatagctatggaatcagtgcagcatctaagagctgaaaccatggcctttttcttttatctttttacaaataacatcaactaagaggaagttccctaagagagaatgagcaaaaaaggtgtagaaatgacagcatccataggtctctgctttataacagaatgagaccctgaaaagcagaaggaagtattaattctggatatagcatctggtgctttaaaaggatacagctattctgtaaatgcgtcagcagaaaagaattagtcctgatgcattcaggagatggtgggaaggatgtaagaagtaagccactggtcctgtccaaggagtctaatctatttcccagttctgtgtttctatgactgtcaggactcacagtcgtaaactagacacgacagtgaagaagaaaaaaaaaaaagcaggcttcctttaacatctaagatcccctggagaagggaatggctgcctactccggtattcttgcctggagaatcccatggacagaggctacaatctgtggagtcgcaaagagtcagacacgatggagcgactaatattttcacttcactttcaagaccaagaaaattaaaagaatgagaattcatcctgactcccatattgagggttaggtgcggagattcacaggaatagatggcgattggaaagaagcaaggaacagggggagaccaggggagagcccctttgcagatatgtgtatgtgcgtgcatgtgtgtgtgtatgagagagagagagggactctaagatgattccaaatcaaacagagtgactggagccagactggagaaagacagagtctggaatgtagtcagaggccagagttccagtcctggctcccaccttaggcatgtcacgcagtctctctgtggttctatttcattatgtgtaaaaagaaggtaacaggattggtggtccagtgggtaagaatctgcctgtcaatgaaggggacacgagtttgatccccggtctgggaagtttccacgtgctgcggagcaactaagccctcgtgtctcaactactgaagcccacgcaccctagagctggcaacgggagaaaccaccatatataagcccacgcgctacacctagag

SEQ ID NO: 46431 - DNA, 1119 bp, Bovine  19866881499275
attctgaaatatatggactttatggttgagggcatgctacaaggatggtagacattaagaggaaaagtattcatagtcacatattcagtttctttgccagatgctagctcataggtgagcctgaagatatatgatttggggctctcctttgtaggttcaaagacctgctatagattctgcctaggaatttgtgctcagtcgtgtctgacttgcaaccccatggactgcaccttctaggctcttctgtccatggaattttccaggtaggcatattggaatgggttgccatttcctattccagaggatcttcctgacccaggggtagaacccatatctcttgggtctcctgtattagcagatggattctttaccactagcggcatgtgggaagccctcatttgtaggtgatgacagggaaatctactgctgccaccacagggctggcaagtccccatatattttgaagatgcatggagcaaggttacctttatctctgggctctgtttcagcttcgaggagactgaggaagacgccgagtgcgttttcttcactgctcttctggcctcggcttccaatttggtttctggctttggatggtcatgctctccctttgacttaaaggagaagaagcagtgaaataaacaactagacgtactttatggtatgtaaactcttatcctgttctctgctgtcggactgggtgctgttgcagttgactgttgtcacaagatcagagcaaccttttaatatcctcccagggttggatagcatcactgattcaatggacatgaggttgagcaaactccaggagacagtgagggacagggaagcctggcatactatatgcagtccatggggttgaaaagagtcggacacaattagtgactgaacaagaagcccaccaacccgccggcctttgctgatggcacgccttctttgcacggtgcctctccccagccctgccacgtcacattcatagtgataatgagtaacactgattatacatattcttgaatcttcagcgcaatgctgtgagggccacaccattaccatcacccccagcttacagagtaggaggcgatggaggcaggagagatttaccaccgggaaacctccacc

SEQ ID NO: 46432 - DNA, 1151 bp, Bovine  19866881787208
aatgtacacatatgtatgatgctgcactgcatatgtaacattaaaagattattttcatctccttgaaaattttcattgtcctcctttgaaaagttcccagagcaaattaaacaacactaaacacatgaaaagaaagagaaaacattcatttttaaacactcagcctgtttcaggactactgtccaacttggctgaagtgcctgaagataccagcatttctccagttttcttagggctgccccaccaactcaagattttcaccctcttagaccatcactgtaaagaagatgggcatcctcgaccaactacactacaaattccactctacttcagaccctgagaagcttgtctacacaaattaattataattagaccccccactatacttggaactaaagcaactgtatgacagttatctgaccttataagtttggaaaacttcaatctaaggaaaagtatttctgagttacaaggagcaagaagtcacacctgatatatgagtctgactgctctcaagttcaggctgacacagtttgagcacagactcctgaaacgtgagctgctgttggaagtaggacaggaggtctgccatcttgctgtcatcatcagtatcttcaatgctaagaaaagaagggaggtgaataaacccagtgccccagtctatacaacacagctttgaaactgatttttcacaggactttcaaatttgctttagaaaaagtcatctaaaagcaaacttcttactactctttttcaaaaacatggtaaaagtttaccctgccctgcaaaggggtaccataccaactttttgaaggaaaaagcctcagcaattttaattcccacagaggaagaattaaaaatttttggatataggtgttgagatttaattaattagttttatgataaggtagagatttcatgaattagtaaaaaagataatttcaaatgattttttaaaaatcatatgtaaatatatccttttaagtgaacataatccattctaattgaataaaaataaaatatacagatgtcatctgaggtacttacttaccaagaaggctttctaatatatgtaccttataacccttcctttagaggaaaatatataattttaaaaagcagggtccatgagtaatctattagcataaaca

SEQ ID NO: 46433 - DNA, 787 bp, Bovine  19866881804514
tcttcatactaaagcacttatatctggcccttgtgcttttaaagagatgttagtcttaacaatattctatctacaaccaagtctgactagagtctagcattttcctaataaaaaacctttttaaaaatgtatggtttcaaacagatacaaaaggagaaagtctaattactagtgtaataaaaccccatgtacccaatttcaaccattattaaaccattattaacctttttcagctttggcctgattacactttaatcattttgactttatagatttcagaaagttgaaacacgtccattaatttactcttttcagtaatcaccgcttttattaaaagaaaaaaaaaatcctctttcattaccttatttttgttatatctgtttaaaatgtgcatttctataatcttaaaatttccctaattaaaaaatgtctacaactttataaacaagtcttcatgctaaagactatgaaacttaacagaattagcactgtcttatcatgctaagagtcaacagggcaaagacgcttaactttaacaaattctatatattactgtctatcaaattatatacgcactagctgtttccaacgccatcaccatctggagaccgggtataagtaatcttgaactctatatcaggtacaagttgcatagccctacgataaaacttgatggctaaaagaagaaataaagctaaattagctatgaccacacattttcgtcatttcctttgattacagtgatcgtggtttaatttggtaactttctttacaaacaaccaaattc

SEQ ID NO: 46434 - DNA, 837 bp, Bovine  19866882123733
gtggtggccttctgcgtttcctgtccgcttcacattctaggtggtagcttgcagattatgtaacttattactggatgattaaagaagcaatcatctggggcacttgtgaaaaataactgatcctgggacttatctggcaatcccgtggctgggacttggtgttttcactgctaagggcctgtgtttgatccctggtcagggagctaggatcccacagactgcacagtgtagttccccgccaccccccgccccccaaacaacaacaaataccaacccctgggcctctccctaaagccctccttcagtaagtctggggccttggaaactaggtttactcacatcctacctgattgtcctcaggctaattgagtgaatacttctaacccattactttctcagttacttaaatacacataacggataaaaagatttaaagtgtttttttgattttgcttttagaacggatgcaattctactgggtcattatcgcttgtcacaagatacagacaatcagaccaaagtatttgctgtgataactaagaaaaaagaagaagtaagtatgcaaggcagaattggcagttttcttttaatttccataccctgctcattcaagagtcttcttaaaatttctttcttaaagtatagttgatttacagtgttgtatttaatcattcaatcattctcaattagaaaggatgaaacgtactcttttataaattatactgttaaacaaaacaggcgttgacttaacagcgtatctctgaagagaactggaaggtttctaaaatgtggttattttttatcaaatcaacttatttgtcctccaggtttcctatt

SEQ ID NO: 46435 - DNA, 1710 bp, Bovine  19866880137876
gtatacatgtgttccccatcccgaaccctcctgcctcctcccctccccataccatccctctgggttgtcccagtgcaccagccccaagcatccagtatcatacatcaaacctggactggcgactcgtttcatatatgatattatacatatttcaatgccattctccccaaatcattccccaccctctccctctcccacagagtccaaaagactgttctatacatcagtgtctcttttgctgtctcgtatacagggttattgttaccatctttctaaattccatatatatgcattagtatactgtattggtgtttttctttctggcttacttcactctgtataataggctccagtttcatccacctcattagaactgagtcaaatgtattctttttaatggctgtgtgtgttttgcttcaattaaaaaagaggaatagatgttatttccccacctattcctaactgttgtgagcataagactcgtactaatcagagactataatgagcacttcatgcaattttctgttttttccaatgttctctagtgagtgagtattcctttcatgcttgggaaataaagaatatgtcaaaaaattatttttgtttgaaaagtagggtttaaaatctaggattttctcctatctgaactgagagtacttcgtctttaccaaaggaccgggctttagagtgactatttttatttagccgtgtcaccataatcagctaaactcagccgcattttgtgtgtgttcgtctttgactatttttcagatgtttagatgattggtgagaccccatggcacctgtttagaagatgtctgctcttaatttctaaggtaaatttaaggcacattcattaccacctttctccagtcatcggcctttgaagtaggcctttcgttggcttgccacagaactgaacttcaaggtttcccctgatgcctccttggtcttcctacatcacttactgcagttagtggcaacaatgcaggcagcaagtagatgtacagcaaagtctaacaaaacagttcctggaacaaagaatgtaggagcactcggtgtgatatctgctgatgaagagctccgcgtcaacagggagagacagaggagcaatcaaacaaatagatggaaagcatcaggctgaattacaaagctagtcaaggttagcgggagcacggtctccgactgcacaactcaggagctctccctgtggccgatggaaccgctcggtggctctgtctgatctctcttccactcccatccatccctctacatcacatcacctgtataatttctttcatcgttaagagctcacaccatcttgtctatttacttgtgacttacatggtaatgaaagctctgggagcagggacaccttgtgtctctctgggacaccacagtatgttcagcatctagaacagtgctcagctctggtcagcgacgcctgcagaacttctacccaggaactgatggagatggcaacctgtgtggaagaggaatagagttaaagctctattttcaaacaagccctatgttgcaagtatgtctggcatggctttgatggggaggtgttagagatgaggaaagcagctcaagatacctccctccgctgcccccttgggacgccatggtcccatagcattttagaactccagagaggcccgtattcatttattttatccttctaataaaatttaagaggaagcaatg

SEQ ID NO: 46436 - DNA, 2703 bp, Bovine  19866880193889
tttctctaaagaatgaagacagttaattgaatatgtcgatatatacccacagcacccaccagctgccaaaatgttactagttgaggcaaagttatttaactgctattcaaaagcagagacattactttgccaacaaaggtctgtctagtcaaggctatggtttttcctgtggtcatgtatggatgtgagagtcagactgtgaagaaggctgagcgccaaagaattgatgcttttgaactgtggtgttggagaagactcttgagagtcccttggactgcaaggagatccaaccagtccattctgaaggagatcagccctgggtgttctttggaaggaatgatgctaaagctgaaactccagtactttggccacctcatgcaaagagctgactcattggaaaagactctgatgctgggagatattgggggcaggaggagaaggggacgacagaggatgagatggctggatggcatcactgactcgatggaggtgagtctgagtcaactccgggagttggtgatggacagggaggccctggcgtgcctgcgattcatggggtcgcagagtcagacgtgactgagcgactgaactgaactgaactgaactgattacaattctttgtctatattatgctgagaactattcatcacctttgttgtataactagaaatggtgttgcatgaatgaagtattaataagctatttatcatccctttaatatcttctgtttgatctggtaggcaaaattgattttttttcacttctacctattaaaaaaaaaattactcaaaactggttccactagataattttatgatcccaacactagaggtaaagagcttctctataatttgcaaaattcatcatggtggttcactacagaaatcagatgtcagcattgggtccagtctggtctctattcttttctctttagagaactacacttgttgattggtcatagtgagatatgtcttacattctgaatgaactgtgctgtgttgcattaatcattacatagctacagggaatgaaaataaccaatttccttaattaaagggttctggtaagacaagaaatgctctattcatcacttttcatttgtcttggctaatagtaatagcaaaaaataataccttgaatttagacagttagtttctttcaagaagttcaaagctctagtatgtctagtatatcatgagaatagacagatgagtactaatgaacttggcaaggagaaagagatgttatttatgccaaattaaagcagtaaaatgagaccataatttatttgatgaatgtattatctttcttaagatgaatgcagtgtggtgtaagaaagaaaaaacagaaattagatgcaggctattgtgtgtaaatcttggctctgttattgagtaactggggactcacacttaagcaaaattttaaccttgctaaactcaaggttctcacctataatagagaaatagtgaatatttatcttgtatgattactgtgaagataaaataagagttaagtatggccatatatatgaaagtgaaagtattagttgctcagtcctgtccaattctttgcgaccccatggactatagcccaccaggggtcctctgtccatggggtttttcaggcaagaatactggagtggattgccattccccgacccagcaatcaaacttgggtctgtttctttactgtctgagccaccagggaagctatctatctatctatatatgtattctatatataatatctatatatgtattatatatatgtattataatacatatgtattatactatgtattatattacacatgtactataatacatatatatgtattatatataatacacatatataataatatatataatacatatgatatgttatattatatatcatatgtattatacatgtaattatatgtatacatatgtatacataatacacatattattatatgtactatatgtatgtatatattatattatatatgttatatataatatatacatacatataattacatatataatacatatatatgttatatataatatatgtaatatattttatatatgtaatatatatgtgtatatatagagatgtaatatattataatatataataatatattatatatgttatatataatatatacatgtaatatgtatgtaaaaacatgtaatatattgcatgtaatatatgtgtaaaatatatgtgtaaaaacatgtaatatattacatgtaatacatgtaatatatgtaaaaacatgtaatatattacatgcaatgcatgtaatatataatatataaatgtaatatattataatatataataatatattatatgttatatataatatatacatacatataattacatatataatacacatatatgttatatataatatatgtaatatatattttatatatgtaatatatgtgtatatatataatatatgtaatatatataatatatataacattatatgttatatataatatatgtattatatatgtaattatatgtattatattatataatatacatgcatattatattatacacgatataatatatatgtaatatatacataatatattaacattatatatatattaatgctgctgctgctaagtcgcttcagtcgtgtctgactactgtgcgaccctatagacggcagcccaccaggctccc

SEQ ID NO: 46437 - DNA, 2324 bp, Bovine  19866880499693
aactatgacagagtgcggccttgatacgcccctcgaaatgtttctcctgcagtgacttttgggttagcgcttggtggggggtccccagggaaggtgatctggccttggctggtggcaaagtctggcaggcaccctggggagctgtgttggggctggcctcatgcacagtctgccacaatgagcaggaagagggtgtagctctggctctaatggagttcgcagatgctggagacatgttgtaaacaccaatgggtgtgggtgactaggagggtggagaagcaggcaggggctgctccagcagctcagagcgggtagaaatatgggcgagaggtgatgaaggaaactctgtccactggggcttgtttgggaacagagagaggcctggggacactccctgaacaagaggcaaggggctatggaggcaagaggggccctaatgccagagagagaagtgccgggaaaaatgacacagaaacctaggaagtgccggcctcgtcccctggcaagtgctgacccagcggctcctagtacaagcctccgtagcgagggtctgactctaagagttggtccccagtcaccaaataatggggcttcctaggtggctcagtggtaaagaacccgcctcccaatgcaggagattcaggttcgatccctgggtcaggaagatctcctggaggaggaaatggcaatccactccagtattcttgcctggaaaatcccacggacagaggagcctggtgggctggagtccacagggtcgcaaaagacttagacacggcttagcaactgaataacaacaacaacaacaaataatagcacaattgacattaactaacttgaaacttgactcattggaaaagactctgatgctgggaggggttgggggcaggaggaaaaaggggacgacagatgatgagatggctggatggcatcattgacttgatggacgtgagtttgagtgaactccgggagttggtgatggacagggaggcctggtgtactgcgattcatggggtcgcaaagagttggacacgactgagcgactgaactgaactgaactgaacttgaaacttgactcccccactcactagctggtgccttggcaaatcactaactttaaactctactttttcaatcgcaaaatgggtagaataattagtaccttccacataaagtcattttgaggattaaatgatacaatgcatgtgaaaaaaaaaagaaaaagaaacacttggcatagtgcttagctcaagttaagcccataataaagggtggctgctaatggtactattaagtgcctcttacgtgcccgggcaccaggtttgtcattgtgcaggaacttgcaggaaacagatgacagactcatttgggacacttaaaatacattttatccaagggactatttgttgacgtctgggtgagagtaaggggaagagtaatagatcttgagacacccaggaactaacgacatttgtgacttatcctctgtccctcagcctcagctgaaagccagagcccaaggacatcagccaccaaccacgacagctggagttagagtgtgatgagagggatgcagccattggccaagaaccaagcaaaagcaggaggagtgattaggaggccctctctctctccccgagtgcccctcagtcttctgtcactgcctccccttggctaaacgccaagaagaaggtggaaagcaaggaatgccattcaggtccacctcccaggcaccagtgaagcagggcagaggctggtgaagcacaaatccgagcacagggagccaacagaacaacagcccagactcccaaattcatttattcgtctcattaaaccctaagaacatcggggtcattatctttctttttcagatgagagaatttgactcaggaaggtgcagcaactcattcagaaacccagcttgaaaactggtggagcccccactggaatccgaattcatctcctcagtgtggcctccatggactccatcatgccaatcactaatagaacagatttgaaagcccctccttatccagaaggattgagtgggagggtattcccacataaaaccaaaaggttgcatagaattttaaatgagtgtgggttaaggaatggtggtacaaacaagcagaataagaaaagtggatgctgtgtgcccacgtgggctaggagttcatcgtccttcaagagacatgtccttgagcgccatcagcacttcctgcgggaccggaagtggcacgtcagctggtagacacagcctttaagtacacggcatttccaagggccacagctcttccaagtacattctgtgcatttacacattt

SEQ ID NO: 46438 - DNA, 1088 bp, Bovine  19866880529321
actgacgggatgggagcaggttattctgcctttttctagatctttgagttgcacatcaaatctagggctgatcactccacacttactcagcctgcctgtgaggttcacaacaattttcccagccctgtgatcatcaatgatttcaaattcgccaatgtaaccatgcttcatcatcactgttagaaacctgacgatgactttggagcacggcctaacaaggacctggcgtttgcctctcttttcggcattgttgatactcttgagagcatcggccaggacattcatgtgcaccattctggcggcacagaaagatggcggaaagagcagggatttgaatctaggagttgagtgactttttcttttagacttcaaaacttagagttgatttctcccctgctttcctcagtagggctaacctcttaacccaccctttctagacaatctgcatatcaagaggcccttaatagaatggaccactctcaagaatttcacagtgattttcagaatctctttcagtgaagaaaacgtagaactttcctctgtacttgaagttagaaagcaaacttgagtactgacaatcttgcaggaaaaaataaattttaaattacccatctgccactctctccagcccctaaatctctctgtaggcggaggtagggatttatagaatataaaatgtaaaatttagagtctttaaaaaccctgacattctttaagattgcagatctcatattaaagtagaataaatagtttataagatggtgaagagtataaggttggtgtggggatagcagatggaaggaccttgccaggtagtcagtcagtggccaaatcatgaaggccgttgtgttctttgctaaagaaatttgattaatcttgtagtcagtgaggaacaactaaaagatttaaagatttgtatttttaaaagatcactttacagaggcaatttagtggggtttaggggacgagggagaaggatctggggagattaagttggtttctgtgttttaattgtctaggcaaaaggtttgaaggatcctagctggaaatagagaggagatggatatgaaaaagtaagagagagaacc

SEQ ID NO: 46439 - DNA, 3578 bp, Bovine  19866880534187
ctccatatggcagccaccttgaggttcaactaggtgagatccacttccaacctcacacagtggctgttggcaggatttagttctttgtggactgtgggactgcggatctggctcttggccagaagcgaccctcagttccttaccatggacgtctctccatacttcagcttacaacatagcaactggagtacagtaatatatcttctcaatgtcagaaatgctgagtagttactgaattccgacatgctcgactctgggatggtttctttgaaaaagaaccttagtggggaggctctctttggagccatgggagcaagcctgatgattgtactggaagtgctgtggtggcctttcaaatgcctgagtcactgaaggaaatacaaatgctaaagagaattaatgtgataagcaagtgctgttggtgaagcatctaaaaaccacagactggattttatctaaagcacagagtatggtggaaagatcatgggctttagagtcatcccgacagagctgggttttagttcaaattttgcctctttctagctgaaacaaataatttaacatctttaagactcagctgtttaccctcaaagttgggtaacaataactatatcgctcacaaggtttcatgagtatcaaggatcacactaaaggttatagataagtttcagctctcatcttcctctaaaaacttgcatgaatccagtagaggtaatacttaacaatgggctctcaatgggtaggagccaagccctgatctgtagcatttgcctatatctatggtgaaaaagttctaccatgtcaacatctagcttactaacctggtcaccaagcatggagttaggaagagatgtgtgaagtcgattcttaggagtttctgtccctctgcctctgtccagctttctcttttattctgacttacgccttttgttggggctatgacccattttttcaaaattaaaaagaaaaaagatggctctgtcttattctatcccctctgagtagatcaaccctcactgaatagactatattccaccaaggataaggcttggttagcagatggcacctttgtccaaagaaaaaagcacccccttccccctgtatctggaagtgtataaccctaagtcaaggcatagggctttgtaagaagaacatggactggatttcactgtcctctcacccccttggctgaggacccttgtacaggatagaacctctccagtttatcaggtggtcttgctttttgtggtttccatttgtcaagtgcagtccctccccttccctgatgacaactgctcaccaataggctatgactaccgtgataaacaaatcaacttttgtcccccattttttattccttcctgaacaagaaagaaagagaatcgtggttgtctctcaatacctggttctgtgcaaaaataagtgtgtagacatgagcatgtgtagggctcagaagattggaggagggaaatcaaaaaagatgtgtgtgaaattttcctagttattaaaatgcttccttgggaatcagctatttgcttaatcactgagattccttttagatcatagaaaatgctcacttaacaaatagaaacttcatctcatttggaactcatcttgtgaggtcagtaatataattatcgtatttagcagatgagcagactaagactcaagagaagtcatagaatgcttaaactgggcctcaaaccaaggttttctggctttggctttctggctttcttgactgcattatctctgttccctgttatcaactcatccttctaggcagtctttcttgattggcatttcccgcctgaaccaaggaatacagaaaatgattagaatggccattatccgaattctcccaaggatacatctagtgcattctagatgaacagggagaagttcagtcactgtggacaatggatgcctcagggcgataggacttagttcaattgcccagaaacacataatccctaactaaatgcttcaggactccacatcaccagcaaagcctgcagtgacctgttcagggctatactcaaagacgttctccttccagttccaccgctgcgtttcacttcttgctagccaacatccaactcccttctaggacaaatgagatatttaaaaacaaaacaaaactgtgctcttagaaaatgtcctgggttatacgtgcaaaactggtcacctggccctgcatgttgtattaacagatcaccacatctctgggcctaggcttctcatctgtctaaaaacttctacctaaatccacagtcagaagatagcatgagcactcgagagcaacaccaccaggcaaggcatgctggcatttgtccactctgcaacaggacgagaatttagagacaaagcatgatctcagcctagtaaagaaactggaatgtaaacacctaacaactgtaataaaagaggaacccagagggcaagcctgggggaggggaggggagtgaggattggatgagatttaacgaagacagagatttttgaagtaagtgctcaagtaggagtaggggtttaccagggaagggtaagagatggggagcagaggatggatcagtagactcagtgagtaaatgatatgccataacccagggtgaatgctatgacccagcgggaaaagaggctgagagtgttggctaatgtcattgtaaaaggacttgcatgcaattttgagtggcttgaactttatcttgaagactaggagctctcaagacagaggaggaagagtagagtttatcctgcatcagattcatttagagctttgtattcaaatgtttgccaagtttatgtagttaaatatattagtctttgccagaataatttgtgcttttggtattatgctttaaaagccccatttgtatgattatttgcctacatctattttctggtactttgttatttgtattttttaaatgtttaatctgtctggaatttatttgccatatggtattcagttcagtttagttcagtcgctcagtcgtgtctgactctttgcgaccccatgaatcgcagcatgccaggcctccctgtccatcaccaactcccggagttcactcagactcacatacatcaaggtcagtgatgccatccaagccatctcatcctctgtcgtccccttctcctcctgcccccaatccctcccagcatcagtcttttccagtgagtcaactctttgcatgaggtggccaaaatactggagtttcagctttagcatccttccttccaaagaaatcccagggctgatctccttcagaatggactggttggatctccttgcagtccaagggactctcaggagtcttctccaacacatatggtattaggtaagactaatttccccctaaattgtgaatcaattacttaagcttaatttgtcaaataatgcatcttttccttacttttattgtagagttttaaatcagtttcttacctgtttttaatcagcttcttactctcggatttgcctaattggtatcagtgctacattgtttcaattgttgtcactcttttttttctggcatatttagcatcagtgaaagttcctctttgctatttttaag

SEQ ID NO: 46440 - DNA, 2838 bp, Bovine  19866880585476
tgttctccctgatataacccaaacaactctgtgtcacattttattaagcgatttagtaccgtggagacacagcttgaattgagttgaaaattcagtaaaggtagagagccaaaggcaggaaatttgacttactcctctcctctagaaaagacctgtgagatgtggcccaaagataaatccagaagaaatacctgagatgtgcaaagtcgtcagaatccaaccattccatagagtccctggtcagtgtgcttccactgatccacacagttatgtgaaggagcctcccagctcactgttctgacccttcttggccatgctggatagcagcagccttctccaaacatggcaagcgcttgagatctctaagcctgagcttacacttgttcctttctctacaatgtgcgggcatgctcagttgcttcagtcttgcctgactcttttcaaccctatggattgtagcctgccaggttcctctgtccatggggttttccagacaagaataatgtagtgggttgctgtgccctcccccaggggatcttcgaacctgtgtctcctatgtctcctgcattgcaggcagattcttcactcactgagccacttgggaagcccatttctctgcaaggcgttttcccaattcctaaccagcccagcctttctctccccacagatgaaaatgatcttatgttctcttttttcagtctcatctccctctaaatcctcctaagagtcaactcagaaacctgttccctgcagaaagtgatctcacattccctagataccaatttctccaccactgtctgctctctttggagggatttacttagcattttctacatttatagcatggctttctatgcatagattaccaccttccacaaatgtaaggactttaaaggcatgatctgtatctgctgtatattgaggcccccaaaactgattaaaatattaattgaatgggacagttaccatgtatggcggctagtacacgctcagccgtgtccaactcccagataagtccgctcacccctctgggccttagttttcccctccatgaagcagcaatgtctttgaacctgttgtgagaggacagctgttaaggcagagttaaaccaggtgcccaacggcatcaacatttctctttcctatgtagagttagggatgagtgaatactggagggtaacgctttctttgttcattgagacacaccttcactgtacaaatttgacagagaagaaggatacagcagaaccagctgtgcctttgggtggaggcctgggattcaagctgacctatttctatatccccagtgcccttcctgacctggcacgtgaaggccttaggtcaatgttgactgcatgaatgaaggtctttatccagccgaggttcagaagaaaggcaaggacatgttctagggattgcggacagggaaggaagctgatcttttagaactgaagtgttggactggggaatagctatcagccaggctgaaaaactgagttcccagagaattagaccagagcttcgtaaatcatgcccgggtttcgtttagggtccctccgtaagtccgggatgggttgagtctcttactgggagtcacggggctacagctgttaggaaaggcggattgggccattcaggagcctggctgagtctctcctgagggcaagtcaactgcatctttcctgcaggtcctttgagctctccggcttccctggggctccgcctgtctgctgagcagggcttactgccctctcacccttcatcccttctctctccctccctctcctttagctccttgatcatgcaatggcgggttacacaaaagccgcaaattccaagctatatgtagcatagagcggctgtttgtcccaaaataccacgtcgctgactacagcaaacacaaattacaagctttatctaatcacagttatgggacccgtcatttttggtttccaaaaatgactgcgagtggcgtgcttctgcagctggtggtggcaccgaccggggtttcagatctgaagtgcacacagatgcacagggagatgggcatcctgagtgaccaattcagaaagggaaataggacagggaagagaggaagtacaactcaccagatcaacaaactccgctgctcgcgacctcaaaaataaatgctttaaaattgcattgcatcaccactgcacccctaaggttatcagccctcatctccctggcatctggtttcctaacataaaaggtgacaccagagtcattctcgagtggccacgctggggggtggaaggaagtgaggcttgctgggaaatcactgatgtcttcttggggtcgagtttgttcattttctttgctgatcttttcatcaggaggtcacactgaggaaagcacgctgggtgtggagtctggaccctgggttggcttgtgaccatgacctgggtcacgtctccaagtgaccttttgaatcgagggaggctgatcacaccacccagctccccggggctgacaggagggtaagatgaaggcgtgtgtggaagtgccagccacccattgggcacatcttggcctggatgagagggacgggctgctggctgggagctggattctctttatgcgccatttcatcataaccatcacgactgcttcttacgcccatgggtgtgggctttcactcacaagcaacaggcaggagggggcccaactcctctgttctcctgagggatgacctgggattgtgattcagagcatcaaacagggccgctcagattccagggcacacatgtacacactcggaaggaaagctctctctactctctctctctctctcagtagctttatataggccaaaga

SEQ ID NO: 46441 - DNA, 1070 bp, Bovine  19866880586298
tatctcatttcaaaactagcacgtcttttttctttatgctacaaaagataccaaataactttctaaaattttcttctggttcctgtcataaatctttttaaggcagcaacttattctctgaattgcatggttaatattctttttttggttattctgtagatttttcagcagttttcccttgaaattctcctcataatgaaagctccacgtagatctgacttttaacaagagaagctctgtcaggttagggtagagtgttctcctctcttacctcttggccctttggtacttagaactgatggaagccatgatggcattccggagtccagcgtgcagtgctctttgccgcttcctcctgcctgcaggccccatctcccaggtgtaccatgctgccctctcgcatggcctgacgtgtgactacttagaattttagtccttaaataggtacaatagctacggcatttttgattacctcaaaaagcagtgcccatgctacagagtgggatttccaagtttttctggttgtttctgtcaggcttaattttcagtgttgatggaggttttcctctgactttcatgtacattttaatggcagcagctcccgccggggctgctagccagatgctattgtaaagtagaaataaaattactgggccaaagagtctgcacactgaaaactctctgtatatattgctgaatagcatcccaaagacttggtactgatttgctcttctgtcagccaggaactttttcccaagctcttggatctgtattattgatgtctcatagaaatgattccttcagccaaacatttttattatcatctgtctatgtgcatagtcagtcatgtttgatatttatatctttaaagcatccaactgacaaacttgtatgtggtttttttttttttcttaaatatagcatcagtgtgctttatgtagcaaaagcccagtgtttgctatcaggagttcaagccctgggttttcccacttacccactgggtgatcaggacaagttcttcaagttctctgggcttcatttgcgaagtgtttactgacatgcttgccaca

SEQ ID NO: 46442 - DNA, 1168 bp, Bovine  19866880592556
aaggtggtgtctccggacccagagtgactagtggcctacaggctggcactgcatatcagaagataaacacgtcaatgggacaactccagtctctacagagttggagagtaatgaggattagctgccaacatgtaaaactcgggaaaatatcacatgaaaattcagacttgtggcttttcttggggaaaataaaaagtatatagtaaaactgggcctgcattcttatctggcaaccaccagctaaactgagagctgccattccctgctctgatgctgaagctccagtactttgaccacctgatgcaaagagcagactcactggaaaagaccctgatgctaggaaagattgagggcaagaggagaagggggcgacagaggatgagatggttagatagcatcactgactcaatggacatgagtttgagcaaactccgggagagagtgaaagacagggaattgttccagggcttgctgcagttcatggagtcgcaaagagtcacacacgacttagcgactgaacaacaaattccctattctccgtggtcttcctgatgcccctgcaacccgtttggtacctccctgtcttcattcaactttgcacttgctgacttaaggccctgccagactgagctacaagagacattgggcctttctgaggaaagggaagaaaattcatagaaagtgaatacatttaaagttgctcaggcctgagccccacctgggccctgggccctgactgaagggacaggaatgctccttgcaggcaagagtacaccctacttaatggacagacagaaaacctgagctgcctttggagcgagatggggagtttgtggttgagcacatttatttctgaacttaatgacatggagaaccacaagcctacccaaagtatcaactttttcataaaaaaaaaaaggagaaagtctattgagtcaaatgttccaagagtgcctgggccagggaaacctccagtatatttataccttggatatacaaacaggaatgacttgttcagcggagaaaagtaataagagctaatcactgaacacttgttttgcgctctctttccatgctcacaattatccagaaaggttttatatttacagatcaggaattcaaagctcagagaggttaactaacttaggcaagtcacacagcttgttat

SEQ ID NO: 46443 - DNA, 1113 bp, Bovine  19866880795770
cattactagccaagagccaatatagcggtggagttaagagcttggtatcctctaaactgactgcttgggcatgagtcctggttccattattgtgaggacttagttatttctgttttctagcccatggtgtttcttgcactaggatggtaagaacagtacctactacacacagagatgttgtgaggattaaataagaaaatatattaacacaccctgacatccaaataaataaagttattagtacaaagctaacttatagtaaatattgtaactatatgttattctttaaaaaataaaagtttagtatttaataaaatgttataatgaagtggaatatgtatttagctctctcagaaattcttagcatggcagcaatagaagacatgtgggaaaaatctgtttgagggagaaaagaatcattaaatttgcttcctgcagcaaggccaatagaacatccacaaaatgaagctgtcatttaactcaggataatgttttgcatttatgcagcatcataaagtggttttcagaagtagcaccttttcaaagacattgctatcaagcatgagcctgactcatctcgagattactgtgataattaggtgacgaatgcatttttaaaaggtgactcaaaatctgtttttaccataaattactcacttttaaaacgatctttctgatgcatggaagtttcttcaagacaagtctctaactttctaggtgatttatggaatcatccttgaagtatgagatttggtcgattgatttattgcagttttcaattttactgtagtttaacttgtgcatagagcaataggagttaatttcagaaaatgtgtgtgtctagaggtacaatgaaaagaaatatgtcaatgtcacctaaaagttttgttgaaaagtaaaaatttgaatcacatttttatatgtgtctgcaacagtagggagtgattgctgccagatttgtctaaataaattaaacagctaatgctgcagagatactaaatgaggtgacaggcaacttcctcagtgtagatgctggattaatggtaacagtctgtttaccagttattgagagtttgctatgtgccagagcctccagttgctgccttgtttaat

SEQ ID NO: 46444 - DNA, 1234 bp, Bovine  19866880802301
tgctattaatattatcttagcttattaccaaaaaatcaataataggccagagatctaatttgcattcatggcagaaaaagaacagaaaaattgtggaacttctcttttactattttttttcccttgagtatatggtttttggctagaattttatttcggcagtgaatccctttgattaagctcacaggaaatcagcatatctcacttgagaagttaggactctttatctctcctatttacgcttcttttttaagggatcttaatccctaccacctcccgcaacacgcgtgcacgctcgcgcatgtgcgcgcgcgcgcacacacacacacacacacacacacacgctggaatggtaaactacaatccaagtgaagttattatgaacgtcgattggtgaagtttaaatttaaaggaacctgctgtattctaaatcatttttgaaaaacaagaaggcgacttggagagaggcaggagtgtgctgtgactaatgtggaactgaattcaaaccttgttttccggctcagtctttttaattgcagcaaattgtgacttcctgtttttttccagtgcagggacatggctaatgaataaggccccataagcacacttggacatcaaatgactcttacaaaagagcattttgatgatttaagtgtaaataaattagaaacatacttcagtatttgatgtcttttaaagtccccatgaggttaaaaatggagagccagtgaaggatgagagaaaatgagaaactttgtgacatgaactattttgaagtactcttggattcgataagtccctaaataaggctgatttgcatattcttatttgataatgaaagtgtcttcgttaatcctgacaatcagagtaatgccagtaacaattatagttggaatctgtttcagcaaatgagcatgtattttttataaggaaatgatcatatgctaatacattctaagtcataggtaatgtttcctgcatttcctaaagaaagtatcttgtgagaaaaatgaaagcatttttctgctgtatgaggatttgggggtgggggacgaaagacggagagaaaaaagaagagactatatttcctggatcttgaaagtttttggatagtggaagccttggtttcaactgggttggttctaagttaaaacaaaataaattatgaacacttcttgctacatttggtaacgttgaggtcagaacttctcattctggtaagccttcttcactg

SEQ ID NO: 46445 - DNA, 853 bp, Bovine  19866880860585
ccgcactctgacgatggaaatggtctgtgtctgcagtgcccaatacagtagccactagacatatttggccactgaacacttgaaatattgcttttaccactgaatgtttcattttatttgaattaatttgaatagcctcatgtggctagtaattaccacgttagacggtacacggctaaagtcctacatctttagactgacaatgaaactgttccagacctaatacacagtgacagcccttccccctcaatttcagacgtgtcataacttggggttaagccaggacacgtgatgtcagcaagcagaagggaagggaagagaagatattcttgtgactttaagtctaaactctcttctaggtccagctataccgtcttgtgctggtaccccatccgccctcccccggcacccccacgccaccgtctcccccctccctgtcaaaacatggccttggtttgttggcctcagccagactttggactctgtcccgcctccgcttacctcctgtagaattggatgctgttggtcttggcaacaaccttgaggctacacttgtttctctaccagcgctaattagttactgacaaacagcaagagagcctcagggtaggcccacatgcaggactttcagaccaggtggaaaatgtcaagatgtaatggaacttctgctctgaatcacgtctggagaatgaaatattagagagaggcggatcctgaaacacaggaggagaataggagaatggagcacagttctccttggagcctcctcatctctgcaacattactgggaggcaagaaaacttcatgtggatgggcagggccaggaggctgcttagctaaacctccctttgct

SEQ ID NO: 46446 - DNA, 2694 bp, Bovine  19866880888495
gagaaaatatttacacgctagccaggaatggtagttggagcatatacagtaccattatatggtactttgtgtatcaaagttatacaaccatgcttatctttaaatggcagatgtctctttctctctttttgtttttggtagtttctaattttctacaatgaacatgtatgtcttttataatcaaggaaagaaagaataaatactttatttaacaagacagaccccctaattgtgagggtaaataccaggcagctgaaaggagaaagaaaaaacaaaacaaaacccacgaggtataaaaataactttccctgggtttgatcttccagcaacaagctacaatctcaggaactctttctcccctgagcttttctgagtcccatgcaacaaaataaggcaaaatgtgcccgtggaattatattgttctcaggtagaaaagagaaaccttttgtgcatttaaaggaaaaaagcatactggtcctcccaagtcttatttttagttttactataattcggtctcccaaaggctctgcagccaagtgaactcggaaagtttgtttttcattcttgaagcgtcatttgttgctctgcttcgtgtggcggtgagtgccatgcagcctcactgcaggcagggacttccctggagattagtgtgttccctggcattcctctgatttggccccagcccctagctggcctccacaattgctacattatttcctgggaggagattcagaacttggagcagtaaggggatgagagcagcggagaagctcagctgggactgtggtccccctgatacagccctcaaaacccagacaccaagaggtgagtagtctgccttttgtcgcccacggggaacccggtatggaaccagatgccacaggctgtgaccagcttggcctcaagccttgccctgacatgcccagatgctgtcttttaaccccttggtgacatcccgcctacccagatgccaagaggccttaaaaatcttctcgtgggcaatgtatggagagaggaggacgagttggagaaggaaaggagaaaggagacaagaagagacttatctccgtaataacagccagtgccttctgcgtgccagactttatcccagacaatttactctacagtatatcatttaatcctcaaagcaacacaatggattcggtagctggttttgtttggttggttttgcctgtttttcagagaacaaaactgaacttcacaatgtttatgcatcttgcccatgtcgtttagtcactcagtcatgtctaacttttgtgaccccacggactgcagcacaccaggcttccctgtccttcactgtctcccgtatcttgctcaaactcatgtccgatgtatcgatgatgccatccatcttgcccgtagtcatgtgctattaagagcaggaagtaggacttgaccctgacattatgtgtttgggcttaaatctgagctatgattccttctactgacccctccccaagcacccatcacaggtgcctggagagctgaggtttttcctccaaaacagaaaaataaaaataaaaaggtgtatgtgtgaccagttgtgtctgactgcgacaccatggactatagcccagcaggctcctctgtccatgggatttcccaaaagaatactggagtgagttttcatgtccttctccaggggatcttcccaacacagggatcaaacctacatctctggtgtctcctgcattggcagggggaatccttaccactgagccaccgggaaagcccacatgtggcttggctgcccccaaatattcaggggctccctgtttcctgaacttatttgtcaggattccatatctacctctacagtctctccccaagatgacccctgcccatctacccaaatcccaggtctgtgcaggatggctggtccccaccttgggcctccacccttccaagttcaaggctgtctctggttttaattgccaggtagcttctctcctttctccagtttcctggaatgacttcttttcagcccaataagtcaagaagccaatcatggattccattaagtgcattaactccttcattcaaccagcaaattttcttaaacagccacaatgtgacagaccctgtgatttaaatcctgaataaatactccagtgaaactcatagggaagtcgagaaagactgttctgaagatctggtggttgatcggggatcttaaagttgagcaagaaaagttaactagaacaattggaggagggggtgttactaagaggatcagaccaaaggaaccaccatgaaacaacagacagaccagagacaaaatgtaaactcgctgtgggaatagggccaagttgttctaccaagctttatgaatctcagttacgaaatgatgtgtgtgtgtgagtcgctcggttgtgtcttgtgaccccaggggatgtagcccaccaggcccctctgtccgtggaattctccaggcaagaatactggagtgggttgccattcccttctccagggcatcttcctgacccagggatggaacccgggcctcctgcattgcaagcagatcctttgccatctgagccaccagggaagccctactagataatagagtgtcattatccagtcaactccagatccctgatgtcaccaccatctgttatccctgcccaaacctccactaagaaagggacttcactgtctgctcactactct

SEQ ID NO: 46447 - DNA, 1526 bp, Bovine  19866880912160
cttgtctggaaaattccatggacagaggagcctggcaggctatagtctgtggggtcccaaagagttggacaagacagagcgactgagcatacacagatcacgtagattatgttcctgctctaaaactgtctgtggttccccatttcttgaagggaaaagtctgttcaccacacatcagcagttaatgggatcttctgcagtatccctttccatacctatcactggaattcaaggggaactacctctattccctgcttgttcttcctgctgccctgcatctttgctcactctgtcccctctgcccataatgcccttctctccctttgcatattcaagtcctactgatttcccaggcacagttgaaattctacctcctccacaaagcctttgcctcttaccaatcagcctctctctcttatcttaaaccaccacactgtctctcatggcttctcagtcttttgtgctttacgttatgattatttatccacatgctcctcctaaccccttctcacatctgcagacatccatggaactttctggaaaggaggcagcatggtggcttcagaagggaaagacatgtggagctggtgaacctgtgtatgtacacctcactcagccacttggtaactgcattggggtagggactcttatctgtacagcctgaatggccagcccataggagttcaggagataatcaaggagccaaggggcaagtcatctcatctctcggagccttagtttcctcgccaattaaacagggaggaaaatgatgataataatacaagcttacaggataacacttgtgaagagtaacgggtaaagaagaaatttcttttttttttttttttaagacttttttgatgtgaccatttttaaagtctaaattgaagttgttacaatattgcttctgttttttgtttgtttttttggccacgagtcatgtggaatcttagctcccagaccagggatcgaacctgcaccccctgcattgaaaggtggtcttaaccactggaccaccagggaagtcccaagaagaaatttcttcataagtattatttgagtattctactattaataggaaacggacatgtctgttgtcaagaaaatcattcatttcctgtaaagtcctgacgctccgctaggttttctatgtggccaataataagtgcacgatgtgctctgttactctgctaagtgctgtcacatgttcccccgtttaatcctcccaacagcctttggagggaggaggtgcagatgttgtccccatgtcacagaaaaccagggctcctgacttgcctgcactggatccgagcctcagccaaaactggactggaagcaggaggagtgggaagctgaggcgtgatgggctaactggacggtgcctccagctggggagtgagatggatttccaggatgtgttgggaccgtcgttcccctgctgggctgggcacagtctcggatctcagcttttgtgggcctggctggtgactgtgacgatctggaatttcggggcctgagctggcagg

SEQ ID NO: 46448 - DNA, 1501 bp, Bovine  19866880979180
tactaatagaagcccccccacccccaccccaaccctgatacccggactaaacaatgccactgcctccctactaataacaaatatatccagtgatttaaacattggtgcatccaatgtaaacaccattatagctaatgtaaaacagttacccagccaagcaaatccaccagcaagttactgaagaaaaagaacagtttcctcagcaagaatgcattacagcctgccggtgacatttgcaatagattacttaagcccataaagaaatgaaaattgcaggcccatgttgagccagaaatgatgaaattggagagcacgggctaagtgcagtatgggacagagcggcttctgcccagggtctgcaggcccggtgtggcttggaatgcaattgccctgagtctctgcgtagacgcagcctcaggtactcgtgtcctttctgccttgcttccagtctgtggtttccacacgtggaggcacgaagctgaggactggcctttgcagtgggtaagtgctcacaagggctgcagctggccgaacgtgagcacgtgggcgcctctctccccaccagtgctggcacaggagggtcagcgcaatggtttctgcctcacactgtggaacttctccttctttcaggttacgcagaaggccagggttttagggagatgacctagagactttttcagagtcaaagtgggattataaatgcattcatctgatttttatctcacctggagcctctaaaataaacagatggacccccagacaacaagacgtggctgtgttcacaacaagctcttgttcattcttgcctgcttcctcctttcaatccagttccatgacttatcgactcctgacatctttgcatttcctacttctggaaacttcctggatgtagttccagtgattctggatgtgtgctctctcactctctcttgttttaatctgtcaagcccactcctgctaaataacccaactcagcaagctctgtctaccaggacttctgaggggtgattccaaaaagaagcagctcataactccaactctcactcgaacacagagggtgttctatgcctgcgctgtgagccagtgctcctgacttcccactctgctcaggggctccctaggaaagtttcaaatgtccccaaaactgtaaagatccattgtgattcagagaaaggaaaaggaaattgcccaattatctcttccccaactatttcaatcaaaattagccacctttccctactggctcagatggtaaagcatccgcctgcaatgcaggagacctgggttcaacccctgcgttgggaagatcccctggagagagcaatggcaatccactccagtattcttgcctcgagaattccatggacagaggagcctggcgggctacagtccacggggttgcaaagaatcagacacaactgagtgacactttcccttaaataattttcatgaaaaaatgtagctaagcttttctactgatgacagaacttaccaattatca

SEQ ID NO: 46449 - DNA, 2028 bp, Bovine  19866881008293
aaactagtaattatgtacccccagaagtgacactgcttaccactcatttgcaagacccagactcagggaaagctgagcgcaggaaatacttagtgaacagcatcagtgactgttgcagcatttgttatctttaacatactgtatattatatgtatttatcatgtttattatctgtctccatgtctagaatgtctgttctataaggacagaggtctttgtttcattcatcaatgccacttcagtgcccagaacgggctttggcaaaagcagactctcaagagttggtcaaatgaataaataaattattgtcagttctaccctcacttgcaggagagggtgatggtaccccactccagtactcttgcctggaaaatcccatggacagaggagcctggtaggctgcagtccatggggtcgctaagagttggacacgactgagcgacttcactttcacttttcactttcatgcattggagaaggaaatggcaacccactccagtattcttgcctggagaatcccagggacaggggagcctggtgggctgccgtctatggggttgcacagagttggacacgactgaagcgacttagcagcagtagcagcagcaccctcacttgctaagcagtcttcagcaagtctttcatactctgagcctccaagtttccttagataagcaggaaattcatgagataaacaggctaaggagtaatacaagacctagcccatgaaaagctctagacaaatattggtttcttttcacctccagtggccaaagtagtcttctgacagtaatccaattttcaggaaatttatgtagagaaaggaagagaaagcaagagagggagaggagagagagaaggagagaaagaaagaaacagagcaactgtatagtttgaatacattccataacttttctatttcttgcccagtgtgcaaaacaatactgatgttcctcccagaaatttttttccctaattgctggaaaactctgtaagtggagcaagcgttataactcagggtgggagtgaggctgggtacagccactggccaagcctttcaaatagtataacaaatgatgtgtgggtatagccagggaaaatgcacacattcttcaagggtctggagaaaccatgtttggctcccaggtgcacttgacctgttaacaatatttagacagatttatcagctgtaaactttgcaccaagcaagaaaaaaaaaaaaaaaacactaattttttttttctcctttttttctccttttaagatttgttagcaacaggaggaattcaaaccagctaaggagagggcttgatactctcgcctcagttgtctgcttagggtgcaaggactccgggcatgaaattcacagaaacctggagaatttctgggtacaaacatttcagtgaggggtggtgagccctacttataagagcctggagtgagtataaaaaaaggacagcacgtttttaattagcaccataacaaagagggaaaaaataaagcacatacaaaaaaaaaaaaaaaagcataaaaactttccagaactttttggggctctattctttatatatttttatgagatcatctgcttggaaatgtattgtttgaaaaactagcaaagttcctttaaaaacgccctagatcaaactgattgcaatgtcagaataccgtaagccttgtgtttatgaaacatcttttatgatatgggggaaagagaatgggatttgaactcaagaaatgaatccatgctccacaatttactagctgtgtgattctggttgaatcactaactaagcttagtttcctcatttgtaatatcagttcagttcagtcgctcagtcatgtctgactatgcaaccccatggaccacaggcttccctgtccatcaccaattcctggagcttactcaaactcatgtccatcaagtcggtgatgccatccaaccatttcatcctctgttgtccgcttttcctcctgccttcactctttcccagcatcaggatcttttccaatggagtcagttcttca

SEQ ID NO: 46450 - DNA, 713 bp, Bovine  19866881042724
gctttaggaaggacaggaggatccagacccagattagctctgagggcagggagcttgttaaggggattttaagtctactgtcttaatagtcctttgtagttctttggcacctggcttttcttgaagctcaaagtattttgcaaacattagctcattaataccgccagcagccttgtgaagtgggtagtgtgaatgtcttatccccacttgggattcttgaatttgaggggaaaaggggttctggctggtgactagtgcctggttgaagagaggccccaggggttggaccaaatttaatactcatgtttgtttctcatcccaccagaagaacagtggatggtgagagaagcgcaagccaaatctggataccagttgaaactaggcttctccagctgtgtgaatttggaccagtccctcaacttttgtgaaactgagttttcccttgggaaaggggggctgatgataagaattataaatgtaacgttgttgtactgagttgtgtcttacccttttgtgaatctatggactttagcccaccagactcctctgtccatgagatttcccaggcaagaatacatggagtgggttgccatttccttatccaggggatcttcctgacccagggatcaaacccatatctcctgtggctcctaccttgccaggtggcttctttacaactgagccaccagggaagctggtaaatataaaatgtg

SEQ ID NO: 46451 - DNA, 809 bp, Bovine  19866881053520
agccttatctgacttcatcgagtttggtagaggcatcccttttcctattcttcctgaacacatttttttttaaattatagaatttttgcactataggttaatcacctgtttatgagcctatcttcccaaatgaacagtcagtttcttgaagactcagagcatgttttatttatctcagcatccactgtgctcagcatagggcctagtacctcaacatatattgaatgaatgaatgagtgagtaaatagatggtttggggtacagggccgggtcaaagtgtagttacagccccaaaatactaagagctttgtaagtcagtgcatgaggggtcttactcagtaacccattaaatcattaggacttccgagagtaaacagctccctaagacaggtgctccggcttgtagagtatgcgatagttgagtggctaatagatcaagtaacttgtccactttcctggagtgaagttttgggctcacctccattcagaaggctgagtacatgatgttacatgcctccttcagtggagttaaattaagcttaatatcttatgactcaagagtttgcacaccaaggcttggcacttaatattgtaattactccttttgattagaactacctttcataagcaaatcgacgcagcgatttgacaagtttgaggaattgtgtttggagctcaccctacgagttccacagggacctgtaatcatagtaattactgttgaagcgagattccagttctcgatgtaccaggaggtgagtgagtaagagtcacaagctgcatcctttcccatctcaggataagctgtg

SEQ ID NO: 46452 - DNA, 928 bp, Bovine  19866881057993
acacacacacacacacacacacacattaggtcccagtagcaccttccctccgccatgattgtagcaaccaaaaatgtcttgacatggtcaaatgtccccgagcaagcaaaatctctctctctctctctctctctctctctctctctctctcacacacacacacacacacacactcattgaagaccatcaagtcagctgggtgaatcgaaacatctgacgaatgaaggccaactcagatgcaaattcttgttcccttactgactgtgaggtcctcctaggcaaggacttacttcacctgagcctcagtggccccatttttgtatcatgggatcaatgatatcccagaaccagggatgtgggaaaccacctaggccttatctatgtaaatccgtgacatcaaatccttagcgactgtgttctcatttatgtcctaaacatctcgtttgcgtctcctccttgaatgagtccacagaggcccagagcatggacagggtgttcttcctgccctggagtctggagagatggagagctggaattccattccagctaaacatcatattaattccgggcaactctttcctagtaaaaccccaactcatgtaaatactagtatagttttcaatttgtagtcagattagatgccaggagtgtttggttctattttattttattttttaagtgaaacgtttacagtgaatttgaaagcaagctattttctgcctctctgggagaagtgtaagttttggaaagcaagctcccctggaatgttttagctgcaatcagagtggatagaaaaaaagcaaaaaagcaggttaagtcacatgatagaatttctggacccagattcatcaactcatttaggaagtgctctctggaacaaaatacgcacggaaagaaggctttgtgtcattctaaaagctattttatg

SEQ ID NO: 46453 - DNA, 647 bp, Bovine  19866881147567
catttagaaggtaatttaagattgtttttatatagagaattaaagaaatagagattgatgatatgtttaaaagaaaaacagtacttatgttacctgcgtgttttatcctgaaggatctgggccattccccacattcccccaaagggtatatcgtggaatgtgcacttcaacttggtggggtcctgcgacagtagtttgccaaaagtatccccttgttctaggccagaggcaggttataggatggcctcttctctcctgttggtttccccactgcaataccagatgctcccatccagaccatttggcaggacaatagagggaggcatgccagcgaagctcccacagtgcttatggtgccagcttcttccttggcatccagcggagtttcatcttcttttgttcgggatttttctggagctcgtgcttatttctttaaggttgtaaaaaggatgaggtatctccacatctgcaactaccagcgcttgctcaatggaaaatgatgagaaattgtttggttgcttctgtaggaagccaaaggtacgggtctatagccactttacaaaatgttctcacacctagtgtttcgctgcaatcttggcaagcctgggaagtacataccacttgtaccagcagtttacaagggctaa

SEQ ID NO: 46454 - DNA, 760 bp, Bovine  19866881163554
tttctggaatgttttttcccccttcttctcctgaaaactcctagacattctctgtgaggttgccttctctctacttcccatcccatgtccaaagatgtatattgtgacacaggcaatacatctaatatgggtaattctttatatgtctgtctcctccactggattacaagctcctcaaggagttatcttattcacctttgaaacattgccacctaacatgtgcccaatacagtccggatatttgttagcatgatgttgaatgaattttgtcagaattgtaccccatggtataaagcaaatcatacctacattttccctggctgctctgtaatgctgacttcactgagtccccagccacccaagtgatctctcatagttgtcatctggaggacaggagagctttaggggaaaagcagagcccctcaattaccagttctgactatcctcattttagttcaggtttctccatgcgaacagacagtcaacatgtgattggagaagaaatagaagtatatttctattaaaaccatgttccttaggttgtcactctgaatttatatccctctggtccttgccaagttggctgttggctatactctatcctgaaatgagagcattcttctcatagccccaggagatgcctacaatgcctgaagattgaaaacagaccttgaacatggatttgggaatttgtagagtccaaagcaccactatcctatataacctgctccagataatcgagcttcccttcacatctctg

SEQ ID NO: 46455 - DNA, 1797 bp, Bovine  19866881169019
ttcggacataacaacattctacacacatgggcacgtgcttacatacacatgaaacccaaaaaaggagtatggaaattcaaggttaaaagtgaaattcaacaatttttaatgaagttaaaaaaataacaagatcggaggaaaatctgctcaatagtattgagggtctttttctttcccctcttgttccacccactttaaaatgcactttgcattatcgcacataatggcttctcctggaattggaaaaattcaaacacgtgtgctctgaagcaacatttccagaaatacagctcaggaatgtgtactggcataaattcagaggtatcagcaggatttcccacctattaaggtaaattcaccaccaccaacaacaaaaaaccagttgcatgcatgaagctcattatctccagtgggtaaggaaaaaaaaaaaaaggccatcttagcacagttgccaaaaatcttgcttctttaagacagtcaatgcctgtggtatggatcaccacattagaaagtctatacaacatttggagtaaattattctttgaaaacccacttattcaacaacctgagtctctgcttcttttccagtctataaaggcagcagcctcttccctccagaagctcactatccatctggttgtacactctccatctccttcaaaatattcattctttcaacactgaccaaggatgagaaagagggattgctatttcccctacttggcgaaagaggaaatggaagtgaatcattccggaagtaagaggattcaaaggcatgttggaactggcctacacactctgttggaacaaactgtccttgcactgggctgagcgctttgtaccccatgcagtacagcaacatgcgcttaccagctggaaaatagcctggaaaggacatgcgctgccttgttaggcttgaccctgatggctacggcacagctgcacgtctccagggctggcatcattttcaaattataaccaacatttagtttttcctcctcttaatcaaccagtatgagatggtctgtggttgggctggcagaactgcactggaaaactgaaaggagtgcttctgatttcagcgtggggccgatcgtgaggatgtgcagcagccttgctcactcaagaaaatgggtggtggccgacacaggctgcctgggcctcatgctgagcgggccccctacactgcactctggaagaggaagctaatgtgctgtatccgcccctggccttcttttcatgtgcttatacaggatgggatcaaacactgctgattcaccgcctaagctacatctcagtatgatgtctcaccagcagtaccatcttccccagtggctcagtggctcaatggcagagaatctgcctgcaatgcaagagccacaggaaaccctggttccatccctgaggaggctccctggaggaggtaaacataccagtatgtttagccagaatttcatgccagaggtccaggcttgcatctcctgatgaacattctcactgaaatattccacaggtaccatcaattcagcatattaataaagataagttatttgccccaatagccacccttctaataataatagaagaatctgcctgcaatgcaggagaccccagttcgatttctgggttgggaagatccctggagaagggaatggctacccactcccgtattctggcctgaataattctatggactgtatagttcatgcggtcacaaagagtcagacacaactgagcaactttcactttcactaataacaactgacaaaaaaaatccgtattctgtagagcaagatt

SEQ ID NO: 46456 - DNA, 1701 bp, Bovine  19866881233206
ttttaacctacttattttctatagttctagagttactgtttaaattcatcactaatagaagggaatgcatatggtttaatacatcatctcattttctgaaaactggttcatagattctaaggagcagcacatgatcagtgcataatcagtaatggtaataagagaggttgcatgagggagggaatctaaggtgaggcttctgggaatggagtcacatggtgggcttggaccagcgggtgaacactgctgggagggaagtttggggatataccagactgcctttggcaggcagaatccagactttgagtccctgcttgatttcgatggcatgggccaggctcctgcatgttacaggaacctttaattagtcggcattttccactaagactgtgttagtgcgtttagtaaaagtgtcttattactcctggacaggtgggtgagatggggtagtttgagaagtactgagtccatctactttccaacagcatcaactgagtaaattaaagaaattacatgagtaacaaagtatttcatttcttcataattacccatattttagcaccaatatgagtatggatatacaattataaagtataaaaacatttttattttgattttcattgtaatataggaaaaattttagaaaaattttaatatgtaacatatttaattattaggtatctaggcagtatcactgatgttgctggcacaactctttttctatcattaaatacatacatttgtgctcaactttatcatccattttctacattgagttgccccaaagaggaaaagtgtcatcataatcaatgtctatagtttgaggtatctgtcaggtgaccactgacttcagttcacacttgaaattggttcctttgtccacagctcagcagccctggactatgactgcctggctctctggagctgtcacactgagaccctctccaagagaggcctggagggccacatgctgtacattctgagtcagatccactcagacatagttttgaatttgacaataatttccaaccatttccatatgacaaattagggggaagaaaattaattacattcatgtaaatgttattggattaataaagttcatgtatggcttttgtccttcatcatgaactgttgggacacaacactcgcactaaatgaaacagcaaatttaaattctcaaaactatttgcttttttattgaaaaatcagtaaccacagtggaagaaaccaaaaaagaaaaatcatctctaattccaacactcaatccaaagatttattttcattctaaccccactcctagctttagtttacatgattgcaatcatagaagacataaatctttataatctgctgtttcacttcatgctcgattgcaaatattctcagtgttgatatgtaatttttattttttatttcattttttggtacaaaatttaggctttttcttttttttttctgactgcgtagttaatcaaatactgtaactttcttagtcaattctctagtaatttaaacacttaacacagtaagttaacatgtagtatagtttttccttgaaataaatgcccagaactgagattttttagcataaatgtgagaaggttttttggcttttactcaaaccatttattagcagcttggatgagcccctggtggaaatctttgccagttctcctctcctcagtcgacacataactt

SEQ ID NO: 46457 - DNA, 1285 bp, Bovine  19866881291345
tctccattacaggcagattctttaccatctgagtcactaggaaagcccatttatgctataaacagtatatatatatatatatttttttttttttttttttgggagaagtcaagccttcatgactttcccagtcacacacttggttagtggcagaatgtgagtgagtcctgtcaggtcccagcatgtccttggctaatattctctgctgtccaggacctgtcagaaggtaagctcacgggactgttgcccatatgaagctgtacgtaagtagcttcctcttccatctgacagtgctggccctcacttccaggccaccactggagagaatcataagatgtcccactaagtcatctccaaggtaattcataaaatgtcctattaaaggtgagctacaactatgactataatcttcacacagccatagatgtcctagtttgttatacttttcggttcaacagctaagaaaaaaaaatccacctgccaatgcaggagacacaggagatgcaggttcgatccctgggtcaggaagatccctgggaggagaaaatgacaagcctctccagtgggacacaacttatcgactgaacagcaacaacaacaaagttagactgaggcctgaggaagtccccaggggtctccctgatggccgggggtcaggcggggctaccctctcctcgtctagcacaactgactgcttggagggaaactctggccctcacatggacccctgctgcacttcatctcgctggatgccgaatgttcggctcatcattccagccaactgagatcatttagaagtttgattttgccatcaatcatttcttctctccctcccagctgtgtgtcagctatagctgcgataagtggacttgttatgcctttgtccaagtcactggtaccaaatactgaacaggtctgaggacagttttcgggggcatacctctgcactgaacccagggcatttgcttgggcctggacccctgcatttgtcccatgctattattgattttttattgctatatataattgctttaagagccaagccttgactttatagtccttttaatcctcgctggacacaatgctgactgttaaagcaaaactcagtgtttgcgacagggcactaaacagagccactgatctgatgtcagaagactcaagttcaagtcacaagggacccacttctaatgactttgtctaagctgtttctccttcaagggtctcagtgtctctatccgtaacacagaaacaggttatccttgtagacaacctcattttagttgtg

SEQ ID NO: 46458 - DNA, 1509 bp, Bovine  19866881303900
actgggacagagagggagagaaacaagagatgctgaattctttctacacgcaacacaataaagtcaaataatacatgttttagtcatcctacaagggagccagatcaatagcttggttggcgacaccgcgctggcccctctctcttcacaagggcaggaaatgtgtacattctcaagggccaactggccaaccacccccgcatcagccattctctttaatgacgctcttccatcagacccctttctcttgaagacaattcattttatgaaacggccgcagctgccattagaagtgggcgaatccaggcatgtgtttgggttcgagatctgtcttgtgtgatgtttcaaatactttaggtttggcagaagccaagacacattctgtcaagttctttttccccttcgtttttttaagcccgtgtggattcgagagaaatgtggccatctgattctcattcgtttttgcctaactcaacaacaaaaattgtctcagaagaactagaaaatgtccaagtggcaaatataacctctttcacagaagccttcttaggatctctgtcggtccaccccgaccgattgacattctccaaacaggccaagcattttcacttctttgtgccagttgcacttgctccctgagcctggaatgttcttccctttcaccctctcctctgctcatcgactcctgctccccaagtcccatgcaaagacgacctccttcgtgaaggttttccccaccgtccaacttgtagatgctcccacggtcccctgaagtcctgcaggacttcacttggagccctaacgaccctctgttctgtgctgctttgtgttatagtggttgttgaaccccatgaatcaagccctcactcatgttgtcctggatgtgaagctctcaaccttaattaaaggccttcacgagaaaggcagacaaggactggcatttgtgggaaagctgttgccaaaaacattaattattgtgtctatcaatgtccataggtgggcttccaggtaagaagtgaacttgaggcttaaggaccagaaataacaatgggcttcttcctctatgatagtgagagctatgttccctttttctcctggctgccaggaagctaagaagcagctccaatgtttgttcatagcaactgtattctcatgccaacttccttttttttttttttttgtggacctgttttcaatttccacattattaacgtataaaggaaaagaaaatctatcgtccaccatccgtcacttcaaagtctccgtagagtagccaagtgaaaataataaagagctatttgtgatggtttcatctagaaaatagctctagtacttagaaaaggttttgctttcagttttaggttgggccctttttaccaggtgcagtcagtcagacagttcagtagctcagtcgtgtctgactctttctgaccccatgaatcacagcactccaggcctccctgtccatcaccaactccggagttcactcaaactcacgtccatcaagtc

SEQ ID NO: 46459 - DNA, 747 bp, Bovine  19866881311402
tgcgggcagattctttactgactgagccccagggaaagccctaagtaaaacgtagttatatataaactatgtgagtagatagctcagcttttctaccctgttttattagatcaacttgaagatcacctttccatatcagtagcctctcttctgtgacacagaactgccatatactatcaacacaccctctctccacatggcccctttgaaagtgttcaggtggaatcttccaagcctggctgggcccaaggggcacaaataccctgagaaagcacccacccagctgcacatccacccctcagcctcagccctccctccggccgcatcctgaacctcccagccgtatttggccaaagttagagctgctccctggggatccctgagggagaagaaggctgcggggtgctgtgaaatcaggttctcaactacagagagtttggagggacagggtgggcagggtgggggcagggagatgggctggtcaggaaatgccagtttaaagttagctctgacctattaatcagcagcggggacaaagatgcaggaggggcgggaaggccggacatgtgctcgcgccagatttatgggcccagaacaaagggtggccagctcgtttagagagtctctttcccttttcctctggcaaaacgaggacattgtttgaaaagccaaaaagaacaaatattctactgactgaggtcatttccagagatgcaacaggtcctgatggggacccataggcaggca

SEQ ID NO: 46460 - DNA, 1523 bp, Bovine  19866881520297
aaaaaagtactccgtgatgaaatactttgtgaagtcctacataacctaacagcttctcagagactcacagtttacattactatcttaaaaaaccctcagaatttctgctgtgaagaaacctgtttagcctgttcatttaggtggtaacttaaaaaatgacagaatgaagacgcatggaagttgtcacttggcaaagtccttcagctggtaaatggcagagctgatctacaaaccacggttgcctggccctaaagtccatgagtttaatgactgcacaatattgtaaagttcagaaggaattgataataatcttctggcaaaaaggcttctttctgaaagtgcagaaacccaaggatgaactcaccctagcgtcccttcatacaaacgtctgtatgtctgcctcaatagcccccagccagtcccctgaatcccaggggcaagcaaggtatcgtttgagcattttctctcttcctgaggcacaggcaaggcacagtaggagaatgactggcttctagggccctggttctaagaagtcccatcaatcatggaactgcattatgagttttcttccatacacacggctcctatggctatgctaatatgtggtgacacatccacatgtttccctcgtcaattgcatgcgtggagctccttcaataaatagcagtagaaaatcaaagattaagacatgaattcactaacactgttcataattttcagcccccaaaaaaatttttttaattaggtccgtgattgttctgctgttacggtcaatgtctttttcttatgtagacgtctaagttttcgacttgagagaaatgaaggtggaattttctgcactgcattttattcaaggcagggatttggatttcacaggaactgataggacttgaacaacactattaactgatttccattaaaggttaatcctaccccagatgtgagttcagttggaatttatgtgctgggtgtgtcacttttgttttcctaaagctgtacttttaaataagactgtgttaaaaccatctcaactatactcagaagtcccaaggtaatcatacttatgactacagctcattggtattaagttaaagttagaaaagctaactaatgatcatcaaatattctgacaacatagaaattcttcctaagtgaatctttaatacccataatatttggctgcttctttcattaacatttcattcctttcagttcaccaacattttaattaaacactcatattcatattttcaatcctcaacacaaattgaccaagcacttttcaagggccagtctctaaatttggcactgattctaacattaataagacaagtttggcctttgaggagtatactgtggataaaaaaagactcaagcagttaaaagtaaccaaccaatcccttactgattgtagacatggcaacataaatgcatcttaaaatacatgttactgatttacaaagaatgagctgtataataccatggtatttatgtaaattttaaaaagcatccatacaacacag

SEQ ID NO: 46461 - DNA, 1629 bp, Bovine  19866881707779
tggcgaataccactggctctcgtcagaaggtgcagtggtgggaatgtgccggagtgtcagccgaggccaataggataacaactagtcaatatggagatgggccactgagtgccttcctcaccttactgcctgtttgtttaaccaacaccagtgagagtctttattaagggctgttaacattccaaaatgctgtttgtggagcctgcccgagtgataagtgccacttgtgtttactgtcttgttctcaaggctgttgtagaagcctaaaacacagttctgaagtggctcgctttccgtgaacaaactattcaattctacaaataagtcaatggcttgggaacaaaatcaataacacacatacacacaaagtccacaagtatttgttggctggtaatggatttacttacttgtgaagaaagctgagcgctgaagaattgatgcttttgaactgtggtgttggaaaagactcttgagcgtcccttagactgcaaggaggtccaaccagtccatcctaaaggagatcagtcctgggtgttcattggaaggactgatgctaaaactgaaactccaatactttgaccacctgatgccaagagctgactcactggaaaggaccctgatgctgggagggattgggggtgggaggagaaggagacaacagaggatgagatggttggatggcatcaccgactcgatggacgtgagtttgagtgaactccgggagttggtgatggacagggaggcctggcgtgctgcagttcacgggatcgcaaagagccagacacgactgagcgactgaactgaactgaacccacaaacacaccactatcacataaaatccctgcccccacgcacattgtctgtatttcagaatacactcttaaggtcagtgttcgcttagtcccagctctgaatttatagttcaagtgttttatttcccaacagtgtgagtgaatcgtgcacgtctgtgttcaacaaggaaaggaaacaccaggattgcaggagacacgaaacgagtaagagtttgctgactcccaacacaggtcctcttcgtgcgagcaaaggctggctttcctggaaaactggcttccttcagaactctggtccactctgataccaaacgtggatgcttgtggaatttgccagttattgggctgaggggacccttcccctggcgaagcagaaaagcatcaaacaaaagtttcctctgtgcctgtgggctgcccgcctacctctgccgtgacaccagccacatcctcatgccttaacgttaacaggttgtctgcagtcccttgtggggttctaagactcaatccatagactcatgcatgttttgagagccccagaatcaaagctggagaggtgactttaggagattaacagtcatgatttattgtccaaaccagaaccttttgagagtgaaagggcgtgctattagtcatgattccaggactacaggtgttgggtggcacatttggtcttctcaatatttattgagcccttgttagtaatttaactcatcctttaatacagtcttcccttgaatcctcataataactgtattgactagacagtattcccattttacagatgatgagggttgaaggagtagttcatgtacagtgacga

SEQ ID NO: 46462 - DNA, 782 bp, Bovine  19866881864008
ctccttgaaggggcttctaggcaatacatctccgtgtccaccttactggcccaagttggagcaggctaaaagagtccagaagaaagttctttgaagagatgaaattgataagacaaccttatatgttttaaatttacacaacttaatgttaagtttggggatggatgaatgagtgatcagtacatagaaacctaagcaaaggataataacaagattaactccaaggacaagaaaatattgtgcaagaaactaatcatataatacttcatgtttgtcgttgtttagtcgctaagttgtgtccgactctttgcgaccccatggactgcagcctgccaggcttctctgtccatgggatattctaggcaagaatactggagtgggatgccattttcttctccaggggatctttccgaaccaggaattgaacccacatctccagcattggcaggcggattctttactgctgagccaccagggaagtgccgtaagacttcaagcccttctataaatcatcatcatgctcagttgtgtctgactctttacaacctcgtggactgtagtcctcctccaatcattggtatatggtcatacaattacattgagagaaggaaaaaatgagacgtggatagcaatgaatctgcatctaccatagtgtagtacttaaaatagtattagtatttaaagtagtttttacaaagagataggagcataggtttggtttagatatatagaactaaagactaaaagactctgttagaggtgctgcaagttgctgccttgaa

SEQ ID NO: 46463 - DNA, 767 bp, Bovine  19866881965296
tggttagatgtggcttcaccaatgaagtagtgaaatgtaattgtatttgttaaggaagcaaaagcactccccacccctaccccctctccaccccaacccccaccccaaaaaacagtcaaatttctctggttagtaaggagctgccaaaggcggcaatcacttgtaggttaaggtaggggaactgctggatactatgaagcaaccaaggagaaggagatggaattttctgtcgcatcgttggcaatttgaggaagtcccaaaggaccaaatgttctgaaagaaatttcgtgtagtaagaatatcccccaattaaacctcttggctaattcaggtcttccggaaccccctggcttcgtgaagggtagtttgcttgcctcctcagcagtgtaaaccaactggattccaccaaatgagggtgagagccaggtaggagaggactccacagggctgattccaagcggtctccaatatactttgttgcgaagtacgccagccccttggaaaagtgcctaatggaaaggggtctcagggcagacagataagggctccctccagccctgctccgcaatttgcatgaccttgaggacatcacattacaacttccctgtgcctcagtttctctttctgaaacacgagggtcatagcagacacctcaaatcccatagaccttgtgagaatgaacttgaatgtttttaagtcccttagcacagagtctggcacccaacaggccttcagtcaataatcataatattattattttcgcaatg

SEQ ID NO: 46464 - DNA, 1906 bp, Bovine  19866880484012
tataaagatgactatttaagcccacggtgaaaaaggaaaattactgaatgtggaggctaggcagtttgtaaggtattttcactcacctttgtcctgtaatgcaatttgttctttatgcagcaagactacctcccgtcccaaagctttcttctgtctttccagttcatttcgaagcaccaaaatttttaattgcaggcactcactttcttttttctaaataattaaaaatacaggtaaatttatgaatataaaagttatgactgaataacaacatgcacaatatttcatatgtgagtggtttaaagcactttaatactcatgtaacttatagatctcttgagtgatttaattatcagcatctgtcattttaatggaatgaatacagatgtaagcaaaatgcagattagaaataaatctaaagtctgggaacagttctttctaaaagacactataaaatatctcaggcctctttcctgataccacaatgcaatatgacacaagttaataacaaaaaaaaggggtttccttggtgtttcagtggttaagaacctgccttgtaaggcaaggaacactggttcaatctctggtcccttcatgcctcagagcagctaagtttatgcgccacaactactgagccatgctctggagcccacaagccacagatactgaagcccatgtgccttagagcccgtgctccgcaacaagagagggcaccacgatgagaggcctgcacagcgcagcgagtgagtagccctggctcgctgcagctagagaaagcctgcacacaggaaggaagacacaccacagccaaaaaaacaactcaactctttttaaaagccctactggaattagaaattagactgatattgaattgaattaaaaacaataataaagaaacagttttcaaaatgttaaacacagagttaccttaggacccagagttgcacccaacagagttaaaaacatgtccatacaaaaatgtgaatatgactgttagagcagcagtactcataacagccaaacaatgaagtcaagccaaacgtgcactatctgatgactagataaataaaatgtggtggatattcaaaggaatactatttggcagtaacaagtgaagtactgatatatgctacaacatggatgaatcctgaaaacattatactaattgaaaaaaagccagttttaaaaggccacagactcccatttatatgaaatttccaaaataagcaaatccacagaaaaaagatttccatccttaccaagctaaactaaaggtgctctaataacccacagattttggagaaacccaagtagggacctggtgttttcaacccatccaaacagtaactagccaagccacaccacaaggagagcctggagccttgctaacagcgtaacaacgtaaccctcttcctccctactgggtaatatcagaggcagccaagtagagagagctttcactactatgcagtggtgttgaaaccaccctatcatctacaggggcagttagaactcccacccttaatcaacactatcaactccttttgcgtgtgcacacacacacagaaacactccccccaccccccccccacacacacacctctgccacatgggtgtcaacggaagcttcttggggaacttggacttctacaccaacttggcagtaatgagatggttgctcttccttcctctaccagaggtgtcagaggaagtcaggtaaaatagaagatttaaataagatccagagactcataatataataccccaaatgtacaagtttcaatgaaaaatcactcatgatattaagaactacaaagatgtcaagtaaataaaaaaggataatcaacaaatgccaacacttgagacaaacagaaaatataattatctgacaaagatctgagagtag

SEQ ID NO: 46465 - DNA, 1979 bp, Bovine  19866880546615
tcagctgggccaaggccttggggatgcacccatggagctgtatatctgcgtgaactttcagccccaaatcgtacacaaagcactttaggaatctgtttacctcccctgtgggcctcaacccatttcacatttgtcagggagaaattggaagagtcagagttgcccttcctcacctcagctactcctgggacattcctgggtcagaacagagtgaaggtgacagccgagagaaggataaatcctgaaagacagagccgcatgtttcctccatttgatgcaaactggtgcattccaggcccttctccatacagcagaggggaggagagcagaaatctagatttggataaaaagaacctgctccccctggatgggaaagctcagcttcagtccagctatccaggcaacttcatcctggatttattgcccactggctggcccggagtccgacattctagccgccatcctccgggctgtctcatacatcaggaccaggcagggagtgaagccaggaaggagtcaggaggcctggggtaggacggcagctttgcggggtgtgagcccccatcatgggagggttcaggcagagatgagaggcccactggacaaagaagctttatggggacccagtccagcttgaggccagacagataagagtttgaattttggctcccttttctattagttggttgattctgcacaagtgggcagttgccagagtgtcagcttcctcaactgtggtgtaaggatgctcgcagcttctttcaaggtggctagggaagcaaaagtggcagtgtctgttaagtgcccagccagaggcccgaaacaggatccaaaggctcactggggtggtgggatttgttgttttgctgtctgtactcattttctatggctcctgtaacaagatagctcaaatttagttgcttagaacaacacaattttatctcgcaatgctgtagcccagatggccaaaatgggtctcactggcgtacaagcaaggtgtccgcagggctgtgttcctttctggaggctctagggaaaactccccctccagcttctagatgccacctgcattccttggctcacggcaccttctcgcttcaaagccaagcagtgaccaattgcatttcctcatgttcccttgctctgatgtcaattctccttctgcctcttccactcttagggacctttgtgattacagtgggctcatccaggtaatccaggtaacccaggataacctccttgttttaaggtcaactgattcacaaccctaattccatctgcagtcttttttaaagagtatttattatctggctgcattgggtcttagttgtggcaggcaggatctctgtggtacacagactctctagttatagcatgcagacttagttgcttcttggccatgtgggatcttagttccttgaccaggatcaaacctgtgtcacctgcattgcaaggtggtttcttaacctgcctgcaatgcaggagacccgagttcagtccctgggtgggaaagatcccttggcgaagggaatggcaagccactccagtgttcctgcctagagaattccatggacagtccatggggtcacaaagagtcagacacaactgagcgactaacacttttacttttcttaaccattggaccaccagggaagtccctccatctacattcttagttcctctttgtcatgtaatataattaatataacatattcacaggtttctgagggttaggattcggactcctttgggggactattattctgcctgttgctctgtccaagtaacttgttgctccttcaagacagagttcgctactcctgctcatcaggaactggttgatgctgtggaccagaggccctgtgtgctgcttcttttctttcgtctttcaaataggagttgtgattgcaattactttattctctcttggccattgcgaagtaatagcaggttggggggttatcattcaggccacagat

SEQ ID NO: 46466 - DNA, 954 bp, Bovine  19866880562987
cctgtaaataggtagggggaaaaaaaagaggtacaagggctgatccctgggcagcccagcacataggggtcaggaagatgaggcagaatcagaaaaggagacagaagaaatgaccagaaggatgggaggtgaagctggagactgaggtggtagtatctgggaaacagctaaagaaagctgttaagtcaaaatgagaactcacagagctagtcatgtgaagtcatcggtgactttgggacgagcaactgtggtggagttagggacaaaagctagagaagaatgtgaggaggaaactgaaaatacagataatgagttgcaaagatagtgagttgctataaagaggagcaattgctagaaaggcaagtgaggtcaagaggtttgttgatttttgttttgtaacttaagaaaataggattcctgatgggattgatccaatggacagaagaaagtttataatgcaggataggagaattgctcatgtactgttcttgactaatgggaagagaagggatttgtggaggtgttgggttcatccattacaacataagagaagtaaattcaggaacaggagggtaggtggggagataacatttgcgtcagttttctgctgagtctcaaatccatatctataatattatctcttcccagagccaaaacccactgccttgacgcatccccaactggatttcctagaagtacttcagccttaggctgtcccaaaccggaatagattaattccttttcttctaatttatggtttcattcattagcaacctcagagctggtgctggaaggagggtagacatcttccataggcaagaaagtaggagaatgggataggcagataactcaaagatggtggaaaattgggatgtggggtgactagggagcagtgagctcagaacaggcccctggaagctattacacacccagaggtcaacaatgcaatctgtc

SEQ ID NO: 46467 - DNA, 881 bp, Bovine  19866880568716
ataggttatgtgttagctagaatataagctttaaaatgtgaaaagataaatagcaaaaaagataaatgattcattacaccagtgaaggaattgtttttaagatagcatcatttctttatttttatggagtacaaatgaataaattctatacaggttcagatgaatgtaagatagttgccagaattaatgtggtttgcttccctctaaaaattgttcaagtagaccaatgctcatgattgtgtctttttttatctttttccttctctttttctttttgtatgatgtggtaggagaaacagctttcgttaaagagaaatggcatgagatttaatctagatattcctatttaggaatacactgggcaagttcttattcttactgtgtctcagtttcctgatatgtaaaatagaaatgataacgcccagctcacaaggtgatagtttatattaaaagagattatgtaaataaaatcaccaggatacttctggacatagaagttcaatagattttggtacgctgttttactgtttttcttttattacctaatttgtgtgaattttttcactatttcattctctttatttttttcatgtaaaatcaaaaccaagtttaaaaaaaattaatgtttagattaaaggttaatgggaaaaaccatagaaatattacagttatatgtgtgtatgggtataacagcactgctattttagttggatcacagagaaacctctatttgctacatggcacacttgtcttggctgacctatctcattttctctggttttctttaaagcaggttttttcagacctttaaaagctgacacttcggcagtgaataccctggaaaaaaagtctagtttcagtggaacttggcccaaaggatt

SEQ ID NO: 46468 - DNA, 1932 bp, Bovine  19866880604854
agagagtatatagaataacctagaactgtctctggcaagaagagtacctttagtaaatggtgaattttattaatatttccaacatcatgtcatctgaaatcaaattcagagagattaattgattagagattagtttagacattccccagtgggaatcttacaactgagacgtgtagatgtttcttgaaagaaaaggtcctatatgtggtcaaatgagtttagaaattgcttggcttaggcacagaacttctcagaacatttaataagtctgtttcagttatctgtgactgtgtaacaacttatcccaaaattagcggcttaaaacatcaaccattttacaatatcttacaattttgtggtaggaaatttgagcagggctcagccaagcagttcttctgttccacttggccttgactgggggtttctcggtggtttcttgatgccttggctgggcagttggaaaagcgtactcaacagaacctgcttctccactcagtatagtctcagggcctctccatatgatctcacccgtggggtgacttgggatggagggactttttatgaacatttagtcctccaacaaagagggctccaagaaacaggaaatggaagctgtcagtctcttaagacctagacccaaaacacacaagttcacttccaccatgttctactggccaacgcggattcaaagggaggggtcagaggcccaacctcttgctggcagcagggttaaaggatttgaagccattctcacctcatcacatatactaataagcatgcaaatccctaaggaggtagggagagtattcaggtttccctcacttagctgatccctgaactgtatttgagaggaaagccatgccagacaatgtttctctctttcctgctcgggcaaatgctagcctagctgacggggtttgagttctctgacctgctgggctgctttctgcttgttcctgatcccttcggttcttctcctcatctgtctctgagtcttggggagagattttacagttttacaggccataatgtcacttaggtggagaataggcctagatccatattctgtggtgtattgagttatttatccatgatgcttccacgccctcatttcactggctcatccatctgtccatccctccatccatcatccatccacacattcatcatcagtctacacatttgtcattcatccatcatccatccactcatcttttatctgtaccatccattcattcatccatccacccatcacttccatccaacatttctgaggcctctctgtgttcagccctgtgctgggttctaaatacagggggccagatgtccaccctttgagagtccccaggggctgctaaggtgcccttgtgctggaagatgtgggagctgcagcatgagaacatcaccaccttccagggcttcttcgtggcccctgggttagtggtctggtgttggagcactgtgctctgggcaacctggaggacctgctgaggaatgaggctctgcagctggactggaccttcaaggcctccctgctgctggatttgatccatgtgagaccccttcccaggcctggaggtgtgggggcaacagggagggaagggagacaagagaggctcatttcccaggcctcattttccactttgtcttattgagaaaaatctgaacagtgtggcaaagggtgaagggacgcagggagatttcctgggaattctgagagaagcaggagtccttctcattcaccacagtcctaagggaccctcatgattccactctactagggggtgcggtatctacaccatcagcgtttccctcatggccgcctcaagtcccaaaactgtgtggtggatgggcgctttgtgctgaaggtcactgaccacggttatgcagagctcctggatgctcagagggctccccgcccccagccagccc

SEQ ID NO: 46469 - DNA, 862 bp, Bovine  19866880662567
aatgatttagcctgcttttaggccactctggttgttcttgcctgaagtgagtttttgagatgtaaattggaaattcacagagttgattattgttctataactttgacttcattagtgctgcttgttagtttttgaggacacatcttggttagacctgacacagtcattatcacatgctttcacaccacctactgtctttcaataggactttcccactcacgatgctgccatttacttttccatgagggtatgttgatttcataagtagcagtagtgttctgtcttatttaatgccattacaaggagactgtgtgtattcttctcaactatatgcatatattccttctagacggaggaatgtagaagcaagcttatagacctctggtctttagggaagctatcatatttagtaaacccatcaacaagtattttagtgattcccatgtgtccaagactgctgtaggtgctatgaagatacagaagatttctcaggtgttcaaagtccacagcaatttggctctgatcaaccttcccagattcagtaatgttgccttcatgtgccctttgctttagcacactacctattcctgtttttcacatgcagtgctctctgctcccttaatgactttgaaaagctattcccaatactgttctcttacatacagttgtcaaattcatacctacccttccttcagattgaagcttaaatcccttccctttaatgagcctttccccagaaagttaactcagactaatgtgtccagtttgaaagggtaagtagatttgtagatccagataataactctagtagtgtctttggcaagctatgtattaaaaactcagggagaaataagaaggataa

SEQ ID NO: 46470 - DNA, 1357 bp, Bovine  19866880694488
tgtggctcctattcatccttcaaaacccattcagtgtctcctctgccatgggttaggacagtgttctcagcatggtatcaatataatcagcagcagaatgtctagagactgtacctgggcatttgggcagctacaaaaccccacaagagtctgacctgcagcctgataaccctggttaaaggctctgctctctctgcttctccccttcctcttcgtttggggaatgtctgttcagggtctgttcccctgctatcctgagagctccttgagacaacagtctgcaaaatatcctggttaaaagcccaaggctttttaaaaaaacaactttattaagatatagttcacataccatgcaacccacccatttaaagtgtacgacggcttttggtatattacagtattcattttttaaattgcagttaaaatatatgtgtgagcatgctcagtcgcttcagtcatgctggactctttgtgacctatggaccatagcctcccaggctcctctgtccatgggattctccaggcaagaatactggagtgggttgccataccttcctccaggagatcttcccgacccagtaatcgaacccatgtctcttgtgtctcctgcattgcagtgctgctactgctgctgctaagtcgcttcagtcgtgtccaactctgtgcaaccccataaacggcagcccaccaggctcccccatccctgggattctccaggcaagaacactggagtgggttgccatttcctcctccaatgcatgaaagtgaaaagtgaaagtgaagttgttcagttgtgtccgattcttagcgaccctatggactgcagcctactaggctcctccatccatgggattttccaagcaagagtactggagtggggtgccattgccttctccattgcattgcactggggaagcccaaaatatatacaacatcagatttgccattttaaccattgttctgtgcactattcagtgacattaattacatttccaatgttgtgccactctaagagcccaagacttttggtttctgatagacctgaattctatcccagttcttccactccgtggtgtgtaacctccactctgaggctctacttacttacctggaaattgagcactctgggaatcaacttgcatagtcattgtgagcattaaatgatgcaacgatggtaaaaatgccttacagactgtggaaattgtgtgtatccctgagtggacccctgctgcatggcatcttcactcatgtgctgtgtggactcaggcaagtccctggccctctctggcctcagttcctgactttaacaaggcagtgtttggattaggcaagcccaggggcctaggagctcttctcc

SEQ ID NO: 46471 - DNA, 771 bp, Bovine  19866880711912
gtctaggtctcaggttacttgactttatgacagtgattattgcctcctggagacagtctgtttctttgactgctgtaacaccaactctcccagctgtccttctgctctggaattgtgggccagaattttttgcagcttctatttctttatttctaatcccttaaaaattgatgttcctcggaattctgttctaggctctgttctctctcattctcacagtcttacagaatgatgtcattactttcatagcattaataaccatctgtgtgttaatgattgccatatttttatctccagccaagatctgtctcctaagctccagatccttacattcaacccatattcaacacctcttctcagatgttacgcaggcgcctcaaactgaaagtagaactttactctcaaattgctcatcccccatcctccctttcaataaatactaccacccttttcctggttccgcaagccatacatcattgatcgttttcttctttttcttttgcagtataatttatataaaataaagagaatgtaaatgtacagtgtgatgagtttgataaatatacacacccgcattgtcatcattcagtgaagatatagaatatttttcattctccaggaaagttccctcatatcactttgccagtcattcttatacctttgccccaaaccctggctgagtcactgttcttattgcctcctcatttattagcttttcctgttcttgaacttcttataaatggaaccatatggtatacttttgtcagcata

SEQ ID NO: 46472 - DNA, 1541 bp, Bovine  19866880716453
caaaatatataaactatatttgaagacagataccaagaaaagcacaaacccataattaaaacaacaaaaaaaatagctcttaatttttcagcgctccttgtttcaaaagggctgctgctttaattcagtcttcttggaattatcgttaatttttttttttttttttctttctggatacccgtaagtaatagccttcatagcagtgatatttttttagtgcctttactaatgcagttatatctctgggcctcaagtttcctatctttaaagtgataggattcaatcagattattttctgaggtctctcagattctcgtgagttcttcattttagctctcaatacgtcacaggcagtcaggtgggcatagaaagggtgtttttagaacatactgtaacccctgttatttccctgttgtaaatatgctagagaattgtgaaatgatcagtttgagttcattattctgtttatcctggaagctttgttctcattttgttccatttgtgcctgtggctctgggttgagtttatagttaactcacttaaatttttctgcaacttttatttctaggcttcatagagcccagtgtgcaattaaacagactcaggtaactgttcagaaaattggaaaggaaattgaagaaaaactaagactcacatctacaagcaatgggctggtaggtttttatatattaacatctttaaattccttgatttctaagtgtgatcatcatattcttcttgtattaatttctctctttttccactcctccaaaaccttcaggtagttttttctttttttccccccttaatgtttcactgagacttttgttagtatttaaatgttagaaatcaactttcaacatctgctaatggtgtaagatacaaagtgcctttttgtgctaattgaaactttagattacatacagttacttagaagataatcaaaagctattttagtaatgtctcataaatatgaactcaaactgtacagacacaaattatataataaatgaaaaatagctgccagaagaaaaagaaatagactaatctgctttaaaaatttttttaattatttggattgaatttagtaaattagtttatggacagtgtgtttatggacagtgttctttttcgggaaagattctgttaaagagatatttcaaagaatagaaattccaacccaaatagacagatttaagatactagaataattttggggttgctttatactcttctagtggaatgaagattctttttaagtagaatagtgagtataaccagttacttctctggaagtgaagtcacagggctaatgatagcttttgaagaaattgtgctgtgattgtgtgagtgcattctaataagtagctttagtcgtgtcccactctttgcaacactatggactgtagcccgtcaggttcctctgtccacggaatatccatgccagaatactggcgtgggttgctgtgccctcctccaggggatcttcccgaccccggattgaacccgcgtctcttatgtctccgcttggcaggcaggtt

SEQ ID NO: 46473 - DNA, 691 bp, Bovine  19866880785814
cccacctcttgctgctgctgcttctcctctccctcccttccttttcttctcccactccctttttttcagcaagcattttgtgagagaggaaaagcagagaatgtgaaaagccatggctttcggaattgccctcggaactgggttcaaatcccagccccagatctcctaactgtgtagccttgggcgggagactcagcctctctgagccttcattttctctttttcaaatggggaaattaatggtattgcccatgaacgatttctgtgctgacgaaaccatttgaagtggactaggtacagtagatgtgtgaatggcaccgttacccctgcgaaagccactctcttcctgcccctcccagctaccccccagggttggagaaggagctaaggatctaccctgcagctttagagcaaaatgccctgtcccttgtcccttgtcgcccggggcaggcggtgactccctgagaacactggcaggcggagggggtggggccagggcccagggcaggcaagggaaggagccccaccacccagcccaacgccctccccctgtccgcaggctctgcgcgcctctctggaaatgaagtgtaagtgccatggggtatctggctcctgctccatccgcacctgctggaaggggctgcaggagcttcgggaatgtggccgccgacctcaagacccgctacctgtg

SEQ ID NO: 46474 - DNA, 1573 bp, Bovine  19866880788207
ctgctcctcttacacaagaggtaagaataacttcttttctgaattttacttaactaaatgataggaaaatatgcttttgaatcatgcaaaatcagttatgtgtttttcactaaatgtggatatattgttagaaatgacctatctaattgaaaaggtagactttagcacagacagaagggaagttattgtacagaattatgaagatccataccagttattaagatgctcttcacgaataaaaaacagtgattccaaacataagccccacattaaatggtacagtagcttacagagagagtaaaaagccagtaatgtatttattaacaaatcggttcttaactgatttgctgagaaatacttcccagatgcccctcaactgatagtaattatttccatgtctttgttgatgatgcatatataactcatgtggcactcttctattttaaattttaaattggagaataatgaggaaattactatacactcactacctattttttaaaattttttgccttttttgttaaaataaatgaagcatttacagataaagtaagcctcctttgttccctactcctactaccattagttaggactctctcaacttcaactaacagaaaatccaaattaactgatttaaataaaaagaatggagaaagattcagttcagttactcagtcgtgtccgactctttgcgaccttatgaatcgcagcacaccaggcctccctgtccatcattaactcctggagtttacacaaactcacgtccattgagtcagtgatgccacccagccatctcatcatctgtcgtcccctctcctcctgcccccaatccttcccagcatcagggtctttagtttcaactaactcaggaacttgataactttatccaaaacccaggatttcccatccttcctctctgccactatctatatatattactagctccccaagtcatatgtggcttagtacataaaaccattcccagaaacacctcagaaaacttgccttaactgtgacagagtttatgcatggaaccaagcactggtgatggaatggaattactctgactggtaaaaagccagttccaatttgctccctggggctgagccccaacttccatacagcaaatgaagagaaagtagtaaccaaatggatctctgctgataagtaggaatccaagaatggctgtgggcagacaagcaacttcacctgcaatggcttttctcacaagccactagctttataaatttggtgaacatctatatacatcactttttatactcttaaaatacaaatgtttaaatcaataatgatagaccatgtatatcattctgcaactcacttttcccctcaatattttttttttattataaggggaataataacagcattaacctcatattgctgttgtgacaataaatatataattatataggtaaatcattttcaacagtatctgaaacatagtaagagcaactataattttctgagtgattactattgttgttattaatctttgtattcctagaatacagaatctattcatatttattgtgggtttttactgtgtgca

SEQ ID NO: 46475 - DNA, 3108 bp, Bovine  19866880873148
aaacacggtggacagacatgttttaagccagctcacgtgttcccttagctttcttgtttcttaaccaatggagttgaaacatatcaccatttttgtttctttttgtcttaaagttctaaattctaaccaagtttcatgactcttaccaggttcctatcataagcaacaaagagtgtcttcctgtccaattctgcagtgtatttttctagtactctggatttgactttgatgggcttccctggggaaggtaataataggtgttagaaattcagtggcagagagagagaggagggctggggaaacgcagagaaggaaaagaatgaccactaactagtaagaggcagcctggcatgacagaaagagcatgcaaccaggaggcagacaactggtgtggccgccccagttccattacttactgtcatgtgatcatggcaagtcacttcatatttctaagtactctgatatgtaagatagtgatcatcacccttgccctgcctctttcacagggttgttataaacttaaataaaaacacggtaaattctgcaaaaaagaaacttccattgtacataacttctaactatagctgagagttaacctaagaaaataagtaaccaaaaaagtaagtaggccactagaattgtgaggtactttcctctaagttcagaggaaggtcgtattaagtacttggggaaaagtagaagggaaatggtgaatattctgtatcactaatgtacaaataagcatgagccattattaaaaaatgtgatcaagaaccatgttctatacctgtttgtaaggagatgactgtagatatttttttatgactgtagattttaaaggaaagataaaatacctataataaaggatggatttaatttttaaaaaagacaactacgatttcatttacccatgatacagttataatactacttaccatttgttactattatgtgccaggaagtatgctaagtacttaatctttatatcaactttatcaggaaggcactataatttccattttacagatacttttaagcagagagtttaaacttgcctgaagtcacagagatagtgagtggtagagctactattcaaacccaaagtcttcatatgctccttagaactgggcaactgcttcccactctggcctgccctgtaatcttcacatgccccagtcctccttatgccccaggtccactaaatgccatctccttagtgaaggcttgtccaggcctcacctacacccctcaccttacactggggagtaaatgacatccttaagaatgttgcagataacttctccaccttccttcagtacttcatactttctgttgtctatcacatcttgttccaatttcagtgcctgctcatcgctgctcagaagctggtgggtaaggcttggtggagagtgaacctaaggcatcaggggagggcctgcttctctgcctgctgagtgagtgaatgaagtaggatgtgagctggaccttgaagtgaaagcaacgtttggagagagcaaagcaggcaattctaggtggtgggaacttgtctgagaaaagaaccgaggtcagaaatgaggggggcctgtctaggggtcggttcagctggggtgagagacagtggagagatgtcactgaggactgtccccagggcctggatgcaggagcccctcacacagtctgttcacagcagcacagcacagactctcttcctctcagcgctaaacatatcatctcagtggcggccgtcaaacagtggctcgcatggcagggaagtcgtcaggcttccctgaccgtaattcagcattggctgtgcatgagcatgtcaaatggaatcctggaccactttctagttagtagtaaaagagaggaaaaatgggatgtttaagtggcatggtggtggcttttaaccaaactattcaagaggacaacctctgagctgaaattctgcttttccaatttgtgttgtttggcagtcacaacaaggttagtgattcaaggatgagaaaatggagacttcttttggaaaggatcagcataaagtactgggaactgtgccccaggtaacttgtgttcttgagaaaagggatagttttatgattagtcaggtaacatcaatatgttagataagaattctgttctgtcacgtgacagaaaagaaaaatcacactgtcttttctttaagaaacaaaacaagctgtcacacaactctgaagcttaccataaggaggaattcagtgactgcactgatcgtcagccagtttgaaattctggacaccgaaagaacacacagcaatctacttccaccgggaccagtctgtgaatggtaaccgcagcacagaggatggaagtgttttcttttacaaaagatgtaagaggctcccttaggggcgttgagtttttttaccctttgccctaaggagcacaggctggggaggtaattcctcagttcacagctgctctcggaaattctcaggtttcccctggggctgaagtgtttgttccagctttgtttaggtttggaacctccgggctgcctttccacagcagtctttcctgggttcgtatgtggcagaccttttgcgctactttgcatctgtctcagcggtccgtttttcattacggcaccaagaagtgatgtctactattcattgagtgttaatgtgcttggcacagctggcataaaggggcactatacagatgtgggcactgggggcttaatgggtttaccatgtcagtgccaggagacctggactccaatcttactgccacaggcttgtggagcagccatgcttggaaagtcactgaatttatctgaacctcagaaatggagagttgctggaaatggttatgttttaggagggaaaagacagtcagggtgcagtgaggaaacacttctatgtaagcattttgggtaaactgtctaaagagattgcagaagaaagggatctaatttctaaagttccagtaactggttatggttttgtttctcacttaaaatatttacttccctccgcctaattttgtattttctgttctgtattgttttcttgaaagggttccctaattatataagctcaatgcgccacaaaacctagatcctctgtgttt

SEQ ID NO: 46476 - DNA, 1537 bp, Bovine  19866880881610
actgaacctgcacccgctacatgggaagcatgcggtcttcagccctgactgccagggacatcctgactcctaactttagacttaattctataccctggtccccaccaatgccccacctaataataatcccattttgtaaatttgtattattttgtaaacttcacttattcaaaatttttataaaaatttgtgggatttcttcaactcacaaattagatgttaatgaaacaaattattaccaaatataccaactgatttgataagctggcaccatgaaaacaagcaaatctagttatttcatatgagaacattctgggtttagtaagtcaaaaaggcagatatgttgacaccaataaccatagatcttattacagtccaaaacacaacttctaaaatcctagtaacaatattacatacatttattattttggagacttatataaagcaaagtagataaaaggcttggaaataaatccatgaatttttgaaatatccacttgatttcactaaactgatttttcaataactgtgtgcataaatctgttaactacataagtttaaaggttaatttaagatgacttattagaaagcctaaaaacttcttgcctgctttctagatgtcaaagctcaaaattacatacataagttagctagtcagtttcctagaatgaatatgctgtctacaaattccatatactcagtatgtttgagaaagacgtatctcttgtgttttttttgcaattataaaattgcaaaaggaatcacctcaactcatcatcttacccaatttcaacacacaaaaggacaatttaggagcccctaaagtcattctgtttaagtatggatttcacaggaggagggaacttgaaggatcattgatctgggagcaaccaatgctaacatctaggttgtcataatcaatctgctttaattatcaacaaggttttcccatttctgaccagtcatttggagctgacctctgacaagtacttacaagtcatcgaaatctcattttattttattgcctcatatttgttattgggctaatctttacctgttctacatcacacaacagcttaaatatttgaatggcccagcaataaatttccatggtccccctgggtcagtcagatgttagctgttaagtaaagctaaaaggatctatgcttcataaatttccttcagggtccacatttgctcttacaggctaggctttcaagcccaaacatctttatagctttgtgcagtgatttattaactcctccttgtttttatccaaaaagatcaatcacatatgtatcaataagctggttgtgctggtgactgctttttattgtacatataaccacctgcctttaatacaaactcgagtctaaagcttttgtaagcgcttgctggattttaacaaccttcacctgtttctaatttggtacaaaacatatggtttagctctgctatttcattctaggccagcttttcctcttatggacccaacaatataaaagaaaacaaatccagagcacaaaaacagaaattt

SEQ ID NO: 46477 - DNA, 1279 bp, Bovine  19866880915679
ctctgtcttctgacctgtaatgtcctgtcagcccttctcacagtttagatctctcagaacattctcttctgctgccagccagagaaaacggtcttcttttaaaggttcgtgtgatcaaattaggcctacccaggtgatatccctttgccataaacataaaatgaccagggatgtaactctgggctaaaggtggtagaggccatcttaaaattctgcctacggccccacccttcaggctgtcattgaaagataactgcccccctaggtttacctggttatcattcatttaagaggtagcctccccagggtgacatccgtgcctgagtcacgttgaaatattccatcatatgttgcacaccttccctgtagtagatattcagtacacatccagtgaattaattatactttctgttaaatgaattgtgagatcaaaagatgagcagaattgttccagaccagatagtaagagcatccatccaattggaggggcgctgtgcacttgacacttcattaacatttggaagggtttttgtttgtttgtttgtttgtttttgcttctctttttttgaggctacatttatttatgatcaaccaaagagactaaacagtggatgcatgggcttggactctaatgcagttcaaatgaggtcaggaaaatgccacaaaagaaaaaaccttaaaaggcatgaagtagatattatagtaaaattgctattggactgtgaagaaggctgagcgcggaagaattgatgcttttgaactgtggtgttggagaagactcttgagagtcccttggactgcaaggagatccaaccagtccattctgaaggagatcagccctgggatttctttagaaggaatgatgctaaagctgaaactccagtactttggccacctcatgtgaagagttgactcattggaaaagactctgatgctgggagggattgggggcaagaggagaaggggacgacagaggatgagatggctggatggcatcactgactcgatggacgtgagtctgagtgaactccaggagttggtgatggacagggaggcctggtgtgctgtgattcatggggtcgcaaagagtcggacacgactgagcgactgatctgatctgacgtcattagagaaagaaaagagcatgctggaaaactgtgttccatttagggcacctcattaccagattatttaagggaaactggagggagttcagagacataaagaatgatgaagaggctatagggattaatttacaagcaaagattttaaaaaacta

SEQ ID NO: 46478 - DNA, 1372 bp, Bovine  19866880917293
aattcccctccagggagagcgttgtgcaactcactctgctggccaatatccagcactcggctaatatccaacacggatcgggaattgcttgattattcgttaagttgacacatttgcttacaggttagcagcttgctcgtgtaatgactgccattaaggtctcggagaaccatagcaggagctagtaccccgaatcgtcctccattttccagcattggctctggaaatgctttaggaatgattgtccctttttctaggtttgcccaatatcattttggagaaagctctattgcaaacagaaatcatcagtgaaataaataaaacattcagatgaaaatagcatgcagatttgtgggcactgaaattagcattagacaggctctgaggccccagccacggatcttgtgtcaagctcagccccccacttacaggaaggctcatcttgaacaagcctctgtaaacctcagtttattcaattctaaaatggggctaaatcctgcccacctcagtttgctgccaggagctgcccacctctaccatacaagtaagtcaatggtgcctcccagggaagtcagaggctggggaccttgcccatgaccctgagtactgctgtctgttcactccgagagttcaatcaccggtcactcattcagtctttctttcagcaaatatttagggaattcttttatacactaggcactaagcaagacgctgaccaagacagacacaggcccaccccgtgaggaacgagcagaacaagagagacaagcacaaaaggctatgtaatgaatcacagttgtggtaagagttacaatggccctgaatcaaggaactgaagatttccttccgcaggctaagaatcaggcaagctcaacgctgtagggaaacagaagtccaggcccaaaggcaccagggagaggaatcagggtctattgtctgcatgaggagaaagaatggaaggaagaatgggttcagatgtataataacaatgttcataaagatgttgagaataataatcataatagttaccatccttaggaaggaaaggcccagttggtaaagaatctgcctgccaatgcaggagacacaagagatacaggtttgatccctgggttgggaagataccctggagtaagaaatggcaacccactcctgtattctagcctggaaaattccacagacagaggagcctagtgagagttacagtccatggggtttcagaaagtcctacacgactgagtacgcactggctggccaatcgtattggatcagtgtttactctaaggaccatccttagggcacctgctcagaggcaagcttcattctttactctcattattgctaatcctcgtcacactctataacttacaga

SEQ ID NO: 46479 - DNA, 1781 bp, Bovine  19866880975450
tatattattttgggagttctacagtctacccataattttttttacaagccatatttatcaaaaggtattggtgattcaccaaagaactttaaacagaaaatgtatacatatatatttatatgaatgaaatatatatatttatagggttggccaaaaagttcatttgggtttcctgtacccatcttatgggaaaaccccaatttttttaacgaatccagtatttaaaaagttatatgaaatgcctgaacgtaacattcactaataatcagagctacaaataaaggtagagatattatgtttcttctctcatattaaaaaagattaataacaaacaacattggcaagaggataaaaaactcaaactttaaaatttatgtattctttgacctagcaatttgatacttaagggaataactgaacacaggtatatctaagaagatagatgcttctctcaccataatgtggttcataacaggcaaatcttggaaatctactgctaatgtccacaaacagagtgcagtgtggacaacaagatcttatacaactgtattcatcaatatgaaactatcttcacaatatactgaatgaaaaaagtaagacatacaacagaatgcacaatgtgacactgtttatggaaattttacctgtttcatttaggcatgtatatttgcatagatgtttggaaagctgatcaccaaaatactataatacttatctctgagtaatagaatcaaaagtggtttaatttttttccttaatacttttctgtattttaaaaataaattcatcctgagattgaatcatttgtatgatttgaaaagttacttctattttggaaaaaaaaaaaaaggaaaagtattgccttaacttgaaacaactaaaagctcactacattgagagtgtacaaattatctgaattttccttccctatagcagtattctcactgatgcagctaaaaaggcaactccccctacccttttactttttaacttgcatttagcttgtaatccactgccatacagcttcacttcatttcgtatttgtggagcctggaatttcttggtcacaaggattacactgcactttgcattttatttattttgcaagcactttttttttttttttactacttaccctgtttcaggcactattctaaaatgtgtttcgggcactattctaaatgctttaaaacaactttatatacaacttttttacaactttataacaactctaagagatgggaattataattgtaggtattattatccctattttacagataaagacactgaaacacagagagattaagtaacttatctaaaatcatatagctaaagtgataaatgggcatttgaactttgtaatctaaatccatagtacttgctcttaaatattcaactatgctgcactttattcatttcattctaggattttgacctttcccttggtaaatttacactaattagggtactaattttatcctccctggaaacccaaatcagcatattttaaaatgcttttctctagtagataccaaaatttatatataacgattttttgaagttcttttctttaaaaagcttaaacctaagctacgctggtctttttgatgccaactaaaatcagaccaaattcacttttcatatatattatttctcgtaattcatttcatgaggcttagccagaaaaaagtagttacaatttgtattctaccttctctgaactaagcattaggtatttcatttcaacgaagttcattctttaaatatttttctcccag

SEQ ID NO: 46480 - DNA, 1260 bp, Bovine  19866880979713
agcccaattatttactggaaccagtgagggatgcattcttggcggcttcagttcgtgcaaatcagagacacgtctgagctcaaatctggttttgatcagttccaaccaaacagacggcttattaaatccgagctggagaggcctcctttctggaaccccctttctaagccctccctgtcccacctcagggctggaaggccttttggggagcagggagtccaacacacccatttgacagatggggaaatggaggcctggagaaactattgcaaggcgcttgctgtggatctgcaacagccaagccaggccagggagggctgtggttctggaactctctaggctaaacagataagctccagagacattaccctggcattcaagggcccccttccctgctcttagctttccaacatatctcctgctcaatctgaatacttccactaggcttccctggatcatctctcctttgcagttgaagatggtggacagaagagacctctgggcttcagcgtcctcatctgctgacgtggggtcccagttcaataagagcaaagtcctcgtgctcagtgggtcctgttgactgaatcacgatctgcctccccacaacttcatctttagacacctctcagggtgaggctggtgaggccaccagccagggtcagcgaggtcagcgggcctggtgcagctgtcggcctcacccacaaggccctttgatccagtgccagctccaatggccggaggctgggctggcaggccctgggcagtgatggatgtgcctgccagtcagtcctgctgggaaatacacgtccagtcacacaggtcctggagcctcagcccaacatgcgaagcccgccagtctcggcccccagtgtctcccttgctcaaccccagccctttatctccacgaccatctccaaccttcactctcactctctgcccctcctgcagagcctgccaagccagagtcaagttcacagctcctggtcaggttcactgtggctttcatgggtggtccctcactatattcccagcacaaccaggacgtgtgaggcagtgcggttgtgatggtccctatcttacaggtgctgccactaaggtttggcaaggcaaagtcaccagctgtccttgataagcggggattggaggcccagtctgtctgcttatgctgtggggcttgaccgagaggattctagaggctcagagagtcctaaaatcagggggctggaaggagcctgggaaggcatgtgcatttaatccaaa

SEQ ID NO: 46481 - DNA, 1172 bp, Bovine  19866881002855
gggccagggccagcatctcctgcgaagcaggcaggtgtcgaccagtgagctgacaaatgggctgaccaagctgaccgtggcccttccctgatgccgttgagagatgcctcctctgagggagttctcagcttcagagcctccaagaggtgcatgtaggccaagcaggaaggggaagggggcccaggcccctttcaccacctcagggatcccgcaaatcaaggccagcaagggcaggatgaggcccactgctgcctggcctgggaggccccagcagggatgccagaggggctgggaggactggctggctggaggccttttggagatgggtgtgttccttcaaatcacttcattcatctatcctcgtttccccgtccactcatcagtcaacaccaaacgcaacagaggtccccctgtctgggagtggggaactcagagatggaggcaggctcagatcttgctttccatggactccacgcctggtgtgcagaggggagactgactggtagacagctaatgattaacgcaggggtgccctgaggctggggtgaccaagcctgccccgaggtcagcagcagcttcagggagaggtaacatctaagttgagtcttaagtgggaataggaggatgtgggacggtgtgggtgggaaagtctcaggcctcagggggcactaggagcaggtgaggggcaggaaagtggccatatggccctgggctggcctgagttcagtcctttctctgttcaactttccatgtgagacccaccagaagggccctgccctgtccagcccctcggaggcggagaggggctctggaaacggccctgagtgagggtcaaggagtgtgaggctcgctctgtgacccaagccgcacagctctctgccctgtgggacttacaccctggagggatgccatcatctaacctctcaagtggccacgatggagatgactctgctgggaaagatggcaggaaggacagaaggcagctaactcagtctgagggtcagaaaggactcttctggggaagggatggtcttgggtgagggaagggtggtcccatggcagaaagagctcgtggaggatgaaccagaggagcaggcagcgcgtgttcaaagtcaatgcagctggagagcggcgcctggaagagggcccgaggcgaggctgccatcctaggt

SEQ ID NO: 46482 - DNA, 1535 bp, Bovine  19866881039226
cccttccccctcaaaaacagacatttcagcatgccaaaggcttcacatgatctgtcttcttcctcccttttcagcctcaccttctgctgccacttaccccaaaacccctgccactggccctttatgccaggaaagctgaactacttcactgaggtgaggcccaccttctgcttctgcttttttttaaatccccttttaccccctttacttgatacctccccctgtcactcatgtgctaaattcccattcggtctccactgtacagctccgtggtctttcctactataagcctttctttaccttcctgaatagagttattattcatcttctactttccctgctcaactttaaaaaaaaatactcatttggaacttgcctcgcagcccagtagttaggactgggtgctttcactgctgtgggcccaggttccatccctggtcgggggaccaagatcctacaagctgtgtagcctggccaaaagacaaaacaaagcctcagtcaaatatatcagtatttttacatgtctgttgtcatttattgtatatgtagatgttccctactagactaataaactctgttaaggatgagagaccaaaatttactcatccctttatcccaacacagtgtctagcaccaaaaatggactgagcaaaggtttgtgcctggaagacagaaagcatcagtgaccctcctctgggaattaaggaatgaaaatttaacactaaaaggaaaagcctgccatttgaaaggagagcggggtacacattagtatcaaatgaaattagtgtcttcacttcttataaatgtgctgggctttgcatgtgtctaggacaataatgcagggctttgagaagtggagtgagattaaagagaagttatacagtgagagagcattttcctttggtaataagttagaggttattgagtacctttttctcttctagtcaaacagaaagctgacaaatgttttccaagtgttatcagaattttctaatcttttgtctttcactgacatttttatttaatcatttcagatgcaatagtaaattactgaccttgtgtgtaattcaactagtgcacttaaaatggcaatacaggacagattgttaccagctcaccaggatgtgtgatgtgataccatttgaagctctgaaaagagaagggaagggattgtgtcttcagataactcaaccctggagttctggcccattaatacagtttttagttgtataaaagttacacatgctgctagtttagcgagtcaaatagttccttaaggtttattatgaaacagtatttttccctgtaccttaaaggaaactactttagtaatttgaacagattctgtcttatgtgtgttagtctcttagtcgtgtccaactctttgtgacccccatggactatagcccgccaagcttctctgtccatggaattctccaggcaagaatactggagtgggttgccattcccttctgcaggggatcttcccaacccagggatcgaatccgagtcttcaccatctgagcaactgggga

SEQ ID NO: 46483 - DNA, 1031 bp, Bovine  19866881042762
gtttcagtagtcatggtgcacgggctttgttgccctgtagcatgtggaatcttcccagaccaggaatcaaatccatgtcccctgcatcgacaggtggattcgcatccattgtccaaagggagaagtccaaaggtagtcttgatttgtagcatttgctgatctttgaggtgctcaagccataatcaagctagcaatgtgacgtcactgaagtctagagaaagggaaaagatgcccagcagcacaccattacatagtacttctaccatacagatgcgtgagatataaataacctcaagagcatagataatagcaaagttgtagtaaaataattaagaagtgaaacattgtgaggattttaaacctgtattttaaagtaattcatttaaatgtaagtttgtgtgatttaacttttagcaatgactgtttaacatccagttctcaaaattcctgaaattttaagagtcggctctttgggctgatgtgagctgactctagaaccttcgttgcatccccctccttacatctaacttattttgctggattgaattattttcttcttactgaagtatatccacttgtattctttcagcaaagtttgtgtaaggtaaactcatcatcttcgcttgtctgcaaatggctgaaaatttggtgtcacttatgaatttaacttgtgcagaattgtagtttgaggtttattctctttccacattttgaagatattatcctcttgtattttggttcccactgttgctgatgaaaaggtgctgtcatagttaacatcccttttggtaatctggcccttttcactgagggcttttatagttttctctttgccttgtggttttgcagtttcatcagggtcattccctctattaaatctttctggaattcctattagacatctgcttgactttctctttttatcactcatatctcttaaattcttgttcagggttttttatttctttctctctttttattctggtttggggaatttcctcaaatttttcttctaagtccctcttcagcta

SEQ ID NO: 46484 - DNA, 1696 bp, Bovine  19866881082821
cagcccagatctgtctgggggaggggccttcagccttgacgaatctaatcccatcgcctggctctgcaggtacaaaggttaacaccacccccccactggccacctccctcctcacctgccccctgcccctggcccaaacacacatacacccctccctctttcctctttgaaggctctggggagatgatccacaggtcacctgccactggctgtacctccattttctgaccttcctaagacattcctggacccactcgctccatgctgaggcctcttgagccaagagctcttttggttggaaaatcagctccaaacatatggggcccctcctgccttgccaactctctggctagtgaggtcgtctccaaggaccccagctccagcagagggccagagaatccccctcagaagtttcatggctgagaggcatgtgtgctcattgagaggacaaacgagctggtgactcacaccaggcttggagctgtggtcacagttttctttggtttcagctttgagagaaagagaccaaatcccatttaacacttctgtacttggcgctgtgctgacatggccactgcccttcctcagggggagacacaggtgggtgcaggggtcaggcaatcagggagtgagtgcaggagctggggtgctgggggaggcccagacccagcttgggtctgcctggaagaactggagcagaaaagccaggctgggaagttccaggaagctgtgggcatctttgatagaaagggaagcttcagatgcagccatggcctggggtattcaatattaagatggaatgaggaaggcctgttgagaggcaaggaggaagaaggcaggcctcacagggctaagaggggctggcaaagagctctgctgttattcacaaatcagtggggagcctttgcaaggtctgaaatgagtgtggactgtccatgaagaaagcctttctgagggtatgaagaacctgggcatcggaggtgaggtcctggctgtgtgtccaggccacagactcatttagcagcgaccacagccggccagggcccagactgaggtcctgcagaccagcccacaggccctggctaggtagcgtgcacaggcagtgaggctgctgccgcccggcaggggcttcaggagactgactcatcagtgtccccagggcccaacccagggctggggcagagcaggcgccagggaaagtgtgttgtggggagaaagcagctttacaaatgcttgcagcagccagactggagttatttcttcctgcccgcacatcctcagatctggaaataaggaagtgtgaggctccagtgagctcctgtactcaggcatggttgtaagggcttggggaccactggagccccagggagacttttcctcaattttctcgtctttaagttagtatgtgtgggtgcagaaggaatgacaagcaatggaaactggctggggtgctggcagcctgtgcattgggagccacatgaccactaacctttcacacatgtaccagtgcgtgctggtggggagatcccagctcctcctcactcttctctctggcagtgaaataggatagatttgttagccccatttcaccaagcgggcctccccaaaacattgactctatttcccagggacttgatgagccaaatggggttgggatggaggggccctccagggaatctctgtttttctagatggg

SEQ ID NO: 46485 - DNA, 1284 bp, Bovine  19866881105956
tgaaaatgatccatcctgggccttccctgatggtccagtagttaagacttctcctttcaactcaagtagtgccagttcagtccctggtcagggagcttagactccacgtgcctccagccaaaaaaccaaaaccaaaacagaagcaatattgcaacaaattcagtaaagatttaaaaaatggtccacattaaaaaaaaaaaaaaaaagacccactctaaatgtcaaaacatgaggtatatgcaactgagaagtggttctgacattaccttctctacactcggagacatgggaggtagaagaaacagcctcctcttgaagactccagggtgatactttcagaggagaaacagtgatttaacttatatcaagaagttttatactactgttatatagtaaagaggttgaaaacttgtatataaaataatcactgaagagagatatcagaaaacacagcaaagatctcagagggaagtgagaagagggataatagattggacagagggtaacaaaagttaagtcctcataaaagagtaagaagaggagtgatcttcccctctcctcctttggggaaagacaagaaaaatagaatatataataggaaatcacatataactgtgaaaaactaaattaaatttgatataataggtagtaaaatgccatcacaagtttttaaaggaaaaatcatgtaatgaaaagatttacatcagattattctctttgccaatattaaatatagttctttagacagagctgtactaaaaaagagaagggaatttcagggaaatagaattccaaataatttcagtaagaaggttaaaaataatccccattttttaaaacttggtaagttgcacggttgtggaaattgttaaagaattcaatatcaatttccttgtagaaactttccagtttttccacacccttttagtaactgttgaaaaatagtctataagcaaatttcaatgaacagagcaaaattaaaagatggaaagcatgtctattttaatagctatttttataaaataaaaattctgccaagtaaatcaaaatcacattccacagcattaacagccatctgcatttgcccaggtttaacagcacctgtttcccacaaaatttgtaaaggttttttttttaatcctacaattaagcatgcaaggtgcataaacctaccgtacttggaaatgccaagatgtttccatatggaaaatgaatttggaagaaaaatcactctccattttaaatttctaaagacaacttcacaatgtgtgcatataatatagg

SEQ ID NO: 46486 - DNA, 1740 bp, Bovine  19866881164177
acatataccattgaaactaaagcctgacagagactgcaggcaaaaagaaaacaagagatcaatttccctatgactactgatcccattgtactatccatacctcatactagctgtgaggcagtgaccaaatggtacaaagttccagtcaaaaggtacaaacttacaggttaaaagacacataagtgctggggatgtaatgtacagcatgatgactatagttaacagtactgcactgtatactgcaagtcgctgggagtaaatcttaaaagttctcatcacaagaaaaaaccctgcaactatgtgtggtgatgatgcttattggagtaatcattttgttatatatatatatatatatatatatatatatatatatcatcaaatcattatgctacatataaagctaatacaatgttatatcaattacatcttaaaaaaataataaaatgttcctatcaagaaagtaaacaaaaaattgaaaatatcaggatctcccaaagtcctgttctactctgaaataaaatatagattccatggaggaaaaaaaaaaatcaattttcttttcttaaagatattaagtatgttatgaggcatttaatctccttaaatctaagactctatcctatctgcctttctagtcaatacctttatgattcagtaacttacgttattgtctcctacccttgagtgcccaatgtgctagcaccctgtgctagagaggatttcaataaactgttacgccacatttcttcactgtacacagtgtcttttaatcttagtacctctgcctagcacctagcaactcatgccaaattcacaatatgacctctaacacaagactccccagactaatttttctactgctcacttctcataaccccagtaggctccagagtatagttctaaaatctgggtttgtttcctctgcttccttttatctctcctgaaagttcactgaagaaaacctgttcctcctgtgcaaactgctttttcattcttctctattcccaagcatcagtttcctctatataaatatccccaacatgagggcctcagaatatactttggaattaaaactcttgtgcttaaggagcctatatgtggaagtaaatccatatatattattacaattttcagagaactggtgactggggaagaattaccatctcctataaacatttttccatttacctgactcctgtttgatttgaatggtaggcttgatacccggtggcaaaggagactgctgaggctgctgctgatgagatactggagaaggctgggccacctgttgctgtgtctgttgctgcacttgatgtaactgctgcttaggagactgctgatgctgtttaggaaactgtgcaagaatctgagttggggcacccactaagcttttgggagaaggaagtctggttgatgccattttgattgctgacgtagatacacctatagaaaagtaaggaaaagaacatttaaaattaaagcataattaaaactacttctggttattatagtagataataatttaaaactaggtaaatcaaagaaacaatgattatccaacacctagggtcagatataatgtatgtagtattttacatatctgatatctagtcctcaaactttgcaagagaggcatcattgctccaacactcaaaaaactaattcattttcccttggtgaagagtcaaaacaaaagaaacatcaaccagcacattctcactcatctctcaataggttttt

SEQ ID NO: 46487 - DNA, 1369 bp, Bovine  19866881171002
agacagaggaagcagtctggtgtgggtgactctgagtccagtgctcttggagagcattatgtctctcccttgttaatgttttgtaggtatttatattatggtcacttctgggcctttatctgtgtccccagttcccagtacagagccagacatgaagaggcattcagtaagatgtgggtgaatgaatgactgaatgaatgaaactgaccgactgagctgtgtgttgccagcacttggcccaggttctcagtgaatgagcccctagcagcactgggatgcgacccgtctgggggctttgtggtcgccctcaacctcaaccaggctgctcatgagagaagggctggcccagcaggcctgggtgtcccactgtgcaggcggtggcttcagtgaaagttaagggcctggcagcctgttcctggggaagtccacgggccacagtgctgggggcagggcaggcctcctggcggggcttcctgtcaaggctccaggcccagccttcaaacaatggcagggactcggggatcagaaaatcaaaagagaaagggcaaaataaagttctgcgggtggggggattgaggaattccgtttggaacttgagctcagatggggggcctgcttgtggcctgtgtggacctggagtcctgagcttggcccagggcagcccttgaggcctgtctgcctcctgctcacctcctccatgctgtcttctgcctgatggggccttttgaagcccaaatctgaccgtgtcacccactgcttaaaaactcctatccaaggtaatggcttagcccctccatctggcactgaaggccgtttgtgatgggctacagcccctgtttcccaccaccttcacaaggggccctgttcacagcaccttcaagtccagctcccgctgtggtctggggttccctgagggcagctgcagacaggagagggcagtgggagcccgcggtgggaaggagcctgcagtcttaccatcttcccctttcttcctgccctctgcagagccatgagccaccagattctgctgcttctggccgtgctgaccctgggcctggctacctcccaacaccgagacaaggtgccctgtaggaaggtaagacgctctgcctcatcagggagagttcctcatatcccctgcccccgggggtcctactggcccagaagccagaggctagagggctcagaagaggaaaggggatccacttaatgccattaaagctcgcatttactgagcacctactagaatgtctaaatgccctgtttactattaatcctgccaggtaagtataatcattccagttttagagaattggaaaccggcttggagaagttagccttgtccgaggtcattcacttcagtagggac

SEQ ID NO: 46488 - DNA, 1914 bp, Bovine  19866881184508
cccctagaacccaaggcccaagccatgccagtgcccttggtgagccattcagtaccttctgtgcttttccttcacggctccaatcacaatcacaataatcaaagaaattcataattaacgcgtttgattgttttaaagtctgtttcccttcctaagggcggggctgggtctgacttgcccacggttgtatcctgaacacccagccaaaagcataactgaagccagtgcataagtgaggaaatcacctcccagggcccccagatggccagagttgtgtgtctgtcttgtattttggggttcttccctatactaggaaaggaaggagctaatccttcttgggcaccatgtgcacttctgacttcttccccaggctctgagcccccatggggagaaatctgccccctttttaatctagtccatctgtggtggacatgactaagagactttcacttatctcttccccagtctctatcctagtttagggcctgaacaagggactcaagttggactttctgatgagtcatgacaacataaatatgactagagtgataggatcacagaaaatcatgagataatacgcaaatgctaagtccaggcccgtgggtaccacaggcacaaaaaatgctagtgtctcttctttaagaggttcttgtccaaccaatctttttttttttttagggtttttttgttgtagggttttgtttctttttttttttagtgtaccattcagattttagtatattcacaaagttatacaacaatcactactaattccacaatattttcattactctaaaaagaaactccattcccaatagcattcatgcctccttttcccttctcctcagcccctggcaaccaccagccatcttattttaaagacagggaaacaggctcagagagggcagtgcccagagccaggaccagaggccaggcctcctgacaccctgtctgcttcgtgtctgagctctctctggaggcttccagtgttctctggtgactggcatgaaaaggctgtttagcaaaggcccattaaattgaggctaacaggtaagatgagactagaccatctggagttatgcccaaaacctgcctgtgcctggaatagatctgagggcttttgaggggcagaagacatacctagacaacatctctaactggtatcctgcttcctacaatagccagtatcctttcatagctgggggtgtcttcccccagtcgaccacatggcctcctctgtggtcagagtaggctcagagtaggcatgaggaagcaggggccagacttcccaggtttcccactgtttttaggaccccagaaagctgagtcagcctatgaacacagcgtgtacatcttcctatggtaatttagcagttttcacattccatgccttagccaaaatggaaaatgaaagaaagggaaaaaaggcagtgctatgttttaaagtggccttagctctgtgagttctaacatgggaaactgctgtccatgatgtcatgggccctgaggccctctgggcattgttactgacacttcacgtggtaggctgggccccagatccacacattcctcttgccagagctgtgtgagcctgtgggtccatctacaagcctgggccagaccctctgagccaggatggagccaggcactgggcagacagggggcaccctctggtaagagcccagttcagctccttgctctgtcatccagaggtctctgaggtcttcccctcatgggatctgcagctaccctgagacacggagggtcagcactctgctctgtgtctgtccatggggcagcagagtggtgtggcgccctgctcccggtcacatggttggggagtgctggccttgcccatcactaggggagccctgccctctctgaatgttatgaggagagggcatggtccttgcc

SEQ ID NO: 46489 - DNA, 1586 bp, Bovine  19866881215265
cccgtccccggaccacactcggagaagtctgggctagaccacgcctctggccagttgacctggggcagaagagcaggtgattggagatgagaagaccaaggatgtgagctgactcacttgaatggttgctgacctcactcaggatagagaccagacaggtggagaaaggccagtgagcctgagggcagagccatcactggatggtggaggggtgcagtgaggggtggggagcaaagggttcttggggccagagaggagctggggtgagggcaggggttcacctgatggcccaagtattacaggagcaggaaagtttcaagaaggtgagaaagccagggtctggtgtcagccttcaaaagcaagttagtcactaagggaacgcataagggaatattcctagcataacagaatcaaaggctgccattgaagaaggccactgggaaagtcacgtactgggaagaaactggttttggttgaagagtaggatatgagcttctctgatggctcagatggtagagaatctgactgcaaggcaggaagcccggggttggtccctgggtggggaagatcccctggagaagggaatggcaacccactccagtatgcttgcctagagaatcccacagacagaagagtttagcgggctacagtccatagggttgcaaagagtcagacacgactgaagcaacgtagcacacacacacagtggtccaggccctgactttcaggttgtgatagttaggagttacctgtcataacaactttaggaggtaaacaacgataaccgctctcaagatattgtgtatcagctgaaacacagagaggtgaagcggcttgcccagggtcacacagaggtggctgagattgtaacgcgggaatgtggctggaaagcccccgggtttacccattctgttctcactagctggaacccactctgggtttgcctgctggtggggaaagttgctctgggcctgaggtcttcctggtcctctccagtccacctcccctaaccccctgccctgcctaccacccttccagctgcctcagcaaaggaggttttgatgctttatttcctgccactcctcccccagcaggagcggggaagcaggagggcctgggcagtgctgccgactccccagctctgctgagagcccccaaaccaacccaggctgagagcccctggcccaggcctgcccagccccaggtgggcctccccagtgcatcctgctcgcaaaggcagcagaccgtggcacctacagaccgtgacctcctcccagcggacagcagctccgtcatcatcgccagctcctacgcctcagtgcgcttggtgggactcagccccctgcctccctgagcccacccatgtgggccggagagggactgtgggtggtggaggaggcctgggacagagaggcaggttggcgttcctgactcagttgggcggcagcatggctgtgtaaccttgagcaagttgtctgagccctctgagcctctgtcccctcacccattcttatgtaggttcactgaactaaggtgtgaaaataggctttgcacaggctgtgtgggtggaaggggcctcccgttat

SEQ ID NO: 46490 - DNA, 925 bp, Bovine  19866881234360
aaatgttgtatatgcttacttgctttttgcctacttttttctattgcttattcaaagagaagtgttaaaatactctcttataattgtgaatttgtctgtttcaccttaagttttatcacatttttctcatgcattttccaatttctattaagtgcataaacatttagaattgttatgttctcctgacagattgactttatcattatgatagtgtctttgtattcctggtaatattctttactctgaagtcaactttgtgtaatactaaatattacttcagctttcttttgaaaagtgttagcatgctacatcttttacttatttgctttttctattttaaccctttttatatttttttatatttaaaaggagttccttgaaaatatcatgaaattgtcctgcttttttatccagtattaaatttttactttttaattggtatattcagactgtttttaagttacattaattactgcttttgttgaatttaaatctgctatttgtcccatctgttcttgttcccagtccctctttatgtgtttattttttgatttcctttgttggcttctcagctacaattgtttttgttatttgagtgattcttttaaggcttataatgtacgtcttcaagtgatggtatgctgtgccacgtacagtattaaggacttcacatcagtgacacatttttctcttactagcctttttgttactttcgtcatatattttacttctacatatgttataaactccatgatacattattatttgtgctttaaacagttgattaacttttaaaaagattaaataataacaatcttatgtttgcccacatagctatcgtttctgatgctattcattctcaaatgtagatccacgtttccatctggtatcattttccttatgcctgaagtatttccttttgcat

SEQ ID NO: 46491 - DNA, 1231 bp, Bovine  19866881244029
ccatagacagaagcccaccaggcttccccgtccctgggattctccaggcaagaacactggagtgggttgccatttccttctccaatgcatgaaagtgagaagtacaagtgaagtcgctcagtcatgtccgactcttagcgaccccatggactgcagcccaccaggctcctccgtccatgggattttccaggcaaaagcactggagtggggtgccattgccttctccactttctccacctactcaggcccattttcagatttagccactgggagggggaaaggagcttaggggcttctatttcctcacttccctccactctgtgtcactcactgctttcagagtcaggtctggatggggggacagagtaaaggggggcatggagggggatagacacaaagtgacacagccaggcttgcctaaggggtgctggaatctggcttggggttgtgggggagtccctttgcagactctgggactttgcaatgtcccagacaagctttctctctttggctgtattatggatttttcaatgactctcactccttgctaagaaaaatgtgttgacataggtgatgccccctcttccagttgatgtccattctcccttcaatgccagttggacacctttgggttgggtcacctgatcctggcagacagcagacccttgaccggtccttgctatatgattcgtgcttcgctccattccagagcgcccacttggcccacagaaatcttgtgttctttgtctgcaaagcctagtagggaagggttgaccctgcagcccactctcctctctctccagtctcaaggcttcagatgccatttcaggagagaatcagacacacagccctctgcccccaaactccaggaccaacaagaggaggggacagtccttgcacatcaagcctgtccttcaactcctccttggactggaagtgagtgtcagacacagaactggtctgaggtcattcttttgtcctgtcctgcacagatgcttttaaatgtggggtgctgggtatcagtggtatgcaatttagggcctcagcatccaagtcaaagaaggtgtccataaagaattccaggcccttctcttcctaaaacaagaggagctagggcttcaaggaaggaaacagaaaagcagaagcagggctacacaaagcatcaggcagagcagagcctccgtgggctcccggagatgcacataaaaccagggattggatggattcagtt

SEQ ID NO: 46492 - DNA, 1165 bp, Bovine  19866881254426
ctctcagtgctgtctgtaaaagaggaagacaactatgaaattgatgatctggggaggcagaggaggctgagagggcctctaatccagctgggagtagatgtttagagtaaagagcaaggaagtcttcctggaagaggtgctgtcttcctagcattgtccatcctgggtgtggttgctctgagcaagcaatggggtaataatgtactaaattttgaggcttgagagggtggccctagtaagtgtgagaaatgctaaatgtgctttgatggctggacatgaagtgggccatcagtggaagtgggtgggaaaccctggagggggcagcaggggccttggcagagccatcaacccctccatgatctagtccctgtgtacctctcaatcctgggtttgagtcccaccctggacaccagcttctgtgtcactttggtttcccctctctgggcctctgtttccttatctattaatataaaacaggaataatgattcctgtcccaggggattcatagaccatgggcagattttctccccctggtagaaattctgtgtaaagctgtgagcctgtgaaagtgaatagccttctcccctctctgcctgccacggggggccttcccaattcaaccctgcccctattctgatcccattgttgggggtcccagatcagcctcagacatggtggaggaggtggggaggagctcccaggagacagccataccctggctcccctgctcttcaccttcacttgtgacctgccagcccccttcctgccacagccctccaggaagactggggctggagagggccaggccctgggctgggctgaagccaggaagggaagggtgcatgggcaggaagtttcagaggtgagaactaactctttgaggtgccaggtaacctgctgatagcattacacacagtatccaggcagcagtagtcaccagtatttattgagtgcttactgtataccgcacactggtatgcagtctgctgctgctgctgctaagtcactcagttgtgtccgactcttagcgaccccatggactgcagcctaccaggctcctccgtcatgggattttccaggcaagagtactggagtgggtgccattgccttctccaggtatgcagtctagatgccttatatgtatcgtgccattgatcatcataa

SEQ ID NO: 46493 - DNA, 935 bp, Bovine  19866881286555
atatctttcacacggatgacgtaaacttacatttatgaacttaaacatatgaaatggtaaaagagctaatgctaagatcttcagttaaaggatgcctagagatccatgaatggcattaccatccacccactaaattaagaaacctaagagccactcttgttccttctttcctttagccttcacatccatttcatcagccagtaaccctgcttgtcaactccacaagggaaggatcttctgtttattcactatggtacatacctggtgcttagcctagcatctggcacacggaagatgcttaactaatatttatcaaataaactgaaattcatgctgtccttgagattaacagtttttaaaagaaaaaaaaataaatccctcatttgataatttgttaaaatatatactaatttttttaaatgtagactatggaaatttcatccgccattttagttgctgaaacatattaaggctaaattctcaaagggacacaggtatgctgtggtaccggaatatgcagaagtagaacataatgactttattcaagtttgctgttacctgatccatgaatatttaaaagatattttattttataaaaacttacatctgtaagtaatggactgaccgttaacagagggcttaacctggaacacatagataggcttagaggcccatgaacccctaaaaattgcaaaacctaacatgtatattggcatgtgagagttttcactttttggtgagagttcaaagtgtcatcagattttcaaagtctatgacccaaaaggttaaaaaaattacttaactagaaacagtcacaaagtcttttaaacaggaatttgtacaataaaataatacccaacagctccatctatgggtataagtcattatcatgtagcagaaataatgacaactacaagaaatcagtgcatctgtga

SEQ ID NO: 46494 - DNA, 1348 bp, Bovine  19866881291443
tcacagagcaaggaaatgaaatatgaggatttaaacctagattagaactatcaaaaattctatattctttccactgaatcagagaggtggtaaacagaaaagataaaagagggcagagaaaaaagatatctcacctgcaacaaagaaaacaggaattcaatgaaggccaaatttgcacactgataactgtctctccctaaatatagcttctttacatgtaaaacagagtctggcatgtatgagaggaatgtctcattctgttccacgatccatagatagtcaaaaaaagataattccccaaaataatctgacagtaataataatctgcattattttcagggtcattttcatataacaccaaactaagctactgaagtcaactcaaacatgcactctcaaatttaatattactctcggttaccttagaaactccaaggaattttaaagcatgtgtcaatgactagattaaataacaataagaaagccttctccatcagccacgtaacccctaacagattaaacacattgactggaacagagaagcagtatataccactgattccagaagacaaaaacagaactttattttctaaagtatcagttcagcatctttctccggcagctattataaatgacttctattgccttattaattttctaaggccttttatccacttctaacaagacaggttcctatcgaaaaattcattccaaggctttttgcaattttgtgattaatgtaattcacactttgaacaaaagggatatttaattttggctgagactaaaaacttggcagtttctagtttcagaacaagagttattcactacgtttcacagcgtttgaatactgggacaaaaacagatgaaaaataagataacttttcttgaaagaatccaaggaaagtcatctctacacactgaaatatttctttactcaccttccttgcttcctgtttctgcaggcactgggagagatgcattgtgctgaacagctgcattggcaacagcattagctgttacagtgaaggcagtttggggaaccagccggggcatcaggggtaccaatcgacgaccttcaatggaccattctgaggagctattaggtccagacatactaaacaaaaaagaaaatgctgctacaaaagttcttgatagctaaaactgaatcaaatacatatattcaaatataactttttaaattataaaaaaagtaccctgagtgaacaggagaggctttattttaagcaagatcaaaactatgaataaaaatcagaatttaaggaatcttacatacacttaggttttcacacattttattccataatctgaatcttataacgaacat

SEQ ID NO: 46495 - DNA, 1274 bp, Bovine  19866881377413
cagcactgcagctacacgtcattgagtacctgcaaggcggtagctgggcttgagatgtgctgtgaatgtacaatacacactggatttagatggtttagaataaaaatggagtgtaaaatattaataattaaaaatactgattacacaccaatcagtattttagaattacaggaaaactactattaaaattagtttgcctattcttttttacctttgtgcaatgtggctgccagaaaatgtttaagtttctggatatgtagctcagactatatttcagtgctgatatagatgatatgatctcaactgtataagtaacacatagcaaactaacttaacagtggtttccctccctggattgtagggctattgtttgcccgtcatctgtgtatttttacattttccaaattttattcattgataatcaaaaagaatgatgagagagaaacaaggcacaaataaaaacagaaaaaaaaaatctctatttggttcaaagacttggctgctggagggtgagaaaagcagcccgggatacccaaatgacttctcactgacggagggttagcacacaaaggatgttggccagctgttctccatcctgactggagacagagaaaagcggaaatgggtgttaaccgcagaagggggcctgtaagttaaatatagggaagaatttcctgaagtgagggtgtttaaattctggaatgagttacagaagaagcctggtcccccaaagtcttttaaaatactacagatacccatatgccttgtgtattcctgtctagaggcaatgagataacttgtcaaggttccgtctgaaatagctgtcttaagagtaaataactccaataaaactttctttttcatttatttttgaccagccttcacttttcatattaaggatgccagccagtaaggagtactttgagaggcacgcccctctgatatggctaccttaagtagtactcttgagacttcaaagacaatgtcatttgatctaaatttaaaaaccagagtcagctagacgacatggtttttaagtcccttgggtcacgtgccagagactagttctgaattcagcatgagcaaatgatggagggaaggagagaagatagatctgcttttaaaaaataaggcgtaaaaaaacgttaatacaggatagggtctcattttcacaggtggatggtttggcttaaaagctgaactattatatcactaccctctgtgttttggtttttttttttaccctctggttttaaagaaagatgggttccaaa

SEQ ID NO: 46496 - DNA, 665 bp, Bovine  19866881447794
taaagtctctttacaatactgttgatgattttttgcttcagttcagtcgcacagtcttatctgactctttgcgaccctgtggactgcagcatgacaggcttccctgtccatcaccaactctggagcttgctcaaactcatgtccatcgagtcagtgatgtcatccaaccatctcatcctctgtcctccccttatcctcctggcctgtctttccaagcatcagtattctttggagacatttgtaaatgtgtgagactagtaatgaactggtgatccaatgggaagaaaagggatgaaaaaagagacttgtattggtttccttttttggaacagacttgcagagttttaaatagtagtgtgctagttggagcatgtctttggagacacggcagtaattttgatttgtgtccagttaaagctgcaacaaaactgccaatttataaggaattctgtatttgctcattttcttcagatagtaggccaaatggagaaattttttaagctgattctgaaatactgtactaaaaacccaaatgagcaaagttaatcttatgtattagcaatagaggattgcaggaaaacattttggatttttactttctaatactagtaatgagaccatttgtgtaagtataaatatagcatgcagatgtgacaaagaggata

SEQ ID NO: 46497 - DNA, 1179 bp, Bovine  19866881595450
acgtctgtgtgtgtgctgtgcatccgtgtacatgagaactgatatatgtgtgcgccttggtatgtctgcacgtatgctgccttagctatgtacatcatgtgtctgtgtctctctgggcaccaaagtctgggaatagtggccaagcttccaatatttgtgtccatgcccacaatgtgggtctgcaggtgtggtgtgtgttgccttgtgtgtatgtgggttgtgtgtccaggggtgtctggatcgggctgtgggtgagtgtcctcgctctgccctccaggatggtagtgtgagaagagcagaactgcctgtgctgagaagggctaaggtggctctgttctcagaggcctctactcagaccctccagggtagaacctgggggctccagggagaaactctggtgctaaagccaacacactgtctaagaatagaccccgcgactctggggtcctcatctctccctagcctccccccattagtagaggaggcggtcacccagggggacagccagtgcccatctggctcctgtgctgtggtccctcctgggatgggccctctgtcccagagcctttggggcttatttactttacagtcaagagctgcctgctgtaggccagcccctatgcctggaccttccacacacattatcttaaccacaagccactcttgggacaggaggtgtttacccactttttagaagtaaaaacagaggctcagaggagtgaaaggacctatccatgccacctctgtctcctgattcaaggcggctgcacagctgctacagaagccaggagagaacatgcagaaggggtgccctcaggggcaagcgactgtctctgtgaaagagctgaggctgaggaggcgcttggagctggcccttcccccttgaggagctggcctagcatctgcatggggcttccgtgcataagctcagatggaacgccagagatggggcctcaagtcatgactttcaagatgaatcagtgccagctggtccccatgaagtcccctactctcctccaccagactggggccatcctcctgtccctcggggtcggttcccagcaatgggacacccctggcctctctggggactggggttcttgatatgacagatagggccacaggggtctggaaggtccttgcggggccggtctggagggttcagttcaggtccttcag

SEQ ID NO: 46498 - DNA, 1100 bp, Bovine  19866880478841
tcattctaacataagtgtttaaattttaaaatatctccaccaatccctttttttccagaacttgtaaataagtgaatccctattattgtaaagatgaaactgaagtattttaaattgcagtggctcacagagcaaaatagcaaaatatataaaaactgacaaatgcaaaatagcactttcaacactgccctctaaagaaagaaaggccagtgtttctgaaataaatttctaaatttaaaacatattttctgtattcagagttttgcatgtgattataataaaagaaaaatttctagagaacaaaacatgaagtaaaatatgggcatttgagcaattatcagaggagaaaaaagtccttgaacttaagaacattttctcaaaagtaatttcttagctgttagatatcaaaagagtccaggcttattccttgtaaagcaagacttcagaatcctgctttaaaaactattccaatatggaaataattctttatattttatagctttatgaagtctttcatctaaggatctccaaaaggaaatgaaatacaatgactgaatttttgaatattaatgacttcaagaaaaatgaagcaattaaaaaagaaacagaagtctacaataaagaaagccagtttttaatgttatacataagactatctggatagttacagaaagtgatagctgatatctgttattttctttctgagtttctgtctaatcagtatcattttgccacatggaccaagtggagatgtctcagaagaaaacatgctttactagtaggaagctgtcccttttatacctatcagaacaaatgtattcataaaatgtttcaatattaaaacatatagcaactgcattcaagattgtttacaacccaaggcctcaaataggaaaaaaaaaatgttcgacctaaaaatgctgcaccattctttacagtcaaggccaccattaagtagtaacatagtgccctgtgaaatatgatttacaggtctctaaaagtcccatctgcttcaaaatgagagccatatatttaaaacagtttcttagatggccatctcagtctaaaccccttttgtcaaaaagggcctctactatttt

SEQ ID NO: 46499 - DNA, 1652 bp, Bovine  19866880782297
cgtgctgtgattatggggttgcaaatgagttggacacgactgagtgactgaactgaactgaactgcttcattccgtattccaaggccaaatttgcctgttactccaggtgttccttgactttctacttttacattatatctatatctatacttcattatgtcataaagtatagatataatggtgggttatacaatttgctgtaggaatttttctcatcaaaaattagtcccatcattcaatatttgaccatttctttggattttttccattaacagtttaaaaattgatgataattttgttaagtttcctaactgatatattaaccattctctagtcattgaaaatctgtttttagtagggaatcattctgattggcctgaaaattatttaacgtcctaaataactctgacttacagtgcagctgatatcattgcctagccacctgtgtaaggagattttggctagtaattgtaattatctattcaggaagctggccactagcatagctgctgttattgtgaagtatcaaggctcaaccctcaaaaagaatcattctgtgctattgtatgtatgtgtgtatgtttactgataagcttgtttggtatctttttgtccatgtaagactttctgccccagtggagcttataagctattgtagagtataggcaatagcattgtatgtatgcatgtttgtatgtgtgaatatagaaagatgagtaatggcacagctttgaaaaaattaactgaattgtggagatagagagtgaaaggggttactacctgtaaagtgatcaataaaagcttctttgaggtgatattaaaaataaataaataaaaactcaatgaatgaaagtgaaggagcaaattatgtgatagttttggacaatgatactcaaatgtaggggacagcaaataaaaagtcattgagaaaaaaccatatgtgaggcacagctggaaattcatgttaacattttgatttcactgtcagtctgctatggatattataacacagttaaatctccaaaaagtttttaggtctttaagctttgcctttaaagtgagagacagcagtcctggcagagccttctttatgggtttgtatattttaaattgacttgtttaatgccagcataagagacagtaacaacttctttattttctgagacatttccaaatagcaaaatgttaccaatgctattttcagtatagaaaataggatttttgctcagaatatttctgtcttcaatatatatctttaaattcgatgtttattgtgtaaacaaatattgtaaaataaaagaactatttgtttttcaaaatacaattatgacaataaccagggttgagaagggaaagaaacctaaatgacttatgtatttgtaatgtaaagatattatttgctgctttaatagttccctgagtgctagcacccacctgcttgttttgaaattttacctagttattgcttgtctctgggttattatttgtctccaacatgtttgagcaataagctttttgacgactttccatttcattcctccactttccattttgacctagtcgcactgcggcttctcacatgccacagctatcccattcagacatttgcctgaatccttgctctgcacttttccttcctgcaatgaccaaa

SEQ ID NO: 46500 - DNA, 830 bp, Bovine  19866880811935
ttgctctatccatttcttgtagggttatagagttcatgtctctgtcaggaagcattagcttgaggcaagagcctaagggcattcagatggtaatttaagtgtctgatgctacgctgtaagtaataggtttccattaaaaaaaaacaaaaaacagttctttatcagtacaataaaaatgtataagttagagattaggttgtagggagaatggcttataaaaaagaaccactagggaggagattatgatttataatatatttatcataaatgttaaaatgcatacacttgtaaaaattaaaaaaaatcaaaatatctttcagaataaatattttatttcagaattatcagttatattattggtgaaattagaggcaatttcaatcattgtttgtatgagattctatcacttttgtttccaaatcatttttgtctaaaatgttaaatatatgtgtctatttctttttctgaattactcaatgtaagccttggtgatgatagtgcaatgcttctctgcaagtctcatccataacatatttcttgatctaagtcattcattgattcattcactcagtaaattactaagcagctactatataccagacaggtgctgattgctgagattcaatgtcaatcaaaaaagacatattttctgccaagaacatggggagaagaagatatcaatcaaaaatgtatgcaaagaagaatatatttgtgaataaaatattataagaaacatggtattctgagagcacaaaacagttatttctcccaatctcataaatcaagtaaaacttctctaagggactaaaagaattccgaataaaagggaa

SEQ ID NO: 46501 - DNA, 855 bp, Bovine  19866881043280
cccctggtacttaggatcagagaagcccttagttaactactaatatattacacaatatcatagaaagtagaagcttcagaaatgaaaaatgttctggtctgtttattttaagatatagctaaaagcttgattttatgttatgtcagtttctatagttaaaagctgcattaatgtggctgaaatactttgaagtatgcagagataaaacaaatcagcaggtatttaaactgagggctatgaggtggaaaaatcatcactttcccttcaggtagaggcctgaagatatatctttgttaatgaggtttcctgctgtcctgctggatcttcaatcatttaaaatgcaaatcccaaagaatgaagtaagagctatcctatataaaagaaggtggctgatttttttttttttttaataaatgatcatgccatctgcttacctcatcattctactgactatgaaattcacttatgcaattatatgaacttgtaaactataaacaacataccttagaagtccgcaaatggaattattacttttcctgaatgcccaatctcctcccatagtttagagtttattcatatggtcaggaaaacaggagagtaagaattaacttttccgaacagtggacattctatttatggtttttatgttattatttttaatcagtaatatctgagttaattagaagaagttttgtaaagaattatttcaaagtgacctactgtaggtttcttgaatacttgaagagcttagtcatgcctgaaaatttttttcaggtaattttgtgtgaagtcaggaatgcaggaagagaacttggtttgtgtttccagaggaggatatttttttcctcaaggaga

SEQ ID NO: 46502 - DNA, 2635 bp, Bovine  19866880153565
ttcctcttccttttctaatccgcttgaacatctggaagttcacggttcatatacggttgaagtctggcttggagaattttgattattacttttctagtgtgtgagcttggagaaggccatggcaccccactccagtactcttgcctagaaaatcccatggacggaggagcctggaaggctgcagtccatggggtcgctaagagtcgggcacgacagagcgacttcactttcacttttcactttcatgcattggagaaggaaatggcaacccactccagtgttcttgcctggagaatcccagggacgggggagcctggtgggctgccatctatggggtcgcacagagtcggacacgactgaagcgacttagcagcagcagcagcagtgtgtgagctgagtgcaattgtgcaggagtctgaatattctttggcattgcctttctttggggttcaaatgaaaactgactttttccagtcctgtggccactgctgtttgcaatttgtaatgaataagagaggcaccttatttctaaatatttttaagggggcacagaaactgcccaccccaccaccccccacaaagaaagaaaacattcagaaaacacacaaacagcaaaaacattaaaaggccacatctcttagccacattttatagtgcattagcagatggtacataatcataattttgactagaaagcagaaaacaaggatggaatacttttcccctggttgattatgagtaattgtgaactcagcataaacccccaattatatgtacaccgggggcttccctggtaactcagctggtaaagaatatgccttcagtgctagagacatcggtttgatccctgggttgggaagataccctggagaatggatggctactcaccccagtattctggcttggataattccatggactgtatagtccatgggtttgtaaagagtgggacgtgactgagtgactttcactttcgtatatatactgagagcccatgtggtaaatctcaagataggacatgtctgatagtgggattttacagtaatgtttctgactcctctgatgggtttcttcaaaatatatccaaagaatgttgtaattatgacttcaatgtctcttgtcccactcacagcatgatactatacttcctgtgttcttgagggttataggcatgtgatggtgttctagtggttccagatcctgtctattggcagctctgtgtgtgtgtatgctaagttgcttcatttgtgtctgattcttggtaaccctatggactgtagcccactaggatcctctgtccatgggattttctcagcaagaaaactgtggtgggtttgtatgccctcctccatgggatctttctgacccagagatcaaacccatatgtctcatgtctcctgcattggcaggcaggttctttaccaccagtgccacctggcaagttcattgcaagccctaagagcatcctggctgctcttgtgaaccagatcagagtctggaaggagcctgaattcaccaaccttctctctctccaaaggaaatattttcaagttttaagaaattgccttttcaatgaggctttcactagggagcattgcagacttattcaatgcaatgaacacatgcatagttgctcctgtctggaatagcagatggcacatcctgtcttttaatagtcagtctcccccaaattctataatctccatttttctcatggccctattaagtttttttctgaatttcccgagtttctccaatagccattttatcttgtgatgtgtcaacatttatcctttcacactgaagtgattgctgtggccgtcctgtttaaattcactcttagttataggctaatgacggtcatctgttctgctagatagctatccattaaaaaagactacaggactaaaagagagggacacatctaagattcttgagttgatggaccaatacagtttaatccagagaactaaagctataaagaaagccacaggcaggcccagccttacggtctttgtagagttcatgcttggccaaatgccaacaccatcctcatcggatggtactttgtatttctaaaatatcatgtcttcactttcctgtctctggggaaagaagcagctttgttatttggcaaacacttctggtactgaactatttacagaattgctgaattaacctcctgttctctctcatccttcaggtgtctaaatctcagaaaccacctagggctgggtgaaagcggggatagggattctgtctgttctgaacaaaaaggaatgcagccaatttcctcaaatgaaatggcctgatcctcagtggagctttgtcagccagtgaccccctgaccagcaatgtcccctggggaggcaaacttgccaacctcactgtctctctgtcttccctctgcagacaaggttgctgatcttgctctagataagatcaggagtgttgcatcaaagatgcagcatattatgtaagactataataatactgctttgtttccagttgcagtgaaaagtggtactattgacagtacatatctgcctgctcaagaaattactaaaaacagaaatgcaatctccatgcaacactcccaccacactggatttattatggatcacagttgaaatat

SEQ ID NO: 46503 - DNA, 797 bp, Bovine  19866880181658
gagatccaaccagtctattctgaaggagatcagccctgggatttctttggaaggaatgatgctaaagctgaaactccagtactttggccacctcatgggaagagttgactcattggaaaagactctgatgctgggagggattgggggcagtaggagaaggggatgacagaggatgagatggctggatgacatcactgacttgatggacatgagtctgagtgaactctgggagttgatgatggacagggaggcctggtgtgctgcgattcatggggttgcaaagagtcggacacgactgagcgactgaactgaactgaactgaactgaactgaatgtgcagtggcagaagcaactgagagaatttttttttttttaatttagaactaactaaataaaccagaacttttggattgatatagcaaatgctccatttcaacagcctgataaataataaataggttattaaaatagcactgatcacatctcttcatctgacttcataacacaagaggaaaagacataaggctaataacttataggaaatttaaaactcctaaaaaggaaatagattgtataaatgagttacagtgttacaaatctgtagaacttacagccatgtgggaaatcactaagatcagttatttagagagatttaaagagcccttgcagggtccctgtcatcaactagagtaaattagcagttcaagtataggtattacaaaaagtaactcctaccctcaagtttctgtatattgcctgctaagaagagcagagggtgaatcccttactcaaaggca

SEQ ID NO: 46504 - DNA, 837 bp, Bovine  19866880431603
tttatccatatctctaattcaactcaactctcagattagtatatgacttatatgaaccattctagcttatttttttgtccatatttgcaaaaaaatgctgtctactttggtaatagttcagtcttttggaatgaccagatttgaagtgtgttgatcagttgcattacagtgttcattttaaaaatgatgtttgctttattaacttcttttcttttagttattagagaaattcaaagagatgaacagagagatttggggttagcgatctaagactcgggtggttcacagaacaaaaaagaaatgcataagtctcaaagggagtcttagcagccagagattccttatagcaacccatgatgaagcatgagtaaagtaattaatgaaagtagcattgttatttcattccataggcactagggagttagaaccgatggcttttggccactgcccatcttttttgttcagttgtctctcatgcctatgccagaagggtttggtcagtatttgcattattactcccactcacaaaactgacagtgaaaatgggatcttaataaggcaatataatggataggaattatatttttaaatcatcaaaaaaataagtataaatatagtcaaatatatgtcatgtaactttcacttaatctgaggacaggcacgtgagtgggtctttgatgtctccagaaaaataaactatgtgaatatgattaccatatggaaaatatttctccaaagttttaattccctatcatttctcctctatttgtctgaagctgctatttggaatttataataattcattttatataaagatccttttcttagttccagata

SEQ ID NO: 46505 - DNA, 1993 bp, Bovine  19866880529389
tatccatccacacaccacacatacacatatccatgaaaatatatccaatgtatgctcttttcctagattaagaatattctgattattttagttgattcagagttcaatagctgagattcagctattttttgtattgtttaggaatatttgattcttacaaggaaaaataggagaaattcataagctctattaagtgcagataagaagtcaggaagtagagcatgtatgagttaaacagagagaggatgggaggactaagaacactgattattcatgaagtattaaatatgcatgaggtaccagaagcactaaataacaggatatattaaataaacatgagccatatgaaacactcattattcatgaggtcttaattcagccacccattgatgatacccattttggccctgacagttctatgctcaagaaattcacagaaaactcatggctgttcagcaagttaattggcaagctatagctattagctgggcaaacatgttctgtgtatctgtgataaagtaagagtatattgtttgccctgggtgtcttcctcaggtgggctcccttgcttgaacctcgactgtcattctgggaccatatcatcacagggaaggtagacagacagggcaattgtgtaccatggattgtgtaccatggactcaggtagtacagtccttccaaagcacttgcattctatcctaaataacataaatccttactccagctctttctccttgctttatgctatgtgtattatttagcatgaatcacattagcattgtggttcaggcattttaatttggtccgtgaacctttctggtcctgacctctaagcttccttgttagtgtacatggaaattactattgcatccaggtacttcctcacccagcaagggtaccaagtcttactgctctcatcagtactatcctcttagttatgctgttggcagagaatggaatcggtattatttttgggtgaataaatactgcaattcttagttcttttcatcttcacagaagatcaacttaattttattttcatttatttttttaaatttatttaaattggaggctaattactttacaatattgtactggtttttgccatacattgacatgaatcagccatgggtttacatgtgttccccatcctgacaacttaattttcaaacacaaatcattttgttagcacaggtagacacaaacacatatctatatctatctatttatctatctatacgtatatgtactgtgcttagttgctcagtcatgtccaactctttgcaaccccctggactgcagcccaccaagctttctcagtccatgaggattctccaggcaagaatactggagtgggttgtcatgccctactcaaagggatcttcccaacccaggagttgaacccaggtctcccacattgcaggcagattctttaccagtggaaccaccaaggaagcccaagaatactgagtggatagcctatcctttctccagcagatcttccctatccaggaattgaactgggatctcctacattgcaggtgaattctttaccagctaagctactagggaagcccacacatatacactagtaaatactagttagaaatatcaaatgtatttcttagaatggcttgcaatcaacactcgaaaaacttacctctagagggttaatgatgaaagacactcaaattttttaatcttctcttatttttcacataagcctttctttctacattctcaattgctttctggacatttattttctctaggctatttagctttcatctcaaactgatactcctaaaactgaactctctctactttcaaataattttattctactaaatttccacatctattttattcactatactcctaattactcttggtcaaaccctttgtaatcttgcctgaatctttttcatctcttccttatcttgaaccatgggggtaaagtggatgtggaactaacattaattgagtacttgaa

SEQ ID NO: 46506 - DNA, 1616 bp, Bovine  19866880574772
caaaaatcagattcaaagatggagaagctctatacagtcaacaaaaaccaagaccaggagctgactgtggctcaaatcatgaactccttattaccaaattcaaacttaaattgaagaaagtagagaaaaccactaggccattcggtatgacctaaatcaaatcccttatgattatacagtggaagtgagaaatagatttaagggactagatctgatagagtgcctgatgaactatggatggaggttcgtaacattgtacaggagacagggatcaagaccatccccatggaaaagaaatgcaaagaagaaaaatggttatctgaggaggccttacaaatacctgtgaaaagaagagaagcaaaaaccaaaggagaaaaggaaagatataagcatctgaatgcagagtttcaaagaatagcaagaagagataagaaagccttcctcaccgatcaatgcaaagaaataagaggaaaacaacagaatgggaaagactgtcatttactcccctttaattacatttcagactatttaaatgcattagaagcacagggattacatgaagtactaaaatggcagctgcacttctagggaagaatgtgcttgcaatccatctttgctgtggccaatagttgtccatctgacattgaaactaggttttgataaccatgacaggcaagatgcttaaagtgatgtatttgctagaagtattgcaaaatgatgattcaggtattttttaaagcttattatcttcctcaaaatggagaccatttatcatttctctactgatttattcctgatagctagaaagaaatgtatgtgcctttcttgcctccaattacctttccttatctatggtagctgtattctcaattcatctttttgattacttgtaatttgaatggctaaagagtacccctcagattcattttccttgtaaaatatattgtttttaaattacacatgtctgtacgaggtgaataacctttaacaaatgtttataagagttgggacatcatagtattactaaattattgagctattgctcctctgtaattctgaagtaaatgctgctaattggcattgtacagtatgttaactgtactttatttttgatctgacagttcattcaataggtttaggaaactgggatagtaaaattatatttaaaaaattgataagctcattcttgtgttcctccctgttaccttcaaatacattataccaaaagagaaatattacatgtaagaagaacatacagataaaatagaattatatttggagagattaccccattattatattattgttggtatgtgattgaataagttatagtccatttattctaatgcttgattaaatgtacaaaaatagtgtggacaatataaaatgtaaaagttgtcatctgattacaaacattcataatgcatacttttattgcttgacatttaaattttgctatgattctgcagttatttacatgcaaacttaaattacaggacgtgtgtttatttatggtgcacatgtgttcagttcagttcagttcagtcgctcagtcctgtccaactttttgcgaccccatgaaccgcagcacgccaggcctccctgtccatcaccaa

SEQ ID NO: 46507 - DNA, 1151 bp, Bovine  19866880600081
ataatggtgtaaacatttttcaataagacctaaagttatctattatatatgctttgctctcctacttttaaattaaaacatctttttgcaagcatcaatatttgtcaaataattcattacatacaaagaatgcaaatatgggtcaaaaaagaacttactcatgtcattcaagattagtcaagattgatatgtcaataaatgattaaaagaatgtgagagaagtgtaatgatagtaatatatatatgtatatatgatacgatctgtggagttggacagcaaaaggatgatgctttgtgtaaaaagtgtcacatgagtgaaaatacagatgtgaaagctcaagacatagtggaagacttgcaaggagttagctgtagcttaagatgagatataaggggtattgggtagaagagatgtaggcagtgtccagaccatggaagtgtttggatgctccatacagtagtaagtttagagttaatataatattgtagtagaggagtctcacaataagttttacttaagagagattacatggggtctggtggattggaccagaaatcaactaaagacagaaagactttaggtaatagaattaaagaacataaccatatcaaacattcttatacaagacattgcatatcaaggaaaagacacagagaaacctgaatgctttgtaattaaatcttgcagtgaaagcctccattgcctgttggaagcaatctcaaggcttcctagtgttttgtgtcaatgatatagtgtgggaacaaatgacagcccaattagtctatttcctgcaatacccaagggggcaattcctcctctaatcctaacctgtttcattttaattctccaatgtcttcttttgttttgtgaattaaatgacctactttcagtaaatttcctttgtctttaacttagccagaattattttttataggatcccagttggctttgtatagatctgaagctgagctacaagttgcattacaaaatctaagagaacatctttaaatatgtaagaggcgatatcagtttcaaaatactcttactttgaaaagctaaacatcaatgcaatctcaagatattttaagaataccttgtggaaagtaacagtgagcaaaaaacagatttgacatgatcattgtatttaaaa

SEQ ID NO: 46508 - DNA, 768 bp, Bovine  19866880619423
ttattatgatagcattttggtcgtttaaatataatttacctatactaattgagaagacagtccttctatcaacagtctagaggtacaactactcattttggtgtttgtacaattcataatgtcagctgatgtcacgtttgctttagtttaaagaggatccaagacagtctacttctgaaagcaaataaattggcttcattggtatgtgtcaaagcatgcttcttctgactgattgttaaaaactggttcattaacttgtttttggaaattgcttggtgaatgaagtgatattgatgacttagaactgctcatatggttcattagcatgtcatctgggaaagctgagttgtcttgcatgaaatgatgtttgttcaactatcctaacagctcagtatgtgagtgtctgggtctgtatgtgaaagtgtatgtatatgtgtgtctgtgaaagtgtatatttgcataaacacattgattttaatcttgccatatcttgaaacaatagtattgcctttcttctcgtttatgattttttgatacaatatttttggttgaccctagtgattctaaaggacagtagtgcaatgtatgtgtgtgtgttcagttgtgtctgactctttgtgaccccatggactgcagcctgccaggttctctgtctatgggatttcccaggcaagaatatttgagtaggttgccatttcctactccagaggatcttcctgactcagggatagaaatcatgtctcttagtttccgcatggcaggcagatt

SEQ ID NO: 46509 - DNA, 1686 bp, Bovine  19866880729637
aatgatagcgaagtagtgtgtttatctctctaaactgatgcagatgctagtgaatacccttataaagttgcataattataatagtaattttatcaatcaatatgtaaaaaaaaagtgaataattcttaattttttctaatgttatctatatattttttaaaaatatatgcaaaaagcattaagttctatgataggaattcttttattttattttcatgggcagaaacttgttcccagagagttttcaaatttgtaaaatgtttccccctctctgtgggattttccaggtcatgctagtggtaaagaacccacctgccaatgtgagaaatgtaagaaatgtgggttggatccttgagtcattaagatcccctggaagagggcatggcagctcactccaatattcttgcctggagaaccccatggacagaggagtccagcaggctacagtccatggggttgcaaagagtcagacatgactgaggtgacttaccacacacacacacacacacaggattttccagtagaagctaagtaagttttatctgaactcacccaagattatagaaaaaaattactttggaggggaggcaaagataagaagtgggaaaactgggcagtgattgatggtcaaatagcattgctttcttccatttcattaactctaaactgtattgaataccatttacagtgcagttaactcctatcctgtggtgtcttccaggtgactgctctgctcccaaaagtctttatgtgtgacatgtcatttcatactttgacatacagtagaatttgattttcaatcaacttaacacataagacttgtcttaaaattgctgacaaacctgatttagtttcatgggttgccaagtgcctacttctttgcttactgctgttcaatgttttcttaaatttatttaatatagaaatatgtgtttctgactcctttattcctttatcagtccaaatttgtctctaaaagtccctacaatgacacacttgtcctgtgacaatagtcctctttgtgcacattgctttctcacatcagaactttcaacctgcatttaaaacatcccaagaaccttctgttcacagcattcatttttgcattgttcatttgtgtcttcacaaatagatttcaatttttgaaacaccataagctgtaacttactgtatgtgtggtctctctctaactcataaacctgtgtggatattaacagtacacaatgcacgtgtaggggaggaaaattaattttacctatacctttctgagattttagttgtaaaaacagacagattaacaagagggaaacaaacagaattgtattaacatgtatatctcatgtatacttgtgagattcacaggggaaaaatgaatgactcaaaaaggtgacttagaattcaggcttaaataaatgggatatagaaaaatagcacagataaacctatttgcaaagcagaaaaagagatgcagatgtagagaacaaatgtatggacagaaagtggggaggagggataaactgagagatcgggataggcatatatacactgctgctgctactgctgctaagtcgcttcagtcgtgtccaactctgtgcgaccccatagacggcagcccaccaggctcccccgtccctgggattctccaggcaagaaccctggagtgggttgccatttccttctccaatg

SEQ ID NO: 46510 - DNA, 2374 bp, Bovine  19866880735452
ataaacatgaccttaacttgtctaaaatattgttgtttttaccaaatttgagaatttatagcatttgctatgtcctcatatatgaaatggagaaggaaatggcaacacactccagtattcttgcctggagaatcccagggatgggggagcctggtgggctgccatctatggggtcgcacagagtcagacatgactgaagcaacttagcagcagcagcagcatatatgaaaagctaaaaaatttttagttcttttaagaatgaaaactgtcactatgtgccagtttcttttaatgaaatgtcacctctcagtcctaaaagtgttaagcattgtctttgaatactttcaaagattgattatgtatgtcattttaaatcttgtctatgaaaactttaaagacgatgtgtcaacatacataattccttctgactgtcctttttgagcaaagaaagatttcttttggtaaaacactgaatattttctaagttgtcttatagttacatgtatatttatactatgctttataatcattaggggaagaaacagtgggaaaaatgctattttttctatctatattttgtgcaagatattttgtgtatatctcatttagtaataaatgtttagcaagttatagctgtcatatttaatattaaattataatcttgttccagtgtctccttggaagggattgtaactgttatcacattagtgaagagaaactctattaacaaaaataagtaatttaactaatagaaccaagatttaaaagtattcaattacagatatttattgagactagtcattaaaagtaaaatatgtctttatatttccaactattaattctatataaaacactgtcatataaaggtttaccccacataatgccaattatccatatgtttatcatcctgctaaaaacagccattcaggttacagttatatttctattttggtcaaaacatgtgttgctgatggtatttcttttctgcccctctcactactttctcattatcctttcatttacaactgttactagtaatgtttgttatttttcaagtcatttctttcttttaatccttaacagaaaaagacaactaaaatttcatttttagtcaagaggtttgaggaaagttttcttgctgcatgcagttgaaccagatagcttttctttatctcagaaataagatagttgcactatatcctgcaaaataatgggaacccactaccaaataggtatcattttctcttattcagaagaaaaactgaaagtcaaaattgccttttcaattctataagaactggtgtaagtcttagagcacattgtgcagaattcaaaaatggtttgactagatttttgtgaaaaatactttgaagataaaagtcatagtcaaatatttaagctttatgtaaaatgaatataagaataccttgtaaagacacaaaatagccaaaggcaaaccttaattgctactactttttggttatctagtttcagaaaataagaaacaatgataaaatatgaagcctagacttaaggtgaatttataatgctttcatattgaaaaactttcccaaaaaatgagtaaaagtatttgacttataaaaaaacaaaatgggactgacataaatatttcccttctgaatcaggttttttaagaggctgtgttgcctagcaccacattagataaattacaataaattaatttctacaatttttgtcaaaatgaccaagtttgttgggggtgatttgtaataactgacaaaacataattgtgaaattctctagcataatcagaaatcagtttaagataatattgtcaaaactaaattaaatgtcattatactataaaatgttagccacaactcccaaaaatatatctttttaaaacaagcatacatttcaatcacagcaatcttatttggagtcaaagcctgacctgcaaattgtgtaaggctgtatctggactttaaggctatatatggagcgaggagagtgaaaagcttaaaattcaacgttcaaaaaactaagatcatggcctctggtttcatcacttcatggcaaatagatgggtaaaaaatggaagcagtgacagattttattttcttgggttccaaaaacactgtggactgtaacttcaaccatgaaattaaaagacagttgctccttgcaaggaaagctatgacaaacctagacagtgtattaaaaaacaaagacatcactttggcaacaaaggtgtgcatagtcaaaactatggtttttccagtggtcgtgtatggatgtgcgagttggaccataaagaaggctgagtgatgaagaactgatatcttcaaagtgtgcgaagaagattgttagagtccctggacagcaaggagat

SEQ ID NO: 46511 - DNA, 804 bp, Bovine  19866880820255
atatctgcgtctctattcctaacttgcgaatatgttctctataccatttttctatatatgtgttaatatataatatttgtttttctctttctgaattacttcactctgtataacagactcctatggttagccactgatctttccaactctttacactcctcagcagaacaactgattttggaaaccatataattcattattttaaaaaacttaaaagtagtgaagcagaaggacactaacatttattggcttctatgatgtgtcagacacagtgcaagctaagtcatttgcatatgatatgtttaatttttataacatttccactttacaaataggacactgaactctgtgaaggtgagaatactgttaagattgttaagagataattgtgcttggatcccttatttatctaactgggaggccccttattgttattttaatgtactaaaaattggagggatcaagaaaaagtttattcaaaaataatgtgctattaaaacattcaaatatagcaaataatatactgctgctaattgtattagagcattttccactaaaatactatacattgaaggaagaaatgatgtgagaattcagtggagttcagccaaaatgactcacatagtaatgttctttcttcacctttctcatgtaacacatgtagttatcaattctgtacctataacattaaaacacaaggtgtatgacttaaatcttattagagacagttagatatttccatgttatgattgctaaacattttgtgagccaatgaattatacactgactttttagttacttcta

SEQ ID NO: 46512 - DNA, 1069 bp, Bovine  19866881024336
aagcaagaatgagactaaatgtctcattccccattccaatctctacttgataaagacagagactgtggctgtgtaaaaacatcccaatcgtatcataaagactgataggaagatcactatatactcctataattagaaataaacaaatgtaagtggacatcacacacacacacacacacacacacatacatttgtactagattgcagctcactttacaactctacagtctctgcagagcttccaagggaattgcctccattgtgtgtataaactataaacattttatgtttcttccgaaatctgagttagttagggggaaaaaactgatatatttttcaaaatcaaaggacatgagtttgaagaataaattggtgcaggagttttcaagcatgtgtaatctagaacaatatttaatacaatattttcttctaattttgcttgaaaattctcattgtcattattctcttgctacctaaaatgttaaaacataaatgtaccctatgcctaaggtggaaatgggaaatatattttgtatgtataataagaacttaattattaaacattgatcaagtagaataaaatataatggattaaaccaaagaaagaaaaagaaaggaagggaagtaggaaaggaggaagaaaggaaggaaggaaacaaaccatctggcacttgacttttcctcagaaacaccaagtttacacaaagggaagtacctcagtgcattttctgctttcagcctgaggaagaagaggagaaataatgacctctgagtctacaaaatctctgacaatgactagaagttagtgaggaaaggactacaacaaggcagatgtgcttttgactctctattctgtcaatattacttactctgtcagttcagttcagtcgctcagttgtgtccgactctttgcgaccccatgaattgcagcacgccaggcctccctgtccatcaccaattcccagagtccactcaaactcacatccatcaagttggtgatgccatccagccatctcattctctgttgttcccttctcctccgaccccaatccctcccagcatcagagtc

SEQ ID NO: 46513 - DNA, 1327 bp, Bovine  19866881031612
ttgacagctgcatgggtcaattttgaaagatcaattttaaatgaatgggttgaaggaataagtttacttcaaatatcttttgctgagtcttagcaatgccatcattgattctgatcagggctaaaagcactatgctcttttcccaaataaaacatttaaagtacagctttctgaacattggaaaaaggtgtaataatggaataataaaacagactaccattaccactgtactgaaaatgacagacaaaataacagtgagagacattgctggctctgtttttacttatacaccatcatttagcaggattcctcagaaccttatttccttaacccgttagtatgcagtgctaaaaaatggtgaaataaacttagacatttttaatactgcatgatttatcagaatctttaatattccaatgaatatagtaaatctccaagaagagaggcattctgctatattttctaaacctatttgttcacagattttccttctcacaaaccatcttaaaagaagtaaaatgtctctagtgttccctctgccttgagagagaaatcattttccttattcttgtctcttcctgttttggttaaaaatagaatttgaatcacatatagttgtactcatattcataccagaatcactcaaacatgtatgaatatatgagatagcaggtgcagctaggtatggggaatacacacatttaactgataaggatatttttaaccctatgtcaaggaactcaagatgtagtcattttctttacccaactccactatcctgttttgggcaaggtgtcattattctgtgacttcacatctccctgaaatgtcctctgttataatattttcttcattatatataattctctgtgcccatgtgtatcccctaccacttcttgagtagactgcttggaggagattatgcttggtttgagttttagaaaattggcagagaacttagcggttgaggaggggagctgaaaattttagatagaatcaggagcaagaatctcaaggttgtaaaacttaacaaggagcacaagatgagagagaatagaaaccaagattgaagtggggttacagagaagcttgtataatttaaagcagccaggactttatcttgttatgtatcactgaaggaactcaccagtgataaggtttgacagtagaattcaattttcacttttaaagatcatctagggtcacacagagttggacacaactgaagcgacttagcagcagcagcagcagtcataatgtagaatataacataattctgtatatttatggctagttgggcatcaggccggcagaccctggtttttga

SEQ ID NO: 46514 - DNA, 1959 bp, Bovine  19866881043542
tgatctattctaaagtttaaaatgatacaaatatatgacataagtacctggggcagagggcaagaataggtggaggttaggggcagaaaaaattatacaggaagaaccggaataaaaacattttttttttatttcaacggttaagagactccatttctctcttttctccctcttgcatcttctggtaagttttatattagacccagggttcagaggcactatatcagtaatttagcttagatacaatatgggttaaatggaattttgcaggaagcaacaactagacataacattgtagtgcaccttggagaaaacatatttagaatcccaactaccagacctataaataaaattttataacagaacctgtctataaatgaagagtttttcacctaactaaaataaacactgcttctcttgaaagcaggcgataactcttttaaacattttctttatatttctggaatgtttcaaactgtgttgtgaaacattatagatcccccgaagtactatgagatagttcttctctcaagataatatgtttagagctgtttgctatagtggcaaaataaatgatgtctgaatgcaccggggtttaaaactgtaagagcaagcccataggtttgctttgcagctatgactcagccatactgtataaaatgagtgtctgttccttacaatatgctttaaaataatatttacatgagaaaggaagcaattttaaataacttctgcagatttaatctaatgactgaaatataattacaaagttgaagtgtgaacattatttttattttatgcataagttagttttgcagaaggaaagagtgatccatttcagtctttgttctggaaatatagcatctcatatttaggaagtatcacgggctctttcatccaacggtgtgcttcaataaatctcagcccatgaatgattgatctcaaagaattagaaaacatctctagtgtgatcaattagatatcttcttattgtggagttctagttcaaaaggcatgacattctagagcctatagttgtgaattattgtactcctgaatcctttctcctttggcaaattctgatctttccaaaaagaacccctcccccctccagattcatattcaaatgctcctatgttcaatgatccttataatgcagtttgatgttttagtatctcaaatgttgattgagttcaagtttaaataatactgtcaaagttgccatagatattttgaaaaggatacccaaacaatgtacttcacaaagaaagatgaataaaatgatgcatgattggatacatttcacattgataatcaacttgctaattttagccaatatcaaatgttaagcacacaattttctgtctgctgaggttgtacatagacctgtgattatttctggccactgatgtgtgagtggacgaaatgggtttcacttttggactgctaagctgctgctaagtcacttcagttgtgtccgactctgtgccacccaatagatggcagcccaccaggctctgccgtccccgggattctccaggcaagaacactggaatgggttgccatttccttctccaatgtatgaaagtgaaaagtgaaagtggggtcgctaagaagtcggacacgactgagcgtgtccgaatcttagcaaccccatggactccatccatgggattttctaggcaagagtactggagtggggtgccatctactttttgactaggtatttcatttttgatggtcagttttcttgccctctcctgtcacatcatagtaattgggaaacatgtgtcagaatgaagcctccaaacagcctggtttgtgagtgacagctttgagccaaggcctccacagcaacccacactaggcatgtaggatatgtaagaactaaacttgttttgttaaagctactaagcccaaatatggtagcaaaaataaacctatctggctaatatgaat

SEQ ID NO: 46515 - DNA, 766 bp, Bovine  19866881056801
tatcaatctaccactgattcaaatgatggcatatgaagagggatagaagccatgtgaggctcatgttaattggggtttgctctagacaggtgtgtcttttccagtaattacaacttccaggggaatgaaggaagcataacactgtcttagtctttgctatcgcttctatcttgttcttctttttaaaatacgattcagcagtttcctgttgatttctttggtaggactcagaattaattacctcttcatcattgcactagaagtcgcctccattttaatcattaaacctgcaattcaaagtcaaaattattttaccaagtatggaaccaaagaacttagatccatataaaggtatttagtgcctgtgccatctcatagcaggcttcccttatggctcagctggtgaaagaatctgcctgcaattcactcatgctactgaatgagttgggtatagatttaaaaagtgtggtaaattatatatcttcaggaaatatgttttattgactttttgttttagagtgtatgtgaatctttgtgtttttctaacattgctttattggtattattttgttctagtaattaaagtcacagttaaacaaatgttttatccaaagtgcacaaatcaattccaaaagatgattggaattctatggctcccatttatataacatttatttttgttccttattttgttaagagaggtaattggatcctgtagtcctctgtggaatttttattttgtttaactttcatgttaaccaaagta

SEQ ID NO: 46516 - DNA, 1513 bp, Bovine  19866881114141
cccacaatccaggaagtatactctccaagatatttcaatatgttataatgaaagaaaccaatgaaatacaggttgatatcatgccctatgatggatttaacaaataattagttctgaaattacagcattcattattggcctttctagtcaatcaacagcgtaaactgcctttgaagcttgaagtatgatatttactgaattcatctactctttatcttatataatttttatctccaaaatatgcaataatttatacaatgtttactttctgaataatgtgttacttctctactttattatttcctggggatagtttgaagcaaaattacaaagtctgatataagaagaatattttgccaaagggttttttgagactagaaatctttcattgtaaagtctagcactgccccaggaagctctaagttgataagcaggggagttatggaatatcagtaaatttgaagataaaagaagacattctttgcaggtcaaatgaagataacttatttacaacttcatttttacttcaccacaaatgatttggagcttttctaagtatataacaaggggaaaagcttcatttaaacttcagtgtcaaacaataaaaggagcattttcttcaaggaggtccattatctaaatatcatttgaaatgtattataaaataaaaaggtagtggtattgatgttagcaattgtaaaaaaaatagcctttactttttgaatccaattctctttcagcatcaaatatttttttttactacatgatagttactcttgctggggagttgttttgtttattttataaactttttttgtgcagtgccttctacatttaacctttttgtacatgaacaatataaacaacattagatttttttatagcatgtccatgtggaaaaagttatcttttgaattttattaggataagctcctgtaaaaaaacaataatatgcatgctgctgacttaaaaaaagaaaaaagaatacacacactcaacatgagagttgggagttaagttttaattggggcaaaatgaggactgcagtctgggaaacagcacctcagagagctcagagaaattgctccaaagaggtaagggaaaggtcagtatgtatgtcattttggtgaagggggagtgtacacaatcaagcatattttttggcagaaggtttctgctagtcttgagaaacactcatcaccatgaaggattttagtgcttttctagatatgaggaaatataagaattgagctcataaaatctgttcctgaaaatatctgaagacctgttttggcagtttttcccagagcacagagtggctcactgctttcctctactgtggactcctttctggtgttgaacattattagctgcagtagcacacaatttaatcctcgtagaggcagatggcaagtgccaatttgtagttaacagtaacaagcaacatttgatttgtcacatgatttgtggaaaggggttctgtgtatagttgggggaagtcatgcattaagaa

SEQ ID NO: 46517 - DNA, 1365 bp, Bovine  19866881114834
caacagtcagcttgcatagatctttcttgtgcatctttacagatactatttatacttagaaatgtttgacttgtgagttttctgttgtgtagatttaataattggacattatttctgtttgttcttgacaagaacctattttttttaactaggtattttcttacttcttctgagcttgtttccaaatatttccagtatatttttatatgttctttgtttatttaaattgattatagcattcaaaaaatggtcctgtaaaatattcctgttggtgaagaaaatgcacatcagccctgactacctaaagggaatgaatgttttcccagaaactattacaaagatatgtactgggttggatcattcaatatttatctttcaaagtggcattaaaaacataaatgtcttacatatattatatggattttgcatctttctgcatttatctgggaagaatatttccatagaaaagcactaatattggaaatcagtatctgaaaacataaacatcaaatacaccttatttagaatgcattctatttttaatgccctgtgaatgtttaagaaatatgtagtacaaggaggaaaatgtaaaataaaaatcaatcatccccactcattctaccatctaaagaaatccatttgataaatgtttctcttctaatgatttttcatgtattatattttcttgtagtagacaaataagcctctgttcatgaactcatagtctgtgcgttgcatcactgcttcaaaattaattgcacattcatatatacatgtatttccacataaacataatggatattttaagtcctcacaataaaaaagggggggggttattgcttttatctctatattggtagtctgaaacatgatttaacttctttaaaaaaaaaaagtcctaaagttgattaccatgtgaaactatttccaccattccataaagttgctagtttataactgattccataataaaactatttgataaggttttgaaattactttcaaagcatttagctttatgcaggcaattaatttgcaatgaaaagaggtaaggaactgaaatgaccatcacaggaattctggtattgcttggctctctaaatactaccatttgctgaacagcactggagctctcacactggaaaacacattgctaagcattttcatgaatgaactaaatatagtttaaaataactttaagcaatttttagtttctatattatccttacacatgtcttatgtagaataatatatatttctcttgattgacttttttgagtgttcaaaatgattttacttactttcaacattttttaattggaatgttattgttttgcagtgttgtgttattaatagtttctgctg

SEQ ID NO: 46518 - DNA, 777 bp, Bovine  19866881298607
ccaaaatgagtaattcagactctaacgggtggtgtgttttgtttacctatacagtctccatcattttcccatgttatccaagatcattccataccaaaccatctttcctcatatttctgaatcacactctaatatttgatctccaaggatgttatttgggactctgaaataatggccacattttccttgctcacctgactggtgcctattctcactccagcattaaagggtaacaccttaaaaacattttttttttttttttacttcacaagatatcgtcttctgtgcttatatacatgtatcatatactttgttttaatataacacttttgaaggaaataagtgtttgtttttcctgcaaagtgaaaaattcatagcatgttaaaatgcatcattcttctttacatacctagggaggagcttcaactttgacatgagtactcagtgagaaaaagagagagaactatgtttgatttctgacctaatattctttacaccatgtttcatatgtgttttaatttccccagcaagcagtcacaaacctctttctaatctttttaacatttaactttctgaattcaaagtcctgttctctactgcttttgctaagaaaactgaggtgatattctgtaattcccttcagtaaagggtgttggaaaattctattccagccagaggaagcagttatgatttatgtctataatattaaataactcccttttgagtcatgagttttattgatagcagttatctaattttacttgtcatttttttcag

SEQ ID NO: 46519 - DNA, 807 bp, Bovine  19866881787123
tcaacctacaacattctctatctactgtagagagcacaagtcttaatcagtgggaaaggcgagaactgcagtccttaggtcattagtgaaaattcattatgaatggcaaagggagcaggaaacaaatcctactgtggatgagagacagtattatatgctgaatccacaaccatggctaagagagggacacgaagaactgggtaggccacaactcatagacccagtgacacaattgcatgcccaaatctgaggcattgtcaaaaaaacaatgaacacacccactcatcacaagctaacaaggtacagataacaagtagaaacataatattgctgacaaaggggcaagaaaggaacaagaacatgtagagatactgtgttaaaggcactgcaaaactgaaaatcaaaatctcagaatctagcatttctttggtaaaccatcctccaccctgcctacaagctatctctacagaattttgaaatctgatgtgcaatgatagtaaccatagcaacaaaaatatcaatcctaacccaagtcctaagtctggtaaatgaaatcctgctataaaggtatagtggaaggaaaagtgtacacatgaacattatcccagacatgaacattatctcagtctaagctactcccccagaaaatgttcgcctctcatcaaaaaattctgaggcataagaaaaccaaaacaaaacagattctgaagagacaaaatgatcataagaatgagactcagatgtgacacagacataaaagaatcaataggaaattttaaataatcaggttaataagtttaaggcact

SEQ ID NO: 46520 - DNA, 1051 bp, Bovine  19866881972982
ctgattttagctctcgaagccctctgtggtgtgatcttgagcaaagcacatcctgattaaccttgtatagtgatatggacatcttggaagtacagaaaggagagacaactagggagaagcaaaagagggacagaaaaattggaaaagcatgcattcataaagttatttcattagctaaagcttggtgatatcccttaatgaaatctttatgacacgtatcaaaagttcagatggtccatggtacttggttaatattactctaaacttttccagaacagtctttggggactctttggggagtaagttgagattgcctggagatgcattggctctttcatgaccctagagttttatttcttgaagtatataatattagaaactcaaagtacctaacttgctcccagggactcattgatgatcagagagacttggcttcccacgcagtggtgttgaggcatcagaattgggaatgtcaaactgtggtgatgtatgctatggggaacaataaagatcaaatttatgatcctctctgtacttcctcaggaatctgcttatgcatgtggagctgctctcagcatatctgaaaccatgcattttgtaaaatatcagttttccccttattgactcactgtattgagagtttgttggtatgtgttacctaatgaagtgagatactataacttgaaccatttttttctctttcatcctatggaaataaatcagacagtttaatttattcatgtgcagttggagtcaaattctctttgtattttcatggtggcataatagctctcagaaacactcccatggtgggaatgagcactataataagcatagtctcaaagaatgatttcagattatactctaaatgtgcacaaaaataattttggaaaactatattatttacttaatagtccattcttaggcagtttgaaaatactgaatgaataactaatgttatcaaccaccggaacatcttgatagagctagactgatcataaacttgatatattaggatacacagttgcatttccaatacgatatgtctaaa

SEQ ID NO: 46521 - DNA, 1137 bp, Bovine  19866880411858
aacccatgttgtgcaagggtcaactgtatacttgtattaatatatgggaagtcatggggtgaaggtctatttgatgtagtcaggggagaatggacaaaggagtggaatgtttttcctctgaagggaaggaatattgtcaaggttctcacttggcactatattcaaaccctgaccttggcacttaggcaagctatctaacctctatgatcttcatcttcctcacctgttaaatgagaacacgaagtacctactcgatgggttttgagtatcaaatgcaattgttcaggtggctatcctcagtatagtaagagtttagtctacttcaaaattaatgattaatcctagtgaataaggacacatttttgatagtatagtacattctgattttatatccaaaaagataaaatgcactgcgattgagctttgccttgcacatcagaattaaagttcaactcagaacgcttatttcaccagttacctatttaacaacaattgaatgggctgaatgctgcaggttacatttcagtttttaatcttaccactgaacaatatggttaccctagaaaggttttaattgtgacatttaagtttaaccctattttctcattgagactcagtaagtaccgcttggaaatcctctttgtaaatttcccttgtttgttattatatcatgtttacacctctattatactgagtcactcaagcaaggaataaatggtaattgggctacattaaacctactccaaattggtttccagagacttgaagtatgatggaatctgttttgaaaatgtggagatcttcagtcctgggtgaagatgtcttaagctttctaagaaaaaaaagtgccaccacagaaataatcttttcactctatttacatgagtctctgttttgaggagaggaaatggggtttgcattttgcaatttttcaaagttattttgtcatactaatctcggatagtggaagaacttggaagacattcctcttaatgtttcagaagcttgatttacatgacagattatgttactgagagttccactattgttcaccaagttcaaagagttagacaagtgaggaaaaaggctcttttgcaaatgggcctagatttaggacttttcccccctttaagttaa

SEQ ID NO: 46522 - DNA, 1208 bp, Bovine  19866880638857
ttaaagaaagcatgagccaaacaggtattttattgctgtcttcgctgtcaccttaaatgattacagaaatagaaaggctggttcttgactctctttcctaacaggcaatcccccaaagtagtaaatacaataccagaccagatcttttctcactaagtgtttccctttgcttatccctggaccaacatatatttcatgaatgagcaaacagaatgtcataaaggaaaccctgtgttttatggtagctagctgcatttagtttgtgacattacaggtctattgctaggtgtgtggcatcttgtactgtttggataaatttgagctatggaattaatgactcttggtcttcatggattagaggcaggtagcaactagagttgggttggttcataggcattcacttgcaaatattttgttttctgtcatcccttttgtgacatttctggctaggtggaggtgggggaacccaactcttccttgaaggaaaaagttactactttttcattttcacatgttgacctgcaggccattgaaaagttggaggcttaatattgtcttgtcctctcccttgtgatttcaggtgtgggtgaaaagcagatttcttcctccgtctttccttcttgtgctgacctggctgtgataccacctgtccttgtatgggcgtggaacctcgaagctgtattcttttttcctctaatatgattaactctctggctcccaagggcatactctccacggcccatggcgtacgaggcccttctcaggttgtctcagctctttttccaggcttacttcctgctgtcccctacctagtactccaactcagccacattgggtgttttgccatctggtaaacacaccaggtgctttatagtttgcatgcctctgttcacatgagtctgaccactgactgctctcccccagtacacacatctcccttttagaaataactgtcaacttccaatgcccagacttgtttttctctctaatccccaggaagaaataggaactccatcctgtactcccatgtccttcttcacagtggagagcatctctacactgtagggtggttggttatatttgtcatctccagtgggtggtaaatccctcaggtcttactcatcttctgtatttgacttgaaactattgtatggtgatagcaaagggaacagaaactctggaatgaaaaactctaggcggaatctcaa

SEQ ID NO: 46523 - DNA, 1041 bp, Bovine  19866880664342
gagtctgtaatgataatctgacacagtaaacaaaaggaagttgggtcgctccctaagcatttaaagtctagccctggtccaacgcttgcagtcttcttctctccaggtgaggtcggtgggagcctgtgacgagctgtcagctccctcggatcggggtgaagaacgcctccccacaaggttcacccccgggagctaccacctccccagcagcccagctccggttctggcagggacaggtgctacttcctttactttgcctgataatgctatcatttccctggcgggttcctttggctggtttttgttttttatgctacgggagttctcaattagcctctctcctccaccatctgctgatgacaacgatggcgttcgtgacagcagcgacagaggctccgtcccgtctgggctctgaagcagcgagagggcactcagagcctggctccagaccagagtcgctgctcgcccgctgtgggcagaccagagatgacagagatggggaggggctgagtttgctcttagaagagcaaataaaatgaaacaattccactcctaggcgtttacctaagagaaacaaatgtatgtccacaggagcccttgtacacaaatatccacagcatttttcttttttaccacctaaaactggaaataacccaaacgtccatcagctgctgggtggattaacaaagatacatccgtacaatggactgctacttggcagtaaacaaatttccaacacacacaacaggattgaacctcaaaaagcattatgctaaggggaggaaaccaaagacacaaaagactacttactgtcaattctatttatgtgaatctctagaaaaggcaaagctatagttaaagaaaaataaaccactggttgccaagggttgggagctggggaaacagattgactacaaagggttatgagtgaccttcggcaactgatggaaatgtcctatatcttggattgtgctactggttagtaagtatatacattcatcaaaactcatttcaactgcactcttaaaatgaccaaatttt

SEQ ID NO: 46524 - DNA, 1078 bp, Bovine  19866880730809
atctgcaacttcagaatgtgcatgtccacgtccccttagtctttgactttggggagtatggagagaatggtaggctcaggaccaccttaagtctttgaactcttttcaacaaaggtaccatgatcatcagctatcaccaggacattggtcttttaacttctctttgacccaatcctatcgaaataggcaattccatgacttcactacacgcaacgaccctcttatttatagacaatgtgactgaagatatgatctatacatttcccatatctaaaatgttcttatttttgagatttcaattgggtatcaaaataataggtacaaaaaacacgctcttttagaaatacatatatatttaatacaataggcatattttgaaatggcaagagtaaatacaattttggaaaattaaaccatgttgtgataaggttgatatttaaactcagtgggaaatcaagttaaagagagtcccttcaaaatgcaaccaaccactccaaagtatgggaaaagatgttttaagatgtgtgtataaagccatttaattcaccaaatcgacccaatcccgttacatgaatgcaaacaaaaatccccactttgctatgttgtaatgaagtctcttactttgctttgagataatgctcctggttacttctttcgatggcccacacggttactgcacttggacttgacaagcacagctggcgccaattcatggggttaaaagtcatctggctcacatctacaccgggttgtgacttcctgcacagaatgacacctgattcccagttcctgagacaaagttgagtttggtgaaaaataattcatttgaatttcatgtcttgagaacatatatctaattattgggttggccataaagttcattcaggcttttccataagagagaatgaaaacctgaatgaatttttggctattcccaaaacttgaaaacaacttacataacttgagaatttattatataatttattaatctattatcttaatatcaagattaaaataattatgcttataattatagtgtacccttctaggaaagcaagacaattattttaaaatatta

SEQ ID NO: 46525 - DNA, 2831 bp, Bovine  19866880740718
ttttatttttcagttttggggacctctgttttcccatgtccttctttcttgcctttggagatgtaagatgttattttttgaaatgatagcatttgtatttatttttgtgcattcctttcctttatgaaatgactagtaagagctcctgacagttccctggttgtcgagcacgtgggtcctggagctggacgactggagtttgaatcttggcggtgccaccagctcgtgccagggtgcttagttgctcagttgtgtcctactctttgtgactcttttggactgtagcccaccaggttcctctgtctatgggatttttcaggcaagaatactggagtgggttgccatttcctcctccagggcatcttcctgatccagggatcaagcctgtgtctcctgtgtctcctgccttgcaggcaaattctttacccgcaagcctgccaccagctcagaaacactaattcagtttctgcatttgttcagtggggatagtcatgcgcatctcacagcattgctggggagattatgttcatatatgtaaaacatttagaacaatcccagacacagagcagacactacattacctattagtctttctctttttcatgtcaaaacttagcaaaagaagatgcaaaatgatgcttttcaagatctgggggaggggacttattcagatccaagaaatctaaaatcagaaactacttctctatctcttaaactttgtaatgaccccatttaacaggtcaagaaactaaagttcagagagctttatgggtcctcagaaaatgcctctgccattattggcagccctcagggatagggcaatcgtgctgcttgtctaggacccattggtctcctttatgggagcaggattttaatatgcagatgttttggtcttttctgaaaattgtgttcagcttcatttaaggtaaataagtttctcagcctgtgtctcttcacactcgcctaggtatacttaatgttcccaattatcgaagcccttttcatattccctctcactagttctctataaatgtgccagcaataacttcctctagcattagagtcctgcaagctttaagagtttcttaaaaagagattggctctggtagactccattaggcagatggaggttaaaaaccagtttataccttcaaccataagtaccttaaacacttgtgatttcagccagcctaaggaaatacacagctgactggtgggctagacctttgattgggttaggaagggttttgttcatgttatgtggtttgaaacaagtagtttttgaaaggggctgacttgatcaacttctttctcctcacccctgtttcattttagtattgagttagggttgaggcattttacaagtgtcagaaatccagagcaaagcaagcctgattccagagatttcattagcaaagaatggacagacagtaagtctgtggtacatactgaggctcttctctctcctcatgggaataccttctacacccacgagaagaacggggcttctgcccaacttcccacccatttctctaactcctgccaagactccttttcctcctcacactcatccccctaagactggaaaggggggcattaatcatcttattggtcatagcctgagacttgggccacttgttgctgatgggccaggttgtcatatgttagatagctcctgcccctctgctgaagctctgttgctcttccagtttctgtgtcagaggtcagcaggccagagcaagacccaccatgttcaccatccatctcactgtatcttcaattgggtggctaggcttcattgagtctgctctgcccgatcacttaagattcaagagaatatcacagccccgacaattctccagcccaatggacaagagaagcctttcatagcatatggtataggtgatatcagacagaaaagcatagtgattaagagctctgactcttgagcaaataaaatgtgttaggccaggcttactcataataccacgtaaccccaaccaacttactttctaagcctcagttcttgatttgtaaaatgtaggttataataatacctttcatattaagtttttgtatagattaatcaaggccatttttatcatcaagtacatagcctcatgcttgcagtgaatgagtgatacctgctaaatatcatagattgtacatgggatgtagattttagaaggatttccaaactactagcttataaatggcttaatataactcaatatttcataggcacactcactttgggaaataaaacaaagtcatttattagattttgatttcttcagttggcaatttaggctgagctcagccagccagttcttctgtttggcttgccaggactcacttgtgtttctagagtcagctggcaggttgctaggagctggttaacttagatggcataattcacatgtatggtgctggcagctggctagagtgatggagtgacagaccgcatgtgtccactaggctagtccaggtttattctcttgaataaactggtatcaatttccagattaccaagagcagcaagaaaagacaagccccaacatgcaggtgctttttgagcctccatttatgttatgcttgctggtgctccattgaccagagctagtcacaagaccaaggccagataaatgtgggagaggactaagatcatgagacacgcagccattcttgaaacaatataccacagtctcctttctttggtatatctaaaggggaaatactttgtatttaagcattcaagtggtacaagatttctttttttaaatcctttgtcagatatgggattttaatatgcttggcatctggttgctctc

SEQ ID NO: 46526 - DNA, 2410 bp, Bovine  19866880959301
tgcctgtaagcgttttctggtctcctctgaagtaggcctccacacgctagctctccaaccctctggctgtaatagaactctctacatttggatgtgatttatctcagagttggtttgaggtatctaaagtataatcagttaattaagctccaggcccatagctggcattctgcattctctgatatagccatttaaactggaaacattttgctgatgaagggttttgtgtctacctaatactctgcacattttatgaattttcaggatttgaacctctatgtgacattggtttgaatgatttccctcaaaacaaattgagtcccaacacttggaactaaattgctttgtgaattgtcttttccctttgtttctctactttaaaaatttttgctgttatttaaacaaaataacctttgatctttttggtatcatgatgggttcctattatccccagcttcaagaatctggaaacaagttagactttgtgtactgttgtttgcaaaaagatgaacctggctagctgggtacccactccagtgttcttgcctggagaatcccagggacgggggagcctggtgggctgccatctatggggtcgcacagagtcggacacaactgaagcgacttagcagcagcagcggcagcagcagcagctgggtaccccagaaagaaatgcccttggttacatcttttctctggagcattattctgtctgtgcaaaggattattcttactgtaatatttctcaaagtgattgaacaagcaatttttttcttttctctgatgtgctgcttgatattctgaatgctgatgatgctgttcaaagtattttcaatctattcatttccctgaccccaagaaagatggtcatgtccatagaaaggctacatttggggctaagatagtgtctttctttaaaaaaatcaaacaagtaacagatccaggaatggataccttatttaggtttcccgtttgttcctaacttaaacatttttagttgctagtggtggtaccttaaaaggccacctgctactcattttcaagggatagatcaaagagacgatggaagacggagtgaaatgtcttttcatttcagatctacccacatgcctcttctgcaggcctcctcttctcaagttttctaattttgttcctttaagccccctaaccaacaatgcaagccattcaccactgagtctgtatgtattcttaccttgggccattttctttccacacaaagtgggtgatggaaattaataaaaataaaacagcaaaataatataaaatacgttgtacaaggacttcccttgtgtccagtgtctaagactccacactcccaatgcagggggtctgggtttgatccctagtcaaggaactagggattccctggtggctcagaggataaagtgtctacctgcaatgccggagacctgggtttgatccctgggttgggaagatcccctggagaagaaaatggcaacccactccagtactcttgcctagaaaattccgtggatggaggagcctggtgggctacagtccatggggtcaccaagagttggacacgactgagtgacttcacttcacttcaaggaactagatcccacatgctgcaaataaaagaccttgcatgctacaactcaagagcccatatgccgccttaagcattgaggatccgcgtgctgcaactaagacccggtgcagccaaataaatgaatgaatgaatataaaaaagtactttgtgcaactctggttgcataaatgtaaaagattgcttaaaatagatatttttcttgaaaatatgtacacacatcaaggcttgactcaaggagaagtagaaaccatagaaagattaataaccatggaagccaccgaaacatctgagagagaattggctccagtgttgtcactgggggtctaattattttagaattgggttccttcaaacttttaagaatcagataattcccaggctatgtaaaattttttttctgtatatgaatttagaaaaatgtattatatattcttgggggtatttttttttctgttggaatttctgtatttcatttatttttctcttttatttattttttattggaggataattgctttacagtgttgtgttggtcttaggggtaatattgattggcgttactttactgacctaacccatgccttctgctgtgatagtgaacaaaaactccaggccttggagaaagcttggggatgaatgggtccttgggtgggatgatctaggaacaagaaggaagaggtagttctcacaaattatgtaaataccaaatattaacttcttagataagatgtttatggccaccctattatcctcccagtgtttaattctcctcataacaccctgtgcatatctcagaattattggttggatccattc

SEQ ID NO: 46527 - DNA, 997 bp, Bovine  19866881143310
aaatcaaattgaaaaagcattggaaaagcatgtcttactctctgcaatctgactgggttttagatgaaaatggaggtctctaactgggtttctggggaatatctgtggctggtattcaggtggagatgccgtgacctctacaccgtgcagatcacaggaagaggagtgctctttctttcttagtctggaggtgaaagacagactatccccagaaaatggacttggagggacaattgaggaaaatgggtgagttctcactgtgaatgatttttgatattagaaataaaatctaagacccataattttttaatctaatcagtgatgcaaggagcagccctgagcttccaaagatgataagcagtgtgtttcactatttttaggaagcctgcaatcctcctaaacccattttagctctttcaactttctttccttgcaaatctccatcccatcatcactagaccagtcctggacagattaagcctaatcctcaccttgaggttttatccctttgtagatctcagcttgtcttaaaggccaaaagagcaaaggtctattcgagtttatggagctctaaaacccaaaacctgtccagaaccatccacaggaaaacaaaacaacaacaaaggacatttattttccaagaagaattcatctcactcccagcttctcagcttttcttgggttgtagccaagctctgtgatatctgaaagatgacttttctcatctcgctaaaatattcacccatgaagtaggttttctaggatctttaaacatggaaaaagattatacagcatattggaaattactccatttattaagtacacgtatcaatgaccttctgtgtattagacaagtatttgctttttgtgaaaggcaatgtgtacaagaaaattgagaaagcaacatgtgagcatcatttctctggatagaaagatgtaaataatcaaagtttttacagtaaaggtaagcagttgcaacagagagtatctacttatt

SEQ ID NO: 46528 - DNA, 1195 bp, Bovine  19866881144269
ctgctggggaccactccatgaatagtgagaagatagtcccaccaaggaaagcagatctgggaggcagagagttagagattcctggggacctagatcagtcatgcctgacccacccctggacttcagttacatgagtcagtcagtcagtccccttttctgcttaagcctgtttaatcttgacttccgtaacattcaaacagtgttctcactagactaaaggtagaacatgggcctttatggataggaaaaccagttctttgttttcctggctgttctatacctgggtttagactgtctttgctttcttgctgccaataaagtgggtgggtgggtgatgggtgatggtagaggagttgttggcttgtctgttgtcatctatgcctggctttaaggccccacttggttgtaacttcctgctctgtctagaaacaagcctgagattcttgccttaagaatactttggccacctgatgcgaagaagactcgttggaaaagaccctgttgctgggaaagagtgaaggcaggaagagaaggggatgacagaggatgagatggttggatggcgtcaccaactcgatggacatgagtttgagcaagatccgggagttggtgatggacagggaggcctggtgtgctgcagtccacagggttgcaaagagacggacatgactgagcgactgaacttaactgagcctgagattggtctcctctcacatttcctggagttcatgcattaatagcacacacagattgaatgataggtgctggatgatggaagagaacggggacagaggtcacagttcacccttgttcagcttgattaatagttaggtgttgctgctgctactgctgctaagtcacttcagtcgtgtccgactctgtgcgaccccatagaccgcagcccaccaaggctccccccgtccctgggattctccaggcaagaacactggagttagtggtaggtcaaattaggatttgaatatgaacagagttttttggtatcagatatctatatttgtcattcctgttgttgtttttatattgaattttactttagctgccatttcacttgtgccccttgagatcctgaggtcccgtcattgccccagggactgagaatgttcctgcacatttaacgaagtcagcaacgggtatatttttagttggcttgtttgcatctgttctctccctgttc

SEQ ID NO: 46529 - DNA, 746 bp, Bovine  19866881260016
caattttttttcaaggtcgatggaaaaagaaaactggacacttcagattaaattcactatcttggatacaatttctgcccagataacatctgccctttgatttcccccacgctactactagataccatttctaatgccccaaataagttgtgtaatgtgatgcctgcccatttaaaggcctattatgtgctattctaccattagctacaagagagataaggggactatttaatatttgtaattttataaaaatccacatttgtcaatttttaagacctttaaataggtcaaatccttactaatttctttgccattggtactgggccacaagaaattccattcaaaggaatagaatcaagacatttgagatctaagtttagttacactttcactcctatagacattactcaatgtgttagcaatttttttttccaccttatttatctataagatgaaagaattaaatagtggcaaaattgacttctaatttaaatgtaaaataaatggctttagtaacagtctctgtataatttagagatgtcaaactttaatattaaatttctgttttcaggaaaaaattgaaatgtactgagttacaaagtcctaggaaagaaatatgtctgtttattatgagcatttaaaaaaaacggtaactccatatttaagtatttaaagaaggcatttctgtactattaaaagtataggcatttcctgtactattaaaagaattagctattttctataat

SEQ ID NO: 46530 - DNA, 1518 bp, Bovine  19866881284534
gcttctgtgatgtcctgaatacgacacttttttttttctaattttattttatttttaaactttacataattgtattagttttgccaaatatcaaaatgaatctgccacaggtatacatgtgttccccatcctgaacaagaaagagacattgaaggaaatgaaaaagaaacctttaattctttgtgtaacccagtgtccatcacacctgatcattagcggagcagacaatttttgtttgtttcagggcttccttaaggtctgtggctgttcagatatccccatcctgtttggacctgctcctctctgagtctgtccaccgtctttttctggacatcatctctctctgcctgcctgggttcccttggtgctccctgggaaaaccaaggaagaactgaggagcctaagtgctctcctactagtatgaacagtgacttgtgttctcccagctgtcttcttgaatggaatggtggaatcagaaacatgtagtttatacttgtagctcagtcatgagctgggtgagcttgggcaaggcgttaagccattattagtattgttgttaaaggtttttaaaatatttagaattttaaaaatttcttaaaagttatcatgtgcataataggaaatcaaaaacaacacaagaagcaaaacacgaagtcatttgtaatcacactttactgtctgatgtgtccttctaggtctcatttgtgtactttcacaactaagcatgcatttgtatatagttaagatcacacagctattgtttttaatttaaggaagaaattctgaaatctaaccttcagagttgctttacgagggccgagtccactgacataccctcgctgacaacatgccccaggagggtctgtgagtacagctctaattttaaaatcgtctctttattttaaacatttctgcagggtttcactatattctagtctattcatgcctgtttggctatccactgagcatctctgccccacacttctttagacagagagctgacattccaggatgatggtatattgtgcacacgctgcaaagccctgtgacgtgtgccatcagccgcctgtccccaccacccactcccctttcaaaggcatggctgtccgaggcagcacaagcacagggcctggtgcttggtaaggcttccgtgatattgcttgaaaacaacctctggaattcaggctgaagagatcagcaggtaaagggctctttggagagcgcccgtttgcccttctcctgcccggggacctgctgccctctgctccttcacgtggccagcctcccactccccctggagcctaacactggctgcttattgagtctgtcagcatttcctccgtggagctcagactgactaattagtcttcccctcctgatgactgaagccacagggcatagacaggccagcacttctccacaaggcatctgctgaggaaaggcacggccgagcccttaggctggtcttgtcaactctgcgtctctgggtaggtcttttgtatgggtgcctgtgaacgt

SEQ ID NO: 46531 - DNA, 1048 bp, Bovine  19866881297966
tggggagctttggtttaataaggaggagagaggcggggtgataggctgttggagaggaagcaagatctattagatcatctcggccatctcgctgggcctgcccgagattgctcccagctgcactggcatattcactgctgctcaggctagtccagttttaagtgatttaagggtaatatattaaaggctcatgaccagctataaagaggtgcttcttcctgagacactagcaaaggcttggctgtaattttagatggatgctcatcccaccagaggtcagggggcacctagctgtccttcaggctgtatcacatcagggccacagaggtcacatccatttggactgtggtcgccattcaaaagagagtaccaatgccgtgtgcatttatcaaaattcaaaagcaaccatgagctgtgtgcattcttattgtccatgacactccgtacaggtaggtttcaaaaggaacagacagacatcacagaaaggtgccgagcaaattctggaactgataatataactgaaaccaaaaacttactacagggttttaatcatagattttagtaaaaaaaaaaaaaagaaaagaaagaaatcagtgaacttgaacataggtaaactgaaattatctagtctgaggagtagggaaaaaataatgaagaaaaatgaacagaacctaacaaatctgtggaaaacataaatgtaacaacatacacaatcaaaacagcatatattttgggcacaaaaacagaactatgaatccgtggaacagaatagacagctctgaaataaccgcacacacctatagtcaatcagtcttcaacaaaggagataagaaaacacaatggagaaaagacaatctctttagcaaatggtgttggaaaactggagtcacatgaaaagcaatgaaattagagtacaccctcacaccatacacaaaaataaaatagctaaagacttaaatatgagccatgacatcataaaactcctagaagagatcataggcaaaacattctctgacataaatcagggcaagtgttctcttaggtcagt

SEQ ID NO: 46532 - DNA, 1298 bp, Bovine  19866881339961
ataaaaggttaggatgcatttcctatgagacaagaactgtgtcttccctcagtaaaaacctaaggctgactgtgaatggaagagaattccatataaaggtccaaatagcatctctcccacaaaggaggaaaaaacacacctgggtttccccaagcgtgtctaatggcagactcttgtgggaaatgttcattatataataaacatttttatataattttaagttttaatgtataaaataattttatttccataaagtttattatataacataagtggaaaaaaccacaatgacttatgttctgattatagttaacgttttaaatatatgttcaaggattgaaaacaagcatggaaaaacataaacaggtgtaaagctgtggaaatttggttgaaatttttccttaatattttgtgtcagtgcaataaaaagttttaaaagcaggcccatgacaaaacatttttaggtattttggtttgtatcttaaatacagcagcttacagctgctatctgttgtaaatgaaaatttcctatttgatgctatttctaagtaccttaaactcattttggagatgggagtatgaagaaaagaggagaaatgagtgtgggtataatatatcacttaatccaataagaatcaaggagaagggattgattacctcctctagcttggtgatttctttatgcaattcttcttttaggccagagcagtcttccttattttgtgttctaagaatcttcaatatcaaaggtggtacctagacagaaaataatgtcttagtttatcagtgtgaggctaaccatactgaccctgtcacataaaggcaggatagaaccctcacagtccgtgtcagggtattctatacacttgatatgtgcacgagttcctcttcacagaggttatatactgatcctagaaacagttttgttaccaaagatgctatactgttcaggattttataagctgcaaataagccattttggtgagtctgaatcaaatatatcttaaaaggacactgaatggcatgtactgtacatgaaagagacttgaagacaatttggcaaagtgagaaggagaaagagtcttttagcaagaatagagaagaaggtggcaagtttgggaaaaataaaaatattcagcatgacatgaatataaagtattaggagaacagtgaagagatgtaactttgaaaagtaaacagggtccagattatgaaagagctcattggacatgtcagagctggcaagagcataatcctgtttgtctttccctcccaaatcactgaacctagagtgacag

SEQ ID NO: 46533 - DNA, 1415 bp, Bovine  19866881489499
agttgcgtgaggagaatatccgtggagattattctaaattattccatttggaaagaatctgtagaggattggttcatcaattcagctgtctcttagcagaattgatttcattattataaaaatcatcctccataaataggacaaaagcttcagccttgagtggatccagcaaagaagacgccttcaagtactctgacaacttgtctacctcctgaccgttgttagatgcaggcaaggcccccctcctcctgacctctcttgcctcaaataacctaaattttcctctccaaaggaaccaaagcttaatgcttctggcctgacctaagccgactaacgggaataatgtctcctttacatgatctttttaatgtatttatagaccatcctaatgactcccttcagccttcttcctttcagtctaaaccatctcagcacttttgttcttgcctggtcatattttccttcagctccttaatcttttttttttccctgctgttctcctcctaagaactcatgtttttctgtctccctccagtttatggatcccaactaaatggaaccaccattgatgccctctggagagatcaatcacaaggaataagtatcaaggcaaaagcagagagtctagagcagggtactagaactttccatgatagaaagtagaaaaaccctgtacctggcctgccagatacagcatccactagccacatacagctactaagtaggtgaaatgtgactagtgcagttaaggaactgaatttctaatttgatttaattataattcactttatataaatagccacaagtggtgtactgcctggggcagcacagttctagtggatgggccactgggaggagctgagctatcagactttatttttctgggctccaaaatcactgcagatggtgactgcagccatgaaattaaaagatgcttgctccttggaagaaaagctgtaaccaacctagacagcatattgaaaagcagagacattactttgcgaacaaaggttcgtctagtcaaagctatgccttttccagtagtcatgtatggatatgagagttggaccttaaagaaagctgagcaccaaagaattgatgcttttgaacagtggtatcggaaaagactcttgagagtcccttggactgcaaggagatccaaccagtccatcctaaaggaaatcagtcctgaatattaattggaaggactgatgctgaagctgaaactccaatactttggccacctgatgcaaagaactgattccttggaaaagaccctgatgctgggaaagattgaaggcaggaggaaaaggggatgacagaggatgagatgattggatggcatcaccaacttgatgaacatgagtttgagcaagctctgggagggtggtgatggacaggggaaacctggcatg

SEQ ID NO: 46534 - DNA, 1314 bp, Bovine  19866880539218
aattctcccaatcatccactgaatgggcattgttctccgtttcactgtcgggagggagttcagaacaatgaagtcctattatcattgaattcccaagttctgctttggaccctgtttggtctgaggctggtgagttctctgaatctagtacagcatcctgctaaatgggcctggccagctgcaagcttttggcaggttcctaaggtgtcctcattcaaatggctccaagatccaaaggttgttggtcatcatctgttgtgagcaatccattctctgaggtaccaaaactgggctcaacaaatgtcaacacaaaactctaggtaaataaataggaaagctgtgcctttttttaaagtgaagtacatggtttccccacagtaattaggtatcttatgagggggaagaaaagccaaacatttaggaaacaattgcaaagtgacgtgaactgaggatggattacaaaaagagaagaggtttgagtctcatagaagagttggatgatataaaccataatgtaaaagaatatgaaaaagaatatacatgtatacgtacaactgaatcaacttgttgtacagcagaaattaacacaacattgtaaatgtatcctgggctctaaccctttggagggctgtgcacttagaaatctagtctgaatcatgtccacctgccttttcaaaacttcacaacacaacctagagtgtgaaattacaagagagaaactagggtttctgcaattcaaaaagtcccctctttataaacagcttttgggtgaatggactcagtgttgatgctgacatggtgacaatatttatgactaggctaattattttgctatttcactaatgaaatcgggatactaccaaaagagagaagactgaaagcttctgcttcatgactacaaaacaacaacaacaacacacaactcattgtgtaacttcgaaagtaagttatttgacatttcattgcaacatgtgaatagtttcttaattttataagatttttttaaagaaggaaaaacatacacatataaatgtcttttttggctgaaccatacgagagttagagtatattgcatggtacttcataaatatgtcagcatgcatctcctaaaaacaaggagattctcctacatatctgcaatataatgatcgaaggcaggacattcaatactgactcaataccacactgcactagtatcgaatgtatggtccagactaaaacgtccccagttgtcctatcttttctgtgtcctgcacaagctacccctttccttaatccagaatctaagcaggattagatgttaaatgtacttgt

SEQ ID NO: 46535 - DNA, 1044 bp, Bovine  19866880619017
caggtggtagccattaggaacacctcgtaaagcggcttcccttttgctcttcaggctgtctcctggaggccccagggtggcatgtcttatattatggagtattatggaactgattcgtaaatatcaatatgaaaagaacccataaaaatatggacactggttagaacttatcacaaataagtcatattgtttaagttagatttccttttccatccatggacaagaacctctccccttttctgttattgctcagatgtagggaaatttatcttgtcttgcaaaacattatgccaaagaaacaagtcagcgtttcactgtgtcttgagctcagtagaaggatgtccacgtacttaatccaactcctgttgagtgattgacttctggtagaactgttaatttgcaaattcttaaagcagaaagtttacatttttccagctgccaaactttgggcttcctgatgaatcactgggacagactttctgggtcaagtgtgagtggtgctctggggctgccggtccgaggctagggaagcatgacaagctttttcagatgcctggccagagctcaaacacgttggcttggggaccagcctctagggcccaggtgacttcccctagaaaacgtcttcacaggtcttcccctgtatagagtcctcacaggctgaaggaaagggttaggaccattgatcagaaaagagctgcacattttttccttctctgtctgccgcagagatgttagtcaaggagaaagcttactcacttgaaagctgtggattacagagcagctcagaaagagccattggcgacggaattttctccttgttgaatatgttctttgcccctagaataccaagccaaaggaaggaaaagatggaaaataagtccctctttcacaatgcatttgagtcagcccaccaaaggaaacgagatttctcaactaacaaataaatggcaatactgcctttgggaattagaaaaaggctccttgataaagttatttgggaattagtcatcagttgacacctaatagacacagagcacatca

SEQ ID NO: 46536 - DNA, 1148 bp, Bovine  19866880775833
cactctcttagctagatcagcctgcaattcacaactgcttcttgatgttttttattgtcaactgccaagagtctgcgtcctctctctgggtctgacgtactgctagacgttggtgtcccagacacttagctgtgggcaccagcacaggagaaaaaccagatagtagcagccggaaaaagagaaagccccagagtggagtgtggggcgcagtgaaatcatgcaaacatattacaggaatatataaggaattttctgggcctgcagaaagctgtgaagtttgcctcagaaggaaaacagaatgaagcaaagcaaaacttaattagtcctcggttactaatggtcttgggacctgtgccctagggttttccttgttttgagaatgttttttgcaaatggctgcccgggtccctgttccagagaaatggctctgtcgtttccttagtttcctggggctgcagtaacaaatgcggtgaactggatggctttaagacaacacacgttaatcctctcccaggatggaggtcagaagtctgaaatcaaggtattggcagtgttggttccttctggggaaccaatctgttctgaacctctttcctgccttctattgtctatggtcatcctacgtggcctaaatactaataccaacagaggacaggttaacagtgatgaagaccagggagatagggaccaagttgctgtggagagaagagcagaaataaaagtcctctgatttctctagcagtcaatttctctggaaagatatggtagcagggtgaggcactggacagactctaattgtcgttttctttctttcctcctagcaaactgcctagttgggctagagctgttgttcccaaaatattttatgtaacagagaaggcgtggaactattatccctacacaattacgggtaagtccttgtacacccaatatgttacaagcatccatgcaaggacatagggggattcagattcactgattgagcatggattatcccagcagggactcacaggagccctgtgacacctccctgaccctttgtctccatacttttaagtcaacactcttcctagcaggaggttgtagggggttaagctaaaccattctatcttccttcttgaagtgatcattgtaaatagcatatagag

SEQ ID NO: 46537 - DNA, 1721 bp, Bovine  19866880853558
tctttggtttagaagcttatttgaaggtgttaagcccaggggacagaatttataaaatgacttccttctagagacaatgctctgcaagatgccagatttctgccacgcaggaagagatgtctggctcgctctgccctaaacctaaatgtctttaacattagcattccggaggattcttgttgctgatgttcccaagcaacacagtactgacaaagaccctgacagaagggaaagagtgattaactgaatacaaactcactctaatcctgccgaccttgacgcaggtcactgaggacaccagcttcttattgaacaggactgtcacagttcagagcccaactcctccatttgcctgggagcgactctgcaacaagcccaattgcaattccttttttccattgggaagatgaggtgtgtatttttacttctgagggctgaatctgatttgggctctgcaaagacatgagtggctagccccatcagtctttctggctctgtgattcaatgttcagatttctccatgtagacagagaggtttaaaagaaaaaaaagtgtaaagttcttcggtgtttcatcagctctctccctggcaggtcaataaagcacgaaaaccaatatccgatgccacaaagaaaatacaaacctgcagctcatatttcaggatatcagtgcatcatcacatatttatcttttctcccggatctttataagcagccctcagaggtgccatgtttacgtaatacctgtgtcattatgccagggtgcaggaatgaaaaagctgataaaaagatttaagaaggagctgggttatcgacatttaattcaaaaatccccttttcatgacaaactaatataaacagcatcatatgctggtgcttaacccatcctaagttttggactgaactggatagaaatagagcaacttaatgccaggggaagggctcagggtatgctttgtgctggtgcaagcaagcagaactctatgcttataactgtgcaaaactgcaaatcgtttccagtacactgggaggtccaggagcatgatccacttgactgagtacaggagagtatagtatatgaaaaataaaagcgcatactttaactgctccttccaacacagacttatccttgggggaggtattctagccttgagaactcacttaatgcacagatttaaaagccaaaatgataactatcagcacatagaggctattttataagcattagctcaagtgagaggtatcattccccagtattgataaatgagaagctgaacacattagcttttagagagcagcatgtgaaaccacagagcaaagacaggaactgccaggactcagttcaaaaccacaagggtagtctgcccttggggcagaacatgggatttctccaggcatgggttgggggacactctgggtgtagagtccagttccttctggttcatgcattgaactaacagagtacactaggccctatagacactggaggtagagctataaacaaggttgacctggtctccaccaaagaggagcgtttcctgagttccatctcaaagacacgaggctgataagcccaagaaacttgaggctgacatcatagccattgaaccatttttcaacaaacatgaaatcaaatgcaactcaagtaaatggagaggtttggtgacagggctgacctttacaaagcaatcaagtctcttgtttactaccaagcagaaaccc

SEQ ID NO: 46538 - DNA, 1300 bp, Bovine  19866880928212
catgccttggggcaactaagcccctgtgccacaagtaccgaggcctttgctctacagcccgtgctccacgacaagagcagcccccgcagtgagaagcctgtgcgccgcaactagagagcagccctcactctccacaactagagaaagcctgaaagcagccaatgaagacccagcacagccaaaaataagataaataagaaaatatgaatctttaaaagagactcagtctttttaaaattaaagtaaaaaatactcagtctttgttctttaataaaacaaataaaaaatacccccctgcttattttttatcttgcttttccccactttttaaactttttattttgtattggggtataactgattaacaatgttacaatttcaggtgaacagtgaagggactcagctgtacatacacatggatccattctcctctaatctcccatcccatccagcctgccacataacattgaggagagctccatgtgctatacaggaggtccttgttggttatccattttaaatatagcagtgtgaacactctggaacctgactgagctcagttaaccattttctttttatgacagtttgatctgtttgccattgaggaaaatgatccatatgaaaataccaacacaatgacattacagacttcttttttagtgtaagccacgatgctagaggctcttaggacaggaagaaattaaatgactttatcaagccactgagactgtccaatctgagtaaaatagtttgaatgtatgtctttctagtttcaaggtctttctataagggatcagatcacagactataaggaaaagcctccccctccatcgataataaccatcatctctttaataccacattgctagaaattgttctattatagtgaactaccacaagtagagcagtcaagctatttaaaaatacaagcaaaagttaataatgtaaagtgactatgaaggcattttaaattacattcatattcttgaacaaatgagaacattcaaattattgcactgtatataactatataatggcatatatttaaatatttctgattctgaattattcctctattttttaaattacattaataagatgagaagtacaagggaagttccaattactcctctgatcttaggctgaatatttttaaatgattaaatgaaacttactgtgtattctggtccccagacgttcatttgggcaagacggaaaagaaaaaaaagaaaatgatgattaagaccacattatatccaatataaagccacagaactaacaaatattgctgaattataat

SEQ ID NO: 46539 - DNA, 1331 bp, Bovine  19866881296992
ttttcctgctgacttcctgctctgccttcccacaccccctttctctctcaccctcccccacttctctttcaggtcccactgctcctcttggccacatttttcttctgatgcagcctatattggggaaaccactctccaattcatcctcatctgtcttacttacatactgttcctttttgccttctctttgctttaaagttcttctacttttttctccacttgggttccccttctcatttttctggacctatcttctttgcaatttttttttctaactactctgtcattagggccacccacctagattgtatagtcatacatgaccctgggaacccagaacagccaagaaagctcaaatatctcccttattttatttatatcagtccctgcaggatgactgagattctgaatagatgtgggacagccagacatacaccttcttgaaactgttgtgtctattaaagattttctatgcacagaagagtttatattaccttccaactatgggacaaatcttcagtcaaaatgaaagggtaaaaattttccaatgaagaattttaaaagttgaaaggtactttaaaatctaggttgtctactgcctctacatacagattcaccacccacagtctgctgttttacaaatagcacaggctccagctctgaattcctagaagataataaatcttaaccattaggcttatttcactaggttcactggaacaatctgaacgtaagtctcctgttattgaaaggacgaggcatttgcaagttcagttttttgaatgatcccttctcaagctgaaattccctttatggccttggagtatatttaatatgataatacagaatatagtaccagagaatcaatgtcttcatgggggttccattagagagatcaagtctgatagagttttggaacaagatggtcagagaggaatgcattgaattccagataaatgctaaaaggaaatgatcttttaaaagcctataagtactttatctgccccaagccagagtctcaactcttacatttaattttcttgactccaagcctccttgtaaaatgatggctgtcagacatggaagaatttcggctggtaaccagaaataaagcattgtattactgggctcagtcagcgatttccaaacttttcttcttttggtccaggaagttccatgaatatgcctcactagccaccggatacttacctaacatattatttgaagaaagaactcgatgccatttaaaaagtggtttgaactactgaactgtatcacctctcagatccacctcgttctaagactccataaaagtgtatacaggaaccact

SEQ ID NO: 46540 - DNA, 1311 bp, Bovine  19866881358847
aaggcagagcctgtagtgggagaaaggtcttcgcctgcaaatcatttcaggcattaggcggaatcaccgttagaagctggcaaccctccctgactggcagctgccagcacagcctaattaatccagcagccatagtggagaagaacatgacacttcatgactgataaacaagcctaaaaataggctccatcttttctccaattcccctccgcccccatctgcttctctcgtgagtttcagtgagaggggaccggagtgaagctaggaatgaggtgaaaatgaaaggggacaaaagaaaagctccatcctcgtaagattctggatgacaggttttatttagaatcactattccagatttgtatcttgactcttttccccagacgccagttgaaatcaggatttttgcagacaagccaagaaacaccacttatttggttgactgaactggactgaaggcccaaggacaaccaccagatgtactaatgtattagtactaatgtaatgttctaaatgcattagggcagccacccaaatgtactgcgcacaacagtgtataagacactataggaagggccagagaatggagtaaccccacaatccagggagctaagcgacaagaactaaaaggataaatggcatttgaaaaagacactacactcaatttaaaaatgggcaaaggatttcaatagacatgtcttcgaagaagacatataaatggctaatgagcacatgaaaagatgctcaatatcattagtcattaggaaaacgccaatcaaaacccaaacaagataccacttcaaaacccactaggatggctgtaatcaaaaagacagacaataacaagtgttggtgattatacagagacattggaaccctcatacattgctggagggagtataaaatagtacagtcactttggaaaacagtctggaagtccctctccccactcactagcagccaggcttgacctgggaactcagtgggatgtttatgcctggaattttattttatttggccatactgtgcatcttgtcagagaaggcaatggcaccccactccagtattcttgcctggagaatcccagggatgggggagcctggtgggctgctgtctatggggtcgcacagagtcagacacgactgaagtgacttaccagcggcagcagtgcatcttgtgggatctcagttcaccaaccagggattgaacctggtccatggcagtgaaagcctagaatcctaaccactagaccaccagagttattccctatgtttggcattttagaacaaaggctagaaagaaaaaaggacagct

SEQ ID NO: 46541 - DNA, 1626 bp, Bovine  19866880368315
gtttcctgtttgttagttttgttcctgttgtgtggatagaagtgaagacttccaagttctttatgtgtcagctcagaaactagaagtgccccccgtttacgtacagtgttccttttctcaagtttctcctaaatctgatctcttcccaaaatggtagcggtggtcccaagcgagaagatcaataaaattaacaggaataaagagtctgaattaaacaaattgggtgaatcacaaggcagggctcacaacttgaagctgcctccgtcttcttgaggtgctctgtttccaaaacagtctcactaagggaagactgaccttttaaactccactgtttaaaatgggcaatgttcacacaggaggttctattgtgtggagatcaaccagcttcaccgataggccagtttttcaggattgcctcccggaaagacaattgagttgctccattttgtggacatttgtgtacaaaatacatcttctccacattcttcagtgtgacattcacagatcagtgaatgctagtgaaaaggaagaggagagtgacgcacagaagttgcagaaagaggatgttgaattttaggcaaagcagcagaaaggaagcaccattcaagtccctgagttcaccaatagccacctgggcttctacagaaagagaaagaaaagaagggggcagaaaggcagaaaagagaactttcctgtcttcttttcattcttgttttgggactttatgggaaggaaaataagaggagcagatccacttttctaaggtggtccttcttaggctttactgtgcccctggatcacatgtggaatcctctgaaaatgcagattctggctccatggacctggcccagggcctgagattctgaatctcaaacatgttcctgaatgatggagatgacattggtgccacactttgaggagaaaaggcctaaggcaccttccaaagagtcatttctcagctcttcctctatgttcacttctggaaacaacaatgataaccaccaccactttccacttatttcctgaatccaacatgcacattcttagctcaggatgatccccatttttagacaactgctggcttcttctccatttccaagttctccgttttccctctaaatgtcattcaaatctctgtccttcaccaggaccctttcaccactcagggtctccataatcaatgtctccattgaggtcctatacctttcctgtggttctccttagccatattttttggcaagtatatatagttattgatcttttacatctgtttgtctccttactgaattgtaagcctcttgagcacagggtgtgtgttttgtcacccttttattccccagaccttaaatagagccccgcttattaagaaattgcacagtgtagcgctattaccccagggagacaggggttcaaaccccagctctaccattcaacagctgttggagcttggaccaagtgttgctgcttgagtcttggtggtggcagtggtggtactgtacgtagaatatttatatctcccagaattgctgagaggaacaaagaaaataaagttgcctgcatgtgaaaccaaggcacagagtgagcatttataaatttaaagtcctctgcattcaactcatgttcccc

SEQ ID NO: 46542 - DNA, 2741 bp, Bovine  19866880490292
tggggtgagctggagaagacaggagtctgggtcccccaccaaccttcagcaacgtgtacctctcttacagactgggtagccacagatggcagcttttgaagaaagggctttgcagctcaaagtagtttttaaagccctccctccctagtgtaacgtcctcactttatcttaaaaccattctatgtaataaaagctgactccctaaggccacacccaagtgaccagtgttccagcactctgtcaatgcctgttgccagattggtattaaatcttgtctatgattcagcagtgcctgtacctctgtacaaatgctatacaaatttttctctttaagagcttgagagtcaggctggacccaacgtcaatttgactggtaaatctgatgaccaagttcttcctttgacagtccagatattctgcacagacaccaaggtctcttctgactctgtacctttatatcaacatgataattgacttagcacactcccaactcagagcccctctccagcgcttttccataaggacccaggagtcttctgcttgtttggagcactctagtctgattactcagtcactctgatcactggctctattgcttgtgtgtggtctgactctggtcttttagatctcatctacatatttgatttacccagtttttgaatctaaattcttactcaagaagtcaattctaactcaagaaccagagtcctggttctaccccttatcagctgtataaacttggactagcattatttgacatacattgctgctgctgctgctaagtcgcttcagtcgtgtccgactctgtgtgaccccatagacggcagcccaccaggctcccctgtccctgggattctccaggcaagaacactggagtgggttgccattttcttctccaatgcatgaaagtgaaaagtgaaagtgaagtcgctcagtcgtgtctgactcttcgcgaccccatggactgcagcccaccaggctcctccatccatgggagtctccaggcaagagtactggagtggggtgccattgacatacactagataatttctaatcattgtcccactgctaaaatattacttatttaaaattccttggctcctgattttatggttggcaaaattacgataagatctgctccatctttctttagagttgctgtaaatatgctattagctgatatatatgaatgttctttgtaaactgtattttgtacccaggggaaaaaaatgtattgtgatttctggacctggtctcagttctgtcactcccatgagataccataaagctgcaaggaacacctggctatcagagttgtattactcaactgtttcttttaaatcttgctaaactttatacccttgaatttttttgtacactaagatatgaaatctctgggctttgtgacatttctttgatctgggagaagaaaataacacaagaaatcctatctaaggatggagtcagagacatcaaagcagataagtacagtatgagaagaaatgttcatgctgcaaacatgttgactgaaaatctgtcttgtcgcaaagtagtggtagtgagcacattctttcagaacaaagtctaaaggtaaggctgtgagtccaaaagaaaaatagaggctgagcaggaaaacctacaaaactgaatcggagatttgactgtgcccaatctcaaattagtttaaaattgtttttgcaccagaatccatacacacaaacacatataacaacacacacacatacacatattctgtatacccttctacatgctgaagcaatctaataaattgtataaccatgggtttgcttagatgaagaatattatgtaaataagaactaggtgacttgcttagcacccccactggacacatctactgaaataagttgtgatgaagagaaccttattctgcatattaattaggtcaagccatgtgtctttgattctaacataaatgtaatattctcactcgtggatgaatctatcaagtttttaaatgtcatgtaaagagatccaaactagaaggtaactgctgcaatcaaactgctggagaataaaaaagttaaaaagacctaggaaatcacgagtatttggtagtaaaattatctccttaatttttgtttctttggcagaagttcctgtggcaacatgcttctttattgttctctttcctttctcctttcttctgggtttttacccattctctctcaactgtggctttttagtaaaattattattactataattataatatttatttttatatagttgtttgagaagataaacaagaaatcttcaagtatacctagtgtttagtttaatcttggatagagaacatgacttatagaaggaagagtcttgaaggatagaagcagacctgtttcttattttatttctatatgatggatgctttggatgggaagatgacatagcagcaccatacttatactgcgcaataagtccaataagtggaataagtgtggtgcatttattttgttaccttttttaatccccaaaaatgtcttagaagaggaatatttggtgacgaggcttgtctacatctcaaaaatgaccacaaacggtatagtctactgtggactttcattgcttaatgaataaaccggctcacttcatatttgactagtgcagactctactgtgaaaatgtctgagagtctctaaggaaatagccaatgtggatatttcatcaatttggggagcaaaaaatcaataggagagtca

SEQ ID NO: 46543 - DNA, 2175 bp, Bovine  19866880506656
ctctggggatactaattgtaacattttgaagtttctttctactttctgtactatttcaataccctatgattttctttttggttgttgtttggttttgttccttatattttttcttatactctgaaggtatttgttatttctctgaatctgaggcattcagtagccaccctgatatacgctgtgagtgacagaggcttttaactggtcagctatataccatagattaatcttccttttctcttttatccctgtatttcttcctcttttctttttaagtctttattgaatctgttacaatattgtttctgttttatgttttgcttttttggccatgagacatgtgggatcttgaacgcgtatcccctgctttggagagagaagtcttaaccactggagcaccagggaagtccttggatttttccctctttccttccttttccttccttcccttccttcttttgtttatttgttttatttgtttattatgctaatacttaaatatattctccctgtaagatataaatagctgcccacactcctttggcccacaagtttgattctaaaacttgtacttctgattttactttccatgaattgaggaaactttaatgaggtaagaacttcacatggcttaaaatatatattgtgtgtcacagacagaatgcagtgctctgcttaataaaatactatgattaacagtcaaatataagccatgaaaggagtaccaatttccaaatatctagacaaaaatacaatacaatgaacagtatttttatatagaaaaccatttactattttcttgattattcaagagattgtttaggatcatggaggcctgtatgttttcattctgaatactgttatagatgtggcagtataataataataatagtcaataaagtacttttgaattctaatgaataatagaatttcctatagcaaagttattagaatctcatatgttctggtgattcctaccaactatatcagggccagtaaatgtatttggtaaagggataggtagcaaataatgttggctttctgggcataacaatttgttgaaactactcgacatttacacagcaaagcagctgcagataatatgtaaataaatgagagtagctgcattccaataaaactttacttaaaaaataggtggaaggccagataaaccaaaaggctaatttgggccagaagagtcttatagtttgtaagactgtagatagctgatttctgatctatttgcatacaggttccaatccaaatttctactacattttaaaatatttctctttaattctaacatttccctttaaatatatttctaacactagtacctaagatccaaaatatcaaaaataaaactcagaatgtctgtataggtcataccaccacatctatttctcttataatttttcttccatccttttcattttaattttatttatgtatttattttggctggcctggatcttcgttgcttagcccagctttctctagttgtggtgagcaggggctacttttcactgcggtatgcgggccttctcattgcagtggcttctcctgttgtagagcatatcctctgggcatgcaggcttcagtgattgtagcacatgggctccgcagctgaagctcacaggctttagagcacgggctccgtagttgtggtgcatgggcttagccgctctgtggcatgtggaatcttcctggacgagggatcgaatctgtgccccctgcattggcaggtggattcttatccaccacactgccagggaagtcccttctattctttattccccaaaatgcatccttcttccttgctctccggctctcttaattagttcttagttctgttgtttctactttcatgatgtatttcacatctctctcttttttttttaactacgtttcctttatcactgtctttcattaactagtgttcaggttctcattaacttgtctagactctcactggatgtggtctctctacttccatgtcatatcctttctagttccacatatccacagctgccagtttaatcttcccatagcagagggctgatcataccactttctagcttgggagccaccaccacctccttattaaccaaaaataaaggcccaaattcaaatctttcatgatctggacctactcagctttaccaaatatcattt

SEQ ID NO: 46544 - DNA, 1832 bp, Bovine  19866880524801
aaaaactttaaaggaaattaagtgcatacatgcacacactgacactctaaatcaataatactaatagcaaagaactgaggaggaaatgatagcaaatgaggtatgggaaacaaagagaggaaaggaaaacagttgaataagtggtaacgtatttgatagattagataaagctaatttttatgcctgaagagaggaatgctaataggaaataagacaatttgtgcagaagaaacccagaatgctttaggaactgaaggttccaagtatctctgaagatagggatgagagggtaaaactagagaaaggactcttcaaagaaagtctaaataaggagcagtcagacccccaaagtcctcccctataccagcagctaggtgagtacctcttacacatctaaaaaagatagtagagatagagaatctacattttcttgtattaaaatacatcacaacttcaactgacaattacaacacaaattcaagcccacagggtttttacttaacctctttgatcttatatttgaacgaccttcttccgtgccaaaaatctaattcccaacaccaacataatttctcatttttttattccatagtatacacatagtattccctggtagcccagttggtaaagaatctgtctgcagtgcaagagactggggttcaatccctgagtcgggaagatcccctgaagaaggaaatggcaaaccactccagtgtccttgctggaaaattccatggacagaggaacctggttggctgccgtccatggggtcacaaagagtcagacacaactgagcgactaacacacagagggagggagagaaggagagagagaatctaaaacagtaacaatactatcatcaacaataaaattagaaaacgcagtttaaaatttttttgacattccccccaccccacccctgctcccttagggtatttctacagatgagttagccacttgaagtactttctctctgagtttatggtattaatttgagactcgtgttcatttgtgccattttgctttcaatttttaaagattgctttgtcttgagattagctttgctttacagttatgtaaaatgcttgtgtgttttttaaatttaaatcagaaacaaaaatatattcacacatttaccttttaaccctgtcccctctgacctcatttcctctctcactccctcaaagtatcttcttcctgagtctttttttcaatataagcaaatttatattcagactaccttattctcagagcagcataccataaacacttcttgcaccatgatttttttaattaacaataattgtagagatcattccataagcttactaatttttgaaaagtatgttattttgtagcccacgtgaaaaatttggctataaaataggagcattagtggccagctgctggaaaaaaagatttaatccaaatacttaaaaaatatatatatgcagatttttggagctttgtagtaaacctttaaaaaatgactcaccagattcacagcatcgtgctgggaaaaattagagtaggtggctttgcttctgagaggcatacacagtgtacaattttaccatgcaaaatgcttctgctactacaattttcctttgctttgcctttttgaaaagtaatgttccttcctattttagcagcaccatttgcatgcctattattcacattgaactgggatttccatttttatcttccttttgttacttgttttcattccagcactttctcttcttgctctttgcctttcctttatcttgcccttaaatggaggcctcatgctatgggaaaagtgccatgaccttatcctccatcaagccagg

SEQ ID NO: 46545 - DNA, 800 bp, Bovine  19866880571868
cctgggaagatattatacccctaaacacaaaagctattagcagccttttctaattctctttcaatttagtaagggaattgttgactatattttctatataaaaagacaaaaatatacaacagattgaatagaaaacatacagacaaatgctttctatttcattcatcagctgactactaagatggaaacacacccacaatgtatgttataagagtttccccactgccacctcactcagtggttcttcaacttccttttcttttttatagcatggggctaatgtattttttttaaatgaaaaagaaaacccattatattgcctcaaatctactccgtctcattgcccccacttcaaattctgattgactatcactgtttttatttgagaccacagacagattgatgaaataagatggacaggggtatcacatacccatatttaggtataaaagggcattgtgctaggagtggtttagttatacagcccacttactccttcaacaaatatgctgaacagtagtattagttaaggcaatgcaaatggacatattaagtaaaccctcacatttcaatgggcaaattttaataccataaaggtttgccattgacagaattagtgcaatgagagtgacttagattcaaagtcagaatcccttctccctgtgtttcttgcaccttctagagcctcagagtcttttacatttatcccagataagagaaaaatgcttgtgaaggtcccctgcttgtaacaccttctgctcacacattattgaaatgaacaaatcacacagtcaccccta

SEQ ID NO: 46546 - DNA, 1276 bp, Bovine  19866880611104
ctggcaggctggagattaaggaagagccactgctgcagatgaggtccaaaggctacctgtcgtcagaaattcttcttctttggggagggtcagtcttttgttctagttgggccttcacctgatgagacgcggcccaccaacactataagggtctgtttcacttaaaacccatcattgaaaatggccatctcgttcaaagatacctttacagaaaaatccaaaataatttttgactgcatgtttggtcatcacggcctagccaaactgacacaaaaaattaactctcacagtcaagaaggcaatgtggtccaatactggtctaggaagtgtttgaaaccacctaggtttcaaaagcactgctacctctaaagtgtctctgtcagatgtatgcttggaggaacaggccaagtggcaacactggattttcagttgcacatgttatctggcagaagaaacctcatcacaaaagtgcgagctccctttttctagaacactggagaacctctgcttttctcattggcagatcaagggcccaccttttattaatgtcattctatacggcattttttctgtgattttgtcatagctggaaaggaacaaatcttctttgtgtttggatagttttcttagattctgccatcttttcgaagcttattgatatggataagttgaaacctcattgtcacatttgtatctcttcctctcttagaatagtgatttaagaggctcaacccttaacaggaaatttctccaaggaaattgagcagagatatgaaaaataaattgtcgtttgtttataatcaaattcattcccctttaataaattttgcattagaagctgccaaatccagtctcagcttcctgtttctcctgcaacctggatacaaaagcgtttcattcaaccacccctcctaagtgactgactccttgccaggaactcccagcatgcactgccatctgttcacctctcagctgcttgaatccactcccctttctaaattaattctaaaatcttttcttccaaatgccagtcctttgcctagatgttttaggcagtatcgggctccatccactactctctaggaggaaacaacagcaacgcaacaaagaaaccaaacttgtctcagtgtatgtatagctcaaataagttgcttaaaaacagtgctgcaatcttgaagtgtgtatccctaacagaatatctgagtctaatgaggttctttgatacgaggtttgaattgaaggacactttagagccaaatcctgtttttctcatcat

SEQ ID NO: 46547 - DNA, 1199 bp, Bovine  19866880611223
ctctttgaggtgcaaatattaaaagaaaataaaatttgtttctcttttatttcagagcaaatgctagtaaatctggagggctttaattcagacctccatcactattgaattaactgattggccttcccttggtttaagtgggtggtgggaggtgcaaaagaataaagagaaaagactttttttgagtatcagttgttggtcatttaatctatattataccatttaatcctcactacaaacttgtaagggagagagactttacactttgtccagatctaacagacaccattcacagagaatacaatgaagagcgggcctgcggcagctgtgtaatacaacacccctaaattagagggcataaccacttttgtttgtctagtgttcctccttttggagaacccgcctcccttctgtagcagtcctgctccatccatgttatccggtgagcctgttttccttgccacaggcctcagtctggtcatttgacccagacttggctggactctccttctgttagccactgatgattcaaaaatgttcttaacagaagacagaccaatgagatacctcctgagacattttcgggagcttttcttcctcttggatcctgagttgtaaagaacatgtgatcctttaaatcttgtagtggctatcttattactcagtagcaagagcctccctacaaatgaagctgtatcattatttgagaacgcagatccagtaatgttgaagacactgggctttttcagttacatgagtccattaatatgtttttctgataaagctagtttgattatttttttctgtcacttgctatcaaaaagtttcaatgaatgcaggtagctattaccatctcaatgaggctgagaaattaagtaacttggccatgctgagtcggtaattgatggaaacaggattctaatatagggcaatctggttctcacatccatcttcttttcattgtgctatgttgcctcccgaagccgatgaaaatcaatcacaatttatgaaagtcatgttgatttatcattaggctttctaaaatagaacatcatttctacaaatatagtttccatgtctcaaattttatgccaattctagctggtaagtttgtgaagcagggttattactctttgttatggaaatatttccatttttacaaagctttagagaatgtttcaatgaggcttgtcaacaaa

SEQ ID NO: 46548 - DNA, 1352 bp, Bovine  19866880613992
ctgctgactccttgctaagagtaatcaccataccccactgcctcccatatagaagtaaataatgcaaataacagatagtatttctcatattcaatttaacaaatatttgttgactgcctaccaagtgccagggtctatgttcaaagctaggaatatactgatcagttgagtcagagataataaatctataaaatatgcaaagatatgtatattttctaggctcaattccagtcatagttctctgtgaactatgtaagtgactgggagggaggaatcaggaggaaaggtacattctgtgaaggcaattttaagaactttaatgtagcagccatttaaaagtgcatcacaaattaattttgcagccagcatgcagttactcctagacattatctctcaaaagaattataagttgatggaattttacagcttatttgcttagctttattactgttttgaagtggttaataagctagctaattttttttcttttaataacatctcgttcccttgtctggggaaacttgaatgtagcagcagcaaggaaagagactccagtgagtttctttaatcatccttctaagcagcatgggtttcttcaccataaaacacaggcccacttggtttcctcctttttactccattcctattcagtggtgcatagtccttttaatggtgcgtagtcctagggagggggcttcgcaggtggcacagtgggaatccgcctgccaatgcaggagatgcaagagacccaggtttgaaccctgggttgggaatttcccctgaaggaggaaatggcaacctgttccagtattcttgcctggcaaattccacggacggaggagcctggcgggctacagtctatggggttgcagagagttggacagcactgagcacacatggtctagggagataccatatcgccttctgcattcctagacaaactgtatttccccgtgaacacgtcagcatcgccgagctggtgcaaaaggtataacagcagagagaatgcagttttggggatcaacagacttggggttgaatccagttctgcctcgtctgtaatagctgttgactttccatgttgctgaacttttattataaaatccttacaacatatttcagcccacccccctcccaaaacgtgtagggaatgatatgatgatttacccatatgctcaattcttagattaaaagtaaagcatggcaatggaatgaaagcccttctgtgtactttctccccattttcaactccactggcaaagaatcatgctgttttatttatttatgtatttgatggctcgggtcttccttgctgcgcatgggctttctctagttgtagcaagcgggggcta

SEQ ID NO: 46549 - DNA, 2524 bp, Bovine  19866880708843
agaggctggagtggaagataaacatgaacatttgtttttcctaaactgatcatcgcagttcttgggccaattatcacacaattttcctctcttttgaaggactaaccttacaaaatacaaaatcacaaaatgatgtcatcccatattttcctctcccttatttcattctttaatatcagacattgaaaggagaagttatttcatgtaaacctgaagaaagtcataatgcatccaaaacacttaaatgaagggaaaggaaataatcaggctcccattatgcaaaatggtgctcagttaatttatcgcactgcactgaataataagctgttagactccacattacgtttttcacgttagatcaaatagcctactgctgctggagcttacttcatattgcataaaatttggatatattacaatggagtagatattagtccattataagagacagacttaagtacttcattgataggatctctccatttggaaaatggcacgggagaagaagagatgcaaacaaggaaatggacagagggggatttatgtgcgttgcctatcaacccgctctgctgtgggtgactgctgtttgccacacatggggctggtgccttggagaaaagcagcatttctagtgggaagaaaatccaaagagagtttatgttccttttcagggaagtgttgacattttaattactttctgttttctttggagctaaacttgagaattggaagcaagttagaaaaataaaaattggctttattagaaatcagatgaattgacatgcagccatgacctggagaaagtccagattcagcccttgacaaactcaagtctccagcaggactcggagagccaaaaaatccagccattgaaaaacgaaccagaagaattcctgcttggggcgtgtcatctgtgagagcagactgcctttttctgagcagtttcatcttttctgccctgtgggcccctgttcttcactttcatatactttttcctttaaactttggtctctcagggatttgtgaggataagtagaacaggggtgcaaagagaatgatcttgaagagttagaatgagttgtgaaaactggtgggtgggtttagcattagtagtttttaagataatcagataacttttggtatttcatcaaacaaaagtgcctgtcttggtgtaggtggagctggagtaaatggtttagggaaatgtggtttatttgcaccctcttcttacaagggaatcaaactagtcgatcctaaaagaaatcagtcctgagtattgactggaaggattgatgctgaagctgagggtctaatactttgggtacctgatgcgatgaactgactcattagaaaagaccccaatgctgggaaagactgaaggccggaggagaaaaggatgacagaggatgagttggttggatggcatcaccgactcaatggacatgagtttgagcaagttctggagttggtgatggacagggaaacctagcgtgctgcagtccatggggtcgcaaagagtcagacacactgagcgactgaactgaactgaacttgcatctgcctgcaatgcaggaaatcagggtttgatccctgggtcagaaagatcccctggagaatggaatggctagccactccagtagtcttacctggagaatcacatggacagaagagcctggtgggctatggtccatgaggttacaaagcgtcagacatgactgagtgattaacacttgcacctgtggttgctgagaactgaagagatatttaacaaaacaggtgtacctacatgggctccaggatcagcaagactaaaaactgtaacttgggacaagattgaagctgaaaaaaacaaaacaaacaagtccaaccagcatgttcatggttcccaaaagggtggcacatgaggatataaactcttgtcccctcctaagccttcctggagaaggcaatggcaccccactccagtactcttgcctggaaaatcccatggacggaggagcctggtaggctgcagtccatggggttgctaacagtcagacaggactgagcgacttcactttcacttttcactttcatgcattggagaaggaaatggcaacccactccactgttcttgcctggagaatcccagggacgggggaacctggtgggctgccatctatggggttgcacagagtcggacacgactgaagtgacttagtagtagtagtaagccttcccagtcttactacacttcagagacagtgtggaaactctgctaagcttagatcagttaattcagtaataagtgataaatctgagcccctaaaaaataatttctcaattatctacagcatgccaagtgtttaaatccatattttaaatttttcaaaaatcctgtaaggagatgttattcctgctctagataatattatttctgttttacaaatgaaaactaaggttgggcaggttaagtaaatttataagttatacaaacctgtattataaaacatttcaaatacatgcaaaaaaaaaaaaaaaaagg

SEQ ID NO: 46550 - DNA, 1575 bp, Bovine  19866880731265
ttatttgaacctggttctcttctactttggaggactgtttccctcttacactagaacataaccaatttctgtttcccaagagtttttgtagtaaacgaatactcctaccaagaagtgaaaagtattaaacatttaatgtgtataatgtaattattctacctaaatccatcaacctccttcccacttctctatatctctaggattgagctagggagtgaggcgtagcagctcatgttaatttgtcacctgtccatcatcatttgatcagtgtcatttagacatatttcttaaaaaaatctgatttctgaaagcttctttcaatttctcaaactacaaaaaaaaaaacacccattactgtatgtgatttttcattttctatctgaaaaaccaatataatattgatgtatataccttatttataagaaaaagggaccaagaaaacaacttgaaactaattaagcataaaatacctccagctttaagtctggtgctatttcagttttcagttctttgtttatgattcatataatagtttgctttagacaaattaattagttgtatgtgtcaagctagctaaatgcatgctaaatattttcccaagagaactaagttgaaactgggtgctattaaaaccttcaaatgaacaaaatctgttttaacaagtcacacattattaattggaactggagagtgaggcatatttttggatgcttgccgagaataattatggagtttcttttattttttattggaagatgacaagttaatcaagaaaagctaatccagctcattatggccaaagcttgaaaacatgaccataaactactcactttaccagtttggattaggcttaataatgtaagtgagcgtcaggaatcatgcttatgctgtacttgataccttagagagatttctgcccaatttattcattataagtaggcaaaacattggccagcacccccccaaataatattattgacccaaagtcacacaactgcttagtggcaaggccagaattatgaaatgtttattttgccatggccaaaagtggctaaaaaacaatgcttattcagtaagtggtattataactttctacattaaacctgaataatactttaaaaaacttactataaatgtgtataattttttaataaaagtatttttccaaatagtggagtcattgccaggaatgattcattttttgccataatatacttttttcccatttgtgtttgctaggctgcagtccatgaggtcactatgagtcggacacgactgagtgacttcactttcactttcatgcattggagaaggaaatggaaatccactccagtgttcctgcctggagaatcccaggggcgggggagcctggtgggctaccgtctatggagtcgcacagagtcagacacgactgaagcgacttagcagcagcagcagcagcagcaacaacagccacttaatcttcttcttttggtactttaaggaattatcttgcctctattatgcatggtcattcagtgtattactgcccaccccctaactcaagcctgtttaatcagattctctctttcaaga

SEQ ID NO: 46551 - DNA, 2286 bp, Bovine  19866880822642
tctaggcttttaggaaaatgtcatccatataaaggctaactactgttttacatataaaactgccattcttcattgattttttaggaaagagaaaaatacgataataaaatgaaacatcaccacaaagacttcttactttcctgtgaacattgtttccaaggatatatttttttcagaattcttacatactaggaagaatgcttttaggcttaaggcaaaaattagggaatttcagcttataaattatgaaaacagacattacaaatctatttcttgataataatagtattaacttaagtacacaaccaataagggtggattctaatccccatataattttttataaaatcggcatcttaaactaaacttcccccctttttactctttttattttcccccataatctttcatggatatgtacttcttttacagttaaaaaaaaattcccttttggaaaataattgttgtataatacatatattacacttagttgatcaccccatcagtttgttccgatcaaattcataattaccaagtgtctttgtaaacctcagaataaagtcctgtgggatgtgatgtggcaggctaggtcctgggagtcactattacctctcttagataaatcaagctttttccacgtgacaagtctatcccgcaatccacatccacagtcaaacaaggaataggaaccgcccactcccaatccacttcctacccacccccttgagagttcccttaagaccactaaaaatcaacaagacgatgtcagagtcaacagctggtagaaatcaggagactagtgacaagaattccctaagccccctgaactgaagtctgacattcgtattccatagagaaagaagagacgagttccactgaatgctcgtgttcagaggctgggctttcttgcaagcttgatattttccatctgtgcatatatttggatatctaaacatgtatttataacatacaatcctattattaaacatctagagaaataagacaaatgcattggagggaggggtgtttatttactctattaaagcattttcacatgaaattataaatccctattgcattctttgcaaagtaaattgcctgaaactctgaggtgccagatttcttttcctaaaccaagacagaacacacagactgagagcataaaccaaggcaactatggcaaaggggaagaggggtgtagacagacaggtgttctgagaagtccccctaaaaataaccagccccaaacatcctaactagatttcatttttccctgtagctcaaatggtaaagaatctgcctgcaatgcaggaggccggggtttgatccctgggttgggaagattctctggcgaagggaatggcaatccactccagtattcttgcgtggagaattccacggacagagaagcctggtgggctacagtccatggggtggcaaatagtcagacacagctgagcgactaacacacacacacacacagaaattaaatgtatccatttgtaccatttgtagaatcacacgtatcatctacaggaagatgcacctcggtagtaaatttgagtatttgtatcagtgaaagagaagatggatctgtggatttcaggtttggcatccatccgaagcacttggagtggtcttcaacttgtgccatctgagcccacagctgaaaattttgattcagtgaatctgacgggatccagattcaatccagaacaagtcgttcccctggatccatccaccaggctacatggatctgtaacataatgttttttatttatagcatatatttggtttaaaagtaaaagggaaattggtattcttctgttgaaaccttctctcataacaaaccttggccttatttttgaactaccttacccattctccatatttctaatattgcaattcttttttttttttagttccccaaccaggaatggaaccatgcccactgaggtgggagtgcagagtcttaacctaaccttggactcccagggaagtccctgcaatttctgatacagaatttcaccggtgaagatcaagagacacctctaagaaaaacaagaacatgaaaaccattatctgttcttaacactcattaacaaatgactcctgtgcactgtcagtcagctggacctaccataagcatgggtcacagttctggaggctgggcggttcaagatcaagccaccagcccatgcggttcctggactctcttcctggcttgcagatagctgccttctcactatgtccttacatggcagagagggagagagaaagagggag

SEQ ID NO: 46552 - DNA, 2481 bp, Bovine  19866880837319
gaagagagatctatatagattatacaccacagctagttctctgttttctttttcctctgccttgaacagcagtcctctaagctgtataaatgaactagtacagttagcacagagctgcattatttgaccaaatagcaagattagtcatatcagaatagtgtttgaaagaaaggattccactagctgctttactgttttttgtgtcttatacaaaagctagcatcactgttcatgtgggagttaagtcagtgagcactgagctttcagaaagactttctgaattatccaaggtaaaaaataaattataaaaatgaaaatacacacacatacattcacatgcgtgcatgtacacatacatacaggaatagcaagatgattccatgattttgttgttaagtcactcagttgtctgactttttgagaccccatggaatgcagcacgtcaggctccctgtccttcactatctcccggggtttgctcagattcatgtcctttgagtcagtgattctatctacgtaaccatttcaccctctgccccttgtttacccttttgccttcaatctttcccagcatcagagtcttttccaatgagtcagctcttctcaccaggtggccagtgttggagcttcagcaatagtccttccaatgaatattcaggattgactgatttgatctaagagtcttcaccatccctacaatttgatagcatcagttcttcagcactcagccttctttatggtccatctctcacatctatacatgactactggaaaagccatgatagatgaatctatttttaaaattgtaaatgaaagcatttgttaaattattaaatatcagcttctatgtgacacttcccaaaatgatacaaatttcttcttcgtatacttcattccaacctctactgtagcctttatgacattttaatcaaagtttgttacatatcacccttcttcccaaagagattgtaagggcatagcggacagacgctggcctggtcagccctggcagatgtgtggcatagggtagacaacaagtatgtgctttggggagtgaattagtgaatgattacaaattattcggtagttgatctatcctaagtggtatccaagttttccttttgatctaaggacacaccttggctcatcactcagaagatgcagtattcttaccacatggttctcctggtaggtcatctacaaactgttaatacagaaaacaaactatgcaaaattttatgaaatgcgcagcacacgccataaaaaacaagtgcttgggccatctctgagccctgttttgagggtatattatttaccagatactttaatgcaccttctctaagtttaccctcacagcccttagaagcggtcatgtcctccatttccaggtcaggaaatgggtaattcaagcaagttgcccagaagtacacatctcggcacatgatccaagctttcagaatctatgctcggggctcattttactgaaatgcagctgctttcttcctttaagagtatttgtttagacaaatatcccaagggggaaaataggcaaactaactgcttggcattgcattggttcaacacgaaacaacctgttgatgagatgaattactcactcttcactcgattattttgtcgtcttgtacacacaagcatactctggttaaggatgaaaaatgtctttcataagactgttcagctctgcccctggcgtgttctgttcagtatgatgttgttatttttcttttaaatcttcatgcttcttattccaaatgcaaaacaatccaagctcctttgcgttctcattctgtaatttattcttgaagttattcctcatgttttgtttaaaatttttaggtttttctttttaaatgcaggtgtgaggcatatataagttttaataaggagggttgatttttttccacctgacaaacatacctttaattttacagataaatagacagctatgatttgctatattgaaattcaccttacagacaactttttaaaaggcatgctcttctgcaaaatgcaacacctgttcagaccaagggactaaaaggaaaaaggtataaaaattcctcttgtagcactatgaatgctctgatcggttgtcacttttctaaatgcgattttcccccaatcactacatttccaagcgtccaaatggagaattataattctggacaatgatggaatgaattgggctccacagatgctgaggcagccggttcactattagatttcaaaggcaacattcccaaactgatgcctgaggagatttgtttttatttggataacagagaacttgagatgaataaaatgatagctttacaagtactattcagcactactatgtaaataagtagcttacacagccagacttagtgataaacaaaggaacatgtcaactgacattcaaaccgcattactgcagtaatgtaatcttcctaggtatgggggaaataatttctataaatg

SEQ ID NO: 46553 - DNA, 833 bp, Bovine  19866880852463
cgaactagcatctgtcttatattatgcaatttattatcaactttaatgtttttaaaatctatgacctcactcattatttatcctagcacatatctggcatagagaggagatacaataaaccttttctgtcagttgagcaattagatgtatttgacccatattaggttttgcaaacatctgtgaagaacttttacaaaacaagggaggatatgatattagcaaagaacagaacttgaaaaatctgttaaaaaaccttaacggtgagtcccagtaaagatgctgaagcactaaagtgagcagtgagagcctagtgaaccacacaattctagtgttgtccaaggcaaatcgatatcagcattcaccagagttttatcttgcacaggaaaagagagaaagcaaagaggcacaattttggaatcactcctccaaccacggaaatgattttaattaccagttcatctgttggcagactcttctggcagatgtacctgcaacttggaaagataacaaatgaaccagttccttgctccggagttgacgctggtagtgcttgctgaatttgttctcagaaaagaatcccaggcaacaatacatctggcactctgttcgaggaatttgtcatgtcattgacatgttcagcctccattgtccacaccaccctgacagcaggtcctttatatttcaaagaaattgcagtctgaattaatataattagaatgtaactgctattcactgcacaaactcctcgttttcaggactacagatctgatagcatgtctgtgttcagaatctttccagtgatggctggaggggagcaagcagatgataaaatg

SEQ ID NO: 46554 - DNA, 1148 bp, Bovine  19866880871184
ccttgcatttatacactttccagtgtatgataatataaacagtggtcattttagcctcatatccatcttctgtgagatccacaaggtgatggtcgttgtatccattcctggggaaaccgaagttcaagttgtgaaggtcaccaatgttttagaaatgtccaagttcacatcactatttaaaggcagaaccaggatttgaacttaggttctgttcactctttctggtatgcagtctgcatgagtcaggatgagcaagattacgttgcagtaacaaatggacttcagatctcaggggctcacagtaatatagcttgatttcttgctcatgtcccatgtcacctgtggcttttgtctactttttgtttacagggggatctggatgacagatcctctacctggaacacaggcggttatgggggcagagtgaaaagcaggagtgacggacctcacactggctctgaaatcctctgatagaaagtggctgtcagtctcagttcattggccaaatcaagtcacatgcacttaccccatataatagagcagagatgttttctctttccacagggtggggccccaaacaggagtaaaaatgtttcaatttatgttagggtagtgatagataaagtcattttatccatcatcttcttgtaccatgaaggtattcactaatcaatgtggtaccgattaagaaacatttcagataggctcagccaagcagtcatcttatacaatttaaaaataaaataactaaataaatttaatatttaaaaaataagctctaaaatatgcctattgtgcatgaaacctcctgcattttcaaataaagcaactttagctctgggaataaacttcccattgttggcagaaaaattgtatactaacactgacgtgatcctgtgaatggtcatcagagtgtcatatttgaatgtgcaatgaataaacattgacagaaatcccctttgccatgtgacttcaaaacagataccagtcggtagggaactacccgttgtgctgagtaggggaaaaaaaaaaaaatgttcatacactctccctccatggagcaaaaatcccctgccaaaaatcacctctccagaaaacgcaggacacacgtggattctcacatgtgtttgagcacgcaaccccacccc

SEQ ID NO: 46555 - DNA, 2404 bp, Bovine  19866880913876
ttttgttatccttttctttaattaaattggtgaaattgatgatcaagccactgttgggtgttttggaaagtcacactaagtggggaaatgaaattctatgatttctggacaaagtagcttagtttctttaaaaggcatccctggttcaggaagattccctggagaaggaaatggcaacccactccagtattcttttttttttttttccactccagtattcttgcctggagaattccatagatagaggagcctggagggttacggtccataggttcaaaaagagttggacacgactgaagtgacaaagcaagcaaacaagcaagtgaggttaatagctactggaaatttgtaggacagttttctgaacaatgtgaaatgctgtgtataattaaggttcttcttctattagcagatggccataaaagccttctgctagtgaagatttattaaatttgacttatttgaattttgcagccagggccctgatcctaaattgtaagccttcaaggaaagtcctagaaaaggcattctcatgaaacatgccgcttgaagaaatgactcacatcatgcctccaggaatgtatgcagttggtgcttatggtgtccctgagacaccaagagcaccctgagcatgccaaatctctagactggcactgattcagtctccaaaacacaatgaactcttaaaaagttacaagctctgttagaaaaatagattaatactttccataagaaggcgtagagaccttgggtgttgatttatgccttttccctatcaaaaagctgggggtgggtggagctgaggatagaggattttattttggaaacggacccagttccactgtgtcacatttgtttcttcccagtctgatttctgtgaccagtcataaaaggtacagtctacctttcctaggtaactaatgccgggaacattgattatacctagctccttaaattatgaaaatgacaagtacatgaaattttttatgcaagcacttctgtggctgaattagcaagcatactgagctaagtagaaactgaatgaattctactgctgggttctacacaccaaaatttaattaagtctctgatctaaagcccctgttgttttatcgattagggaagtcatgagtggaccatgtcattctcaggacagtgcaattgtgaaatctgagcagtctgtatgtcttttttttttttgcctgaatgttcctttcaagtctcattagattattatgagtgttacagctatactaatctttttttctgggaaatgaacttttaaaattgcacattttaaaagtgacttctagagttaccatggcagcttcattataatgcacagagatgagcattatcacagttcggcctgatctttccagggctgtcaggaaatgagaattccacataaagtgaatcctccagtagggctcataaaacttgccagatcaagtgcctagtctttcagtttaacaattttaaatgaaaagctttctatcatatactgcacacatctctgtttccttcaatgtgttcttgatgactcaggatctctgttatcaatagcttattgtacttagagctgcacacagtgctgtttgattttttagtcttcttttccatttcagtttgccagaagtttatgatgaccagggacactaagaatcatttcagactctgaaagggtttttgtcctcccacctcccagcaaagatagatctataaagatatgtcacccagggcacctaggtcctttgctgaagtcttcaggggaagaaatgacagattcatcactaatatgcaatgccgttggttccagaaccatctttctagaggcacaactggtattttgtcctgacttcctgcccctagtccaatataattcagttcagttcagttcagttcagtggctcagtcatgtccgactctttgcgaccccatgaatcgcagcatgccaggcctccctgtccatcaccaattcccagagttcactcagactcacgtccatcgagtcagtgatgccatccagcaatataattactccttgccaatttctagatttatcatattctgatgggctttttcttacctctgcactgcgtaccttaagcagttccttacacagaagtttctagggctccaaacaaggggctaagactcaccattcattgtgaaacttaaggatacaggcctgcttaacctcctcgggcttgttttctcatctgtaaaatgatgtttttaagataaaattcagttatatatttggagtacatagtatagtcttcagctcatagtaagaattcagtctgaaagcaactatatgtatggaatatgatggtgattgtatgtaaaaaacagaagcaaaacaccacaactgataaacggtagtatcgtagactgtttt

SEQ ID NO: 46556 - DNA, 2217 bp, Bovine  19866881022989
tctgagaatgatggaaccgagcgattctgtcttggtccatctatttgtatattacaggggcatttgttagcactctactttagcataaatatcgcatacatgcatagccacgtttcttttgaacaagaccactaaaacaaaaaagccctgaaatagacaacataatccttgcaaagatttttaaataggaagcacaaatattcccacacttcagactggcaaggttagaaaaaaatagatgaggggtcacacatattaaatactaatgtaagtgattgcaaacacccatgctttaattggcaccgtggtttaattcaggacattttagaaattctgataatcttagaaaggagtttcagacatctatatttgtcctcagtctttcttccaagattcaatttatggaccattttttaaaatcctgctagctcttcacattgtgccttctaaatttcctctaagtgaacttaaaaataaaatgtacttgccttcatgctaataccatttggagtctaaaaatggtattcaggactttagtcctgctctttcgcctctggctgtggtttttagtctcctggatgtgactgacgcattgggaagggaccgcatcacacacatcttcgttctactcagaacagtgatgcttaaggggtctgcttattctctaactatagctccttcactaccctttcagccaaatgttatctggaatattgatagctttgaaaaaagttatgtttaaaaaggggtgacccagccattacagggattaaaggaaattgttgttaggtcgctcagtcatgtgggactcttttgcaaccctatatactgtagcccgccaggctcctctgtccatgggatttccaaagcaaaaatacaggagcgggttgccatttccttctccagaggatcttgctgacccagggatccaacctgcatctcctgcattggaaggcgaattctttaccactgagccaccagggaagcccaaaaggagataataaaggttgtaaaagggaaaggaagaatatgtctaagcattgggaagtggcatcaataaacactgacttagaggctgaaaggtccttggaagggtccttcacattaggtatctgacttgttgttctctttatgctgtggtcaactctgaaactcagaccttctccagaggtgcattgtgtgcatagacaggcacagtgcgtggccagtgtcctctgtgtgatatatcgaaggccacccacgttgacttgtagcaagatttctaaaaatgcactgggtagtctgacctcactttgcaactacctttttttccccagcctggagtgataggaatgaaggttttagaaaatgtgtgtaattgatgagtagtccatagcagatatttcttcttctttttttcttggagtataatcgctttacaatgttgtgttactttctgctgtacaacaatgtgaatcagctataaatacacacacatcccctccctcttggaccttcctcctaccccctcatcccaaccctctaggtcatcacagagcaccgagctaagtgccctgtgttggcagctatctattttctatagctagctatctatagctagctatcctgctagctatctattttcctatggtggtagtgtatacatgtcaatactaatgtctcagattgtcccaccctcctttccctccctgtgtccgcatgcccattctctatgtctgtgactcagtttctgccctatcttttctgacccctactccctccttaggtggcataagatggccacatcctttggatcatttggtacctgggcttactcccctaccctcctacacacaatgctttattgtatttattcatatacagggctgtctctttcccccactagtctccttagcagaagggactgagctttgtttgtactttcatccctaaatgcaagatgtagatgtctcagccaggtgaaaggatcaggaagcattctccacttcctgtatgaaagcctgtaaaatcctgctcccatgggaccttgtaaagtaggaattcacatagtagaaagagacaaacacattaattcttccctgttccaaatcatgactaggtgggaagttttaacggaacaacacgtaccacaaaatgtttatctatcccttgtcctaatgatgaagcaaaaaggagaaatatagggggtcctggctcctccaggctgaatttggggga

SEQ ID NO: 46557 - DNA, 1379 bp, Bovine  19866881044197
tatttttttttttaaagcaaatttttaaaaatagctggtacacattctgctcagtgaaagccaaggacatagcattacacagtggctctggaaagtcaattattcaaaaggctgtagtgactctgtccaagtatgtaacctaatgaagcactcaaaggtagaaaaccggcaatgaaatactagccctgcacttattagcagagccaccatagcttagtccctctcattccctgagcttatgttttttaagtgtaaagaagtggtaataataccaatacttgctttgtgtgagaattaaattaatatataaaagtacttttaactctctaatgtatgtgcaaataggtaacatattttcatcaaacgatactctaggatcatctagataaaggataaagtcagatcagattatacatactttataattaattgcataaaaagttcaaccaatgagtcattaaatagtaaaaggttattttaagttttcattgcagctctaataaaaaacctttttttactcctccatatttattattattttattatttcccatgtttcaaataagtgagatgtcatccaccaaaaaaacagttgtttgaggacattattaccaatgtgatccctaccaccaccattacttctaccaattgctacaatttattgagcatttactatgggtgaggcaggaaatgaaatgcttcatatacatttcaaacacaatccctgaactaggagtgacaaggtgaattttataatgcccctcaagagcagtaaaacattagactagttacttatctctggtcctgcttttctctaggcttggatcaatattgattttacatcttagaagtttccttccagacttcagtattctattactttgttagggtcaatttcatggtacaaattctcacatttatgtcattctttttttttttttttgctataaagtgaggcatatgggatcttagtgccccagctagggatcaaacctgagccctgtgcaatgaaagtgcagtgtctcaaacattggactgcaagggaagtccctgtgttatatgataagtgcttttacctcaattaggaatgtatacttttcttagaatgttctctttggtagtatatcaaaagcagcaccatcatttttattcaacaaacctgatggggtattcttccctaagagtgaagggcatatttaccacaatttgtggaattttgtggaatgttttccctgaaaaaaaatagcaaggagtcaatgagtttgcattattgccttaaattagtgagtggacattctatttcaagaaaaaaaaaaaacttatttttttgcctttatttaaaaatttgagatataatggcataacatatttcttaaaccc

SEQ ID NO: 46558 - DNA, 1012 bp, Bovine  19866881183449
aaattccctccaaggttaagaggtggcttctgactaacagcagaatgaacaggaaggcaaggaaaagaggcctcaggccaaaggggaatgaagaggatggcggagcagcccagaggaggatcaggcaatggaaaattcaggaaaaattagtgggaggacagaacagaactgagggcctggaggatcatgggagaaagaatgaaaggaagcagagtcaagactctagagcccagagaaatggccgggccccctgaggggtgaagagggaaggggaaaaggaggcagcaagtcaaatcgaagaaaagggtagaaaaataaggagacagcattgacagattgtgcactcctggggtggagacacaaatctatttgttgtgttaatgttttttgttaatgtttttcatctagatcctttacaattttagtttagaacttctttaaatagttctaaaaacaggaccattagctgggagttattataaatcaaaaacaaaacaaaaccactgctaacaagtgggagttctcatacccctaatcagaaaggcctgtgtcggatttccaagtcctgtccctagagactatgagaagtttttttgtgtgtgtgtgtgtgtgtttttaatgatagcatttccataaaagcctgatttaatacaatcaccactcagaccaaatgtggaggaaataaaaaagtgctttcaaatccaagtctttctttgaaatttaaaattatattctaggatgctgcttcatataaattctaaggcaagggaacaaactaaaagcagcagcccaaagaagatttttttttttttaagtagggtaggaaaaaggacaagtcagagtctggttacatctactcatgcaacaggcttccctggtggttcagaaggtaaggaatctgcctgcactgcaggagaccaggtttcaatccttgggttgggaagatcccctggagaagggcacggcaacccactccagtattcttgcctagagaatctcaggatagaggagg

SEQ ID NO: 46559 - DNA, 1419 bp, Bovine  19866881196932
ttttgtgggcaagttaacaaaatggttttccaagcataaggatgctgaagtagccattcacccattagtcgtcaatagatctcggcccctttttcccctgaagctttggcttcacccttgtttacattgctcagttctgtcagtttagaacacattaaaaagcagaactgggctggctggtttacgttggtggtgaactttgtgcctcaactgtatcgtaaccccagagtttactcaagcccacctggcagctcggctccgtgagataaagcaggttttgtctggcggaaaccagtagaggtttatctttttcctctcctgctggcagacagctggttgggcatctaagagacgatcatctaccagtgaaggctaataaaacacacatgcacacgtacacacaaaaccaaacagacaacaacaacaaaagaagataaaagaaatcctttatatcagaggaattaaaaccaataccttgtttgggtagccttgtttcagaccaaagcaaggtcctcttttgagaaaccatactttgtgtgtgtgtgtctgtctgtctgcatgcagatgcatgtgtgtgctttagaattatatgaatgcctgcatgggatggagatggggaattgtgagtgaaagaacagctagcaagaatctaaaagcaatccttacttgctgaagtactgtgtggtttggatcaatttctcatacttgaaatggaaaatttcatttcattcatcttttccaaaaccatacacagtcattcccttggagaaagttacactgatagtaacaaagcaataagcaattttatataggagaatataaacacaagacaggtggaaaagagcagcctttgctgtggtgagttgtgatgctgagcaacaggcaacgttcatgcacagccccgaaacttctgcatccaagttcagcgcaggagaataaaatggatttttccatctccagtcaatccaagtgttatgagctgaatggtttcctcccaaagatgttgaggtcctaacatccaatacctgtgaatgtaaccttatttggaaacatgagtctgcagatgatcatgttaaggtgaggtcatgaggtggggccctactccaacataactgtgccctcgttaaagaggagaaatgtggatacagagacaaataggcacacagggagacagctaagtgactatgaaggcagaattcaggataaagcacgcctaagcccaggaagactatatatgcccagcaaatcctcagaaaccaggaagcaggaagggagcagattctctcacacagcctttgttgttgttgttgagttgctaaatcatgtccaactctgcaactccatggactgtggcccgcctggctcctctgtccatgggttttatcaggcaagaatactggagtgagttgtcatttcctt

SEQ ID NO: 46560 - DNA, 1328 bp, Bovine  19866881202551
ttgtatttttaccatttaattttatttttgaaataatattttgtatgcattttattacatgagcaatatacaaccatttataattacaaattataatttcgtgtaagcaagaagaaaaagttattttaaatcttaccatctagagaagacatttataatgaccgcaacaacaccaccacacacacttttttccctgtgcatatatgtgcctctattatgcataaataattccatttaaactaaagtgagattaaaaactctattcgtgtttgtcaaaagctgcctagcggatgtccctcaaagtgtcatgaggattaagtgagaatttatgtaaagcatagcactctttattatagaaattcctgtgtgaggatatatcttttaaggcctttttaagggtaacacatctggatctagtgtgaatctattcatttcttctctctctgctaccttgatgctctagccctttaattcttcacatgaccagtgttgttacgcctctggtttataggtgatttctgaatggaaaagtctagctcagttgagatagagtaagtacccatagtaagattatttttcccaataagatttaatcaggttgggagtagtaactgtattttacacttcttcatattacccatgtatatacgtgctatgctttgaatgtgaaaaatatgattttttgaaagagtacttgagaagtccataaagtaacattcatcaactgagaaaatgtttactcactgttctaaatgagttacttgtatttttttttttttttcgactttgggaagaggcaattgaatgtgctgataaagatttttttctataatattgcttgaactgtattaaagatttttttggcctttgcttgcaggtccttaagcattatttttttcttcaaattggcatttgctgttcgctatttgtctgtacaaagtgtaaggcaaaagatgaaagtaaatactctaaaaaaacctgaaatctctccaaagatgattgcaacaaaaattatccattgcaactttataattaaagtgcttgatgaaatgcacatgttgaataagtttttgaaaaagttcccctttctgccttctcccgtttaaaagattaattcatttaactgaaaccaaccagaggaaggaaacagtatgcagacttaaaattttgtttggaaacaattaagttctgtctttcccaaaatatagattgtgcaattaatacggaacttggctagagcaagactgttgacaaaatgtagctagaagatttgagctatttttagttattatgccagtttgtacttaataatttctaacatgaacatt

SEQ ID NO: 46561 - DNA, 2224 bp, Bovine  19866881214023
atcctgttcagaaggcctaggagctaccagacctggtttttaaagtttgtgttggaaaataatgcaaaattctttcctttaaggactggtttcctttcatcatggcttcaaggagcaaagaaagagttaaagaaagcttcttgtttcactgctaccaattcctaagctctttgcccaagagctgggctcatgctgacttctcttatggtcccctcaaggcacccagcacaaggccttgcatggagtaggtggacgatagaggtttgtgaatcaatgtataaatggatgagtcaagtcacactattttcatggagaatcttaaatgtcactcttcttgaaaattgaccatgctgctcaacctactaaaaatttcataatgaaccgcctacaagcacaatcttgtatgaatatcccctgtgttccccaaatcctttgtgacctatggacacaattgccgaatatgagtcatgcttctaccacgctcccacacaagtggtatttttaacgctccagcacttcctgaagtcgcgctctcaggaaacggcttttgcaataatgacctcaccctccccatgttcccctcaccccaccactgaatcccaaaatagctgaacaggtgtcaagatacgtagaattacccaaaacactccacaacctgtcttatgcctcctattaaagtcacgaggatgacctcttgtcctttggagtttgaaaggaatatttgtgctttatttatatctagatatagtttattcttaaaactggcaatagccaccacgcaccagaactaaatcagtataacacagtggttaaggttatggcctctggggtctgacagccctggagaccaaattttgaccccatcgctaactatggattaaccaacactaaccacaatggatgtgctttcagtcaactcatttaagcatttagagcttcagtgttatcatctataaaatgggaataatagaagaaataattttcttggaatgttgtgaacatcaaataatattaatacaactcctatatacttctgacctctgggctgataaagagcagctgctcagtacttgctaatggtcattattgtgtcaagttttcctggacctcaggcctgagttgtctctcttggaaacagttgaccacgatgtggtcactgtgacttccaggagtctttagatgtccagataccttcagaaacttatctggctcaacccattctggagggtactgccctagcaccctctgggaatcagaaaggtcaagggagagcagagggtgagaagtaaaggagaggggatgggaaagattatatcaataaagccacctggtctcacccaggttcaaagcaaacagagaggctgccacatgactgtgggaggagaggtatttacacagtgaagctcctggcaacgatcatgatcaaagtccatacttctttggaaaagagtctgtttatcttttatgtctttcttagaagagaaacccaattgcaaagatgatactgaaaatgacaatttgactctgagaaactattctcatcagaccatctgataagcttcccaagggacttttctaggctccccaaacagcacaggacaaatagccaactctgaagaggatgccctggggtgtagccaaactgcaactgccctggaagtcagatcccaaagactcacacacaagggcaagggcaggatgcatacatgcccaggccattcaccattcatccccaggcaggagcacacacaaagccaccccagaagaactgctttggaggcacagagaggaagaaaaagatcctgctggcactgctgggaaacatagcggtaaccagcacaccctggccctagcaaccagccagggacagactcagactgagaaaccctttctggacacatggcctgaaagcaaactcctcagaggctcaggctccatgaaggctaaggatcaacaacaaaaagacattaaagaccatctcctaaatggtatttcatggccatcaaacagccacaacaagctcatcaagggagcagcccatgtctgtaggctggtggagatgctctggcaattgagacacactggcagttccagggagggaacactgtctgtgggatctctctacttaggaaggcagcattttgcataacaaatgttccaggtataatctttccttggcataagtctttctggaccccatagtgagacttactctcaatcctaa

SEQ ID NO: 46562 - DNA, 1436 bp, Bovine  19866881306742
ctttataaagctgatatttgtttccttttaagagaagctgaatttagtataaaagtaagtaagaaaaagtctggaaccagaagggaaacggagacatatccaggaattttaagcagaatgaggtcataggaagctgttgttttcctgcaccttccttttttttttttgagcaggaaaattccacacaagaagcagaccagttgatctcgcaactgtgctcccatgtctggcacttatctgggtcaagtcaaggagagctgcccccaggccctggaaatagacaacccacccagtggctgggacacatagcacgtacaactcttcttatcgccagacgttctcccccagcgtccgtctggaagcagattctctgctgagtaggcagcacaccggactgacagaatcacccagggccacctgagcaaacagcccttcccttcatacatccatcaccccgtcccagatcctggaggcacctcgcttggtgttcgtgtaaaggtaccaaaaggtgttttcctttcagaaggatttaagagagcagcctgtcactgggcctgggctcaactcttactgctgatttcctaggcgcgtaccttagcaccagcttcataacctctctgtgcctcaatttactcatcagtaagttgaagataccaggcatacctacctcatgggggttctttagcagattaagtgaggaaagagatgtaaagcacaatgcctgcatgcaatagtgaaagtgaaagtgtcagtcgctcagtcgtgtccgactcttcgcaaccccatggactgtagcccgccaggctcctccgttaatggggtttttcaggcaagaatactggagtgggttgccatttccttttccaggagatctttccaacccagagattgaactctcctctcttgtgtctcctgcattagcaggcagattctttaccatctgagccatcagggaagccagtgcatgcagtaaatgctaaagatgtgaactgtggctaggggtcagtccacaggactgtctaggacaatcctggcttcagagctgcatgtgccatgctaccgctggtttgggggcttctgtgccactgctgcccactgtgggtagctgcccactgtgcttcccatcaggcttcctgcacttgagcactctgggctatcagtggcccccagcctgcctcattgtggctctgtgttgtagacctccatgttaatcgtggccatttttcacacagtaaatagcgaatgttagtttccttgatgacagacacacagagaagcacaatttttcagattcaattcatagatcagttctcaatccttaagtcatatctcttgatctttgagtcgcacactgtaaattttgattatctctgttttatagcatcctttgtcagtctgatcccatgcaatatggagaaattgaggtatggatgaca

SEQ ID NO: 46563 - DNA, 888 bp, Bovine  19866881374562
gcaggcgtgggaccaagtgggcggaacgtcccaaagcggcacgtacatctgtgtctcgtaagtgtggcagcatcagcctgtgctttcccagtacagctgtcaacatcacagggccaagagcaggaaggaagggcaagtccccacaggcccagtgatggggcagaggagtgagtgataataacagctcctggcagccaggcagcagctaatcaggaccagaaaatctggtgtcagtagcagggtccctgaaagctttcccaccatcactccatcactcccagatccacagccacactcacacacatgcatgcgcacacacacacacagacaaacacacacacacacacactgccccctctcccttttattaaaagtgacagctatttatcaagcatagccacaagagtcagaaggcctgttttgagtcctggttctgccatctatgggctgtgtgacctcgggcacatttctcaaagcctctataacatgggtctgcagactgcagggttccccaggacaggggtgctgagaggagtcagtgagatcatgtacaggcagtgctgcagagcttggcacatcataaatactcagtaattaggatgcatgaaaatggaaccagtgctggagccaaaactgggcccacacttgagaatcaagatagttcccacaataaagatgtccttgaacttagaacagcagcaggactttgttcatgctgcgtctcaggggatggggtgagttacctgtatgtctggcctgcctgcctcagggtgggtctgtagatgggcacagggtttgtactccaggtgaagggcaggaagagggatataggctctggaaacctggaggtactagtacactgcgaggcagaggtgtagtcttctagaa

SEQ ID NO: 46564 - DNA, 1712 bp, Bovine  19866881383097
ccatctgtaaaacgggtaacatagggaaatagtactcatcttgccaaactgttacagtacttaaggcaagaggtaaaataatttctccaatcaccttgtattagggtgatcctgagtctgccgagatttctagtttgggccataatgtcacttttctcttccaactgggaaattcttaatagttccttgttatgttgaccaatttttatattctgtatatattgtatttatattgcacatgagaatgtattgaaaatgaacaaaatatatcttatgaaaatatatcttggaagttagcatattgtgtaagttctgatttatccagctctgttagcagtggaaaatcaacaaaagaactcatgaaactttattgagactgatctaggagataaatacgtctgacaactcatagaataccaggatcactatacttttattaattgaaacataatgtctatataacatgacattcaattccctcaccttccatctaaattcgcacacatcatatcctgcagaactaatgggattttaatactattttttaagttgtcacctttacagttgcaaaaaaaatgcttcttcatttgcgtttaattacagtacatgaaaagggcacatgggaagtggattcaacaaacatttgttacaccaaacaagttttgtctcaatcctagctaggagacaaaatcattggaacagtataggcatttgcaaaacctctttagtttctgttggttaggcacttgcagaggtgctaagaggctgcagcaggtgccaacagagcacctgtattcgtgggtcttgaataatgccatttgcttaggatttccattatctcagatggtaaagaatacgcctgcgatacaggagacctgggttcaatacctggattgggaagatcccctagagaagagaaagcgtacccactccagtattctggcctggagaattccatggactgtatagtccatggggtcacaaagagtcagacatgactgagcgactttcccttttcactttcacaaatacaagaagttggtttccaacttacgttaggattaacgtaagttaatgggtcttaaattatgaaatatatcaaaagagcctaaaagaaatcagaccaaaagagagtgaacatgtcagtacttttctattattattttcattattattaatgaccccccccttgtgtatattctagatgtattctaggatattgatgatccttgaccttgggtgccacaccatcttgtaattattgtgtcagaagaattgatagcttctagaaagtaacagcaaggctgaaattaacttccagctagtatgctgttgacagcagctgatggatgagagttcaggaaagatgtggttgcaaagaaaatcacaagttcctgcccgctgaatctccaaaatcaacttaacgtgactccgatgaacatctttgcttttgccccatcatcatgaattctggtggtagaatgaaatggaggcctttctttttcttctattgaccaccaaacccgagcatactgatccatggattcccctgttaagtggaaagcaatcctttgactggagttttcttttatagccagttggagcttcaaaaggctctgatttctggtttggtcaacatgatctgaatgtaggtgagaaacacagaagttcagctaattataaaataataatttagaaaaagaaaatagagg

SEQ ID NO: 46565 - DNA, 1250 bp, Bovine  19866881385187
aattttcattttcatgtttccaggtgatgccgggaccaactttattccactaggcacagtaggcagagggcctgtggctcactttacttttcaaaggcccatgaaaagcacttttttaattcatttttttaaaacttttcattttgtattggagtatagctgattaacaacgttctgatagtttcaggtggacaggaaagggactcggccaaacatgtatatccattctcccccaaactccactcttgaaaataagaatatacaatgatggatccacagctggactatattcatctttgtatcaatgaagtctgaaaattttccctcttatttatgtatcttttttttaaaaaaaattgtttttatttattcatttgagtcagttcagtcacccagttgtgttcaactctttgcaaccccatggactgcagcacaccaggcctccttgtccatcaccaagtcccggagcttgctcaaactcatgtccattgagtcaccgatgccatccaatcatatcttctgttgcccccttattctcctgccttcgatctttctcagcatcaggatcttttccagtgagtcagttctttgcgtcaggtggccaaagtattggagcttcagctttagcatcagtccttccaatgaatattcagaactgatttcctttaggaatgactggtttgacctccttgctgtccaaggaactctcaagagtttattaaaaattattatttatttttggctgtgctgcatcttccttgagacaggtgggctctctttaggtgcagcgagggcgggggctactcttcagctgtgctgtgcagccctcttgctgcggtggcttccgctgcggagcacaggctctaggtgtgggctcagtagttgtggcacaggagcttggtggctgagaggcacgtgcaaccttcctggaaggggaatcgaacctgtgtcccctgaattggcaggaggatccccaaccactggatcaccatggaagtcctatttatcgatgtattaatttaatgaagggatgggcacacgaaggcaaaagggtcccttgccctcaaaagtcaccatgtggccctgagtgctgctgctgtagctggtaggaaacacactgaaacaactgcactgaactaaccgatcttctgggatttgttagcgttctactttttatcctgaaccgttttgaccctgtgctgtttttactcagaagaaagacacagtcaattgaacatgctaatttaagt

SEQ ID NO: 46566 - DNA, 869 bp, Bovine  19866881419399
cacttccccaattgcggatcatttgaagttttagtacaatttttttttctattaagcataacaatttaagttcaacaatacacttttaattcttttgttctttttaccatgctttcttatatcccacatctttccttatctcagcttcttagtttcattggtatataagattgaataacttgttcacattttagtagaaattggctcagattatggagctcatcccagcgactgtggagacagaagaagacatcctgcaaggaggacatgtgaatatcactggctgcttgtgacaatgaactgccccagctctctggtctcagagcccagtcttgtattttagcctgtgggcaatcactgctctgtctagctccatgtattcaagaggtggggggctggctgacaagcctagttcctttgaatgcactgccccaattaatcactgtgacaattgctccctgacctccttctgcctgaagttccctgtaatcactctcattccacactgcttctctcctgtgtgctattctctggtcttgtttccctgagaattcaaacctctctgctccgtatctcttacgatgatcttcctctttggtgttgacattactctttcttgttctccagtgctgttatgaatatatttctttgatcatatcacagacagagtgggagagagtgtgtgttcattccactattttgttcctatttctggattacatacataacatgtaataatgctgctaacatatatatcgtatgcaacaatgtccctgctaaccagctcctctactcttgctgtgttgtttcaaaaagaaattttaattttttaatttgttcttcctttcccttcgtcttgtctttttttt

SEQ ID NO: 46567 - DNA, 1041 bp, Bovine  19866881433619
atagctgaaggctgggaagttctgtttgagctttggtgtcaagcctgagccaggatcccaggtgtacgaggatcatgaagcaagacttaatcaagtatttccactccacgcttagattaaaatatgggccttttttttttctcctttctggatatactgttttgaactcttccaacacttaattgccacaatgagaaatcatgagaaaatgaataataaaacgatgcttttaagattttcctgacaagtttgaaaagcagatctagctgtagacgcttagcagtgatgaactattgaaccctggggagtgactggttgatccttgggaacaagttacagtcaccgacagctgatgacttccaaggaagtcatatggtgacagttaagtattagccttcagttcaaataatttattttacattttggccagttcacttgggaaatttctgtaccttacatgtaaatcaataaagcatagctctcaaaaatttagagaaacatataacagttttatttgaaaattgagaagatgggaatttgactaacataactccagggggtaggaaaaacagaagaaaaaaaattgaatcacttataatgttaaaaatccactctttcagttttgttccaagtatcacaatctgaggaaggatagttcatttgtgttgggttatttattcattcgatctttaaaataattttaaagtactttctttctcagcactatccccaggcataagcacaaatcaaaagaaaatattaattaaattgcataatagtcaatactgttacaattttacagcttaaaattgtacatgaaaatagctttttaaaaaatgctaccatattaaaagttcccatcttatggagaattctgatttttaaaaggtgctttgcattgggccctgatgaccagaaactgggtttatgtcaaactgacccagggctataatcttacttcttttgacagagaaaaataagagcatgataatcatggggagcatttcatccacagcagccgagctgtatttatttccatcc

SEQ ID NO: 46568 - DNA, 1338 bp, Bovine  19866881481013
tctctgcccttcctcatcctgcccccatcctcacaggtcttctaattattcctttcatgcttcttccctatagcataacctcattctactgtgaactccattatgtaggtaccatggggaatgtcaaagtccccactgctgcctactgcagctgtctaaattcttttcactcttttcaatccctgatctcataattccagtcttggcacatgactacatctctctttctgctgtgcaatataggattatctctgtgtaattttccacacacacaattcagctttgttccaatagagagaaaaacttattttttcttacccatagaactcccttgacaccataataaaatgcttctaactatgaatgtttctgttaaaaagctggcagtaagaaatagttggtttatcattaaatctatgagaagttggtgtgcaggtgaaagatgatgcacaaacagtttcttgccattcctagggctccttggctaggatttagaataagaatggactttttcctaagatgaaagcccattcatctttttttcttttagctcaggaaataatggcttcctttagctggataaataactttaaagagaaatgagaagggatgtgtataccttagtgtcattaaatggcatgagggagtcattacttaggacagaatttaatgttgaataatgatttaatccacctcttaaacagtgttagatgattctgaagttccccaaaactgaaattacaatctctgagggcctgagatggtcccttcatggagttactaacaataaggcttggtttggcatgcagctcttcaggcgtgtcttattctttcatttcaacttttcttatggagtcatctgtctgattctcttttctcacatgtgaagacacctatattgcttgttaacacatactgaaagtggtgttttgcgtcatgaggaaatgaatctaatacataatgttgaccccactgtaaatactagcttgcgaaggatcaccttagttgctgttgtccagccgttcagtcgtgtccaactctttgcaaccacaaatttcaacacgccaagcttccctgtccttcactgtctcctggagtttgctcaaactcatgtccattgagtcagtgatgccatctagccatctcatcctctgtcgccccttctcctcttgctttcaatctttcccagcatcaaagtccttttcaatgagttggctcttcgcattaggtggccaaagtattggagcttcagcatcagcatcagtcctatgaaaaggatcatctgtagcaccataaatgcagaaaattatgccaagcctagactggcatccaacataa

SEQ ID NO: 46569 - DNA, 1291 bp, Bovine  19866881491333
ctcatgcatatgagacttgagcctagtagttacaagcctgagaaactcattgtaagcaaactacctggagatacaccatactcaattaagggttcaggacaatcgtacatccctagtttagccatgtactcaaagtaggcaaattcaagcctccatagtcactaaaatggtacaagtcccagaaaacccattgccaatcacaatagccaatgattagtggagccttcctttttttggtatctgtttataattctgcagttgggagatgtttatgttcatatgaaaataaatgtaagcaaaccatcttatggtaaacatctctccggaaaaaacaacttccatcttttcacataaaaaagggcaatggcaagatgaagttaatcctgttggctcatgacattgtacaactgtctggaagctctttaacactgccctaagaaatcattaatttggattatttcagggtatatagctctcataaagctgctctgggcagctgcagcttttaatgaggctgattagataactggaacaaatactctctggattgaaagctgtctcaacaaatgtggaacaactaactgtatttatttaattcaaccattgggtttatttctacccttcctccctccagaaaggatttaaggcagtttagctagtctgaaggtgtagggactcctgaaagcctcagattagtatctagaacatataacgtgtccagatagttttcaattatcaatgtgttaatcaaagcttggaatgagcttttaaacagcaatgaaacatcaactagcttcaaacttgcatttttagtaagctattttgtcatttggaggcctgcacaataaaccttttgttcctttttttaaaaaaagaaataaagaaagaaaagcaagctctggtcttgcttttgttcatcttatcatcttatccttcagcagcctattcaggatcacatgtgggaaagtatgtatgtaagactgagccctatactcagtgcatgaattccttgggaaaaaaaagtccttcttaaatgggtagctatgtaagaaacaagagaatttctacttttatgctgaagttggctttttagtccatgtgttgaaaatctaatgtttaaaattaagaaaatggaaagcaaactatctatgtggatgttttcacaccccacttttatgacaacagcctgctaaactgagattattagtggattcttgcaataagagcaagagaatatcatctttaagacactccattctgtttcaatatccctttgtttgggggattaaag

SEQ ID NO: 46570 - DNA, 2090 bp, Bovine  19866881519564
ttagtatcatcttgatcatctttttcccttttttcatctccctacccacaatccacctcaaacagtaacaaggtcttggaattccctggtggtacagtgaatcagaatacagctgccaatgcaggggacatgggttcaatccctggtcttggaagatttcacatgctgtggaacgactaagcccatgtgccaaagccaagtactaaagcccatgcacctagagcctgtgcttggcaacaagagaagccaccacaatgagaagcccaaggaacacaaggaaaagcatcctgatagctacagctagaaaaagcccacgcatagcaacaaagacccagcacagacaaatgtaaacaaataagtaaataaaaataaaggtccatctagtcaaagctatggtttttccaatggccatgtacagatgtgagggttggaccataaagaaggctgagcaccaaagaattaatgctttccaactatgatgctggagaacactcttgagagtctcttggactgctaggagagcaaaccagtcaaccctaaaggaaatcaaccctgaatattcactgaaggactgatgctgaagctccaatactcaggccacctgatgcaaagagccgacttactggaaaagaccctgatgctgggagagattgagggcaggaggagaacggggcgatagaggatgagacggttggatgacatcattgactcaaaggacatgagtttgagcaaacaccaggagatgaggatggatagggaagcctggcgtgctgcagtccatggcgtcacaaaggattggacatgatttagcaactgaacaacaacaacaaccaatgtcttagtgttcaatcagcctgtagagtccctacagcatcagggccaggcctggacagtctccacgctcatcgaaacacttaagtactcaccaaatatatgttgagagtttcctctgtgccagacaccattctcaacaatggggccataacagtgaatgaaatatacaagtccctaccctttacattctagtaaggggttatttttgttgttcagtcactcaggcaataaacatgtaaagaaatatatatcatgtagggatatcatgtaaggaagtcaggcttggaagaaaaaaaaagcaaaataagagggcagagagtaacaagaagatgtttctcttttatctaactcttgtatcttttctttaccaaattagatacgtaaactccaaagagatctataatttcaagtacacctactagatgtaaacacattatacttacaggatttttataacttatttttatcagctattttccccatagttgtatgggaaaggacaccaaggaagaaaggagtatattcattcatactgtcaatatttattaagtgcctactttgtgtaatgtttttagaacaaagaatccaaaatgagcaaaatacacagattcttgctatcatgggtttccgttatggccagaggagtcagagaataaacaaaaataaaataaacatatgttagaaggctggaataagtacagtggagagaagaaaccgcagagaaggagacaaggaagacctgggggcagaggccaggctgtcattttaagtagcaagcaactgtcccttgatcaggtaggatgccacaaaaacaatacctatgccaatagcaagcctcaggttttagttcgcccgttattatagtcagagtgtcatcaattaaaagaaaacacaggcaggatgttttgtgttgagcattctatttaagtccatagaaagaaatgttattctttcaaactcatttttgcccttccctttcccttgcctcggagaaaaatgaggggttggcagcccaaacaatgtagggatgggagaggggaagggaaggaaaaactaagggccagcattcacgccggcggactgttttaacaaggatgtagctgtgacccagccctcctgggtccccagacagccttgttaaggaacccacaaaaacagagctggcagacaccaggcattttccattaagcatggcatgcacttttttcaagatgtaacgagatgttaatatagatttgaattttaatcagatccaa

SEQ ID NO: 46571 - DNA, 1134 bp, Bovine  19866881698738
ctgactaatcattcttaggggtgtcacagagcagcaaataaaatccaaaaactctctgtcagctctgagcttagatttagcggaaggaggctggtttatcagacaaaaagtcatttttatgaagtgctgtatcagcttcatgtgcttgggtactcgtgaaggtgatctgtgttctgtttcttagttggctgtcattgctgttgcatgaattgcttattcatgtcttttttttttccatgtattaaatgagttcttgatgtgaaagctcatgagatgcctcagagcttctatttccctccaagttcccacgtggcctcctgagtcctgggattgtccttagaaatcactgtcctgtcatcgccacataaagaattcacttacagctaagaaaaatccacctcccatggcgtcctgtttctcctgcttacagacctcccattttccagtggagaaacaatgggaaataccaatccaccgtctcctctgcccatgaaagcagttaccctccttgccagtgaggtggattttctaggctggctctcctgattcattccacatccagactctatcctctcagtttttccttcttttcttcctctagaccttcctagatacaacgtttctgggtggccacatcctgtcctacctgaggaccactccagtccgccagcacccccagagccttgccagagctcaccaggccacaggccagctttctcctccctgtgcacaggccacatccaatgtggacacccaggtgcatccccagaacacaagccctgctcccgcttgagagcgggtcttctgtgctcccaaagctcagcatggagaaaagaacctgtccactgcttccgcttctcctttgagggtttcccaccacagatggtggcctctgtcatgtctgatgtgatcctttcccatctggtgacctgagttattttgttcttgttgttgtgcggtgtttaaaagtctttatgcagccaaatgtgttagtctttccctttgtgatttctcctgtcacttcatagtaaaaaaaataacaataacagtaataatgatttctccagacatctgacaggcaataacttatctgttccgctatgttctcttacctatcatgttagccattcaaaa

SEQ ID NO: 46572 - DNA, 647 bp, Bovine  19866881886169
aacactggagctgttctacttctgaacatggggatgttttgccaagacatgtttcatcatcactataatgagtgcattagaaactggggaaagtgctggaaggtcccccagtgaggtggctgacaaggtgggttcttctctgtgacacttaccccaggtaaccggggtactatcaaatttagctcataagtgattcaaagaagtatgaacagaggaaatactcccaaaccagagaaaacagtataagttttagtacagtcttggtttgtttccaataagtcttgacttcttttttcatcctcctctcccctccagagctaaaaaagttcaattcaaaataaagagctcactatgagcacctacattgatccaattattctgctaactgcttgagcctggttaattcagtggctaagattcaaaaacatggagttgagttaaacataatggcaactttatattcacaacattttgtaagctcagagaaacaactgggtcaaaatgttttaattcatttaaagtttaagtggattttaatattacagatgttctttgtaattctcggcaagtttatttgaatggtacaaaagtaactagaggagagtttttggaagaagaatgtgcttaagtgataccaaatgattaag

SEQ ID NO: 46573 - DNA, 743 bp, Bovine  19866882200985
ttgtgttactgatggcgagaaaactttcgggcaagagtacactaaataaatacagaaaatactgatatttaagcaagaatattgttttttttaaaaagttacccaaagtactcgaatccccactgcaacacatttcccccccataggcaaacaaatcaaacatttgcttggtgagcataacatcagagcaaagagagctggttgatcttaagaataccttaggctaagacaactagggcatctttttgtcttctctaggagtatgggccttagtatttttgtctggtgaccagagctcccccacccctagttggagttgtatgtgcactgctagtctttgtctccaggagcctcattttcctgtgttccatggttgaccaactcctcttttaagaccaccacattaataactctaatgagtttacaggaaaggctgactctagccagatggcgattctgactccttggagagattttgtacatttctgtgtttatttcatagcttaacattcagagggcagctctataccattttcttagaggggcagcagagtgtttagaactcaggctttgaaattgggttgcccgggctatgcctcagtttgccttttgttaatagtgtgacctgggaccagttgctctcattggatgtgcctcagtttccctatctgctcagcagagattataataatacagatttcacagggttgtttgaggatttaataagaaatctatataaagga

SEQ ID NO: 46574 - DNA, 1035 bp, Bovine  19866880454992
ctgtgtatgtctgaactcacactaattaaaggtgtgattgcctgcttttgacatccacttagctaacttgcttgctgactgaaaaagtgatgggtataggaatctgggaactggaatcagggtttggggtatgtgagggttgagggtacctgggcaggctgatgtttaaaacggtcaattaacagtgtgggtcctgccttgccaggtcacccagctgttgactggctgagcaaggcatctgaacgtagagctgatgctctgtgtgctgtgccttgtgacccagccttccactggctctggtctctgctcatggccacagctacacccacatacggcacggaagatcaagtgaaaggtaagtacagcctgatttttgcagcctgctgagctgtggttgatacctaacctggagaaatcattgattctttgacacagaaattagcatgtaagtgcaggcacctaacagctaaaaacagtgtctaataaacctagtaagttttcattgtttctattcataatccaaagtgacttggctggctggctggggttggggctgagaccagggccccatctttatgtaatacatgtttgctaccagctgccgagggagccttcctgtctgtattgttaatatgatagaggcctttggtttccagtatcatctctttggaatttctgtctcagaccctgtgcaaatgaacataatccctggcaggaaaggcatttcaaagtcctggcataggcttggggcctctgactttcacgtgaggaatgccagatgctgctggtctttcctagggcctgggttttactctggaggcttcaggtgttcttgctggggaggaagaggctgctgggctgtcataagggctgtcatccaggactttcccaagaaagaggatgcagaacaattttctaaatgtctcaggacaactagagacatttaggataacccatcttccaatttttaatgagcacgacacacatttaatctttattttttttaagatatttatttattggcttcattaagtc

SEQ ID NO: 46575 - DNA, 1682 bp, Bovine  19866880547817
tgtatgtctcagctcttagagcaaggttaatcagcccctatgcctatgcctcagcttccttgcctgtaaaactggcaagctacattcaccagaggatctgaggagagagaagctgtggaccaaacgagaaaatggtgatgaaagtgcttcaacgagtgaaaacacgagttaagtgggagatgttattatcttccgccatctgctttactttaatctttttttcccctcggtaagcggacctattgattgcagcttgctggaggaagctctcactgtctaattactgccccagctcagcctgtcaccgtgtcctctgcagtcagcgcatcctgacactgacccctgataccacagctcttggcatatcagcctgttctggcactctgcgcccgacccggaggaggcaagtccccgcagctgggcctggagggctgcccctgtgaggcaggcagctggggagaagcagggacatgagtgctgctgcagccaaaggcagagggaatgtaatttttccctggagccagcagggatgtgtcccaccatgacacgcagttgtgagcattcccaaattctggcttccacaagaatgtgccctgaaaaaaaattttttttctggcctgggatattattagtgggggttggcagtatgagaagaaatcatttctaatgctaggaaataataattcctttcccttaaattgtggaaatcttcaaaatatccagggtatcttcatatgcgttaccctcaggtgaccctcacaatgtgataagcattccttttttttatacggagggggtgtggtctttagaaccgagggctgtgattttcccaagctaaacagccaagtaagggagaagggaattagaatccaggttttctccgtctagaccaacagcctaggccttcacagggctggcccaggctgcagacataactcaggttatttaacctgagttgaaaacagtccttgagagaaatgcccagaagaaatcagaacgttaaaagtactcttagagaaacaaatatctttttgacctgcagaggaaataaggatgtgctggaattggtaaagaatccacctgtgtgccagagacccagttcaattcctgtgttgggaagttcccctggagaagggataggctacccagtctagtattcttgggcttccctggtggctcatagggtaaagaatctgcctgcaatgtgggagacctgggttcaacccctgggttgggaagatcccctggaggaggtcatggcaacctgctcaagtattcttgcctagagaattcccatggatagaagagcctggcaggctacagtccatggggtcacaaagagttggacacgactgagtgactaagcacagcctagaaaagaaatataggtattgtgtctgttgtttagaagaaagaaaaggttcatataagcaaacagcagaggatttttttttaaatttctaaataaactacatttttgtcctggcttcaacacctcaggtaaataatctaatcaggtaacctctaggctaggaaagtgccatatagaagctacttggcaaatgcttgttgaatgactaggtgaatattgacctggattataaacagcctgtgcaaagctttcttctctcattttcgtgaaaaagaaatcattttttaaatcagatacagagtcacaaaat

SEQ ID NO: 46576 - DNA, 1098 bp, Bovine  19866880578665
aatcacaggctcgcagttaaaataatgctcacctactgcgcttccaactgggccatctacctttttcgctggcggggtcatgcccagtcaagcctgatgaggctgccgcgggccccgagagctcgctgcaggccggctacacctgtttatcaccaagtctcttcatttccccttcccctcctccccgcttgaaaagaagcattaattaaaccggtaaacaagccggctcccattctaaatcagggctgcaggcaacggagagataacttgggctccggagaagagggattttctgttaatttatggaatccaccgtctctctccgagcagcctgttccccgcttaacggggaaattgaagcagacagcctttgtctaaacacttcttttgcccagaatatcttaatttttctatttgaatgtttaataaggtttgggggtgccgctgctgctttttaaatttttaatggtgcaggcatttgggtgttatcatttggctcgtggttgcagggtgtccgtcctcctggggcgtggagggaaggaccaggttttgtttttttttttcccccaagctaggctccgacggccagcgaaagaaggaggctggggtttgggggaagtttaggggggtcccggaagtcagggcagcccagcaacactatgcctacctacccttttttcttgtatggtcctcaatgccctgggttcctgcagacgacccgggaacgcggcccgggccccggtgagcgctgtctttctctcccagcgcctggagcacccacctccggcagggcacccagccctcgctcgtacgcctcggtcccgcctgggaggggtggggggggatccctctccgtcaaagggctagaccgaggctcatttccggccgcggctgcgaaaacccgggctgcctaaattaattatttctccaagaaggagggtgtgcgtgtgtcttatttcccactgataatctggaattactcagtttaagtgagaatcagtgaaattgtagttttcactatagacagtccaggaaaaaaaaaaaaaaaaaccctccgtagatctttgtcatttccgatgttaaacttcgtaaaacaca

SEQ ID NO: 46577 - DNA, 1597 bp, Bovine  19866880640136
cctgttggctgtgagcttcattcgtaactgcgaaaactggtaacacttctcccctagtcccctagaaagtcttgattcccctttccttgttgtctttcttccttcccctctcttattaaatatttgttgcatgaataaatgaatgaattctgctctatacctgtgctcttgaaaccaagtcgccagacaacttatcctcgtagatggagcctgaggagtttaagaggttaccttgtactggagtgatgctcaattgaaaaaaaaaaattgagttattaatgtaatccataaggtccttagctggagaagataactcaccaggagtcactttagtttatgagcaaatgcattcagatgacattgatgctggctcccttctgcattactggactagatggttgcgcgtctggcataaccggagagggaccagaacagcgcttcttcccaactgtcactcacaccgacctgtctcagtgtctgggattctactgttagagatgtactacttttgcagttataagagcctcttaaaactccttgcagttgacaaactttgtcaacaactcagtatgtggttggtatgactctaaatattctgataatgcatctctatggttggggttgcataaagatagcatcattatcctaatcaaattaaagaaaatctacacatgatgaaattcacatgcttcttattttctgaaactgaaggcacttggctgactctgattctgccttcccttttcttccctctccctcttttgtcttctatattaggagatggactcagcagcaccttctgctctttggagtttccagcagggcaaagtcatgtctatggatcccagacccaaagcttagaaagggagggtgtatgaggaggaaatagtgctggggagaagaaggatgggaagacaaggaggcaagcaaagaataggacaggagagaggtaaagaaaggtgcttccgatggggagagaaaagagaactatgcgcccatctcatacaggaagcaaagattcgtcctggtgaggctcagggtctaatccgtcccctggacgcctcctattccagttcattctggggccaggaatcctcccttcagggatgagctgtttggtaacttgactgctcttcagcaaaccttaccggtaatcctggggctagtttcctgtactctgcttggaactgcctgttcgcggtcatcttctgctcctctaattgaaggtcagacaggaatacagaaaggctgtgtagacccagcctctcatattgatgctttgttcacactttcgttggcatcttcacaaccagaacaaaaaagttctaagaagaacgaaatgtgtcgcttggctggatctgatcaagttgctcagtcggactgtctaccccaagtgcaggatgctggggatggagacaggaagttcaccattgacctgctggtatatctcctcctttgcagcatccagctcacaagtctccatctcccagtcatcattcagagatctgggtgtgaattggggagcaggtcctgggggcatggtgttcactgcttctggaggaccaggctaataagcagatgttgctttgcctgtttt

SEQ ID NO: 46578 - DNA, 1367 bp, Bovine  19866880680187
tttatgagaggacgaagattacatagagaatgtctttctaggctgttttttcccattacaaccactggctgttctttaatttgtttccagatcttttagaaaagtacctcccgtgctgaaatgccttttgccatcttaatcccagagccccataggcacagtgagttgttcattgtacctatggtttattcatttaaaaaaacaaagatgttctgctagtgttagtatctgttttcaaaagaatctgcttatgaagaaatatttttaaagtctttttcaagacttttcaagagtatttgtctgttacatgtaaatatgtatgatccagtagagaacatacaaggttttaaaaagatactatgaggaaaatatggaactttgttcagtattccctcccctaaatgtatctgatttttacttttagtaaaacagtgttacatacagtatttctatggtgctgaacattgtcttagtctttaaaggaagtatagaaagacctcttgtatactagattcgaaggattgtaggaggaactactgttaaataacacattttctgttttctcaaatgttttccattcttctgtcagttctgtcttttatgggtcactcaacccacacatttctggatgacttttaaactgtcacatgtcaaccaaagaaaagtagatgtaagatgaggaaatgaacttgccttattagaaattggctagacttttcccgtaaaggtttttacgtttttagtttctaagtgcattttgcattttgacaataataagaaacaagaagggacatgagtgaatgataattgctaaagaaaatactcaagaatggtgcatcagaaaaccacttgggaataaacctaaagtgtatatggaatatgcaaagtgaaattttgttgctgtagtctacagacagtgttccatctgagaggattttttgaaataattgtgagataattttagtgcttaggaccaaattaaaaaaaaaaaaaaaaagagcagtttagatcagcaattctttagaagtttgtggtagagcaataataacaatgtggattctgacctcaaaaaaagctgacgagtataaatgactgcttatattcctttttaaaaatcctgtaaattttaggtaaaattctaatgacccaaacaatatttctttgaatttgaaacagtctgtttataaaattgaaataacttgccctggaattcagaataaggtaactttaaaaaaaaatagaacaattcatctttcctggcatcaagtcctttttttttttttttttttgaaattttgtaaaaaacattttattgctacaaagggaaacatggtcacaaaaagcctttaagcgtatcttaacgcaaa

SEQ ID NO: 46579 - DNA, 1265 bp, Bovine  19866880700061
tgataatgaggtgagatgaagggcagaggggtatgcacgttgtagagttgagcacccttgaatatgagaatttggtaaagttgttccctttgtgtttctagaagcaactgataattttacttttctgtttttgagaaaactaaaatttttattttctttttctgtgctctgttttaactaggattcatccattccttacctcttttttcaaccttgttcattttcaagagttcacattgagaaattcatagagaaaacctaactctgtcctttctcttcaggaaaaatgaaattgaaataagttcttttagtggtacacaaacaaaaaaaacacacgctttgacagtttgtaaattggcgcattaatgtaaacaaataatcagtgagatatttgtgtttaaaatgatttatttgcttgaatacaactatgttcttcgtatagaaaaatttggggtcattactctgtaatctgtccatttccaaactgttcctttatagagtgtcaaaaatgtaaagaagatgtttccttagttgattcttaagaaagccctgggcaggttgtaaaaaggtaaagtggaagattactacctaccctatccttagctgtggttttccaaacaaggtactgtggattcaggtaatgagaggcatggcctggggctttgaatcttctgcctgtccctccattctttcttcgctctttcactctgatcacaaatacctgggttgacaagtgctgccagccttgcttggaaattactacacagtactgttgtcctattcattctgctgaaaataatctcatgtagcaggactaaagtaacttgggaggtgttgtggattatcacttaaatattcagtagattctttgaagggtcagtattgcacagaagagtcaggttaactttaatattttattttatatacttgggtgatttatttgcatttcagttttcctatctgtaaagatatgcacaataataatacttattaactcgtagggttattgtgggggctaaatatattattgtattttaatgaatttaagatgttatcacttttaagacacaccgtttttttatgtacctttaaggaaaaaagtgacaattatgacattgtgctttatcatcacatacacagtagctttttgaatttccttgacttacattttttcccatattttacttttgtatatacataaaaagttaaaatatcaaattgatcaagttattttttaaaactgcattcaaagacttagttcaagg

SEQ ID NO: 46580 - DNA, 1515 bp, Bovine  19866880736430
ctactgggtaagtttttgagggcaagccaaccttaagggtttcacaactttgcatcctttctccttggcccgactacccaacacacacacacacataaaacgcggaccaacagagagtaccctgctctgttatgaaatgtaactttcattaggggttttacttccccctagaccctaaggtacccctgttgaaggccctgcccacaagcaaatagaaaatgataatcaacttggcaaccacttctctactttcatctcctaagctgaactaatttctggggtttccacctcctctgagccagtgcttcctgttgaggaaataaatgtcaaatgatttcaccattcagagtgatgatcacagtggatttctgggtagcaagcaggcaggggaggccccctttaaaaagtagacatccttgattactttgaagggaaaagggtgaagggctttgaggggagtgggacgaagggtcagatttctccagaatgactcagagtaatacctcctctcagcagccaccctatgaattctgacacatctcaaaaaacaggagtctggaaaaagcagtcagaatctcttaccttctgcaaaaagctactgtgcacagtctgtccctttgtagtttgaagatttttttttttttttttaaatcaaaccatcttggaaaaatcaaaaagcagatgcacccataattgaagttggcaagagcaacagaaaccttgttataggtgttacaggccctcataccccaattaacctgggggtgcgggagtggaggggctgtgggtttctctgcacagacgtctcgggggagaggccctggtgggcaggagatttaggtaccctgagatccttctggaaactaaggcccaggaccctcggccagtcctgatgtagaatcactctccagcattgggaaagccacatccaggggagtcctggccccgggctagtcctggagaagtggggctgctatgcggctgccagcccacccgagagagagcagggagcacccacagccccgacccggggccgaattttactacctgccgtttaccattctgacgggaaaacaaatttaaaacacctgggcatttatgtctctgatgggtcgagttgcactgttccattatattaaataatccaggcggtgtgcttcaaaggctgccatctccaggagggcgggctcgggaagagccttgtgcgggttcagaggtggaggcttgagagggcccagggttttcacctgggacgcagggcccctccaggccacaccctggccctgccgacacacccctgccccagacttgatggcaaaatgggattcactacacgtgatccggtcacacagctccataggtcaagcagagaggaggttggggtcgatagaacactcaaaaggctaagactggatggcgagagcgggtcagaagaagctacgggaatgtttaggacacatttgagacttggggcccaacagacctctgaggctggggcagccaagagcagcacgg

SEQ ID NO: 46581 - DNA, 1763 bp, Bovine  19866880772785
tattatgtgttgttattgaaaggtgtaccctccttgaaaagtacaatgttccgtataaatgcagggtggtggtgtcgttattgttatcatgattatttctgcaggggaaggagaggaggggccagggtgggtggaggttccttccccagctttgtccctcctgccgtgtctgctaactgatcggcaggatgcctttgctaggtgtcgatagaagattcagaccagaagtattgtgcgaggacatcacgaataacgcaggcagaatgattcaaaaagaaatcaatggtcctaaaaatagcaaagagacgttcccagaataacatcctaatgggaaaaaagggactgaatgatgagttgtattgtaaaaagtcaagtgtttttaaaatatctgtgtagaaagatgagtgatcagtttatacaagggaaatgaaagggctggtgacattcagtctggaaggcccctggactcctgcccttggcagggcccacggagggtggactcatctctctcctgttagctgccacgtcttccttgtatattggaggaaagcgcttctgatgagacaatcttctggtagtaaaagtcacccaggaagtaaagagcatgcaaccacgataaaccattcacatatgttgttgtttagtccctcagtcatatctgactcttttgcaaccccgtggactgtagcctgccaagcttttctgcccatgggatttcctaggcaagcatactggagtggcttggcatttccttcttcaggggatcttcccaacccaggaatcaaacctgcatctcctgcattgacaggcggatttgttaccactgagccacgagggaagcccatccatgcatgatacacgtgtgtgcacacacgctggctcttgttttgtttgttgggttccttgtgttatatcacattgtcctgtattgatttgcatggatttggtcaaatttgagtgaatagtgctgaattcatagttgtcctcagtgcggatataaaaagcatgtagatattcccaatttcaaccagagggggcgagtgagtctgcagataagaatcctgaaattcaaagaagtacaaggactcttcagaactctctagccttgctgtcttggataatgaaccgtagggaaaattctgatggtagtccccaacaggagtgctctggtgaggctcttagatttgcgctgcccctccccaccatcaccacctccacagtgatgctctgttggttcattgcaggatctggggtcaagctggttaaggaagctatatttttattactgatcatagtgataaaagataaaagtttatctagtgattggtccaagagttggtttatcacttcagtacaatcatcgggggaccaggctctttgcattctttattctgctatcttaagcttcttggcttttattctcaagtttattccctcatggtcacaagatggttgccactgctccctaacataagaacatgtaaggaaaggtggaaaggagcaaaagcgtttctccttgtgctgctattttgtcatggaggaaaaatttccccagaaaccacagcagagttttccatcatatctcatagagagactggagaggatagaaggtcttgagctctggactcacacacaggctcgtccacttactacttttgtgaacctgaggaagtactgggtctctaattcaataactataaaatcatcatgataatagggcctgtctcctgataagggtgttatcagagttaaaggagttaata

SEQ ID NO: 46582 - DNA, 778 bp, Bovine  19866880835889
cgttgaaataggcactggaatcccaggtagtagttaccgtgagtggggcatgagatgggaggggattgagaactgggagaggcgcaccaggagtttctactctgtttatattgtgtttcttaagttgtttggtgggctcatggtgtcccttataatatactctacaaccttttgttaaataagtcaaattttataaaaagatgcaggaaagctgggtcaaatgataaaggtgttttatctcagcaactttggctttcagttggttttaatttctgccttatacatttgtgtgtgtgtgtattttacagtgaggatttatataatcagaaaaatacagctgttttaatttcccagtgaaaatgagaaaatactttcctattaggctacatttctcttcatactattctttcaaatttttatcttcaagactcttgattttgcaccaaatcaaatactcttttaatgcagagttttaacactgtctttgatttttttttcactctgcaaatactggattcttctctgaattttaagaattaaatattgttttgttccattatttgaaatgatcatttgagacatggcctaggacaaacctgtagactgttataatttctagtgtttatttacagggcagagttgggtagaacagatgtttaaggagttatagtataatgtgttgtaataatgttacataatatgactagcattcatcctgtactattttcttttcaccactacccctctcaccaacacgctcctaaattacctaaattag

SEQ ID NO: 46583 - DNA, 2613 bp, Bovine  19866880869123
tggtctctgctgtgtgactttaggctggtccttaatctgtatgagtttaaatttctttatctgcaaatctgtatccacagtaaatttatgagagaattaaatgaagtcatctttactgagcactttcaacatatttgtctgtatgtaaaatcctacctctaaaacagcagatataagtagaagataattaattctgatatactgtcattacttaaattagactaagctcattcagggcaaaggctctgttatcatgtttcatagagtctttttccacagtaaataaatatttattgaggaaaactgaatgattttctaaattatttttaattcacttcagcattttgtctcatgcctttgaagagccttgatttaaacaaatctttatcatttgaagatgttgtgtgtgtgtgtgtatgagtgtgtttaaaacaacacaggctcaatggaaagaggatgatcaaactgagcaattgggttgttgggggttttttcctgtttcttttttttttttgatgggggattattgttttaacaagtgtaagaaaactgattttcctttgtcacttataaatttatttctaagacaggattttagaaatctttagagcagtaatcacaacattttcagtacatgatgcctttccatgtttgtattttcatgtgcacttggatgtatgtatatatacattaggttttttaaattatagctttaattatacttacacagtatatcacactgtggttctgaaataggaaaacctacataaaaatcaatgctgcttattctttgtggtattggttactatttctctgatcttaggtattttgtaactgcatgtcttcttcagctatttctaaagagatcattctaatctcagatttttagaggatgtctatataagcacactttaactgttttctttttttaacaaaattcattccctttactaaactgctaaaataaaataaaaccgctttctaaggatattttctcccacaattactgcagcatacatcaagtatccagcctctatgcacgtgtaatagacctttgaaaaaggaggaaacatttgctaagtttttcagaagttagaatcaggttaacagtctgatgcttataccaagtctcttggaagacagaccgcatccgttaatctgtggtagtttctttttggctcttgtttttttctgctgcttacagatccaagagtatgtttagatgcaggaagtactccagagacactctaaatggtgccaagcaatgacgctagaagtgccccctgctgcccaaagagttttcagaagtaaccttggttaccctttctgaaagggttgcatttttccaaaagtttatctgcagtgtataaattttcaaaagctgttacattcttatgaaaaattactcgctgtaactttctgtggttgatgatacgctaacaaaaaccatttcagtattaccttcactagatacctgctagcttctgagccccgtaggttgttctgtgtgtgggcttctctgtaaatgccctctacttgaatttaccattatttgtggattttacatcagtgaagattttgaaggattctggcccagttcagtttcttggtttaatagaggttagagatttgaaaagattctttgatgatgattaaagtgcagttcacactgccacccctttgatttgactactgaaacagcagatgtggtaaagccacactggtctaagcaaaactaaagtgtgctgctccatgctcatctaggtgagttcagctcccataaatagcgtaaaggagtagtgggtttccctcctttaccatgttggaatttacattgtctttaatacaaagcaataggttttaaatacatagaatctgtgggtttcagtataacaaactgaacttttcttttgtgtcctaccacttgctctataatcataatcacagataagaaagacaggttacctcttttgttttaaattgttaaatgtctgtctgtattacagatgatgctgtctgctttatctgtaactactttttctaaaatgactgtgctcttgcatttattggcttattgatatgattactttaagactgagtaaaaccaatggataaaaataaacaagtatgaaagtctcttttaaaagtatcttgcatggatggacaactaggagtactttgcccttgcagcatgattctttgtggagccttaactcttacgtgtttagcccacaaagcacatgttaatattaagttgtttttaaagtgatggagttgcatcaccatgatttttctgtgctctgtgggatatcatgttgctttaatgtaatgagtcctgggctcctaaatttctctctccatgctggaaatgattacataaaactgaatggctatatctgaagtctaatgaatcttgagaatttcttattcttcaagaaaaatatcacaaagacttttcttattctttgaggaggagaacttgcatttgtaacaagtttctgttgaagatatcagcgattttaggttttatatagcattctgtttgaaaaacaagcagcctctctctgctgcaaggtctgtgtcttaactttgtgcagatgtgagctaaaagaa

SEQ ID NO: 46584 - DNA, 1228 bp, Bovine  19866880883213
actagtgcttggcaaggaggaggaggtctggggaggcatgggactgaaaaggctctccagttctccccagtcctctttaataagtggtgggggctccctagatgccagtaccatggcaagaaccagtgatcaggccaacacagtcatctgccccacaggaaatctccagataactccagaaaactatcatgctgctgtatattagatgacagtcaattctgatggcatgtcatcacctgcaccaactgaacacccatatgccacatctctaaaacatttgatttctcagtggacaatcaaggccaaatctctactctggcttgagctgtggagcgacacagcagtgctgcccagcagtgaagggtactctggagcagaactgctgggtttgaatcccagctctgtcccactttccatgcctcagtttccccatctgtaaaatggagctaactcctattttgtaggggttatgaatactcagtgaaatgatttagacaaaatctctcagaacagtgcccagctataagtactataaggttggctggtaccaccatgcattcaggagcccacaaagctttcaaacctgccatctgagctaataaagtctagaatgcagctccccaggactttggggggaaagctgagcatctctcacaccagggccaaaaagagatggccttggatgttctcctcctcactctggtctgcagatcagaggcccttccacgcctccaggtccagggagccactgctgctgctgctgctgctgctaagtcgcttcagtcatgtccgactctgtgcgaccccatagatggcagcccaccaggctcccctgtccctgggattctccaggcaagaacactggagtgggtcgccatttccttatccagtgcatgaaagtgaaaagtgaaagtgaagtcgcccagtcgtgtctgactcttcgcgaccccatggactgcagcccatcaggctcctccgtccatgggattttccaggcaagagtactggagtggggtgccgtcgccttctccgagggagccactaggactgtactattgatttggaaggctgcaccccatgtctgcacaatgtgtccggatgtggcctccttttccatcaggtttgtgccagacggctctattaccatggggtgcatttcaagcctcctcactattatcagcttctcactttcagctgctgcaccaggggcaggatccttcccttcctc

SEQ ID NO: 46585 - DNA, 964 bp, Bovine  19866880912328
cttacaaataacttcttaggtctgtttacctaatcttcatttattttacagcatttgtagctgggtttcttttcaggcaagtctcccacaaggaaatatgtttttatcattgtaaaagttagttggcacgcaaatgctgaataaagctgtggtgaattttagatgtgggaggtgtgtcagacatactcattaaactaagtgacttaccctcagaaaattacaaatcaccacaagtcaggggccttctgagtttgctcacagttgaaactatgaataccaatgttctactgctgccattttgttttgttttttaaataaaaacaacctcaacttcctgtgttacagctgcttattagctagaaggcttcttgctgggcagaaagctgaagttggaaagaatgtgataaaacctctgaaagcaaggctaaaaagaaaaaaagaaaaaggagttcggaggtgctcaatccttgaacaggaatgggaaagaaacagagattgagatgtgctcagttgttaaaggtcttccgtatgggctgtcaagctctctggtttgacttatgttagctccatggcagtgcacaaggcagggtctccacagggactctctactcctaggccccccaagtgcttttagctcaggagcaatagttgggatccattccttgttgagttaattctacttttgtaggcctttctctcatcagcttcactgagatataattgatatataacactgtataagtttaaggtatacaacttaaacttataagctaaggtgtacacctgacacacttataatagcaaaatgattaccaccacagccttagtataataccctcatcgtgtcacataattatcactcctttttggggatggaacacttaagatctactatcttagcaactttcaagtttataatagaatattaactataaatcatcatgctgtacattatatctccaga

SEQ ID NO: 46586 - DNA, 915 bp, Bovine  19866881026100
ttcccccataaggttatgtaagtgagatcttccttgcagagcttccatttggggaagaagtcactttttgataatcctctcatcctttttctgttgacttctgaatccttaatatacttgatatgatttagtccatgcgaggcataaccgttgatggagaattcttagattgagcatatgcttgcacaggttacactgtcatcatgggtacacagaagtaaagaacagagatatggcatatggataaagtgatttgtttgtcaaaagttggcaatccttgttgggtattttgctggattttgatagcagcaattcattgtttgcctaataggtaatttaactgcaaaacattttcctaactgaaatttgcagaaacatgaagcaaatataggtatccttatttagaaaatatatctggcactaaactctaatgaacattgcactgtaaaacatttctgatgctgattctgagcaggagcttctttggaaagtaactcaaaaacctcaaatcatcctcttccttttttctcccaagacagatcaactttatggcatggggcacatggtagattttcagtagagaccagttgattgattgatgtatggatctgagatgaataggggtgatttatgtaagtagactggaaaataagtaatattattaatatgtggtggggggggggggttcttcttttttttttcctctgcaggtttttgtcattcattggagggacactgtatgagattggaaagccagaaatgcagcaaaaaataaattcattccttgaaaaagaaggaatggagaaaactgcagaaagattgcaaacaacagtacacaccttacaggtcatcgtagatggtctcagccagcccgagagctttgactttcgaacaggtaaacgatgaatgtgaata

SEQ ID NO: 46587 - DNA, 1925 bp, Bovine  19866881029069
atggacattcactcaactgattgtgctgatcacttcatgatgtatataagtcagatcattatgatgtaccttatacagtactgtataccaaatatgtctcaataaaactagaataaaaatttaaacaaggcttggaaattttctttaaatcaatataaaattattccagacattttgatgactttggagcagtctctcactttctagtttgctcatcacttgcaaatggatagttagcccctcccactcactgaagtctgaggtgacttccagataaaattatacacttgtgttccaaacacaatttaaatgcctttcccccctagcttttcttttatttatttttttttttttctgtgattcctgtggaatctggtagtggaaggttggttccttgcaagtggcctcccagatccctgcggtttctctgcagttttctgagccaggtaacttcttgggaggtatattaaaacatttaaattttagataatacactaaatcactcatatcctgagaatagcacggctcagtgtatcatttggtgtcaaaatttcagctgatgctacctgctggcttgagttaactgtccgctggctggtccccggactagtcaggaggcctggaattcatggcatgcgattccaagtgtgagtcaaaacgcgcttgataaatatggagtcagagcagctgagactgtttcctcttgcctctgggatgcacaacctggtagactttactcgtgtctactcatgaccagtttcatcccctttctggcaacaggaaggctacactcttcaagcccctggagggtggcagagccctgtgctgtaagggggtctcccagcatgaagcacggaaaagcccaggcatggttttccctctcttcttcagcctcgttgatcaaggaggctgtgtttcacacagggccctcgtggacccctgagttgtcatctggaggacatttgctttgtagaatcactgggactggtgtgagtgaaaagttaattgtgtgtgttaaaacactgatatgaatgaatgagtagtgaaggcttctgcagaaggcataggcacccactgcgtcatcctggatagtgaggtccaaggttagaggtatcaggctgctggttacccacaggcttctgttcaggtctgcaaggatatgatcagacctttagtgtgaatatgaacaagtgcaccatattcctgggtggccggagccatggagaaacaaacaaatccaagccacagctcctttgcacagcagtgcctgtctgagacctcatcatccctaagatgaaaatggataccagcctatgtggcatggtcacctccctggtggagacacgtccttcttaaaagaccaaggcagctggggtgggtgaggagcagagagagatgagcaagctgcctgcatgcagacatgacatgaatgctgctaagtcacttcagtcgtgtccgactctgcgaccccagagacggcagccccagaatgctctctgcttttcaactctctcttgctccttcagactctgcagtctcctgttaaggttttctcttttaaatacctgtatctgagccaggcagctgcttttgcttctggcctccctccctcctcatcacttcgcccattctccatgtccctacttcagctcctcctcctggctaaatttccagataatggttctccctactcacctcactccttgagaccctttccgtttaccttccttgagggaagttaatccactcatcaccaaacactcagaaagaatcccaagaggaagggggcagtgccctagaaaactctgggttggggggtaaaggatgatgcctcatggtgctcacggctccaagggctgccatgggactcagccacattccccatcatttaccttcttcctccaggtcctgaggcaaagtctatt

SEQ ID NO: 46588 - DNA, 898 bp, Bovine  19866881033278
tggaagggaaaactgaagtcgaaggattcgtggcttttcacatacaaaggcatcctcccatccctcctggccagccagcgaaggatggacaagtgcacctggaggctactgcccaggtgcaaggggtgggtgtggggcaagctgcagaatgccccagaacaaagacacctccaggggcctcctcggaggtcacccgctgcctccagggcagattaaggaggactggagatggcgcttggaggaaatggtgctgttctttgggaaatcaattcgtcccacccttaatagggtgttttgccctccctctttgggagttccaggcaatgggcttccaggtctctacggttctgaaagaggcggcccctttgccagcccatgttccttcaaacagcccaggccccacaagaatctcttctgctctctgccacgtttcctttcccttttctccctctttcaggctctcccgcccctctctatacccaagctcctttcataatgaggctggaagtggaactttcccccactcccttactttgagatttcttttttcccagtgacctgggctgcactttacccccactccctgcctgccaatctcctcagggttagggcctttctctatccattctttcaggttccccctccttgagagctccaggaggccaggccttccagaatctgatctccttccaacactgcagcccccctgaggaggaaggaagaagcctcctccgaatgaatggccggtaaggaggtttttaatttgtctggagctccaagaaaaaagcctctgagctgcggccctccctcacctcgtttggaagcccccaggccttcctggtggccactgtcacctctccatcccaggccaggtccacgggcagaatgggtggaggag

SEQ ID NO: 46589 - DNA, 1575 bp, Bovine  19866881033364
aattggaaattataaatcctttgtgaacaaagtataatcatgctgaatttcagttttctagaacatcctaaaatgtcttaaaatgtggacagagttggatacttcacagatgttagagatgaagttagtaatttatttaatgattgaaaagaagcatgtttataattatgtgtttgatattattaaatcacatcaaaatatgagaaggaggaattacctctaattaaataaagttggttttataaagttcaggatattatgttctagtttatgttttgggaacattttatcctacacctgtacaatggtagatgttctattttttttaatcaactttattacttaagaagttcacaacaaaactgagcagaaggtccagagacttcccatatatccttctccgtaaacttgcataaggtcccccaatattaacatcgcccaccacagtggtacatttgttaaaattgttaaacctacattgatacttcatgatcacccaaagtctgcagcttacattaggattcactcttggtattgtacattctgtgggtttagacaaatgtgtaatgacatgtatctaccagtgtagaactatccagcctctttctaagctatgtcagttcatctcaccctcacctctaatcctcggcaaccactgacagttttattgtctccttggttttaccttttctagattgcagcagtgttggaaacacaatatatagcctttttagattgacttctttcccttggtaatatgcatttaagtttactccatgtcttttcatagcttgatagctgatttctttttctgtgctgaataatatgccattgcctggatatgtcagtttatttatccattcaccactgaaggaccatcttggttgtctccgaattttggcaattgtgattacgtttaccataaatacccatgttcaggtttttgtgtggacataagttttcaagttttttaggtaaagactagggagtgagattgctgaatttcgtgggaagcgtatgtttagttttgaaaccaccaaagtaaactgtctttgaaacagctgtgatattttgtatttccatcagccgtaaatgagagctcctattgccaacatttggtattgttaatgtcctggccaccgctttgtgttgttagtgttttcgattgtatgtggtgtgtagtggtgtttcattgttctttaaatttgcatttatgtgaagcatctcttcatatgtttatttgctatctgtgtattttctttggtgaggtgtcagtggcccctttttttaatggattgttgtttccttactgaaatttaagtgttctttgtctattttggtggctgtcctttatcagatatgtcttgcaaatgtttctctcagtatgacttgtgttttcattctcatagatattctattttgaaggatgcaatttaaattactttgtgaaaagtaatattaataacaaaaggaaagtattagaccatcagtaagtgaaggacttataaaaagtttattaatcattgttgctatacatattatttacagtagaatataacattcctgttataatgt

SEQ ID NO: 46590 - DNA, 855 bp, Bovine  19866881043128
tcccagggcacagtaagttgccagggattggtcccatgatccttgagggaccgtcactggcttttcaccgtcgcatgtacaccctggagactctggatctgcctggcacacagtgggcatccaggagatgttcgaacgaaatgaccaatgggattagactgtcagcaacaactgggaagtaccaggccaataagaaaatggccctcttcttcctctttcctcccgtgctttgcttccagcctgcttctttccctcctttctttgcaggggaagactcatggcgttctccagccagaagtcctgggtgctgtagcctccaaagggctacctagaagcgacagacctaacgctctgctcttagcaattcgagatctaactgcctttagcagtaccaggctcccttgggctgcaggagagttttccaagttgagctattctcatttttgtggggctgcttctttagttgcatttccttagttactttacaaaaatcctctgtaggcaacgtgtagatcaggtttcctgtaagaagtgacttttttttttcctttctttcttctttccattacctgtgagaaattctatccgagagtagggattcctggcttggcacttctctctcctgcagtatctatttttattaccattaattacaatgcatcagccccactcatcagtgatacccctttcccctggctggtgactgcgcttggctctcctgacttgggtggctatgcctgggccagagggcactcccaccccgccattgaaggcagccacacagggctttccagtaagtatgccttgaaaagggaaccggaaaaagccaagatgttcttaactggaaatccaata

SEQ ID NO: 46591 - DNA, 1557 bp, Bovine  19866881044267
atacaacagggatgcgctaaggactgagtagaatgatttctatgctgcaattctgacagctggaactttgctctgatcttacagtaaacatggggggtttttttgcaagctgccccactcccctgcacttcagattcctcacctcaaagatgattccttgtactcttctcaggactgttttaaacataagcattaatatctgaggatagctggagaaaatgaaaatgttattctaatgttaaattaatttgcattccaaagtggagggattctgctcgagccagccctcccttccttttccttctatccatttagcaagtgctgagtgccaaatgcccttgttgggcctgggctacgctgggcttacccgcacttcacagacaatctccgtacctggtttgactccaccacctttcctgcctagtggctcacgtcgtctcacctcttgtaaccacctgctgttcacagccttggggcaaacagtagtctacccatttcatcttcatcatccctgcgtgaaaccctgaggaagaaatcagctcgcacactgcgtttcaggcccactgttacccccatatgatgaaatgtacacagagaccctcaaaattggtgttaaaagcacataaacctcttggattgttgagattctagcccaagcagggtgtgtgtgtaatatcactaaaagcaggtatgatggataaaaatgaatgatggccccttctcaacgtaaaccaagctgctcatccctcagggttgtttataaatagaggggagtccatttgttcggtattccatggacaggccggcactcaatttagataacgaccacactttgtgcccagccatcactctctggcttgctgggtggtgattaatcaaacagtgttttggtttctcctgatatacatctagttcttccggtttagagtgagctgaagatggcttcaacagtttacagaacagccctgggccagtacattagaagggcgtgaggatgagcgccttggagggcctatcggggtggacattccagttggaattatgagttgagagcagctgagtgaatatggatcccagaagtctggtccccccgaggcctggccttctgggggtatcactgacttattatggtcagtctgagagagtaaataacacttgtcattggatagagatgcatgaagttgaaggaacaccaaaactggattagtcagaaggtagcttttcctgataacatactcagatactgcccccagcctcctcagctccatcagcaggagcaaggaggggtcccagattccatgtgctcttacaagacactcccaccccagcactcacagcctcagagccatagtctgccttgcagaactttctgctcttcactcctatttatgtcaaacaccccaaggcatccaggactcccagactatcctttactctctaactctcccctccagatagatccacgaagcccatgatcttagcctgtctcccactcccccaattcctcaagctctctggggtctcatagtccatcatgagtaaaatcccctccatcct

SEQ ID NO: 46592 - DNA, 1191 bp, Bovine  19866881064151
ctcccggccttgatgccttattgattttcaatgtggcttgactccccaggtgggcagacttcaaaaacggtctgtatttttctgctgtcatgtttccatccctgttcgtttccatctccagcaagattctgggtatgttggagggcagcttttcctttttcagctttctctcaataattttcttctggacaggattttagacagccagggtcacttctggggggtgtgtctcccattgtaagtaccgagttagaccagctgctggtaagtgtgagggagaagaggcagtccttgcccttaagggcttcactcccatcagtcctaagtgtggccatcaggcaaggtgtagccttggaggggacaggtctagtgacttgatatggcctcccagtttaacacatgtgcagtttaactgaccacaggccaacgagtgtttgtggagctatagtatgtccagccttgagactagaagattcactaaaatgctgactacaggctagatgctgggcttcatgaatactcactgttagcgttcctgaaacttcatgtaaattgtctactgctctgtgaagcaggttgttcttggctcctcattataaatgagtcagctggttttgcaggggtgtcataatttacccaagctcatttagcaggcagatgacagagcaggatctgaccccgggcctgctcttgctaccataccaggctgggctgcctgtgtgcctgtgtgtgtcacagggaggaggaaggaacactggaaagttttcgtctcacaggcagacacacccatttgtgtggaattaacaagcaagacgaggtatgtgtgtgatgatagtaacaatcactattctagcacctaccagggactggtcaagtgtttcccaatgttaactaatcccagtgaggaaacagaagctcagagatgttgggtaactttcccaaggtaacacagctgggaaatgtcagagttgagattcaagcccagagtgcatcttaaacacttgattgagttttgggcctgccagagagggattgccagcaagtgcggagtgagcattacctttcactgaaagattttatcctgctctcccacacttgacctctcctaagcctccaagcgcaggggaagctggcagctggggcctggggtgtcacttccctttacagatgaggtgaagcacagagatgtca

SEQ ID NO: 46593 - DNA, 1546 bp, Bovine  19866881084141
gaacatcggcataggaggactctttaatttgaggagacagaggttgctgtgaggcagcacacagtggtgtaagggactcggcagaaagaggaaatatggagaacaagcttaggttttttaataccgatatgattccaaccccgctcctcagctgtaaaacgggcatgatgctgcctaagtaactggtatgcgtgcgtgctaagtttcttccatcgtgtctgactctttacgaccctatggactgtagctcatcagactcctctgtccatgggattttccaggcaagaatactgcagggggttgccatgccctcctccaggggatctttacaatccagggatcaaaccagcatctcatgtctcctgcattggcaggcaggttctttaccaccagtgctgcctgggaagccccaagtaaccagtaggctgtgaaacaatttagccaaaatggacacttggcaaagggtttaatacatcatacattccaaccatgatcatttacttattctttggtcatcaaattcaagatggtaaggtggatcctttggaagagaaagatgtgcacactttagacagtggaagtcagcttctgaaattccttctttctaggtgtggctccgatggaaaatacagagagtgcactggagaactgggacatatcatgaacactggatgctctgcctttcgaggctatgaagcagcctcctgatggtccccacagcaaaccatgcctgggtgtttcagcagtcatgagattttaggtcagacagaacctgggtcctgttaccgggaggtctttcttgggctctgactttgtcttcctctggcctgctaatgtgacagtgcccaagcttaaagtcaacaggtggccaagagtggcttcaaaagtctccttacagctttgggaggggacttggagatgcctaaaagatagaaagcagagcagaccccatagagtcactgcactttgtcagttagtcatgacagatggcaccaaagtgccttgtgtcccctcctctggacttgtcccctgcttgtggccttctgaccctggacagcaagcctcagctcttccaatgctttctccactttggtcaaggccagatgcttccctgacagaggcagaatcctccttccacatgggggtgatgacctggccacagctccaacagggtttgtgttcccagactgaactggatagaatttgttcagtatctgtttagcttagacaacccccactgaacatcaggaacaagtcagaagaccagtgatgtttctgcaaaacaggttttgcctgtttgtttttgttttactgtttcaacaagaggaaaaaactacagaattttgtagatcaaaccttgttttttgtgaagtttcctttatttagatcataccttttttcccaggaagctagtaaataaacagagtgtgtcccagaggtaggtgtggaggatcaaccacataaaaagctgcagtggtctgcttggatcacaccgcacaggtgagccaaggggaaggacaggctgcactgaatttagttttccata

SEQ ID NO: 46594 - DNA, 1290 bp, Bovine  19866881114047
catctttcccgttctctccatccccaggaaatctggttttcctctgagttagggtcaattttagcaaaattataaattcagtcaagatacctttccttcttcccaggttgtacccctcaagcccctccaccctcattttcaagaaaagactctgtatcaggcattttatacctttttgttaactcaaatttttgcattcctttcccccaaagtatttgcatttcagccaggtctattgttaaaatattttgaacatcaaggagctggctggggaggattttagagacaggtggcctttctggctctccagcatcactccttcttcaactccaagagacagtcttctgatagagtcacctctccttcccctagcagattgtcacctctttcttacatttgcatcagtcactggctaaacagcaggattttcatttaataataacacatcttaacagaaaatagaaaatctctataaatagagatcaagtaagatgacagtggattaacattttaattaaacatggcaattctaatcatttttatcattatagaaatacccaacattttgacacatttcaggtataaattgatggttccagtccaatggcaaattgaaatgatttttcaggtgatatttgtaagctttcagtggcagcaagggatggtattcaacaatcaaagctatagattctagacattcccattcaaagtaaccaacccagggactcccctggcagtccaggagttaaccctccatgcttccactgcagggggctaatgtttgatctctggtctgggaactaagatcccacatgccaagtggtgtggccaaaaaacaaagcaaaacaactcatcctgaagcctccctcccttcttatacggctttaaaaatgatctcccctgatatcacacacactatcataaattaacacgatgctttatgatttgcaaaactcaaaccaaatggtactttgttttccttggtagaacagcagactacattctctgactagatggcatggcaaacagcactgacaaagtttattcgtcttagcagttcccgattgactgaacgtggaggacatgatttagcatcatgcttctgcagatcctcacagggcactctgcaagcagctattcattgttcctccagggtacagaatccaggcccagagcagtcaaggaacttgcccaaagacacactgctagaaaggaccagatctaggtctggcccccacaacaatcaagaatcagaaactctttgattactgtctttcttccccacagaca

SEQ ID NO: 46595 - DNA, 1568 bp, Bovine  19866881114881
ttggagcaagcggctcccaggtgacatgagtcatattggcatccatcacactctgaaacttttttggacatcattttccacagacactatagctgggctcacacccagggtgaatgaacgtggtgggtgtgggcaaagagggagcatggagttactgcagaaaaggtactgttaagtggttctttggggtgaggctgagaacagttagaccggcacagatggggtgtccggagaagggaaaccagcttagctagacaggcccctgttttacaatgttataaaagacgaatcatgccagcttgaaaagttagccattggccaggaatctgaaaaattaaatgtccagaaatcacttgcaaaatgacctcacaggccccgatcatccccaaaattgatcagacaaatggatggaaacagatcatttcacgttccttgttgttggttttgtttttcttcccccgcccccaggcctctgctccacatcctccctcaccatccgcaaagaaccaaatttggaaagttttcgattggcttttggcgctctgatttttttagagggaaggaaaacacctattaaaaatgttcgttccaggtggatggttgcttccaacagcctccagtgccagggaaatgaatctaaaatccccagtcccttgcccaaatctcaatggctagtaattaaatttccactaacagtttgttttatcacctcgggttagcttgttgacatataataggtgctgctgagaggtagagctagttaatgattttcttttacatattgatattagtacctggagagggaacatctcctcttcagaatatgattactattttgaaatcttaagcacaggagggaaatccgcagctataaattaaacaagaagttctgagaacttatatcttcagttcccatccagacactaatgcatctcatttactttgtgctgttcccctgagttatctgtgtcacacaggcgactcttgcatgtcgcgttaactatctattgaaaaaagctcgaagtgtgcttgtaacggtgccctgagccaggagacaaggtagaaagctgaagaggaaaaactcatcactgtttcaagttgcttggatattttaattcgaagaggaaagaacccatgtcagctaaggatggagctgtaattaaactgatttcacattcacaattgtctccaaatcggctctcattgattcttctcatctttaaactatatgaaatcaattatctctgcaaaccagtggtaaggatcatacgccagcctcttactcctaaagtgaagaaatgatttggaattcattattgatacgaacaactcttccaatggaaagctccttctgattctctggggggtgggttcaggaaagcatggcctgcccctggcctccagtttggatgcccagggcgagggtacggtctttgtgtgacaaatgctggggggcaggagaggagggcatgacaaagcggactttgcctccagagtggccagccttttaacgtgtgagactttacacacagtgacaaacgtgtccctggcataccccagagtgacaa

SEQ ID NO: 46596 - DNA, 1614 bp, Bovine  19866881125797
aaaatgcctgaaggtgtaatgtgaaagtgattttatttcatatgatggaatcatccaaacagattccagggaattccttggtggttcagtggttagaactccatacttgcactgctgagggcataggttcagttcctggttggggaactacaagctacacagccaaaaataaaaagtaagcagattccgtttatgctggtgggtttgtttttaaatcttttatgttaaggttctgtttattcctgttatttattcaaatcttctcaagtattcccagaatcattaaatttcaagccacaggagaccttagaggtcatttacttcacactggcaggtataagcatgttcatggcctctgctagaagggaggacagaagaatctgtggggaaggcttccagaacaaagaatcagagtggcggtgttgctgtggtcatgatccaggaatgaggaaacaggcccattgcctgagctgcctcatgtaaatagtaatggcaggacgtgttgcacagggacagataggcatttgaagttgaactggaaagtacactttaaacttctgttagttattacctagagaatgttttgtaagtctatagtgctttacttgttatccttgcgtatctgattcttctgttgtggttcacatctaatgtttaaattgactcagtgttttggaggtgggaggagaagaagggagaatggtcaaaaacaaacacaacagcaacaacagaaacaaacttctccgttggttgggatgcacaatttggttatgggttgtcaataagaaacagctgtttgtttgttgacagcctgccttgccttacccataatcaagctgtttctcatcatataattaccagatctttagtatatgaggcttgtagatttatagctggttgtgtagcatttgccaaaacgtcatagtttagataaaaaattagtgattcccctgtagtgattctactgaaatatggatgtggggttgtaataaaagaaggatgctcgaggaaagttctgacattcatttcagacttaagagaatgtcgagtgttttgtgtgtgccttctaacgagggagtttcagtgtaacttccctgtcttgtggactctactgccagtcagaaaaggattctgtattctctcatttttttctttctgtctttctctttcattcttttcttccttcctcctcctttccctctctctctctcccccttccttccctttctttctttccctgcttttccttcccttttcttcttccttgtctttcttgcctttgctctcttttcctgagtggtgtgaggcaggactgatgtgggcaccacaataggtttctttttcgtgcagaaggacacacttttgttcctttgttctttctttttctgtcttcttacaaccctgttccaatgtggaagccaagaatggaaggaaagttaaattttctgagagtccaaggtgatgttacagcctccttggatagttttactagctggggaaaaaaaaaggctgaatgtgccccttacctcaagagaacatatcgaggacattttacaaacgaacccctttcaatctggattatgctgagtgaggtccattttgaaataagagtaa

SEQ ID NO: 46597 - DNA, 1390 bp, Bovine  19866881147176
ttctgtgtgttagttaaggattccaggcaaagcagcaacatttactgatcacctatcacatgccaaactctatttcagttgttttcgtgtgatctctgttgactggtaatgatgctctgtgattatctttgttttcatagacaaggaggctaaagctaagagatattgtgtggcttgctcaggttcacacagttgaaaaagagtggggctaggatttggatataaatattgatataattgactccaagtccgacgtacttgcttctacgctacaccaattatctattgcttcagtaatgctgcatgatgcatgacaggcaaccacaaaaccgcagtggcatgcaacagtaagtgcatattgttcacccctctggggtcagctgggagtcagccaggcccttctgctgttcttggctgggctcagccgcatgtcttgtggttgactggctattggctgatctaggctggccttgtctggggcaaatggggtgactcggctctgctccacatgtctttcatccttcagcaggctagcccaggcatgtccttgtggcagtgacacaggtggaacagagcaagaggaatcatacagccccttgaatcagataggctgggaatagcacacagtcatttctattggccaaaccaagtcacgtgatccagttcagcatcaagaatgaagaagacactcctcctcttttatggaagaatcacaaagttatgttgtaaagggtgtgaatacagggaagggtgaaaattgaggccaatcgtatacgacaagctgccttattcaagcaggtgttctgagggcttcatctggtgggtggagaggaggacgacaaatatctgttgaaccaaaataacattattccataatatgttattagaggtgtgtcccattcctagataaatttgagagaggctgcataaatcaaactgaagatttatctactgctatacttctcagtgccttcaatatgtcagggtgcattgtgatactagatggagagagtattcaatattccccaaaatcattttttcatacagcctacctgttaacatcttttagggaaaatgttctgggaaaccccaattttgaaaaaaacagactaatgactcatgaaagtgaaaatcgcttagtcatgtccaactctttgcaaccccatggactatacagtccatggagttctccaggccagaatactggagtggggagccattcccttctccagaggatcttcccaacccacagatcaaacccaggtctcccacattgcaggcggattctttaccagctgagccacaagggaagcccaatgactcttagggtgacttttaacaccaagtcctactatttgacactatcctgtaacacgggcacgcactctgg

SEQ ID NO: 46598 - DNA, 2020 bp, Bovine  19866881168513
attatagcttattgtcattaattcttcagttaaaagctgtgacctcaagaaagtagatttctttccatggtgttctagtgaacatgtattctgtagacagatcacctcaacagattgggccctcctaagttccttggtacgtttttgctttgtccttggactgtaattccccataaaagcagtgcaagtgattaagtcattggctgttagtacatctatttaactcttagtgtaatgttgtaatacactatgaaccaggcctgctgctgttgctgctgctgctgctaagtcgcttcagttgtgtccaactctgtgcgacccaatagacggcagcccaccaggctcccccatccctgggattctccaggcaagagtactggagtgggttgccatttccttctccaatgcatgaaagtgaaaagtgaaagtgaagtcgctcagttgtgcccaactcttagcgaccccatggactatagcccaccaggctcctccatccatgggattctccaggcaagagtaccggagtggggtgctattgccttctctgcctagtaacttcttaaaggaaatttctatctgaattccaacttgggctcccataattatatttcttactacaggaaaaatcatatttcttccagtttctttgactaagctttgaggatgatagagaagacctgaggagtgactcattaagcagtgattcccaatgttttgtccacccccacacactctgtaaacatttcagacttaatcatagcagtacccctcagggtggatggggatcacctccctccttattgtctgacgcatggtgattctgacgagtgctccttcctctgctgggaaatactgctctagagcccagtgcctctgctgggaaataccacttctctgtctggaattgtctgtgtgttacctttctcttcaaaggaagttctttttacccatgctgccttttctattacctactagttgaacattgcccgtaacttttaattatgatttttcttctctctgactcattaaggaatagaatgttgcctcatagccttcttctcattcctgaacagtccaaaattgagaaactgcataattaggctcctttctatgccttttttttctttttttcacttaagcctacaaggaaatgttttaaaagacatttaaaacagcctgcatcaggttcaccctgaaggctttcttaacatgcacatcccttggttccaaaccagacctaccggggcaggtgggtgtgtcccacttcccgtctcttctccttaacttttcagcctatctctgctgttgacatagatctacctctagtagttgaccctgagtaggaaggagggggggaaggtttcaaagcacaggaagtctcttgaactatgggaataagttttgcaaaatgaagtcaggggttagttattctatgaaactctgcttcacacccatatctcataatctgtgtaaaagaaagaaatgaaaataaccctacctatgacagttgtttacaggtaatagaatcctgcttctaatgagcttaagcagaaaagaggatgcaggggcctttcgaagaatgcaaaggacaaagcgtgatcaagtctcctaaggccttgaaccagaaattggaaaactgaggacttgaggaagccattttctcaattttctctatttcagagatttcatgatcacccattttcaccccttctctgtttgagttgttgttttctcttggcagatcagaaagcagatcagatttccctacttctttatgaaaggtgggagatgatagccccacacttcatttaccattagttttagctagtgaggagggaaaagcgtacagtgagaacaggttcccagctgccatagggtgagtggcagaagaagagcagccaggagtaaaagtttcatctgtaaatcggtagcaggaatgtccatgagatgtttgaatatgaaatggaagcaagctttcaggtctagaactgttttatggcctttgaccgtattatctggg

SEQ ID NO: 46599 - DNA, 1094 bp, Bovine  19866881210022
aaaatggtttatgttgagagagtagattgttccaattggcagtggaggaagaagcaacggatgatgtgggtgggaagtgggcttacatacctggaaatcattaagaacaaaagtgatatgatcaagacatatgcttatcttatcaggctaaagccctgacttttgggtccttttccagctctgggtttttatgttactaaatggtgaagtcaccaggtgagaacacagactcaatgcctgtctctgtgaccagtttacactgcagtggcctgatttgggttcctattctcaatgaagctgtttcctcatctgtaaaatggggttgatcatatttctggtgtattagttaaggtcctccagaaaaacagaaccaacagaaatatctgtatttctgagagaagggagaggagagagagactgactttacagaattggtccatgtgattgcagaggcttgccaagtccaaaatctgcagggtaggctgtcaggctgaaaactcagggaagagttgctgcccaagtccacatgtggtcagctggcagaattccttcttgctcagggatggtcagactttgttccatattcaggcctttaactgattgaaggagagtaatctgctcactccaagttgactgattcaaatattaatctcatccaataaactaccttcacagaaacatccagaataatgtttgatcaaatagctggtcactatggcccagccaagttaatttgaaaattaccccttgtcacatctggtcacatgggacaggacagaagctttaactgtgagaagtgttttatgagtgtaaattgctctatactgccaagagagagggaagctctgtgggttctgccctgcaccccaagtgagagtgtcctggcacacagagggttaaggggcccctgcctctcctgctcctccacctgttgtctgaactgtcactatcccctccctgaccctcaggtgaggagggactcaaatgggggccgaagtcatctgacatctgatacttccttcctgcctggattagagtcatattgtcaatatcatgccagtgtttaccaaattaacaaaggacttcaagttaaa

SEQ ID NO: 46600 - DNA, 977 bp, Bovine  19866881240493
aaaagaatatgaaagtatatatatttgtatgtgtaactgaatcactttgttgtatagcagaaattaacaacatagcaaatcaactatacttcaataaaagtttttaaataaataaaatgccatttgtttgataggcagtatcttttaaaatatagtggccagggggtaaactaataaaaagatggagacagaaagttagaaaagcagtgatctttaggtatggcttgttgtctaagccatttaattaacccaaagttagaagtgtcatgttaatagagcaaattattcctcagcacttttgtgggctttccaggtggtactagtgacaaagaatccagctgccaatgcaggagatatgagatgtgaattcgatcccttggtcgagaagatcccctggagaaggcaatggcaaccactccagtattcttacctgaagaattccatggacagaagatcctggcaggctacagtccatggggttgcaaagagttggacatgactgggtgactaacacacacacacacacacacacacacccctatttaaaataactattttatttggaacaaattgcctctggctctgaaacacacaaacagaatctcttatattataattttaatttttagagaagtggggtaaatcacaagaaaaattcatagcagagatttgttatgggaaaatatacacacacactgaaaatcaatatggccaccactataaccagatggggcttcccaggtggtaaatgctaaagaaatcacctgccaatgtaggagacacaggagacatggattcagtccctgagtcaggaagatcccctggagtatgaaatggcaacccactccagtaatcttgcatggaaaatcccgtggacagaggagcctggcaggctgaagtccatggagttgcaaagagttggacgtggctgagcacatacactctacactcataatgagaataacattcctgctgtg

SEQ ID NO: 46601 - DNA, 1467 bp, Bovine  19866881247257
gaaaagatggaggaaggagaaggccactcactgtctagcctggctgaggagaaggattccaggctacagagtggaccaaagttgcccatccaggcacagccagaggtggggggttgggggattcataggcgttttgaagtagatacaaaataaaccccagtcttcctcggactttctgtcgatagcatcactggatctgacaacttctgcaaaggcggagggtcctagtggggctggggagagaggcctctgcacaggcagcctaggaggggacacagagcctccctgagacccccagccggcctgctccctagtggccgctgaagccctgcagtgccgggcaggatttccttctgctgatgggagcgtgcccctaacaggctgcatatgcctgccagctgttgctctcctcctgcccccgcagctgagacaagaaaagcattatttcctctggccttctcatctccaggcctctataacttcacaggccttcttcaggcatcgttaacttggcgctgcttctcagggtgagtccctctttgctcagaaaagcccccttttattctccccatctcatttgcctttcaggttgacgtggggttcctccatgaaggggctggagtatgccaaactttaacaaggatatttggttttcagaggctttatctgtatccttagtgattctgaaggggctgttctgtctacatgccagatcccaagcctgggagaattcctggtagcccaagaacaaacattttttgagtatgttagcctctagtctttacatgcaccatctcattttaatacagaaacccagccaaagagctattttgaaacttatttcacagataagggatctggatggtgggggaggaaaaagatgaatgggagatatcgccaccaagaagaggctgaactagccctgcctgaatccatgggctaaaataatccaggtctttccacaaaggacactgggattgtgccaagactttcccattcttgtctttgctgtgccattattaaggatggcccggatcaagtccacagccctctcaaggctttgcttccctctgcgtcatggatggggtgggtagcacatcccaggccctgccttccagagcctctgcctcaattccacctccgaataactgcaagaactgggccatgcccaggctcaacctgaagaggaacaggaggccaaaacccagctccagccatatccagttactaacaaaacacttgtctttcttcccgactgaaacctggatgtgcctgtcgcttgaggctctcaaatttttaaccctttcacagcagctgattttttcccccaaagtgcataaaacacaaggctcagattggtcacacgttactcagcttcagatctcacccaggggagaaagatctttgggagcccaggcaggacacatcgtttttgacttaaccagtgctaacagttcacttctgtcc

SEQ ID NO: 46602 - DNA, 1032 bp, Bovine  19866881275995
gtttctgtgtggaaaggactgatgtctaaacatgatggctggaaaccaatgaatctttcatccagttattcactgatacctgtgatatactcaacaagtaaagaggcagagcccatctgtagaaacccagctacctgctttggaggaggaaaaagaggtcccacctcatcttccttacagccaggccccaggggcacaaactgtcatttcaagatgcagaacaaacttcatgaaataattcttaggacctggtgagctccaaggggcaccatcctgtatcagccttctttggaccttcttccaaggtgccgaatgtgccagtgggagggggcactgttcaatccaattgactgtaccttgatctgcttccatgatgcctctgcttgaacctggaggaaactggctggcattggaggagaaaaatgggagtgttctgatgataaaaagcaagttaggtcggcgtgctggggcagctcatgctttatgtagcagaactgattgagcttcatgattcaccctccccttggccttcagcccttgttaacacttccaggaaggaagctgtccagagaaaggaggggagagagggagggaatccaggacgattcccaccatgagaaggtgccggcctgggacgggggagggcggaacccgcaggctggctgtgagaggggcagggaaggctgggtgctttgaggccaaagtgctcattatgagaactttcttaatgaccgtaagtcctgagggaggcatgtgagcaaagcctggcgccagccatgattgcacggggcctcccgtccagatggcaaatgtgtagggagcgagggaggagagtgagaagagaccgcgtggctgctgaaggtgactgatggccttgggacggctgatctggctcctgtggggtcaggttttactggaacgagacacaaagattagtgactttcatttaagaaagaaccccggtccccagtttcgggaacaaagtttctttgggttctttgagagtttcattgattctccagacctgctcat

SEQ ID NO: 46603 - DNA, 955 bp, Bovine  19866881422521
ttttaggcaagaggattgttaactaaactggggtgaactgtcaaacgtgcatatttagtacattgggggtaatccagcttcaggcctcaaaagttgtgaattctggctttgactccgctgctgtctaatttctgtcaccctggacaagtcatttcatctctctgagcctcagttccctcaactgtagaaatgagataataaatatctcttgttttatagagttacaaagatagaatggcaaataatttgaaagtgctttgtaaatcacaaagcacaaatatgagcattaagtactatcattaatatagtgactgggcagtttctttgctgtcctggggatgccccatacccactgagtctctgagtctttggccatggtctctatccacttggaaatccaactttgttaggtaggattagatttggatagaagaacagaaacccaaggcaacagtggtatgtttctctcctctaatagtctggaggcacttcagggctggtgacttagccacttagtatgggtgacttagactctttgttttgttgctttgctgcgcctgggttgccatttccagggtcaccttatggcccaaggtggctgctagcgttccagccgttacattcacatttcagcaaggaagaagaaaagacagagagcatcctttctgtctttaaggatattccctgtctggtagttgcatatgccacctttttatatatttcattggccagaaattaatcatatggtcatatctaccttctggagaaactgggaaatgtggtttttattctgtgtggccatgtgcccagctaaaaatcagggttctatttttgctgaataaagagggaagaatatttaggggagagctagtatctctgtgaggcttcccagatgactcagtggtaaagaatctacctgccaatgcaggagactcaggttccatccctgggttgg

SEQ ID NO: 46604 - DNA, 1317 bp, Bovine  19866881559710
ctgataatttactcattaatcatattcatgtgcatcttgttatataacttcctagatcctacagcgcccagcacagagctttgcaaaaaatgggccttcgaaacgatatctgctagatgcccaaagtaagggaggaaaagaagaagggggtaggggtaaaagatgaattgcaactaatcttggatattacattcttcaaggtatactatacatacattaaattacattggatcgctttctagtaattacagtgctgggcttaaaatggtttttagaaaggcattagaatttcctactttaacttaatcactgtgtttagttttcccttggaaggcactttatttatttaatgtcacaatactaaaatcatttcattctgcaaggttcaataaacagaaaaaaaaaaaaaaaaaccctcaacatctacactaaattgttactaacaaagtaaacatttcttccccagttttttctgagttgattaagcaccagtatatttaaaaatgtttcccaagcctgagaaaaactcccctctgaacatacaactattcagtgtagaatgtttttcctaccacttgattacaatttggcagtagtttctgaataatttacaaattttaaatttctgtgccccaaacacacatgtgttgcaactaaacagacttgaaagaatatgcaaattgcacttttatgtcaaaaatgagtgaatgcagcttcatgcagaaaaaaagctaactgtcaccctcatgtttttgtttagactaatctgtgggctgtcgcccccacatcagactgcatcaacattttctttgggatattagacgtaaatgtttatggctgcagatagcctataagggattggcacttattaaaaacgaccctggagtattttctttggtttccacataaatatcccagggaaatgttcaatcaaacaaggctgccaggtagagggaaatgaacattgcagcagagctctggggtccctcgggtcctgtcaagtgaagggccccatccaagaatggagtaagaaggctgagcccagagaactgggcttcttttcgacatagaaggtaatgtggttgctaactggaaatgtcccttgccaaggctaggaatcctctccacaccaaaaaacttcacattttaaaaagttgtcaaaatactatcgatactatatgtggattttatcgcatctctagctgtgagggccaagcctgcttgtgttttggaggtgggacaacttcatggcacaattggctttattcatgggttgaagcaggtgcgagcccattgtatcctcacaagcggtgggaa

SEQ ID NO: 46605 - DNA, 898 bp, Bovine  19866881592102
ataacagattaagtacctggtttttatttttatttttttaatgcataatgagtagatggttactaaagagggtggccaatcctgcttgtttacctgggacagtcattgccctggcataattttaaatagtgcttctttttgtttccaaagtgccccattttatataatgaatcatatgatcatctttgtagattctttaccatctgagctaccagggaagcccttaatactaacagtcccttacaaagtggtaaatcacagcatgtttattgatagttgcgaatggttcatgtttctcaaaatttgcagccttccagctggtttacgtagatcttcttaatgccgtgggttctttaaaagtatataatgcaattcctgtttgcctgacgatttcatttctgaaatgctttttctctcttactggtcttcaactaacagtggatcttaatgttgtaactttaagttggccttcctgctcactcctccctgtgttcttcctgattcatagtttgtagatcatcgatgagtgatatgcacccgaagagtcttattctgaagcctgcaatgtaatttcaagcaaatgctttttttaaaaatttgaggtatagttgtcatatgacattatattaatttcaagcatacaacataatgatctgatatttgtatatattgcaaaatgatcacaagtagtttggttaacacccatcaccatacttggttaaacaaatgctttcagggaaagggccttctccctgggcactttgaatacaggaaccagagtagtcaacagtgtgactcatctctgttgacctggtagctaagcccttggagacacaaggaggacttgatactgaactaggtttcatgatttatcctattcagcccaaacatggtagtg

SEQ ID NO: 46606 - DNA, 695 bp, Bovine  19866881923544
tccacaaaaattccaaacaaggtggcattctcgactttgcctgtaagaactgtccccaacctgcaggtcttccaagcagactatgcttctcttgaaatcaggtttatcgaaatctacaacaaaaggggaaaatggacagtgtgtataaataatgtagacacaacataatttaatgagtaagtattgtatacatatcaattgtgtgcccagaccagtattaagcattgaggggagacataaaaggagctgaagatatatgcctgccttcagagaaaaggcatcctagttggagaaacagcatgtgcaaagtaggaacaattcaagaaagtttactcaaacactatcttctcctcaaactctatcttgctaacctgtgaacattagcacatacataagggactcaaaagactatagtggcttattttcttctttatgaagaggagatgagaaaatacatttgctcaatgaatatgcaaggctaaattacaaatacggagaaaataagatccttgttgacagaagaatgggagttttccttcaagtgactgaattctcaaaatgtttaaagtgggtagaacatccataaatatttagtcaaatgtgaaatttaaatgttctttctcacttctgcccccaaattttgaactcaaggatcaactcctatccatttgaataaatttatccaatcaaaaaga

SEQ ID NO: 46607 - DNA, 515 bp, Bovine  19866881926753
tgattttttattgttgctgtagaaagatgggacctcgtgcagggtccgcaacaggtgggtttggagcatggaagagatgaggctcattgcaacaactgcccgccggtagaaactgtagttcttacaccagactgagttgatgatctggggtggagctggggggtgggtaggcagcgctactgtttagctgtgaatcacaaagtcgtaactaccaaacgtgctcctcccctcttgggtctcggcctcatctccaggggtgatgacaataagatgggctggattcccattagaccgagaaataggagggagtgtccactgacctaaggaaaatatctcatgaaaacatggtttcttttatattgggaggcatataaaaatgcatgtaaacaaggattttttatttgaacattatgttttattggtacagagcatgtgttttcttaccctagtgactaatgcctttttaaaatgagactttgaaatgccattctgcttatgtcatgagataaagagtt

SEQ ID NO: 46608 - DNA, 1855 bp, Bovine  19866881006942
ggagaggagaaatctgaagaggcttataagtttatttattcctctttatttaggtaaacatgctctatttatttttagcgactttgttccctattccctctccctctagagatttatggtgcttcagagggatcttactataaaactattgctataacatatcatttccccttatctataaacaaatattggagaatgcaatggcatcccaatccagtactcttgcctggaaaatcccatggacagaggagcctggtaggctgcagtctacggggttgctaagagtcagacacgactgaacgacttcagtttgacttcactttcatgctttggagaaggaaatggcaacccactccagtattcttgcctagagaatcccagggatgggggaggctggtgggctgccttctatggggtcacacagaggcggacacgactgacgcgacttagcagcagcagtagcagtataaacaaatattctgtgaaataattagaaatcagagaggcattcactctctgctgatccttggcttgtaattcttggcttccacaataatatgtaatttatttacattccatggaaggagtgataggtttacctactcccttgtcatcatttgggctctctggaaaggtgagagagatatggatttaggcatacagaatagtattggtagtaacacctgtgaaaagaaaagtggaccaagaggacaagacagagttaaccacatgcttggaatgcaaatatgatggagccgagttgggaggtctaaagtataaattgtccattcgaggtgtgccagttagtgtagaaatcagaaggtcataatacctcttttcaacttagtcattggctggggccatactgagaagagagtgttctcaataactaccatcatgatcattcattggcagaagggcaccttgagaatagcatgtccttggcttgcctgggtcatgattttggaaggtgtgctagagtggcaattttgaagaatggccatatctgaactttctgctgatgtgacagaagattgaacaaatacaggggaaactgagaaaataagtaaatacttattgctgattggagccagatttaacttaaataaaatatgtcatggtataaatgataaagcactctatgagtaatattacttaatatattttcgttagtacaaattcctgtcttccagcctttttcttcctggatttatgttcatattaaagaatttggtctttggtatttccatatcaatttagtgctgaatttaattttcattatactcctttttgtatttctgttctttgagtttctataatgattttgatacagtaacttagtcaaagtttacttggtggctgggaaaagttaattcagtttctataaagtatttcatttcctatcagtagctcttttaggccctgggagaatctgccttatctctattattttcactctcttcaaagtaaacagaggcaggtattgttatcacatcttaggaacaggaaagttgagccctggaaatttaatagcttgccaaggtcattttcacttgaaaacacagctgaatccatatttcatgtatagaataaagatttctttaaaaataatttaatataattatatatttgggtatttgcaaaaggttatgatttttaaaataagcagaaaaataagctgtgtcttggcacctagccaatcaatgcattgactattatgtagatttatgtaccacaatgaggtagctaggcaaggctttaaaacataaaaaatatacagtaatttctcatttccatttgtgccatgaactcattagaaaaatgaagacctcctctgtttttacaactctcaatc

SEQ ID NO: 46609 - DNA, 1422 bp, Bovine  19866881021382
cagagcagaagaatgagagtgtggtgtctaaattaacagcaagttgatattcagggctgtgcttctgttaaagaaccagggttgtctcttttgaaagcctgagcccaggctgcctcctccatgcccctgaacaggagcaactcttttcccatgcagccccagccccaggcctccttcaccccaagaagtaaatgcagggagatgtcctggccagtcccaggccacctggtggttacaattctgtgttatttactccaagatcacatgaaacacacacctgtggtgggaaatatttaatgcagatgttgggaagcagctttgccaaaattgtcagaaaagcgcatgtgaggaaattacctcctggtccctcggtggggattacgtcttttatagtctccgtattttgaagtattttcttttttaaagatgcaattgtcaaagaccgctcctttgagagcaaggggaagggaggagcagagagagaagaaaacagaggaagtaacacaagacagggccccccacccacaagaacctgagttgggggatctggacccttccactctgctccatggggagctgtgaaccagaggcccagctggggaggacaggagcttggtgtgaggagaaactccagggaacctttggaaggagggagggggcataaagctgtggtccccaaactttttggcaccagggaccagtttcatggaagacaagttttccagggaccttggggttgggggtagtttgggggaggattcgagcacatgacatttttgtttctattattattatatcagctccacctcagatcatcaggcactagatcccagaggctggggacccctgacataaatgatgtagatgcctgcaaagcaagccaggctctcccactggggccaggctgtatccgagggggaggatctatgggcttaaagtggcagaaaaggattctaacattcaaccaacgtcaaatcagccttaaggactgggctgctgctgctactgctgctaagtcgcttcagtcgtgtccgactctgtgcgaccccatggacggcagcccaccaggctcttctgtccatgggattctccaggcaagaacactggagtgagttgccattttcttctccaatgcatgaaagtgaaaagtgaaagtgaagtcgctcagtcatgtccaactcttagtgaccccatggactgcagcctaccaggctcttccatccatgggattttccaggcaacagtactggagtggggtgccattgccttctcccaaggactgggcagtgatgagcaactagcaagcacagcagggcagagaaagcaggccacagaagagaggaggccttccaggggccagggtcttcccagagggctaaatgaggaaatgctaaaggagatgtaagtgccagtgtaggacgg

SEQ ID NO: 46610 - DNA, 1694 bp, Bovine  19866881116362
ttttgaggtggtgggtgtgggtagagttgtaatatatctcagtatgattactcggagaaggcaatagcacctcactccagtgttgttgcctagagaatccctgggacgggggagcctggtgggctgccgtctgtggggtcgcacagagtcagacatgactgaagcaacttagcaacagcattattgctaaactaatatggatgtttgaagtagttactttggccatgatagttatgataagagagcctatgcattgacattaaaacattttttaaatatgagaaatatccatgggtttcatctcttatagaatatatcttttcataaatgagactactgaaagcaggaaaaatcatagaaaatgtaagcaaagaaatagtaattataatgctatataccttctctccatactattacttttcaatatatttccatttttttcaatttgcatttttttcttattaactcttgaacaaagtgaaagggtagtatatgtgtgcatgcatgtatgtgtgcgtgtgtgtgtattcatggttgtaatttaagattcttctgggtaaagaaatcactgatctgtataatataagtgacccagattactgcagggagtcttgcctgctgccattaacccttacctccataaagcaaacctatgggtaaggaaagcttctcacagcaggctgtgactaacatctatgagagagggaaaggattataaatagatccagtaaatgaaagcaggacaaaaatctggatcaggaagcctgaaacttaaatgccaaatacttgagtttatttaaataataattgaaatcaagctgtactttttagcttaatttttcaaatttagttgatgtctcagtatgcaaaataattcacctacaaaataatgtcatacaaaagcaattttagatattctgaacataagctcctgaaactaaatatgatgatttaatggaaattgattgctaatgagattgtattaataagaaaatatttgagcctgatctatacaccttcatatgctaataaacggtcatgtaaacttcatattttcttaactagtacaggaaaataactttctacgattatgagtctgaaagtcaagttcaaggtatacttaattccttgcttattctctgaaataagtgctgtttatatattttccatttgttaggattaatatgaatcccttaaacacatataatttaatcatttaaaaatatattaaataataaatatattttatttgattattcttataaagaagaataaaacttactttaataattatagaatttttctgagtgtccaagactcagaaaggaagtcaacctttctgtgaaggccactgaaccaatttataagtgatcagcaatccagtcatccaagaaatcagaaagttctggtttcatttattcacagaaaggaaatcgagcttcccacatttatttcacatgacaagaaattctttatttacagaacgactaaaacagcacacttccaagttgatataccaataatgctagttttcctttgtattaactgttaaagtctccatatttttactcaagtctaataatccatgaaactggtggaatcaatataatcacagaagtggttttaaagtaactgttttatcttgatgacagttcgtgtttttaatgacctttatatcaacttgttaagatgca

SEQ ID NO: 46611 - DNA, 1142 bp, Bovine  19866881155767
cttattaaatcctttaaaggtacataactgaactatatttatggcaggtaagtaatagaaaatttctagttcttaaatcatacctatacatgtacatttttttcctctgaagatttagcttatttgtgttgttaggattaataacttgaattctatgtataggtacccaatccttttgatcttgtattggcattcatttttacgttccaaatatacacctaatagtttcattatactgacatatttgacaataaaaacaacctcttgtttctctacctttaaacaatttcacattcatattctaaaaagaatagaattaattaattaacattttgtattaaatttaatttacaaatatcttgactatttccccagaaaacagtgaaagaatacatcagtttgtcgtctttgagtgtgttttcagttttataagattcaagttattccttggagctttccaatgattaggcaatacatattttttaaaatatcattataatccctagaagttgcactttagagaatagagctattctttgaagatttactggaataccaatagtttattatcttgaatctgaaattcagtttccagcccagtgcatatacttaatcaatatctcattgccattgtatttttcaagaatctgtgaaatttcatacctattcacttgatcctgaaatcattagtttgactctaaaaccatggaaactactgagtttctataatcccttctttttgatctgtttatatagaactctgttaagcatagattgtgaaagcacactggttactatacatatgatttgtcatctttcgctttcttatttaaatgtaagaattaagtggcacaatttgtttaaaaagtatatatgtatactttatatgttattatacttttcttcacttatgacaagtatgccattgtttgcactttctgccagggattttcttttcctttgttaataggaggttcatactgacctaaacttatcctaatcacaagagtatcaatcctaactcctcccattctcaccagagaggaaggtgaagcatatacttttccagagaatgttatttcagttatttcaggctatttctagtacagagatttttacagtaataaatataatatttgcag

SEQ ID NO: 46612 - DNA, 1414 bp, Bovine  19866881210273
tcttttgttatgataaaatgctcttgattctgtgtaaaaaaggatggtacaattttatggcaatgcaatttatgttaacaacatagatgagcctataactgctctcccattaacacttgttgtttttctctgctcaccattttctaaagagtccacctttaaggttggaatatttcatacttgtctccaaacaaaatgtgtctctttttataaaatttcacttatgtcagttgagctgttattttgggtaagaaaatgggaagaagaaagtcgtttctattttcccctaaaggcattttattcatgagcaaagtctaaatggcaaaattttatttcttccacaagtttgttcatgaggataaatgttactccacttataagaaatagcatgtgattgtaaaagtactggctaatttagtccaagataaaaaggtccaattgaagtaaagtaggtttttctgtttccatatgtaaataattcaaaagttacttatgtaaaataaattaactataaaaagtaaaatatttttactttgcctatgatatttatacagtaaaactaaccataaaatagatgcagaaaaatattcttaatagatttgaaaaaataaggatgtgtatatatacatatataaccatatatataaccaatgaagctagaaagaaaaaaatttaattgcttttaaagtgatagaattaatttaacatataattagaggaggtagtccctggtggctcagctggtaaagaatccgaccacaatgtaggatacctgggtttgatccctgggttgggagcatccgctggagaagggaaaggctacccactacagtattctggcctgcggaattccatggactgatagcccatggggtggcaaagtgtcagacacaactgaatgactttcactttcactttcagaggaggcagttgagagagaaggtgatggggtgaatgaaatacatttaattaccaagagagccttaatattctcctcagattgactaaactttagatcattttcttccttactatgggccccataaccccctattcttagagcactggcactagatgacttgccattgcaattttttcctctttgaaatgtatataaatcacctcttgcaaggtttaggacccaagaaatgtctttcttaaggacctgggagccatccctttgaaaggtaatccttaagaaagacagagccctgggtttccctggcggctcaatggtaaagaatccacctgccagtacaggagacattggtttgatctctgatccaggaagattccacatgctggtagagcaactaagcccatgagccacagctcacaggcttacaacccatgctctagggcccaggagctgcagctattgagcccatgtgctgcaactaccgaagctctctca

SEQ ID NO: 46613 - DNA, 930 bp, Bovine  19866881313180
ttctgatttttataaaatctaagtatttgtaatattaccacaggaattttgaagataaactagcatcttaaacatttaaatatgtgtgcatgcatgctaaatcacctcagtcgtgtccaagtctttgcaaccccatggactgtagcctgccaggctcacctgtccatgggattctccaagcaagaacactagagtgggttgccatttccttctccaatttaaatatgaatgtggaccttatttgatattctctttaaatgtagagtaacagaagggccactgtaacagacagttagacctagaacttactgatgaatctcacactgcgctgtctgtgtgttaagactaggcctactgagtagctcatctacttcacacactgcacagctgaacttgtaatgataacgtcaccgtgtgcgtggcaagctctgaggatgctgtccacatctgagcactgttactctacgcttgaagaagtaattttaagttgatatttttgctaacttcccaacccatgaaatattaaataagtgtttgaaacaggctgcatttacttcatatacatatataatcaaatgtttaaatctgcttggttgtatgatatgaggttgctaaaattatgaaacagaaatatatacctttggaacatgcttatcatttgctatgtaattaaatatatagaccattttgcttgagaatatgcatgtgtgagtacacatgtgcacagaggcttatccctaggcatttacaagctgttttataaaattagttagtctgtacatttttaatccttatctttagctaaccttatcttagtcatcattagttttctgttgttgcccataacaggccaaatgactcaaagattataagcagtaaaaagtcatgtcataagcatcaattcccctaacgagcagctgaataaaatat

SEQ ID NO: 46614 - DNA, 1830 bp, Bovine  19866881400389
ttaatttttcaattcagactgaggcatgtatttctgctgaaatgtattagccttttttaatagctcagtttccatcatttacctacggaacaaagttatgcctatagttactcactttgttgatgaccctggcttcaatcaatggccaatcttaagaacccagactaatgactacaactgcaaaacattcttgtgaagctctgtctcttaaggcaatctctaatatttcaggtaaagtcagatttttgtacaaacaccactgtgagttcaaataagatagtcttctgttaggtcacaggggtggggctagagctttgaggaaaagtatgaaaaggatttgcggcagaaacatatggttacattttttaatttctgagatgtcaggactggcatgaataaataactacatctatgcttcacataatacaaatactattttataaaatagagatgaacaactgtgcatatgccaaaaatcatttatcatcatagaaagcattttatgttcatttggaattatcaaagattttatatttacctttcagagatgttttattttattcagaattgagatacagcttaaagacaaaataagtcaaaatatgaagattatggaattgaatttcccctgcagcagacaccttttagattaacatttgcctacttactatgtaccctacaccatcgtgatttcattcagacatgaataaaagataatgtttgtttattgaaaatttaattatctctcaaacaatttaaagattcacaaatatacagtctaaaatatatgaaagcataacaggcaatactctgtttactatccaggtcttcattacatcaggtaagatatgatcaactgcaagcaccagaaaatccaactcactgacaaatgatagaggagatttaggcacttgcctcatattcacacaaagaacagggttgatgggagagtattttccaattctcaaatcactaaagtctcaggttatttagaccaagtgaccactcaatgccactgaaatgatctcatctctgaactcttctaggagccactttcatccacaggctggcttatatggcagtagtaaagttgatgctgcaacttaagatctaacattccttttctacactgcccagaagacaaaactttattttttccaactattacccaatgttctgggtttgattccatctagaataatttagaatcagattttgaattaacagctttgcaagaagatatacccatcatgacccttcttggagatgggagatggaatcaaatttactcatactacaaggctgaaaaacagtaattagtggtagatgaatgaagcaaacaacagtgtccactgtcttcctaagatatagagacattatatttaaagataagtcattgtaaaagtctgaagtaatggtcacttaatgtgtgtgtgtgctaaggtacttcagttgtgtctgattctttgcattctaaggactatagcccaccagccttctctgtccatggggattctccaggcaagaatactggagtgggttgccatgccctcctccaggggatttttctgacctagggatcaaatctgcatctcccgcattgaaggtggtttctttaccactgagccacgggggaaatctggtcaattaataccactgtctaaatattttatcatcaattatttcttaactttaaaagcaataaatgacccttgcaacaaaacaaaccacatgaatgcagacaactaatctccatatttcctccaatgtaaacctttatcctatcaaggcaaacaaatttcaaaagcagatttccacaccaatcagaga

SEQ ID NO: 46615 - DNA, 1365 bp, Bovine  19866881426352
taacatacacttttcctattcaaccacaaggcaactccctactctgtctccaatgtggttgtgttcatttacacttccaacacaaaaaatgtgagttcccagaactcactgttgacatcaacactgacatcttttttctttctagtaattgtgaaattatatctcattatcattttaatgtgcattcctgaggttactaatgagtgtgaacatctttatatatgtataaaaccgtttcatgtattcaagatgggactcgaaattaagtgaagctacattcaggggaatcagatcttttctcacattaccctacccccaagttcagcacagtagtagaagtatcataaagggtgagtgatcttcctagactttcacacagggcagcaaatgtagcttcaaggctactggaaaaagagatgataggttaaaagtaaaacagttggagaatgaagactagacatgaatggagtaagaatgaaaaaaagcaactcctcccattttcctcaaatgtaagagttcaaagtgacttttgaaaggcagggaataaattgcctaataagatttttaaagtactcctcattttaaacccataggcagtatctgcagagccaaggtcttggaaaactgaagcaattgtcttatccttaactgttttagctaaacatctgcccctctattcaacgtttttagagaaaacatgcatgccttagtgtgtgtatggccagtattttaaaatttagaaatgggttagcagtgaaattaagttccttcaatacagagattatatagccaaaaccttggtattaatacctgtccatttaatttactctacataattagattttgtcctatacaaaggtaaaacattttatgtctattcaaaccaataaagtgtagaaattcaattatgtaaagtcatcttcagtgctagagaaatatagacaccagcacaaataaaatctccaaatgtatatcctctgtccatgcaatactcttttaaatcaagtacaaatcttgaaaatatgattcacgtgtgcctaagacaggggtttagctatgcagatatatcagttgttacctctaacataagtttttaaagtttactagaaacaaaatgtacagagcctttgaagatttatcacatactcagattccaacattttgttacagtattcacaaatcttctttgagatgaaagccatgttttaggaactaagaaatatttattttgatgcagatgattaagccacccagaagaaatttttaacttttttcctagtgaaaagacatgctataagaaaaggaatattgctaactctggaaaaaattacagtcaaatcagacactttatttgaaaaggaggtt

SEQ ID NO: 46616 - DNA, 1144 bp, Bovine  19866881619404
tctgaattgaaaaattattctaggatttgttagatatgttaattggttcaaatcgcaattaacatatgaaaaggaaaggaaaagacactgaaaatagactgtgaattaaagcagcaaaagaagtaatagaaataaaccttacatgtgacagcttgtcacctccatagaatagggctgtgtagcaaaaaggcagccgttgcaaagcaccgtgacactgatattcaagagctgcactgaaattggtaacataggcattttctttgcaaatattcatgtcattaatcttctttcaaaaatcactgaagtctaaacatgagccagacttgcatttgttcacaaagaatgcacagaaaaataagtgtgttacactcactgttactctttctgtttacacacattataacaagtgtatgtgatatgagatgaggccacatgctctgaatacttggtttacttgccacatatgtagaactcacagtgtatattaagaaattcagaaactcctgtttggatatgtgttatgtctttttttttacaaaggcttttctagaatgggatctaaatgagatttgcattatagtaatcctgttttatgtctatgttgtggtataataaactattcattacttatgtaaatatatagccacacctatagatggagagaaagagaaattatttattatttttaaaatcatagcagacaatggaaaacacaatacacattgattaacgtgcacagttagaaaatatgtacataatatgctcaaagcactgtgcaaggggctaaagaagaaagaatccctgcaaagagacattatctagaattccaaacaaaaacaacaaatcaaatggaatcctgttggttctcttttggggtatgtaagcaaaacatcactgaggtagagaggagagaatctcttcacataagcaatggcaacggttttggagaagttcatggaagaaaaggcaagtgcaattcaggtagaggcaacagtacctggagttattagacagtcgtgtgtacaggctattacaagcagcttattcagactctgacatagtttaaatatacagtaagatgtatatacagtaagatggctctggacagctttgctggatttaactatgaagagtttttatatct

SEQ ID NO: 46617 - DNA, 897 bp, Bovine  19866880384706
tccttttatctctccttctttcctcctttcttctctctttcttccttcctccactagacaagattctggaaatttgaaaaataaatttgacacatattatataattttattatgagtattttttaaaagaagaggaaaagaaaatcaatttgcccttaaaaatttagatctggtaatattttacatgtattgaaaggaaaaaataatctttttattcttatcggaaaatttttaaaaacctatatcacttaacttattatttgaaaagcctaatttgggttgctttctagaagaaaaaaattatgtaattttttttagtaagaaaaataggtagtctcaaaagtcaaacagtaaaattgagaactcataaaggatctcacaattgggcattaataatgaatatttattgcttgaatataggccttatttaagaaaagagatatcatgcacaccaggtgtaataaagttgttggtggcctaacgtgttgcaagtgttttgtcatctacagcactgcattctttaaggatgtctaacacaaaaaaaactctcaagtgaatttattgactaagaccagttccacagaaccaattagtatcttacacaggctgccctgcaaggcttatgaggccatccatcacctgtccatttaactatttagcatttgttcaagcaatttgtcactgtgtcagaatgctagcatttcagaatgggagtttttggttgaaagaaatctaactcagatactgcagatatttctcctttaataaggcttaggaagatttatgtttctattatatttaaccttaaacatcttgtctagagggtgaggttctttgtactgcaaatatttcaaatttaaatcaagtttttgtgtgaatttaaaaatatcatgcaaa

SEQ ID NO: 46618 - DNA, 1833 bp, Bovine  19866880449303
ccaatgggttactttttgtagagagaaaatacttgaaagcattgaaaatagttgatggcatgaagtttttttctgatattgtagataccacaattacatttacaggtaacatggattccattttttttttttttcaatttgaacaggttttaagtatgtaggccttacatatttttcacatccacagccgttaactaaagagaaaataaatttcataaactttggtttagctgttggcaggttttcaatctgatttttttcagagggataatagcatgctacatggatatttcttttggaaattagtttatatgggaaagcaaagttgattttgctcaaaatataataacagttggatttcaaagtcctgtcaataacagatttaagaggtatatgcaaacactttctgtcaacttctgtggcttttttttttctatttcaagttaaaatcataaatttaattctcttaggatataaaacaatgctaactacatttgtttagtttatgcctgcagtatatttttatttattttgaagtgctgtcatagtattaataataaaatatgacttttttgttaggctccattttatttgctgtacttcaaaaaactacttgtgtatattctgaaaatgagaaactgagtttttttttcttggtttttattaacattatgtaatataatcccaagtgatttattgttttatggtcatttaaaaattccgagtgtcagtgtattatgagagatagagggcaataaaatcctagcagtttacaccccaatttccaatgttcactttagcttcatttcattatcataatccatctaaagctttaaatgtaatattttgcatatgctgtgtgctaatcaggcactgtgttaatcatgctttatataaattaaaacagtcacctcttacaacatgactgaagtgaggggatctgaatttgaggaactcagcattcttacacaagatgacatggttcatgaccaaatttgaattaataaatctgggctgacttactcccaagggccagcttgcttatcaacatgtatgatcattacatgccaggtggagatattagtaaagataaatgtataactggtaattttatgagcactgcctataaacagggtctatatagaacaactttttcttagtatgatatttgaaagttattgtccatgtagatgacatgtcagtataatacagtgactatatatatcaatatactagctttaaagacagacttatatattcttggttatgtctctagcttcaggatgttgctactgttcatttgctaactcatgtctgtatctctgtgacctcatagactgtggcatgctaggctcctctgtcctctactatctcccagagattgctcagattcatgcccactgagtcagtgatgctatctaaccatctcatcctctgctatccccttctccttttgccttcaatctttcccatcatcagggtcttttcccatcatcaaggtgtacatactagctagtaaatgggttattatatttgtttcaaaagatgcatatgtgtccagatacacagtggaaatgtcagcatacacagttccttcaatattccgcttttctaaaaggtttccagccagcacaactctaagtttacttaattgacatttcattttaatccctactacctatgtcccacttggttgaactcttatattatataataaagttctcaccatacactactattagagttagtatggaaacaaacttcactcacttttcagaactacagtttttcaatatattcttactagactgtcctctaatttcaacctcgcaa

SEQ ID NO: 46619 - DNA, 840 bp, Bovine  19866880736592
atggagagaaagaaagaaatatgagtattttacacatagttaaggaggatgtgtgtgaagctttatatagtgagagagttagggcaatgatgaaaggggcagcctgaagcattcttccagggaaatttttttcagctacttagtactcacttaaagtttcccaagatattcattgttctacatacatacagtattgaaaatgttttatttttcgtttctcaactgctggggtccagccccagtgggtccagggaattcgaagtggggacggcgtctgcgaggatcagaaaacaattgcttaattaaacattaattaaggatataaagagtggtttaataaggatagctcagtgagaaagtttagtggagaaaagaggctgaataacttggtttacgtggaaagctaataaaattccaaaataaggaatttgcatcgcctacataggccgtaggcgtcctcccattctcccgaaggagaggagacactaaggcctccctggtcagatctcagaaacccaggcaaaattagtaggctcgacgaacctccctgccccagatgggaattcagccagaaggtgagagaaagaacggcatggggagaccaagttttggtgaacaaagcccacactttattttccaaagtagtttttataccttaagttgtgcataggggataatgggggggaggggtagagtcagcagtaagccaggctttcatccagcaaacttatcatatgcaaaagtttaggtgatttacatcatcttctggcccggaggcctgttaacattttaagacccttttttcagaaaacttatttttctttaaaggtgattagtcag

SEQ ID NO: 46620 - DNA, 1112 bp, Bovine  19866881022176
cttattcactggtggcatgcagtcttgaaccatagttgaattgacaaaccatacaaaccttagataaggtaagttatctagaaagacaatgcagaattgatgttatattaatggcttaattgtaattaaagaaaactgacatcaatataaatgtcagtatataagcaaatggattttgctgcaggaatagtatggtaataaattataactgtgattgcttcttgaatcagcaaatctttcatgccataaagaaatattaacatttttaatttgtcatatatacactgaattttatggctaaatttgaattatctattatccattctattatcaagtaaaatacccaataaattacaaaatattaaacatcgataacactaaaaagaagtaaaatatctttcagagctagtttaaaataaaagctaacaatatttcttttaggttaatcaaggcatcaaatctctgtatattgttctttattcataatcctctctagagtacaaccatgtgatttttgcacttactgttttactgtagattgtcacattttaaaaagaatcaaagttacatagctactaggtaagccaaattattggtattaaatgaactgtgattattaaatgaacacaccacagtacttgagcttaattttcacattttcagaggaataattttctgcatattttagatatgatgtcaaatcttagaagtatgtgctctgtgaaccatttttgataagcacagcactgtgtcagttctgtatcttgcattgttttgctacaacatgaatatcatatgtcctaagatgcttggtctagtaacactgttattttgttatgcattagtaaatatagtttcatagcctgttttgtgtatctgttcttttttacttcttttataactgaagtttatgtgttagataaaattttatatgatacatactatgcactaagtataatactgtacattaaattttaatactgtacattaaaaaatatgtacaatcttgggttctctatttaggaaaaaagttgcagggaaaacataattttcaacagaatgctactactgtgggtggcatggggcctctcccaagaatatattctcacact

SEQ ID NO: 46621 - DNA, 1338 bp, Bovine  19866881083395
aaaagttcccctaaaagaacatatacttatatttaggtatttagtatccatttctctataaattccctaagttaaaaaatctatagataatgtccattatttctcatgaaactgaacaagggatagggtgtttaaaaacatctcacagaggaagctgatatgctactcagcttgtttatcaagagcctgataaacttagtattctaggtgagttagggattttgggcattatctaagaacattttaatgcatttttcaatttggcaaattgttaaaattatgaaaaaagagagagacaccatgtctcttcttaataatgaaaaatattagttctgactttaaccctatattgcttgtgggcatgtgtttaatttagtcaaattgaactgaaaccattgtagaatataaagtaaccaaaaatgttcctataaggcaaaaaatgctagatgttaaagggaaagtagctatatcatatattttaataaatattgtaatcaagaatcctgagaaataaatgtgttctagtcttaattttattttgtaatttatatgatacttatgatggttaattttgtatcagcttgactgggccatagtgcccagatatttgaccaagtattattctagatgtttctgtgaaggcttttgttttcccccagtgagattaacattgttttgagtaaagtatattaccctccataatgtgatgggcttcttccaatcagttgaaaatcttaggagaacaaagaaaactcccttcagcaagaagaaattatgctagttgattgcctccaacgataatttaggtcctcactcacatgagtctgttcctttaaagaaacctacctctcagtgaatcttcatcacctatcgtctctatcgctatgctcttatctgtatctatatatatttattcctttacatttacctatatacctgcatctatatcttgctgttctttttctctggagaatcctaatacccagtactcatgtttttttcattgattttgtttctttttacaaatatcaagtggtgctatataaatacattttatattaaaccattatctaaacatgtgtaatgaaagacaagtaagggttaactaaaaataaaagtaaatattttctatcctagtccatgtgtcttaatgtgcagtatgagaattacaattgagaaaattatccaagtgggttttccaatgttttcaaagtgttgcatcatccagtaaatgccattgttttcattatttcaggagattaaaaaattaaaacctaacttacataccaacagttattaagaaatattcttttttcctttcggcttctcacctattca

SEQ ID NO: 46622 - DNA, 943 bp, Bovine  19866881772754
taattaataaacctataagtgaaacttcacaggtatgtcactatgcatgtatctttctatcttgtgatctcaacctgttatacagtaatctgccattggtttatttccattattttcaatgctatatttattctaaatgcagctgtaaaattaattttctcttccctaagttcatattattttagttacttaaagaacaatttcctgttcacaagtgaattgagatgaaactgttattttttgcatcttttaatttctgttgaatggctcccttatatctagttaacaatctgtgtctaaacttttagaggagaactgcaacctttcagtaaaaactgcccttccatctgggccttgttccatttttaaatctaaggcatcttcttatttgactgcctattgatgaaatgttctacagcttaaagttcaaacatgtacgctatttaattactttaagatccaagatgaagcatcaatttccaacatgtatggtgtgtttatgttagtctgcaaactgaacagagtccatcttttcctcagatgttgattttctataataatgaaatatacggagggcctgggcatatataaaaaggtgcacaaaatagacaataaatgaagtgatgatagtgtcaagatagtttctacggttttaatataatttatagtatattctgaaaaactttgattgattttttcattgttatagtaagaattggccacaaatttggcttaaccaattcagcttaattatcttatagttttgtaggtaagaagtccaacattggtctgacttggcaaaaatcaaatcaggttgcatggctgcattcttttctgggttttaaggaataatctgtttccttttttaatcctagcttccagagatcatgcacattccctcagttcatgccccttttccttttcttcaaatcccgcagaaatg

SEQ ID NO: 46623 - DNA, 1538 bp, Bovine  19866880359118
gtttacttacttaataaaaatgtattcttcccttgatagatcctcatctaagttgtacccatttcagggtcattctacaaaagagaaattcaaacttgttactgtaatataaaatgcattgccagcaaaatgtcattccttatattcacagatgacttcagcaaagacctggaaccatttgttagagtgactgaaaccagaaatgtgtggtttacaaatatagagtgattcacataaaatctgaatctgaaagcttgctttcatgtgtgttgtcaaatcaattttgtttttcaacctaaagaaatactttagaaatgttgttaatataagccatccttgaacttttgtaggatagatttacctgattctaggcaagaaatcatacatggaatatgaaaggacttttagagcaagtgggaagacagatacttttgaagataatctccaaatcaataaaactatttgtaagcatactttacatctaaattataggatataaaatcaaattatatgattctcatcattgtggatttaacctctaaggatttaaatagtcatgaactaagtatttgtgtccaaagtatctactcttggtgacctacagaatatcacaagttgtaggttgtattttgtcattgtgcatgcacatgaacacacacatacacacacagaacacatatctgttgtcagatgacattcatggcatattgtcagtgaatagtaagtttccaatattcaaggaaaagtttcactaatgtggatcggtttcttaaaaagtttgtcacttaaatatccatttaatttggctacatgctcaagttcataggcaagaaatactggatatctgaaaatgaaaatattaggttgaatttcattaaacaatattttaaaagatgtaatatgattccatatccctaacaatggagaaaggactctgcaatgtgtacaatcattggagaataaaagatacacatttccacctatgattcaggctggttaaaaaaattattctagaggaagcattgattcccttcattgatacatgccttgttgtggcaaaggggcttgcataactcaatgaagctatgagccatgccatgcagggccacccaagatggacgggtcttactatgctaaagcctttgactcgtggatcatgacacacatggaaagttcttagagagatgggaataccagatcatcttacctgtctcctgagaaacctgtatgcaggtcaagaagcaacagttagaaccatgtatggaacaactgacttccctatagttcagatggtaaagaatctgcctgcaatgcaggagacttgggttcaatccctgggtgaggaagattccctggagaagaaaatggcaatccactccagtattcttatctggaaaatttcatggatcaaggagtttggagggctacaatccgtggggtcacaaagagtaagacacaactcggcaaacaactgatattcaagactgagaaaggagtacaacagagctgtctgctgtcaccgtttgtttaacccatat

SEQ ID NO: 46624 - DNA, 1916 bp, Bovine  19866880556767
aaatctttgacttaccattggaaaagcctcaataaagttaaaagatggtgattataggaaaaaaagcatttaagtgagaaattaacatcaaacatacttttaaaaacccatctatttggaaattaagcatccacttttaaatgacaggtgtatctaagaagccataacaaggaaaattagaaaacatctgtaacaaaataaaaatgaaaaaaagaatttatcagaatttgctgcatgcagcggtagctgctcaatgcaattaaatatgatgtggactcttaaaaataacgcatgaaaacaaataatggacactagcttaaaatgttctgaaattagaacaaaatctgtactttagttaaaaaaaactgtatcgcatgttaatttcctgttttccagatgcacaactgaattatcttgtaatttttttgtcaaatataaatgcccaggcattttttttcccccttctccaaagttccaaatgtgattctaatgaagcagccatatttaaaaacaatagtatgatgatctttaatttttatttagcttgtttcactttttctatttcacatttggtgctccattttcagttttatgtttctaaactatgtatatatatattttagaaaacttatgaatttttgcttaactaaaagatttataacattttgattccacttgcttgattcattatgagtagaatgctagatttctaatttaaaaaaaatagatacacagcgagcaacaaaggtttactgtatagcaaaggcaactacagtcaacatcttgtaataattcataacagaaaatacagtaatatatgtgtatatgtataactgagccacaaaaaaaagaaatctaaaagaattcttctttttgaaattttataacgtttgtcttctatgccagtttttctaaatgtgctttggacatctaacaacaacttatgagatacaatattttaaatatgtttttcaagatataagattaatataaattaatataaatataaaactattatatttaaattattaatgacatcattcaagatgctcctatgttttctgcatttgactaaattttctcagataaatgttaatatgtctcactatgattatatatatatttttatcccttatgtttcttctgatttttgctttacatatccttgttcctttgttgttaggtgtctaaccatttatgtcatctaacttctttatgaattgtacctttaatcattaaaaatattcacctttgtttcaaaaaaaatagaaaagaagtcagtgcagatagagatatcattaagtgttttaggtatcaggaactacaacatatccaaattttccttttagccaatttagacttcaggtctccagttggtattagacaaatgtatattttcttactttccttaatgattgcctaatctgatttactaatggctatgatctttattctagagaattgataagatagaaaagtgtgtctatctgctttttaaggtgtcacagataaggattttcttagaaacctagtctcaaaattacttcaaaagttagttttttaatctaatatttcccatctttttaaaatcacaagtcaatattaacagaaaacaaaatgaaggaaagtagatttgaaatgttgaaaacaagagaaagaaaggaaaataaatgacataaatatttgtgcatgataagtaaattacctctgaagttgcctccaaaattaagtttcaaaactgtttgagacaatgcagcagcatttgaaaaaaaaaaaaaaagtcattgctttttaatgattatattttgcatagtatttattttgatatttaaattcaaatattagtaagctcaatctcagtgttcaattatcgtacattatttctgtcgttaaaaatcatgagtaaatgaaaaatg

SEQ ID NO: 46625 - DNA, 2377 bp, Bovine  19866880726882
agcttccttgataaatatttcttaagtaccaattgtgtatgtgtatatgtgcacatgtatgtgtgtgtattcttaatatgctggatatacttctggggatgtgagaagaatattcatatttttaaatagttctgattaaggattttaaagagtatatgactcgtctatttccccactatttaccactattatctaatatggactaaagacaaatatttatctggtaatgggtcaaatattatggacaagttaaaatgatttgataattcactaacaattaatatgctcttatatatatctcattaaatagctgtttttttccacaaagaattggatacaacttggcaacttaacaacaacaactccttttttatgatccaatggataccaaattgattagatgtgttgtttcactttattctctcatcactgaattacacagatgttgtaagttgtaacagttgccagtaaaggtcagtttcattccaatcccaaagaaaggcgatgtcaaagaatgctcaaactaccacacaattgcactcatctcacatgctagcaatgtaaggctcacatgttcaagttggatttagaaaaggcagaggagaaccaatacaatattataaaataattagcttccaattaaaataaataaatttaaattaaaaaaaaaaaaagaaaaggcagaggaaccagagatcaaattgccaacatccattgatcattgaaaaagcaagagagttccagaaaaacatctacttctgctttattgactaggccaaatcctttgactgtgtggatcacaacaaactgtagaaaattcttcaagagatgggaagaccaccttacctgcctcctgagaaatctgtatgcaggtcaggaagcaacagttagaactagacatggaacaatagactggttccagatcaggaaaggagttcgtcaaggtgcatattgtcaccctgcttatgtaacttctatgcggactttcttatagctcaaacagtaaggaatctgtctgcaatgcaggagactagggttcgatccctgagttgggaagatcctctggagaatggaaaggcaatccactccagtattcttgcctggagaatactatggacagagaagtctgttgggctatagtccatggggttgcaaagagtcggacatgactgaggaactaacactttacttcttcatgtagagtacatcatgtgaaatgctgggctgggtgaagcacaagctggaatcaagactgttgggaaaaatatcaataacctcagatatgcagatgacaccacccttatggcagaaagaactaaagagcctcttgatgaaaatgaaagaggagagtgaagggttggcttaaaactcaacattcagaaaacaaagattatggcatccaatcccatcacttcattgtgaatagatggagaaacaatagaaacgtgaaagactattttggaggctccaaaatcacagcatatggtactgcagccatgaaattaaaagacacttgctccttggaaggaaagctatgatcaacctagacagcatattaaagaggagaggcattactttgccaacaaagctccatgtagtcaaagctattgtttttccagtagtcctgcatggatgtgaaagttggactgtaaagaaagctgagcaccaaagaattgatgcttttgaactgtgttgttggagaagactcttgagagttcctttgactgcaaggagatccaaccagtccatcctaaaggaaatttagtcctgaatattcattggaaggactgatgctgaagctgaaactccaatactttggcctcctgatgcaaagaactgagtctttggaaaagaccctgatgctgggaaagattgaaggtggtaggaaaaggggacaacagaggatgagatggttggatggcatcactgactcgatgaacatgagtttgagcaagctccgggagttggtgatggacagggaagcctggcgtgctgcagtccatggggtcacagagagtcagatacgactgagcgactgaactgaactgaactgattctctgatgttggtctgtgccaagggtggttacaaaagcacttgattctgatgaaccagaggggaaaacacacagatgctgaaatggctacaagcacaaacatacccaaagcggcctcctgccagtttggtcacaagcgatgcaggaaaggcagatgtagcacacacgtaactatcgtgccttctaattcccaccggggcagacatcactaatcgatgacaatactctgctgatcaacacagaagaaacctcatagtcatttcaggccagtgcattggcagctgctatcaatggtctgagtaggtacaagactaaaacctgt

SEQ ID NO: 46626 - DNA, 1715 bp, Bovine  19866881022658
aactgaactgaactgaagtttatgtcttagaaaaagtaaaagtaagttgctcagttgtgtctgactctttgcaaccccatggactgtagcctaccatgctcctctgtccatgggattttccaggcaagagtacttgagtaggttatcatttccttttccagaggatcttcctgacccagggcccaaacctgggtctcctgcattgtaggcagacactttatgtctgagccaccagggaagtccatgtcttcagccatgttcatggtaaatcaacttgttagcttgtaaatagggtaaaatttcagacttttcacagttcttaacaatcatatgaccttgaattgattcctctgttcaatacatatttttaaatgacccttacggttccatttgtgttctaggttgttgctttttttttttttttaatggaaaaaagcgaaaaatattccactttcatgtatcttacactctagtggcattagatggggcaaggtcagaaaggatacctcaacaagtaagatatatgatatgttaacatagttattattgctttgaagaaagagcagtagatagagagtttcatggtcatggttgagggatagtagctgcaatttgaagttgtagccttagcaaagacatcactgagaaggtgatgtttgaataaagatcttgaaaagtcaaggaaaactctagaaggccatttgatagtttcttagaaaactaaacacactcttaccatacaatctagaaatcatactcctcatgatatataaaattgagttgagaacttatgtctctacaaaagcctgcaagcaactgtttactgcagttttattaataattcccaaattttgtaagcaacaaagatgtctctcaagaagcaaaggaattgcctgtgatatgtgcatgcaactgaagattattgataaaaggatatgagctattaagccatcaaaagacacaaaggaatcttaagtgcatattggtatgtgaaagaagttaacatgcaaaatatacatacatattcatgattccaagtgtatgacatctggaaaagataaaatcatggaaacagtaaaaagtcgtggagacagtaaaaagataagtggtttccaagagttcagggagacggaggaatggatatgtggagtatgggagatatttagggcagtgacactattctgtaggatactctaatggcagattcatgtcattgtacatttttcaaaacacatagaatcaataatacaaagaacaaaccctaatgtaaacatgtcaagtgtggatttttgttaataatggctttaatcaatattattcatcaatgtatggcaagtgtaccacattaatgcaaaatgctaataataggggaatctgggtgggtaaggtaggtttgaagaggtatatgagaactctatgtacatttcactacatttttatgtaaacctcaaccagcccattctgaaggagatcagccctgggatttctttggaaggaatgatgctgaagctgaaactccagtactttggccacctcatacgaagagttgactcattggaaaagactctgatgttgggagggattgggggcaggaggagaaggggatggcagaggatgagatagctggatggcatcactgacttgatggacgtgagtctgagtgaactccaggagttggtgaggacagggaggccggcatgctcgattcaggggtc

SEQ ID NO: 46627 - DNA, 1451 bp, Bovine  19866881163542
ggaagaagaactgcagagacagaaaacagaagacagcaggtgtcaagactaaagtacggaatgcttggtgtgggcaaggaaccctagagcagatgactgacagagtggggagatgagatcacagagaagggaaaggaaggggaagggagagaagaaacctaaataatgaggagtactgtaggttgttttaagaatttttattttcaccctggatgagatgggaaggtttaaaatggttttgaaaagagatgtgatttttcttaaaggatctttctggcttctgtgtggagattagaaggagtgtagacgaagctacaaattaaaaataagaagttaattctctctgttgaaaatagagcccccatccattttcttagagaacttgtaaattctttcactgtctctttgaaatgtatgtaaatcttttcaaaatctaaataagtctcccgccagctttacaacctaggaatgtctttctcaagggcctgagagccatttctttgaaatgtaatcattaaaaatgatagcacccctatctcccaggttctgcagaagagcacaagcctaacttctgccggttccttgctccaagctgtaaaacagccttttgccataaagatatgagaaggttttacatctgctttggataaagccaattagctaacacaaaaggtcactccttatacaaaacgaatttagaatgaactgtgtgtgacaaattatgctggcaggtgctcttacttgagaattagttatttatcttgaaaacatgtatgtaattggttgtatctgcttcattgtataaaagggagagatttcttctgtctttgcaacctcctagtggattgcctgtgatgtacactcaagctctggtttaatgcttattcagtaataaaattgtttcttttctacctttgtgaagagatttctaggcaggaagaatattttgtttttaatatatcctcccaaaagggcaagggcagaaacaaagaaaatagttaagatatcgatgtgatactccagcagataagtattggaggctggcagcacctgttagcagtagggactgaaatgtgagtcccttctaaaccattctaaaccttcccatctcatccagggtgaaaataaaaattcttaaaaaaaaaaaaatctatagcactcattttttaagtttcttttctcccttcccatcctttcccttctctatgatctcatctccccactctgtcagtcatctgcactaagtttccttgcccataccaagcattctgtttttcagtttaacgtgctgtcttctgttttctgtctctgcagttctttcccatatctctcgaaagctgttcctccactttcttccctctttatcactttatcactaaggacttttgtgaccagctttgggtagcctgctacttttctcccccttatttcctatccttctatgcactaca

SEQ ID NO: 46628 - DNA, 693 bp, Bovine  19866881170176
ttttacgcgggtatagttcgaaagctctggagagtctaagagaaaacatacagtaagtcccccaccccacccccgccgtcattatatagaaaagagacagaaaggaaatcctcctcactcgggggccccttttgtgttgttctgccaacgcagcagccctcccgctatatagagcgcgcgccggccccaccgcactgaactccatccccgcgtccagcaaccatggggaaggtgagccccgcgccggcgggaggggcccgcagcccggctggaggccaggcctctgagcctctccttcccttccttgcagatcaccttctacgaggaccggggcttccagggccgccactatgagtgcagcagtgaccactccaacctgcagccttacttcagccgctgcaactccatccgcgtggacagcggctgctggatgctctacgagcagcccaacttccagggcccccagtacttcctgcggcgcggtgactaccccgactaccagcagtggatgggcctcaacgactccatccgctcctgccgcctcatcccccacgtgagtccggtgcccctgggcctgccgtggcctctcgtcagccgtggtcaggctgtaggacggtggcttcctttgctggtcctaaccggatgctcttttcctttttaatatctcttaattggagaatgcaatgctcttaa

SEQ ID NO: 46629 - DNA, 1911 bp, Bovine  19866881178085
tgaaaaactgcacctctttctctcccagaatttcttgatactataacaggttacacaggactctggctaatgcttattatgcctctcctgcccattcagtcatctgtctctcctctgttaaagctatagagacagtcctcgttagtgcctttttgtcctatgaaccggaaccattgtggatcagaacaaaaaaagtaaaaggttgaaaacaatttattagactagctgagcaagtgatttctcagggattcacccttgatcttttcaggggcaatatttccataaacaaattggggctctgttatttcccatgaagatacctaaccccaagcttaaagacatttgaaagctagaatcactttattttttttttgctttaatgatttaagattgaatgtcattgtgctctcaagcttactagataattgagcaaatatgtgctttatttgatgatatagtcatggctctttaaatatcaatgactaccagtgttagagtataaaataatagttggcaaaatatgtagctattatgaatgagacacaacactataaaattcatcattttaaaattaatggggtttgaacattattaacttagaattaattgattgtatcttaaaaaaaatcatgattatataattataaatctcacagctcccttggagagaaaagcactttactggaagtataggcttttaaaattcctttcttgtttagtgggaagagtagctatttttaaaaataattgctttatttctttagtgacgtttctgtttggggttttgtggcagtcgaggcacattccatcattgtctttttatatttcattatttttcatatttgcattattaaggaatggattgctttcagtaagaaacatgagggtttattgtttgttatgttttgtctatggtgaaggaatggtgggtggaaatttgtttagctgattaattctcatcttgtcgttcagattttctagtgggtcctgcactcatgcagtgactggtcaggtaagtaatgtacctttgattatgagctgatgagaaaaacaaaagggaggtaaattgatgatgaacggtttcaactctgtgtaaggcactggggtgggaaatctgactactcaccaccaacactctcaagatggttgatcactgattatgtgcaccgctctcagtactttaatgcattacatcatttaatttttacaactactctttgaagtaggcattaaaaatctccaccttggaagtgaggaacttaaagaatggtcaggtcattaaatgacagagcagaacctgtatttccccaagtgtgttttacacaacagggtcaaatgagatgaatcctagaataataataagtaagcacacaaaagtatttgttgagtaaattaatagaatcatgagaactcacatttattcaaactcaactaattacttatcatggacttgttaggactgtaactgattgatttcacatatgatgattcatttaatctttttttaaaattccagataaggaattgtatacctttaggaaatggcaacccactccagtattcttgcctagagaatcccagggacgggagagcctggtgggctgccgtctatggggtcacacagagtcggacacgactgaagcgacttagcagcagcattttataatcagagaatacactatcaaagtatacttagataagattgtgcacgttcagggtggtatggcataggtattggcatatataaactaccatgtgtaaagtagattgctagtgggaagctgtacatagctcacagagctcaacttggtgttctgtgatgtcccagaggggaaagatgggggcgggtgggtggggaaggaaactcaagtgggagaggatatatgtgtacacatagctgattgactttgt

SEQ ID NO: 46630 - DNA, 1518 bp, Bovine  19866881261122
ttcctcattccacattataagtcatcctgaaggcttccctggtggctcagatggtaaagcatctgtctacaatgcaggagacctgggttccatccctgggtcgggaagatcccctggagaaggaaatggcaatccacttcagtactattgaatggaaaatcccatggacagaggagcctggtaggctacagtccatggggtcgcaaagaatcagacacatctgagcgactttgcttcactcacttcctcatttcactttataagtcatcctgaaactttatgcctgtgagcttcataccattttttgaatttggaagcttccagtttgcaagctgttttttagatgcaccacaataaattcttagtcaatgctatttatcgatttggtagttttaattttgctatttctggagttttttcacagctattacaaacaactcagtctagtctaccttgccagcacacctccagaattcagtatgtggacaaaagaatttacagaagttgcactgaaaaatgaaatgccaataagagttgactaaatttaaaacttttgcttcctaagagacacagatggcaagtttgttatagttagctcatcacagaggtttttaaatagccctgtgtaaaaatcaatttatgaacatgtagccattaaaatgcaatacatctagtcaacacaataaatatgcaataggcaagaactataatagatggcttcacacttacttttaatactaggctcaaatagatttgatggtttaaaaggtgttaggaaattttatgtttgcatgtgtccattctagtggtaagtgttagtcactcagttgtgtctgactctttgtgaccccatagactgtagcccaccaggctcctctgtctatgagattctccaggcaagaatattggagtgggttgccattctcttctccagtctagtgggaaatgaataagcaaaaataatgtaataagtatgaggtttttcttcatatgcttctgcttaatttattgttgcaatgtgaaaaatattttaatgtaacactagtattagattttcttacaaaaatcaatctaatggaaaaacaaagccaacgcatgcacaagatgaatgataccaacatatgtacaaggtgaatgatacccatagcaatttttttggtatatttccattgccagtaatggtcattacctagaaaccctgtttgtaacaaaacaaaacaaaacaaacaaaacccacattttttgaggtgattaacagtgatctaaagataggaattctgtattgatgtgttattattccactattctctgagtaaattgtggtttctgggaaggaattatctttgaaggtcttggtaagaaaatgctgaaatggcacatcacagcctgacgctcccctggatgagtcatctttacctgatgccggagaggctttctgaaagaccaactggtgtacttctctcctgttggcataactatatttagaatccataactagagagctcaaggcttctcagg

SEQ ID NO: 46631 - DNA, 847 bp, Bovine  19866881887623
tctatacagagttaaacttctagatcaatctttgtgcatttagtactgttcagtatccatttaaatttgtctcacatccgacagaattaaacattaaaagaatatttacaaaaatagtttcatcatactagtaatataattatctgagaaaattgggagaaaaattctgcttagtttgggtattgagaagccaaagttccattaattatttgctgacactccagattaaacgtatcatatatagactgcaaaggggggactgacaggactattcttcttcagttacggttctttattacctttctctaaagatcaggatcactgtttctgtgttattaaagacattaatctaaaaatacctgaaatgaccctaacaattgacttgctagtgtgatggtttgttcagctgactgatcatgttaattagattggcgaactagagaaaatatccttagttttaatgtgatactctgaatatgagaatttggaacttccagacaatcaatctgctattagggaagatgaatcatcttcagagtcaaaatagttaatgtaaaactgaatagattacagaattaaatattatcacccacagagtttttcagggatctagatactatgcctaagaagaccttaaaattgagtgaatatcattggaacacttagtgcaaagattttggacatattttattagaatgctttctactctgtggtttgaaagtgaaagtgaagtcactcagtcgtgtccgaccctcagcgaccccatggactgcagcctaccaggctcctccatccatgggattctccaggcaagagtactggagtggggtgccattgccttctccaa

SEQ ID NO: 46632 - DNA, 1165 bp, Bovine  19866882053722
aataaataaagattcatttagtgaaatgtcaaaacttaaggagaataacaagagcaaatttttcaactttacttctaatacccttagctgaatcccagggaggcaaaaaggcaatttgcaagttaaatcactaataaaccaaaactcaattttgtaatcacctttcctgagctgataagcttcaagttcacgagggagcattgactgcttcctgggaggcagcagagaacacccaaactcctgtcactcttttctccagcttatctctttctgcctaaataagctagaatcgggaaaaaaagtttatacaaaaaagaaggaagaaagagaaggaaggcagggagagaaggaagaaagaaggaaaggataaaaaagaggaaagaaatatagggaactggagaaggagggagggaaggataagaaggggaaacaaaaggggaggaatatttaaaatataaagagcagcataagagaaaggagggaataattgacttttatttaaaaataatttgttacttagcatctttcttttttgttcatgttaaattctgataaatcacacagcatgttaataaagtgctgatggtgatcaaagtatgtaaaacctgatttatatacatatgtgaacaagtttagctgagtattttccaaaatgtgttttgtggaatactgatattcccaaatgattatcactgaaagaaagtatttccatgaagaattcctaaaatgggccattttatgttttacacatatgttttgatgaaggatactaaatattttaataatgccagcaataagggacttgttcagttctggttgaccatgaatttcttaagctaattttacccatttacccatcaccttaaatttgtttacctttgaaaagtacctggtgtaacatactcattagttaccaccacaggttgtcactacagggcccacgaagaacctattccagaatatttcagtggagttgcattaatctttgggggaaggtctctgtgagtgttaaaaatgttaaaggacacttcggataaaatttttctaaaatccacaccttgaatttgaccttcttgttaagggttgtactactggacaataaactaaatacaaaatctatttcaagatcagataaattatttgggtgtctattacctttaggcat

SEQ ID NO: 46633 - DNA, 1672 bp, Bovine  19866880554695
acagctggaaacacagcacagatttgggcagtgacttttcaaagcgtggtcacatacacatatacatcacaacaaaagaaaatatcctgtgggctgagtgtgtctgtatctgcacgtgaggcacatacacactcaagtatactcagtcacacaccggcaagggcagagacgcaaaccaactggaaagcgcagagacaagcccctgatacccgcctgccacccagtgcaagtttccatttatctcccacacactctcacatcctcacacaggtcaagtcctgcaaggacgaaaacaggcagcagtaaccacacactcatctctcagaagtacaaagcgactcacgtagagcccccaccggcctagggtctccttgtaagaaggcctccccgaccagcagacactctctcccggttgctactgtcctgagctcgtaacccgagtggcctcccgggctgaaggaggaaatggtcgtcccagatctgagagacgctgccaggctgggctctgggcctgggctggggcccctccgccccccactggtagtctcctccggctcccccttttggccgcagagaaagaaacctcagaagtcaaggagacgggctagtggaatggagtgtccaggagacagaagagagacgtagggaaggtggggagaaaggtgggtgatagagagagagatgagaagagagaagtgggaaaagcggcagaggagaaagacggaaacttatagatgatgaatgagacaattgatggcaggagcaaggctggggagagggaggcagacagggagaagacagggatggggagggggagacagaagtggggagaggagaaaaattggagtggggagacaggagaggggaagcaaatggtggggagacaaatgaggcaggggagtaaagtggagaggggagacaggggaaggaaacagatggaacagggagagagatgttgggggaaatctcttcccccacccgaaggttctggggaagaagccagaggcctgaggccaagactggggctttgagcggaaactgggaggggggaaattattgaccaagcgcccgccttgccctgaatttccagaaggtgatgtggagtttccatcccccagccagtccacagacagggcctctgcgagggacagctgatcctcaggagctgggagcccaagcgagtaattgccaaggagctacccccttctcaggctcccaagtgccaggctccagggtgccaagtattgtgtacacatcatctctcttaattcgcaggtcagagaggaaatgatgatcatttaggatattttaggagcctcagagtggagaacttggctctcaaaatcgcacagctggtggaaatggcagaggcgggattcgaaccagcggctcagttcgaaccatggccccgccctggtttccgtagaaacaggccctctgtgtctccatagcaacccctccgcggacttttttttttttccccgccacctggtgcgcatgcactattggtgacgtcatcgcggcgcctcacatagtcgactcgccagagccggaagtgagcggagcggcgccggaagcagccggcagacgagacctcgtggaaaggacggcggcatgggacagtcggggagggtgagtcccggcggccaggacagcgggcagcgcgggcggg

SEQ ID NO: 46634 - DNA, 2453 bp, Bovine  19866880566439
tctgggatttctttggaaggaatgatgctaaagctgaaactccagtactttggtcacctcatgcgaagagttgactcattggaaaagactctgatgctgggaggggttgggggcaggaggagaaggggaggacagaggatgagatggcatcactgactcaatggacgtgagtctgagtgaactccgggagttggtgatggacagggaggcctggcgtgctgcgattcatggggtcacaaagagtcggacacaactgagtgactgaagtaaactgaactgatgtggcatttgctttgagactggctcataggtgaagtctggaaaagatggtaaggagcttggtaatgaagcctagaggaatgataaaaaaacttttggtgcaggatgaaacggaaatgaggggaaaggtcacccatgttctgtaatgatgaaacagttacctgaggtaatttggaaagcagagactgtactgaactcctagatctacttaaagagatcttttagataaagtgttaaaagtatctattgaatgcttatgattgttttttaactataaaaaagaagtgaactaaaaaaggtgttccaaacttgttgagtttaaaaatagagctgtttttcattaccgatctctctggtgctggcaaaaaattttcaaagtaaaaaatgacttcagagtagagcccaaatcaagagtgcctggaagatcctttaaaacctcagaaataatttaagaactaggaaaaaaaggacttctaagaattttaaaaacgttgtcccacagcagcctgacatgcccaaggtatagagaggtctgtgcagaaaagttatggatatgtttttggggcaagaagtgaattttcagtatgattcataggaaactcataaacttttcaagatacttatattgatgaatgtaccaaagggactgcaagggacagagacagttcaaactttaaagaggcctcagaactttcaatttcctatgaataggaagcagactgggaaagttgttcagctgtaaacattagtcatttctcatagtaaggggagatttttccggaccccggagggcttctaagaacagaggggaaccatggattaggaagccactcccagggatcagaattggaccacagagaaaagcaaaacaaattccatgcctgtggagtaaggaaacctgacaccgtctacccatctggacttcagaattgggtgtggaccagtgactgttacggagaaggcatggcaccccactccagtactcttgcctggaaaatcccatggatggaggagcctggtgggctgcagtccatggggttgctaggagtcggagcaacttcactttatttttttactttcatgcattggagaaggaaatggcaacccactccagtgttcttgcctggagaatcccagggacaggggagcctggtgggctgccgtctatggggtcacacagagtcggacacagctgaatcgacttagcagcgtagcagcaatgcagtaactcagacttccctggtggctcagacggtaaagaatccacctggaatgcagaagacctgggttcaatccctaggttgggaagagtccctgaagaagggaatggcaacccactcaagtattcctgcgtggagaattccatagacagaggagtctgacgagctacagtccatggcattgcaaagagtcagacacaactgagcaactaacacacaaacacacacacactcacacacaaataacaatttttgtagactgttaggtggcctctgctggtctggtcagtgtctatgagttagggagatggacctctagccccaggagatgaatccctgcccccagtcccttcagcctcatagctgagcttgtggcctggttattgagagagagacgagccaggagtctgttgatttaagctgctgctgctaagtcacttcagtcgtgtccgactctgtgcgaccccatagacggcagcccaccaggctctcccaatcccttttttttttttttcctcccaatcacttttaaattgtttgagcatggcttctttgtgacaggcatgtatggtcttaagataacccgtgtctcccccagggtctggtctgtacagcctgattatgacatttgcctatttttagaatgagtagtccaggtacttaaaatagcaggaatttctgtcagctacataaaacatttttattaatagacttttccccttttctctattagaatcaaagccctcttggcttctggccatacttagggagagatgaagtgtgtggttatcagattaacttaaagcctatttgttagagaggggagctggtgtctctcttgcagaccactgtggttctttccccctcaggcctataacgccaagagcaaaagctttgaagatcctccgaaccacgcccggagcaccggaaataaagggaaagggaaggggaaag

SEQ ID NO: 46635 - DNA, 2115 bp, Bovine  19866880597057
taaaagccccaataccccttttcttacctaaattagactctaagtcactcttctctcagtagagcaaatgtggagcctgggattcttaaatgctccttctagggtttcaccagaagagaggtcctgaacatggctctctgaacttcctccaattctcaccaaagtagcattcttaaatctgctgccctctcaccaaaataagagtacctctcctagtttcacaccatagtaagaattttgttccttatcagagtaagagcagtatctccctgttccatcaacagaagacaaatgcatcatttccccccagtcccctcaccataagaggaatctcacattaaggtcctgactcctatttccctctattcatgctgcactgggaatcccctggctcctcacacccccaacagccacgcccttgacttacctgctggtttaggaggaacagcagggtgccccaagggcagaggagaggccaggggtcctggctgtctcagggtctgatctctctggggttctgcagctgagtttaacctcctgccagtgtcatcagtgccacccaccaaacttacaggaaccacaggtaccaggggtgggggcaggacctggggtaaccaagaaagtcagatacgttagccctggaggctctgggctcctacatctcccagcacccagatgggaaggcgatcaagaaggagcatggcttgatcctcccgtgcctaactccagcagtcaagaagagacagagttggacttcccggtggtccagcagttgtgactttgcttctactgcaaggggaagggttcggtccctggtcggagaactaagatcccccatgcctcaaggtgtggccaaaaattttaacaagagacagagctgggcttaaactcttgctctggtgcccatagcttaaccaatctgtgcctccaaacttttctgtaaagcagggataatatgaggcaatccaacacttgagtattaacttactgaagcctcccaaagctgtaaggtagctaatgtcagagcaataatctcttattcaaaacccaaggccagacatagtccagaattctgaataatacagcaggagttagaaacaataactggagaaggaaatggcaacccactcccaatattcttgcctgggaaaccccatggacacaggagcctggcaggctacagtccatggggttgcagagagtcagacacgacttagactaaaggacaacaagaaacagtaacacagggtctacatatattccctagcaaccccaatgaggtctttggtcttcatgcacatattaataatatacctgattacaggaatctgcctgcaatgcaggagagctgggttcaattcctgggtcaggaagaacccctgaagaaggaaatgacaacccactccagtattcttgcctggagaatcccatggacagaggagcctggcaggctacagtccgtgggggtcgcaagaatcggacacgacttagcgactaaaccaccaccactatgagtattcatatcaggtagataaacactttaagtagctaccagtagcgttttgacccaaatgaattgttggaggagaggcagggatccggtttatggagcttttttacttcagaactgcagataagagatcgtggggtttcaagaggccccaccttacaatgcccacaagaagtggctgcgatttggggagggtgatagtttcggagttacctgctgctgcccgcccgcactccccgggcacaagcgctccaggcgggcgatgaggccactctgctggctgactagctgtgccagctcgcggaacttgacgtccagctggtggaagcgggcggcggcgcgctgagcctcggcggaggcgttcagcacgcgatccccgagcagcgccagcgcggaggcgggctccgcccccgggctaggcgccgcccctgggcccgcctcgtgctgcagctgcgcgcgcagctggcccaggcgcgcgctcaaaccacggctctccttgcgcagcgcacgcacttcgccggctacggcgccgtcggcagttgccagccgctgaagttcgcgcagcaattcctcgtggcggctcacgcgcacgcgcagcgccgcca

SEQ ID NO: 46636 - DNA, 1374 bp, Bovine  19866880671465
ttgtctttcggggacatgaaacgcattgtaatttttttttaagtctttttttttttttttaatttgttaaaacattctggtgttttaaaaatttttttgttggagtatagttgattttcaatgtgttagtttcaggtgtacagcaaagacaatattctgttttatgttttggttttttggctgtgaggcaggtggggatcttagctggttgaacagggatcacacttgcacctcctgtgttggaaggcaaggtcttaacccctggatcaccagggaagtcccgaaacacgttgtattttgtcattaaataactttccttttattttagtctttatatcatatgtatggcattatattacgttaaaacatgtaggtcagaattgttgatatatggcagaaaccaacacaatattgtaattatccttcaattataaataaataaaggaaaaaaactgcaaaaaaaaaaaatgtactgatctcttttgagtctgggggagatggtccaaacatttgtcaggaaagggggcttctgagtgtgctggggctggcacatagccagccgaagggaaagagttccctttgtcaccagcctttaatccagtccctcccctatctctccatggccttaggaccctccaaggccagagcattccctggtgccctgctagggttgatgtctttgctgaagtcacgccgattgcaagaggggattgctccaccatgtgtggtcatacttcctgccccctgctagccggcctcgtgagtaatttctgtccatttcccctcccacagggacttccttccccgaggttcaggaatcgtcactcggcggcctctcatcctgcagctcatcttctcaaaaacaggtatggtggggcggctggcagcccagacaggaaatgagcgtggtggctgtgcctcgtgggagccaggggcttccgaggtgtcctaggaggccgtttgggtctgcattccccttttcccagtgggcagggaagttgaagcacggttcatggaacacctccacccaccccaagcatcagctgtgactaggctgccaggtgccacattttttgctctatcgtagatgacacgttcttgctggacactttcaaaatcaatagcagacactgtgacacgtcagcctgaaaggctttggtgtactccctttgcaataaggacatcctcttgcactcacagaaccacacccaagagaagtcatcatttctgcatgttcccttaccccagtccatacccatgttgtcagttgtactccagatatcttccctggctggttctacaactgctgggatcaatgccatgctgcctttcattgtcctgtctactcttttcatgcgagcagcattctcgcca

SEQ ID NO: 46637 - DNA, 2368 bp, Bovine  19866880682077
ccctactctgagacccaggaccaggtgagagaagggggcctttgatagtggaacttgaggccggggaaggacacagagagtgttctgtcatcacaacctgtgggcctctgctggctacagccttctctctgcagcaggaaagttctgactgttggtgacgcagggagtctaccccgaggctcctccctctctccctcccctccctcctcctccttgatccaaagaccaggcccagcccccactcctggaaagaccagaggaagacatcttcactcccagggcttcagtcgcactcagacaaaaagtccgagtctgtgctgcagccaaaggccctgcatgatcctccttgcctccccctgctctcatctcccagccactttccccttgcttgctatgcttcagtcatatggggcacctccacgcccctcaaacacaccaggcacgctccagcctcagggcctttgcacagccagcttcctctgcctgcaaccgtcctgccccagacagccatgtggctggctcctcatccttcaggctcaaacatcacctcctcagaaagaccttccctgatcactctcctctctgtttaaaatgacacgcgtgggaattccctggtggtccagtgggttaggaccctagcactttcactgcaagggtctgggttccctatctggttggggaattaagattctgcaagccacatggcacaacccaaaaaaaaaaaaaaagatgcccttcaccaggctgttatttcattcctatcacttcccttgtcccctactagctgactgaatatttacaaaactccttatttatcatctgatgtccattgccaccccctcgtaacgtgcaagagggcagggacttttgtttcattcgctgctgagcctgcaatgccaagggcggtgcctggtgcatagcaggtgctcataaatactgtggccagtaaggaaagggctgctaacgtctggacttcagaggccggtggaaatccagctctgctgcctgctggctgagtgacctgtgccagcctcttcagctcttgtgcctcagtttccttatctggaaaatgggaagaatgactgtacccattgcatatggtgaaagtgaagtcgctcagtcgtgtccaactgtttgcgaccctgtggactgtggcctaccaggctcctccatccacggaggaaaagaaactcctggcaaattgggagagtgatgactcccaggaggagagaagagtgtctacaaaggtttggccatgaaaagatggagcctaggcagtgagggccgatgggagggacttacctgggaaggagacgtgcacaggctcactgaggttcgacagctggggttgcctattctcgccaagtacgctatactggcagcagaacggtccccctcgaacctccctgctgccaccactcaggttgaagatgaccctgagctggtccttgggggctttcaggagctccaccacctccccatcttgatacagcgtgaaattcgcccctgggaaacccctgggggccatgcacgagatgtggatggggtcctctttactgctggggtgtgggggcaccagcatgatggatggcgccgggatcgccaaggagcctgcaaagcaagataggggaggttaggtgcgggggtggttagagcagaggccagcctggctgtgtggccttgggcaaatggctcaccctctctgggccttggtttttatgtacaactggaggctagttgtccttgtgagtgcatgctgtcgcttcagtcatgtctgactctttgtgaccctagggaccgtagcctgccagacttctctctccatggggttctctaggcaagaatactggggtgggttgccatgccctgctcaaggggatcttcctgacccagggattgaacctgtgtctcctgcattggcaggcaggttctttaccactagcgccacctgggaagcccctagttgtccctatcctactgctatgttgagaggatcaagcgcccagcacatggtgagaggtcatgttgttggagtcattttattataatagccgtggatgttgcacagcatcacagttacactcgtattacttctatcaacagcactgaccatgtttaggccctgtttaggctctgaggacagagcagtggatgagacagacggacagacagatgaacagacaagacatgcctgctggggagctgacattctcaaggagacgagggtgatggggtagcctgagaggacttccctgaagacacagcatggaagagctgggagcgagcattctaggcagagggaccatctcaggcaaaggctggaggctggaaggggtgtggagtgctcaaggagtctgggggcaggagg

SEQ ID NO: 46638 - DNA, 1440 bp, Bovine  19866880721623
cacagcctttccagatcatccttcagtgcaggcacccagcccagaacattccaccccagtggccaagaagatgctcttcccagaagcctttgcaatcaaggttgccactttctcagcagccccatggccaggggcctctgcttcccagggaccccgcatcccaagcaagaaatccccctcagtgcatcttctctgctggctccccagtgcctcaccataggtctggagcttcctgggggccgaggtgttctggaagagttccagcccttgtgaccgcaggtccagttcccagcggcaagagaaattggtgccatggtcctctcttctcgactgcactgtgaacatgaccttggcgggctccccctttcccacgggctgccggcccagctcctcctcccctcggagcagcaccacggagaggtgggcccggggggccccgccagacaccaggcagctcaggttgagttcttcacccacaggctgccagaggggcaggggagccagctccacatgctccgggaaccctgcaggggaaaggggtgttatgtgaacaggacaggctggctgcctgcccacagcgggtgtgttggggccctggacacacctgctccaggaacctcaccactttttccccacaacactccccaaaccacctaagccagatgggaatgttaagagcttcaggataacctggtgagatgtccccaagtggttgtgaaggaggcaaaacaactctttattcattgcagcatctgagagtcacaagtgggaaaggaacttaaaggctattgccaggagtcccagcaaataaatacagtacatttaagctgcccagtctctagactttgctataaaaaaacaaaacaaaacaaaacttctgttcttccttctctctttggccatatttttctgcatagcatctctcacctctgaggtacaaaatcatcgactgagttcatttgttttctattattcctgccatggaatgtcagttcaggagggcaggaatcttttttttgttccctgttgtactgttggcacacgggaggtgctctgtgtttgtagaaagaatgaggttggagtacccacacctatttgaggcctttcggaagcctgcttttgaaggttcccaaataaactgtctgatcccctgaaatgtcaaaaatgtaagaacaacccacagatgctcaaaaaaaaaaatacccccaagtatcccctgaaaccagtatctgtgggcagggtattcacaggccagggtctccattctgcatgaggtaagaattccaagcctggatcttcctgccagtggaaattgccagcattagctgtggcttagcattgagagccccctgctccaccctagactccccaaggagaggtcttgaggcttcccactcctagtcccttctcaagtggccctgaaatgtcacttaaacagca

SEQ ID NO: 46639 - DNA, 2487 bp, Bovine  19866880881689
cttgcctgggtgccaaagggaggacccacgcatggtggaggcccagtccttccctgcccagggcaacccccctctgctgacggacactggcttagctggttggacctgttctcactccgctgcccacaggaacactgcccaagccaggaacaacaggctctccatttcctctgtgtcttttgcttcttgttcctttattctctttgctcccttcccccgaaaagaggcaagacattcatcttagtaatcaagtcagaccatgatttttccagcgaaactcatgacagttctgcacacctgaatgactaggtagaaacgttcacaaggatgagctcttgggtgaggcgccagccagcttctctgacttcctctctcttccttgtgtgtggggcaccctgtgctgccccaggtgaccccgacttccatttcctactcatcagagtgctgccactcccactgtccccatcctggcctttgggggtgttagctgactgtttccgcagcctcctgttgccctggttcactctttctaacctctgtatgcccttctatggactcttggtcaggttcaactggaggaagaccacctgttggtcacttaacttgggaaggaccccaactatgcttccactttcccagtgccttttttttttttaaatcttaatttttgactgcactgttcaacatgttggatcttagttcccgaccaggggtcaaacctgtgccccctgcattgggagtgcaggctcttaaccactggaccgccagtgtctttaaagtaacattgtcatagagtgcctgtattatccctttccactatcagaaaaacaccccccaaaaagggaaccttacttagattgcaaatgacttcttaatgtgtatgtaggcacttgcagtggggcattctacacattgagcagggggaaccattgtattttctaatatccgtgttgaagttatttccaaagttctttaaactgtggtattatagatgaacagtgttgcttaacaagcgttttctttcttcccttttttcttcccccaggctcaaagatttggaaagagatagtttgacagaaaaggtaaggtcatctccaccttaacaaaatctattatcagatgtgactgtctgatagactatgtagctcaaagtggaattggctctcttttccttaaactcttaaggataacttggatgtttttgtctaatgtgctatattaataggctgttatcagttagcttttggtaactcatcaagtttcccaatctaggttccctatcagcaagtctagattataacttgccctggtcacactgtttttttcagaatcagttttgttctactataccattatgtgtctgtttcacttcctaatcttcccatttttcaccaccctgtagatggtgtgatatgatctttttttttttttttaatatttatttggctgcaccaggtcttagctgtggcacatgaaatctagttccctggccagggatcgaacttgggtcccctgcattgggagtgtggagtcttagccactggaccactagggaagtccctcttaaaaaaataaaaataataagtaatatgatcttaatggaactatcacgaacatgtcttgactcagcgttgcctgcctttcagtcattgttatgtggccaggcagtgtaagtgtgccttagtgcgttgttttagagtgtggggacttctaaacatatatccttcccttaggaatgtgtgaaggagaaactgaatctcttgcacgaatttctgcggacagaaataaagaatcagttatgtgatttggaaaccaaattgcataaagaagaattatctgaggtaagtcttcagggtcctggcgtctggaagacttggcctcccgggtaactggtctgtgaccagggaggctgaataatcccaactccccatgtcacctgatagttatacaaagggaacacatgtgtttccttattattctctcattgccacttgtttacattcactgctactcaaattatcctttcctgctgtaggagggctacctggctaaagtcaaatcccttttaaataaagatttgtccttggagaacggagctcatgctttcagtcgggaagcgaatggatgtctagagaacgggagccagacaagtggtgaggattgcagagtggtaatggcagagaaaggcaagccccccaaacctgtctccagactttacacgcccaggagaagcaagtctgatggagaaacaaagtgtaagagcattcgactcatttgaccttgttggagtatggtatcaccaaaggggaggacaattagacttggcgccataggttcatcccacccgctcccctgggcatcacttctttcttgtgtatccatctgctgctaagtcacgtcagtcgtgtccgactccgtgtgaccccatagatggcagcccaccaggctcccccgtgccctgggattctccaggcaagaacacggagg

SEQ ID NO: 46640 - DNA, 896 bp, Bovine  19866880900936
tcctgatccccagggatattgggggggtatatgggggtagagactgtgcagttcttgctccgtgtctttgggaccctcgtagttgccgcccacggaagggggttgaccacaccggccattgtccccaggtccttctggcctgcacaccaagactcggtcaccgccctgcgcttcctccaagagacagcagaggagctggcccagaccccctgggacacccaggctctggggccctactgggagccgaaggccctggagaccctgggacctctacctcaggccaaggatgacaagaacatgctgaccctagtcagccagcagagccccaacctggggtccccacgggctccccctacttctccagcccaaccacagagaaggccccggaagcagtcaaacccccagcggggtgccgaaaaagtggaccctctttttgagggggtgaccctgaagtttcagataaagccggattccagcctacagattatacccagttacaggtaggagctggcctgggcaagggcaccctttctgcaagtaataacaatatcagtgggccttccctagtggctcagtggtaaagaatccacctgccaatgtaggagatgcgggtttgatccctgggtggggaagatcctctggagaaggaaatagcaacctgctccagtattcttttgcctgggaaattccatggatagaggagcctggcaggctacagtccatggggtcaagaagagtcggagagacgactcagcaactaaacaataataatagagctggggggtagggaggtgctcccaggcatttgcttatggactaccaccccagccctgcattacaaatggcctcatctctgtaactgcctttctcctttttttatttctttatatttttaa

SEQ ID NO: 46641 - DNA, 1447 bp, Bovine  19866880922625
caggtagggctggatttcaacgcacagccctaacccatgccatttctcccaaccaactgggaacacaaggatcggttagagataagtgatacgagtcagtatttactttgtcttctccttcattcatttcagcctgagctcctccaggcctcacatctctgtctggctcctccttagctttgtgtttaggtgtcctgtcacagaaaaaaacacacagtcagctaagggagcccatcaccgtttcaagaagccacagtgagggtttacacggttccctcccccaagttagagagcatggatgatttttctcatctgaagggtaagttttcattgcaagaaacccaagagggctttggtacttcagaacttatgatctcagaagtgccaccaacacttcatgtgttgctgagacacgccgcagtttaaaaacaagagacaaaagggctcccctgatccctgataacctgatgggaatcctgcctgtggaagattcctgtgcaggtttgctagtgggctgaggtgacatctgagaagtcttcccctccttccaccagggcccaggcacttggttcaggagttctgcccaccccagactcaggcccagtcaatacctgcttcagtccattgcatgtcagaggctgcttttcactgccgccctcacacactgccactgctgagcgcacgccccagctggcctagtcctagggctgaagcgggtctgcctggccaagatcagtcaatggccactgagccgcaaacatataagctcaaaaagtgcctactgtcctgagccgctgagctctggggcaatttgtcacatagcatcttcacagctacaggcaagagacagagctgctcaacgctctttaaccaccacctaacaaactgcttcctgtatgaacagcagtaaggacagaccactaaggacaggccagcggtcaaggtcaggtcaatctcagttgacctcagcctacactgtggttgcctgaccttccaagaacagaagttacccacacattacacgtatgaccttaatgccctgtccaatccataatttttacgagaacacttacttttggaagtaaatttcacaaagtacaaaaggcatgttaactgtacttacggttctttggtttgacttctgagtctcttttcttcctaagtggatgggacggggaggcaaaaaaaaaaaaagactagttaatttccccccgtttgattctaatatttctattaaagagctttatggaaataaaatacctaaactgatcctatagtctaactggtaagaaggagtctcttctattcagatagcacattttttttggtggggtaggtaggcaaggagttaaagaactcttagattctgctgtttaagatggatttgcgggcagaattactgtcacttgtcaggattaagtgttgacaatctccttgataactttat

SEQ ID NO: 46642 - DNA, 712 bp, Bovine  19866880935843
attgaatgtatttttctgggagtcaggagggggttacgtagccacgagggagatgacaggaaagcagagaccagcggatgaaacttgagggacacacagggacatccagctgactgacgaactgcttggtgctcccatttccatctcggcaaacccaggtgccgaggaggggaagactggtcaggcccgggcttgggcaggcactctgggctgtggggaaagctctttacctccctcttggctttacactccttgtcataatctcaggacctcagttgccctctgaggcaactgaaatggaggtgtccatacctgcctggcgtgcctgggattgtctgagggagtttggggtggagggtgggggaatgctggaaagcgtttctgccagcaacaggagtgtcatccagggaggttgctcaggtgaggttgggccccaaggatggaggttcatacaatgagacttggaaggcgggcgagaacgtgacctgctgccctgtccttgcagtatacaaagcggacgtggcacgcctggtggcccggccagaccccacggctgaatggaagtccgtggtcatcctggtaccagtgcggcttggtggagaaactctcaaccccgtgtacgtgccctgcgtgaaggtaggttctgccaggctcccccgtgcctccccgcacagcccccctcactggagccctgcagacattttcagcttgg

SEQ ID NO: 46643 - DNA, 1786 bp, Bovine  19866881022693
ggatcttcccaacccagggatcgaacccaggtcttctacattgcaggcagattctttaccatctgagccaccaagggtaaaatcaactaattactcttattattcaattatatttttattcttttatgaaggatctgataccactttcaaaaaaatcttgtttcacagaggaacaggctgagtctcctagagtcaagttttagggtgctccgtctttggcctctcctctaaaaatgaacacctgtccttgactcctttctcccccacacccaattcctcaataattctgtccaatccctcccaagtctgtggagaatccatacgtcccagtccttgtcatcactctcctaggcagttaccatcacccagttctcctggcttcaccctctacagagagcagaggcagttgtaaatgcctgagcctaattaagtccttcctctgcctagaaccttccaggagtactacttcactcagagcaaaagaagtttctcccctgggtccataaggctttgccccacctgccccattattttcctttgtttcttctctgcctctccatccttgctccaatagcactaagatctttgcttttgggagaacacacaggcatattctagccttaggacctttgcacctgctgttccccaattctgaaatgctcttccttcagaagttcccaggacaaggaattccctagcagtccataattaggactccctgcttccattgcaggggttgtgggttcattccagattagggaactaagatcccacatgccaaaaataaaagttcccaggataaaaaaaaaaaaaaaagttcccaggataataatcacctcagctcacagcacatgtcaccacttcttccaaaagacatcacctgaccaccatcgcatcactgtattgtcaccggaatcatctccacacttcttcacgcccttatcatctctgagtccgacacaagaacatcacttccacaaaagcagggatttttgtctgttttcttcattgctgtggagtttagcgtcaataaaatatattttcctaggtcttttctgcttccaccatcttcatctttggctgctttttcctataaattcctgtatttaaaaagtctgcaaaagtgctcttaggaagggcaatcgcggtcaaagggcgtcagtctgtagctggcggggttaccagggtcccggcgaccgtgggtgcaccagggcaggcggtggaaccgctggtctctaacccgtcccgctggggcgaggagcgctcggagcggctggagctgccatccaggccgggaggcagccagcggtgcaggtcgcccgaagccccaggggcgctcccaggccgccgggaggcacctgggtctcggcagcaggggccccggttgcagcagacgaggcgcaggagcgcgtgacgcaggtcgaggttggtgaacgtgtagatgatggggttcaggagcgagttggccatggccaggcccaggaaggggtctgcctgcaggagtacagggcaggcgcgcgccgggcacgccacgtccagcaagagcagcaggaagagagggccccaacaagccacgaaggccaggagcaccacgctgagcgtgcgcaacagcgccaaggagcgcggcgtgtggcgcgcgcgcatcgaggcgccctcgccagtcctggggtgcgcccgtaggcgccgcgccttggagcgaacctggcagtatattcgcgcgtagagcgcgcagatggcagccagaatgccgagaaaggcgagcacgcagaagagcacgtaggccttg

SEQ ID NO: 46644 - DNA, 963 bp, Bovine  19866881057311
tgatgactggaagactgcccccttgtgccctctagtttaaggcctcccttaaggtaattctcaagttctgggattctggttaggtcaccccacacagtatctccctgaaatgcacaatgactgtaagaaatgagtcttatcacaattttacagatgtagaaatagaagctcagagagctggaaagtcttggtgggtgaggcgaagctgagattagaaacaaggtgtatggcctccagggaccccaactttgccccacgtcacactgcctccctactgtcaacacacacacacacacacacacctcagtgattctggaagccccattccaggcagagaaatatccaaggagtcccctgggatcacctgtccccagatcagcctctccccatttcagaaggtacaaaggtcttcagccaagtacgctccagtcctagcccctaagcccaagccctcatcaatgacaccctccatcctggcagggtgccagggctcctttcctggccccaggaaaggggcaacgaagctcaggtgctacctcactgtgggacagtgggcaaccctcccaaaatacacttcaatgactctgttctcaggctggtttcccagacttcatcctggcctgagcccctacctggttgaggaccttctgcaggtagggcgtgcccatgcggtcagccaagtggcggtaggaagggtgggagaggaagaacttgcgttcagcagccaaggcagctgtgatatctttcttaccatcgatgtccttctggcttcggttcacgactccaatgtagcctgtgggtggggtggaggtcaaggggcattcagtcttgcagggagtgaggggctggaggtgaaagggaagggctatcacgtgggtcaggggcatggcctacctacctctgcgcagcgggagcagcttgttctccaaaacatcgcgggcatctggccctgtccatcagatc

SEQ ID NO: 46645 - DNA, 1609 bp, Bovine  19866881087900
ggaccagtgagaatcaagactcttactcaagtaaggggttgactggttcagcttgtgcctctcccatgtccctgtgcccataggcccatggcaggattgtgcagaggcccgccaggcaggccatggacagagtggagtgtatgagttacgagtgggccggcacgtggtgtcagcatggtgcgagcaacagctggagggaggaggctggactgtgattcagaggcggcaagatggctcggtcaacttctttcactacctggcagcactacaaggtgggcacaggtgggtggggcagggctgggcaggggaaggggaccagctcctgcctttctgactttcttgccctgctaggtgggcttcgggcagcctgatggggaatactggctgggccttgaacctgtgcatcagcttaccagccgtggggaccatgagctactggtgctccttgaagactggggaggccgtggggcacgtgcccactatgatggtttttccctggagcctgagagtgaccactatcgcctgcggcttggccagtaccatggagatgctggagactctctttcctggcacaaatgacaagcctttcagcaccgtggatagagaccgagactcctattctggtaaagggctcttattttggtggtgtgtcggggcaggatagaagactcttaatgaggaaatgaaagagggtggggtaagactttcctctggtagggatcagggcaaacaagagaatggaggacaggactcttattctggtgagggagtctacgttcattctctaatgagtcaataagtcaggccccagcctttgtgaaaggtggtgggggaaagggggagctgtgagagctaggacttttaactgttgtagaaagaaaggagaggttgttttttctggtaaagggatgagaggtaaagctccttgtttgcagaaaggatggaggaaaatatgacttgtactttggtaaggggataaggaagaaactaaggctattactttgaagtagggggacagagtatgcctggcaaaagccttgtgttagtgaggtgctggtagaggcttttattctggtgagaagaataaaataaggcttttttttcccctctcccctcaggtaactgtgccctgtaccagcggggaggctggtggtaccacgcctgtgcccactccaacctcaatggtgtgtggcatcgtggtggccactaccgtagccgctaccaggatggggtctactgggccgagtttcgtggtggggcttactctctcaagaaggctgccatgctgatcaggcccctgaggccgtgaccctctgtccatctgtccctcaggtcccaggggatgtgtgtcagcaggagcccaagttgttctggccacccctccttcgtggctccatgcagaccacgcccacagacctcctcccgttgtggatctgcagggcttccccagggctgtgcagacagtgcccaggaatccccctgccaatatcttggacccacatggctccccaagggcattgagatctcagtttgagctcatattttataacaacacaaaatagccacagaccgtgtctggtttgcatctgcatcggcaggggtcactccc

SEQ ID NO: 46646 - DNA, 866 bp, Bovine  19866881144706
cagagttgcaaagagtcggacacaactgaagtgacttagcaagcatgctcccctgaatgcgggggctgccctggccctcaccacccacccaggcccagcctgcaggccacgcaccaggtaactgagggcgctggccagctgctgggccactgccaacttccaggccaggggcacgcggcccctctcccgccgcagccatacgtccaggggcccgtgctccacgtactcggtcaccatgatgtctgcaaaggcctggtcactttagatgctgcacacccacacaccctccagagtgccgggggcaggacccacgggctgaggctcccctggggcagggcgccaggggagacttgggagtgactttagggagaagagaaacatgggctggagtgcaggctgaggtgggggcagggtgaggccaaggtgcaaggcagcattggggtccagggtagggctgaggcagagaggaggctgagagtaagtgatggaggtcaggaggggactggggagccagggggaggggtagatgattggagggagaggagctggaggttggagcccgagtgacacttggatccccctgtgcactgggaggggtgtggggtcagcacgcgggccagtattggggagaaagcaggagagatggagctttgggtctgggggctgcccgtggccgccctatacaatgaagtacatgcagaggaggtggggtggaggaacaagggctgagctctgggaagacagcggggccagcaaggctggggtctgcatggtgccacggcatagaaggggtcagaaggtacacaagggtggggctgtagaggtgtctggtggtaaagggagtttgggatgcagtctgcagtcag

SEQ ID NO: 46647 - DNA, 1064 bp, Bovine  19866881248344
ctctgtaattcccatttgtacagacagggagactgaggctcagagaggcgaagccccttccctcagacacgccgctagtaaaagcggaggtggggttcgacgcgggagtcccaggaattgggggaggggtgttcccacgcccccagagctttccggggcctcgctgcctgcaaggaggggccgccccctgggtccgggagggagcaagcttcacctgccggcctcccactccctgcacccagcctcaccttgcccttgacgtcgaggatgaagacagccgaggcggacatggtggcggccggcggacctggggggtggggagggagcgccgggaggcgacggtggtggcgccgcttccttcttcctgcggaagcacccgctcgcaggtgaggacccaggtgagcgcgtcttaaaggggagggccaccaggtgagcggtgccgtcggccgacgggaagacgctgcgggggcggggcagggcggagcttaagatgtgacaactgccccgcctcacttttccttcgcgccctggagtgaggatgggaggagaccccagaccaaccgattctccctccaaggaaccgaatatctatccatccatccattcatccatccaaccacccaaccactcatccatccacccatccactcatctggtttctcctgactttgccacactcacatccaccccaatagagcaggggcttagtccttttcatgtctgtgtccccagggcccagtgctgggtgctcaatgtgtgtgtaatttattaatacatgccataaatatttgctaattaatttattctttcgttcagtgacaagaactatgagttacactctcagcaggaaaaacgtagctgcctttttttttttgggtgggccaagtgggatcttagttccctgaccaggaatcgaacccattccccctgcagtgaaagcacagaggtttaaccactggaccgccagggaattccccaagtagtttttattgttattccttatgttattctttcaaaacttttttttaacttttaaatttttatacaggtctaaaggtcacact

SEQ ID NO: 46648 - DNA, 766 bp, Bovine  19866881312621
ggcaggaggagaaggggtgacagaggatgagattgttggatggcatcaactcaatggacttgacttttagcaaactctgggagatagtgaaggagagggaagcctggcgtgttgcagtccatgaggtcgcagagttggaaaggactgagcaagtgaacaacgataacaaagagaaacaaccgcaataaagacaacactaaatgctactaaaagtcaggcactgtgataagaggtttaccgaaattacatcattatctttgtaaactatccccatttaggatgattaaactgagggtaagggactcgcccagagccaagcattaccaaaggagcaggcccatttcacctccaccaggggaaggagcgactccccaggatccgctcacctagcgcgttctggatctccacggacctctctgggctcagaagggtctcatcaccgtcataaggggagcggaagcggacgccctcctccgtcacttcagacagggacaccagggacaccatctggaagccgccgctgtcctgagggagatcccaccgcagggctgtcaggtactggatggggaatatctacccccaaggaatgccctcgaaccccggcctcgatcccaccttaccgtcagcagattgtggggccaattcataaagccgtggagaccttgggccttctggatcagctctgggccctggtttggcggaagaaagggtcaggttagggggtgagtgcaaccctgggttcaaatgttgggggcgacagggttgg

SEQ ID NO: 46649 - DNA, 879 bp, Bovine  19866881401440
gacaggactggcagtagggagggggcggaacacaaggcagcttaaacagatatcagggttttgatggcacctcagacagagcccaggatattccatgcctgccttggtcacactctggacctccgctccctgatttcttttggacaaagctctgcagctttaagacaggaatccagggctgtgctgcacagctgtagtgatcctcagcacccaccaggtaatcaggaacacctgggaggacacctccacccctgccccccccccagaccaccgtgtgtgcgattcactacctcccacgactcaggcagaggcccctggagggcagagccctcaccgacctgtagaacttgttgaccctgatcttgatgtctgtctcattgggccggccgttgctcttcttgctgcagaagatctcctttatgcggccaatacggtagggctcaggggcatccaggttgctgcccttgatgtagtcagagtacttccggtagtgttctggatacagagcttcgtccacaggctccttccgggggcgtttcacaggactggacagcttgatgctgcagagaggcaaatgctctgagtgactgaacgtgaaatgttagaaagtggtttggcgtgactgacctgtgataatcactgtttaaattccagcgcctgaactaacgcagctcagtaccctgatcacagattcagagattcaacctcatccacactttgacacaggtattccccatctgtgctctgggtctcactgctgaggttgttcacattctccctgcacccggccttagggcaggacttcctggcaggtgatgtgttcagctccatgggtgtgagcagccatatacacaagccctgcccggcaggagagtgcca

SEQ ID NO: 46650 - DNA, 1076 bp, Bovine  19866881410106
ttctccttcccatcattgagtgttcacccaagcagctaggaaactctgcctcggcaggaaccctcttccagcggctgcttggtgacatctcggctttgcctcggctgacccaagggggtagtccaagcacacgtggggtccacctttgcaatttgggcctccagcgggctggaaggccttcgatgttgccagatgcgcttactcacccgcagcagggatcagagtctgtgcccaacgctggactgctttgagaaggggggttttcaaaccaacactgaggcagtaaaacactttgctggtgtgctgatgtgcatattcttatatcaccagcattgaagaaattttcagaattccttggtggcgcagtggttaggactgagattctactgcaggggactcgtgtttgattcctgattgggaaactaaaatcctataagctatgtggtgtgaccaaaaaaaaaaaatttgttttcctccaactcatggactttgcgcaaactgtgaaaggtgggcttctgtgcattggtttggttgccactgcaaaggccagggcagtgggggtgtcggaggactggatccttaaggcaagatgcttgggcatggttttctgccaagggagtgcctctgaggtagatggcccagatgctgcccctcgccctggtgacccaggggctttgattccactgtgtccttgctctcacccagcactccgaggcaggtggatggctgtcactcgctttctctgccacttgccacctcagaaccgcattctctgaaaagcatctctgcgtgtgcgtgggcatccactcaggctctctggcccaccgtccccccaccgccccttcttgtctcatagctgcagcagctctgagataggagcagggtggggtctcggtgggtctgccccatgtcagcccctcagccatgctctccatttggctcacatcatgtgcccatcccccgcccgcgaggaccccgccaacgtcaccactctgctttcccccagctcagctcctacccgcggttgcgagaggaaacggaacgcatcgtcaccacttacatccgggaacgggagg

SEQ ID NO: 46651 - DNA, 1201 bp, Bovine  19866880247360
tcagtgattttggagcccagaaaaataaagtcagagactgtttccactgtttccccatctatctgccatgaagtgatgggaccagatgccatgatcttagttttctgaatgttgagctttaagccaactttttcactttcttctttcactttcatcaagaggctctttagttcttcactttctgccataagggtggtgtcatctgcatatctgaggttattgatatttctcccggcaatcttgattccagcttgtgcttcctccagcccagtgtttctcatgatgtatctgcatataagttaaataagcagggtgacaatttactatcctaaagtagttgaattaatccactcactgagttaatttcatattttcagggcatgtatttcaactcaataatttataaatgttcttttaaaaaatagaaatatccataacacatgcatatcaggtttgaccatcatttctgtcatccaccagaaaatgaggcagaaaaacccattagcattttgttaatgatggtgcctacaatgtaaaaaaccacaattctagattctttctaacaacacttaaatctaaaactgttttccatcccagtttcccccttgattatttattacttggcacacaagaagcgtctcttctctttcaagaacatctttgaacacagaacacagtgtatcatacaaatatcacattgactacaatctaactgaaaaccgtgtggtcctgacatttgctgctgtcccttcgtctctctgctagcaccatatcctaaatttacaatctgctagagaatattcagcttggcttcaggggcattctggtggcaagaaacctccttgggggatataattctcaagttcgcacaaaagcaaatttctcatctttgggaagcttgtcggcactctggctgctagtatccaagtaactattagatgaggaacaaggttggtcatagggttagagagaaaagatgataagaatgtatgcatcacttaaaataaatcagatccatgatccatttgtctaagcttaagtgccatgcatgtgtgctcagtcatgtctgactctttgtgaccccatggactgtagcctgccaggctcctctgtccatgggattctccaggcaagaatacaggagtgggttgccatttcctcctccaggggatcttcctgacccaggatcaaacccatgtct

SEQ ID NO: 46652 - DNA, 1389 bp, Bovine  19866880264460
tttccttttaaggagtaagcgtcttttaatttcatggctgcagtgattttggagcccccaaaaataaaggctgacactgtttccactgtttccccatctatttcccatgaagggatgggactagatgtcatgatcttcgttttctgaatgttgagctttaagccaacttttccactctccactttcactttcatcaagaggctttttagttcctcttcactttctgccataagtgtggtgtcatctgcatatctgaggttattgatatttctccctgcaatcttgattccagcttgtgcttcttccagcccagcgtttctcatgatgtactctgatagaagttaaataagcagggtgacaatatacagccttgacgtactccttttcctatttggaaccagtctgttcttccatgtctaatcactccattatcaaattgcctttctcatttccatttcagcactattctaaaattttatttgtgttaaaaactcatttctttctctttggttactaggagacagcattctgtgagttgtgtgactctttatagctgaaggcaaatatgatagctaactcaaaagcaggaaataattagcaaattcacacattacccttctgttttgaattcaaatccaatggctacaggttaacaagatactttatctttggatagaagggtttccaattttttaaaaatgtggtgataatttggctcaatggtaaaacaccaaacacgccaaaccccatcaccttaaaaaataaataaataaataaacatctctgttgaagacagggcatggtactagctaaagaaacaatgtgtttgaattttaaatagaagataatcatttccaggcacacacacacacacacacacatatgtatttgagaatggaaaaatcagatccatgacagttaataatacatacacagatgtgtaactggctaaaaataaggaaaatcaaatttattaaagacagacatctatatccatgtgcgtggctgccttgcaaggaagtccaataatagactatcttctttaattcaaaaagtccccaaggacagaggtcactatcatggactggatagacacctgttatggaaacagaaggagttgagatggggttgtcatccagggagcccataagtgtcctatgactcactgtgaactcacagacaagaggaagcaggaaacgttctctaacataaaaaactgtcattttaatattgcacaccccccaaaatacagtctttaaagaagacaacaaaattgaaactgttagttgctaaccctactttgttgttgttgccaagtcatgtccagctccttgcgatcccatggactgcagcacaccaagcctccctgtccttcactgtctcccagag

SEQ ID NO: 46653 - DNA, 3530 bp, Bovine  19866880353653
tcaagatctttcaactttcagcaccacagtgcctgtggcaataacttgattccagaaaaactgtaaagtcagtgtaaccaaatagttttcttagatcattaaaaagcaccacatacaacatattaacaaccaagtctatcaaataaaagtgatgtaaatttaaagtgttcctccaaaataaaaggtttgcacaattaatggaaaaataaataaaagcattcattagttgtttagtgaaaatgctattgctcagtcatgtccaactctttctgaccccatggactgccaagctcttctgtctgtggaattctccaggcaagaatactggagtgggtagccattcccttctccaggggatcttcccaacccagagatggaactcaggtctcctgcgttgcaagcagttaggtatgtaaggtgataaatgatatggaacatctacccaagatgatgaaattatttctggaatactcaatttccttttatttctttctggcagtaattggttaatatagctagttgtcaactgagtcaaagccttttcatctgcatgtgtaaatgtatgctctcttcctatttgctctggtgaagtaacatgcttgaggtaaatgaaaacaatccagattaattaagataaggaaacaagatacaatattcctgttttaactttctgataaaattgcctgacctatgaaagaattgtttctactgagcctgaacttcaaaagggattctgtgtaaacattaagaaatatggttccatgagtgtgtggattttagcctggaggttattactgtctcagaaaaaggctgaagaaaggtcacttaaagtaaccacatgttatattttattccaataaagtgataaggaatataactgcagagcaaccacagaaatgaagaggttatgaggaagttgaaaattacctggagtccactttataggttcttggtcgttgggatcactagaaatgtgaaaggaagcatcatagatctaggagaatattgtgcttaaagatagcagcctgcatgtgagacaccctcccctttaagattgtcagataagctataagctatctggttccattttaatttcagataaacaaattattccaatataagtatatccccaaaactgcctagggcatacttacactaaaagaagaaaaagttatctgaaatcaaaatataactgagtgtcttgcatgtttatttgccatgttgagcaaccatattcccccattctctcaggatccttttaaattttcagaaaatagatgtgtgcatgctaaggcagttcagtagcatttgactctttgtgaccctatgcactgtagcccaccaggatcctcagtccatgggattctccaggcaagaagactggagtgggttgccatgttctcctctaggagatcttccccacccagggatcgaacccaggtctcttacatctcctgcattggcaggcatgctctttactgctatcactatatgggaagccccagaaaatagaattaaaaggtaaaaatgtgttagggggccatcaactaaaatcacccaccctagccaggcatgataataactacttgcaggagttatttcataatagggaggtcccaataaggaacagggaacttgcaatttgcctccagcttggaagcattcaagaatttgggagaggccaaaaggaaggaggatatgctttagcctataaaatggcctgcaaacctcccagaaatctttgccctggaatacaccttgactacgagatgcacacagcaggaaggaccttgaatcgaccaaacatggacatgagcaagacagttagccagagacaacctgaaaggttagccctgtgaaaggaaaatatctcttgccatatcaataaatgagaaacagccattatcgatttctggcctccaaatgagaaagagcgcttctgaaatgtgatccagtggatgtttcccctccctccacccacagtaattgttgaggagttggggaatgcaggaaaaaaggtgaagaaggaaacaggttggccccagacagctgaagtacatatgaaaggaaggaattcagtgagcccagaggcttgcatcttcccatgcatagaatactaaattccttaacttgacacctgatcactgttgttcagatggtctactcctctgttgcaaacttgtatatagcccaacttcgcctcctgcctccttagagctctgaagtgctctttcccaggctcagagtcctaaacattcccaccaaataaaataactctccattcaggttgtgacttttttagttgacaaccctaccaccataagccctaagactatgagccacatggcagagcagtcctcctggggttcccttacactgctcctctctgctcaagctcacctttccaattaagactcttgctttatcagcatgtgtgtttcctcagacaattcatttctgagtattagacaagaatgtactcttgggccctgcaagagatttctctgccagtaacaagtgcacaatcgcaaaggaaatacatgttggctgggaggtccatggagacatcagaagaaagtaaaaactctacttgaaggaaggtgaatgagatgacattagtaaagcacattgtagatagtttcagcctaacgtgcctgcgaaggagcttcagtgaaggaagcagccagcctgcttggcaacgtcgttggaaaggtctggaccaaggaatttgaaaagaattaacagaaagtctgtatcttaaagagctaatattctacacctcccagcaccacttgcagaaatgcagactgcatagattttacatctcctagcaatatgacaaaagtaaccataacaataaataactattacagagagaaatcaaaagacctgtttggcaggaataaggaagctataaggaagtggttgccctctacctggaactaatttctcaacatctcaccctaaagcaaggcctttgagtattcaaagtactcaaagatccaattcaacttttctctctggcatacagtaagatctcaaaatggttagctataattatgatgagaaagagcagactatagtggaacagtaagtcagacccagtggtgacaatgttctttgagtattattaagtggtagctcaaccaaagagaaatgggattgtttggacttgcttctctaagatagaaaagaaagcctagattcaagatagatgtgtgtgactgctgagaatacattcaggacttgtctcttgagaaattaaggttttggggaatgagttgaggggggagacgcaaggatctctaacatgcattttagatgctttttattgtttagccaccagggtacacgattttgcctcctaaaggagcaagtgaccctttaccactcaaggggaattcagaagtgaggttttgtaagattaggagtcttaatcaaaaatatccccattggttaagctgaatatttctttctagtgtatccgtaattaatcaacaccaaagaaaagcccagagggaccagaggtt

SEQ ID NO: 46654 - DNA, 2990 bp, Bovine  19866880488886
ttctgttttgttttggttttttggcctctagcatgcaggaatcttggactttatttagctctgcaaccagagaactggatagccagggaatacccccaggcaagttgtttaatagtgtagaagggctggtttctgaactgctggaagataattagcattttaaaggaagtgctaaattcctctgatatgacttctaaccagccaagcctctccacttgtctctgaaccctccgtctcttgtcagctggctctccttcccttccgctatctttctccctctgctgctttatctgtctacctctccctttcccactctctccctctctttatacagcatgcgtgtgtgttcagtagctagtgcagtccgactctttgagaccccgtggagcctgccaggctcctctgtccatgggattttccaggcaagaatactgtagtgggttgccattttctgctccagggtgtcttcccaacccaaggattgaacctgggattgttgttcagttgctcagctgtatcagactctcttgctgccgcacggactgcagcatgccaggattccctgtccgccaccatctcctggagtttgctcaaactcatcatcaagtcagtgatgccatccaaccaccccatcctctgtcgtccccttctcctcctgccttcaatctttcccagcatcagggtcttctgcagagttggctcttctcatcaggtggccaaagtactggaacttcagcttcagcatcagtccttccagtgaatattcaaggttgatttcctttgggtttgactggttttatctcactgtggtccaaaggaccctcaagagtcttctccagcaccacagtttgaaagcttcagttctttggcactcaaccttttttctggttcacttctcacacctgtacatgactactggaaaaaccataactttgactatacagatctttgtcagcaaaatgagatctcttctttttaatacactttctaggtttgtcatagctttctttctaaggagcaattgttttatcttaattaccatttattatcttaatatgacacattcatacctgagagacaattattttaatgcctaaaaaatccaacaacagtgtcaattttctgacagttttttattcataaagcattttcctatattttaggagtgtgtttgctttcatcacaatatataaatcatgaataaaaaaatgtgatctatgggcatgctaatattttatgaattttctttcttaaaaaagtgattgtgtgtgatggctcaaaatggaattttgaaagcttattaaattttactcaagtagaggttcagttcagttcagttgttcagtcgagtctgactctttgcaaccccatgaatcacagcacgccaggcctccctgtccatcaccaactcctggagtccacccaaacccatgtccattgagtccgtgatgccatccaaccatctcatcctctgtcgtccccttctcttcctgtcttcaatctttcccagcatcagggtcttttcaaatgagtcagctctttgtatcaggtggccaaagtattggagtttcagcatcagttcttccaatgaacacccaggactgatctcctttaggatggactggttggatcttcttgcagtccaagcgactctcaagagccttctccaacaccacagttcggattcattttgatatttggcaaaactaatacagttatgtaaagtttaaaaataaaataaaattagaaaaaaaaaagcagaggttggacttgatatattttattatgtattttaaaaaatatctggttcaggttggcaaatgcctagttgccaaaaattttaaaacaaataaatagaaaaaaagtgaagattattgcctaattttagggataatagaccaaagaatgaaagtgttaattagctaattttcatacagtactgattgtatccctttataatatgattcagttcagttcagttcagtcactcagtcatgtccgactctttgagaccccatggactgcagcacaccaggcttccctgtccatcactgactcctggagcttgctcaaactcatgtccattgagttggtcatgccacccgaccatctcatcctctgtcgtccccttctccttctgccttcaatctttcccagcatcagggtcttttcaaatgagtcagctcttcgcatcaggtggccaaagtattggaatttcagcttcagcatcagtccttccaatgaatatttaggactgatttcctttaggatggactgattgggtctccttgcagtccaagggactctcaagagtaatatgatgaatgaccaaatgttgatgtttaataagggttcatcagaatcgaagcaaatagaaggtctctcatgagctatgacctataggattgcttagtgatggagagaagatatctatggctttattttgggattggccacttttgaaagatgctcaacaccatagggattcatttgaagcagctgtgggccctctgctttcccatctgttggcttgttcttcttgtattttgaccaacatgtcaaattcatggcttctgttgtcttcctagacaaatctttcaaatcttttcctagacaaaagaaaaacacctctgtagtatctcagacctcttttactgagcttcaaagggcaaatggttaggagccatatggcaaaatctgttttctgttagaactcttttggtcatttccccatccagctctaaatgagcctatccaagattccactcaacagtgagccacactgaattcctgaggatgtgaccaaatcaaaaccctatctatgtgtgtctgggaaattaaaaagtgacagaatgcactagggcttgattacacttctatgtccatagttaaattgtaactgaaaggctctttcccctaaatatatttaaaaatatgcatcccaggatattagtaaatcaggtatgttatgtgattctaacttatgcatt

SEQ ID NO: 46655 - DNA, 1140 bp, Bovine  19866880535166
gtgtgttctcctcctgcctttaggaaaatctgattcccctagtgttatcaatatccaggaattatggagggacatcttcaattctttgaaaaataaaaggcaatattattttaggttttgcctttgaatccactgcaagcacagctcaaatcatttcaagctctcttcatttgcgtggaagaaatgactaaaagtgattaatgagaactctttgagaacttttgatgacaagtttattgggaaatgtgaatatggaaactgctatcatttctgtttctaaaaaccatttccatgaaaagagtgaaaaacattattaagcccagaaagcctttgcttttacaccaaaaagtgaaaatggaataaaaaggcaagtcaatataaacatcatgtgttccagatgagatttaccacatgaccacaaaggagtgagacagggttctgagaaataaatgacagagactgaagaaatgtaaactgtaagcccttttcatatcatctaaaaaaaaaaaaaagtgtcacattttctcttgtgactctggaaaaatggtagctgatgaatataatttattgtcaaatgccaaaggcagatgtgactattaagatgcttctcttttgctttttactctgcgactcatgaaccagaaggctaatctcatgagtaaagaatcactccggtttcccaggtggtgctagtggtaaagaacccacctgccaaaacagagacataagagactcacatttgggaagatcccctggagtagggcatggcaacccactccagaattcttgcttgaagaatcccatggacagaaaggcctgggggctatagtccataggattgcaaagaattggacatgactgaagtggctttgcacaaataatcacatgtttgctctgtaggtctataaatatgtataatctaaatttttatcactctttataaaaatctcaggctggtttgaaaattcaggaaaggtagaccaccttgacacaagaaaaagtgtccttgttatacagtactattgttgtttagtcgctcagttgtgtccctctttttcaaccctgttaggctcctctgttcatggaattttccagcaagaatactggagtgggttgccatttccatctccacatccagta

SEQ ID NO: 46656 - DNA, 982 bp, Bovine  19866880602999
tgtttgataccatgttataaaactccaaatcttgctgttgccattattattttattattaaaatattttagcaaagtacattccaagtcaggtacttcgtataactattgatttataaagtcatgaaataaaaagaaattcctttgcagtatctgtgaaaccaatatgccttcattggtaggccaatagcaagccctaaataattttatgcgtctttatagaaacgtattcttttttttttttttagttttttttttaattggaggataattactttaccatattatgatggtttttgccctacatcaacatgaatcagccatagatatacatgtgtccccgctgattctgaaccccccttcccacttccctcgctaccctatccctctaggttgtcccagagcaccagctttgggtgccctgcttcatgcatggaactcacactgtcatctagtttacatatagtgatgtatatgtttcaattctattctttcaaatcattccaccctcaccttctcccatagagtccaaaagtctgttctttacatctatgtcttcttttaattaaaaaaaaaaaaaaactttttttaaaaagcaccttcttactctttccctgcaaaggtcttcagagttaagtatgcactttattttgcagctgaagaaagtggggcacatggaggtttaagcaatttgactgtcagtgtggggtttggggaagataagctgctacaggaatccagtctttttcaacaagcttggctcacagatctcaactgaactgactttactccttcctttgcttcgatgatcatatacagtttgattggagagttaaactataatttcacagtgattacatgcccctgaagatcattttgtaagtaaatgttttgaaaccaaagataatcattgttgtatgaccataagcctttttcttatgccatattctccaccaaagaaagaaccaagccaaagttacgtt

SEQ ID NO: 46657 - DNA, 2409 bp, Bovine  19866880613248
ttgccttcaaaagcagatataaggtttcagattatgaaagatttcagatttgaagatacagaatttccagattgtggccagagaaaaaaatgcatctgtactgaaaaaaagaatggaacaatattcaatgaatttgctattaattacagtgcagtgttatgcttttttcctgtctggagagtaaaaggacttataaagtctgggtgagcagacggttctatagacataagttctccatggaaaactccttggatccttttcaagatcagtgctgtctgagctctgtttaagtgatggcttgaagcaatagccaaccatagggaaaaagcactgtcttggatgctaagaacccagactaactcatggaatgtctcatgaggctcactggacctaaaataaagtgaatattctctgtcttctggtttggtttccatgggaatttatgtttatgggggaagcctgtctcttcctggccaaaatatttggacaattcagtcagttcagccatttacagagttcaactgactggatgctttgtctttctggctggcacgaagtgctggtagtattggctgggtgaaaaatactgtcaagtctgagtcagtgcactttttggtgatgctgggcaaatttggctcacagttgattgatggcaagagatggcatgagcaaagaacattgagtgaatagataggccatgggtgaagttgagaatttcttaattcaagctccttgtagttatttaagaataaactcataatctttattttttcctccccccagagcaggtgaatgatccaccagaatagaatggatgtcttcatcatgcttatgttactatcatagaagtggaggaaggatagacaatagtaagattttctttactggagaagtggtttgtaatgaatttcttttggacaattgaagtcaattcagtttaatttgcaaaaatacttattgtataccaagtcagtgcagcttaaaggaccgacatggagacattagtacaggcacaacaggtatctctatctaccctcaaggcctggagtgctggttctcaattgtggccatctggtagtataacttggaaaattttttaaaaacacaaacgaacttatttgctaagcagaaatagagacatgaatgtagagaacaaatttatggataccaagtcggggaagagagcagtggaatgaattggcagacatatgtatattatgatgtgtaatatagataactaaagacaacctactgtgtagcacagggacctctgctcagtgctctgtggtgacctgaacaagaaggaaatctaaaaaagaggatatatgtatatgtataactgattcactttgctgtacagcagaaactaacacagtgttgtaaagtagctatctaaaattttaaaaaacaccttcatttgggctcctctgaaggccaatggcaccccactccagtactcttgcctggaaaatcccatggatggaggagcctggtaggctgcagtccatggggtcgctaagagtcagacatgactgaagcaacttagcagcagcagcagcagaaggccacttaaatcagaatttctgtgggcctgagctcaggtgctggtgtgattttgaaccttctccaactgcttataatatgtaatcagatttaagaattatgttttgtgggatagaaatatgaattcgtaaatacagcatgtgatgaacgctgaaatttgtggctaaaattagcttagtggtgagcttttcagcacactcatattttttttccttgagattctcttttacaaacacagcatctatgagccctcacatcaagtcccctctagaatttgtctccatggcaatttgcacttaccttttcataatacatgcaatcacatttgacattataaatcattatccatgttcctaagtcatgtggaaactcagtgggattattttgttccattatctaacacagtgctagagacataatagatggtcagcaagtatttttttaattgaataaatgaatttaccaaaagtaatttactgtactcatagaatccatggttcattactaacaaggttctcacctatattctaggtcatgaatctgtcctgaaaatgtcaagtgcataagaaatagatttggcgttgaagttcatacttaacactagtacttagagttacttttgtgcattatccttcacacaggctggcttctctcccacaatgaggaaattaaaaagtttttgtatctggagttttatttattgctattcaatttttactgaataacttcattcttttttacttttccaatatcatagtagaaaatactatctcaattacatgccaagtcaaactgtcttctctttaatgaaattttcagttcagttcagctcagtcactcagtcgt

SEQ ID NO: 46658 - DNA, 3648 bp, Bovine  19866880626667
tattctcacctggaaaatcccaaggacagagggagcctggagggatatagtccatacgctcacaaagagctggacatgactaaagcgacttagcacgcatgcacaagctcataatcaaagtactccctctactcaaacaaatgattgatgtaaatactgaaataaaaagatgagaataaatatgaattatctaattttagtttcccatctgaacactttgtttgaaattgatgcccatggttgctgagtatgcatagaggtattgggaattctgtgagtactaacttattgactttagagattttggaggaagatttcctattcctaaatatttgtgtcctcattctctctgggaaccaagagttgtgagattctgactctcctctgaagcagtgtgggccacagaataatctcctattgatttgttagagaacagatacctgagtcctactcacaatataataaaatctaaatcttagtttctacactaaaaaaaaaaaaagaaatctcagatgaatcttaagttatctagagtttgagaagtacttatagtctacctttccttatagctgataccatttgatctccgaattcagaaatttttcttgtctctagaacacatcctgaaagtaattaaaaacaatcaacacaaaatgagaaaaggatagtctcctcagtaaatggtgttgggaaaactgcatatacacatgcaaaaaggggaaactgcatccctatcttatgccactcacaataattaacttgaaagaaattaaagacttagttttaagacctaaaatcataaaactcctagaagaaagcatagggaaaaatgctttttgttcttgatcttgaaaataaattttaggatatgattccaaaagcttagacaacaaaaataaaaataaatagttggtattacattaaactagaaagcttctgcacagaaaaggaaatcatcaagaaaatgaaaatggactaaaaggaaatatttgcaaataatatatttgataaggagttactgtgtaaaatatataaagaactcacataactcaatagaagatgctgctgctgctgcatcgcttcagtcgtgtccgactctgtgcaaccccatagatggcagcccaccaggctcccccgtccctgggattctccaggcaagaacactggatagatccacttaaaaataggcagaatatctgaatagacattttttccagggaatatatataaatggccaatagacacttgagaagatgctcaacatcagtaatcatcagagacatgaaaatcaaaaccattgagatacacctcacagctgttagaatatctattttcaaaaggacaagaattaacaagtgttggtgagaatatggagaaaagggagaaataatgggaggtgatgaatgtgttaatgaacttgattttggtaattttacaatgttatatatatatatataaatataaaatttccacttagaaatatacaattttatttatcaattattcctcaatagctgaaaaaatatatatatcaaagagggaataaatagtcaacacattgaataatctaggattcagcatcaaactcctcatgtttttctttcttgtccttttttctcagtgtctggcaaattttatatctgccaaataaccttgcccctagagagttagagacctaacacatagatactatttttggttttctacccatgttcaggttgactttattggtttgagagccttcaagtcatggcttaagtggccatggatcacaggaggcatgattcaatctctaaggctgagtttcacccttgggtttccagctgctcatatcactaaatcacgctttgtcctgctaccttgcattgctggttggtttctagggtaagctccctactagccagtaaggaaatctagataaggcatcttatttatgaattctggcatttgcagagcttatgaacttcttgacttccaataagcacatcataaatacttgttgcaccaaaaagaatgaaatcatttctgtgccagagaatgatcacagtacaaaacctgattcttggtgtatatttcaccatttaattctaatttttgctctttgatcataacatattgaagcagaaaagagagccaggaacattctgttctctgactaaataatgtttattttaaaatttcagagaattcagttagcctactttctctagacttaatgaaagtttgtgattcaaagtaaactaattattgctgaagtctagttttcattttgaattaaagaaaatatgactttaaaaaatcttatttaagcctctagcataacaataataatcattttcttttcattgattaggctagagctctctgtcatcttttgtcagtgagtaatggcaacccactccagtactcttgcctggaaaatccaatggacaggggagcctggtaggctacggaccatgggatctcaaagagtcggacacgactgagcgacttcactttcacttttcactgtcatgcattggagaaggaaatggcaacccactccagtgttcttgcctggagaatcccagggacaggggagcctggtgagctgccgtctgtggggtcgcacagagtcggacaatgactgaagcgacttagcagcagcaaggccccagctgggtacaaaaagtttggtaagaataatgtgctagtggctttgaaaacaaatatttatttgctttttattgaacttttgtgagcccatgcaagtccattatcttcaaaattctggatctggctatagcttaaaaattttatatgcaaattatataagaagaattgaagtcattgctgtatatttttcttttgtgaaatatatgtgtacataccccatgtatcatcaaaataagatcttgcaagacagtataaataaacttaagtaatagaaagcattcaactgctaaactgcattagtttgttctctttttaaaattgctttaccaaattatctgctatcttactaagataataattaagtctgctagaattttaagtgaaaatttctgaattagtgggtttttggagggaaatttgacaaaatgtaacagcacaagtatacacgctcttacaagtgctcatctatagatttatcctaaaatatgctaaaatgtgggaaatatttagataaatatgtttattgcagattttttaaatgacttcacacttgaaaaaattgaaaattcaacagttgaacaagattaccgcttgacttagggattgtggttactcttgaatatttttatttgtataccttttttttatttttgaaaatagtttctatgataattgataattgacaaaaagacaattgtatggttatttgaaaaaataaagtgaattaacagtttacttaagactgtttcactagttttctagttatggttccactgagtaagaaaattgtctataaattactcttttgagtgttgggccttaaccaagctattcatcctgttaacaacagcagattcaaggaaagaataatcaaaccaacaaaggttttctgaagcttatatcccacactaagatctaggaaatattaatacatcagaaattcccactcttatcagaagctactacctccaagcttagttacctacaaattat

SEQ ID NO: 46659 - DNA, 1079 bp, Bovine  19866880639200
tagcctatcacttctccagcagatcttcccaacccagaaattgaacttgcatctcctgcattgcaggtggattctttaccaactgagccaccagggaagccctgtatagtgatgggtaggaatctaaagtttctttttcctgcttgcaagaggatataaattgacactgtaaaattttgtttccaactgaaactcacatacattatttcagcctgtaagtgtttagaaaggaaatgactgttacagattggaaaggtgcttgaaaaggggaaagacacttaatttggacaaaaagtaatttattcaacaaggatttgttgccatccaatgaatgatggcacacgcaccttggacaattttctagatatttattgattaaatataactatgccaatacaaaaataggtagaagaatcctagccagtatgatcacaacggttttgttcaaatcagctctggcatttgaccaaccagggctcagttaagtttatgagtctctttttggctgcataattgcttcaggcaacattcacagagggattccctggtggttcagtggtaataaaccctcttgccaatgcaaaagatgtgggtttggaccttgggttgggaagatcccctggagaaggaaatggcaacccactccagttttcttgcccgggaaatcccatggacagaggaacctggcaggctacagtccacaggatcacaaagagtcagacacaacttagtgactgaacagcaacaatgtccatagaaatgcttaggccaaggtgcagtgactttggcactctcatatactctggggaataaaaatttccacttttctggaaagaaatgtgtcactatgtacgaagatttctttaaatgtctcttagccaggtaaattcatatttaaaaattcatcttactcaaaaagatgtgatcacatataaataatcataggaatatttttaaagaaataaaaatgtggaaatgacttgaaaatttaaataaagggaattacaataaaataatattagagcattttgccactataaattatcattggtttgattaaaagcaaagttaatgtccat

SEQ ID NO: 46660 - DNA, 1160 bp, Bovine  19866880701030
tgagatcccacatgccacagagcatggccaaaaaaaggtaacgataataaataataataaaggattttttaagaggacacttctgtgatgtacccttttccctgtccttccttgaccactccctctcctctcactgcctttatcatccacagccagctgtgtgcctaccctgccggtgtcagcaaaggaacagggtgccttccaagaggctctacatgagcccccaaatatctgggaaatgcgtccattgcctcatgacagacagacccttccaccctcattttgtgaagggatagtgagaatcctggagttctccctgcccatcagtcacaaatcatttcatcacctgtgctctggataaagctataaaatcagacatccactcaagagacatggtctaagtattaactttgggctggtttccggtggtatatactcagttccttgcctcatttgctctagtgttctgtcatagaatttaaaggatttctaaagacaatgaagctgaaagcaatggaaagaaacttggccagggaaagagaaaagaagccttcaatatgaaaatcatttaaaaagggatgaaagaattatattaaatagaaattatagtttagtaaggaaatgactccagggctggtaaactcatcatgatttaggaggtgaattccacagtaaagcaagcaaagctttggagtcagagcatagctaccaatgcattgatacctggaggatgccactagggcaaaggtcattgagatagtctgggggaagtgccttccagcactactcaattcacaagggagctgggaatcatgatggtgacctaggaacgtctggccaagtgtttaatttattcaataactttcctgagtctctcactggacatcttggttagggtgctaagaaataaaaacaatgaagaaagagttattatcctcagctacttgttgagggttaattacaatgcagttgatacattctcaatcatccctgctcagatgtcaccgaaaccaaaagacctcagcccaccaaaaggttaatcactcgttatagaaactacagctctgcattgcagatagctttgtatcatgttgatcactaaagtcttttaaggagttccttcttttccttttctttttctctcagtcttttcttcctct

SEQ ID NO: 46661 - DNA, 1198 bp, Bovine  19866880758924
tagtttattgagctgtattctgattatttgctattttttgccggcatgtgcatgtcagtacagatggtaatttaaaagatatccatggggagacgttgtgaggggagagacagaaactagaggatttagaaacaacatttgcccctgtcagtaagctcatgagcagggggcatgtggtaacacctagggcacagtgaagggtttggttcaggcaagaagaaagacacttctgtgcttgctgaggaggtaccagcagagggtttgtgcagttttccactttatcagagctcccttctttcctttgtctccagcaaaaaaatttaatttagtgtttccaaaatatcttttggcaagtctctttgccttttctaaagttcatttaaaacaccatccatttctccagcaaagccagggagtccttgtgtccatatgacacgactcctgttgctatggcaactgaatgtttactagagaaaatattaccagttaataatagcctgaatggaaataatagctactgctaggcccttcagagttacacaccatcaatttccaatttgctgaaataggtgcaatttgctttttgagcttcaaagtattactttttccaggccttcacgatccttcccccacaccatgcaccacaggcccacacccacacatccatatgctcctaaagaatgttctgtttgtccaaaatgaggacagagggcagctgttctgttggagccccgtcagaatcccaacagtaggaataatgaataaattagaagtttactatttattggctttggtgaatagtgaaatcacagagagaacgatcacagaaagagagtataattcatactctttcttatagccaatcttttccagaatctcattcccaaagagcaaaccagcaagcagatgtgttgaattactgtgtcaaaaatcatgcctgtgcataacaaaaatgcctttcaaggtattcagcccactctctccctgagtctgggctttttacgcatttgttcctttcttgactgatggcttctttctattatttattaattcagcaaatgggtattaaattgggcacaagcctggctccccgggtatgcagacccagctctggcccgtgagaggagctttcaagatactgcgtgcagtgttttgatgaagtcacccctcccaccaccagctttcccactgcatgcca

SEQ ID NO: 46662 - DNA, 1543 bp, Bovine  19866880904361
ctttttgattataacccttttgtatgatttataacccaaattaatttctgtgattcattacctttagatgctgagatttagtatccaaactctcacttatttgcccctgaaaattaagaaatgctacaacattgttaagtagaacaacttcccttaattaaaaaaactcacatataaacataatgaaaagcagaaatgagcataactgtagttgcttgacattgaaacaatacaagatcagggtcttctcaccctgaaccctgttcgcctttgcctaaacaaaaatcccttccatcgtatactgctggttatgctgaaattttatcttctgatcttttattccatttggaagagttcttcctttcttcccaaggggaaaaaacaaaacaaaatatgctatgctttatgaggaagatcacaatataaaatcaccttcacaaagatatatttttcatgcaggttttctttgtagaatgtttgctttgtaacaatcattcatattctgactaaatataaaatccttgcttccctcctctaccaagttcatggttcaaaaacctgggagtcatctaactcatccttcttccccaaccatacatacaggtcaccagatacatttgaattttagttaaacaatgaataatttgcatgtgataaacatgtataatttgtatgtgatccaactattgcttggaatgcacttatgttaaaaaagttattgttgtttatctgaaaatcaaacagaagtggacatcctgtatttctatttgctaaatctggcatctccacccacatccaattcatcaccaaacccaccaactcctacttcctcaatattttctaaattaagtccatttatttccatctctactatttgtactcttggaaaagacaccacatttatacccatttgctttaatgacctcctaactggcttccaacctctaaacattcttcgttctttgttaaagccataaagattctttaaaacacagccctgatcacaaaacaccatcttcgattattcctgttgctttttaagataaggtctaaattcctaaacttggctttcactgctatgtcttatctgtctggcttagctctaagcaatcatgattttgcactctcatacattccaatcattttgaaaaacctttcaatctcttgaaaatgctagaccctgctctttggttttaatatgcacacatgaattttctcctacctagggcattctttcaactcatgagtttcacttaccctttaagctggaccttggtctctttattctcagatatattcttttgccttcccctgctctgctatcattcaactctctaaactgatgtcataatcacctcttgtttacctactgattaaggagagagacccacccttcagctatggggatggctgagccctgaaccctgtcccgcaacacggaacagattagactgacaggagcattagtcacagatactcataacctgggagccaaggaccttgcagcaagacatagaagggttgcgcttaggaccagagtgaa

SEQ ID NO: 46663 - DNA, 1325 bp, Bovine  19866881023414
cctcacctttagcaggagttaacataagtctctaagttaaatggtccagagtcaagaaaagaagttacaaatgaaaaatccagatggaaccagctgggaccagatggcaacaaatctgacctccaacagaccctgagttctattatacacagattttgctacattggcatggtaaataacacacacccggtggccatgagtggacattcaggacaataaagtataaaaaagagtgatgcaccccactcccttggaaaaagccccaccccttccccagtagactggtgcacctacctccccatcattaggctcagtcttcttccctttgtctttactctttaaaattaaatccatctacccagatggatgaaaggtgatctgtaaacttaattcccccttctctattttttggccatgaaataaagcttaagctgtgttgatctcagctttgatttcatctactcaaaccacaatggaaaaagaaccttctcctgcagaggcacagagaccaggctgggctcaagactgagtagggtccaaacacctcatttttttttttttttacagtttctatttaaggatcatttagccagtcttctaactgtatcatacactcatgtttaaattagggataattttggccacaagtaacagaaaatctaacagcagattaaacaacatggtaatttgttttttgcccaaagtcaattcaaaacagagacaagtgtcagaaattttcagagggagtgctctcagaaacatcaccttaggggatttgaagcaagcaggactctgggtagagggagagttggcctgaagttaatttataataagacctgaactgaacttgtggggagctccaaagatggatggctcttcagagatggttttcccatgttgaagagagacacccaggtatttatactcccacatcaaccagacgttgaagaggggcttctccagggaggaggcaaacatatcctcagtagggaggtgttcttcagctgataaaattctggaagatggcttgacagctgagggatgttagctcataatcttagcagttggaagaataaatccttcggtcttgaagggggaatctaggagcccataacctcacaataagactagctatttgtagttgctatggttttagttcacccactcagagatgtcagaccttctgcatatttgtttgttttagcctttcttaacacttgcaagatggccactccaattccaggaatccacataagaaagaaaaggtggctggtaccactggttatgattctcatatctagaaagttaaagtccttcagcagatg

SEQ ID NO: 46664 - DNA, 687 bp, Bovine  19866881059428
aaccatctgcaactggataaagtgctcattttgcatgttaggaaaactataaaaaatgactgcatgaaattaaggcaacatctgagctcctggggttgcttatcacgtttaaagttgacagtatgggtctcaggaggcagcagagagtttatggataaacacagcaggtagtaaaagaacttaaatgccaaaaatcactttaccatagaaaagagatggagaggtaatgatgaaattaaagacataacacttaagaccttacttcttcaaagcaatttccttttaaaatgtccaaaataattactttaaataattaaccggcagagtggtctgtaaactattcaactggtaaaattattttgaatgtctctctgagtgcatgtgtgctcagtcatgcccgactcgcttgcgacctcatggactgtagcccaccaggcgcctctgtccatgggattatcccagcaagaatactggagtgggttgccattccctcctcctcagaatcttcccgaaccagggatggaatccaagtctcctgtggctcctgcgttggcaggcggatttttcttttctttaacccaatgagccacctggaaaatacccaagtgtccctctgtacactcacgatttttgggtgaagcagagagaattctaaataagttgcctaggcttaatttcccttttaag

SEQ ID NO: 46665 - DNA, 775 bp, Bovine  19866881105558
aggcttgggctctcacaggcacatttggatctgggtttcaatttcaatatgtgctatgtctctttccttacaatatcatttggcttgagttataaaattgtattacatagtaagtgtatgggctttaaaatagaagtgtatacagaaacagtattcatttacttatttattatccatgttaaaattaggtaacatttataaacctattaaataaaaaagcaaaatatatcctctcttcattttttcattgtttatttaaggcgaaatggtataacactttaaattgaaatagtatgtcccttattcctcattcagtagagtgattatttaacaagtcttaaatttattgagaggaagaaatttagtagctcaaatggtaaagagtctgcctgcaaagccggagacccaggtttgatccttgtgtaaggaagatcccctggagaaggaaatagcaacccactccagtattcttgcctggagaaactcatggacaaaggagccttgcgggttacaagtacatgaggttgcaaagagtcgaacatgccttattgattaaacaacactgaagaaatagcatgctacaggaatctccacaagacaagatttccttttaatatctccagaaaattctcactacagatgtgagagatgtttgaattgaatgtttcacctgtaaataatatggtcagaatttcatgaattcgttagttttaacttacatgttacaaagctgtacctttgtatttcatttcagttatctggtaagacatgtcat

SEQ ID NO: 46666 - DNA, 1943 bp, Bovine  19866881112252
tgtgtacacagagtttcatccaactctgtaccaagcctcacacgtgacccactggcatgccctgctatgggtgtgatgcctccgtgtcctgctccctgtggtgtggaccgtctccctttctactgatctcacctgtgtgggcacttactgatatctcatttgcagcagcaactcctttcctatttctctctgatcatatcggttttatcttttatcttttttaacactttcagtagaaatgagaaggaaaacaggtaaagtgtagtaagatctggctgtatcagcagttctcatttgatagacaaaagtcactttaagttattctttggccaaataataattgacatattttatcaaaataaggtacagtaattcccctacatatgaactttcaagttgcaaactttcaaagatgggaatgtgcatttgcatgcccagtcacatgacttagttcacatgtgtggcatgcatggtcacgtgtgtgcctcctcacagctgtgcttttgtgtactctactatatagtattgtacagagtacagtagtacagcacctttatttccagcccaggatgtctggtaagcaagcgtaaaagcagcagatgattgcgttagtttagtacataggctaactttgttgggcttaccaatgcattctcagaacagcactcatttatatgtaggcaaattattgtgttataaaaatgtactgtttcagatgttccatgattttgattggttttatagtattaattatttaggaagaaaattttgcaactttggaagccatacttatccatttatgacttcttagcatcttagtgacatgtagcaattaacttgattatcaagatggccaagctagtgtcgaggatatgaccaacactctggaaaaatctgactcattgtgtactgggcttttcactctggggcttaacaaacaggaaagaagcatacacagtctggtgcttgcagtcaaggagctggtgttcagtgttctgggcagatttcaaagtcttctgggttgtatccaggcggcataaactcatacctaggtcatggaatcagaacaccagaattctgtttcgatgtccaacactttagtacaatcaaatggaatgcaacactgaaatatgaaatgcaatgtttcagctaaatccatgttcaagttggcaacttgtgttctgctgtgcagaattgaggaatttgctattgtctagaccacgctttagacagtgagccacaaatccccaattcgaggctattctgttgttacataacttgaagagatttttttttctcccaaagtcattgaagaaaaatgcaagaataataaaactttaaagaagtgggaacgcatgtcaaataaactcaaatggcattatctatgaaagagaagtctgtatgctattcgttaatttcttaaaactatattaagactattgtaactacattaagttctaataaagtcaaatgagagattggaagagaagatctcaaaactcttttcctatttaaatttttatagtcttatgaatatgcaatatatttgaaatagaaaaagacaaggcagaaagaaaacaaatacaattccctccataatactgactgcatttatttgattttttaaaagcacaaaagagagggtaatttatcttcattggattttctttttacatgttttcaatattggaacacatagtgcagagcctcctttcaagcagttatttctcaatggcttttttaaaaagtgaggaataaatgactgtctaataagaaaaaatttcctaatatacactgtgcattaggaaaattggttttgaaatcttaaataaaccgctaaatataactattattcagaaactggcaaatatgaactatgagcacccattcacaaaaaaaagtaattttattcctttctctttaaagaaaaagagttatatttg

SEQ ID NO: 46667 - DNA, 867 bp, Bovine  19866881122905
aaattgcatttagcaaagtcacaaatttataatataacgtgtcaattccaaatgattccttctgaagactaggtcttcattaaaattgtatgtatatgtaggaaagtaattttgatgcattcactgaattgagatgctgcctgtatatacagagcttttattgacaatactagtaatgtgaagatataaaaagcaacgtccactttcagtaatacaggaagagaaggggctactctgtcaataaccagggtgaggaaggaagctgatccaaacttcagaggctttgaaactgcaggaattagctttctcaggttggtcgtttcattgttcacttactagacagccttgagagcttaataattaaccacagaggctatttatagaattttaaaaacatggccattcctgagcgatctgggccgtttatcctactgctctgagagttgacaaggtcacgcagaattcccgtgtgaagagacactaacctcaaggtccaaattccccaggttgaagagaagctacgctggcatgagaaagtgataaaagagcagcctggacagtttatcttcccccgatcctccaaaacctccctttgaaggcttttttacctaggtgcaattccaatccccttccattaacgccagggcttgattatctcaactgcttctaatagggttaagtgaatttacctcagtgttctgaaagaaaaccagactcctaaagttgctaatatacacttactaactcatgaccaggtcacacatccactcccttataaattttactggggttcttctttttacgcacaacgcctcctctccacttgaagccatctactacactctgagcgccttttcgttgtgtaat

SEQ ID NO: 46668 - DNA, 1276 bp, Bovine  19866881206439
ataatctctatgtctgggcatgttgctgcaaatgacattgttttattcttttttatggctaaataatattcatatgtgtgtgtgtgtgtgtgtgtatcacatctcctttatccatctgtctatagatagatatttagattacttccaatgtcttggctatcgtaaatgaatatattggagtgcatgcactttttttgaattataatttattttggatgtgtacccaagattgtgggatcatatggtagctctattttcaactttttaaaagaacctcccataccattctccatagtggttgtacttatttgcattcccaccaacagtgtaggagggttcctttttcttgcactttctccagcatttattatttgtagactttttgatgatggccatttttactaaagtgacgtgatacttcatttgtagcttcccaacaatccaaagaaaggacaaataaaacaaggcatactatcaaaagccacagaggatttaagaggccgaacccaatgacctacactggaatttggtcaaaactctaggcttaacacatctaactctttcagaaacaatatcatgggatttctgatgaccagcttagaataggactagagctggccagactccttgatatgaaatgaaacaccactgaaaactaataggctggtgaattttgaactagaaagtttggcctttcatttcttttggccagagtgctttcaacaaaagtctaaatcatatttttttaaagtagtctcttaaaagacatgaatagctacaggtcagttacaattggttcacttatgttcttccttaagttcaagataataagatggagtctgaggcttgggggaacaaaatgtctacacttttgatctaaatattggatctatatttgtaacaatttttcacaaggatgtagatgatactcaaagtgaatgaaaaaagagagagtataaatctagaaacatgggtttgtagtttaatgtgatgacatgtgtgtgcatatctgagaaattagagtgatagttgcataagtgagtagatgtgagtgaatatgaacaatgaaattacagggtaagctctaaagagaatggaatacaagaaaatcctttatttccttatagcaccttttccctctctcacaactatgcactggggatactaatatactttttctccaatttaccattttgtccccaattgctatatgccagcaagtttggaaaactcagcagtggccacaggactggaaaaggtcagttttcattccaat

SEQ ID NO: 46669 - DNA, 824 bp, Bovine  19866881232870
accagcctgtttggtgatgttagaaaactaatgtgcacttcaattcttgtgtatagtatttacttagaggaatttcatcatagataaaaattactcagatcgagaaataaaattatacagatcaattgagaaatatgagttttgctagtaatgagattgcctttatgggaaaataatgccttgtttgtgaagaaaaatgttcagaggttagttgcattttttctgtttttgctcattaaataaatattatctgtttactagtatatttccctggtggttcagatcgtaaggagtctgtctgcaatgcaggagacccaagtttgatccctgggttgggaagattcccttggagaaggaaacggcaacccacttcaggtattcttgcctggaaaaatcccatggacggaggagcctggcaggctacagtccacaaggtcacaaagcgtcaacatgactgagtgacttcactcactactgtatttatctggtaccactgtgcctagggcattgctcaccaatttattaattctggatgctacccaaatgcatcagccagattcttcaactttgatggacttcttcagcattattaatatttctctcaagttctccagtatttcaggtattcatgcatatccactgcacaggccggcaaatctctgaaggttctatagactttcagctgtgtttgttaccacaagaacattcagtttctaaaagttaaaaacatatctctaagcagctcataaattctaacttcaagtttaaactgatgccagatgccagagtcaataaccctttaaattggtggatctcaattccgt

SEQ ID NO: 46670 - DNA, 1018 bp, Bovine  19866881276690
tgtagattcctttcctttggcctcaaaaagggcaaaattgggactgcaagagcgaaagtgaaagagtaatagcctgcctctctctctattcccctgctattggatttcactctgggctggctctccgaggactgtggagttaatgaattgtgttctccttctgactcagtgtgaggccacacacttttcgggtcactttagtacaacagcaacatgggtgagagtgttattaacaatcacctcttttcacattcttgcaaattaagcaatactggattaaaaactctcatttgtactcaattctggacaatttcacattgaagcctatttttaccaccaggaagagcagactaagtatcctgatactcaactggatgtatttatcattagattttctctcactatggcaatgtgctgaagtggctggcggcccagcaggactcattttccctctgcttccaggaagtagcacagtgatggttaacagacatggttgtagaaagcgtttcttttaaaaattcctgtgactgcattgaattgtatgccaaatatatacatatgtataactaaaaatatgggaagcatgtatttttccagtcgcatttaattgcatcagtatagagattatattggcttctgcagcaacagctaatgaaccatgtatagcggaatccagatgtttagactatatactctgccaatccattatacaaagtttcaattatgactgtctcccattgtgtggaaagaagaactgcatcaccgataaggaaatacaatggaaggctaatcacattgttgctatttgaaaatgtggagggaagagcttagggtagggttaggttaggttagggaaagtgttattttcagtaaggagatggtgaggttggggtaaaggattcatggcttatgtttccatgaaacccttctaattggtattgcttatatgacaatgtgtttgtttcattaactccaatcacagtcacactcatatgccacaaaatacaaaaacacaatg

SEQ ID NO: 46671 - DNA, 1477 bp, Bovine  19866881336024
tccagagcagtctttgagaggctacattgccttttatttactttcttgagccttggagcattttttttaatacccctcagagctttgaaagggactgctttttcccccagaggaaacctgaatagttcacaactggtaaatagctcaattcttctttctttcagaagatgaaacccaagatgaaaggatgtgatttttccaaccaccattttaacaaggactcctcccccacccaaaagatcaatcatatggaaaacagaaaggttttcaacacaaggatgacttatcatagaacatgaaggaaaagtataggaaatgaagacacatccttcgtgagataaatcagttctcaacggggaaaaaaggagtatctggaaattcatgaaatctaatgcaatttaaaataatagatagatagctgtgaattgaaccttagaagcttccttgggtgtgacagatattaagaggtcctgatatcttccaatgttcagtaatctttgatgagtaaatgtgagttaaactaattatgttatcagaatttctaactggagtatgattatggagttaaggcaggcattagtcgtgaaaatttaatttgtgtgtcaatttgttacataactacagattaggtgcaattgtagcgatatttttgtccctctggtgtattgagagctatattcacaagatctactctcatgaataaaacatcactgagtgtatttcaatatcacctggagtaacagaagcaaaaattgcctctgggacagaagaccacattaaagagaagacactctcaccttgggccacagctttacatacaactacagggcctggaaaagaaagattcttcattaagactatttttcatatatcacactaactgtacatgagtccagaaacaaggatccattagacaataaattccttacgtatttacagctcattttgaatgtgtacacagctaatagacacatataaacaaacacactgcttttcaacagcacatcaaaaaagaatagtcatcagaactgaatatgtagacttcaaaatatggttcagtcctgaaacaaaatagcagtctaaggattaatatagattgtgttaaatctagaaaatagaacagaagtagtcaagaaaattagagataccaagggaacatttcatgcaaagatgggcacaataaggaacagaaacggtatggacctaacagaagcataagatattaagaagaggtggcaagaatacacagaaaaactgtacaaaaaagatcttcatgacccagataaccacaatcatgtattaagctcactcatcccgagttagacatgctggagtcaaagtcaagtgggccttaggaagcatcactataaataaagttagtggaggtgatgggactccagttgagttatttcaaatcctacaagatgtgaaagtgctgtattcaataagccagcaaatttggaaaactctgcagtgg

SEQ ID NO: 46672 - DNA, 755 bp, Bovine  19866881365437
ttccaaagcactctgctagaaaggtagtatttggccttatagcactagaatcaaaagaacaggcagaaataattagtctcaaaataagcacaaatatagtcaccttctcaggagaaattcacattatatttttacctgagggatggtggagacagatgagtataactcaaaactttcatttgaaaagcattactcatattctctcaatcaaatcaacttcatctgagtctttgatcctgtaattatttggcttcccctacatgatcggattcctcaaggaatctaagaattgtctccaataggagccacagtgaaaataaaccatgcagggattcaagtctctgaaccactcagtcttccacgaacaaacgtctctgtgtcatgtacctgtctgggaattctcgagggagggcaggcaagctctccacattggcaatactattgttgggacactgtattgctcccggcttgcccatctgatagcctctcccagaggaagagctgcaggaactgatagacgctttccttccacttcatgcttcttgaccagtgaaaacaaagttgcagaagcggaaaaatcagtaatcacataacaaaagacctcaggcataaaaatctttcactttggacagtggaaacttgattttgctacatcctctttgaattttgcttagaaatcacaaaaaccatactggaaaaagccatcaaagaccacgtgtcctgtttcctgcccccagggggtctgttctacatgt

SEQ ID NO: 46673 - DNA, 1508 bp, Bovine  19866880404712
cgcctccaggcctctttcaggctcttgggagccggaggaagaggtcacgctgtcagcgctcgccttttctgccagctgtgcgcctgtggtgggtacccccagaatgctgcagtggggaccggagagctttgatgtgcaggtctcacgtgatgctggtgagaaccggcccccatgaagcgcttgttctgggtctgcattgcttttatccagtcctgatgaggtaggtactatttccacttttcagatgaggaccccaaggtacagagaggtagagtaacttgctcacggtcacgcagccactgagcagaggagcagacgtgggactgtcagccattacctgagctgtcccacccgtggccgcccgccgcacatggctgtgagcatccgggatgtagctggccccagtggagacgtggtgatttcaatagtaggaaaaagaatgtgaactcactatttttttatgtttattatacgttatgtgtgtgtgaagtcattcagttgtgtccgactctttgcgaccccatgggctgtagctaccaggctcctccgtccatgggattttccaggcaagagtactgaagtgggttgccatttccttctccagaggatcttccccacccagggatcgaacccaggtctcccgtcattgtaggcagacactttaccgtctgagccaccagggaagacaccagtagttaggactctgcccttttctttttcaagggttcaatccctgatgggggaactaggatcttgcaggctgcagggtgggaccaccaccgcaacaacagcaacaacaatgaaagcccttatacacagcacaagatcaatatacaagttttctaaaccctggagaccaaagcaagtaaaataaaggctatcaagacccagaatctcagaggtacgtgctcacatgatttctttacaaagaagtaacaagaggttttgctgtttgttttttgttttttaggaaatgtatagttgtttacagaacagccagagtaaatgcaacctgatgtttcagcttcaggcatcatatcccagacatttctgaaacccacagagggtcgtttttacttcttcagaatgtctccccacctcccaccccatctgccttcctttttcctccagtggaagagtatacacaaactgtacctaagaatattgtataaatgatatgccagtgtagaaaacacattcctaacacagtctaaagagtgcaggattcatacatccattcattcaatgaatgtttactaacaggtactgttcaagcagcactgtgtgagtgttgatggcaaaatggtacaaagcaaatgcagccagacctccgggaagagaggctgttacacgtgaaccaggcagaggcaggaaaaatgcagcacaatgaacgctcttagtgaaggggtgcactgggggtggggccaggggaggggtgccttcctcttgagagtggggagagaggggaagtagtttcaaggagctgacagccctcacattggccactc

SEQ ID NO: 46674 - DNA, 926 bp, Bovine  19866880478889
cctgcccttttaatgagctattattaaaaccagtggctgacttaaaggcttcctaaattaacactgagaaacttggctttcctagttgggtttggggagagttccagcagtgtggcccactcctggttattgataacttttggaatcctgctgggttggcctgcctcacgcctacaaagcaaggaaaggtgaagacaagtaataatggagacctaaaatacatcatcaggaataaatgtgttgtgaggaaattccaagctttattaaatgcacttttggtaaaagaagccctacagagaatttcttaataaatttcagagaggggaggtgtttggtcgctggagtagcctacataagcaattgtggtatttctggaatgtcaaaacggcagattgctggaggtgatcactcagcctgtatcacaactgtttcttaggataggctgaggtggaggacagtggtttcaggttggctgagactcctgttcttgtcttaaaggattctgtgagggacatggactcctcagtttggaaagagcttgagagtatagccattcctacatggagctgatcttcccgcatgtaaaaatctgtggccggaagagacactgtcctgatattaaacaccttggtaactcgttcccaagtccaacaacacccacagccaggaaatgcttcttgatgtttagcctaagtccctcatgcttcagtgtaagctcatttcctctcactctgtccaaaacagaaatagggaacagctgctctccatccattggttcatgctcctgaggacctttacttcatccattccctaagtcttctcttctccagaataaatagtcgaactcccagaaacattctctgagactgacccaaaccacagtgtccaattactttctgagtgcttcctttaattccaacactgat

SEQ ID NO: 46675 - DNA, 789 bp, Bovine  19866880502712
gagtctggctggctacagtcagggcgataggatccaaagggtaggacacaactgaagcgactttgcacacacacacacacacacacaaggaggccaagaaccctgatcggtaacactggtgattctctgcctctcaccctcctctggctgaaaggtcagctccagaggaagacgtatctctggcacgagcccagcttctcttcctggggtgccctcttttttgaattaagctttgtggaggattatccacactgctcaagtcagaaggggcctcttagagagaaatgctaccatgggcaaaataccttcaattcccttaaagggaaaaaaaaattccttttggtctacagatgggtaattgtgttcactgtttccaaatgtccacatgccagcctgggccagctttctactgagatcaaacggactcccgggtctcctttctactgatgtgggtgtgcctttagccatggtgtaaaaagctgattcctccacagagtggactgggcagactacactgttcacacggcaaagagatgaagaatcaagccttttccagagtcagacaccagaagtcacaccccctgtgaggaactctcaggctcccagatcctacagtctaggttgcccaacacatagaaacaaacctggaacatccttgagctcaggctgtgaaagtgttagtcgctcagtcatgtccgactctttgtgaccccatgaactgtagcccaccaggctcctctgtccatgggggattctccaggcaagaatactggagtgggttgccatttc

SEQ ID NO: 46676 - DNA, 2325 bp, Bovine  19866880510016
accctaatgctgggaaagattgagggcaggaggagacagggcaacaaagggtgagatggttggatgacatcaccaaatcaatagacatgagtttggacaaactctgagagatggtgaaggacagggaagcctggcgtgctgcaatccatggggttgcaaagagtcggacacgacttagtgactaaacaacaacagaaggtggagacttcagctttgcttttatcttttcagtatctagcatggtgccatttattgagtagacactaaaaatgtgttcagaatctgtctgaatggatggatgagtggatgtaacacacacaaatccatacttactaatcaccccaattctcaaaagtacttatatgatacatataagtctagaaacacatgggcccctttgtataaatgcctctcttctatttctacctccacttccaacctctccacaaagctggtttgggagcatcgaacagttgagagataaagaactgaatctcatttccccctgtaactcaatgtgtgaccttgcacaagtcacttgttttctcatctaaattatgaggggaatggcctggatggtatttgagccccttttctgtcctaaattcccataattctatggctatctacctaccttaatcagacttatctaaataatcacaaaaaacaccacttcatgctgaagaaacacagtcataatagactaagcaaaaccaaatgcccttcaatatcctgttgtgaactataaaatgtcccctaaaatcacattttccccttgaaacaggatgtaagaaaaatattttcctattaaatccttttaaagtgcaagggaaagcatttactctgtgatttgccgtccaactcaataaaaaggggaggattcagccatgttaattacagaagatactgtcagaaaagcaaaggcggtggaaattcaggttggaaaccaagataccacgccagcaacacgatgcgcgagttttctggaaggagcttccaagtgtgtattgagcagtttatttctgccattacgtggggaaaaccagtaaatgagtttttatgaagtgatttatgaaactcctggggtggagggagggagaactgggaggcagtggcaccaccatacaaccctgtgggggagaggggagagagagggcttgaactttggtagctgttcattacattgctgcaagctgcatcctctgaaatgggttaagcaaagtgggacactccttaaaagaggtaaaagaggctagaagatttcagaggaaatcttggtacttgagatacctgaaagcctcctgttagattagagcttttaagggtagagattctgttttccttatttctgtagtcccttggagtgttaggaacagggctagaaacattgctccagaaatggaaaaagaagaggtggatctctgtgttcatccaggaagacagaaagaggtgtctactcagctcataattagctctcttttctgttggagtgaaccccctgctctgtgctgggcttagtcactcagtcgtgtccgactctttgtgaccccatggactgtagcccgtgaggctcccctgttcatgggatttcccatggcaagaatactgaagtgggctgccatttccttctccaggggatctttcctacccagggattgaagccgggtctcttgcattgcaggcagattctttaccaactgagctaccaggaagccccgtggtaggcagaattatagcccgccaaggatatccaagtctcaatccctggaatgtgagagtacttggcaagggggaaccgagattgcagatggaattgaggttgttaatcacctggcctccagatacagagattatctcagactaccaggtgagcccaatataattacacatgttcttaaacatagaagagagaggagcagagctggtgtcacatgatagcttgtaagaaaagtgatgcagttgtcagaaacctatttatcttgtgtaactaaaattttatacctgttaattagcaaaccccctcccccagctcctggcaaccactattcttttcttccttctatgggtttgaccatgttgttgttattcttgcttagtcactaagtcatgtcccactctttgtgaccccattgactgcaagcacaccaggcccctctgtccatgggattttccaggcaagaatagtggagtgggtagccgtttcatcttccaggggatctttatgaccaagagattgagcccacatcccctgaattggcaggcagattctttaccatctgagccaccaaggaagcccatgattattttagatacttcatataagtg

SEQ ID NO: 46677 - DNA, 3223 bp, Bovine  19866880666663
taatgtctttgctttttaataagctgtctaggttggtcataacttttcttccaaaggggcaagcgtcttttcaaacaaagcatagtttgtttcagtcctttgtaaatggcttctataaggttatgtattggtttttctcttctggtgttctgacctcatggtaggccttagatcacctacctctagcttatacctagagaaaggaaatagtacctggagaaggagcgtaaaattacgttaaaaattgagtgtataagtaactttcgaaaagatgcttctcaagtagcgattggctgtgttcgatttggggatagcagaatagcgctgatgtggtttcccagcgtgggctgtcgggcaggcgcccaggcccccaggggatgctcctggacagggggatggggctccggagccctcaggtgacacggcacgtggagaccgaggctgcaggttggggggctgcagcggaggggcgtggaagggtctggaaccggcatgagtgggtgacagcagggcgcagccgagttcacaggaaagcggggtcgtttggcacttgggggcggcggggacatcctcccgaacgtcctcctctgaagagcgccctgtctgtccctgcagggaagtgtttcggagggtcgggcgacctccgcaggcacgtgcgcacgcacaccggggagaagccgtacacatgcgacgtgtgcaacaagtgcttcacacgctcggccgtgctgcggaggcacaagaagacgcattgccgggcaagtgacgaggggccgggcgccctggaggcgctcgcgcgggccatcgaagccccggacctggagcggtcccagagctccgactccttctcccaggacgtgtccgtgcctctgatgcccgccgtgaccgtcaaaatccccgcgcacccggtggatgagaactcggtggcggggtttgacagcccctgtaagttccagccggtggctcagccccagcacgggccgagtgagtcagagaagctcagcctggagccggtgaagctggccaagcccccgcacgtgccgccggcgcagcaccaggcctacggctacccggacgtggacgccccagccggcgctgagccgctgcaggccgacggcgtggccgccctgcgatcgtccctggcggccctggaccaccccccctgcaccgaccccctgggcagccgcgccgctgcccccgcctacaggaactcggagggccagttcttttctagcatgaccctctgggggctggcgatgaagacgctgcagaacgaaagcgagctagaccaatgatgcccctgtcgggtctcactcagcgtcgggcgccggggccgggcttcggggcaggacgccttctcaccagctccagacagagcccgatcctgacctggaggggctgagcgccccagcaccttgagctcagcgtgcggaagaaagcctcccggcccctcgcggaggggcacgtgggactgaacaaggctcatggaccgggcggtatggactgcggggaacgccgcacattttggtcatggtaaagggaaaatacacatctataataatccagatactatttttgcatttttacatggttgaaatttgtagcattttgtatttttatttacaaaaaaggttttatttgtatagggaactcatacaataatttaatttgaataaatggaagttgcctttctgcatactattgtgtttcctccaacattcttattaacctaaagaccatgtggcggtggtggtttagctgccaagtcctgtctgacccttgtggaccccatggactgtaggccaccaggcaagagtattggagtgggttgccattgccttctccaggggatcttcccgacccagggatggaacccagatctcctgctttgcaggtggattctttactgactgagccaccagggaagccctaacctaaagaccatgctgctgctgctaagtcacatcagtcgtgtccgactctgtgagacctcatagacggcagcccaccaggctcccccgtccctgggattcttcaggcaagaacactggagtgggttgccatttcctcctccaatgcatgaaagtgaaagtgaagtcactcagtcgtgtctgactcttagagaccccatgactgcagcctaccaggctcctccgcccatgggattttccaggcaagagtactggagtagggtgccgttgccttctccgatagtggaataaaaatcaacatcaggatttccctggtggtccagtggttaagaattcaccttccaatgcaggggacacaggttggatacctggtctgtaaactaagatctcacatgcctcagggcaactgagccaaactacagagcctgtgccccacaactagagagcttgcctgccgccaccagagaaaagccacacaccccgattctgcatgtgtaacgaagacctgtcagaaccaaataaataaattgaaagcttaaaagaaaaagtttttttttttttttttaaagggactcccctggtggtcctgtggttaagaatccacctgccagcacacgggacatggacttaatccctggtctgggaggatcccacatgcaactgagccctcaggccacaactactgaagcccgtgcacctagagcctgcgctctgcaacaagagaagccactgcaatgagaggcccgcacgccgcaaccagagagaagctcccactcaccgcaactagagaacgcccgtgtgtagcgacaaagacccggtgcagccaaaaataaataaaaagcgtccaggagggctcaccctgaggatgaatacctggttcagttcttccgtcatcctggacagtggcttcaggaacccacagatcagagcctgggtcctggctgccacatcccagtcaggtcacgggcaagctcctcaatctcccagaaacttctgtgggttcacttttctgtggtggtttagtcactaagtcatgtccgattcttgcaactgcatggactgtagcctgccaggctcctctgtccatgggattctccaggcaagaatactggagtgggttgccagtgccttctcccacttttctgtagtgcgaggtgagtagctttcggtagtcttacagggctcaaatgatctcctcatccacttgaaaacacctgcccagggcctggctgtcgacagcttctgaatgcatccttcttctcagccgcccagcagagccgcgcggcccccgcagg

SEQ ID NO: 46678 - DNA, 3251 bp, Bovine  19866880724602
tggagtttataacatgatctaaatatagtgctaagaaaataaaaatgcaagcaaagatgggatcctgaccaaaggggaaaaaaatctaagttatcagagaaacacctgagtttgaattgattctgctacctacagtgtgacctggggcaagtcacttaaactccctgtaactcatcatccgtgacatggatacggtaatatcacccacccagagctgttgaaagatttaattatatgtatacacatgcatatgctgctgctgctgctaagtcactttagtcgttgtccgactctgtgcgaccccatagagggcagcccaccaggctcccccgtccctgggattctccaggcaagaacactggagtggggtgccactgccttctccacgcatgcatatacatatacacaaaaggcttaggacaatgcccgagcctgctaccataacagtgcttcggaaccactccctctttttccagacccagtgttctcaaacatcctcaaatagtagagtaccaagcactttggggggacctcatgaaatatggataaatgaggcaaaaaattttgttgttcagtagcaaagtcatttcctactctttgcaaccccatagactatagcacaccaagcttccctgtccttcactatctcttggagtctactcaaattcatgtccattgagtcagtgatgccatccaaccatctcatcctctgttatccccttctccttttgccttcaatctttcccaacgtcagggtcttttctaatcaattggttctcattagaaagcaaaaaataaaaaataaaaatagccatgccctataaaaatttatgtcaattctcacagcatctaaactagaatggagggtgatatgggccaagaggctgaagaaattctaggcagggacagcttaacaatgagaaaattctattaccttaacctttctctaaaactgagaagtatcattccaattttaactataaagtctccctctgttcaggataaaattggatggagcagggcaatcctataatgttaccattagtatctgatgtcaatgtgatgccagatctcaagagcagtgttgttcaaactatccaacagaactgagtctttacctacctttgatctacaatggagaaatctaatatatggatgaccacaggcctccaacaggtcaccaggaaggcgcagcagcaaaggtcatatttcagcggctcacaataccttctctgtggacaaacaatgactgaccttcccatcaatgtctgacctttcaactcttgacaaatgtatatattttctcagcaattacaacttaagctactaaaggggcagtttaatcacttttatcaaagggaataaattaaagcttccctggatcccagaacaaaaagagctcaactagcctttgcggtcaaagaaacctcttttttcactggggcacacagcttttctcagaaatcctcactgtttgaaagcaagatggagagttagaaggaaggttcagccccaaattacagaagttaaaaaatataaaatctaaaaggacagtctcagagtatctattaataagtagatgtcttttttttttttaactgagggaaattattattctgatttatctttaacatcattcaagactgaaatctgtgaaaacttggagatgatgttttccagttttataacctagtggtaaaccccagagattatacagctattttgaggagctagatacagagatgagctttccaggtggcacagtggtaaagaatccacctgtcaatgcaggagatgcaagttcaatccctgggtcaggaaaatctcctggagaaggaaatggcaacccactccagtattattgcctggagaatcccatggacagaagagactggcaggctatagtccatggggtcgcaaagagtcggacatgacagcatgcatacatgaagatacagagatgaaatttagtttcagtgcaattggggcaaagtaaactgttcagagtttatcacctcctgctgtctcccatgtatgtaggaatgggtgtcaggtgaaaggtaagtgatgttgctaaaattctgcctctgttcacaggtaccaaataggaactcagagacagagttttgggtgaagtagaaaagaatggttttattgctttgccgatccctagattgggaagatcccctggagaaaggaaaggctacccactccagtattctggcctggagaattcagtcggacacgactgagcaactttcactttcaggaaagaacagttttattgctttgccaggcaaaggggcccacagtgggctaatgtcctcaaaactgcgtgtccccaactggaggggttagtgaagagttttacagtgttcagggagcagggcgtggtcaactcatggacattctgattggttggtggttgaggtcaccaggagtcagtatcattaaccatcttccaactggactggggtctatgtgcttatggtcagcatgaagttaaccttttccacctggcgggggtcttagtatctgcaaaacaacgcaaaagacatggctcagaatattatctatagtccttgaggaagaactaaaggtctttgactttaatggctaaagtattaatactactattttgttttgctggactgttttcctttctttctgcattttctcacttctctggccaattttattctttgaccaaagttcttctacagacaaaggggaaggtggagaatacagacgtgggggctctattctgggaaggcctcacagggtcctgctcagttatctaacctcagatggattgttttgacttgaataaaaggggtaagagaggttctaggctaaggttacagagctagcaccacacaggaaattagttaatgcttcacccagagacaaacttttacagcaagtaaggagaaaatgaagtgcacaaagtaatacagggtgtcatgcctgtggtcatgttttttaattcaattttattaaaatacaattcaaactttacagttattgtattaagatgggaaagaccatgaaagtcttctgtgccatgcaagtactgtcaacttaaaggtgaattgtagttttataaaatatgattgacctttctttaacaagtggaaaacattagcatgtcatgtggcaatactgaaaaacaaagcattaaatcccctaaaattgtttttattgtataaaaagaaaatcaaaagaaactctataggtattcactaaatata

SEQ ID NO: 46679 - DNA, 1696 bp, Bovine  19866880767847
gaacagaaggcagatgagtggttgccaggaggtgggaggaaatggggagtgactggttaatgagtacaggatttccctttggggcgatgaaaatgttctggaaccagtagtggttttggctgcgcaaaacagtgaaatcactcagtgtcactgagtcacacacttgaaaatggttaatttaaagctaggtgaatttcacttcagttacagtaataacacattgcttatggctaatgatgttggaatatttgtattggttaaagacgagatggtgtgataacccagcacctgctctcagccccattttaagcccttgacagcaacctgatcatggagttcacattgttgttcccattttgcagatgggaaaacagagggctaaagggcatacaaggaagcacggagctgggatttgaacacaggcggtccggctccagagcccacgtgagaaagcacaagagagaagcctcttgggtcacaggactggactcagtgccagggggaccagggtgtgaacccagcactctctgactttagatcaggcccataaactctcagatcctcgacatcacaccccttgagtggggtgggtgtgcctgatgctgccagtggggcagtgaggttgaggtcctgtggagggaccacctgccatgatcatacccactctgctcacaggtgcctctcctgggctttggcatgcttgaaacaacattttggtagcttctaattctatctccaagggttctctaggcaatctccatcaatgaaaggaccgcgtctttcatttttgccaagggctctgctcccagagacaggcccatgtaattaccaccttggccccctgctgtgtggtagacagtcactggattcttttacgaatcctgcaggagatgggattggcctcctgcagggaggccaaacccccaaagtgaatttataagtgcaaatcagggataaaggtaagggagtggagagtggcccacatgaattgctaaatctggctcccagaggggcatcatctgtctggctacattctggaaacatctgcgtggaccacttggacctgagcatctctctcaagccactgatggaattctgtttcggccactgaatgtttctggggatggtggactggtaatcttgggggcctagcatggtatgtttagtcagggaagccagtgtggtcccaggaatgtgccattttttttaacacaaaatatttgtttttctgtcttgtgggcatggagcctttcttgagccaaaatgtatgtagctcacccataaaaagtgctttttgtcagaaaggaaggatgaaacccctgtctactggatgcctgcctcctggcatgctctgctccaggcaggcccatgagattaacacatccatctgggaagtggttatttttgcaggtgggaacctgaggctggggtggtggtgggatctcctgtgcgggatcacaaggagagttggggtagaatcaggaaaccaacccgctctgagtctgaagagtgagttccttccactctaccagggcttccctgcctggggctgggagatgactaggaccatgggcctgggggttggccaatccctatttcctttgcgtggatgggtgataggtttcacatatgacagccctactgttctgtggttgtatgtgatactctagccaataggagcaaaatattttaaagg

SEQ ID NO: 46680 - DNA, 1078 bp, Bovine  19866880788133
attgccatgaacagagatttgttgttctttcacttgctaagttatgcctgactcttttgtgaccccttggactatagcccaccaggctcctctgtccatggatttcccaggcaggaatattggaataggtttccttcttcagaggatcttccagatccagggaattaacagagacagaggatgatcacgatgccggtgatgagagcaaatccttaacgtaccacttactagcttacttattcttatcattcccattttatagataggaaaaatcaaggtacagaatggttaagacacttgctaaaagtcacacagccagtaagtaaagagcagaagtgaaacccaaagagcccagatccacagtctgaaatgccacccacggagagagcagttatgccggaaatgcctgcaggggccagacaggcggaagtacagagcagctgcaggaactctggctttgagaccagaagtggattcaaaacagtttaggagctatctctccccctgggctcttggcctggccagacttgcccacgaggccacccttctaactctgccttgttggctggaccaacatcctctcttttctccccttcactcactctcacccacgcatcctccttaagtaactcaatctcatcccaggcatctccaagcttactttatacaatactttctgtccttggagttattccaggtgcctcaccaccattctgttgcctgcccatcaaatttctggctcccccttcacatgggcatccccaaagttcacctttacatacagcttccctaagaggaatttgatttagagttgaaaagcagatacagtgacaataatcatctccttgggcagcagtatttttcccaggcagttgttttcctccatctctgctctagctcgtggagctggaaaatgtgagggctccactcaaagaatataatttccataaaatactttccaaatttattaagggagcagacagcaaaaggaaacccacaattaagggagtttttgcatgcactcagtatctttccactggctggagtatcatcttcctgaataatgaggtctggcaaa

SEQ ID NO: 46681 - DNA, 755 bp, Bovine  19866880968103
tacttggtgaccacgggtgttacctggagactcacgggcccgcctcctgcgtcagtgtgtgtgtctcaggggccgcttgtcttgcagaacacccagtgcatcccagaaggcttggagagctactatgccgagcaagactccaatgcccgggagaaattttacaccgtcattaaccactacaacctggccaagcagagcatcacccgctccgtgtcgccatggatgtccgttctgtcggaagagaagctctcggagcaggagaccgaggccgcagagaaatccgcttagcgagatgggcaagttccttaatggtgtcgcttgaaggtaacaaggggactttgagggacatttcatcaaatataattactgataatttatagaggttactcatgtatggtgcaaccgcttctgtttgctaattgctgctttgcaaatacaacttgctgcggaccattcacgggcgtaaagtcaagtgcgtatcagcactgcttagggagctctgccaccactttccatgttagggaatcttaatttagtgactttcctgggatttattggatgctgtcaaaaaaaaaaaatttacactggatatgcaaggggtttgaacttcagataaataataatgcattttgtggaattttttttttccttttaaaccaccttgctgtttcgcaaaccttactccacagccacatctagagtgatccctgctgtgctaagggcaagctgtacttcacgtttcttcccacctccca

SEQ ID NO: 46682 - DNA, 2656 bp, Bovine  19866880980769
ctctggaaacccattcttaagattctgacagcatgaactgtcctactctttgttgttttcattctctcttttcttctctttcttttcctatacttaaattctttagtaaatgttactggtaattatgggttctttatgactatgatcatatctgcctcaagtcatttcaactatcctgcctccctccctacagaaagaagctgtgacttgataagaatttccttggcatttgagctggatgtcttactccgtgggcctgagaggggccccctatctgctgggatgcaagcaggagctggatgtgagtgttttctggggaaaaattttagatttaaatcgacctcaaggatgaaaccaataaaagtgcctggggatgcctcgcctttgaggttagaaacctcttgcattgatgtttgtgcttctgagtcaccagtagtcgagtctgcagaaatgtcttttctgggacaggaaatcctcaggctaaaatataaatgctctacctgagtgtgctccccagtcaggcttttgaaaaccaaaaaggagatgaaatcacagaccagtttaaaacatgcctgttcatctcagaaaaaagtctctctgctgaattctttagattctcaaagcaaaaatgtctgtgtggaattaatcactcccaaccccacccctgcccctaactctgatcatgttccaaggatatctttaataaaaaaaaatttgtttgaaaatttttcaaaaattttttttgaaaattgaagtatgattaattaacaacgtgttaatttccagtatacagcagaatggttcctttatatatacatatgtacctatttttttcagattcttttccattataggttattacaaaatattgagaatattgacctgtgttatacagcacattgttgctagttatctattttaatatacatagtagtgtatacacacatttgttagtcacaaactcctaatttgtccaagtatgttttctcttttccttaaaaacaggagactcttcatctttgttcattgtacagctcaagctggcagttaggaaaagtcatgattactgaaaatacacaagaagcttcattactgtgaacacgtgattgtcagaccatagctcagttcttcccataccttctgttgccttactcctaagaatcccatgctaatgtgcatctttcaggctttctgcgtggaggctgagattttagtggttggcaacaaaagaaagggccttaggaatgcttatcctttgcaaaacagaggtttgtccagtgatggctgtgctgcgcttgtagttctcaggtgctacacaagagggcgcttctgtatcccattgcacaaggccctgaggataacagggtgttgcgtggggcagctttcagtaaaagtatttcataaccagggcctgcttactctaggccaaatgacttctgaccgcaattaagaaaaaggaaagttagatttgtgcagattcctctcttacttgtatactcaaattgaatggaattttgcagtcccatgacagtttctttgagctggggccttctaaggaaggaatcagggttgtccagctggaattgcttccttttgtacagccagagtccacagtaggcaaaactaggaaatggccaaagatcgtcattcatctcaaaatgttgccaggaagtaactgttctgaaacgagccctccctccttcctgttcttcattctttatctcatgctccatcccatctcctatgttccagactcaatttctgagggagaaccaagccctgtttttccatttaaaaaatctgattgaattaattccccactgagacatgaattaatcatattattcctatctgaatgctttcagaattaataaaacaaacaaaaatacacttacttgaaaagaggatacccaatttaggctatagtttatagaattcagatgttggtacagtgatatgagaaaaaatgtttatgttagctggttgttgttgttcagtcacccagtcgtgtgcaactctttgctaccccgtggactgcatgcagcacaccaggcctccctgtccctcaccatctcctgaagttcgcccaagttcatgtccattgcatcggtgatgccatccagccatctcatcctctgttgccctcttctccttctgccttcaatcttacccagcatcatggacttttccaatgagtcagctgttcacatcagatgaccaaagtactggagcttcagcttcagcatcagtccttccaatgaatattcaaggttgatttcccttaagattgactgattcaatctccttgctctccaaggatacagcaagaggttagctggaggtggattgaaatccagatgttatcatggggtgatgttggaatcactacaataatgtactcagtatacctattaagtgcctacagtgtgcaaagcaccagggatgcaaggatgagcaaaaccagacagggaccctcttccaagcatatagtcttagggggaaaggctgacataaatcagtcaagaaaatgcgtgtcaattcacacctggggtcactgccactatggtaattactagtgatgttctctggagaggtggtctccccatccctcatcatacatggatagggttgcactttcccattctttgaagttagg

SEQ ID NO: 46683 - DNA, 1053 bp, Bovine  19866881024005
tttttaatttgttaatatggccgaatacacaaaatgtcaaacagctggctatgtggttcatatgataaattcagtggcactgtgtgcattcgcattgttgtgtaaccaccaccactacccagttccagaaccttttcatcatcccaaacagcaactctatccattgaacaataacccccattatccccagcccctcagcccctggcaaccacccttccactttccgtctcggtcaatctgactgatcttggtatctgatgcttctcagcaacccaatggtccataaaccagcagtgagagagccctgtaagttaatgcagggaaaaggcaccataaggcccaggccctttgttctgggcctaagtcaggttcacaggtgaatgaatttgtctcctgtaaaaatactgagtcaggtaagttgtcctgtaagtttgttaaagacattttatcaaataaactagccaatgtatcataacatatagacctaactgtcctggaaagacagaagaaacaggcaaagcccaagcaggggaccattttgcacatgggcagaatgctgcctcagggagtcaatccactagaatacgacttgcagcacatatgacagctgagacttaatttgatgattcaggattatcaaggaaagagtaaatactgttccatgtatcatttactagagtagtaaaacagtatatatttaagggggaaaagttctgaaaaagtgcttgtgtgtgtgtgtgttagtcgctcagtcgtgtccgactcttgcaaccccacagactgtagcctgccaggcttctctgtccatgggattctccagacaagaatactggagtgggttgccattcccttctccagaggatcttctcgacccagagatcgaaccctggtctcctgcatcgcaggcagattctttacctttagagctacaaggcagtcctgaaaaagtgcttcaggacagattattccagttaaccagaaaatgtgtgtagaatacttaaatgaaatactattgcttgatcttattggttataagtaaatctttcactgagg

SEQ ID NO: 46684 - DNA, 2558 bp, Bovine  19866881045228
tatttcagctttaattctcttactgcaattcagcaatgggaacattgtcaacagctcccttttatttgttaaatcaggcctctggacaaagaatgactcttttctcaaaacccaatttttaaaaaatgtttgttgttattttaatcgctcagtcatctctgagtctttgggaccccagggactgtagctcgccagactcctctgtccgtgggatttcccagccaagaatactggagtgggttgccatttccttctccaggggatcttcccaacccaaggactcaacctgcatctcctgcactgcaggtggattctttaccactgagccaccagggaagcccaggaaatcttagggaatgagtcttattgtcctgactggagcctgatccctgcctatggtgtgtgacctgaagggtggaggatgttacatggaagaacagcagcttctgctgaaactacgttcgaagtcagaggcagtatcagcttccaaaaggaggaaggtgctattgttgatagaagagtggtttgggaacaaaaaaacaaaccaggcatccaccacaaccatttaataatgaataataaacgtatcacagggcaaacagtcagcaaattaatatttcctcatcatattggactgggtttcctttactacatttgaggcacgtttgtgagctgagtattctgggaagcatctgaatccaccgggagatgagtagaatttttaggtaggtgggcaggcataacatctatgcctggctattttgtcactaatgtattttacagtgagtttctagatgacacatttaagtaatccacagatgaaatcctggaatagtactactactgtgagattactgcccacaggcagacatgacaaaggactgacagttggtatgctttgtgggttactagcaaaatatacttctaacatgtgactctgcctaagtcaacggcagaccataattgaacaaccattgcccaatttgtgggctaacagaaaaccaaatgtttgccttgaaactttccaactcggttcaagaataaaatccaggaatatgataatatacacatcaaatggacatgaatgcattcaactcaaaaatttaaggaaggacgcagtgtaagtttaaaatttttagaagtttcccaaagactaagaggagataggagacaggaaacctttccttagttctcccattagcaaatcccagaaattacattccatgttagttcagaagcacttgcaccttgagagtaagatcaggaagaacctagacgccaaatcccagctgtaggcacgccagacctctcagggcctcccattcagctatgatctcacagaaagtaggctcaaagacctgaccgcaacattaccctagaaaaagcaaccctgcatagagccacaggccaatcctaatcaaaggaaggacagagaaaaaggttgaagtgacggaggagtgtgggggacttcaacctgcagagtcatctcagtcagctttctctcctcagttcctgaatcttactgtgttagagctgactttaggggctacatttgccagcagaatatgggaatgctgatattaatattttcaaagtccatcagtagattacttaaacatggcaccttgaatatctctaaatattccaaggtcaataaaaaatcacatttctacgttttataacaggcacccaacagaaaggaataactgatgagattcttaatcctctgatgagtaaaaagtaccccagcactcacgacaaagccagaggtctgcagtgtctccttgctagcacagtaataacatgctggttggctacgatgaagacaaccataaacttctaacttttcttagaaaagacggatgttcaatcattgcttctataaatgacataaatttttttctttttaatgtcaatctgagggcagggctatgatgaaaacatggaggacctggaagaaaaccatccaaatacgtaagagttgactactggagggagaactctgagattccagcttccactgagggagagaaggggcccgaaggagacatgatgatcaaaggagccatgattatcagccctcagccttcacgatccatgaggccaggagttgtccattatgacgtctctgcttcgagcagcaccttgaaagtgctcaggaactctttactgagtggtcaagtaaaggcttcaaggcttctctacaaatcaggaggactcgtagatacacaaatcaaagaaatctttctcagtcttttcactgcagatgaggaaagcagttgcataaacattatcataaattaagcaatcaatttgtcgaacacagcaacagacagtgcagttggaatggaaagcaaactctgtgaatgaaattcatcctatcattgttctcattttaaaaaaactagagtaaaaacaaagttctttcagctatttggttatggcagaaagagaatttcagagttagatatgatttctaccttttaaagctctttcactcctgtctttcaatattaagaacccgaaggatggttcactttgccctatttttcaagaca

SEQ ID NO: 46685 - DNA, 1036 bp, Bovine  19866881055071
ctcccccaggccatcaagaacaacgcaggcttccgggtgtgggtgctcttcttcctggtgatgtgctccttctccctgctcttcctcgattggtacgacagctaggcggcccgggggacggcgccccacaccggagccactgatgggagcggggctgagatgtgtgctcacagaagggacaccagacctgtggcttaagcattcagtaatgaaaaagaaaaccacacaactgaaactggtctgcgctgcaatcctgaggccagagggaaggagcggggggatggttattcctgcacctgatggggctgctggggggcgggggctgccccaggtagggggcctggtgggcttcctgctccacaaacgtctccaattcagaggaggcagcggccattccccaccccagcaggaagaacgcggtcagtcgctcctcagggcagatgacctgcgctccctgtggtttcctgtgtgcctgagcaactgatgcacagactcctgagcagaggaaaagccagctcgccttcattcaccctgtgaaactagtatagaaccgcggccacttactgtcttattggtgggtccaaggttaggatgtcactgcgggccacctgcctcctgtcggggaagaaatgtgggcaggggcctggctcctcccagcactttcctgcggcagaggggggcgggcaggggaggcctgacttcctgcccctggggccccccagaagctgcgtccagagaagggcctgggcctctcctcccacccaggccccaggagttgggaacgcccactggtacagattcgtgaagcatctgcaaccacatctgtgcagaaagtccctggtactcgtgggccccagggtatggtcaagggctctccacaagacaggccagggcctccacagggatccttgtgttctttatttgcacagactgagaatgtcgaaagttacacgtgaacgagtttacagtctataaatacacgcctactagaaaacacaaacagggttgccttggcactgcgttgacgtgggctgga

SEQ ID NO: 46686 - DNA, 1421 bp, Bovine  19866881254440
ccccaagacatcaaaaaggcactgggtccagtaatgctggaggcggccgtcattaagccctaatggagtgcttcattaaggccccttcaaaggcccccatttacagactcggagattgactaatttacacattgtgggaaaattgctaccagctctgcccacacccagcaggaggagagacgccctctctctttgaaaggtgggaactgcaatcgggcactttaatggtagcgaaagacccaacccaggccctaacttttggagctggctgaagcgtttgtgcactcacccggaatggtatttgtctttccggaggcagggtgggacagacacaggtgtgcggctttggagccgaccactgttaaacatacctgggtttcaaccccaggtctgtcccattagctgggagtgagcatatgacttagccttcctgggcatcagtttctcttatcggaaaaatgggtatgatcaactcactgctccgggctgggacaagaggtaagagcagggaaagggcccgatgcatgctggctgttctcaccttagcataaacataaaggagagcaaacagctaacctgaagcagtggccatctttccagaggctctctttgtgggattgttgatcaatctgcagggagatgctcgcaccaagagaggcctggggtccacaaacagatggcagtatttgctgctgtgagtcagacccatcggctgttggagaaccacgttatacagccttgagggtagcacataatgggatctatttgtatactttttcctttgtcatcagagcaatttgggaaggacgtaaggaagtgtgctgtctttgggatgctttcatgtggatatatgcatgctaagtcactttaattcttgtccaactctgtgactctatggactgtagcctgccaggctcttctgtcctccggattctccaggcaagaatactggagtgggttgccatgccctcctccaggggatcttcctgactcaggggtagagcccaggctcctgcagcttctgcactgcaggcggattcttcactgctgagccaccggagaagccccactgtgtgagaatagctctcagccagcaaaggaactcgtgtgtcatcagaggcgaacctcagcatggctctgccccggatgtgctaagcaacactgaccacactgccagccctctctggtcagcagagacttccgcagggataagccctgtgatgtccctggaacctctctccagcctgatacactggggtcctcccaatgcactggggtcctcccacctgtcgctactcacagggtggtccagggaccttagcctcactaggaccttgtgagatatgcagtttctcagcacccctccccggtctcctgaacaggcacgatcacggggtctgggaacacgtacagtcgaaggc

SEQ ID NO: 46687 - DNA, 1209 bp, Bovine  19866881343112
tgggctgtttgaaaggcagttctgtgcagctgccatcgaacgggtcgggggcttgtttggaggtttcggctgtgggcggatgaaggccgactgagggtggggcgtgcgagagtgacccgtccacggccctacactgctgggcgcccgcggagcactccggcagcaagtgaggtgggtagttttcactgaggacacagttcgtgtcgggagtcagggtgctctgcagggagaaggtgccgtgacagggcaggcctggaggctggtcaatggtggctgacttcaaaaaggtgtgacacagactgaggacgttctgaacctgcaaacactgggccgtgtccagcatgacttgtatgttgtcctggttaagatccagatgcgacgtgtacatgaagtccaggatctgcccgatgccactcacattcttaatatccaaatgaaaaacatcattcttctggcctgaagagttctgaaagaggctcctgataaaagaaaggatatctgcttacagggttaacaaaccatacattctgatagctttttcttttaagtaatatgcatgctaatgttcaaaatgactatcctttgataaatgctaagattaaaaattaagtatgcttttgagaattccacggacagaggagcctggtgggctacagtccatggggtcgcagagtcagacataactgagtgactgacactttcacacttctatctgcaatagctcggacctggaagcagggcttcccaggtggtgctagtaaagaacctgcctataatgcaggagactcaggtttgatccctgggttgggaagatcccctggaggaggaaatggcaacccactccagtattcttgcctagagaatcccatggacagaggagactggcaggctacagtccatagggtcgcatggagtcagacacaagtaaagcaacttagcacagcacaggacatggaagcaacctagatgaccactggcagatgaatggataaagaagtgtggtacacatacacggtagactattactcagctatgaaaagaaatgcatttgagtccattctaatgaggtgggtgaacctagagcctattatacagagtgaagtcagtcaaaaagagaaagacaaatatcatgtattaatccattatatggaatctagaaagatagtattcaacgatgctatgtgcagggcagcaaaggagacgcagaca

SEQ ID NO: 46688 - DNA, 747 bp, Bovine  19866881480695
attgactacatagatggagaacagattttacacactggaggccaccacaaatgtgttataacttggactgccaggttaactagattttgttcagacctaagaaaaaacaaccctccttttcccctctgtgtaactaattgttacctgagaccactagacagatgtgccaccatttgccactatttagctctgtgagtcggagaaggcaatggcaccccactccaatactcttgcctggaaaatcccatgggcggaggagcctggtgggctacagtccatggggtctcgagagagtcggacacgacttagtgacttcactttcacttttcacttttatgcattggagaaggaaatggcaacccactcccgtgttcttgcctggagaatcccagggacggcagagcctggtgggctgccgtctatggggtcgcacagagtcggacacgactgatacaacttagcagcagcagctctgtgagagagaattcctttcaaaactgtaaattccaaatagactccagaaatcagaaataaattcacttcagcagcaaagaaagcaagtctcagaacaccttcttttaattgtttatattcaaaacttcactggctcaaagtaaacattaccatggattaatgaaatgccactgagttcgtggtttttttttttcccccagaaatctgtatatgaatcatcgggcaggaatggccggacctggacctcacatctctgagcagccattggctgga

SEQ ID NO: 46689 - DNA, 2325 bp, Bovine  19866881519722
ataaatataataaatatattaaaaataacatataaaaataagtttgtcaataaagtatattacttgttcagtcactgagtagtgcccaactcatttgcgaccccatggactgcagcatgccaggctcctctgtccatgggattttccaggcaagaatactggagtgggttgccatttccttctccaggggatcttcccgatccagggatcaaacccttgtctcctgcactggcaggcaaattctttacccctgagccacctgggaagccccagtaaagtatatcagatggtgatgagtgttatggggaaaaacaagaaaaagtaaaggaagggaaatctaggtagagtgtgagggaacaggtgaattataatttttaaatagaggggttaagatggcctcactgacaagatgacatataggacatgcttaagggaggggagctaagagttctcctgacagatactctgggggaaagcattacaagtagagcgaacaagtacaaagcccctaagacaggagtaggacaggagcagacctagcatttgcatgaaaagcaaggacaccgagggtctactggacctctgagcaagcacgtcaagtaggcagtagaatgtagtgtttgaggagaagtttgagctggaaatcaaaatttagaagttagtagaattcaaaaacagatatgcattgttcttcgagcaaacatttaatgagtcaactatgtgccaggaggagtgggagagggagagaggcagagaaactcacctcacaaaatgctctgcaattcaaccccggcttaaccagagcgatgagggaggccaagaagaaagaaacttagggcgaattcccagtcacggtttttagaagacattagtcaaagaaagatttagtgaaaaatgtaagaaatattaaatctgattcctaatctacaagatgaactggagggctgtgcttaacacctcaaattctcgctgtgaagtcattactaacattcttttcattgagttgtcattgagaaactcctgtatatgagtctgaaaatgaatcagaggtaccttactttgcaatagtttcaaagagggaacttcatttgcccagcccatgttaatacagatgctgtagctccctgtacttaccaagcatgatcaaggcccttataagacggtgttttgttccacacagttactcctaaaaatggatatttcatccctaacatgggctgaatataaatctcaaaagaaatcttagggaggacagcataattttgatgcaatcctagcagcaatttatatgaataggttatgcatcaaaagtttgcaagtttagatacgtcgcttgggtacacaagacaggctataagtgtccatctgaacccctgtggtaggtgaatcaacagtccccctaaatctgagtgatggggttcatcgggtcacttgtgtactgaaatatcttaaatatgggactaaaatgtgtaccaataacaaacaacattcacaattagttcatatatacccctaaattagctaagggtctcttgaatagaaactagttctagctagcgttccaaaaatggggagtggggactgaatggatgccaatgttatccaacatgtttgaaagaaggattaaacttcagggtttatcaccctaagctctactgacattttgagccagataactctttgttgtagggaaattatgtggggagtaggagctgtcctgtacattgtagggtagtttagcagcatcccccaagcaatgtctctagacattgccaaatatacctaggaggctgaactgccaccagttaaggacaaccgtttaatgttaagacatgggaagggcaaagacacagctggccctctgagacaactggaagtaggtatttaaaaacttctctgtgagtctgcctgaagggttatcgattctgcttatctttaaaaaaaaaaaaagaccaccaccaaaacaaaagaaaaaaaaccagctcatagtttaaccaatcttttctattgtttgttttggtgtctatttcatttatttctgctctgatctttattatttctttccttctactgactcggggtttactttgttctttttctagtccttctaggtgtaaagttagggttgttcatttgagatccttcttgtttcttaaaataaggcctgtattgctataaacttccctcttagaacggcttttgctgcatcccacggattctggaaagctgtgtttctactttcatttgcctcaagctactctttgacctcctcttctgatttctctgctgactcactggtgctttttggtagcacgctggtttcgt

SEQ ID NO: 46690 - DNA, 1905 bp, Bovine  19866881527291
cgctggcgcccgggagcctcgcagattgccttgagaaacccatacttttatcaaatcgccagatggccccgtattagagaaaccatttatttattttttcccctctgagctgcttagattctcagaagccggctccatctaaccccatggaccttccagtagcatctacgctcctgcctgaaataattgttcctcgggttttactggcgcccccatggctgcttgtaaattcttgctcattcccaccgccccccccccccaccatttggggaaaattttgttcaagaggagagacatgaatacagcactcagagcccacccagccgtgggtgctgagtccactcttcttttaccttgagtcgttcggcccatacagaactgcttgagatgcatccacctcacagacaaaactatggaggctcgaggtggccccctagcttgccaggaatgatgccaacccagggttatctacctcttttcaaggctgcaaataatttggaatctacactgaaaattcctaatagtctgatatgtatatttacataatattttttccctttaaaccagagacttggcaggacctgtgattacgtagaggaaccccagatgattatggtgtggtgtctgggcttcgtggaagcttttggcattggtggctgccttttctctctctctctctctctctctcttaaggtttgtgagaggaaactggtgctggccctaagggggctgaacaagtgaggggctggagagcagagttgaggagcaggaatgatgcaggctggaggcctgggaggggagggggaacacaaacagagaaacgagagttgtaaacacaaatcagccccgtggaggctcggagggttgggcaggatgggaatcctagctggggcggatggaaaatgaagaaggaggttggaatccgctttgaatcctgcaggcgattgactcccgggcaatgggacaggcgcagggtggggtggggggtggcatattctgcctcccacttgaaacgtcgttcccaaaaggcgggggagagcccacaagcacggcgtgtcgggggaagagctcaggcaaagcccaggaactgcagggatgactctgaattccagggaacgcatgctgatgagtaaaggaacagatgcgctcagtgtaccgcgggggcggagaagagctgcccacatctcatcggcaccgcagacctttgcagtcctgggattagcctcattttaaagatggggacgttgaggtttagggagatgaagtcatgggccaaaatccccaagagagtaagtgggaggctgaagtttgaacacttcttcgggttccagaatccggctctcatcactgcacacagataactcccggagagaagcaggggtgggaaggaggctccaaagaaggaggaggagtttgctcctctagatagggtccatggagagtcccacgaagaagcgctggcagaggaattcacccggcagaggggaggagaggtctaggcagagggaaccgtgcaggcgaagggctgggggcttcactccacccagtgggtttgggggcctgacaggagtttagggaggctgaggcagtgggagttcgcgggttggaggggcggatagagcagaaacgggaaccacaggtagtcctgactgtcagcaaggctggcggcacgagctcacatctgtgtttttgcaagtgatcgctgatggaacaacagagcatgcgcacgaacagaacagaggctaggtgtccagcgtttcctcaagttcttggccccgccccccgtttgggtgtagtgtctacgaggctccagtagtgcagaattctgatggaaccaaacgtatgagaggtcagtgagactcaaagcaagtacaaggtaagatggttccatctacagactgccaa

SEQ ID NO: 46691 - DNA, 856 bp, Bovine  19866881536443
agactggtgaccctagcgatcagagccgcagggcatccctccataatttttattgcgttattgcaagaggatggggcaggaggctgttccattcagcaccgttacgacaggctgtttgatgttcacttcactcctttcttaacgggggctcatagccaagtaccataccttacagtccgactgacccgaatcttatttaaaaggctcaaccctgaaaatgaagaaaaagaaatgccacactattggttttaaattggaaagcgttaatagcaaattgtggtcataattcatagtcactgttttggaatttttcctcagggtaaaataatgaattaagctctataatagcaatttaatccattatttcacccacatgagctgttgatacttgttccagaatggctgcggagcattatgtaattcttcgcacatttccattcatcactcgtgatacaggtatattaatacccctgggttaatataagcagatgtttgtggtcaggctgagtggaaccaaattgttttctgatgttacacagagaaaaacacctcctttctgagcccaccttcactttacttgcctccagtgaaaccactgcacttagtaatctatttctttggggtaagttttaaagacatgaaagtgactcctgttcttcagttcttcagtttgcctgaaaagtgtcccacggcccctgtgccgtgaggcaggcccctggaagcaccaggtgggtggctggcagggcctatggtctgtggccatgcttggcttacacattgggaacatgagcattgttgatagaatttgagcgccacacggacaggcctgcccaccctccccgtcatctaggccgta

SEQ ID NO: 46692 - DNA, 1726 bp, Bovine  19866881615159
gtggtcatgcagtcagcaggtgacacgcccagggtcccacagtcagtgtgaagccacctggccagcttgacccggaggcctgtggtcccaactggctcagctgaatgacctgtatcctgcacacttcctgcttttgttcccaaacaggaagcaggtgtagctggttccctgcctgcctgccctggggctctgggtgtggagtgtagcctccaggtgtggcctggggccacctctgttggaatcacctgaggtttgattgtagcagtgggacctcggaccctagggtattgtaacaccctctccagatgattcttttgggtttgtgaccttttgtgggtggggctgcattctagcacgtgggcagggcaggctcagaaaagccggtgccttttgaagatgctgagggttttagcccttctagaatgttctcttggctttttcctgcccacttatgtttctcgaatctctgaatgcacgcagacagtgaggcgtgcttctctggtgggtggtgtcagctggctgagggcggggggctctcttttggaaaactggggtgcatgtgggcagcagagaggaggacctgcacgcacccccccccccaaccttgagggtcagtcacagctctcctgggacagaacatcttcctcgtcctgctggtgaccgggcagcttccatgtggctccccagcccagccgtctcttcattctttccggccccgtgtgtgaagggccagaatgaaaccatgcctttcagctgttgaagcaacaagtaaataacatggcccccttttgtctgtaacttgtgtagttcaggagccggaggccgctgctctgagcctcatctttatatacctttggatggcatcctcgagacgagatgtctttttggatgttgctttatgattatcacccggggattaatctcttggctacgaggttgctaggctggttgctaggtaaccgctggctggggagagggttttctgaggctccttcatatgggattgctggatgagccacccagcggtggcccaaagtctaggcttccaaagaggttggtgtcaacaaggaaagcggtcgcttagttaattggaggtgtgtttgtgccaagaataaacatgggcctaagatgtttctcaaatgaactaaacctaaacactgttttaattgcgtggtcctgctcacgcatgcagagcagcatgtcatggtgttgtgtgggattctggagagcggaggggccatgaggcagattaaaggaagacttctgcttgcgactgctgtgatggagggctgttgacacctctgacatccacgcgtgttctccttgtgagttcagggttcgggtgaacaggctgcaatcccagcccctgctgccacgttgcctttgggcctttaagagattccaaggtcagcctcgcccagatggcgcagggctgggagaacgtcctgggaggagagactggatttgtttgcatgggccctgtgtgctgcactgggggttccctttgccttctgtccacaaatgaatctgttggtagggacttccctggtggtccagcagttaagactgtgcactcccaaatgcagggggcaatgggggggtgttgtgtgtgagcagttagatccctggtttgggaaataagatcctgcatgccacacagtgtggccaaaacaagagaaccaaccaaatgaatctgtgggggtttgtatcttttctcacatcctta

SEQ ID NO: 46693 - DNA, 741 bp, Bovine  19866881847945
tgttcccgctatactgcttaggtctaccccagaatacggtgctttccctcagtgcagacccccagcaactgccaacaacagtgggaggtgtcgcggttacaagtcctaccacatggggcgtctaaactaataaagctcaagtgctcagacgccgctggacagagcaggtgatatgatttaactgctttattccatttagaagtcggccagactttcgaacaggacctcccaaaagggtttataatctggtttaaaggctgcagatccacattgtgcatactttgttatagaaatccttttctaatccagaaaaagaaaatcactcctcccaaggcctctgagtgtcaaatgaggagaaatatctgcgctgcaaagacctaagaagagttcactagagcaacacggtggacccacggggggcttggcccagagggcagcctgcctctcagcttggagcccactccccagacctgcttggggctcttccagttatgttttatttgtgccaaacaccttcacacctgtggctccatgcccctcaccctgacctccacctgtgccccagtgaaccttcccagggtctagaccccagctttcacccgtgtggcgctcaaattctatcaacaatgctcatgttcccaatgtgtaagccaagcgtggccacagaccacaggccctgccagccacccacctgggtgcttccagggggcctgcctcacggcacagggggcccgtgggaca

SEQ ID NO: 46694 - DNA, 1893 bp, Bovine  19866880603795
tggtttaaagaatagaaaaagatttctgtgctaacactaatcaaaagagagctggagtggctatattaatataggacagagtagatatttgtgcaaagatttttactaggatgatagaaggtgatttcttaaacttagaggttgactcatcaaggggatatcctaacttctctggcttaaacaatgaggacatgtgatctcatgcgataggaatgctgtgacatctgcttacagggttggctagttcaacagctcaaagacatcaaaaagtcaggttatttctgtgttttggctctgctatccctagaacatcagcttggtccttaggctctcctccctcataaatgaaagatggccaccatcattctagaagtcacaggaagtggatgaaaagaaacctcttttctccccaattgctctcagctgacttttcctcaagggtcatttatcagcaccatgtcaacccttgggcacctctaaactaaaccaaactcgggcaaagggaaaggtattgctaactggatcagacgagcattcagcaaattttttctgtagagggtcagatggcaaaaatgatagttctgtaggccatatgcagttctgttattgtagcatgaaagcattcagagacataaatgatgacatggcagtgtatctttttacatatagaaacagcccatgcactggatttgactcacaaaagccgttgtgtgctcacccttgatacgaatcacctggagtagagacaggactcccattgtcacgggctgggtgctaaaacaaaatgaatattctcttagctaggaagttggaaggcaaggctgttgcgttggcagtcagcaggatctgtcacatacagtgtctcctacagtccctggagttgtttggtgctcaggaaaccctggctggttgagtggtgagagagacatgcactaggagagtgaatgagcacctctgcagacagacctaagctctgatagggaattgttgccgcagtctcacctctgccccagggccttgcacgcccctgacgtgagatttgcgcaccttacagctgttgtgtgatacaatttgggtaagctggagggcaaccaggtgaaagagagagctcatggtgctgaagcgacacctttgctccaccaggatgacttgcctccctcgggtccctgacatcaaagcttccctgtggcagcagcacaaataataaattaaaaggaaaaagatcaagcgtgacagtgcatggctgaaaggctgaatgatgatgttatgaagccagagaaagacagcccttcacccccctttaaacctagagttacactccttcccttggctagtgaacacggttcttttatgtctgcaaatgccttctttctgtactgaatgtgtaacatgctgtgaaaatatgtgggtgcctactaggatgattcatttccccccaaacatctagcaattgggggagtcatatcaccccatgtaattacaggtttggggcaccccttcctgcagctagccaggagctaccatattcatgagcaatttgctgttaatctaaccaggatcctggggaattctgaatgggggagatacttaagaactgacaaatcggtaagttggcttttaaatgatgaattctaggaaaggaaacctcagggttgattataagaatagtttgtttctagaactaagagctttcaggagtgttgcctttaatttaacaaaaacagaaaaattctgaacatttaggcgatgccaagttcagctccttgccccttttctctcagtgcaaggacatttgtcataaaatgcagttaagacatggagaacacagcaacctgtgtggtgaccccgggacgaaagagcagataaaaccaaggagggtctcggaatgcagga

SEQ ID NO: 46695 - DNA, 2149 bp, Bovine  19866880221659
atgacaatctctaggtccatccatgttgctgcaaatggcattatttcattcctttcagtggctgagtaatattccattgtacacaggtaccatattgtttttacccattcatctgttgatgggcatttaggttgcttccatgtcttggctattgtaaacagcactgaactgaacactggtgtccatgtatactttcaaaccatgatttccctcagatatatatccaggagtgggattgttggctttatggtagctctatttttagttttttaaggaacctcctccatactgttctccatagtggctacgtcaatttacattcccactaacagtgtagaaggggtcccttttctccataccctgtctggtatttattatttgtagatttttttggtgatggccattctgattgttgtgaggtgatatctcattgcatcacaatagctttgatttgtttttctctaataatttgtgatgttgagcagtgatgttgaccatcttttcatgtttgcctgtatgtcttctttagagaaatgtttatttcagtcttctgcccattttgtaaaagatgtatttattttattttttggctgtagtgggtcttcattgctgcaagcaggctttttctagttgcagggagtgggcgctactcttcattgcagtgtgtggggttcttgtcgcagtggctttttttgttgtggagtatgggctctaggcgaatgggcttcggtagttgcaacacaggggctcagtagctgtggctcgtaggctctagagcactgattcagtagttgttgtgcacaggcttatttgttctgtggcatgatcctttcccagaccagggatcaaactgggtgtcccttgcattgcaaggcagattcttaacctatgggccatcaggaaagcccattctgccaattttttgattgggttatctgttgtctctatcaatctttaaaatctgaattgttgtcaacatttaaaaatcaaaagatagctaaaaaatgtaaagttccagtgtctttgaaaatgagaatatctggttatactcagcccactttacttcgtggtaaaaattcactggggtagcctctcttttcccttcagttgccagacttgctagttttccccactccccaccatgcctcagtgtgttctcagcaccagggctaagtggtggctgccatctgttcagtcaaacttgatctgctttacttatttccattgcttgtctgatcctgcaggcactggagtttgtagctgtttttacagagttgattattgttatattccttatattcaaagatatattgacctttgctatctatatggatgtcaggggaggaattattgtgtccattttccagattggaaaacagaggcccaaagttaaagaagttgcccaggatcacacaactttagtactgaggtgaaagtagttttacgaatgctcaagatttgcatttggtttgttcagttcagttcagtcgctcagtcgcgtccgacgttttgcgaccccatgaatttgtaattgactattaaaacatggagacatttagttttttgccactatcctctggtcccacaactataaaaggacaatactggtttagatctgtagttttcagacttcatgtatttctgaaatttccgaaaaattgaggtacccaagcacaaggttgctgacattggtgccaactttcatctcgctggttaatattaaaaaaaaaaaaacacacaaaacctcaaaccaagcactatttactgccactgctatttaataactgtaatgaaggaagaatatagtctcagaataaaggaggcctttttaaggaaaggtgtctatgcatacagacaaatattattaaacatttccttagttttttatttcaccatggcagatgcagacacagggggagtcgctggactgggagatctttaaggttatgtctatcttactcattttaggtctttcttttttccaatgctctagtgagagccagttcgccaagccagcccccaaatgtacatcagaatgcctgatggtgtctgggtagttatgtgggcacatgcgcttctgggttctgttctactcctgtttccagagtctctggtcttcataaatagacagaaatcacctggtccttat

SEQ ID NO: 46696 - DNA, 2574 bp, Bovine  19866880353328
tggtgttggagaagactcttgagagtcccttggactgcaaggagatcaaaccagtcaatcctaaaggaaatcaaccctgaatattcattggaagaactgatggctgaagctgaagctccaacactttggccacctgatgtgaagagccaactcattagaaaagaccctgatgctgggaaaaattaaaggctggaggagaaaggaacaacagagcatgagatggttggatggcatcaatgtccactgactcactggacatgagtttgagcaagctctgggaggtggtgaaggacagggaagcctggaatggggtcacaaagagttggacacaactgagcaactgagcaacaacaaccattgagacttcctaaatagctctgagttcccttctttaaagcccaaagaacataggactttccttggtggtccagttactaagattccacactcccaaggcagggggtccaggtttgatccctggtcagggaactagatcctatctgctgcagctaagacctggcacagccaaataaataaaagatcttttaaaccacaaagaacagactattgctttgtgactaaaaatgtttaaaagtagcaagtgcattctctaagttgggttaggaaaggctggcagcaagctggcagctccttggaggaaagtctcttccttagtcccattttaagacccaaattcatcataacacttcagcacaattaggcaagctgcttagttgctcccaaatatccatctctctttacaaagtatcaccagagcctgtcaaagcagcactgaagtctccagcactctcctctgtgaatgtcattctggacagaggattgccattgtgttaattacattagctggctcaggacaacataatctcacctgaataacactgttccttcctcttcttttcctccctcttcttttcctcccttcgggttctctgcctgaacatttttgttcttctttcattcactcactcatttatccttgcacgaaatagttactgagcatttcctatatgccaggcactgtgccaagtgctaggtatatatcagtaacaagcctggtaaagctcttcccttgtagatttccttaacctttatcttagttggaattaaaaaaaaaaaaaaaaaaacacagtggaaagatcctttagccaaaattagggtacctgtattcttatcccaactctgttaattttcctcttcaatatataaaagagtggaataggaacagtctctaagaatcttacatggatttttttttttcagtagctcctaactagtctgaagctttcattttgcctctctcctccctgcacatttattctaaacacagcagccaaactaaccttgttaaaatgttgtcagatattgttactgctttgctcaaaaccttccagtgggtctcactgaaaatacaactcaaagtccttactatgccttggaggtagaatacaatctagtccctaactactttctaaactcttttcaggcaccctctccttcactcactccacccaggcacactggcctccttgctgtttcttgcacactctaagcatactcccccctcagggcctttgaatttgcctttctgatgcctggaaagctctttctcccctccctgaagttcacagggctcatttcctcactttcttcagtcattttttcaaagatctccttttcagaaggcagtccctgatctgccatgccacagttgcagtcctccaacgctgctgctagtcgctcaagttgtgttcaactttctgcagccacatgcactgtagcccgtcaggttcctctgtccatggaatttcccaggcaagaatattggaatgggttgccatttccttctccggaggatcttggcaatccagggatcaaatcgacgtctcctactttgcaggcagattctttactagtgttacctgggaaacgtgatctgactaccctatgtaaaagaccatctcagagttggtctctgaccctttaccctgctttttcctttttaatccttattattgcctaatacatcataatttacttatttatcttctgtctccatctgctagaagatattctccaatggaagagggatatttacctgttttattctgtgctgtatacccagtgtctagagcagtgcctgacatgaagtaaatgttcaataagtgtttgttgagttaatgaaagaatgtgtctcctctagtaataaaataaggtctcagtgcatgtcataatttagtcatatttggaggagttcaaatctggctactggggcctataagggaccaataaagtactggacttaggctacaaaggatgttcaccaatagcaaaagaccatcaactgaagccaatccatcccactccattaagagttctgtttcagagtatggtggtcaccctagattagacttgaatgccattgcttctatgcagcttcttattgggagaggagtgggcatgactatctttgtttgacttaggccagagaggtttggtcatttatccaatgtcatccaggctttttaaagctgagagaaaataagaacaaaaatc

SEQ ID NO: 46697 - DNA, 1178 bp, Bovine  19866880396356
attctccaggcaagaacactggagtgggttgccatttccttctccaatgcatgaaagtgaaaagtgaaagtgaagtcactcagtcgtgtccgactcatcgcgaccccatggactgcagcctaccaggctcctccacccatgggattttccaggcaagagtactggagtggggtgccattgccttctctgaagatcacattagtattactcatcaattctgataatatcattgagcaccaggatctagccatgcctaaagccaacaatcccccagattttccagtgtcatgactcagatacatcctctttttaatttacaggggttgaaaagttccctgtttccattaatcctactgtatcccatttctatcacttgtaattgaaaaagatctgagaatatgcaatctatccagaaagtgagattgctacatatagcacataatataaagctttagatttagatgtctccataggtttttttttcctgtaggtcaggagtcagaaggggaaaactgtagagtaaagatcatgccaatgtcaagaatctgccagacaaagttgcagaacaatttgttgaaatgcccttttggccagtcgtgctgagcatttttaacagtttatagtcttcgcctgagaaatttagctgcctacagggaaagtctgcgactcttgtgatgtcatagcattaatgaaatagacaaacactccaacaagataagctgataggttctacatgatacatgactgaggagaggtagcagccatttattgaagacctactgtgtgccaggaaggtcctgtgcactgatgtcattctcacaataaccctggagagtgatacagtcatctcccttttgttaacatcaatgttaaagtcagagaggctaaggaaaatttttctgaaatatcaatagtcagtaagtagcagattctgtgttcagcatttagcctctcaggttcaggtccacagttcttttccccatgctaagacagctttccttctgtagaatgcaggggcctcactgaaagcaaatggcgctaaaggagaataaaaacagcccagccctgaaggtaggtgggccaggggctaagggaaagcatctatttccaaaggggcagagcctgtggcaaggacaagcatggaaaaagctgtgttcacatcatggttgcagtatagt

SEQ ID NO: 46698 - DNA, 923 bp, Bovine  19866880472333
gtctgggatagagcttcattttaaatagcacaagacagccacccctggagagactgtttcatatcctgtggtctctttcctgccctcacctgttttgcctgcattgaaattttcctctgcaccaacttggtctgaatataaaataaactatccctgtgtagtttatactccaagacagatatacagttttaaagtcagacacttccttgtggtggttgctttgatcctttcgtggaaatatcagattaaaatgcaaaaatatggcctgggtgaaatcaactggacaagtggagtttgaaggacaaagaggtaaacagagtgcctaaaacagattagacgacagtgtgaataagatatagctggaattaatagaatattattacttagtttgtaacattttataattagagtttaccttcatgtgctcatggtgataaacttctttctttctttttttctggatctaaattatctgaaactgttgttttgtttttaatgaaaggagaagtgagtctatatgattcctttcctggtatattctgcatcaaaaatcacagagaggaaagctaaacatgagagttttatacccatttagggaggtagttatgtaggaaatagtcatgagaccatttagactcccacgtatgaagctcatatataagatgccttcaggtaatgtctcacaattctctcttggaattagtttctatatttataaaatgagaagtttacatcagatcttatgtattagcactcctgatcactctaacagtctgtggttccttaagaaaaggaaaagggaatctttgagtgggagcaatgtgagttataagtgaaaggaaaacaaaacaggcatcacattcacattctatgttgtaagaggctctggtaccatgtattatggataattaatatactcccat

SEQ ID NO: 46699 - DNA, 1709 bp, Bovine  19866880485433
tagagcagttttggtagcagggtatttcaattattataagaattatattcacgttcaaaggtctaaaagaattgaggaccataataaataatctcacttcctggaaagctatcccaatctagacatgattattgacagattccataaatatgtcagtttccccagaaaatgctttgtatgatgagaaaatatgacgtctgatcattatcctcagagatctgaagagaggcctgagaaagagaccaaaggcgtctatactcttgtcagtgattctgtttaggtttttccctcccctataaggctaagttttaaaaaatttgtttaccaaatcccatccattgttaacttgttttccccatctttactaaccaaagataaactgccagaaatactgaacatcatgtgataagcaatgccaccacaatgagttaacctaagaaaatacaaaagaaaaggtgtgatgctttcttgttagtctatagagccttgtcagaagtaaatatgcaatttgataatctctgaaatgtttaaaatggattctgagtcctcattactatttaataaaccctctaggtactcagggaccccatttgggaaatattagatttgaattattctatatggctccgagagaagaactggaattaatagattaaatatatttttaatgcacacacacaaattctgttttaatgtaattcagaaccttctgacagatcagtcaactgtgtaccggctgcctcagttgtagtaagggtccctgtcagtggaggtatgcaagcagagactggaaatccacctcccaggagggatgtagaaggaattcaagctacttttgtgaattgggatttgtaatttgctgcagaaaagtaaatgaaatgcaggtcagagacaagtcttcccccggctcctgatctccaaattatcatctgatctctgtaacttttccaagtcatgccgtaaatacacatccactcgtgccttttccttctctgaaatggcttggataataaattgggtgatgaacacgcacatacacacacaaactcatatgcgaccaaggattattaaaaggaaatcaccttggttatgtaagactctggctttaagaaatgagaaggacctcagaaataagacaatgtcagagccagaaagaccaccagaaaattcactggttcacagaccagtcctcaggcacagatggtgttcacaggactgaatggatgaaggcctcgcagccctaaactccagctgtctctcctgaaccaactccctgttcagcctcccacaactgaaaacaccatcaggccagccaggaaattcattcagaaagcacattggaaaggaacaatgccctgagatgctggggagaggggcttctatgcacagtgcttatgctttgtagtgcaagcccttatgaggggtgctgaagccctggcgcttttgaaactccttataaaggatccctttgtggttttctgaagttgatattgtccgagtcccccgaggctaattcagtgcaattagattaccactctctgcttttgaattcggctgtttttcagtgtctgttgctaaatgagtttaccatcttaacagggagctgctgacagtcattatcccagccgtgaaatgggcagcgttctctcttgcctcgtatactgggcaaccccaggcccctaaagaacaaggctctgctccctcgctcg

SEQ ID NO: 46700 - DNA, 1493 bp, Bovine  19866880752565
attgtatacacacatctcacctcactaacccttgtaacaatcaatgcagaggaggtgaaatgaggaaaggaaggttcatacaagttttaacgggcaatggaagacatatttgcagtcaatagaaaggccatagggcctccaaggtggtactagtggtaaagaatccatctgccaatgaaggaaacacaagagacataagtttgatccctgggtagggaagatcccctggaggagggaatggcaatccactccagtattcttgcctgataacacagaggagcctggtaggctacagaccatggggttgcaaaaagttggacattactaagtgactcaaaagggctagaactttttagaaggtgatgagattaaaataacttatttataaatagatcatatatatatatataactataatgattttgactaacatttattgcccatcccctctacgcagataccatgctaagccctttccatcaaagacttcttttcaacagcacatctgctctaagagtattattaataaccacgttccaccctcacggccagagccctccccctctgatgtttcttcatggtaaccccgagttcatattttatttgtgcttccttggaactgagactgtcagtaactggaatcattaacaccatttctttagtttatttgtctggatgggagaagtaaatctgtttcctagcaactctgtcccctgctccctcaatttcccctcctcattatcttccccatgatcaactacaaattagccaaattatgggcaggttttagacttcccagaaacagaaggggcacttgcaaacatttgttctcttggcataaagtggctctgaggacccatgcttgctgaggacaaggcaggagaatggaaatggccattcatcttaatgtgcctgtgaatttcggagccaggcctcccaggatagtcacttaaatgcaatcttttgatcatttcatgtaaaaactaatgttaaccccaagaggagtcatcattttggttaaaaggggatccctatgacagtaattgccaatatggtaattttactctgagctctagtgtgaaatctcgaaatgactccccacccccaatgctacacttaatatcctgagaatcagacaactattccaactgacctagcacatactcttgtggaaacatgaaaaagtgacccctactcaaaatgtagaatgctattagggactcaagtagcccagatcctcttcaagctcaggcctttccaatcattaataatctatatggggacaatttttcccaaaagtagtcctttctggagttatttcctaagatgttccaactaagataatttcagaactgcttcaggaaccacggttaatcctgggtgatatggactgttagtttactttcgtttgtttattcagcccatatttttaagcacctaccatgtaccagaaactgttctaaacgctggggatgtggtagaaaacaagccaa

SEQ ID NO: 46701 - DNA, 1541 bp, Bovine  19866880825348
tagggatccagttaactggagtcagcaacaggagtgagaaggcatgaggcaacctctgctcaagtgcctgactgccactttcctggggacaagcctgaaagcagtttcaggaaggagtctttctcctctctctgtacacaagcagcctcttgccccctttcctccccgtctgagcatcctcagcatctttgcacccacaccaagagatttccatacaagggaacagccactcagtctggaagtgacaagtgcctgccagcaaccaaccatgatggcccagctcgttcctcattctgacatggctgcaagtgactccagcttccttggcgacaacctcaaggttattggaatactgaattccccctggtagcgggtgtgttcctgtgcatgtgaatgcacacatgacgggggcagccgtcgttcgggctcctgatagccttcacatcagaggagcacgagaaagaagtctttcaagagacatggaaaactgccctgctccagaatcagccacatgtccccaccaggtgcaggaaacagccaagctcccaccattggaggccacaggatcaacctgcctttccagtcttatcctcaaccccactgttctctcaaggaacctcagtcacatatataattttcctaaaactccaccaagaatgtccctacattgggaggaaggcagcctttcatggttcttgtttaaaaaaagaaactaggctattccttagtacctaaaatggtagttcccttataaaaccacagataacctcttccaaccaatactactgagcagtcacagcagaagtaatgacaagaatcatggagtacctgctatgcgccaaacactgtactgagtgctttgcctgctttacattattcaacccgacagccaccctattggatgaggacactgaggcaccaagaggtcaggtgccttgccccatgtcacacagctaacacaaggcaaagcaaggattcaaacccagaacctctatctccagaacctgagccctctggatataccgtcttcctctgaagttccccataacctctcacacacaccatgaggtacagagcaggagacagcacctcaagaaaaaggggaggagatggaagtcaggcagtctcaccactgatgttctgggtcactttggttaggtcactccacctccctaagtctctctttgactcttctctataattaaatttctctaaaagtagtgcttaaattagatgacccaccttgatgtagtttgggatcccatatacaagtcatttcactgaatgtattacaaagatgccaaaaggaaaaagaactgcacatggtggaatttaaagcgatatgagtgtctcagtgaacataatggacataggatagaaaagcagtgagatgtgcaaaaaccaagacatcagttcagttcagttcagtcagtcatgtctgactctttgcgaccccatgaatcgcagcacgattccctatccatcaccaactcctggaagttcattcaaactcatgtccatcgagcccgtaatgccatcca

SEQ ID NO: 46702 - DNA, 1766 bp, Bovine  19866880829171
tactccttggaaggaaagttatgacctaactagatagcataactttgccaacaaaggtccgtctagtcaaggctatggtttttcctgtgatcatgtatggatgtgagagttggactgtgaagaaagctgagcaccgaagaattgatgcttttgaactgtggtgttggagaagactcttgagagtcgcttggactgcaaggagatccaaccagtccattctgaaggagatcagccctgggatttctttggaaggaatgatgctaaagctgaaactccaatattttggccacctcatgcgaagagctgactcattggaaaagagtctgatgctgggagggattgggggcaggaggagaagaggacgacagaggatgagatgtctggatggcatcactgactcaatggacgtgagtctaagtgaattccgggagttggtgatggacagggaggccttggcgtgctgcgattcatggggtcgcaaagagtcggacacgactgagcaactgaactgaactgaactgaaatctggcccgtggtctgtttggggatggcttgtgagctgtgaatagtcttcctgttttgaaaacattgtcagaagaagaaggaagaggaggaggaaatagtacagagaccctatgacccacagagcctaaaatactggctcttcacagaataagtttcttgacccatgagctattgtataatttttcctgtgaaaaagcagccactgaaaatgaaaagaaaaaaaaagatatccggtatgcactgacatgaaaagagatctactacatactgctaaataaaaatgcaggtatctgaacagcatgagtagtctgattgcatttgtgtcaaaatatggaaggcaagttatctatgaggtatatgcaaataaaatttctggaaggatacacaagaaagcaaacggtggttgcctctggggaaatgagactgagatgtaggtgatgaaagagagaaagccttttacacggtactttacattcttctccaccctttgatttttcccgtgagcacgtgttagagcgctaaccataaaaatgagccggttggacaatacgatctcctggggcaccttcagctctgagtctgtctagaataataagttacaatgttggttactatctttttttttcgccagtgtgattactacgatgcaagtcacatcctgcactttgttttcattttcacaaaaacctcccgagggtatgacctccttctgccagatgaggagactcaggctcagactagagctgaggattccaggcctctgctctactacccagctccagaggtgacaccatcctcctacttgagcctgagaggcacagtgaggttgactgtgccagcaagtagaagcagcagaagatatggggtgagatgtaaaggaggccagatatgcaatatggctgaatatttcttccctggacccactgcaggcttctatggaacagatggcaaggatgggaggtcgattttttacaaggaagtgagaaaaaaaagtattttctactacccttcaaatcatatcatgaaaagggaaacctactctgctcgtgggggaagccgtgtgaccttcggtgaatcacagtccctctctgaacctgtgctttagcttttaaaaagaagaggttggcccacattggggcttacaaactcatgctgacagggccagtccagtcaagttaacggtcaagggacctgtggggatggtggggaactcaagaagtcttgccctatttagagcagga

SEQ ID NO: 46703 - DNA, 1520 bp, Bovine  19866880980557
cggtgggacttaccttgggcagggatgctcgagagccggagctctgggtggtcatggtgagcacagtggtgatgcccaggcccacacgggcgggggcagcatccatgttgatccagaaggagatccacgagaggatgacaatgagcaggctggggatgtacatctggatcaggtagtagcccatctgtcgctccaggtggaaccgggcctcgatgcaggtgaatttgcctgcgggaaattagagtgggaaggcaaagtggcctagtggataggaacaaggtgctgaggtcagaacagtcttggctggaatcctggtccagcctcacactagccgtgtccttgggtgagcgtttgaatctttctgtgcctcagtttcctcatctgtggtaaatcggggatgatgacgatgatagtaaataataatgacaccaacctcacatggctactcgtgtttactgcgatggcaaatgagatggtaaaatgagtaaagaacttagcacagccctcacaaaccattagtgctcagaatgtcattcaccatcagcctcatcatgtgattatttgatacctacaggggagaaggtcagcctctgtggtctgcccttcacagtgcagcctgtttccactccacttcccttttcttcacctcacccatgacccctacactccagcccttgccttgaatatcctctgtactttcacacttctgagtttttgagcctgataatccctctgcccggaatgcccttcttccaccccacaacccgccaaggaatcctgcctctcctgtttaatggtgacatctcccccaggcagggcgcttcttttttccccatgtcccttcagctctgttcacgtgagcattggatcctttaaggtgtagtacactgagtaggcaagtcgacctctctttctctttctctgtcttctgcaccaggctgtggacaacgcatctcccagtctgtgtgtcccttgagctgggccgggccgtcccctggtggggtcttggctccagtccactgacacacagttgccaggggatttttgtacagttccctggactgcaccttccatgtggtcagggccttgccagtcttttctcattgaatccacagaactagcccggaactcagctcttacttaaatgtgggtaatgaagggccattgagataatgaatgagaaaaacgctgtggtgtatgagagccggctgtaattatttgatacctggggactcactggctctccggacccatgggccctgcatcctccagtgaggagggctgaccatggccttgagcatccccggatattggtaatttggggggcctggaacccagttcctttggagactgagggatgactggtctgctctctctctgagtctcagcttcccagggatgaagagagtagattttgaagtttctaggatatctatctccgaggtcactggaaagggacacctgtcctaaacagagcaaaacccaggctgcctgctcttctgggccttccacttgcatca

SEQ ID NO: 46704 - DNA, 1454 bp, Bovine  19866880993060
aacccaatgttagacatgaagcttttaaaacaaaaaaggaccccttgcttctgaaaattagaagaaaactgactttaatgagcggcagcaaccaggatcccaggagagtagagaaaggatattgtgtttttatcttgcactgttggctttggaaagtggctggaggcctcaaaggctcagatctccaatctcaaagtcagctgtcagctaactgctcaaaggcaaacactgcagggactctgagagccctgccgggacctctgagatgttaccaagaggaaggatggacacagcccccaggaagcgcagatcacactcaggctagggatcatggtggaaggggaagagtggtggtaatagcaattataataataatcctgcactttctctgtgccaggatatgtttcttttttgtgtgcatgactacacactctcccaatgaggtggatattgttaccatcaccattttacagatcaggaaaccaaggttcagagacattaagtaactttgccaaggtcacacattagcaagtagcaaagccaggatttagacgccgaagcccacattcttagtcattgtgaccaccatctatgtgggtatcaactgagtaagatttaccttttgagtacaagtttttctccctagagcattccacgaccaaccacaatgaagatctcttgaacctagaagcttaacccctcctaagatgctggaatgtcctctgcactcatcgtcaccccaaatctgctttcatgccttcaattacacatattaactaccttataaggcagatccaccacctttcaagagctttggttataggaaatcctacaatgagctgaaacatgttcctctgaaatgtctacccattgggcttatttctgccttttagggtcgtgagaacaagttcaatccttcttccacctaacggtcctctaggtactgaagaaacaattctggacccttggaatacaccttacaggagtggtcacctcctgccactcttataaaaaagaaaaaaattaagcatttatttacttgttcacactctcagtaaacattccccaaatacccagcatagatcaaacactctgctatctatgtgctgaggggacaagggagcttaaattctcagaaagaagataaaactatacacaaatcattatatacaaggtagaaaatgatgaaagcataggaatacctggaggggtgccacacaggttctgacaagagatcttttccagctaggtcgtgtgtgaagacagcctagaagagacaccatcagagcctggtctggaagaataagaagtattactgaccatctgctgttccaaagacctgggtggtcagagggtcctgttgcagtaaggaaatgagagtactggtcttggaatggatctgctgtcctgtagcgctctctctctctctgaaccttattttcctcttctgtaaa

SEQ ID NO: 46705 - DNA, 1148 bp, Bovine  19866881024774
tctactctactgtgtgacagaccagtaagtctgacagacaaggtattaaagtgagaaaaatgactatttggaaagccagctgatcaagaagatggcagactaatgtctcaaaataaccatcttatgaggtctgggtgccaggttctttcatagaacagagatgggggaatatggagaaacacagtaaacaggccattaatctcttaaatagctcctggaatggcaagcttcggcagaggatatgttaatttcttcttccctgccattcacaggtggacagggtcctgaacaaaggcactttagtttaacagtaggcagaggggcagggttttctgagcaagccatcctgtatgattataataacaaaagcgatgaaaaacaaactgaagaaacagttccagtatggagccacaactggctcctccctgcgacagaactaggtccaaggccattgtgtggggcacgttgaagagacctcagaaatacgcagatttgactcccagtcctgctaccaaagttagctgggtgaccttgggctagatgcatcatacctctgactgtcggagagagagaaaaataactaataatacttcctatgaaaggctgttgtgatgattaagaaatatctataacaaagaccaagcacagcacccaacacttagcaggtgctaaaggaagagtagctctgaggagagaagagctttcaaagaacgtgcagtaaagaagagaaaaatgaaaggacaggagaaagcagtaaagcaccaaatgcagccttaattttaacctcccttttcctcacttgctctcctgcaatggccaagtaacatcacagccggttaagtacatctttgcttcaggaggtctgcttgtcgcttttgaaaaaggtaaactatagtccttgaggctgctttattgctcagagactgactacaagtttgcttgatggcgaagcagccttcagggcaccctgggaggtggattcatttgttattcttgcgtaggaggctttagcttctgggttgttaaagaacaaacaaaaatacctcttaaaaaatgggctatgggtttggtgaagcttgaaatgtaatcctttggttcagccctaagagaaaatcttcattaagctttctgaggtttgccctggtggg

SEQ ID NO: 46706 - DNA, 665 bp, Bovine  19866881032320
cctgctaggaataagtctgtttaagattctgggatagtagtcttcccttggagcaagctgtccctccatattttatatcttggagcatattttatttttaatgatggcatgaatgcatttttcattcatcttgtgtgcaaaggcaaaaggtccccttgctttcaggatgacaaatacaaagtgattgaaaattatatagtatgttggggactggaacaggaccaagaattggttcaaaactgttgacagtatctgatggcatagctgattgacaggagtctggttgttcccaaggattatttttccctatactgcatcccaccctatcctattttctaccttactgctctcttcatcccacagacccttgggcgattttccacgtaaaggtaagggagggctgattcccagaccttggctcactctgccactccaggctgcctgagtgttagagctagtgtttgcccagctgctggagtcaactggtttccttttgaggatatacctctccccttccttctgctctcctccccagatgtttgtgaccaaaggcagccacaaggcctggagacactagtcttctgctctggtcactcctaggtcaccagcttgagaccaggaggaccaccctgctgcattatttagtctaggcgggcttcctggag

SEQ ID NO: 46707 - DNA, 789 bp, Bovine  19866881114978
acttctatttgtaaagggctttgtgtttatgaaatacttttacatcagtatttattggaatttttacaacatgacaatgacgtgatcaaagatgacactttccactttccagaaggggagattgtggtccagaaagcttacagttcccatgtagttggcatgagtactacaactaaagcccagtccagaactctctccattccagcacgttctcccaggccaagggaccagagacccaggcatatgttcctcaatttgtttggacccctcttcctcaactctttgggcctgtttcctcagtactcatagtccatactcatcaaaacatagggaaaatattcactgcctaacaaatatctgggtgatgttcaaaaacagtcagaaccctcttcctgtgccaatttctattttaggcacagtccatgactcactggcgaccttgggtgaaaaagaggtaacctttattcctataacaagtttctatttctcagaactgagagctacgagaaacacagtttctgacaagatttccccacttcccaaacccagaatgggccctccagagatcatggatccagccctccatcatttgacagattttgacaaaccagtttcaggctgaagtcaccaaccagaaatataacctgggactgatgagtatattaagatttcagtggctttcccaagatctcctggctaatgaggagttagggtgtgaccaggatgaacctcgtgattgccaatgcaatgccaatggcaaactcacctgacagcatctctgctgtccag

SEQ ID NO: 46708 - DNA, 2693 bp, Bovine  19866881121831
tttgactcatggacctttgtcacaaagtgatgtctcccttttcatacactgtctaggtttgtcatagctattcttccaaggaacaagcatctttttattttgtggctgcagtcaccacctgcattgattttggagcccaagaaaatgaaatctgacactgtttccacgttttccctttacttcatacacaattataaaagtcattgtggaatagagggagaaatatgaaggtggggctgggaaactgagatgtagttttggctctgtgtctaaatttttcttggtctaattcttggtctaattctttttctcagatggtccccagtttctccatctgggaaatggaagttttggattaggtcagctgtggtaaacactttactttgagcagctgcttggaagatgggtctggagcctgaccccagcaggaaaggggaacagggtggattatcagtcactgtcaagagactagattattgagtgggggcttgtctgatttttatgggttctcttgctctacagtcctctgatccttctaatttattatgcacctactacatggataaggcgctgtggaggagaggcggataaatatgttgctgtctacagaagaagccttctgtgtggactgagttggtgtttgtctacagtgcctgacaggtagtagcactcaatgatcttttcttttctttttttttcttgtccacaccacacagcttgtgggattttagttccctgaccagggaatgaacccagccctcagccatgaaagcacagagtcctaactactggactgccagggaatttccaatgatcatttgtcgatgagtagcttttgcccacttattgtttatagttcagcagatagactagagtaggtacatataaacaaccataagaggttgccctcagcctaaggagcataactggagtgctctggtggttcagaggaggaaggcagtatttggaggcagatggggacagaaatcagaatttttctgagttttgtgaacttttgcctctgtacacgtttgggaagacctgacatttgttgatgtccgtgttgtatatttctggggagaaagctttcttctgcctgtggggctgtccttagaaaggaatggagggatggtgtgagggggtaggtatcctaggtcctaggaagggatgaggctgagtaaggctggcactctctgaccttgtggactgaaccagtttcctgtctgttactctgacaccagggactcgggggggttgttgcacagtgtgggccttgctggtcactgtcagctttgcctgggctgcaccctcagttcaacagctggctggctttggccagctgtgcaattccggttttatttgattgcagtaaggggcttaggttggcctggagtgcctgacatgttattagtttcacttcatgatctgctaagcaccccttagggagcagaatggcacagttggcatgccctgagcctgcttctccaggtcttatgaagcaagactcccttcccttttctgtcttaccttctgcagctagatctgcctcttataaggaaccattatctggataagaagtgcaagtatttgaacagggttcttgtctgcagtgagatgaaatcttgggggcatacccagtggcccagtggttgagactctgccttccaacgcaagggatgggggttcaatcactggtcaggaaactaaggtctcatgtgcttcaggggtgcagccaaagagttaaagaaacaaaacaaaccttggatccttgaggctgaaaggaaccttgaggttccatctggttcttcccctgcccttagggaagtcagattctcttgggatatctcacattccttagcattgcttccagtctgttcttctagatagctttccctccattaattcttctgttgcttttatttaagtatcctcatgaagtagggtgagaagaatgaggcgcctgtcaaaattcaaagaggctcttactttgagatctgtgtaggtaccaacccctgcacgtgcagagccctgaaagtgagcgcctccttaaagtttgtgccttcacttgctttaccccagtccttgtcctcctagagcatcctaggtcctcaaacccagtcgatcaaaggtagagtttcctgtggataatcaagtgtggtcacctaaagatggatgtctgcctctcacagcatctcatttaattttcagaaagcttcattttaatttttattgtttgctggcaaaaaatcccctaacattaaatattttatcacagtttatcctttaaacaacctgagaggaagggatgtctgcccccattttaaagtaagaaaattaaggcttaaggagcttgtggcttgattgtctaactctggcataccacactgcatttgcttaaaccgtgccaatgttttctttcttctcatctcccttcttcttacctcatgtgcttgtttcaggaccagaatcatggcagtccttgatgttttctggttcaagttcaaccttcatgtctccaacctttcttttccccaaattgggacagttatatgttatgtagacaagaccccaaaaacatgactttggcaaacttcttccatatggttttcatgaagtgcaaagcctggcacctggtcagggctcaataggtatttgttaattgtatacttgtatacgccggtacttcagaggaa

SEQ ID NO: 46709 - DNA, 1028 bp, Bovine  19866881201466
ccttcattcatttactcatgaattgttattgcattaatctataagctatgccattcatgtattcattcataaaggcatatatcaatctattttttctcttagtttaaccaggtattacaaagaatagtatgagaattacctgatctggtagaaagaacgtaccctcctcaaatataattttccaactaaaagaagtagagcggaggtaggggaggagcagggtgcagaggcagggcttgatgacaccaaacctctaagtcagaatcaaaggcctcctccaattctataattccttgagtttacaaagtgtaagctgcaactcttgccctacaaaaattcatagactagaaaagggtctttactgtgattcatgtattttacatcccaatctactacacacatgcatcgatatgagttcaaaacaaagctttatgaaataatatttaccctgcaatataatccattatatattcattttaactgttggacaaaatagagtaagttgatttcataatctacaaacggttatgaccggaagttcaggaactacagtttagaaagtcaagagacagacttagttacaaggatgtataattcaagctagctacttggttaccatcatagactctcataatcctccagatccaacagccatctactcgtgtaggtgctatcacttaaatgcctcttaattgactgtgcttctccatatccgtgtgcctgctatctgcctctcatgtggacctcacttcctgtcctgacttcctgtctcctgtcttaccccttcagtccatcctccaaactgcagtcagtgattatgctaaaaaatgcatttgatgaaaagtctgtaatgctcctcccttatccacagtctacaaaagtgaatgaatatatccaatcccttagctttgtctggccttgattccttcctccagggtcatttctaacttcactcttgtatctatgctgaacccatgctgatttgcttgcaaatttttgaatcttacgtgctcttccatctctctgag

SEQ ID NO: 46710 - DNA, 799 bp, Bovine  19866881241506
aaaaactggctccagtgaggtctgtgtttcctgcacaactgaaagccattttcaaaagtttgccttgtcttatggaaaggggcctctctgcggacccaggccccagtgggaggcagccatatgtgcaatggcacagatgttttgagaagcccagagtttggacatccttggctagacagcaaggataaggctaaacaactctcttcaatagctcttgagccagggctgagctgtatgtctagctcactctcactgtgactcatttcttggagcaaaaaggtgtcactgtgagacatagcagtgcattgcattggctggttggaagccttctggtcctgggcttcagcagagccaataagagaaggatgggagcaggtatatggggacaaaataattcaattcaacaagatctgaatatctaacatacatgagccactgggataatactgtcaatgaggggaacggagcaagctgaaaaccctggtgagcaccttttcttcatgttggcctttcacatgaaccaagaaacccattaagaacctagtctttgaagggcttattgtccaactgaacaagtagaagggcacccaaatgtttgtaaggccacagtgtgtgaactgagtgctgaaggtaatgcctacatttccgaggagatttaggaaggagaatccatgcccagttctgggtagggatggtggcagtctggggttgcttcatggaggaagtgttgttagaggtggcttgtgaggtgtggataggatcggagagaagtggagagggaattcactaagggcttgtg

SEQ ID NO: 46711 - DNA, 832 bp, Bovine  19866881320772
ccaagcaactgggcctgggttacctttctccaagtgtcttttttccctacctggtataggttgtctttttattaaggtgaggtccaagtttatttttgtgcccatgctttctgatatcctctttctttcttaaaaaaaaaaaacaactttccagctttcaaaagtaataaatattattttaaaacatccaagcattactaaaatatttaatgtaagaagtaaaagcacccaatagtctcattctcaatagataataacaactatgaacagttttgggtccatttctctagacttttttcccatgtgagaacaatgaaacatttaaaaaaataaaaatgggatcctacaatatatatactgtttgcttcttgctttcccccctattgaatcttttttcctcagtatttttgacttttttgcatggaatgaggtcatctgcctttggcacttactgactgtgagactgtagatgaatcactcttcggctcagggtttcagtttcctcatcggtaaaaggaaacagccccttcccacttcgctgtgatgtaagctttaagggagagagcatgtgaaagtgtaggcaccctgcggtggcctccagtgaaccctcctctgtcctgttctcctgtttgactgggtttggagcactgaccatgacctgaaattctgatttcccgggttgtttctttgtttgtaccacctctagaagttaagctgtgtgagagcaaagaccgcatctcttctgctcatcaccgaatctgtcccccaaatgtaggaagattactagtttatggtataaaagtcaataaatattttttagatgatgaagaaa

SEQ ID NO: 46712 - DNA, 797 bp, Bovine  19866881359821
gtggtaaatcctctctggtccttatgttatgaatgcagataaaatctcatcattgaacaagcagttgccaaacatcattacacaggattccatgaaggttacagagacaaaatgaaatgtagtttgttctttcaaatagtgaagagtttggtgtgggaagcataatatgtacttattaaaaatcagacagagctctaaaatgtgtcttcttattacccctgatgcagtctttgtcaacttcccactaaaatatccagatgacagaagaaaacacataaaaattcataattaaaaaaaaaacagaatgtggtaggaatgtttactaatcatgaggcagctgatattgctagagaaaaacttggcaaagtcttgcctcaagatgccaggcttcatctcgtaaagccctaaaacacatctcctcactgtctgcctaattcagagactcaagcagatcaccaaacagccatgtcaatattacatggacgctgccttttgaggaggctgtagcacaatgtttggtacatgtgcacactaattaagcatctgctaaatggctaaatgaatgaagaagcccttccctgatccacccttctcacactgccactcctaataccctaaaactacatcctttgagagacagcaccctctgtgggcatgaagcagggagagctggaaatggtgaactacatcctggaacatgacattttgtatgtataaaggggctcagttgggaaaagaaaaaagggatttgggggaagcaatagacactggaaaattgcattttgcaggcattcatt

SEQ ID NO: 46713 - DNA, 1341 bp, Bovine  19866881405620
atagaacctgggtctcctgcattggcaggcaaattctttaccactgagccatctgtatctacacctaaacagattaacatctgcacctcagtggaaaagacacatacagtattatgactaatccactgcagtttaagcttacaaaccccaaataagcactcacactgtctggatttattgctttgcttcctctcggacaactcttctacacttcactctttctgatgtcttaccacttccatgccctctctcttatctgataactttgcttaaaaatagaaacagagggatctcttgtatttacattatcaaatgagaacctgtccttatttagacccatattttctatttgtcattctttctctgcttctatcaagggccagtctcccgctgtgctgtctaccccggcccttacagcatccttgtgtttgtttctgtagtttccccacctcctgcatcacaattgttgccttttatccaaatcgttcccactgcatataaatatactgcagttgctcacagtctaccttctcgtgatctgaatgctacttctactaccatcagatttctctattctccttcacagtaaatcttgaagaatccatctacactcactggatccttgtccttatctttcactatttctttaatctgcttcagtctagctttcactgtcattacttctttaaagcctttcatatccatgatcatcatattgccaaaactaatgaactcaccttcaaacttcttactcattatttactgttgaccacactttacttcttaaaaccttcatcttggtatctaggatcccatcctcgcataatgttttacttgcctttttatgtcctcctttcttccccacccccaagtttttccttcacaatcctgcctttaattgtttgagttctccactaattggtcccagatcagttctcagtctgcacattttcccacagtgatctcatctacctcatggctttaaataccaaatggatgaaaatggctcccaaatgtgaatctgcatcctgtattctttcctgtgttccagatttatatatccatctctttactatttataactgaatatatgataggcatgtcaaattatcattttcaaaagagaattaaaatttttttctccctcttcttccatgcttcccacttccaccaagacaattttgtatcattaaatgactccttcatctatctaagaacccactcagagactcttcaggctgaaatcccaggagtcaaccttgatttgttccttactttcacttcctatttataatccttcatcacaatgtttcattctagttctgaaatatgttttcttta

SEQ ID NO: 46714 - DNA, 1191 bp, Bovine  19866881433911
aactagaaaatcagtagaatattcattagaaggactgatgatgaagctgaagctccaatactttaatcacctcatgtgaagagctgactcactggaaaagaccctggtgctgggaaggaatgaggtcaggaggagaagggggtgacaggatgagatgttggatggtaccatcaactcaatggacatgagtttgaggaaacttcaggagatagtgaaggacaaggaagcctggcatgctgtaatttatggggtcgcaaagaataagacacgactgagcaactgaacaacagaaaatcaatgctgtggatttttctccaacatcctcagcagccctgagaaggggtgagccaggcatatggattagcgcagttgactggttaaatcacaaaaatatctgacagcacagatgtgtaaacagatgtggtgggttgctctgcagtctacatttctgagctagactttaaatgcttgagtatgctataccagtgttttgccttgtaaccctgggagtaacttcttccactcccaacttgtacttatctccacccatcctgatgcatttccttgtttcttctgcatctggctgtgaaggcccagaaagtagaatagcacctacatcacactctgcacactgacagtgtgtagtacttctagaaacacatattgtatcaaaacatgagctctggtgccaggctgcccatgtatttctagctccatcactcaccatctgtgggatcttggttgaatgatttaagattgctaaagcttccattttctcatctatagaatgaggatccttcttacttaatagagaagttttatggtttagataaaatgctacagaaaatgcttagcccagcatctggccataacgaagattttaataaacattagtagtgtgcaataaatacaatgattctaaaccagcatggagcatgttcatttagactgttggatccaatcagttctaacccaaaagggaatgcactaatgcaaagtgaatggtggagttgagagacgacatgaaaaaaacatgagggccactacaagctggaggcaggtctccccactgagcactgcctgaggaaaggctgttggctggggcctctgagcccagacatcttctccaacataattgagaaatatgttcctcatgcattcctaatggagtagagcagatggcacaggcat

SEQ ID NO: 46715 - DNA, 1254 bp, Bovine  19866881648642
gcccaaagtgatgagattcaataagaaaagtcctgactccccaagcttttgagcccttctcccagccacatggtgggaaacggataggctgatggaaaggggaaaaaaaaaactgtttcttccttccctcctgattgttttaattactactgaaaagttacaactggaagaagtggtttccagctaccttgctattaattgattttctgtgcttccagcaagcacacatcccctaagacttggatgagactgatgggcagggggggtccttggctgggaccacatgtgtatgtccatcacaataccctctggtccccaacctaatctggaagtggcagcctgaagctagtagtcttggcagctcacaaagttgcaagtgaagagagaataaagagagtcggtagtgaaagtgaaagtgttagttgctcagtcatgtccaactctttgctactgcatggactgtagcccaccaggcttctctgtccatggaattctgcaggcaacaatatactggaatgggtggccattaccttctctaggggctcttcctgacccagggatcaaacccatgtctgctgcatcgcaggcagattctttactgtctgaacagtaaagtaaaaaagaaaatatagaaaggtcatccttagaatgagtttataaaggcctgtaatctacggactcttaattttgcagcccataaatgggcctcaagaattccacaagactcttgaaatcatatgcaaaacttggtgtgtatgggcatttttctagggaggggatccatggttttcattagaatctcaaaatgcttcatgatcccccaaagttaaagtgcagcagtgtaatctacttaccattctttacagaagaagaaaccaaggctaaagaggaggttgtaagatatccaaggtcatcctgtaaattattggtggatcaaatttggactaatacctccatatacttgatcctatacatttcccacctgccacacatcctctttgccccaggcttaagtttagaacttgagtggtatgtttgatggaggtttgaggacatagttagtcccaaaaatacagtccatttgttattattagtctgtgagacctgactgtgtttcctctccaccacccactgctttgagggtcttactttccattgggacccatttctgttagttcactttccaacaccttgtatctgtgaagaccccaccatatcaccgatttacctaaacatagtgtgtccatggcagtg

SEQ ID NO: 46716 - DNA, 921 bp, Bovine  19866881649882
ctcagtttctattcattcattcattagaacaatcatttgcttgatacctgtctttccctctgctctacaagcaccaagaagggggaccatccctcttggctctcgctacactcccagcagttagcacagggcttgggctccccaggaccttcaacaacagctcggaaaaagtaaacaggacatgactgagtggcatctgatctgtcagtgcctcctcctccatacagtgcagctccttcaacttgaagacacccatgttcatcccgaggccacatttctataaacatctgcctttagttctgtgtgtgtgtgtgtgtgtgtgtggcactgccctggatcccactgaggtcaagtaccttgggcctcctccctgcccatcagctcttacttctgacgctgctctctttacagtcttcacactcttgaaacaaacattcacattaatattaattctgcatcccaggcagcaaatcacttagatacgtgttttactaaacgaggttctggccacatctcccaatcacacatgccttctccaacaggcacttgtagagagcacaactgcaggcagtgtgatgaatccttaatggcagcattccaggccggatgagagggccagtcaagggagcttctctgtttgcctggagttctaaaatggaggcaaagacctaaaccttaagagacactgcttctaagacctcatcttgcttcagctaaaacagccatagctacaggaataagaatccaaaccaagagaaccacaatctggacagcaccagcaacttgctgtatgtctcagctaaggtcacctcccctccctgcatcttgctttcccaccagtaagatgagattggtctaatagtctctaaacccccaactgagacatttcacaaatctgcagaatgctcacatttttcacat

SEQ ID NO: 46717 - DNA, 700 bp, Bovine  19866881656664
cacagaaaacaaattatggttaccaaaggcagggaagggatacattaggagtctgagattaacatatatgcactactataaataaaatatataactaacaaggacatactgcataacacaggaaactactaaatattatgcaataacctctaagagaaaagaatctgaaaaaattatatgtatatgtatataactgaatcacttagctatatatctgacacatgttactataaatcaactatacttcaacaaaaaaaatttttaagctgacataaatattatggatccatgctctgatatctaatagcctcaattaaaatatggttgtgtacatcactaagtgcagatcttaatccttctgcaaaagcctttatggccacaagtgttttcaaacactatttgaggtctggggagacagaattggataaataatacacaaatattatacaatatacctctatcctgagaaatgtctggagtagtactcaataattaaacacagaaatatttttgcagcaaaacatattaatattaacattaagagagataaataattatagtctgatgtcaggtcatgtcaggctttatcacaagatcagtttaagtcacatcaggttttgctgacaaataagcttttttaaaaattaactttccatttcaaagtatttgactgaacctgtagctattaatcacagaaaat

SEQ ID NO: 46718 - DNA, 824 bp, Bovine  19866881738471
actatagctgccaggttcctgtgtccatgcaattctccagcaagaagacgggagtgggttgccatttccttctccaagggatcttcccgactcagggatcgaacccaggtcttctgcactgaaggcagattctttaccatctgagccaccagggaattaaaatctctagaactccaataagtcatgtggcttgaactataaatgttagagtttttcagggaaagaagatcaatagtattgaaactggatggttttagagaacttgaaatgcttgacctaagctttggaggaggataaaggcaattgagttgatgcagaagtatgaacagagggacaggaatccttcaactgaaggtgagctcaagagatggaaaacttggaatgttttgctaagctgttcacatcttattctataggcaatggggagctactgaaggatgctgagccagggtgtagcaggataacaacatctttatggaaagaagaattgttaactggcctttgtgatgcctttaaagatagcaaatcctgtaaagagtttgtaacctaaactctgcccttaatgtgcagatttatcctggataaatgctttattggatgggtttgatttgccctgcatatcaaaggagaagcaatgaaggtagttagtgtgtctcattgcaagtgccaactccatacactcagcagtggatctctaaagcaccatgtttagaagtattctgagatcttatcagggcttaaaagaaaagtgctgccttcagctagtaatgtctgccgcaggtgcaggaatgaggggtagagggagccatgccacatgtttgaca

SEQ ID NO: 46719 - DNA, 809 bp, Bovine  19866882065552
cattaaatgcatggataatgctctgtaacataacttctgaggtttcctaacttttcttgagcattttggggacaagaacacacttcctcttgagagaacccacttcattatggaaattaacccaaatgttaatttccccctcattacctgcctccctatcacttctccagcaatcaaattccacctgctcagcactctgtgtgctgtaaggaagaccatcagcagtgaccaggtcttcctcctgacacttctctcctcccatgtgatagtgccagggtcaccatgggcatagtttatcttccttaccttgcaaggaagtacaaatgtctgcccaggctttatacaggtgaactccttctttgttcctctccctctttggggaagctgtggtccagccacgagttagtggaatttctaaacccatcacatctgatttctctgaatctcatctcacagccaggatagcacaaaggcagttcctccctgggaccatgggagctgttatctgccgctccttggatgatgctattagcattactcatagctcctgttcctccttcacagcctgaaatcacaagcatgggagaggctgataaagaaactggcttatatatgcctttcctttcactgctgatatgcttgtcccttgtgggttcttgcagaataatggaatcacaaagagaagagaaaagttatcattgggttaggaagtatggagctccagtgtgcaggactgtctgggggtcactgattcaggggctggaggtgagcagcatttacagacagaataaaactttgctcagaaaagg

SEQ ID NO: 46720 - DNA, 919 bp, Bovine  19866880361279
aattccctggtggtccgtgcttatgctccattcttgcactgctgggggcccaggttcaatccttggtcggggagctaagatctcacaaatcaagtggcagggccaaaactaaattaattaattaaaaatacacagacttgtgtaaatgtaagagttccaatttaaatgcaaatagccctgcagccataacacattacatcattgtcattcattaacacctttcaagcgtaacagcaactgggaagtctaagaaatcctggaaagggagagaacgtaaaagtgcttccagaaagaacaaggccagctggcagcctcagcaggaatatgggaaaggggttgccaagcgattgaagaaaggtgaactgagcacacacttccacttggagagactgaaggactttgttgaaggacaacaggacaatcagtaacaaactgaatgatgtctggtattagactatgtaattagctactcatttatattctcacgtatatctgaacctcttaatggttcacaatcatttttggaagaagatgtggtatattttatgtaacaatatggagaaaaatctacttaccaggagaacccacccactaccaaaatcgtttacttggatgaataactaaattataagctttgatgaggaagaaggccttcaagaggcagttgatgatcactctggggctaattccagggtttggctttgctgacaaggatctataaattggggacaaaagctgaataggctggataataaaagagtcttcagaggctgtttggagtaagagaggaagaatgacaagatcactggcagaggacagaagaatgaggaccttattagttctctaatgtgtgggctctgatgcaaatcaactttcctatttcctcatgaaatcttcagaaaaagtccattcttgttag

SEQ ID NO: 46721 - DNA, 1159 bp, Bovine  19866880373482
tggagtctagctttagcaccattccttccaagaaatcccagggctgatctccttcagaatggactggttggatctccttgcagtccaagggactctcaagagtcttcagggcacaataaatgcaatgtgcttgaatcaacccaaaaccatgcctcccaccaacccccagtctatggaaaaaattgtcttccatgaaactggtctctggtgccaaaaaggttggggacttttgttttcaaggaaagataagtgtgatagttcttgagcatatgagattgagaactgctacaatttccgagtgtcccagaaagttacaaacatacccacccaaattctttcatcccttggttttgccctgtttttttttttttcccatacatctggctgggtttctcagatggcctcttcctagagctcctctagccttggcctacaaatacttgggttttataatgccattagccccaagatgtttggaagtttctgttgctctgacctgaacactgtgatcctgagattgagcagcaatttccagattcctcacatactagaagattccaaatgcatagttttttacctaacaataaagttcagctcaggccagtctgaagaatggggtgataagacactcctgtggtctctataaaactgagaagaaaagtggagccctctctggttgtacaggaggcaataattccacagggtcagtttcctggtggctcgggtggtaaagaatccatctgcaatgctggatacccgggttcagtccctgggttgggaagatccctggagaagaaaatggcagcccactccagtattcctacctggaagtcccgtgggcagtggagcctcatggctacagtccatggagtcgcaaagagtcagacacgactgagcgagtaacacttccctttaagagcatcagctttaaagtcagagaaaccaaattcaaatcatggctctgtcactcaccagcttttttgtttttcctttaagttcaagttcagtcgctcagtgtgtccaactcttcacgaccccatgaatcgcagcatgccaggcctccctgtccatcaccaactcccagagttcactcagactcacgtccatcaagtcagtgatgccatccagccatctcatcctctgtcgtccccttctcctc

SEQ ID NO: 46722 - DNA, 1184 bp, Bovine  19866880391859
acctagtacagtcaaagtaaattaataaaaatttttagataaattaaaatgtttaaaaaaacaaaagatttagagtgcacaggaagcagggatacctaaccaagatctggggaaagcttcctaagtgacaatttctaatgtgaaacctaaaggaagaggagaaatgtgataagaaaagagaggaaagaagagtgttaacagagggaatggctgttcaaaggcccagagaccgcctggatccagattaatatcatttccaatgcactgcaccttctcttctccaggccaaatattctatagatcactgcttataaaaccattagacattctttatttggtatgaaacatctctgaaaccacccacagatattaaggacttgggaaagagtactatgttcatatttcctgtatcttaaagctaaatatagattctactctcgcataggctcctgattcattcaaaacgtgcagcaattttttatgtgtgcaaatgaatattctttaaggagacagcttacagcaaagcaaacatcatgttactcccaataagtgtaaggacaattggctgtggtgaggacaggtaggtggtcgggtgcaggggcaggagaggagctcagaggcaaaggatgggcacaaagggggatgttaggaggccatctagcacagtggtgagcactcaggccctggcagctccactacttaccagctgtgtgacgccggacaatcacataaccactgagtctcagtttcctcattggtaaatgagggaaggagcagcacctatgatagaatgtcccagctgcaacactgcagacatgcaggccagacaattctctgttgggagggtctgctttgtgcactgcaggagcagcatctcaagtctttactgatcagatgccaggagcacccctcacccgggctgtgacaaccacgaatgtctccagacatcaccaaatgtctcccgggggtgcaaaatcactgcccacttcgaaccactgatccactgaatgagtcattgtgaggattaaatagaatcctgcgtgagaagtggaggcacagtgctcgataaacgtttgctaaataaatacctaaaacaaagggatgaaaagctcctatagggatgaaaatggcactgagaagacctgccattttgtgaatttaaccagccatcactttagcccagg

SEQ ID NO: 46723 - DNA, 821 bp, Bovine  19866880420296
atagcagacatcactaattgagcacagccttgttccttcaggacttagactagacctcaggattaggtcacctgataatttctgcccccctcctgtgggcagttagtctctgaaaagcatttgctgtgagaagctgctaatgtacagaaacaaccttgtggacttcccagcagcaggagcgatcttgaggaagagcttttcttatttaggatcccagtgggatgttatcaagcaggtctttgaaaagttttctctagggatttttggggctatggcaacaacaatgaggataatgcctcacattttgatttgtgctttatagttttcaaagcactttcatgcacattttctaacttcatcttcatagaaaccctgcctggcaaagcagagaaggcattagaatcagaaaaatagcaatctttttttaaaatgaaaaggaccctagagactttgtccaaccttctcattttatagactaagactaaggaaggaaataccaccattaaaaaaaaaagtgtaggtagagagtcctaaaactccataatgttttgagtccaggatggaaaaggagcatttgttggcaatgattttgaaatgttaggttccttaagatttaataatcccacgatacatattatttgctttacagaactttgtagcaatactgggccttcctgtatgatgctcaggtcttcttctacctctagatccaaggagactccaccccatcatcttgggtgtttttgttagtcttcctttgtgaggaaggggaccaatatatggctgatcttgcaggaaaatctaatttgggtcaactctat

SEQ ID NO: 46724 - DNA, 3068 bp, Bovine  19866880491750
cctgcccaggtcctcagagactccatacttggcattgtctgtggggagaggtttctagaaagcagaatattacaggaatcaagtcctttagatgctaatggcaagagaaaatgtctgtgcttctaaactctgaaaatcagagtcaatttggtaaaccatcaagagttttcaacaacatatccaactttcagtaaaaaaaaacatatcctatataaccgtgctgggattctccacttcttctcttccaactggaaagctgtgctcctggcacaggggagccaaacatagatactttcaaatgatgacttttcattttgtggcctctgagttataaatcctttgcctagaaatttgaatttgatctttttcctctgctggaaggtcttcaccctacatctaacacatctctttcccttcctttaaattgcttcagaaatcccaaatccttctaaagggttttggttcactcactgggtctttcacccaccctgctgcacaaggggccaggggctgggaaggcagcagcaggcagaacaatcacgcagaacaatcacggtggtttggttcttaccacgttttgactcacaaggaaagaggatataagacaatcaagtaaactgttactttcttgcaactggagaatgttttaaacatgtaacagaagggcctgacctagtctctgaggcctggtggggttgggggtaagggtttcctgaggtgcggctcagataatacctcaaggatgaactgaacagagagcagcagcgagagcatttacgggggagccaccggcctgcaaaggtgctgaggcagcgaagaacaaagcgactgccaggaactgaaaacaaggaggtaggtcactgtggctggagtagaatgaaccatagaggcagaagacggaaggtaggaagacacatgtgcaaggctggtggccataacatggatcgtgcattttattctaggtacagtgggaagatgttaaataagactagaagtgaagatatagtaaagacagtcttataggcaagtggctgacatgatcccatatacatttaaaaaaaaaaattactctggctatgtgtggaagtcagattggagaggactaatgttgatatccagattgattattttggaaatgcagttatccatgaatgcagatgatgacctggacttgggtgagggggttgcttagaggtggggaggagtgtctgaggttaacagcagctcatcggccgctgcaggctcttgcttaccatgcccacgtgacagcaagaattccagtccactgactcataaggcagatacaggccttaccaataaataaatacaaattggcatgcctgggaattgtatatagcctgaaagaccaagagaaaagattcttttacattagccagctgcacgtcggaataatacacagacctctgtgaatcatttcatggtttattaaacaaaattctgtttgcaattggcaagttaggaaaataaatgtccacgtttgttttcactttctatttccttgtttttttcagagacttacagcccaaatcttagggctgtccttggagacccaggaaacagacccgaatccccagttctgaatgtcccagtgaaacacagatcatcattaactcctgtgagaacaaagaggattcactgatgttgttctgtcatcttcttattgtgcattactgctctagaccccttggaccatctcctcttcccaaccaagagaatgctgtgaagaatccacgggcagaggagctttgccttttttgagaagtgatactctacaagctcaatcaagatttgtttgtaggcgggtggtgaggatttagttggcttagtcttatttgagtacgtggtttctaaagaggacaaaaaacctgcactaaaattacttggaggacctgtcaaaacagggagtgctggtctcccagaatttctgagtcaggtctgggatggagtctggaatctgcatttcaaatgtgcttctggatgatgctgtagctgttaggctggggaccacactttgagaaccactggtctatataacacagccccacagaccaactgtactcaatggacacatgaactattaaatgcctcctgtgcttggccctgtacctgcctccaggtctttgaccatccagtttccttggctgggaaattttctggagctttccttacttctaaggatgagttaatctgagctcctgggacctcactggtgctttctcaccattaggttatttatcactttgccctcccttggcggcaggaacagtctcattcttctttgttcagtacttggcacatagcagaggttgatttaagcaaaatcatcagcttttggtaaatgaatggatgagtggttcagaatggatctttgacccaggacatcttggcagcatctagaatatttacctggaacggaatcatatttctattgacttcatcatttaatacccatatttagggcctctaatacgtgctctgttttatactaggtaaggcattatctctgcgggcaaggattttaaaatccaattatagcaaaggaaacagtcaaatataaaattacaatacgaggataacctttactgttgattggcatatctaaagtcactaagcactttaggcatcaggaagaaaaggtcatttttgctgtgtgcaggtaagtctttgatctcatatgtttacaaaatctgtggactcagttattcatttaccaaaattcttattaaaagactacaatgtgttagggcaaatccagaagaacacttttcagcgttgtaagaagaattagggttaatttagtgtaacctatctccagatactaagatacccgcagagcttgcccatctcaagtgactgtccgataactccttgaatgcttctagtaacaaagactcaccacctcacgtggcagccaatccttgaattactgctgactgttaacctttctcagattgagatgaaatctctttccctgaactttctactactggtcttttgggctcctggagtaataagggatatttaatttctcttcctccaacaaccca

SEQ ID NO: 46725 - DNA, 953 bp, Bovine  19866880506536
gggacaccctccctcctcatcccccagggaatgacatctcctggagctggctgcttctcacctcaggcccgaggactgaagtggaggcgcccaaatcgccgctccagtcctcagtgctcagctctcacgctaatacaggacacaggcagagccatggtttttcgtagcaattgctggttgttatggtgggccagtttttcattttatattttggaagtgaaagcaagggggacaaagagtgaaaaactgaaaattcccactcctttgcaagcgacggggctctaactttcccagcagtattcaaactctgacttgccagttacgtcttaaaattgaaatcagatttggagggacgtttaggatcatctgttaaagacacatatactcactgataacactacattcttaataaagtacatgtatattttgtaattacaaattccttccggggaagatgagaaagctcatttgtggctaatgttcaacgaacatagtggggtgtgggtgttttttccccccatcttttttctcttttagtaggaagtttggacacaaaagccactgactcttgtcttctctttccacagcaatatctggcatgattgttcctcccatgtgaaagaattgccttgaagaattttattaatgaagaggttggattctgctacagagagtaatctgatacaagtcccagagtggaacttttaactcaggcctttttaagaggaatcacaataactgcagatttttaaacaaacaatatcgccgaccttgcaaatactgaaattggaagggatctgctaacgcagggtgttggttacagttgtacctcccgcgtccttcgggggatatatttattctgtgttgataaaagcaaatccactttttctttctctctctcttttttttttttaagcttaactgcaatcacttgtcttttataaaccataaag

SEQ ID NO: 46726 - DNA, 865 bp, Bovine  19866880523725
tccctgggattctccaggcaagaacactggagcgggttgccatttccttctccaatgcatgaaagtgaaaagtgaaagtgaagtcgctcagtcgtgtctgactcttagcaaccctatggactgcagccccaccagggctcctctgtccatgggattctccaggcaagagtactggagtggggtgccaccgccttctccgcaaagaagcttaagtcagtaaaaacatatgtgaaaggatctcatccaatttcattgaaggaaatttgctaaaactttttccctctaacctccttgctatcaggacccatttataaagcagagggctatagctacaaaggaattagtcaggtttcctcttttcttgagaggataaaaatttagtttctgaatagagtaagctatatgatgttttcactgcctattctgggaaggacaagtctataccacctaatgactagcatttcctctaggttttattttcttggagcctttcacagcagctggcaacagctgtagggagaggactagcaggttagctgcctccagacacagtggagagagaaggaaccacagaaatagagcacaggagtcacttttaggggatcattctccaattttctgccaaagtgtttttggtcaagacaattaatggtaactggctcataacaacactagaaaagagtgaaggtagttattgtgaggataaagaaatgcattatgggaaggcaggagactgtaaacagccaggactcagaaaagtaagaaacaaggtacctttggggtttgacctcttaacacacactatccgcctctctctctttttctcttctttctccataaccccctctctagaaaatagcttgtg

SEQ ID NO: 46727 - DNA, 1889 bp, Bovine  19866880542869
tggttgtgtgaatgctatgctcttgggaagggtgtcgcagcctttgtggtcttgggacatagggagagggagcagctttttatcatggcacacaaaaggcatagtagtgagagtgaccagaagggactgcccagagcttttacattcccccctggaacgcaccccacccatgctctgatgcaaaccaaggcagaggagagaagccacaaaaatgactgatgatgggtgtcatcttctcactgacctcgttgtctgggacatgaaggtggattttgtgtggtttataaacataaaaatatgtgacactgctcatatctggagtatcaagtcacaatttctactcattaaaataactttcatacagacttcaattcatagcaagtattggcaagtgtcaactcatatgccaaagaaaactggcataggagtcatcttccccaccctaccgccccagctaaagcacctggttatggggattattgactttcttacttccttctctactctctttcccgagcgcccacggcaccctgtataggagggacagtctccgagagtggaagtgcgtacattgaagtcttgaatgggtgcttttgaaagactgcagaccctggctgattgtatttcctgctggcagtgaggacgtttatgacgatccagattttggactgttatcagctctgctgctgctgctatcacaactgtcttggcaagagaatgtcacacaacctctgccaccacccacctcccatgcccctttctccttgtaaatctcaaaggactcccaaggaaggagtaagttaccagcggttgcactgccccccaccagtttgactggtttttcctgctgcagcagaccagtctctgaggccttggtgacccatggagacctatgtggttagcagccataggacaaaaatactcaggtttggcaggcaaacactaaaattggtcttttcaagtgattctgaaaacctgaagagcgactttgttgtaaaacctgtgattttcctttttcctttccaatgagttggatttttgaactatacttagtattcagaactcaaagtcctctctgtgcccatggcttgagaacatattacaaagtgaaccctttctctcagtaaggggcagagggtttttgaagaaccctgctgttgtccttcagatggtaatcgtatctgacatacttcaactggccgtcctcacaccaggttcttagtacatttctgaacaaggaaaaggggaaaaccattctcctactcttaaagagaaatgtgaaaaaattactgatttaattcaaaccttaccttgatagaaactgattaccacagaaaatgaggcaagaaactcacatctactgtaacacctactgtgtgctagggactcaggacatagtctcttgtttagttttccacagggactcagtacatgttctcttgtttaatcctgcaattggctaacttggcaggctctctggcaggctcccatgaattaacgtggcagcagatccaagagagccacaccagaagctgcaaggtcagttgagacgccagggccacttatgccatattctgttggttcaagtgagtgatgaggccaaatcagattcaagagctggggaaacagcttctatttcctggtgggaattcctgaaaaaggatatgtgatataaagggtgggcagagaaggcaatggcaccccactccagtactcttgcctggaaaatcccatggatggaggagcctggaaggctgcagtccacggggtcgctgagggttggacacaactgagcgacttcactttcacttatcactttcatgaattggagaaggaaatggcaacccactccagtgttcctgccggagaatcccagagacggggggagc

SEQ ID NO: 46728 - DNA, 1412 bp, Bovine  19866880599116
caaagaaactactttaggaaactttcccaggatttgtttgaggtttactgagaaacttaggcatcttcactatagatttgttattcatctgagcacattttactgtatttaagagcttcattttgtcaatatttacagaactggatggacaaatgaaagtcaaaggctctaaaatatggctggagtcttgaagtcccagagtcagggctagaacacatggtggcaaacattggtaaatttgctaaattatgcatagaattcgcaaggcacccaacactggccagctccaataaagtcctccatgaaataccaaagggcttggtggatgagggtcagagggtggtgaatagtctgtgaacaggtgttaaaccacttattcaagcactcctccaaatggcctaaaagattttcccaccatcctcctgctctcgatgagtcactgtgggaatagcagtgaggtttggagttgagttataaccattcagtgaagcatttcccttcagatgaactcatactataggtcaggcactgagctcctggaaggatgcagtgatgtgtaatatcagacatggtccatgacttcatgccacttacaaactgattccagtagaccaaagtttgaacacaccagtttcctagtaaaggacattcacctccaatgtaggacaaaaaaagcaaagtggagagtcagcagcagctctgcatcccttctctgttctttcttgaaagtgcaccctcttttcatattcttatttgccgctaagataccttttttgttaaaatgttcaaatatcttgcctattatttttcaataaatatttaattaatttataaataaactgatttagagatatttagaaaaataaatatataaagagcttccccagtggctcagtggtaaagaatccacctgcaatgcaggaggtgctggagatgcggattcaatccgtgggtggggaaaatgccctggaggagggcatggcaacccactccagtatgcttgcctgaagaatcccatggacagaggagtctgtcaggctacagtccatagatttgcaaagagtccatcgggttgcgaagagttggacacgactgaaatgattaagcacagaaaaataaaataacctccacctggtataacatgacattgctaataagatagaaagacttctcaggtgtcacttgcaggttaatgaaaccacctgccaatgcaggtgacttaagagatgggggctcaatccctgggccaagaagatcccctggaggagggcatggcaacccactccagtattcttgcctggagaatcccatggacagaagagcctggcaggctacaatccatatagtctcaaagaggcagacacaactgaaatgacagcacacagttagacagaaaggaggcattgaggatg

SEQ ID NO: 46729 - DNA, 1205 bp, Bovine  19866880666793
gaatcagcctgataggattaaacctttatactgaattctgctccatctgttctccaaggtttgcctttccttatctgaatatgaatttttagtctccttgtgtctgggagtcagactaaattcagcattcaaagcagagatgtgtgcagataatttaacatttcactagttaatctcagttgatatcagcttggtctttttctagtaaacatttttgtaaagaattttcctaagaaggaatttaaaagtatggagaatccacgctctttgttagagggcttttctcctcccactgaattctaggactcactccattcactgttctaacaagggtttacattgacgtttgcacataaagacagaaaaggaagacctgtgtcctctctctagatctgactataagaagagatgacataattctgactggatgaatgatccaaggagactatattcatgtatgttttgttctttttctccctttcaagtattagtcgatacttgataaaatcatgtacagcagctgtctctatcatgtttattaggttttctgtttttatggagactttctcggggtggaggttataattcagcttcatcttcagtgaaacgtgttgatgtttgttttgccctcctgtacctctatccctagaagcagttaaagcagtgaagttactcatttctcagctggaaaagctggttccgggcaagttggaagacagagaccagtaagttgccactgggccagagcctggtggatggtttgggggtttccgacgctgtaacaaaggacaggggaggcctatgactgctgggctcagagaagcaaaccaagatacaaacgaataaataagttgcatgaaagaaggatcttctggaattctactttgtgtctggtttatggccatgtgatcattagatgtgttggatttacacttgtgatggaacacaagagccagcagcctgtggaaccccaggcctaagaagagaggatccctctagcagggctccagtggttgtccacagtctccttggtaaccctagtttctggctctgcgccatcacgaatggcagcagcaagcagctcatcaaaaatttaggcttttccacacatatgtctagttattatatttacacagtacccttaactgaacagtcagggggcagagagcagcaaaacttcccattcaagcttaagtagatttata

SEQ ID NO: 46730 - DNA, 2356 bp, Bovine  19866880703433
caaagtgggatgatgtccacaaattaattggttcagaaaaaaaaaaaaactatctttctctctatatcaatctgtgtatgtatgtctgtgttgagagagagggaaaacacatatgaaaaaatgttaatctttgttgaaatcaagtgacggcaatacaggtgtttattgtactctcctttcaacttttgtatgtttaaaaatgatcaaaattcaaattaggaaaagagaaaagatgacctttatctgaatgggcactcatgcttgtgttgcctttaagaaatgtccaattccccaattacaggacaagtgtaccagagaaagaccatttgcattacaaaataacttttaattttccagggggaaaaaatcccctcaagtcttattcaaatcatagcaattaaaatgatccaatgaagagctcagctgtgggggaaactggaattagcactagagggcagtcttccctcccttcttccctccttttgtctctcctttccctctccctttcttttctctttttatttccccctttcttccttcagttattttgctaaaataaaaaaaattttttttccctttttttcttttttaacaaactaggaagttattataaaaaaaatttcagacaataaggaaggagtaaaggggacagcaaaaattatccttgatgttactacctacagataatagtaaaaacagtgcaaggtattattctaagcattttacacatattgacatgcttaaacttcactcataacctgagaaggtagttcctactctcatgcacattttacagaagagaaagttgagtagagggtgttaagtttctgaggatcaaatcctacatggccttgctgagaaagagacactctggactctttggtaaaagtcctttgctacatacatacttgcccacattcatgtgtgtatacaaatgtgtgcacatgataatcacccacatgtatatggatttgcacatatatgtatgccacaattacatgtgtaaacacacacattttacaaaacaatcattttattcatgggactttatgacttggttaaaaaaatatatatcacaacattgttaatcctctgaataacaggaaactgtggtgagagagtttaacttgtcctaggctgagtggagctgtgaacctggctggttgactccagagcctgtgttcttagtcatgtactgctcctttttttttttttaatccagttctctaatttttgtgttttagttatttcttagtcttaatgttttataaataatgctgtcatgaatatctcagaataaacacttttaagaatcctcaaaatcttagctcttagacccctagactttatttctttattcacaaagcagatattaaataaactagaaaatatgctcagcaataggtcttcctgtaaagctgtgtcaactgagagttggaagggagacttctgatcgatttttctgttctgggtaagaatcttttctaacaatgacctagtagctgatatgattacaatagtagtaccaccccttgaacacgtcgctatatttcaaccactgggtcacacctttttcctttatcatttccttaatctttacaataactctgtgagggaggtgttatccctgtgtgttcagatgagagcaaacatcctgtgacatctctgagaagatgggcaaagcctctgtttacacacatctatgaatggggagctctgttgtgcaaagcagaccagaccacttatggagccctgtaattgcttacttactattgtaagaattcacttacaatcactgtagaattcaccaactctcttttcacacaatagagcttgtttagataataacaatgaaaatagctgccattttttgggcatttgcaagaggccagcattagttcttagtgtacttttcacaggtatttttaatacctcacttatacataatgaccttatatggggggtatattatttttttccattttatatatgaggtgactgaggcctgtggctattaactagtgaggccaagacagtcccatctcacctgaatgtacttacctgatggctttagaacctgacctctctagaaagatgcctgagggcggggaaagttaagatgattagttcagtcaacatagaacaatgtcagtttagagagatggaaagccgctggccaagttccttcctaaaactttccaaagttttcagaatttcatatagtgtggatgtaggttggaacaaggaaaatttagatggaagtctagcaaacattaattatcacatcaacaaacatatccgtaacatttattgatgtagtaggggtttgctataaaacctaatattgtgctgtgtg

SEQ ID NO: 46731 - DNA, 973 bp, Bovine  19866880712615
agaacataggatgcatgccttgtgaagctctaggtgccactgcggttttccaattctgtgagcaggtgtgtggccttgccatctgtaccatgccaacatctgggtcagagctgagcaaagcattgctccagactaaccaggagaagataagcctctggctcagcccatggaggaggaggatggggtatctgggaagaagagctcactttattttcttttttgagcatctgggtcaaaagtcatcatttttacagaaaagtcccaccaactgttttgtttttatgtccagaacctcaacatcaaggccacaggaattagtgataaatgcccacattttaagtctgtggcagaattcgctaagaatttgagtgttcaaacaatgtcacatgcataaatttcactcccctctgcttattttcttatttgcatttggctccttcatgacttagttcattcgttcctcattttatttaccaaatatttattggggaatgaaaaaatatactgctggaaggataagagtttgcattttgatcacctcaagcataatgcctggtggggcgtaaaaagtttagtaatggctgttgaatggacagattgatggatatgtgaataaaaaaattagaaaaccataatttttatacttagagattatttttaattaggaatgggttcaagcaaagtattcagagtagctcttaaaaaacaaatgtcattcaatttttaaaaaaggtgcaaataaaagtaaaaccaaatcaaatttgtcccaatagagttgagtgatttttacaaaacaaatccattgatttagatctcccagttttgtctgcctgtgcctggggtcaccagtcaagatgactgattatcctgggaaaggctctgtagcctatctcataaacagagggaaaaaaaaaaaaaaaaaaccctatctcacacttggtcagaaggcagcccaaatgcttgtctccagagg

SEQ ID NO: 46732 - DNA, 1551 bp, Bovine  19866880726228
ttgttggtgaaatgagctcactctggctattagacccttgagtcccaaggggaacaccatggaggggagtataaaatctggcttatgcttatatttaagataggcagtatgacctatattgggcccataagagtgatgctacatgagaaaataaacagggagggagctgttagagatcctgctcttctagccagcatcctcttagagcagggatctgctgtggcccttggaccaaacgctacctctttttgtatattctatgggctgaaaatggtttttgcatttgtaaattggttgaaaaaatcaaaataagaatattttgtggcatggaaaattatatgaaattaaaatcttattgtccataaaattttgggggaggacacagctatgcccatttgcttccatatcatttcttgcagtttttgctttctacatacaaattgagtggttgcaacagacactgtagctgcaaagctgaaaatactctctggccatttgaaggaaaagtatatagactcctgtcctgaaggaatttggacttggactctgaaaaggataaaattgctggtacaagagttcaaagtcctttatactgttagcacatttggatattgactttcgatgctcattaacatattttctgaaatggacagataagcaagttaagggaagaagatagggatttaaaaagtagtttttggatcccataacagtattccctaaaagcagctcccagggtgacatactaggtgacatcctttccctccctttccagtgcttccttatgtcttctgcttatcatttccagtgctgcagccttatcaaagccatgaccatcctccttggtctttgaccccttaaatggtctatttccatacttgttcaataacagttcactctccacataacagctgtagtgatttttaaaagacaaaaatcagattatttaacttctttcaggtttttgtatgaatattccttccttaattcaagtctctattccagtgataatctctgagaaaggctttccttatctgttctttctagagtagtcgccatctcactccactatcatttattttattaccccttttattactctcttagcattcgtcactgtcttacattatctgggttggcttactgaattatgtgtggtttctcccatcagaattgaagcttcatgagggtaggtatgttgactatcttattcattagagtatttctaatactcatacatttttcacataagtactcaagaaaagtttcttgtgtgaataaatgggttggtccttctggtagatgctccatgcagcattggtatcacaccctgcctgtttgcttctccaggggcatgacgattttcttaatttcatcttcatctcttgcctatcagtatatcaggaagcaacatattgactagagaattgcaccgagggtcaatttatgagttttcctgtggtttgtaccttagatcacctgaacaatctgatttctttctggatccttttcatcatcagggacattatgaaggtggttggaatgtccaga

SEQ ID NO: 46733 - DNA, 904 bp, Bovine  19866880743826
cgtgtatagcaccgggcacaatacctcacataagaagcactcaaaaacttgcaatgagaattatactactgcctagtttccagagcttgcatatgtttatttttgccaagctcatacttgtatttaatttttttcttgtcaccatctcatcagcaggagattatcaagttttagcagcatcatcttgctgcctagagtagatagagagagtcagtttgaagagagacatattattcccagaaacacagactcttttatactcaatacaaagaaccttcaaaagtaagagctgtgacttcctccctccagaactggttaacctgttgggatatttggtagatgaattctgtgccacgcactcttgtatactgtgcaccaggccgggagacagcagctgctctccatgctgtccttccaacacagaaaaccaatctcacagcaccaggggagactgtaaaaaacgaaaaaaaaatgcaaatgtccagcattgattagttttgccagctgcttttctttagaatcaacggatgggccactttagctttaagtccattggacacacttaggggttctttttgttattgtttgtttcctttgttgttgttttttttttttttttagaaattgtattaaagaataaataatcctttgcaggacaaacctgtcaaagaagttgacaaatggaaggagggcttaaatagaagaactagataataagcctctattgaactgtttctgaaaatatctttgacccaggggatgatctggttctttcaaacgtgggattgaagagtcaaatgctttcagaggctaggctacttatgtaaataaatgaggaagcaggaagagtctgggtgtaaggcaatagggagtggtggtgggtttgggtgtatttttttgtttt

SEQ ID NO: 46734 - DNA, 1929 bp, Bovine  19866880782442
cccaaggactaaataactgaaagcatcagaaaagcaataacaactctttctctgcccttccctcttcagctgaatccagcagactcagaatgctgaaaagaattacaaaagcaggaaagccacagccactgcccttcagctcaaaatgcagacacactggagagacactctgtgcaaatcacaaagagtaaggccactgttctctgattccccagcaaacctgggacactctgagatgcagattgctgaattgttgcattcctggagaatctttgagggcctgtcctttgatatttgataataacaatagacttataaagagcaaataagtttatagatataagcttacatcacagggtccctgtgctgtgttcagtcactcagtcatgtctgactcttcgccactccatggtctgtagcccaccaggctcctctgtccatgaggattctccatgcaagaatactggagtgggttgtcatgccttcctccaggggatctttccaacccagggatcgaatccaggtctcctgcattgcaggtggattctttaccaactgagcccaccagggaagctgtgactagcttttttttttttttttaagctaggtatggcaactgtttttcagacttgtgatgccaattcactgtcaaagacaggtatatgtttagtccccgacttcacaatgaatttgaattgctttccaggggttaatatgttttttttctttcatgcatactaggaattggtcaccctgcttatttaacttatgcagagtatattatgagaaatgctgggctggatgaagaacaagctggaatcaagattgctgagggaaatatcaataacctcagatatgcagatgacaacacccttatggtagaaagcaaagaggaactaaagggcctcttgatgaaagtgaaagaggagagtgaaaaagttggcttaaagctcaacattcacaaaactaagatcatggcatccagtcccatcactgcatggcaaatagatggagaaaaaatagaaacagagacagactttattttggggggctccaaaatcactgcagatggtgactgcattcatgaaattaaaagacgcttgctccttggaagaaaagttatgactgacctagtcagcatattaaaaagcagagacattactttgcagacaaaggttggtctagtcaaggctatggtttttctagtagtcatgtatggatgtgagagttggactgtaaagaaagctgagtgccgaagaattgatgcttttgaactgtggtgttggagaagactcttgagagtgccttggactgcaaggagatccaatcagtccatcctaaagaaaatcagtcctgaatattcattggaaggactactgttgaagctgaaactccaatactttggccacctgaagcaaagaactgactcactgggaaagacctaatgctgggaaagattgagggcaggaggagaagggaacaacagaggatgagatggttggatggcattaccaacttaatggacatgagtttgagtaaactctgggagtttgtgatggacaggaaggcctggcgtgctgcagtccatggggtcacaaagagtcagacacgactgagagactgaactaaacagaactgaactaaaaagcaaaggccactgaccttttctatttcctagcaccagactagatgcgtctgcaaggaaagaatagccatcgtgtagacctttatagttgtgagtatgcttttatgtatgttacctcactttgtcataatgatcctatgaaactggcattattttacagggctgagaaggtatttaatatcatcaccattatccccatcattatcactgtattttgaggctgaagaagatttgtataagtgaagaagacttcagggagatagagcagagaaaataaagactta

SEQ ID NO: 46735 - DNA, 3532 bp, Bovine  19866880837811
atcctttttgttgatctgcttttaaaaagggggtacaaatttatatgcccatataatatgtaaatgcattatcactattctcttatcgactttttaaggaaatggtgaacatgcagtaaaatggtccaaagaaactggtgaaacagaaaagaaaaggacccaaatatattactgcttagacaattagaatctgaacaactaagagctgtttatactgacaaggtatgaatgaaatcaggcaaaatgaaaaagaagcctggatcttgtctctgagcaagggctatgaccttccagaatcaggcagcaatgtaaactagaagttttcttcatgccagccaactgagcacttagaaggagctggccaggcacagcttactttcccaggcttcacccatgggaaagccagatgaacgcctggcagtatgccatgggattacatttctcaaggatcatggctcttagagccatggaggcatacctgtcaaaggcagacactctggcccataattgccccaacacactgtggctaattgccattgctgaaaataatctctgaagattatagccggcatcataaataactgggagttctgcaccgacacactatgacaaggtctaagtccctcttatcttttactagagtgaagcttgtgcattcgtgttactaatgaatctttttcatttgtgcaagtgatgtttccatttgacaatgacatgaacataaagtggaagttaattcactccattgtgagaggttcattatttaacttgatgttgaagacaaaacaatgtagcttaatagatgacaaatagaaattagttgtgatgaattttgccatttaattctagcaggctcattgaatgtttgccataaacatggcaagaaagccatcgctgacctctctatgggtgggatttgttcattctgctatttccaaggtatcacccaaggattgggaaactcattgggaagttacactgggaaatgagcaattcccagttacacaaacgacttgagactaatggtgatacactgacaccgggtcagatttttctttttattggatcacttttctttatcactggataaacaattaacttacacagctgaacactagaagttgtattgaattttgatagctgttaccattagcatctaaaacctacacttgtgcctttttattcttccatatggagatagctaagtaataaaagaaagagctataattctagaattaaatagagcttatgttggaatcccagaccagttagttactaagtaggtgcttttaggttagttattcaacttctcctatcctcaatttcctcattcatagagtaggaatattattagtatttacctcatactatagatgggattctgtaaagggagtgatatgtataacttagaatttttataaagtcaatttccttgaaaaatggttagcaattcagtcattaattctgatgcttttcccctccatcaagacatacaatctgtaagaaaagcaggatatgtcatttacaccttcatcccttcaatagactccttctcccaaagctatttgcattcacagtcagttcagctgctcagtcatgtctgactctttgcgaccccatggactgcagcatgccaggcttccctttccatcaccaatttccggagcttactcaaacccatgtctatcaaagttgccatccaaccatctcatcttctgttgtccctttctcctcctgccttcaatctttcccagcgtcagggtcttttcaaatgagtcagttctttgcatcagatggccaaagtattggagtttcagcttcagcatcagtttcttcaatgagtattcaggactgatttcctttaggatggactggttggatctccttgcagtccaagggactctcaagagtcttctccacctccacagttcaaaagcatcaattcttcagtgctctgctttctttatagtccaactctcatatccacacatgactactggaaaaaccatagctttgcttagatggacctttgttggccaagtaatgtctctgcttttgaatattcagtctaggttggtcctagcttttcttccaaggagcaaatgtctaaatttcatggctgctgtcaccatctgcagtgattttgcagccccccaaaataaaatctctcactgtttccatttttttcccatctatttgccatgaaatgatgggatcggatgccgtgatcttagttttctgaatgttgagttttaagccaactttttcactcttctctttcactttcatcaagaggctctttaattcttctttgctttctgtcataagtgtggtgtcagttgcatatctgaggttattgatatttctcctggcaatcttgattccagcttgtgcttcatccagcccagcatttcttatgatgtactctgcatataagttaaataagcagggtgacaatatacagccttgatgtaatgctttccatatttggaacagtctgttgttccatgtccagttctaactgttgcttcttgacctgtatacagatttcgtcaggtggtccggtatgcccatctctttcagaattttccacagtttcttgtgatccacacagataaaggcattggcatagtcaataaagcagaagtagatgtttttctggaactttcttgcttttttgatgatccagcggatgttggcaatttgatctctgattcctctgccttttctaaatccagcttgaacatctggaagttcacggttcacatactgttgaagcctggcttggagaattttgagcattattttgctagtgtgtgagatgagtgcaattgtgtagtagtttgaacattctttggcattgcctttctttgggattggaatgaaaactgaccttttccagtccttgtccactactgagttttccaaatttgctggcatactgagtgcagcactttcacagcatcatctttgtattagtccatgccttttcactgaggaaagactttgtccccaatttaggtccaactgagaatgtaatgagagaaaagaaagaaggccattttaggaaaaatgtgcaaagctttgcaaaggctctgtgttagtgaggagtatggaaagtacaaggcctgaaagaaatccagcttgtcttgagcatagaaattcagaagattatggtaagataataggcagagtcaagattttgcagacctcagaaggccatggtgaagagttttgtctttatctgaagagcaatgagggaaggccaagtgttccaaccaggaccataatacatttagattatttcaaagagataactctgaaagtagtatggaaatgagatttggaagtgggcaagagtagctacagcctgaccaggctggaagctactgcagtggcccagatcaagatggcagtagcttagatgaggcagaggtagataaagtatggaaaggtttggtaaatatctaggaggtgaaattcattagactggtaatagattcgataggatatgggataaagaagaaggagg

SEQ ID NO: 46736 - DNA, 1569 bp, Bovine  19866880998332
ttgtgtttctctttgtcttttggctgtggcttccctttccctagggtgagagagaataaatatctagtttgagagtaagaggaccattgagtaaacaaagagattcattttatgtacgtcggcgtatgtctgtgtatgtgtgtctggcgtgtgtgtatacaaatgtatgtgtatatttatatttttggacaagtaccgtgtagttcaacttgagtaagtgatgcatgcaggctggaactacgctgaactttaaagatatctaagggaggcaaaaatagagttggttttggcttcttaaattgttgaacatcattggttattgcatgtacctccagacgaatggtatctgtaaatgatgattcccaaagctttacagatggtcctgactataactgcaattaaaattcactgcctcaagactgctggggctctgttggttcttattactccagtgtttaattgaagtgttactcaaggctgaaaacagcaagcatggccggaaacctcctagtgtctctgtttctttggtctttaagagaagggtgttgggtagaaatgagccccttgtgcctcccctgtgacttctccttgaactaatgagtaattatattcaaagcctctgtacacagggtgtgatatgaaggttaaagttacccacacacatgcgtgcgcacccacccatcaagagctccatgctaaaaaaggacttgaaggaggctcaagaatacaggctattggagtagctgttattacaagtccctgccgtgatgactcgggggctaaagagaaagagaattatctcctggtactgtatttttaattcctgctgcctctttcccctgactcagccatctgtgagctaccctcagaccctgctaccaccttcctcctccccctagctgaacttgcgaaattctaaaaatctggtttataaaactgccttttttcttacaattcccatttcttaattctaggaggcagtgctttagagattcgggctctggaatccaaaagcattgactcaaaacctgctcggccactttcagcattgcaaacgcaaccctcggtttcctccgtttcctcatcggtggactcagaccagcttcaagctcagcagacagccagtgaggcttacggagcaggaggcagagatagcagtgataacccttccttattttccagagaatttgggcaaactatgtgcattcttagagccaatgtggattatgtgcctgcaaaaccctgtgaaagactctgaacagactaatggtgaggaaatctggaaatggaaaatctctatcgacagctgcacgagctgtcctgagcctcagtttcctcatctctaaattgggcatgattcaatagtgacagaataacttattgcagagttggttagttaaagataacatacataaagtaacacagtgaaaattaaaacttctgtgggagtcatggcctttttaatgaatctacaatctccctccccagaaaaataatgtgtgatgcaggtgtgtgcatactcatctcacacacacacacacttgtgtatcaattttaagggcacacaaa

SEQ ID NO: 46737 - DNA, 1940 bp, Bovine  19866881024878
tagcactcctaatatgtttctttattctttgcatcaacaaatactgtaactggggatgtttaccgtgtcagcacatgatagcttcagtaataatctcagctacagaccaagatacttctgtttcttcacaccccaggtaagattttgaatcttgggggaaagctaaaaacagctggtgtctggttattcatttgtgttctttatctttgaataaagaaaaggaagatacactgcaaagatatgacttatttaaataagagaatttacttctgtattgaaaaaaaaatcgcaaagtaagatgccacatcaaacactgagacacatgatgattattacaggagtaaatgataattgagtgaggaggcagaacaaaaagatccagaaatttacccacctcaactgaatttttatcattaaaaactaaacgcgcttgcagaatgagtcctttagtataaacacacagttaattaattaaaagtataataaacaatagtaacagttcagggacccaagagtatatacttcacccaatcaaataagtagattctaggtcataagaggagattctaagatacagaaaaaaataacctaaagtctgaagctgagaaactctctaacattattttgagttctctggcactagctagaggacaggatttctgtctttttcattaaattatacaagtgcctaccataggatcttaatatgcaagagctttttgctcacatgctcatgaggatgatctacatggtttaagcaaagagctttggtttgactttttcctcctattataatccatcctacccaagaattcaaatatgcaaacaattattgtgtacctactaagggcaaatgacagtgttggatatacacaaaaagaccccaggcaccttaaagtaataaaactgtcctccactccttatgttaactgaagacatattatcagcagaaaaagcagcacagttatcaaatccaccctgtgtaaatatagtcaggaaaaacatctttttcttttttccatcatgcctaatcatctttaacactactgtttaagggtttgctcctattcgtggagacttacagactgagagagatacaaagcatagtcccagactttgaggactgtctaataccccaactctgaacctcttcaaatatctagccaagggcaatgcaaatgatgtaatgctgaataataaaaatggaaggagcaatggaataattaaaaagggaaaaatgtagagaagactagcaacattcaccaagagataaagaacactttctagaaaactggtcagatatcgtatcataaagttaaaaacaatagtgaagcaaccatgcctatgaaggagtattataaagcagagatacggagcctcaaataattgatggtgagatgaaaaacacaggcgataaaaaatggcagaactcactaagaaatacaaaaacaatttaaagccaaatcatccaatattgaatgaacatatgagataatagacactgttgaaaattcagtaagacaaatagtagacagcaatttaaaaaggcaaaaaatacggaataaagagtttaaaaggatcaatgactaaaagatatatatagaagatgcagcaatcatgtaattggagtctgtgctaaataaaacaaaaaataatggatcaaaatacatatggaaaatacaatttaagaaataatttatttttaaaaagaagatttgaatttgcccactgaaagatgacaccatgttccaagaaaaaaaaattgatataggaaggtaaatagtaattgtatctgggaaactcttgaattttaaagacaaagaatcctctggagtcaataaaaaagattaagtcactcataagatgaaggaaaatgatcccagatttttccacttcaatattcagcagcagggagacattgagcaataccagcaaaatat

SEQ ID NO: 46738 - DNA, 1217 bp, Bovine  19866881029558
ggattttaaattcacaacatctaatttgctcacaaatctgcagtcttagggcttggtggagaatgctcatttccgctctgcttgctgatgtgcactggggcagcttggagactggagaagggaatcatctgaaagctgctcctagcctgggctagaagtcttaaatagttgaagactggccaaccagtcctcctcagatacctttctctagccctttgtggtctttctatgtaacctcttcagcatggtgccttcagggtaacttgactttgtatatgatggctcagggcttcctgggtggaacagtggtaaagaatctgtctgccaatgtaggagatgcaagagactgggtcaggaagatcctctggagaaggaaatggcaacccactccagtattcttgcctgggaaatcccatggacagaggagcctggtgggctacagtccatggggtcgcaaagagtcagacacaattgaccacacacacacacacacacacacacgcacatacacacatgacagctcagaggtctagagatgcatgtactagggacagagggaaaaccaagtagatggtgtattgttttttttgtgatctggttatgagtctcatggtgtcatgtccactgcattctatccctttgaagaagtcattaaggccagcctgtgatcaaggggagtttgaatttagactccacatttcctgggagaagtgtcaacaaacttgcaaagatatttcaaagccattactcaaccaatcactttactggaagttttgcaacatcaattaagtccagacttaacacttactctgagtgagacagaaactcctgcagagaagtaaaactagaatatcatcatcacttcttacataaaaggataaagatgaggagtttgaatgtggacccttcttactccaatataaagtaaactgttgtaactcctccaaaggctagacttttgggatgcatttctgttctttgaatgggtgcaagtgggactcttataaagggagagggagaggaggggcagcagtcaatgtcaatgtcaatatagacgttagtagacacaagcttttctgtaccctcattgcttcccgactgtcctggcttgtcccccgaggctaggcttcaggaaggctgcttagtgactttcccttcatcttccagttgccttttccagaacttttctttcccagctactcccacaattgtgcaaa

SEQ ID NO: 46739 - DNA, 1943 bp, Bovine  19866881053874
tgtctcccttgcctcactcaacctataaagatccatgagggcaggatcagtgttgctgtgcttgttatagaatccaccaggcctcacctggtgccagatgaaaccctcaaggtctatgtgaataagtaggccttccaggaaataggccttaaggaaagtagaagccagtacgtagaggtgtggatgtccgtcttattctgtggagcattatgagtgtcttgtccttaacactctaaactactctgagtatagattcctcgtctgagattatgcgtggcctaagggcaggggactcttgttccctttttatcttccgtatgtgatacagaattccagaaatgtatattgaatgaccaaattaatcagcatggatttaagatgaggatggtggcttctctgcttattaacttattcattacactctttcatcacctcaggattgggctctattccagagcaaaagtgtatcagcaatgcccaccacaaatgattctgatggtcgttgcaagatgacccagcagctctggtcatcaagtttctgttggtgcatggcctatttgctgagttttcgaggcattttataagcatcattaagcttatcatgtccaataattgtaaaagtagggaaagcattgaatgtgcaattggagagacttatgatgatgatggaaattaaagtgaaacagttttacaggagtaggtgcctattgggtgtttgtggaatgtttgaccctaggtaaatttgtttttttccaacaggaaaaaatgtcttatcgacatgggatttaaaactatagatcatggaaagttctgtgttcacacatgcctcctcctcagtaaaccagggcacatagttgaccagaaagctcactgggattaattagcagtggtatgtgaagagcttggttcagacttggaacatggaggatgactttccagcgaggccagatcctaggtacataattcagtcacttaggggatctcatggcttgcctagtgtaatcggggctcttggctcagaccaggatgggcattgtgtgtccagctgctgccagcagagggcagcagcacgctgtgtgagttcaatttgcattcccgattagcaaatacccatgcactgacaaagagggaaagtgggtgtcccaggactactcactcttgctgcttttctctgggtgataacactggccccacgccattgcacacacagacctttttacattatgttggacttgggctcatccaaaatagagaaatgaacacacaactaggagctgccatcacagacaagaagtaactttaattaaatattgtgaaagttgaaaagtttttacagcttgaatgtttgcaaaaaaaaaaaaattataacaatctctacagtagttaggttctctaacgattgaactgtacagtgtgtgtctattccaaaagtctgataggaaggtgaaaggttagatttagagatgacttcgttaagctgcatcctagtacaatgtgaggccagggtgtgttatgcaatccagtcatccagaagctgtatttttccccccaaactgaaatcttagttgaattctctattttgttttcttcttaaagccatattctgtatttaggggaacatcttttatttgtaaaagttccatgtagaagagagagggtcagagggccagaatgtcttttcgtctaatcaatgtaaatagaggcaacaaaacacaaattatacacattttaaaggctctttggactttcaagaaaagttctaaccactacaatggctgacaatgggtggcgtctgtcaccagggtctgagccggacacctcaccggctgacctggggtccttcacaaacagttaaggggctcaccagacaaaatatggctttaaattgtacacatcttcaggccagcgcttaccacacaaatccaggacaacctttctgagta

SEQ ID NO: 46740 - DNA, 980 bp, Bovine  19866881068726
gaactttctgcatgacttttttttttaatgtttcagtgagagactgaattcttgcattgagacaaataaaaatgtaaaaccctaattctgttttgtaggatttaagttataattcactccaatttattaaaaggatgctttggggctttttaccaacaacttggcatttttaatatgttctcatcataaattttttaaaacattgtgtttttaaggaacaaattttcaaactggcttttgaaagtgtccccagagaactgctgtggattgctactgacgtgaagaaaaccaaacatttaccatgtggaattgtcatctgcatatccacaggagcccttcccggaggctgtctggggaccagagcccccaaattgcatttgtgctatgtgatgaacagcagggaaaatgtctagtttcgtgtcttgctcgtctgatgtgggtgccagtaagtgacaaaacagcacaaatggtctgtttgtgttaagtgaaaattgatatgggctatcacttattaaagtacttattaaatgtgcacttttttgtatgtgtgttatttaataatgagggtaacagaatttcaaaggcttgcacccatgtaaaactgcatgtaatatcagtcaatgatggctatgaagaggcaaaaaatatcatagttcagtaatttgtgaacttggaggatgagagcaaattctccatatttgagaatgaagaaactagcaacaattgtttgggtgtataaaaactcaaacatatggggttgtataagagttcaaacatatgatgaacattcattgatcaaaacgaacctgagtggcttagagcattttttcaaaccttttgactgcaacgcacaataagaaatacattttatatcactacttcatgcagacacatatgtacatgccacacacgtgaaaaatgcaagtttaatcaaataatacccttactacatggtattttccatcttattccattccatt

SEQ ID NO: 46741 - DNA, 2054 bp, Bovine  19866881153654
aatgcatgaaagtgaaaagtgaaagtgaagtcgctcagtcgtgtccgactcttagcaacccccatggactgcagccctaccaggctcctccgtccatgggattttccagcaagagtactggagtggggtgctattgccttctctgggaatgcttcttaatgccttttaattttatgtacttcagcccagtgcgtctcctatctttattaaaggctctgaattaacgcaaacatagaataagctaaacgcagaggtaaggaagctatgaaatagaccaactttagcactaatttccttacactgagttatcatatgtaagccttaaaaaccaagatttataatttttaaattgttatttaaaattaagttgctgaagatgttatgttttagagagaggtacttcttaccaagatattctaaatttaaacactgaaaatatttttatgacttaatcatccccctagaaatgtttaaagatatagatttcaacttttggtggcctatgttctaaccccttcttccacatgagctgctgcttttgttaatgtgatctgccactcatcactgaatttagctgcctgtgtctttttgaaaatctgctcatgagacagattatgcttcatcaatttgagagaatatagttgggacatacagcgtctcctgcttgatcggaatgggagagggacagtctaaagaatgatagcaaggaaatgataaccaataacaaaattcctagagaatccttcattaaaatgatgtattaggaaaaatatactggcattgataaaatgcagaaaaatttacaagctaatttcagagcaataaggtttcatttcatttcaagtttagaatgtaaaaggctaatagtcagaaagtttataaaaagcaaaagtacagaaaccatgaaatttgcaattcacaagaggtctaaattatataattaaatgtcgtgagcatgaaggtctttaagtttgtaagatttcattgttaaactaataaaaagtgaatgtagaagaaataatttctgtatccttgtattgaaaataacaatttatgctgggtcctctttatagcaaataagatgcttcagattatcagcccaacacaggttcttgaacttgttgatgaaatcaccaacaaagcaacaactctgctagcactgctaacatttgctctatgagaactggaaaccatactaaccactttaaataatgtaagcctcacagtaaccttatgagttaggtactattaacatttccatttgagagtcagggacacaggggcttagagaggttaagttacttggccaaagtcacatcagctaggaaagcttgagagtcaaaagtcataagttttgttttgaattttagttctaaatagattggggagatagtaaaaatagttaacatttaggtctacttagatctaggatataagatagcaaattgtgaaccattgtaatgagccaagaaattgaaaacttcattgcaaaatcttcaaagtctgtgtatagttgtggcctctttattccctcacattgaatattgtcacttggagaattggacacaaacagaaaataccatggaacacactgagtattcatcagcatgtctgtggattgctatactgaaaagccatgctccttccccagatagttttacttccccccaaatacaatgataatacgtatatataaccctaaacatgcctaagcttaatacttatttcaggagaaataaattgggcatcctcacaaataaattggaacaatttatttcaaaatcattctacagcagccctgtccaatagaacattcttcagtgaagacagtgttctgtaactgccttgtctagtatagtagcctccagccacatgtgactagtgaccacttgaaatatggctatggaaactcaggaacaatggaattttaaattttatttaattagtttaaatttaaatagccaaatgtgtggttactgtattagtataattctagactatgttaattataacagatatcataaaattctaaatatacctgttcctcattttat

SEQ ID NO: 46742 - DNA, 1598 bp, Bovine  19866881201746
ctccatgggaagcgggtgcttggggatcagtgaagttgactactgaggacaggcctagaaaagttaccttttctattgtgtctcattctggtatctgtttctatgtgagggaaatgaatagagaattctctccagatcatctggatctatggattatgtgatgatttgaaaaggaattttttactgaaatttcttcttttcagtcaaaaaagaccactcataggataaaaggccaggccttgcagtgatttgctgaccacactctacatattttggaagtttgatactttatgtgtaatttcttgcacatttgtaatgttaggtcacgtgacccattccgtgagttaacacacctgctactgttacacccatttgacaaggaagaaaagtagaggcaggacatggagatttgccaaagtcagacacttatttagtggtgctaagttagaaactgcatttcctcaccccaaactcgcctcactagagcatgtagcttctgtgagtattgagctgaaaggaggatacaggtgttttgcactcctgttccctttgtcaatgttacttatttgcaaaatcttgcctttttttctgttacttgacccaaggtctgtatctgccacaccacttacaaattgctccaatctctatttttgttgttatgcctgacatatagtcactttcttagcttgcagctcaattaatcatgctcgtgtaattttgaagggaacttttgtgttcgtttaaatttggaaggtgttgaagaatcacttacagctttcagcactactttctccagatatgacccagctgagaatgtctatttgatttactgtgttaagttgtgtctatttcgtttttcaagagggctagcattattaattttattctatttgggggaataattaattttattctattttatggaatctatattatttataatttatttatatttataattcatttatttataattttattctatttgggggaataattaattttactctattttgggcttcccttgtggctcagctggtaaagaatccacttgcaatgcaggagacctgggttcgatccctgggttgggaagatcccctggagaagagaaagggtactcactcctgtattcttacctggagaattccatggactgactcatgggttgcaaagagttggaaacaactgaatgactttcattttcaattttgggaaaaaagagaagaatatatttattcctatatcagaagatattcctatgctggtaattcaaggccaaattttttttgttaacctctgataaaataacatgtaaactgaatgcaaatcaagtgtgacctaagacttattatattattgacaattctggtcccatccaaagccacagaagataataaattaagtacttcttcacgtagtattggtgatgttcaatgcaaactcttttgaagatgaaatggaacatttttatgaagagggatgaatgaaatacaataagctactgtggagataattactagaatggaggtaaaataggtaccttggtgattcttctctagtgttgccataggtaggtcatttagatgcagcatatgcct

SEQ ID NO: 46743 - DNA, 1615 bp, Bovine  19866881269923
ctgtgtttgccctaggtgtatggagaaggggagaacaaacagaggggatctatcctgttttgggagtcactggaagggctgattgctttttgctctggcctagtgccaataggaactcattgcaaggtccagctgtttccagccatttccttggtccaggtattccttgggggctggactgtagcataaaatatcttttagctagctttttgtgggaatgggtatcctgggttgacctgcctgagtctgcttcaaatggaagcaggcaatggtgacagccactttgtgacagtatggcagggactgatactaaacatctgtggggtcagttaattactgagactaatgatgatgtaaactgcccagagtagacatgactagcctccttcctccttctactaaataagagaattttggagtgaatctgattgtcttctttcccctctgtttcttccctagaactccctgtcttggtgcttcactgacaagagttaatagtaaggaagacccccttaattaaatcatataaaggcattgagtggttctatgcctttcaagaacttcatctcaagacagttccctgtatcaggtggccaagtgaaaagatacatcagcactagacgattttcttaacttggaaaaatgttaattatctcagaggcatgattttcttttgtcttttcagatgactactgttcaatctgtcaccccaagagtctaaaaaaaactcatatcctgaacacacacacacacacgtgatgatgcatcattattaataaatgaatggagctatttgttatttattatttaaaccttcaatactggctggcctgagtgatacatgaaatataggcaagtaatttatttattagagaaaataatgatttttttccccacagcataaccccctgtgaccccagacagcaagagctttatcaaatacaaatacgatggcttgtaattttagagtcttccagaacattgtaactgacaacctttttaacataagtacattgaacaaataatttatagacatattctgggaatattttagggtattttattgctacttctgaaagctatggcatgttatcgattttggtatattaatataacctaaaagggagggcacactctcagcttctaatccacatcagctttgatggcaagcgatatattttactgaagggagccctgagccaaagcagcagaggttaacaattacacctcatagccaaaagtttaagataatgaatttcactcattacagaacttccactttggggactgaatcaaattttttctacttagtatttcatcccaatttctcacctaccatttgtcagcatgatttctctttccttcagccccttcctctcttgccacttccttggggttcagccttctgctgaaaggatcaccttttcccaaaacttattttcagatttatttttgagggtttgtttaaaagaggcgattatgatccttcttgcattacttgcttctcttaggtggtttctagataattaatgcttgtgacatcaatatcttgttaatagttgatattttaaaataactcttctctttggtatatttagacccagagctttaatta

SEQ ID NO: 46744 - DNA, 1161 bp, Bovine  19866881271825
atgatgacaatcttttagaaaaattagatgggaaagatgaattaggggtggaggacatttgtgttagggaagcaattcaggctgttgaaatagttaacgcatgtcatggtttggcccaggcttagatttagggcaaagaggaggaacaaagcaaatataagtttcctgagaactggtcccttacttgtctttatcactagtgtctgagagcctaacacagtgcctgacacataatgggcactcagtaacatttattgaaggagtattgaatacatgagtttgtaggtaagtgaatacgaaagatagaaatggggtgccccagaaactttgtttccacttttctttaaaaaggaaaactctccaaagattctataggtaatgtctggagtagatctcagtgacctcaaactccattttctatttctgtgatcctgattggggccagcctgttttcaaagcccattcccattctgaggttgattttaaaacgttccttttcttttcatatcattcgtgccacaaacatttattgggcatctataatatgcttggcatcatgatgggccccggggggagaggatgagtgaaggttggtcctgcggtgcttcagtatttctttctctgctttcatctctagtcatctcagaagtttatttttgaaataaagattcattttcttagtggaattcttaagtggggagtgatgagatgaattcgggcttttaggaactgcttttagaacttgtggatgacttctactgtttgctgctcacccttgctgatatgccctattaatattcaaaagctgtcactttattttatctttgttctttcgtagactagactgctggctgggagaacctggtttgtctggtttagtcttgtcacactgtggagcaggacaaaaagaaacatggcccaaggttgttagtttaaaacaggaagtttctgcatatttctcttggtatcacactctatttaattgacttctgtccctttgccttgtaaataaatttcaacaatgttaggagcaatcccaggctattgacatttgctagaggacacacagtctgggatataaggctaaggaaaaggcctagagatggcacttgtatattaagggcattgtccttttaaacagtagtggctgtcagcaagctg

SEQ ID NO: 46745 - DNA, 1360 bp, Bovine  19866881291486
actgtagcctgccggctcccctgtcctggaattctttaggcagaatactggagtgagttgctatttattagtgtgtaagctttcaggcattctcacaacattggtttatataaatatagattatatacatattcatatccatctcattctttttaatggttgtagcatattatattatatggatgtccataaaatttatgcaataaatcccctgttagtggggatgcattttttccccaaattttcactgtttaagtgttggaatgaacaacattcaggagaaattcttggataaaataatatatacatttcaagacttttgattcatatatttcctaaaaatcctcataaaatatataccaatttacatatcgatgggttacttttgaaggaatctgcaaaagaaaactaatttttaagattagttcattcctgaactcaattattctctaagttataaggacctctgaatatttttaatagatgttaaagatcacaatgattccttggagaagtgtcatttcaaacataccccgaggtcatataaaacccttttcccagtaatatcctagcgctttatagaccttatctcactgattcctttaatatgcccttgacataaatgttaaaatttattactctcaatttgaaggtgagaaactgaggcactggaagagctggctacaggaatcagaacaaaagcctcagtgctctacttactaggccaagatgactattttaatattgataaatctcaattagcagcatattgacaagtccagctaccaaatcaatcaaatggcacctttttttaaaactaagtatctgtgcaacagaaatgcagcactaggaggaatccttgtgccggactcctgacttttacaggtgaacacgcacttggcctgattttttaaagctcactgtcaacaggcacaaacctattggagaagcccccctggcattttaaacttgcctcccaaatgatcaagaaactgtactttctgtctcatcaagttcttcttataggtctgagctgtggtctcaaaagttgatttgtcttttgagaaaaagagatacataatgctgttgagatccattaaactgacttatttcctaccacaaccaattggtattttccagaagatctttgatgagaggcaaaagtggagcatttcttaaacatacccccttcttgccctggagggttatactcttatctaaaatgggaagtaggtgaatgtagaatcattagggaaaattctactgctgtctaattgtggtgaagttgatgacgttgccccggttcctacgtatgatgtgctcttaacagttggccttccaggatccttagttttccaaa

SEQ ID NO: 46746 - DNA, 1205 bp, Bovine  19866881330179
cacacaacacagacctggctcctgggtacacccctttcttttctagctatagtgactgattcagggatgtacatgggattgatatctagtgcatgggatctttgaagggccaatgagaaccctttgcctggaaccatcatgcctggcaaatacatagggcatttgccagaactaatgggagagaggggctcttgttttctggggagattgctaacctaggaggctaaaatcctagagcaactgataccacctttgctaccatttggtgaagtcttatctgaaagaaaagccaaaggcgaagaaaacagagctaaaacctataaagaaatagattctgggtcttacgtgaatgcatgggtctgaccaagatgaacttttcatctatgtgcagataatcaccttctatacttacctagtttgaagttttcttttttctcttttctttttccttcccccatttccttttcctctcctccttattcctccctttcctcttcttcctcctttttcattagcaacttaacaataaagaagctgagcctagaccagtggttgattaatttgaacaaagagctgttgaatatgcttcatgagcaacaaataagaaagttatgcacagaataatcacaatcactttcaggattgtgcttaaacaatgtactcctaggtctgatgaatacctgatggtcaacatattcattatgccatggggtaattagtcatgggttctaagtagtttgtataatctgttgtaagtacttcatatacattatgaagaaccttacatatggctggcattccacttgtgaatgaaataaacaggacttcctatgtttgctttgacgtgttcaaatttacctatactaagatcctaggaatgttgctgatagtttattatttctcaagcaggaagacagagatcagcagaaacacagtttgatatatatgttggaaagcaaagagttaatatccttgaaacagataaagacaaaagagactaaggaattagtaatcgacctggaatgctgatacccaaaattttatttcaggtatgttacataaaacattaaatcttcagagagaactacttccttgacttttagggtctgctaaaaccttatcttaaaatttcacttcctcagtccctgaaaaaaagcaaattcaatatgccagccctagaaagaattgttcagtaagtgaagaga

SEQ ID NO: 46747 - DNA, 780 bp, Bovine  19866881412007
tgtgctttattgtgaggtggggaagcaacaagttaacagatatgttgagagggtgagaaatgacttgaaagaaataaatacagtgatgtgttagtgctactgggtgggacatcactttagatgagtactaatgtttcacatgagatttccttgacaggaagggagcctgataagcaaagatctaggaaaatgactctccaagcagagggtaccacaagggcgaaggctctgaagtgtaaacaagcttggtatgattgaactgcaaaaagtcaatcagtgtgacacacagagtgagcgggcagaagtgtgatggaaggcgagtggagacaggcaggcaggaatagagacgcagaattcagcttttctggtcgattctgtcctgatatattttgcatttcatttggcatgattctgaggccctggtagctgtgtttcttcagcataacatgtgctgctgcagaagagaatgtttcagaaatcacttctctcttcttgtctgcctctgctccagtcaacatctgtcccttagaaagccagttctgaaggaaatctggccctttgctgcagccctcgatttcatttctggtggttacagcctccgtgtttccagggacctggttgtgattcgctgatttgagcaggggttgaagagcccgctcctggaccattcctgcttcgtgctctgccctgacctctggtggacttggcctgttaaggcataaaccaagctagaagctggaaagcctttgccttctatctctacctgcctgatttggtttg

SEQ ID NO: 46748 - DNA, 710 bp, Bovine  19866881644771
gattttaacctgatatattaaacctcacggcttattgggcaaatatgtatcttggcatgagccttatgctgggccttggcagaaaatatgcatcactgaaaaggaatccttatgaccaggatttgatgagtggtagctctgcacttagaggaaataaattcctacattaagtacagttgctattgaagaaaatgtaaaatatattaaaggatagacatagaagtgtttggtttgatcagtgttgcccagtggatattggatctgaggatgcatggtgcttactgagacttgccaacccagaggtattcttatattcttccactttttaggttgtaacttacagagctcttactatgtgtgagaccttgtactaagtgttttacatgtataattttatttgtttttccaccctctttcccttgtttactttgctccaaatgagaacattgaccttccttctcttccgtcatttttcttcaccaaatgtactaaactcattccttcctcaggatttttgcacttgctatcctatgcccctggaaattcttctgccacatcattgaatggctggttacttcttaatagtcagatttcagctaaaatgtcacctccttagagaggccttcctaatcatctgcttaaaagtagttcctgcctgggcttcgcccccttcctcattttattttcttcttggaactttttaccatctg

SEQ ID NO: 46749 - DNA, 672 bp, Bovine  19866881751483
tcctgctctctcttcccaacttactgacttagcttgtcaaggcagggcaagggcaagggcaatatgacgtgcagatcctggtgtttcctggaattttgaacaggagcagactcgttctccctgtgcgtggtgtgctctccaaagctgccagtggatcacagagcatcacagatccgtgctgggaactcctgctggcctgccctactggagaacaccccacagtttctctgttaccttgatgtagaattgaactgtggaggagttagacaacataagctaaaagtattctcaacttgcctttgatttaggtagggaaaagaaatttttttttaagataaaataaaacatactcccagaccatcaagaccacagttcttagaagatgtgggcaaactttcagctctgtcaagaaatagataagtgctctagtcgacaaaccattaaaggaaaatgaggacatatcaaaactcattccacgacatctgtcttagtccttctgggctgctataacggaatgctgcagattgagtggcttataaaaaatggaaatttatttctcatagttctggaggcactggcagagttagtgtctggtgaggaccagactcctggttcatagacaactgtcttcttgctgtgtccttacaaagggcaagggagctctccagggta

SEQ ID NO: 46750 - DNA, 744 bp, Bovine  19866881755412
acttttcagcatgctgaactgtatctttaggtattaaaataatacgtttaattgcctaaagctgtttttatggttaaacatctttgttggcaattggcattatgggtgggagatatgtaatatacaggttaacctaggtgctcattcctgttgctcttgtgcatttcttgattaaatactggggattttatgagtcacagcccccctgcataaagaattctatggctttttctctacaagtctaatttgaaaaaagaattcttctcaagggtttagaaagtaattcataaaatgggaggaataataaatattatgccttaactcatatactagtatagagaggtttggttcacttgggtgtaattttagttaatttccacaagagacagattgaaagtttaccatttggaagtggtaagtgggagaaatggctaaatctcatatttgtaaaaatgattacattatcttaaatgaaaatgctactatattaacaacttcaacaagtactgcatttgggtaaaagaaatcttcttaataaaaagttgcctgaagttcactccaacttaaaatacacaagtgaggaaaaagtacttactctgatttatatgtcttttggaggtgtaattattggctttttactcacctatgtaaaacaatgtacttttgtaaatggatttctggccactttatgcagcctttttccttcattttttttttcttacataaaaagtaagcactgtcaat

SEQ ID NO: 46751 - DNA, 751 bp, Bovine  19866881758129
aagagatcgcatatactatcaatttgattttaaaaggcatatatcttttatactacctgtcatttttataatgccttttacaaatttaatcaatacattttaacattctatatactttaagtgcaatatacaataaatattcaagtttcatcttaaacatgctttagcctttaaattgttaaaactgcagtgccctttcaatctacttacataatgtcataaaatatacatttcaaggtaaatgaagtcagctacttcaatttagtccctcaaactggtagtaaatgagaggttaacactatggtgccaaacccattattgagtaaatttagcaccttggacagctctgtaaaatctttattgctttcctgacctgctcgtcatgttctgtctgtgtgttcagtggttctcagctctgattgaaaggcaatatattagatccccaacacaaacacgcttgggggctagttcactgggagcctaatgacatggaggtgagagcaattttctggtcaccgaaatccaagcaccttgcaggttcgctgcactaactcatagaggacccagacatttcctttctccttcccatttgtagaaataactaatagaagctgaatcacattggccaagctgagccaaaagctgtctcccccttaatccccaagttgataccacaatgaaggacactttaaaataggcaagatgctatttaagagagtcactttcaggacatgacattgggttcactgtc

SEQ ID NO: 46752 - DNA, 781 bp, Bovine  19866881934759
atgtgagtgatcacattttccccttctactcaaaaatccagtgcctctagacagatgttaaaactgcatatttaaacctgatagcactctctctcttgcttatgtcaacttcttctgaagccgatggcctctcgagagcttgtaggcacacacactgtgtgagaatctcctttgagactgcgtggaacagggtcaggcacagaattccaaactatcccctccagttacttatctagtcaaaatcccagtaacacgccgccatttacaaggttaaagtttactcatcctaaatgctgacttcatcccaatcctccaacacagcaggtctttgagatttcccattcgagattagcgcctctgttagtcgacccttactatttgtaacatagtagattgaaacaacgggttaagtgctttggaatcaagaataaaaggaaactgggagaaaggaaaagaaggttgagacctcaaaacacagttttctgttcgatgggaatttttgctctcattatctgggaagtgttcttacaatagaagttaatggcgaagatgcagcaaagctccgaggatgcatttgcctgatatttttttctttgctgttgtgtttttgtatgtagttataaatactgtagattttttgtgattttttgccaaagttgttgttctatttatacattttaatgtcttaagacggtttttcaatatcataaaaagattttactgcatattttgcaaaggaaaaaaaaagctcactacctttagcttgcacatacttgcaaaa

SEQ ID NO: 46753 - DNA, 779 bp, Bovine  19866881963161
ccttgaaaaacttatgtatgaaggatctttgacttcatcctaagcagaagaggaagcttttgaaaggttttaagtgtaaacacaatctgccttacctttctttttgtaaaaaattaccatatcaccatccctgctaacctcttagatccttgaaatgacacaataaatcaaaaaaaaaaaaaagtcatccctgcttcttttctaattagtcatcttgaaagcccacgtttcatttctgaactcccttcctggccaatggagcttctgccccctgactcatccttgcaaaacaaaactttgctcactctttacctgtccatcacttgggagagggagacccagagatgcttcctaaggcaaagcatgacatgtatgtatgagaacacttctcagagagtgaagaaaagaaaaatcgggtttcctctttttgctttaggctttttccatactgaaactcagcatcaaaaccatttcaaactgggatgaaaccatatggtttccagaatcacacattgttttacaaggttcagtgactaaaaccaccttactctgttagtagaaatgaaccagacttttcccatttgttacttggggtctttacatggaggctaattaattcatttgtaacctgcatggacaacatgtaaggtgtcacagatgatctggaacatatataacatcaaagacaacattctttctttctgcctgaaatcattctgagtcctgtttttctcaaaaaggagcgtttataaatctccaggcagtaggaatttgtgttg

SEQ ID NO: 46754 - DNA, 1022 bp, Bovine  19866881998475
tccacaagtgtgtcctctactatctgcatctctgttcctgccctggaactaggttcatccactgtttttctatttatagattccacatacatgtgttagtatatgatatttgtttttctgtttctgacttacttcactctgtatgacagattctaggtccaaattatttaacttctctgagcccagttcttcctctgcaaaatagtatataataaagagttgcctcaaatgaaacaatgcatgtaaaatatttatcacagagtatgctgctacaaatgagctctcacagagggcaagcaagtaaatgggaaattagaattaggtgtgatacatagctggggatggtagaattcacacggaactttgcagtccaaaggaggaacatgaaacacagattggtcagagaaggcaatttggaagagacaaaacaacaaagcagtgctaggttgagatctaaagtctgtctccaagagagacatgttcagggggatttgggaaggaaggaatgtggtggttgggtctttttcaggaaaaaggaacagaatatgtgaaggcccctagagaggcaggagagcatgccttgcttgagaaactgagacaaatttattgtgactgtagtggaaagggtaagaaagggattaggtagggtgtaggtagactggatagtaaacagagtggaaagcagcctggagtggtttagaattcattgacctttcccatgaaaaccactcatctggggaacgcctaattttgcaccctcaagccatccttctgcgagtatacgtaaattcaatccaaccaaactacacatttctggaggatagggaattatctcatacctctcaagggcactgtcttgcctatgtagcttctccacaaatatttatcaattgcacttggtgttaagtaaagtttaatggagcatgcacttttatctggagtacgttgtgaagtagcaaatagctttccatttgggtaaggacccttaggccccacccaacacgtgtatggaaagttgttcc

SEQ ID NO: 46755 - DNA, 1621 bp, Bovine  19866882081422
ctcccatagagtccataagactgttctatacatcaggtgtctcttactttatttagaagaaaatgcaatatataatttttggcttcattttgtatacatatcaatttttatgcatatttaatttatatttacattacttctacatgacatttggaatttttgacaatatatttcttttgaaaattcccctctcctttgttttacatgaacttattttcctttcttaggcttttttcttctggatcatcatcttttataaagtttatttattttaattggaggataattgttttacaatattgtgttggtatctgccacattaacatgaatcagccataggtatatatatgtcccctccctcctgaacttctctcccacctgccacccaatcccatccctctagcctgtcacaaagcactgggtatggattccctgtgtcatacagggaattcccactggctataaagctgaaaccccagtactttggccacctcatgcgaagagttgactcattggaaaagactctgatgctgggagggattgggggcaggaggagaaggggacgatagagaatgagatggctggatggcatcactgactcaatggacgtgggtctgagtaaactccgggagttggagatggacagggaggcctggcgtgctgcgattcatggggtcgcaaagagtcgacacgactgagcgactgatctgatctgatctgatctctgtgcttagaattgggtcagatctgagaatgatattgatggaaacacagaacacaccagagcaattaaagaacagaggacagtgtgtggtcaggtatcacacaggagagtacagatgacagaccaagtcaggcaaggttaaatgaactagaatcatgataatgagatcagtgataaagagaggattaaatctgagctagcctttaggagccagccataatggccattaaaaattctccaaaggatttccctgtctcccccctcaaaaataagctaaatattaatagtatataaataattcaatttttaaaataaacatatgacacacctgttacttttaaaagggtggggggagaggtgttagcaaatcaaaccattaggtgtcacaaatccaagaaggttggaaatcaccacattcaagtcccccttggatttggagagatttatgcttcttaagggcgtccagacattagcagttcaaacccctacactgtatcctggcttcatttaaaagacccaaaggtcagaccaaaacacaacagggctttatatgccaattttccttgactctctgtgggtcaggggaagttaagctcatgtaattaggggataaagacggaggctgtgaggggggatggaagcatgatgaaagttccagagtttaaagtctcagtaggaagccagaggaaaagtctgataaagtcatgtctttatgaaacatgtgttttccatggtagagtaaacgtattttccatttcactcagggaatctctctgcaacttggcactcacacctacctctgggacaaggacaattcaaattcatcacgatgggggccttcccaggggcacagaggtaaagaacctgcctgcaatgcaggagacagggctgatccct

SEQ ID NO: 46756 - DNA, 741 bp, Bovine  19866880507774
tttgtgtctgaataaagatccattttagtaatgacaaaggaaaaagataaaaacttctccagatgaaacataaaaaagaaaaatctctataggatccattccagaataaatcttattttacatttgagataaatggttaagagagaaacaccacattaatatctccaagttagcaaatcatactaagcttttactaaaaatagtagtgaaatactaaatcaatatgcacaaactataggaaaaactcaagaacctagagcttggcaggaaaatgtcataggatgttcaaatgagcaagcttaagataatgcatttagagataaattattttggacaggaggctggactctactcttattattcaattggttcacacaggtgttatcatattcctgtctttattctaaatggtttgttgagactacaatcagaacagatgattctctgaggacatcaacccaatatgctgcagtggcccaaacaggcagggcataatctgagtattaaaaaaaaaaagaaacaaacaaacaaaatggaaaatactacccttcctacataactcttacatggaaaaatttaagtggaattctataattagttctagttacagtgcttctggaaagttacagtaaatctcagtgaaacttttaacataatccatgattgggatgtgacaatagtgataagagtaccgggtagtactgggctaccctgatggctcaatggtaaagaatccacctg

SEQ ID NO: 46757 - DNA, 2922 bp, Bovine  19866880523597
tgtgtttttcctcatgtcatttcttctgtacctcattacccagaaaactattattcagatgttaagacccatgctttcctcctccaggaagacttctcaattatcctattttaaatcaccatcctccttgttgcttacctccatagctgggcttaattaacgcatagcttactcgtatgcattttcctttcctgtagattgaaactgatttttgctcatcgtggattcacaatgcttatctctagctttccataaatggtaattgaatacattaagtctcctagatacgaaccttcaagttatgaattttcaaaggtgtgaacatgcccagctattgtactgcactactgtactttttaaggtactgtaagattaaaattttttctttattttttgtatttgttttttgcttttaatgtattatttgtgtggaaactattgcaaacctattacagtatagtaccaaatagacaattttgttagctggtccctagcctaactttgttggacttacaaaggaattggacttatgaacatactctcagaactgacctcattcatgtgtaggggacttactgtacatgttgtattcaattaataacaatgcaaatagaataaagtaaatggtttaaaaagaagttaaaagcagagaatcatctagagtaaaggagggtaagagaagacataatttacttagatgataatttcctgaggtagtaatattttagctgagtgttgaattcagaagattttatgataataaaatatatcacaaggctttaatctttaacacaatttaattggatgacacaatcgtctattcatttaggaaactaagaatctgcagaaatttcagcaacattttaccagaattattaaccatgaattttgcattttaggaataaagaaatagttaaaaaaacaaaacctctaagcaaacaaagtatttatatgaactaggctttcacgggtgcattttagaaatagtcttattcttggtcttagcagaatgaggaacaagtttactaaaaatagtcttgaagcagcttgggcaagggaatgatttttcacctcaattaaaccaagctcatgctgatgagaagttaaagattatattagaaaactaactctgatgaaacagaaaaaaacattaaaaagatccccatatcagcttgcattatcaagtaaatgaagaaagatgtaatttaataagaaacaataataaggtagtctcagacattctaaaaaaattaatatgtcctagggagataaagaaaacaagactctttaagacattttgattcagtgagaatacaaatgaaatagttttagaaagttgtgacagaacatcttaagagggtagatcaaggacaaagactttttctgaagtagcaaattttaaatatttcccattatcaaagaagagctataataattctctatatatgtatgttacgtgtgtgtgtgtgtgtatcctttccttctgctatactaccttgagcttaagtcttagatcttaaaagaaaaactgtgaccgactagtagataattggataggcgtctacaaaaggaaactctagtgctttaggaaatgtagtgagtgactaagtggatctgccttctttccttggatgtcaaattgaatgaatgcatgccatgacaaagtctttatttaagacatgtatgaagaatgtcttcctataaattctacactatacattgtattttatttctattttcccaatgtacgaaatatgatgattagatcataaagttcaatagtaaaatatccataaaaagctttgtacaagaaagtccaaagctttatccatacaatccacaaactagaaacatacaagacattcctcgatggaagaatagataaacagaatacagtgtattcacacaatggaaaaggaactcattactaagacatgcatggatatgatggcctgaagtgaaagaaagacacagaagaatatatagtgtgtgattctacttaaataaaattctaaaagtggcaaaactaaactgtggtgataaaaattagattgcttctgaggatagtgcattaagaattaaaagatgaaacaaatactctcaatgaccccctggaggactttgtgttttcctttcctgcaactctggattctgtagggttggagctcctggttgcaaagggctacacttttgttaaacgacccctgcaagggtctcattgaactacaagctacaccagctgccaagagactctgcacttcttgtgtctagaggatgaccagatgaaaagctaagtctccaaaccagcatggacttttgaccctgagcagcatgaggaagtacaactgttctcgtaccatgcagccaggaaggagtatgtgtgaaacctgggtctttcactcaggagccttctagtactctcccgaaaaagacacatccagcaaccccagtctgagaactatgaccaaggattcagacccttcagaaactaagcttcggttcacaccatcagataagcccccgaccctatctggattgcaaagataatcaaagattggattattgctgccaggtcactcatatggccaagaagtagaaggaggcaagttctacccaaatctcaaggaatttacttctctgtcagtttggctcacagggctgcagcccactgaccttactagttcaactcactagttcaacactagttcaacacacttctatcttaaggcttactgtactctgctttccagtgaatctgcacaggattctcatttctttcactcaggctaaaactcacctctccacgtttttcctgaacacatgatctaaaatagcagctgctttgaatcttccactctttaaagatgcttttcctccttagtgctcatcactgtctgacatcaaattatattggggagggga

SEQ ID NO: 46758 - DNA, 1688 bp, Bovine  19866880645701
tacttacttctgtagtactcaccatatcaccctttctctcactttcccaacccctggactcataggtagtatcggatttaatcaggtgggatgttgtcaatcatagtagttcagcaacccctcacaccgctgttcagagtgtttccaacatgcacagtgggattacacattttaaaatcattttgatgagtgaaaaattttcacttcatttctgcgatactgtaaccaccctacgtatatttgtgtggtggggttgttactttctttttagtatcttccgcgaccctgtactccccttgaaggcttttagattgcccattacagatactctgtaaatggctgctgtgatcctaaataactactgaccagaaggtcagtaaacacctattagtcctacagataggatattaacccttaggtcaggtaaaaatagtatggatatagctgaatgaagctaggggatcagaggaacagctttggaggccagacaatttactaagtttctgactctaggtcacttcaagaaattttcagggaattactcagtagtaaaaatttagataaattcctttgtgtgatcaagagaatgaagggcctggatgtttgaatgcagatcccaaggtcaccacataggggatatgttgagcagagcaacgtattagaaagagtgctatggactctgcttattaaaatgaagtctgctggtcatctctcagatgacctaccttcaggtctttaaaactgtatttgaagctgtaatgtaataatatgtatatatgggtgcatgcatatggggtatagttaaagctgaaaaggaaaaggaagactttgaggcaggcttaaatgtgcacagaactcatactattgtagaataaatcactttgatcttcaaattgatatgtgtctgtaaaggtcaatggggccactgagggctacataataaaggattaggcatcaattcaaggatccatatagtccttgtatactgttgctattgtagcaagttaatactctgggaggcatattaacacttttgggccacatgggtgttattaactaaattatgttaaaatataacaaattgtactcaagtgacctgaaagcattaatgccaaataagtctctgttgcttagcattttaaagaataattcatatattagaattggcataattcacttgagttatataagctgtcacacagttcaaagttacaatagtggttagtaaatgagttttactttgattataatgagcagtttttaactctgcttttatgtggcttctgtaccatttttgaaaatacgtttgttgaaaatgttatacttgattaaattcaaataattctttttatttcacctgctaatatctctttttcagtcattactgagttttgaaagcagagaggttttccttttttcatgtagtctgggccagatttgggatcgggagttgataagcatataaaagaataattataataccttaagtgtcagaatgacacatacaaaagatactagatcatcacaaataaatattgtgtaaaaaaccctagaagtcttgtagaaggatttcaaagaaaagcaataacattatctgaattgtgaagaacatagagaagaacgaggagtgttgaaggtagaggaaagtgccagttaagacatgaaggggacagattggaaggcctcta

SEQ ID NO: 46759 - DNA, 1273 bp, Bovine  19866880685222
tgacattacagagcattttacatcaatgctttgaggaacctgaattgtccaggatattttctcaattgttcccttcatgtcttgtttgtagacttagactagatctagcataatatctgaaaacaaatccccatcatagatagccccaagggactgccattgagctccattgtccttaatgctaatccccattgacaggccatctgccctctcaccacttgtctcagccattttgctggacttggcaaacttctcttacaaaccagctctgaaagaagtgaagctgcacagacagccaggcctccaatcaaatcagtgcagtctagtgaacattcggtacttgccagagtcgcagtgccacttgctgctaatgcatcttccacttttgcatataaactgagttagtggttcacaagttgggaattctgtgaaagatataaaaacatccaataggaaagatgttactgattatgtttgacatctcttcatttttcttgcagtataatgaatctaaacagtccttcatcaagtgattttcctttattttagtcccagaaatatactcctacaaaagttatttaaagtatgcataccctgtgtccaaaaaatgctgaactttgcaaacttctgacttcactcagttctatcattatattaatatgttattgtgtttgacttcatttgtttcctatttgctaatgtaatcagagctctgcccctctcttccacacagtccatagaggaaacattagataagcaaataaagtgacagtaactatttgaggacacaggatatgcataattttagtatcttttataggaatacatttcagtgactaaaagccaaagaaaatcacatgatgaacgactgtttagattcattatgcggcaagaaaaatgaaaagatgtcaattcccccacatcaaggaactcaaccttctctcagtgaagaacaactgcatagagctctatactattgcactgaaaagtgacatatgtgttttaaagcaggcttccctggtagctcagctggtaaagaatctgcccgcaatgcaggagactctggtttgatttttgggttgggaagatcctctggaaaagggataagttacaagtctttttctgaacatagggagctgaagcagaaaagttaaatccaactttgcctgaatgatgtcaatatcttaagctgagagtaaggaaacaaacacaaacaaaaaactcagtttagttgctatcatacatgttaggtagttagaataggaataaggag

SEQ ID NO: 46760 - DNA, 1924 bp, Bovine  19866880725702
tttgcagtaattttggagtacaagaaaagaaatactgtcactgtttccattttatccccatctgtttgccatgaagtgatgggaccagatgccatgatcttagttttttgaatgttgagttttaagccagcttttacactcttcactttcactttcatcaagaggctctttagttcctctttgctttctgccattagggtggtgtcatctgcatatctgaggttattgatatttctcctggcaatcttcattccagcttgagcttcatccagtctggcatctctcatgacatattctacatataattaaataagcagggtgatagtagatagccttgatgtactcctttcccaatttggaaccagtccattgttcatgttcagttctaactgttgcttcttgacttgcatacaggtttctcaggaggcaggtaaggcggtctggtattcccatctctttaagaattttccagtttgttgtgatccacacagtcaagggctttagcatagtcaatgaagcttaaatagatgttcttctggaatccctttgctttttctatgatccaatgtgtgtgcttagttgctcagtcatgtccagctctttttgacctcatagagtatacagtccatggagttctccaggccagaatactggagtgggtagcctttcccttctccaggttatcttcctaactgagggattgaacccgggtctcccacattgcaggcaaattctttaccaattgagccacaagggaagccctctatgatccaatggatgttggcaatttgatctctggttctgccttttctatctccagctgtacatctggaaattctcagttcatgtactcccaagcctagcttgaaggattttgagcattaccttgatagcatgtgaaatgagtgtaactgtgcagtggtttgaacactctttggcactgcctttctttgggattggaatgaaaactgaccttttccagtcctgtggccactgctgagttccaaacttggtggcatattgagtgcagcactttcacagcatcatctcttaggatttgaaaatgctcaactggaattctttctctccactagctttgttcatagtgatgcttcctaaggcccacttaacttcacactccaggatttctggctctaggtgagtgatatagtaaatcaactatttgtcaataaaaaaggcaaaatgtaaaataaaaataaatcaaagttactactctaacatttctgttgtaaatacctttgcaaactaaagtatttgctgttacgtttctgaaattattagcgtttagcaattttctctccatgccagggtttgcattaattttctatcagtgtgtgtgtttaatcactaagtcatgtccaattcttatggacaccccatggactgtaacccatcaggcttctctgtctatgtgtattttttcagggaacaatactggagtgagttgccatttcctcctccagagcttcttcttgacccagggattgaacctgtgactcctgttcagtttcctgcattggtaggagtattctttatcgcagagccaccagggaagttcttttttatctttatatgtgcacaattttctaaatttctcccagcagaaatggagttacctctgagaattgatattttagacctatgtctatgtttcacaagttttactttaaaacagacattccctgacaagataaaaatattttgctatagggaatattgtacaattttcagaatctttcctttctgagtcttctatttgtatctattccagtgcaaaagatattattctaaaattctgtttttattaatatcaacagagaattagataagttctaagactttttccaatacctcaaattcactcttgttctctatcatttataaaaattcattttcttctaat

SEQ ID NO: 46761 - DNA, 3179 bp, Bovine  19866880831913
gtttctgctgcattttgtgctgtctgcttgcgtatactcgtctattgggcttcccaggtggtgctggtggtaaagaacccgtctgccaatgcagaagatgtaagagacgcaggttagatccctggatcgggaagatcccctggaggagagcacagccacccattccagtatttttgcctggagaatcccatagacagaggagcctggtgggctaccacagtccttagggttgcaaagagtctgacacaactgaagcaacttagcacagcacagcacccaatctactgcttgtagaaaaaccatacagggaaagtaagtcatattaattatgttggaggtaattagaattcatttatctctactaatgcaggaaatatagtttaactttataatttgctatcagtttttaggatttatttcaggaatattcgattaaacagacactaatactctttgaagttcccagtgttttgtttctttattattcctagaatgtaaccatttttacagaatatttatattttctctatctacctattaatgacttttaatttaactttttaaatgatagcagccttctccaaagttaactttgtttttcttgggtgcagtctaatttcactagtcagtagctaaggtagaatgccatgttagaggaaataacaagaaaataagagtctaaaaataccactcagtttaaagaattattatctttaagaagagtgctgacttactgcccacaatcaccttagattatgaactgaataaaattcatccatttactgagagtccattggcattcctaacttgttttgtctattttaaacacatactgtttaatttctcatttccagtgaaaaataattgctatgatagaaaatgtcatattttgattttataatcatcatacctttgaggaaaagttgataatatttatagtaaatatggtttattatgcaaaaaaacaaatagtgtatgagcacaattcttatttaggtatgttcatttgaagaaatagtagtgagtattttctgcctctctctagaaacaaaaactgtggttcagctgtcttccattctcttacaaggtaattgctttatctaattatatttgctattcttatttctgttatgggtgttaataaggttagcaatgtcatgtaaaatgaaattgcctaatcttttttctcaagagttatgataacaaatggttttctctcctttgccctcaagtagatgttagtaaataacctttcacccttgttgccattaacattcataaactgctctgggtgaactaattcagatgtggaccccgatattccagaaacatcatcatttcccaaagatagatttgacaagaagaagccaagagttacttttcaatctctctgctggaccacagaatttcaatatgaatgcacaatggatacaagatacttctgtaaagatttgtcagctctgaagaatccagtatcactctgcagttccacgtgaatacaactgtgcttgttttaacactacagttttctgtctgattcatcccctctcatcaatagtgagacgcaggtggcttagtagggacagatgtatttaatctattttgctgcaaggacaggaatctactgtctacaaataagccttgctgttttgactagaggcattggtttactattggcctgtagtgacctgtgaaagcaacatgagtgattctaatgcatggctaacactccaggcttacagatggcgtcggatccagacaattacagctgaaaccacaaaggcaaactgaaatggagagtttaagcaattgcttgagaaattccgggaaatgttaggtaatgaaaaaacattggaatttgtggcccaaattattgaaattaactgtctactggccaattacatcactcccttgtttgcctcagcacattcttaaagtcttttactattttgctaagaaatgcccttttggattatgtgccaacacacaaagtgagaaaatatgtatatgttcttgcattaggtgtagtagttctcctggttaaaaaaattatgtcaaagtgtttgtattagaaaaaagtttccaagtgtacatgaatccaagaatcacacttgtttgtattaaaataagaacaggcaaaagagaagatccttctggtatacaaagactgaaagaagacaaaagatgtaactgaaaaatactttcagcttatgattcttatttttataatgtagacatatccaactctactgattttctaagatgaaagatatgagatgaatatacagatgaggagaaaaaaaaactgaacacatcgtaagagtttaccaatttttagttttccaaaatgcttctctcctgtctttcttactcacaactagtcttgatgttaaagagaaattaaccctttttatgttgctggataattttcatgacaatattagaaaacttgaaccgttatttacagtagaaacagtttgggaaacttagctgttaataagtatatactgtaatggtactaattaaagattgtaatgcctttgggaggtataaacatcacacaaggctgcaatgttacatttttaattaacagttcagaaatgactacaaataaattgtgtgagacattctttctcatttacatactctgaccaactgtgagtgggttcactactaagctactgtctgtacactggtttattttggctttaattaattttgctattgattgaattcttaaaatcataactcctaagttttcagatatcattgtgtataggtatttctccagtttacccaacatcttccagccataatcagaggatacaacatttatcactcttcgggttattattacctatcacatggtgctataggtagaatggtaaacagctcttcttagaatagagagataagccaacagggtctctaataatggagaagagtacaacgtcaaacatatgctaaaacaattccaaagtccatgtgtgccattttgaacagttatgtgtcccatcacatcttaattctctttacttactcacacatctgttgtcttccagcaatattcgatcccctctgcaggaacaattcactctgccattaggagttaaaaggcacaagtcatggcaacctccattcaataatgcacatggagaaagttcacctgcaatgaagag

SEQ ID NO: 46762 - DNA, 1173 bp, Bovine  19866880837346
ttgtacatattgaatggtttatttgttatgtatataaaatatatattgagtgaatcagtaacatgtctcccaaatctaacttctcctttaatttcactttcatgtgaccaaatcgaaaaggttcaaaaaaataagttgtaagaattattttaaaaactactagtatctccaggaagaaaatatgactgcctagattggtgaaagacagttgtttctaaacatttaaagctacttcatttggattatcaattaccatcttatttctcagtcatagagttgttatgagaagaaactgctttcaatgcaatgttttcaatatgggaagacagcagggtgacaaattgaaaccccctgctgatctttgcaacataaacatgcccattcctgatatacatttaaattaggaagacaggatggcaagtgaatgttgaaaagtcccccaggtaattcagatttgcttatctgattgaggatcagtgctaacagagtgagatttagtatgatatctattactggaagaaattataaagaaaatctattaaacagatgtagttttaatttaaaaatgaatttacctgctacctattatatctttagtgctttctataataaaattctttccttacaaagttattttcacatcattcctcctttttatctattttttaagctagtcataaatacagtgtcactttcagtattagattctcaattagtgctttaatttccataatatttttattatttagctagagatgtaaaaaaaaattcattctttctgctaaggaagttttgatgcatttaaaactccttttctgctttcttattatcacttcaatttattttcaatgtacgtataacaaatatagcattgatttaagtgttgagaactttaattctgtatgaccttgaagactagtgtctgagtttcactctaaattgaggggtatgactagataattactaagatatctaaaactataaaatggcacaaagctatttgcagctaattttctggctcccttgaaagtggttcaacagattctgtgttaagagcattccaaaatatcatggtcaattagaaagaaaatgagccaaagaaaaaactcatggcttccttccatagttacattttcatctggagacacattgccattcacaggggaaatgaat

SEQ ID NO: 46763 - DNA, 2228 bp, Bovine  19866880855240
caagcaagaacactggagtgggttgccatttccttctccaatgcatgaaagtgaaaagtgaaagtggttgctcagtcgtgtccgactcttagtgaccccatggactgcagcctaccaggctcctctgcccatgggattttccaggcaagagtactggagtggggtgccattgctttctctgaagtatggtatagaggggtaaattaaactgtgttcaaaaagtcctagcatgtgcttccacttagtttgtcataatttgaaaagaatatatactcagattatatttgtttagaaaatatttatttatagaatatgcattttaataaattaaaattagaggaaatattttaaacacagtttaaaaaatgttttagtattctccaaggttttataagcaacacctacaaaaaaatagtgtgtgtaaagtaagtcttaaggaaatagctcaaatatctctgctagtattgtgttagattaatgttgagttattgattagatataaaaatattatatggtaccacctttttaagactttctcatttactctgactatacgctcagaatattttcttacgtttacctatcaaatattcattgaaggcataatatgcttatgattctgtgataagtctgaattaaaaattcctgaaggaatttgatttactaacataaacattttttttttaatggcagtaacaaatagtacactatatgccattaaaaatcatacaaatactacaatgataattgggataatcaagagatatttatttaatatatttgaactgggttttggagaataaattaatatttgggcagaagtgggtggtgagtcctgggtgatgagtcctggcttactgaagagacagacacatatgtcatatctgggaaaaagcaacaagtctaaaacttgaacaaagcagttataggatataaggcttaaagatgctttggcatagattgtggaggactctaaatctgggttaaatatttgaacttctttttttatttagaacatttaaaaaagttatgctaggaattgagataatcagctctgcaccaggaagattaagctgctggtagtatctattaaagtattgacatttcccacaagcctttattttgaatggatgagtcaacacttccattagaaacatgccaaaatgaaacacataattactttttttctcctctgttaatatcaggggatgctttaaaagattcactgtggctttctgtctaatggcacactggatggatcttaacccattgcacaattatgtgaatgtgccaaaatcttttgtgaacccaaaggaagagtagcccaacttgttaaggcagaatttgcaatattattgtttgtgaaaatacggctgaattttgaaccaaatgtcacatgcaaattttgacttggccaaaaatgtcagtagtacaaattccagctgatgcgataagcatcctaccatatgccaagtggcaaagttttactgctggtttagtcactcagtgctcacatggaattacctttcttctgctgtgtccaactgctgattacctcgtggtcctctcccactgctgtgtccatctgttggcacatacagatgccttcctaatgccccatgcacctgtttataccattcctcccagaatgcaatgcatctcatcattaccaaccaaactgtaaattaaatatgcatgttcatcttttggggaagcggtagaggtttgtttgttttttttttttttttttctccttttagtggaaccaaaataagtttaaatattgatcaagtagatcttgcaaacaattctcttaaagaagggtttttcacagcgtgattataaaatgctcaacaaagaactcatgaaaagttagagaaggtccatattcagttaaaaggttacacttctttgttcttagattataaaaaggtactttaagcaccctacacacaatttacagaatagatttggctccttgaagccattaaatcttcatctcaatatgtttcagtttggtaggatgagtaaatatgtctgaaaaaataccccttcccaggtcagacacttttgtgaagatgtgagggtggcagaataagtgaaaggataaagtgcttgggttctgtccttgtttttactgacctaaaagggacaactgagtaatgtagtggaatgaaatgaaaccctgtatacaggacagcaaaagagacactgatgtatagaacagt

SEQ ID NO: 46764 - DNA, 1997 bp, Bovine  19866880918169
tctatatccctattagtaaacgtatttgtttgctagggctgccctaacaaagtctcatagactggatttcttgacagaaattcattgtctcactgttctggaatcttgaagtctgaaaaccaggagtcaacatagttgatttcttctgaggcttctctccatggcttgtggatggctatcctttcctcattgagtcttccatctgtgtgtttctgtggcctaattttctttttataagaacatgtgtcatgtaggattaagatccaccctattatgtgaaagtgttcattgctcaatcctgtctgactctttgtgacccccatggactgtagcacaccagactcttctcttctgttcatgggattccccaagcaagaatactggagtgggtagccatttccttttccaggggatcttcccaacccagggattgcacccaggtctctgtcactacaggcagacttttaccatctgagccaccagggaagcctaattacttctttaatgattttatgttcaaatacagtcccagtctgagatactgacagttagaattttaacatatgaattttgtggtgcagagttcagcttataatagtgaaatagagatattcataattgcttccaacataagaaagtagtttttgaattttggtaatttctgaagattctagtatatttatatgaataacagtgtaaggaaaaaaaagtgatagaaatatgattctaaataattacagagtcaaaaccaaagttctttatattagaggagttgtcaaaaaaagaaaaatatttaaaaagagaacattttaagaggaggaagtggaggagatggctttatttaaatgttttctaagaagtaaattattctgggagatatttttagggatattatttccccagccatttcacagatatttagggaatttctacatcacactcagttcaaaagaatacaaagcgctgtgaagaatacaaagaaatacaagacaggatccttattctcagattttcatctctggataaagagtcaaaattagtacaagtgaaaagaaaagaaaaagcagcaatttcatacaaaaccatatgatgctgtctgcagaggctttggaatcaatgagaaagaagagtcaatgtgggatgtgctagtctgaattattgcactgagcgtaggtttagacttgtgcaatgaagggtaagtagagtggagtgatgtgcagacaaaaataggaaaaccagaaagtgaaactatgcctattttctttataggactcatgacagcctttagttatttcttatcttttttactgtggtaagaacccttaccataagatctaccctcttaacaaatttttaagtgcacaataaagtattgttagctgtaggcacaatattgtataaaagatctttagaacctattcatcttgtgtaactgaaacattttatacctgctggacagcaactctctcatcccccagccccatccccagtcctggcaaccactagtctactctgttactatgagtttggctgttttagataccgcatatgagtggaatcatacaatatttatccttctgtgactggctaatcttatttactataatgtcctcaaatttcatccatcttgttgcatggggtgaaattctatttttaaaaagactttattttgttagaacagttttaggttcacagcaaaattgacaagaaaatacagagatttcctatattctccttatccctacccacatgtagccttgcctgttatcagcatcccccatgagattattatcctttttaaaagccgaataatattccattgtatatgcacaccagatgttatcaatccattcatcttttggtggactttaaggttgtttccatacatttatgcttgcttttatgaataaggccgcagtgaacattgggagtgttaatatctcttcaagattttgacttcagttattttgtatatatacccagaaatggtattgcta

SEQ ID NO: 46765 - DNA, 1835 bp, Bovine  19866880952210
ctgttgctctgagatgcagtcactaaaatgcagtctaaaaatgcagtctaaaaatctaagctttactcagttgatagaccactaagggtcagatgagaaattgctacactataagggggcttcccaggtggttcagccagtaaagaatttgtctgcaatgcaggtgactggggtttgatccctgggttgggaagataccctggcaaagggaatggcaacccacgccagtattcttgcctggagaatttcatggacagaggagcctggtgggctacagtgcatggagttagttgcaaagcgttggacatgattgagcaactaacactttgacatacacacttttatcccccttataacttctacttatttggaaaagcaggtgaaggggccatagtggaccatgatcacttagaaccaactattcattaacttcactgctgaagtctccagaactgatttgtaccagtttgaccttccaagccagtctgtatgacaggcattctatcaatccaggatattttgttaaatttttttgtttcatttggaatacatgtatttttgtaatagatatttcttccctcttgagacagaattaaaatctgtttctggtaactagattctatgtagaatagggcccaggaagtattaatctcagtagacattgtcacaaatatatccttattattatgctcatgtcttggttttcagttttgtcaaaaaaaatctatcattttaaatatgtaaatatatagtatataaataatttataaagtgtataaacattaaaatgatattatagggacttccctggtggttcagtggctaaacctcctgctctcaattcaggaagaccaagctcaatccctggtcatgggactcgaacccacatgactcaactaagacctggtgcagccaaatacataaactactaaaaattgatattttattgacctagaaatcaatgtttatgacaaattaaaactgaaaaaagtttatatataatttgtaaaaaagatcataaattttaacttttctaaataaagttttaaaatacagtttgctaacaaatattactgatatctttaaatgatcctattctgctcatttttaaattattcagcattaatgttaaatttttacttcaattaatttaaatcatttttacagtgtgcttcttgagcaatgttttcttcttttaatatcatttgagattcagtgaactagtatttcattctggtttgaacacactgtatattaaaaggttccaatatttcaaaaattgcttcaaatggttgttctatcctggataatttattgctctgtctttattattaaaatatgaatgttgttgttgtagttactatgcaactcttgacactgccaaataattaatattgtaaaatttactgactagaaatatatatatgtgggtgtaaacataaatatattactgggaaaaggttaaaaaataaatactgtcaaaaataaatgatctttggtgctcccatttgccatgatcctgtctttcccaaataatttaatatgatatatctatttatttgaaaataaaagcacataaaacctctacattatagcacatttcagagggaagcattgcccatttaaataacgttaccaaaatattatatcattgcaactcaagactttcaattgaattggatgggatagctgccagttggagcaatactcttgaatcagaaaggtaaaaataaaattgtggtttgtaagagagaagcatcatcttagtactcctttactttgtaactcattaaattttgtaacattaaatcatagtttcaactgtattcataaaa

SEQ ID NO: 46766 - DNA, 588 bp, Bovine  19866880965481
ccttcagaatagactggttggatctcctgcagtccaagggactctcaagagtcttctccaacaccacagtttaaaagcatcaaatttcctccagctattcattacatattcactataaggcactgtagttgtgataagagacaatatggtccatgaagctccaaatatttactatccggcccttcaagaaaaagcaaagagcctcaggatcattgtcattcaagcatgcactggtgcatggtgcagagatgctgtggtagattcctccaggtacacccagatctacccttctgaactcattttttcagttgccaagggctactgtcttcataacataaggtaatggtgctgaactttcaccatcctacacgctctaaatatcttctgtaaatgttctccagtggcagcataaagattctcccattaatatttacttggatttcagaaaaatgtgactgagaatgagcctgacaatgaagagaactccattcttctctcttcaaagcttctgaggttggtttgagggcccaaatacagaagataatctcattattttgcaatgttcttttatcctaggacaactaatca

SEQ ID NO: 46767 - DNA, 1905 bp, Bovine  19866881025029
ttgacatgattcatgtctttcctgacagaggacagcccaagaagctataatgaaaacagaaaatgactaagaaaatttttgtaacagtatcttatcaaatttaacatgaacatatttgaatttaattttgcttcaaaatcgagaggaaggataaatctctctccacacccacccccccatctctatctcattcttgtctctttttcctctctcacttcagttggtccactggtacatatgaactagaactttttgcttttaactaatctagagtggaaaaagaaaaggtatacaaaagatatttttcctctttttctttgtatatttgagacattcatctgtggcgtggttaacatttcattactaaattggactttgaatgcatactacattttccctcacctcacagatgtctctttaggctcctcatgagttatacatctgtggcctgctggcactgccccatgatgtgctgtgaaagaaattgccatgatgttaatttgctttcatctcagaagtgagatctcatccctcttttctgtgtgtatgtatctctaagttaaaatgatcattgcacgttaaaacattttggagagattgctttaattttatgagtatccaaagcgagtggtacagtcccttataggctctctagacagttatttgggtttggattatagaatcagtgcctagttaatgttaatgacctttatctttaggtcattttgctaatatattattgtaaaggaaatactgtcaacgtgaataccatgcgtttcttatatgattaaagtaatgcactaaggaaatgattcagataatccacatgattcttggccatgtttcaaggaaagaatgagaagaacttcctgaactaatttacatttaactgattgtaaattgtactaagattctcttgtcaaaaattctacttggtgaatacaggttgtaggcattgaagacaggcagcattctggaatgactttcatgtaagacaatctagagtattgcaaagggcatttaaatatttttatccatcattattttatgtattttgatatggaagttgtaaaatagccatgacatatagaattgttagcattgatcaggaaggccattttgcacatggaaggatttgtgaggccattgccaagctaaaatagaaatttgatgcagttagtcatataattcagtcccagaacctgctgggaagaaaagagcaggggattctggcttgagtttcagtactggctgtcaaaactgatcaaatccaccatataattgctgagcacttcactttacactgcctgtgtaagcagagcaattggtacagtttctctcaactcaaactgttttcaaaaggacagaaaatactcttgaattagactttaatagtgaaggagcaggagataccaagagatgaacatttcatatataatctctatttcagcaaattcctgagtttaaattaaattcatattctctctgataccactttcaagaaaataatttctatagtgatggttattttttatcattagtatgattaatatatggaaaagtgttaatgtctggtcctctctgagattaatgttcactcatctctttctttcttcatattgtgctgctcttttcctctcttccaaactccctggggggcttcatagatagtgctagtggtaaagaatttgcctgccaatgcaggagacatgggtccaatccctaggttggaagatcccttggagaaggaaatggcagcccactccagtattcttgcctggaaaaattccatggacaacctgatgggctatgatccatggagttgcaaagagtcagacatgactgaatgagcacacaggaaagaaaacacacatctttacaaatcactacctaggaatatacaca

SEQ ID NO: 46768 - DNA, 1145 bp, Bovine  19866881032789
ccagagaaaccagatgaccacaaggatccatgataaagcttagtttcaaccatgaaagtaaagagagaatttacacctcagcaaaaattctaagtttgagaaaataattggactcactcacaagagaataaatgctttccttttcaaagtagctgtatagcagcctattaggtaattactttgattttaatgtctgtaattccaatttccatgatagctcataattgcttagagaaagaataaggaattgaagatgaagtttgtcactgtatatttaccatcaaaaaaaaaaaaatcctacagcttgatttcagaaaacctggctcacatgagttcatatttttttaaaaatctttttgtttaaacagccttttgaggggaactagaaataagagcactgggacttcttaatttaaaagctactacttcaaaagtctatagggaaagctgcttcagaaacatctccctgcatttgtcattggttttctttcttactttccaaactaagcacttgaaaaatgaagaaaaagaaagaaaatatcatgaagtccagctatctatgggacacatgtctatgtcagtcatcactctcatgatctattgcagtaattaatcaaaagaaacacaccacttgtgtaatttattgcagcaatatatcggcaggttaaggcctccaggagttgagttatggacatgaaccttgcagtgctgcttttatttacttcccctatttaaatttgatataagaacacagagtaggaggaccagaagtcagaattgaaaaaatatttgcctaattttctgaatggcttcagacatgtaaaccaaggtaacattcttatattcttaatattcttatgacttgctttttataatggtggcatgatgtggctcagttgttcagtagtgtctgactctttgcaaccccatgaactgtagcccaccaggctcctctgtccatgggattctccaggcaagcatactggagtgggctgccacttcctactccaagggatcttcccaacccagggattgaacccatctcttatatctcctgcattggcaggtggattctttactgctgggtacctgggaagcccttttctatggtaattattataattaaatgtcttcctttcattcaa

SEQ ID NO: 46769 - DNA, 2293 bp, Bovine  19866881112959
aatgaggaaactgagcctcaggaaaattaagtaatgtacccaaggtcaacacttgttaagggtttaaactggttatagaatccaggttgtctgttgctaaaatctggcctcttcccaccataggttttattggtccctatgtctgaccatctttgatttcaaagcaagttctatctctctgttttctaattaacagaaattttaatagactattcagcattctaatttcacatgactattccaaatgcttgcaatccttttacatttagaataaaatgattttctaaagagccttcctttctaagaatgcaattttaaaatatggacaggtacaatatgaagaacacaaagttttaacaaataactaggaattgttctattgaaaaactattttgatacaaagtatgtttattacaaaatatcagtagttactatggatttggagcttcccagggtggcactaatggtaaagaatctgcacgccaatggaggagacataagagaaaggggttagatctgtgggttggaaagatcccctggaggagggcatgacaacccactctagtattcttgcctcgagaatcccatggacagaggagcctggtaggctatggtccatggggtcataaagagtcggacacgaagtgacttagcacagatgtagaaatagggagaatactattctttgcaaataaaattacctctctagtggcatattatttgaaacttcaacatctcagggtcattataaaaccctggaaagtaaattcaactcatacagatgatcagttttcccttaaggaacaagagactgctaatgatctaatcacagcatttgaccaaatggcttatttgacatttgatttggaaatttatcaaatactttcaaaaatcattatggagtttttaaaataatcaaatatgtgatgccagctaaaacatgagattatgcatatttagtaaaaattcatatatgaatatacttttcaagaagttcaagtttttcttagttttgcatctattaaatcctattaataaaattctaaagaaagatatgtttgtaaataaaggcagtgtagattacacatggtagggtaagggagtattccacaaataatgagattggatcaaagagccttgtttgatcaaaaaacacgctaattttggaaaaaattaacatatcaatcaataaaatatgctatatctgtctaaatatatttgggaaaaccatttaaccatttaaaaatcataggaaagttgcctttctgtgattcaaagtatttagtacaaataatcttcttaagaaaacccatctttcaatcatctgtgaaaatccccagtaatttttttaatttatagccatgcattgcattaacacatgattgaacaatgtgtaaaagctgagggggaaaaataggcttaatatcagaagctcatgtattgatgcttagttttttttaaagattacaggtcaaagaagaattattttaatattagataaaattgtctttacatacaaaaaaaaaataacttggaacatgaattatatcttcaaacctaaaacaagaagcacaagacttggttggatgagagatagaaaaatctgcttttataaatttaatccttcaagcatagaataataaatattaatattaacaaaagaagcatatccaatgcttatgctatatgtgaatttagcataattagaacaaaagacttatatcttacaatagatttaacagtttctaccatcaatgcccaatcacacaagtttttttttgtttatttgttttgttcatttgtttggctttgacactcagcttgtggtatctcagtttgccaaccaaggactgaagctgggccctggcagtaaaagtgctgaatcccacccactagaccaccagggaactggcccctccatcatatactgccggggtccagccccggctgatccagggtatgcgaagcgggaacggcgtcggcgaggatcaggatacaatagtttcaattagatattaattagagatgtaaagagtaatagaatgaggatagctcagtaggaaaattcagtggaaaaaagaggctgactggcttggtttatgcgggagaccaataaaacttcaagacaagaagtttgcaccacttacttaggccgcaggcgtccttccgttctcccaaaggacaggagacactgaggcctccccggttggatcttagaagcccaggcataattagtaagcatggcgggttccgcgctccagatggggactcagccagagtagagagcgagcga

SEQ ID NO: 46770 - DNA, 997 bp, Bovine  19866881118388
ctttaaacagaaaaacattagaaaacaattcaaatactgttattatgaatattctttctttaaaaagattaatctccctgatacagtaacatgaaataatgttttgttacttcatgctgctgtaatttccatacagcaaatgtatggaaaacttcaaaaataatcactgttaggtttaaacaaccaaatcaaagccaaccatttgataaaattcaatactttgcttctttgctatagagtaaaaagctttagaatctgaacatgattagtcatttcaactcctattgtagtatatgaaaacagcaagaaagtttgtttacatgtgttattctgagggaaggtcatactatgacataatctgataatgttgaaatgcaaatgcttcatttggacattattttaattcataggaaggtgaactaagttgtcaaatatttccttctctcttactcctaaaataacacaaaaaatgtggtaaccaaaaactcattcatatttaatcattccagaagtaactctatttcaagggaaaatagtttcagaattcacactgcaaaatagatccaaatttatacctggtccagcatttttttttccaactcagactctaaagaaataagcaagtaacagtaatatttataactgtgacagcattccttttccaccaagtcaaatttctgataaataattaaatactttcataagtgtaagtcttcattattttcccatgaatgactccagtggccacttgtgcacattttatttaatcagaatatttaaaatgtcctctattgcaaagtctcatgggaactaaacaaaaataaatttcaattttcaggccataacactgccttccctgagaaagcaacataataggtagtttgtatgtatatggtggcaaattccctgctaagcaaggacattctataccatgtaaacaacaagaagctaaaatgccagatattcacaaggaagaattatatttttattatttaaa

SEQ ID NO: 46771 - DNA, 764 bp, Bovine  19866881293519
cctaattccaaaaccaggcaaagataccacaagaagataaaaatgataggccaatatcactgatgagtgtagatatgaaaatcctcactaaatgttaacaaattgaatttaacaatatgttgaaaggatcatacatcatgatcaggtgttaattatgcaagggattcaaggatagttcaatgtctataaatcaatcaatgtgacacatcatgttaacaaaataaagaataaaaaattatatggtaacctcaataaacaaagataaagctgactctggttgcctaaaaactgtatcgatgaaataaatgcactagagataagattttcaaaaccttataccttgacatgacatgcggttcttttggagataatatcccactgtacacatgcaagttcttgtagtttctgatgttggtaaacaaagctgagaacatccaccattatttagttggcaggaattgctgcctgaaaagtagaaaaacaaacaaaagaaacataaaaatcaagaaaagtttataaacatgattttactgatttataaatgctgctgcttcatattggttagtatcatgttttattccctcaaataatttgaagtagcagattatggttgaagtctgtctttccataaaaagcacagtatactgattacagaaaacaatactataatcaatttagagtgttgattctaaaggaaatcaacctgaatattaattgaaaggactaatgctgatgctgaagctctaatactttggccacttgat

SEQ ID NO: 46772 - DNA, 888 bp, Bovine  19866881346446
acggcttctcacagtgaacggtctctgacttggtcatctgtggtaaaaactagagggccatctttttaaccctcccagggccatgtctcttaggtgcttagcccaatgttttatttcctctccattcccactaaaactccttagctcaggactccattacttctcattctcctgatgacctttgctgaggaaacactagagtgatctttccaaaatgcgaatctaagcatgtcacttcaccacttaaaattctacagtggcttgcattcccctgccaaaccacttagcatggcacaaacgccatttgtgatttgatgcctacttaactttccatcactagatctattactgcccactgtgtaccatgtttagaaatattgaacttcagtcaactttcaatttcccaaggatagattaactacattatgagggaaaatgggtgaaaatgggccaaagacagcttacttgtaaagaaaaagaactaaaagtgtagtggattagagaaatatctacatatcagaatgagtctattatttataattatataggaaccattccatttttacattgtacctattgcaaataaggaacgccccttccacctgggcagtcaaaactggctatgtgcatatgcaatctgttagctgcttttgggtgcaggaacagttttctgcagtttgcctgaagctctgggcaaaaatctatttcttaggacaatgatggtactagaagtctctatgctgtgctttgtcccaagacttgtttttatttatttttctcaaacagagaatctagaaagtggcattggaggtgagaggaagagcaacatagaacagaacccagaattttgttctgaagcctttggacctgaacgacagatacggtcta

SEQ ID NO: 46773 - DNA, 923 bp, Bovine  19866881357690
tctgctctcagctggtgttctacatatacttctgtgtctgatggtgtattcctgatgtttccatggagagagatgtccttcccccaccacctattcctccaccatctttcatttataactcctattgtcatacttgcatcaatgaactttgatttttgataatttactgttcttatgtgtggccagaggagaacgacttatatagcctggtgtgctttagagatggaatattagtttatttagactcagtaaaatggggtcattgatgcatctgtttccattaatgaaagttagcaactgctgcgtgtatcttataattagatttatagaagtgctgagatgaaaaacccagtgatgcagcacagtgtattttcctcatccaaaagatgctttccattgtctgaagagacagatgcctgtgttctgataagaactgtgtatgtagcttgagttactaatataaattattcaatatgaaatgatgcctgtagaagtggtttacttttttttctatttatgaatctgaactgtttcttacaaatttaaaatatgtatctgtaagatctaaagagaagctttttttcataaagtaaatatatctactactaatttttaagataggctcagaagtcaaataaaataacaaaagtgtggtagattaaaataaaaaataaacctagggtaggaaggacttctggaaagaacttggcataccttatccccaggaaaacagcaatttaactgataaaaattatttttgaaagttcagtcataaaatgtttctgcaaattgtcttcagagaaattctgttgtatttctgtacactgctgctgctgctgctgctgctgctgccactgctgctaagtcacttcagtcgtgtccaagtctgtgcgaccccatagatggcagcccaccaggccccg

SEQ ID NO: 46774 - DNA, 858 bp, Bovine  19866881451905
cacgattaaccaagctgaaccatcactgaaatgtatgtggatttaaatcaaagggagtatattaaaaaatgaacaccattaaccttactgcaataacattcttaccttaccaaacaggcatatcagttgtacagattccagaaaattactctggatggttgagcctttcaaaattgataagttttgattttcatctattttttaaagttgtttttcatttaattcagagaaacatttttataatttttctttcagtttatttatccatttcctcaatggatcaggaaatatttgctgaatacagcaatgtaccagacttcagggctacttacttttggagatacaaagatctccaaaacaaattctagtcttcagatgctagtaatcctataaaagaggcaatgaggcagttatgatttattgcaatttctgtaattaatgctcatataaatgcatatgtgtgtagtgacaatcattacacaattattgattttgtttatttttaaatttttattattcaaggggaattttataagatttaatatttgttgactatcatcaggtaacaagaaagaaaaataaaaagaaagaaaaatagctctaagtcgtgtccgactcttgcaatcccaaaaactgtagcctgttaggctcctctgtccatggaattctgctagcaagaatactggagtgggttgccatttccttctctaggttgcatacaataaaaagtagcccttcaaaaatacatcctatgaggcataaactattagtcttattttacagaaaaaactcaggcacaaaaagaacaagaagataccctaagtttattaaacatacccaatggtaggggtcgtaaaa

SEQ ID NO: 46775 - DNA, 1589 bp, Bovine  19866880470894
tcatgtcccataccctgagtgcaggcttctcagggggcactggtgctgaagaacacggtgtcaggaagatcccctggaggaggcaatggcaactcactccagtctttttgcctggagaatcccacagacagaggagtctggcgggctacagtccatggggttgcacagagtcagacaggactgactcgacttagcacgcaccacacacatgccctgagcaaccgtggagacagggctagtggaggagagagcatcctggagaggcggaaggagaccggacgtagagagacgtgaaaagcccactcagagtgaagcgatggggccagagcagggtgtcagccctgggcagggggaagcagagaaacgagttagctgggggttctggagccctgggtacaaaacacaccaagtagaagagatgggattggaaagatgggtggaggtagagtggctaaagcactcacatgcctgacttaatggtttgggatccgtgtgaccccaaagcagagttgttcaaggttttgaacctggaagaccatgacccagaagggcgttggagtggcaagagtcgtcagcacaaaatggtccaaagctctagcagtgttccagttagggaacaacacatccttcaagtctccacttgagtgccctgaggatagtaaaatcccagactctggtcttgatggcaaatgccatctatcttctgaagtcatgaagaattaaataccaaacaggtacagactgcagacgtgtactccagtctcaaaagaacagactctgcggcactggtagaatggctgataagcagcttttgttttggaaaagggtatttttttcccactctgagtgtggaagagaatatgatgaaagccagtgagatgggaagatgtgttctccactcatttttggactgtgaagccaatattgatgactgtcattaattaatcaattaaaccattaatttattgagtcattggcaataaaaagcataatgatgtatatctgccaaagtgaaagtaaagtgttagtcgcttagtcgtctccagctctttgctaccccatggattgtagcccaccaggctcctctgaccatggaattctccaggccagaatactggagtgggtagacatttgcttttccaggggatgggtctcctgcattccaggcagattttttatcatttgagccaccagggaagcccaaatgatttgcagtctcactaaagacaataattcagcaattgaatacaaagaaactccattaatttgttttaacttaccaaagcagttaattagaaagtagaataattagtcagaaatcgatactaatcaaagcatgagttgcagcgagaaagatgcccaaggaagcacatgacaaagtcattgccaaaggacgaattgttgataaaactaagtaatctagtttctaatatattttatggcaaaagggggattttcactctttaatctcataaaataccagaaagaataataataattggaaagcacttttcaaaataaaatgcaaatttctttttaaatgctgaaaactaagacgtcagccacctatttaatagtaaaactttaaa

SEQ ID NO: 46776 - DNA, 1847 bp, Bovine  19866880490062
tgataaatgcttgcaaaggtggtaaagaattgaatcagaaagactcggccaaaagaacaagaacagaaattcaggccatttttcaaggaaatcatcatgacttggggagcaaaaaagtagtgaagggctggttttctgaaaggagatgtagcagttgggaaactaaactaataaatcccaggagacaggacgagacctttggactgaagaaaaagctgggaggaggatccagaagggaagccccgtcgtgtgctggcagggtgagcgtgtcggagttctcggcaggtttctattcatgttttattctggtgcagaggctgccaacaccagcagaagcagcagctccagggtgtgaagcagccttcagatcccagggaggaatcacagaccctgcggagctgggcgtgtccacttagtgaatagaaatctcagcacaagaggaaatgagaagccagagtccttccagatttcccaggttgacatgacatcgtgtttgtcgggtgatggcacaagactccttaaagatcaggtattaacctgttaattgcaacagcagtcccctgctgcccgtgtttgagttcatgctctttctcttaacacactgtgctcacccttcagggcccgacggcctcattctcattctctctgatgatattcatttgtcaaaacacatcctgaagaaaatgtcagttcacaccatttgtactgacctgggcgttactattagtaaggtaaagtgtgaccttcttggatatcagcctcggagccccaagtgcaaggaaaaacctcaggcatcgatcagccactccaaagaagggaggcctgggtgtaacttgttcttaacagccagacaagccatgaagtccaccatgattcctgacctggttaggcgctggtcctaaaagctccctgggagcctgcattcggtgtcgtatgccctgaagacatctgagactctgaagacacctggcgtacctgtccactcacctgtccaggtaatcctctgcgctggggaacactgacagagcatgggctgattttcatgataaatatctgcatcttagagctcagtgcaaggcttggtgctcaataataggtgaatgagtgaacgaagacagggctacagggtccatccacaggctccaggcttggagccagagaccctgcagtctttgttgtctccatagaaagttgcgttttctttccaaacccttgggcctttgcatgctctctttctgtccttagctcacggcatttggctctgtttgactggttgtttgtttttaagcatctttcatccgtgtccatttttatggtcagctggtttttcttcccaactctcagctcctatcagctactatcgtggctttagaaacatttcctgtttctaatattcgtgcagttcagtcaacatggcagaagacagaaagcattaccttcaacaggcctcattttgatgttgatttatttggacgggatttcagtgtgtctcagtactgcctctaaaatctaataaaatccaagtcttggctctaagttgttttactaactgacccttggttagccgagccagactcttctgttttatgcaattaaagtaacttgattccaacacacaatgtgtgtgtgtgtgtgtgtgtgtgtgtgtgtgtgtgtgtatgtgtgtgcgcatgctcagtcacgtctgactctttgcaagtccagggactgtatccccaccagactcctctgtccatgggatttcccagacaagaatactggagtgggttgccatttcctagtccatgggatgttctcaacccagggatagaacctatgactcctgcattttcaggtgggttctttac

SEQ ID NO: 46777 - DNA, 1396 bp, Bovine  19866880918135
gtcccttggactgaaaggagatcaaccgtcaatcctaagggaaatcaactgtgaatagtcattggaaggactgatgctgaagctggagctccagtcctttggccacctgatgcgaagagccgactcattggaaaagaccctgatgctggaaaagattgaaggcaggagaaggggatgacagaggatgagatggttggaaggtatcactaactcagtggatataaatctgagcaaactccaggagatggagcaggacagggaagcctggtgtgctgccatccatggggttgcaaagagtcacacatgccttagcgaccgaacaatacaagttattcgggataaggcgagataaattattcagcagttagtttgacatttagaaagctatttataaaaatgatcatttctcaagaaaataaaaatagtgagaaaactaaaaattggcagttctagcagcaggagataatgcgatgcagaaggcattttcagggtttccttaaaacatattttgggtttattcagggttctttctcctcgctgacattcagctattcctctggcaagattctccattcttccatttttttttttctttcaacattgattgttgtaccaacatccacatcatcggtgtcatcttccgggggtgggtcagctcctctcggtcctccccggcgctgggcagtgagggaggaagaactggaatctgtgttccatgagtgggtgtttggtggcatcacacaggaagttccgtgatgccacacacaggagaacgttttttaaactctcaattcaagtaggaggtgatgctcttccctgtgagaatttacatctcctctctctctccctccatcctgcccactcctggctgggatctatcaagggcacagctgatgaaatataccctgttcagagggaccacaccacaggagcgtgggacagactcggagtgctatgtgggtccctgttgggctccctaagtgaaggctgagagcagacatggccaactgtcatgggtccgccaagtaatagcaccactcaagcagcccagaccacatgtgggaagagtaacacgggtctcacaagtctggatccactggggtggtatccatcctgatttgcggctgaagttaattctctgaggagtcttatcagaatccaccaaatatcatgcccagttggctatgagctgtaagtatagtccactgatatgcttttcatggcatggggccaacattctcaacagatcccttgggtttataaagctccaagtccaggtgtctttttgggtgtcgttaaacacagctatgtacctgggggacccctgcagggctactatcattcgctgtgtgctgtgtgcgcgcagttgctcagtcgtgtctgactctttgcaacc

SEQ ID NO: 46778 - DNA, 907 bp, Bovine  19866881025104
gaggtggcgggaggggcgcgcagtggactggccttaagagtccagcctcagagtctggggaagaaagccaccaggcctagtttaatttcagttcggcttgggagtcctcctataacaccgggctggtcccacagcctgcgtatgaaggtggggttgcaaacacggctgttatatttgaacctccgtaaagctgcaagcccttatccacagcatttgactccgcctttggtccatcccaggggcctagcaccagggcctgcacaaggctgttgccagaaaaactatttcataagcgttccgtggcccctctcagccccccagcacccaccgtcatgcgattcctccagtaacggtaaactgttatctggccctaatgacttctccaaatggggcctgaagggaaggtcccagtcagggcaaaacgggaaggaggcagccgcgagcacccctgcgcacagcctggaccaggagggacaggcccccgagcaagagaaggggccaggcagaggctcgcggccggacccggcttcccaccccggcccaggcagacaccgccccatgtgccactcacagcttctggttgagcccggcctggctgctgggctggaagtcgctgacgataatgccgagctgccggatgttctccacgaacttctccaggtgctcctccaggtggtcgaacttctccgccatcgccgcgcagcccgcacaccaacccgcggccctcgtcctgccccaccgcttcctgcttccgtccgggcccgccaccacttccgcttcctctgggggcccggatggggcggggccgccggggtggggaggggccgccggggtggggtatgggggccgtggttaggtcgcggggaggggcgttaggcggggccaccggggcgggggcgggagtcag

SEQ ID NO: 46779 - DNA, 708 bp, Bovine  19866881205169
catttatgtgtgtgtgcataaagagttggacgtgacttagtgactgaaaacattcagtccatagcaagggttattagagtgggttccaatccaatgtgactggagtcctcataaaggggggacattcaggtgctgagaagagcatacacagaggccactgtggccatttaccagtcctggggagaagcctggagcaggctagcacgttcggagcgaacgtggcgccgccataccttgatctaggacttctggcctccagccttgtgagcaatgtatttctgccgtttgagcctctgcagttgctggtactttgctacgacagccccaggaagctcatagacagcagttggggcaccacaaaagcaggaatcagtcctctgatctgccagatgttacccaaggtggggaccatttccactctaccagccacacgatgcccagggcaagatcagtgtcacctccataaatgccgtggcgctcagtcaccatgaggacccagacagtcccagcaaaaaggcccctttagcagctgctttgctatttctttctctgtttttattagtgagatctataaaaagatttgaacatcttgaagactgggaatgcgtttgggtgcagcacaggcatggaaaaatccccccaagaagagttctgagtgttggtgacatcacgtgctgtaacaatgtctaattagatgagaaattatta

SEQ ID NO: 46780 - DNA, 690 bp, Bovine  19866881283834
aactggccttgggtgagatgcagtctttgcacggatggctatagagtgtaactgacccgataaggtagggtcctggatggcccccactccagccaattaattagctggcatccagtctcgctttgtctcacaggctggaaaaggcgttataattagattttcccatccttgctgcaaaataagggtcgattgtctcacatgcccaatcacagctgcaccacgcttactgcaggttgaatccatgtgctgagaaattacacgggaatcaaatgcacactggcatcagaaaacaactccagattgccctcaatggtcaaatttcatctgaaattaagtgctgatttacatgaatttacatctaaaatgcaaatcacagtgttccccagagacagcagaaggaaagtttgaaggcagctagcttctcctttatctcaaaagcagaagtcctgttggtctttagattggaaacccccaaacaggtttccatcagcagccccacacgcaaaatataagcgccagattatgtgaacacaggcccctttatgctccctgtggcaactctgaagcatgagcttccatctgcgcttgatttgcatcaggctccactgcctgttagcaacatgggagaggcattgctgggggaatggggatgcttctgtttcaaagcaaaccgtggctagggggcaagtg

SEQ ID NO: 46781 - DNA, 1404 bp, Bovine  19866880662738
acccgcgatttttgaggaaaagagggagatgcaggagaggttaagatttggaataaaatctcccttcagagacccttgggggagcagaagagttcgtccatgtgggcaggtttgggggaagtcggccctgctgggagccctgggttcaagaggagcttaatgtgtctttccctccctgttttggcccagagaagggcatggcccctgccttccaccgactgtacaaggagctcatgggcccgtggaacaaggatgagatcagcacagccgatgccatcttcgtgcagcgggacctagagctggtccatggtttcatgcccaacttcttcaggctgttccgtaccacggtcaagcaggttgacttctctgaagtggagagagccaggttcatcgtcaacgactgggtgaaaagacacacaaaaggtgagcaggcagagaaaggcgggcggtcccagggcctgcagagacgggggttcaagtctcaagcgtcctgacccctcccttccagcaccttctgctctgtggacagaaggtcaagtgccttaagaatcaaagcatcttgttttttccataattagacttgccctctgaaccacctctaaaggcatccctaaaaagtactgtgagatgttataagaacagtaataacccatggcaggaggcaaacacagcccttcaagattacagcttagggaacaaagtaaggggagacttacatttccaggtctgatcctagacaggatcccaggaccaaggcagtgtggtgagctggaaggctttctgagacacttaggaagatggaacgggttgacagcagctagactggttcactaaaccttacccagtccatcttctgatgggatcccttctgacacatgtccatttgaggactgggagctcaagggaaccatctaaaaagattaaaacaatatccagcctcctgatcacctggatttcccataggcatgatcagcgacttacttggtgaaggggctgtggaccagctgacacgcctggtcctggtaaatgccctctacttcaacggccagtggaagatgcccttcccagagtcaaacacccaccaccgcctcttccacaagtccgatggcagcaccatctctgtgcccatgatggctcagaccaacaagttcaactacagtaagtgcaagactctcccttctccaggtcccacaatgactgaacctcatccctggggtggtccactccaagggaggagaaaaccctagaacacaccccagctgcaacaaacactccccaagtaggagacacggggattatcggagcagcagaaagtagctgtatcttgtgcaagatgaagctgaaatccagaaattaccttaggatcccacttgaccacttgatacagtctctcatcttcatgtg

SEQ ID NO: 46782 - DNA, 1108 bp, Bovine  19866880682591
gaaatggagaaatacgcagagagggaagatatggtcatcatgtttgtggacaggtaaaggggagggggcagacagaaggggagaggatagggagattcctagtggtcgtcctcctcatcgtcccccgcctccctcagctacgacgtagttctggctggcagcccctcagagctgctgaagaagttcgtccagagtggcagccgcctgctcttctctgcagaaagcttctgctggcccgagtgggggttagcagagcagtaccctgaggtgggcacggggaagcgcttcctcaactctggtggtgagtggcagagggtccagcagtggtggggaatggagtgtcccaggtgcttgagggcgggcaaaggaacggggaccggccctgggacactgaagaagtctgggagtcagtgcatcctctccccctgccaggattcatcggcttcgcccccaccatccaccaaatcgtccgccagtggaagtacaaagatgatgatgatgatcagctcttctacactcggctctacctggacccagggctgagggtagggagaggccaaggagggcccccatctccacagctctggggggtggcaggccctgaggaaaggagtgaagaggctttcagaaagacacggagaggaaagagtaggaagagatgtctcagcccctcgttaattcactgcccccacctcatcccatccaggagaagctcggccttagtctggatcataaatcacggatctttcagaacctcaacggggctttaggtgaggagacagcaatgagaaaaggggcgatgagagaggctgttgggggtcctgaatgtgggtgggtctcctagtagatcggggtgaacttcagctcacctctgtgttaactgcagcaaacgtctgaatggcccgtagaataaggtgcactctgctaccaggaatagcagcagcccctgttgtacatgtccattgctacgtgccaggctctgggtcagggttttcgttctttagtttcattgaacacagcaatcgtacgaaaggcggtctgtgattatccactggttacatatggggaaaccacctccctgcggggccagagacttccccggggggca

SEQ ID NO: 46783 - DNA, 3966 bp, Bovine  19866880734595
gtgatattgtgaagacggagaaggagaattacagctcaaataaaaaactttatataaattttaagcagtctgataacactaaaaggaatacttgggggaggaggacatacagtggcagtgcgctgggaaggtcataccttcgggcatcattatggtaggaagaagggagggtgtgagtcatcctgatggctctaggggtagggggaggagaagtttcacatttaatggttgctttatcctcccgaccatcttcttctaccactgcaatctggaagcaaaaaaaaaaaaatacaccagattcactttttctaaattttaactgaaactgatgaaaatagagactcattaaagcaaggctatttgagtaattataatataaaagcaaaacaagaaatttagggcatataagtcttacacataaaaactcacattattaaagagcaggaatttcataactatttaaaagttaagacactccagttaaaagagacatacacacacataaatggacttactacataaaaatattagttaactgtaaataaacaccatacatcaatatctagggactatggaaaagctatcttggaatccattaaatatatcagaatgtaaaagctttacaaagttattgaacacatatttgaactaattcactaaaaatatgcatagtcatcttttaagtgggagacttttgaagtgagaatttgacaaaataaaatgttatcagatagggtgttttaaatcaggctaattaaatgtgttcccagatattaaaaaaaaaaagctgcagtttataagaaaaaaactttctttttaaagtgagaataataaaggtaagaatggaattttcgcaaactgtttaatttcactacttcttatgggaaaattgagaaggacatacagttcaccataagcagatgcgatgaaagggatttctttaaagaatttagttccaagtccagaacaattcatgataccataaattttgccagagatggatatacagaactgtattaaaataagacttttcaacaaccaactgaattgtatgataaagatttttaaaaacaatgctgcatttttcatagtaccactgtgcattatatatatatatagagagagagagattgaaagattgtggaaaccgtagctgaaagatgtatggttctagaagttctgatgaagaaatgtctcaatagggctataacaaaaggtttaaaactatgttctcgtcttctgtctataaatgtctcgctagtttctttacattaagctattatacttaaagtgtgtttatatgtgatacttcatgtattggagaaacaatacaagtgtctgtctgggctcttgtcattcaaacctaggttacttttaccagcacagtgcatgtgttctcagtcgcttcagtctttgcaacaccatgggctgtagcctgccaggcttcttccgttcatggtattctccaggcaaaaatactggagtgggttgtcatctgttgttccaggggctcttcctgacctgggatcaaacactcatctccttctcctgcactgcaggtggattctttaccactgagccacctgagaagcccttaacaggataggacatcttaataagatctcttttctccatttcaatgaatatagtgctattagaagaatctttttcaagaactgctttcagcataatgttgatactatggaaaaccctttctaaactcacatctcatctaaacttgtaaagcgtatttcaaaactcttcctaatacatatttatgttttctcagttccattattttaccaagattgttttccacaattgtttctgggaagcctgattatttctgttttcagacttttcctctgaaacaccctcttataaaacaccttcttctctccagatggcaggtcaaactaggccaactttcaaaatatcagctcttaaaaacattaaacacaaaccctttcgctgaataatacttaaatctcatgctatatgagtaaagtggaagagaaagacttcagattcagagatggatttgaatcttgacttctcttctttattgagtgacgaactaattacttatctactctaagattaaattttcttatcaataaaatagaagtgaatatactcagtttaatttcttttgaagtgcaaattaaatcacgcatataactccttaccctgatatacaataaatgttagtttgtggttttctttctgtaacctttcttttttctttctttcttttttacaattccacaacttgaatgacatgacatatggaagatggcaaaaaaaaaaaaaaaaaatcaccttgccttttcagctctttggagagatctggggcaaaggaatcagaattcaacagtaggattttctcagctgaactaaggatagagaatagaccgtagggagtcaactccctggctgactggtctttggggcaaataaagaaaatgccttcacagccaaagggaaatgagaaccttcttaggtggatggacttcaggctctgcactgatattaacttcatttgggatgtggatatctcctccgggtctctgctctcggacactaagttgattatgcttcttaaatactggatgaattccatcctgatctcttccgggtagtcctcaagattcgagtgcaccagcttcagcttgttcaagggtggtgccagagctgggttttctttgtcacttctggagcctggtgtgtggtgtgcaattaacagacacggagtattctgtaagaactgctgctgaacgaaacaggaataccacatctcaatttccttcaggtgacttaggatgctggcattgaagacgatcaccaccccatgagagtccttcatcagggctggccagtaagactcgaactctggatcaccaccacaatcccagagctcaaattcacacccgcgccttcgttgtttgctggtaacacgtggattctcaaattccaggatcctcactccttgggttgggttgtattcagtgatatcagaagcttgtgtcagaaagtaggccaaaatggtttttccactctcgcaggggcccccaaggaggactctggccttcagcaactcagtcccgggcccacgcaggcgccgcttgagtccgcgctgcagtctgcgcggagcggaagtcatcgcactataaccttcctttcttaccaatcatctttctatattccctaaattccctgaggctttatttctgcacaagatcttcctttacattttttccccctcttatgcacactgaaattatttcacatatcatatactcagatttcttcctgtatttccagtataatccttttaagtggtgaaggaagtcaaagacaagtggtaataacattatgcgtgataaatttggcagttgagaactaacggatagcgtcaaggagaagatactaaaagaagatagatgatggacaataaaaagaaaattcaatcaatttaggtcatgtaagcatactatgattcccttaattaaaaaaaaaaaaaagttccctagttgcagaagtatttgggcataggctgattatcacatcttgaagatgctgaaaaatagatttatttatgtattggatagtaggttgaatctttaaaatttgtcccatctgatttcctgaatctgagctcttccactctcaattatctaacacaatgttattttgtgaatctgaactttattccattttgtttctaacccagggatcaaacccaggtctcctgcattgtgggcagattatttaccagctgagccacaagggaagcttgtttcctatacccaagatttattctcttgacttcattctaaacaggaaagtagtatctggagccatgctgagaatgcccctccctgggctagctaattcctagagatagcaaactatgttcctggagtgtgccttccatatgcacaccaaacactctagatcagtatc

SEQ ID NO: 46784 - DNA, 1121 bp, Bovine  19866880941703
atcccagcaggtgcatccctgccccgtggggtcttccctgccagctcctctcacctgctcctccagcaaggcctgaaagttttttcggaagcggagtttaaaatgatcacctcgtgttttcttctttttctttcctagacgtcaagggcgatgagttacttggccctcacccagaagacaccagcttctctgccccactgttcccaatgcccctgtgtcccttccctgcccaggtgcctgccaggttctaagccggcctctctctaccatccttccctgcctccacttctccaacccgagccttcctccatctccacactcctgatacctagagctccatgtcagagctggaagcgatctcaagggctcacctgccctggcttctttattctatacacaggaaaggaaactgaggcagagactgggagagggcctggctcaagggagccagaggagctcgcaggccatccatcccccagcccgacatccttacacagccctgacccagccaggctcttccctcttcctgcagccttgcctcctggaccctcccttccactgccccccgcggcacccccttcctcctccacccgcctcaccagtgtctgcgtcgtcatcaaactgaggtagccgcttgcccagctgggggaggcctgcgtgggggtcgtcctggaagttgtcattctccaaggcctcaagctgcctgttgatgcggcgctgccgggctgcccggtccagcacccgccgctgtccagggtcctgggagcgaactagatgggatggggccacaacagttacaggagcaaagagacgctgggcagcctcggctctgagccgtgggtggaaggaagatgtccagggtgtgggagccacagttctctgatctcaccctagtccccaaacccttggcccctggatctcctcccaatatatcgcccattctggctgcttccttcttagccacctaagactgctgtttcactcattcatgcctggtttccatccttttggccccatcctttcctcccaatcccagacctgggcagtgaaatgtctcctggagacctctcgttgctggcagaaacacacaaccgtgccggtggagaccgcagtgcacttgg

SEQ ID NO: 46785 - DNA, 609 bp, Bovine  19866881028163
ttgtaacagacggggtttccgagtatgaatgcttgaaatgggactgggtgggctcatgaggaaggtcaaagctcgacgactcctgcactggatccagaggcaccatcccccttgcgagcatctcaggcccatgaacttgacctgggacctgaggacaaacaggttgggcttgtgggtaaattactttttaaacaggaatttagacaaacaaaaagacagtaagtatgccaggggctgggcgagggccagggccagaatacttttttaacagccaagcggagcaggatctaagtaccacaaagactataaatccaagctttaaatcagtaactctctctctgctccagtctcaaagtccacgtgctgctcacacatcacatgcgtcacctcgcctcacctgctgtcctgacaaatccagctccagatcctccagcaaggtcacggcctcctccccgctgtcaggacggtactcctgcagccaggcctggagctcccggggcagaatggagaggaactgctcgagcaccagcagctccaggatctgctccttggtgtggatctcgggccgcagccactggtggcaaagttccttcagtcgactcagggcct

SEQ ID NO: 46786 - DNA, 1667 bp, Bovine  19866880352929
taatttaggtttagggtaattttcatgacaaatctaaaagtgttttaaattttaagaagtgcataattggcctgcaaaggccacaaagccagaccctaattaggacaacttgggagagaattaccaaagagaaagacgaaatcctcactacttaaaacctacaaagtatgacttctcgacctccagatccataaggaaggaaagaaatccaagagagccaaattttggctgagcatggttagctgcgtggtaccctttattggtctggctgtactacagctaccatttaaaaatgtctagagcaggcatgagcaagaggcattcctcaagtggccactctgagcccaaagcagaaagtctagtcacaggcacataggtaactctgcctcaggtacgtttgattccatgtgctcatcatgagtcctggttttaccaaagggaaaactatttctgtacttgaactctttctggggtagagaggcaagggaaataccagaaagagcccaagtcagaaaaccagggttcaaatcccaacccttctactttctagatggtcaaatctaccttcatttatgcttcctcaggtaaaatggaaatagtacctacctcttcaggttatcataagacttagaaataatatatatataaataatttgcatataatagtactcaataaagttgggttaagtatttacttaacaccacatacaaaaaaacagaagctacaaaaatgatgaaaattacaggctaggcaaaaaaagttcaggattttcaagtagaaattaagcaatttactaaagaaaaacaaaaactaggagccagagatcccaggcctctgttttgtaactaactagttaaatgaccctggacaagccaacttgaacctacgtttcctctcttataaaatgaaagaataaaatgagcctgaaattattctgtcctttttggcagtgtcactcaactagcaatggatatgaatttagaacccagacctagttcaatactacctcaaaataatgtttctaaactgtatcacaaaagagactatcaaacaatatgtggctggcagaggcagttcggacaaataggtagaaagaaagatttcatactgggcctgaaacgagatgataataatttataaaattaacattaataaagagaatgttatattaatgtatagagtaagggatataaaaaaggtaaagcacagtaaggaaaaccagtttagaggcaggttatagacagaagggagcaggaatcaaagatagttttagctgtgacttttaaaattgaattagggaataaaatatgaagagaaaactacataaatccaaatagaagctgacaagacttgagttagaacaaagagcggagagaaagggggagatataactcattttcaggaagtggcaaaattcagcaataaaaatacagcaatatgctgtatataaaataaaaagacagcaatatgctaattaaacaaaaaaataatgtaaatcagtagagctgatttacaatgctgtgccaatcttacaccaaaatgactcagtgttacatacatatacattcttttttaaatattcttttccattatgattgttcccaggagactggatatagttatatagtacggccttgtagtttatccattctaaatataatagttt

SEQ ID NO: 46787 - DNA, 799 bp, Bovine  19866880356952
cccgctcgggcctgagccgtagacattcagatgcttggcccagggcaagcatcagcgggggctgttttggcaggttctgagactctgtggagaagagacaagacctggtcactgccctaatcagggctgagcccaggtccaagttcctttgggagcagaaggctgtggggagtggacagaatctctcggaagagagagttcatatgcctccatgtgtgtccaaaccaccagactatggccctgtcaagagcttgtgaaccttagctttctttggagcaatgagctggcctgggcccaggtcatagtctagggcccattgtgatctagctggccaactcagttgggcagagggaggtcagggttctgtcatgggagcccaagagtcccgtgggccaccagacagcctctaggcagagttcgctgccctgatttggacaaacaggaaggggtgactgggccaccccaggcactcctggaacagcttattttcgttagaaccacttacctaaaatggcgctgttgagggcggcacacacaggctccctctggatggggtcaagctgctggccaactgggcagctccaggggtctgagtaggcaagcaggctaaaggcatcctaaggaacagggcacttctgagaagactgtggtatgcaccaacaccccccatggctccagggggatacggggccctgcgtggtgtcagggaggcacaaaataccccgatgtcccatttcccactgaggtcttatctagagctcactctctcctattgctgctgcccccagtgccctcccag

SEQ ID NO: 46788 - DNA, 1023 bp, Bovine  19866880397122
tgaagagcaggagagggaggggatggatgcggcaccagaagctgctccaaacacaacccacgataaacccctttgttgaagagaccttggcagggggtgggaaacagcagtgatgaaagaaccttggggtaacaaggtgccgtaggtgggcagagtaaagtattttggctaaactggcttagtgcaacaatgtggggagatgggcatttgcttctgccagcacaggaggtgagtgtgtaaccaaggcaacagtagcagagaagacggcggggctccagggagccagtggtgggccagcggcgcacatgagcccctacccacatggacagtggggacacgaggcaattaaaggcgtctagtagaatccaagcacaagcctggaaatccaccacctgcctccttgcattctgctctgctgcctgtaacgtcaaatctccagctctcccatggcccctggccgccctccccacagctcccaggcaaggccctaccctgctcccctgccagctccctgttggagcacgtgaagcaggctgcacgagcagccccacaggctctggccccctttgcctggagagcaggacacaccacacgctccacacctcattttatcttcgacatcccaggggagaatggcacatgtctcagttgctacgagatgcggcggcgagctgggatggtctcgtaaacgtccactctggctctgggcagtcacgctactgcagggctctcagaacaaccacagggtgcaactcgctggccctgagcaggtgtcccttggcccaaatggatggatagtcagcctgcagcccagaaacgcccccctggagagccagcccctcaccaacacaatgccccggggagtggcaggtgggcttcctctcccactggagtccaggcccctgcctggcagcactcactctcctaagcaaggctctgggaggagctctgcccaagcccacctgttcctggtgccgtcacctgggcccacccacagctcacagactgcccaagcagaggagg

SEQ ID NO: 46789 - DNA, 1631 bp, Bovine  19866880458920
ctggggccgctcctctcgcttccttggagataagagatggggctgggggctaaatgccaaaggctgcgtcacaatgagccccagtgatgtgagccaggcccgacaatcctccctgctggcactcagaaaggctacgtggccagcagggacagggctccaggctacaaggcagggctctccctgaccccagctgcagaaggcaggggcagcatgggtacacaccgcatccagccctcagaggcccgcaggtgaggcgtggctatcgggagccgatgagggtggtcacacggccacccccaacttctcctcatctctgccagagatgagggacacagccctaagaatgctgcccctactgtcctggtcttgcccttcccgggggacagggaacagctgccgccactcagacgggccactcccacacagctgcctgtgctgaagtcaagctgggcagctgatcctggggagaggcagctggcacgggcaggccacagaccagggctgtcaccaagggtcacgggaaggcggggccacagcccgaggcccctgaatctaagatcagctgcaagaagttcctgtgtatgagtgaatgagtcttagggatgctaaggtaaaccccaacctgagctgtgctcacgggcgaaccagatggccgaccaaacagcccttgcccaggccctgtctatggtgtccctctgctatactcctcaaccaaagtgtcagggcccctggggcccaagaaagtcccatcaacccagcctccacctccaccttcccacacccctagcagcccaattctaacccatccttaacagctttgatagccagaaagtccctctttaaacttgcccaattctgtcttcctagtcttcccaattactgggaaaaaggaatagctttatttattcagggaacaccatctgccaggcactatgccaagactgtatattcacaatctcgtaaaagctttgcgacaaccctataaagcagaaactatcttaatttccaaatgaggactgtagttctcagagaggttaaataacttgtccaaggacacacagccaaccaacagcagaactgggatttgaagccaggcatctgagcccagagcctgctgcctctggaaggggtgtgtatgtacaggtgtgtggcttttcacctccccctgctggcttcaacacacacagctctgcttttctctgtttctatatgttgaagttctgggttcccttctctgaaaatgctgtaatagacacacctgcaagaaatgggctgttcctataagacccttgaactcacaaggaacatcattcagaagggaggtcactccagctgacatttgccaacctgggatttggtacacaagtacatcctggacatagggagcaagttcgactgggaaaccaaggatagccttcagcaacacctcagctctcaacagagaacacattcactacagacctaaggactgtttaaagcagtccctgtgacagctggtagtccaacgagggcagacaaaagaggtggtgcctataaaagaacagcggtctgcctggggtcattcgggagaaaagctagagctgaatgtagtggaaagaaaatgagattcagaagcagagttctagttccac

SEQ ID NO: 46790 - DNA, 1442 bp, Bovine  19866880499821
ctttgctcggcactggcgtcctggctgtcgtgttgctgcagcaggtgataaggtggtcggtggaaggccaggctcttgtgcttttcctggaggccattccgggggctggggagggccaagccaagtcagtggcggatgactctacctgaagcccctaccattggtacactccccccgcctaccctccaagctcctcacctctctgccaggctgctgcaggtctcgcgagtgatgtctggagctgtaggccagacctgactgtcaggggctgtggcctcctgggtcaaggctgcctccaggagggaaggggtactatgccgatccccatccccagggaccccatccaggctaagctgggggccgagctcgggccctggccggggccgtggagacaacaggtggagcgccgaggccgctgaggccatgctgtctggctccaggccctcaggagcagaggcgccaaagccacgggacagcgcctcagatgcaatctcagggatgtcctgggacaaggcagtggaggctgaggagataacatcgggggagcgggtgcggctgggggaagcctgaggcagccccaggggttccacttcctgcagctccagggcgagtgcagaggcagcagtaggcacctgaggggaccaagataagacttaaatggtgggaggtagggctaaaacaagtatggagatgatgcactggtgtgtgcagtgatgagagatgggacacgggggatggggacgcaagtcataaatggtcacagtcagaagaggagggggaaagagaggctggggggctgctctccagggacactgggggctaagataccctcaggggaaacacgggctatctgaggcagagtaggaccagcacacaggaaactgggagatcgcccccaacctccccaccctcacatgcctgccaccctgcacttcacacacccacacacgcacctgaccagaccctttaggagtcagtttgtcagccggacctgggagcaggctgggcaggagcccacgtgggcttgcctgcaggctgctgctgctcatggtcagaccaccatccagctgtagcttggggctcaaggtcagctcctcaggtggcctggtggcaggaggatgaggtataagtagacaaagcctggtgcctcctggcaccagcccctgcccctctctctgcccctcacttcacctgggcaaggaggggtccacggcccgaagtactgctcatggcagacacggctgtcagagaggagctgctgctgctgctactgctgctgctgctgctgctgctgctgggagatgcagcaatctggggaaacatggagaatgagggctgtggctgtggagagcatccccacgtaccaccttcctcgaagcccactccttccaagcacacctgctgcagggaggcgctaggcgtcatgaaggcgtcaggtgtca

SEQ ID NO: 46791 - DNA, 1964 bp, Bovine  19866880712593
tgatatctatgcactgacaaagtttttgtttcttttttacgtcccatcgcctgcctgaattttttttttttttttttagtatttatttatttggctgtgttgggtcttagttgtgacatgcaggatctttcgttatggggcgctgactctctagttgtggtgcacaggctccagagagctcaggctcagtagttgtgacatgttcatgcttagtcgctctgcagcaggtgggatctcaggttccctcaccaggtatgaaacctgtatcccctgcattgcaaggtggtttcttaaccattggaccaccaggaagtccttgcactggtaagtttttaaaaatgttgcagtgttacatcaagtatgtattgcactcagaatgctgtccagtttgtcactgcagtttgttagtgcaccaagtaacagtgggaaacatctctcacagctccctcagctctaccgttgttctgtgagattaaccacaggctgtacagaagtgaacgagcatggttatattccaataaaactttatttgtggataccagaatttgaatttcatattattttgtgtcattaaacagtattattttgattttcttcttaccatttgaaagccattcttagcttgtagcccatgcagaaacaggtggtaggccaggtttggcctgtgggctgtattctgccagtacctgctttacagtttaaatacattggtaggcaacctgtgttgcctagattactgcatgcttgcctggggccccctggtggctgaagggagcaaataagtcttgagatggtcaaatttctgaagcaccatgaatctgagaattctagagttggaaatctagatgtaggactatttatcatagggagattgtagtggccactcatcatttccagaatgtgggctttggtgacacttagggaaaaagataaaacagcactccccgaaattttgtatgcaaatctcaacagtgctttaagacatcattctgatataaaatgtatctcttcatctgcaatttatttgtgtgaagggtgtgaatttcagcattattctacacaaaatggcactggtacaataattacatttgaatgaacctatatcttccaagggtaactttattctcttttcacccaccctttttttcccactcaaaggcttcaagtttaatatattgataatttttgctactttattaagtacatttctaagtaaaactgggttttaactatgagagtatggtagtaaagaagtcagtgactttgtatagttgggtgctgctatcttgctttgaactagggtaccagcagtttttgtatttttgttttttaaattttagtaaactatacatagcataaaatctaccatcttagccatttataaatatatagtttattagcattaagtatagtcccatttttgttcaactacaggggtgagtttttttaatctgccattttaaactcttgatccaaaaaaatgaaaccctcgtgttctggtcaatcctaggtttactgtagtaactaggaatgaaattatcctcaaatatagtagagatcgtgccattccctttttaaaactttgctggtttatattgtccttagaataatatttaaactctttaccatgatccttctaggttttgcctccttcagttttcccctttcagctgttagctagctctagcatagttgggcctttcatttcttcagagaagccaaggtcttatctgactcactgtttgctggtgctgtcccacggtgttggagctgccctggtgttgaagcttgtatacccatgcctctccaccatcacctcccttttctttgcttgctggttcttgtgctgtcttctcagaaaggccatcccagtactctgtaaaataggttccttccttagactgtttccccctacttagtaagacttaaaatttttgtttttgtcaatctccaacccatccaaa

SEQ ID NO: 46792 - DNA, 4563 bp, Bovine  19866880798015
cgtggcatgaaaccagagatgcctttagattctggtttttatcaccaccagactctcagcagccgtgtgagtccttttcctcccagcccgccccctttcctccccagcgtccacccccccacctcccgctgtgcacagtcaaagcaagaagcctctgggttggccagagaggaagctctcacatgggggatctgagaacctaatttctaatgacttccctcgtcagccgcgtgttcagcagccaggtgaccaggttctcccccagtattgtgattctcctgtccctaatcctaaaacccctcaagtatggggaaggattggaggccctccaggagcagacagtgatagcagtcaggggcgactctctccgcagggcccctctccagctccagaccccagtacaagggcctgtccccttgcccaggccccctgctctgtgcacacggctccctgccttgggcgtgtggcacttggctagccgttctcctggtggtcctgccagtacctgttgtaaagcttttgttattatttggagaagaatgagagatttcaagagctttgtaaagtgaggagattgaattacgtcacaggcgcctgatctacatgtgctcctccttgccacagcactgggagttcacacccgagaattctgtctgggtagatggcgaaggccatgtggggttctcaagggtcagggtggcggagagagggcaggaagtgaggggagcttggaaggactggccaaaggcacgagattatccactgtgggctttgtcaggatgtgagcttctgaagggctgggctggacttagctctctgagaggcctggtacacagtacattgaataagaaacttgtctgtgttcatgttgatgtttaaatacctttttaaaaattaaaattccaaaatattgaacatcagtattattggcctagaaaatgtagcttctgtgtgagtcataaaatctaggtcacagtgggcccttttttcctgtatttatgacatctgctgagtctcccatggtgatggttataaactgtaccaatgacagagctgggctggccatttacatataccgcctcatttgacttactcttctctcctaccctgcatggtaaatgtgactctccttctacagcgtggtaaaccagaacccagagaggttcagaaatgtcccaggtcatgcagcaatcaagtgagagaaccagactttgaaccccagtgtctgggtccaaagcgtggactgccctttctggacagtcagctgtcctgggtccctattgtttcttctgcaaggtgaccagctgagttccccccgagcctgtgtgaatggaatccagattcatcagaagctacaccctgtagtgggccaccagaaattatctgtgtcccagccattccctctctgaaaacactgagaaaacttttcaggggaccaagggaatgaccccagagttactggagatacacatacctggagaaagcataatcttgatctggctgccccaagatacaagtgtccaggcttggagactgctctgccaaccggtaagtgcctatgcagtgggagagtggagcctggatggcactggaggagaagcctgaatgtgaacattgttccaggagagtaagcagcaagagagattccagcccaagactgtgtcctgagcacagtggctaggcctggccctgcctgtccatcgtctctgtttagcaatcagcgcctctccccagccaccaggtctttgtgtaagaagcagccctcttctcatattcagtggctcaagcagaatgaacaggagagggaccacgggaagcaaagggatcaaaaagaaaactttagaggggcgtacaaagcatatatgtatgaccttgtgggtaggcaactgtaagaactctggctcattctgaatgaggtgagaagccagcagagggtttgatgcagcacagagatatgatctgatccatctcaaatttcaacagtttccctggcttctgtgttaagaaaaaactgaggaaaaccagttacgttgccatggcaataatccaggtgaaaaagagtggtgacttggatgaggcaggtggcagtgctggtagtgagaactggtgagatcctggaagtagtttgaaagccaagccaacaggatttattgatgattgaaagtgggatgtgagagtgatttcagtgattttgtcttgaaaaactagagtggcatcgccattgtctgagatggagaaactcaaggacaagattccatccccactcctactcttgaccttcagtgtctttgtgagagatgctaccagctctctatcccatttcctccgttgcttatagaccccgtgtaatccctccagctggtttcctggtatgcactcagggctttaggaatcccagctcctgggcctttcctgcctcagtgcctttgcacatgcagttccctgcctggatgtcctttcccgcttaggggaacatctccctggaacatctgcatccttaaggataaccccttcccttatcctgccatttgtaccagacccttgagcttgttccctcaagaagcccatgacttcttggaggaattgaggaggtagggtttgagtcacaccccaaggacagtgtctgtggaatgagtaatggaataactggatatcttcacccttcccagcttgctgtaccccaaaactatgtgtgtgtctagtccataccacttcttgggcttttaaaattttctattgaagatacgagcgtaagactttcttctacttgaaccacaccaagttgacaggaatgctctaggaattggtgtcttgtggccgttcgtaccctatgagcttctcatgttgtgatgtggaagagtgttcatcctttccttttcctcatgtgggagctgctcaagtcctcttgctctctccagggctttgtctagctttgttttgctcgctgggtgccttccagctgcggtgcactcagaacaggcttgagacagaaaggatgttttctctccctttcccctcctactatagccaagcatcttctggccttttgactacactttggaccagtgttttttgagaacagtctgcagggaatcttagagtcctttctgcaattacaactgagagtgccaagcccatcccctagaatatagattttattttcttaccccaacctgatgatctaataaatgcatgaaccataagataagcatatccacctctccagcccacttgtattaggcagttttccagagaaacagaaccaacaggatgtatattgagagagagagtagagatttattttaaagaattggctcatctggttgtaggagctggtagatccaagatccacagagcaaatgtgaattctagcaagagttgatgctgcagacttgactctgaaggcaatatggaagcagaatttcttcctctatggggaactttagtctttttttttttaatccccccaaggccttcatctgatgagttgaggcccacccacattatggagggcaatctgctctattcaaagtctactgctttaaatgttaattagatctaaagggatcttctcagcaatgtttaggctagtatttgatgggcaccataacctaaccaggttgacacataatattaaccatggtaccacctctctgtacctcccactcctggttttcaccttctgcctctactcatttccctttaagaacttctctttctctaacccataactctttttccaggcacagcccctgggtaccattttcttccaggccaatcaccttcctcttgtcctaggccaccacctagcctcagagccgactttcctgagtcatctgccttccagaaatgggttttcttttcccagtgtgaaccccctggatctttgagatttcctgttgttttcttctcaggtattgggaagaatgtggtttgtgagaaggcggcaacctcagtggatgctttccggatggtgacagcctcacgctactaccctcagctgatgagccttgtggggaacgtgttgcgcttcctgccggcctttgtgcgcatgaagcagctgatagctgagcactacgtgggcgcagtgatgatctgtgacgcccgcgtctactcgggcagcctgctcagcccgaactatggctggatctgtgatgagctcatgggcggcgggggcctgcacaccatgggcacctacattgtggacctgctgacccacctgaccggccagagagccgagaaggtccacgggctgctcaagacctttgtgaggcagaatgcggccatccgtggcatccggcacgtcaccagtgatgacttctgtttcttccagatgctcatgggcgggggtgtgtgcagcacagtaactctcaacttcaacatgccaggcgcctttgtgcacgaagtcatggtggtgggctctgcgggacgcctggttgcccggggtgcggacctctatgggcagaaaaactctgccccgcaggaggagctgctgctgagggactcactggctgtgggtgcggggctgcctgagcagggcgcccaggacgtcccgctgctcta

SEQ ID NO: 46793 - DNA, 2866 bp, Bovine  19866880845549
cactctccaacctcagagccacacaaagcaagatagaaaatattggccagtcaatcacaggcctaagagtccatcccaatgggaaaaaaaaaacatcactatgaatttttagaacactggttatttacaaaggaatgggaagaaaaatactaccagatacagataggtaataacctaatatgaaggtgaacccaattccagagtgttcttagtacaatacttacggtatctttccttcaaagatagaaaagtgtaccaaaatcagaaatctaatgtcccttaattaaacgagcctgtgtgactggtcacaaagttcacttacaaaggaaaaaggatcagaatgacagtggacttctagaacccactggtgcaaattttccaagattctgaaggaggataaactcaccctacacagaccctttaatgttaaactttatttatgtacctaaaattcatttgttttatacatacaaacattctacctacatagataggtatatatggaatatatatatatctatgggatatatatatatatcaaatggaaaactgctaaaataaagtaaatgataattaataaaaattaagcaatcatttgaagacaattattagctccaggtaaaaatatccaaaagggaaatgtaagatgatatagtgcttagaaattatttaaaataattaggaagacaaggagaaatgtgggggttggtcaaatacaaattagagaagattgatgactattaaagctgaatgaaaagtgcaaagatgaaaacttaaaattctaacaattatatagtaaacaatgatttccaatgtcattaaaaataaactaaataactatctcaagaaatataagtatgcacatattatttagaaatatgaacacaaattccaggaaagctacaggaaacagaagtattggggagagggaaagagaactttctcttaattaggaaaaaaaaaagtttagaagatatacaatgggatattactcagccataaaaaggaatgaacaatgccatttgcagcaacatggatggatctagagactgtcatacttaagtgaagctaattcatagaaagacaaatatcatacaatagcagtcagtgtgaaatctaaaaaagggaacaaatgaactcacctacaaaacagaaactgagttacagatgtagaaaataaacttatggtaccagggggtcaggcaggggggaggataaattgggagattgggactgacatacacacactatcatacgtaaaataaataactaataaggacctactgtacagcacaggggagaaggcaatggcaccccactccagtactgttgcctggaaaatcccatggatggagaagcctggtaggctgcagtccatggggtcgcacagagtcggacacgactgaagcgacttggcagcagcagcaagtgaagacagacctgttaaaaatactgagttccccatcagtggaaaggttcacacatggacatgtgtgatgtggtggggtggaaatgactgaccctttccaaatgatagtttatctctataatctcaatggagaaaactgccctgctttgcaacagaagatcaagaacatggatggtatcaagaactgtaagggaggaagtcaagttctgactcttacccggcgtgtaaatgttttcccacacttagaacagacaaaggccgcagggacaaagttggggtcatgatagcgtttgaagtgcatgtcaaggagctgtttctgacggaaggtcttgtcgcagtggctgcaggcataaggcttctccccagtgtgggtgcgcttgtgcatgatcatgtgcctctcctgcaagagaacgaggtgaaggaaagtctcagatcctgtcttagggctgctatcccccaccacctgcatgcgtaactctaaagacctttctcttccaagggtccaggcccagaaccgcttgctgagaggataacgtaaacctgatcggggtacaaaactgcttccccaaatcctagcaggtacactcacttctgctgcttctgtagatcactcccaagcatcaggccccagtaccaaattcttcccttctctcaagtcctggacttaatttcatataaggtatatataaaaaccctctgataaaacccaacactgatgagacatcaattgttttctaactatgaaggttcctacctgtctacaagcgtaatcacactgatcacacttaaagcgcttctcgttcttgtgtgacttctggtgctggatgagggcatagcgctcatgaaacacagcatcacagtaccggcatttcttgccctgctcaatgtaggaatgctgctttcgcaagtggacaccttaaagcaaaacacaaagcccaggccaacttgtgaaaacacaaacatctcaaagagttaagaacacatttctttctgcttctgaatatagttactctggctgctatatagaaaatggaaaaaaaggagtaaaaacagacatggagaccagttgagacgttaaaactcaacaggtgagggaaggtggtagtttggagatggcagtgggtatggagggaaggggacctgatgagagacctaagaagctgaatcaacaggacttagtgactgaccagagtgaggaagagaaaggtgggtatcaggaatgacctccaggttcctggcttggaaaactgagcagatggtggagccacttactgagacaaggagtaagtggaacagggctgaagcctgagctgtgtgtctgcaagggggcaaggacatttagagttgaggggaaagattaaggagaacttgaaaatgaaggtaaagaggcaatacttgatcatgtaaatgttgccaggacacaggagaatgggatca

SEQ ID NO: 46794 - DNA, 1374 bp, Bovine  19866880954043
cctcttcccacagtccagactattctgggttctggtgtccctcccttccctcactgcacttgaggtggtaccagtaccagcaacaactggcccctgccagtcccccagtgcgccaccatcccttgcaggtttcccttacccctgtcaccaccgtaaataacccctcccttaaaggcatttcaataactctctgaacgtgctggctgtttcctgcctggaccctaacttataacagtgagcaatgagaaccactgaatttttttttaacttgaggtaagtggaatagagttcaggagacagacaccgagaaccagttaagataaaaataagagataaggagggtctgatggagggaatgaaatggagcagaaagctatcagtaggacttggggttatgaggggagaggaaaaagccaaaaatggcatcaaattatagaccaacacccctcatgaacacaggatcaaaatccttaataagctattagcatcatcaatatatgatgaccaagagaacgtaagcctggttcaatattctaaaatcaattagtatacttcaacatatcaagccattagattagttattaaactgcattaattaggaatgcaaattaaaacttatcacaactacacacctattggaatgggtgaaattcagaaaatctgatatcaactactgatgaggatataaagttcatgaaaatgagaaatggtatcacctcatccatcttctttcatctccctctgctccacaatgcctcaaagtttattgacaggatatggggctacagcaatggttacctgctagttttctccactccttgcgatgtcattcaaatggaccagaggtaaacactcacggagacagaggcagtctcccttccccgtgcctgctcttccagcgaggtatttggtgagaggagaattataacagaagaactgagtagtgttgttttctgtcatgttatcctttattccgaaacaactcgcaatatatccttaagcatgcttttgactgactgtagttttttttcaagggtcattacttgttctgggattgtgtcttcctgatgccattagaattatcaagccattgagaagcttacatatggtggagcctgggtggttccatccaagctatatggaaacctatctattatagttttccttgtaactacatatttttaaattacaaattgtgctttctctttttcagtgccaggtttcaaaaagagccattagagatttctagatagttactgccttgtaatagtatatttacactgcaagccacacaaatgcagtcaactgattttcagcctaggtattatatcaattcatggggaaagaaaactctttttaataaatggtgtaaca

SEQ ID NO: 46795 - DNA, 748 bp, Bovine  19866881026023
gagggacactcaaccctgtcctgggctcaggccccagagccgggtgatacgagctggcgggcctcctggcaggcgtctggggggaggaccccgtgaagctaacagtggctctgaagatggcccggcaagacctgacccgcacacagatggaactcaacaccatgaaggccaactttggagatgtggtgcccaggagggactttgaaatgcaggagaaaaccctcaaggaactgcaggagcaggtgctggtgggcagacagggtagggcagggccacacaggtgggtagcaaggaccaatcaccctgcccacagctggagagcctgagagacgactacgaagaggtccgcaaggagcacgagatgctgctgcagttgcacatgagcacactgaaggagcgggaccagttctactctgagctgcaggagatccagcgcacctccacgccacggccggactggtccaagtgtgaaggtaacgctggccctcgggccctagggactgcacaagtgtgtggtctggactccagctccctctctgcaacccctgcagatatggtggctggaggacgagatcgctggcacatgctggctgagggcaagaacagtgaccagctggtggacgtgcttctggaggagattggcgaggggctgctccgggagaaagacttcttccctggtctggtagggtagtccctgggctcggggaatagccaggcctcactgctgagaaaacttcaggttactggg

SEQ ID NO: 46796 - DNA, 902 bp, Bovine  19866881028804
aaacaggcaaagagcagtttccaagtggccatagcatggcctgaagggaagttgcgaccttaccaggcctccttccttcctctcacgaccgccctgcatctgttccctttctagggtttaatccagccattagtggacatgtagggccccagcctggggcttttcctgtcatccctgtatccatgtacagatacctgtccttcggacatgggctggctttagtcactgttgaggatggggggctggggagggtaatgttcctgagtacctgtgaagtgccaggcacggtctgggctgccgtactctatcatctcactcactgttcctggccccacagcagggtgcgtgttgtgctctccagtctctgaagctgtcatagctgaagggcttggccaaagccacatacttaataagcagcagatccaggagttgcctgtttctgacaatgctggtacgaggctggggctaccttcaccaaccccctatctccgccggctgttgcttttcagtggaggatctcacgaccacatccaagggtatttggatatagaggacttccgacgagccacggcagcctcttcagtgatggtggcccgggcggccatgtggaacccgtccatcttcctcaaggagggtccacggcccttggaagaggtcatgcagaagtacatcagatatgtacgtctacacactttttcacaacaaacttttctgtctgtctgcccgctttctgcagaaagtgctttgggtgagcctccggtccccggaagcccatgtggttcctctctttttctttgttgtgttgcgaggcattgggttttcctggctgcagtgtgaagagtgggctgctggtggggagggggtcatggccctaccgtcaccctcttctaaagcctccaagg

SEQ ID NO: 46797 - DNA, 612 bp, Bovine  19866881053330
ggggcaaggaacttctaggccctgggagtgagacccccgacagcaacatccagggcacccctcgatgccccccttccctgccagccctgtcagctgctgggcctcacccaagggttgagcgagggaagaccttccttatggcagcagcgatgtgctgggccagctgttccagggcagccacaccagtaaactccaggaccagttcaggcagggactccagctcaaaggtgacctgggggtgggggtggggtgagggatgggttccagggtgagggatgggctccatgtggaggcgggggtggggaacagaaggacaagaccagactgcaggccccggtggggtactaggggtctcacctgagggggtgtctcctgcagcaccatggcctggacctccaggtagctgaatgtgcagtccacctatggagtgcctgggtgagcttggaccaaagcccaagacccaaagcgcaagacccaccctcttgggagcccagtcctttgtgcagcctggatctcagagccagacctgtctagactccagtcctgcctgatgttggcagcccagtgctgttgggagggcagagtccacaaggacaagaggacaacgtcaca

SEQ ID NO: 46798 - DNA, 1963 bp, Bovine  19866881069542
accttgattctaaaggtaattagtagtttatcagagaagtaatttttgtggggaaaatttatctaaggtttgcgattagaattctaagaaactgaaaggtcatgtattcggctaacgtgttcgtttgccttttggggtgacctataaagatatagaagagcacagtagccaggttttgcccatgttgttttatttaatttttacaacagccagtgaagtgggtaccattattatctttgttttgtaggaaggaaaataaggcacagaagggtagcatgtttgactccaggtcacactcctagtaggtggaagaaccagaaatgggattcaggtctctggcaggaaagcctagctcttaatgactattccattctatttctctccccgccccccccttttttagtatggaacaagcattttcctcatatgaggattatattaaaacatgatttttaatatctgtgtgatactgttttatggatgtgtcatcatttaccaaattaaactttcccctgttgtaattttaggttgtttataattattcactctgattaacaatgtccttataatctctgattatttctgagcataaaatctgaagctaaattattggatcacaatttgaatattaaaaattcttgactcatatcaccagttaccttgctgatttttttttttttctagtttacttagaatattatattagtttcaggtgtgcagcatagtgattcgatatttttttagattgcacaccatacaaagttaatattttttgttctttgtaacatttattttataactggtggtttgtacctcttagtcttgttcacctgtgtcatccacccccagctcacctcctctctggcaaccactagattgttcgctgtatctgagttaccttgctgttttcactgggttgagagttatcctttaaaatagtcttaagaaaaaaaaaataaattaaaaataaaatagtcttaaggtttaatagaggtacagtgctgtcacattgttttaatttgtattcttcttaatgtttagacttagttgtttttttgttttttttattcatctaccatttgtatttctttgagtgatctacttgtgtccttttcccagccttcttttttggtatttgcctttttcttacaaaatttataactactaatataataagggtattattattaatcttttgtcatatatgctgtagatatgttctttttggtcattttattcaacatatttttgtttttacagttttgggggtgttttttaagcttcaaggtggtcaaaatttcagcagtttcctctatgctctcctattatttaggaatcttaaacataaagccttcctcattctgagatcagaagaccatttacctgtatctttttcaactttggttttcagatttggcttgtgggatcccagatccccagccagggatcaaacctgaggccttggcagtgagagcatggagtcctaaccactggaccaccagggaattcccatttcttttttgtttctgttaatgtctccttatctcttagaacagaatatattccaggtggatcaaaggtgtaacttattgtaacttaaatactctactcatttatagtttttctggcaccttttatcaaaataatcctctttccttcctgatttaatttttaagtatttatttggctctgctaggtcctagttgtggtactcaggatcttttttgtggtgaaactcttcagtgtggcacatggaatctagtgccacacagtttcctgaccagggatggaacctgggcccctgctttgggagttctgattcttaacctctggaccacaagggaagtcctccccaagtaattttaaactgacagctttatatatgctacgagttgtttctggattctctattctgtttatattggctggctgtgatagtgacagtactacactatattactta

SEQ ID NO: 46799 - DNA, 1020 bp, Bovine  19866881095812
cccaggaaatgcatcaaaacacagcatattctgtttgtgacactttattgatgctgaggggtggggaggaaacctagaagtgtatgtggcgccaagcaaccccaggtgggacagggcaggtgttgagtcctggcccctactgggaggggaagacagagttgccactgaaggcacaagggatgagcagctgccggtactccaggggcaggtgccgctccacgagcacatgcagggagacttggtcagtgaccaggccctgcctgcagcagaggacagagaatgagagaatcagtgccagcattcccatacccagcacctccctgtttccatccgcttaccttcgcaacagcagctccaggtcctctggcctcacggtcttgcgcccagcatgagcagcaaatacctccaagtcgttacaaagatgctggaagtacttgtccaggctgccaggaaggttggggtaggaaagactgttcatgatctgaggggctcctctccccagcctacaaatgtcaaggactcaccacttctccaccatctcctcagccttcttctccatgggcatcttagcatagaagctaaagagttttgcgtagtggttcagtccagccttgttgggatcttgacggggtctggagccagggattcggggcctgggaggaatcctggccgagagatgctttgggagttctgaaggtaacctggagacaagaagtgaacagagttaagctaaatgctcccttaagaggcccctaatcaaagataaatcttgctggctcctgccaagattggggtccttgtgctccttggccagcctgggcctacagttccaaccaattctggtgggcaatgggagatgtggggctatgtagaagcctggtctttccctggggccctgatgcttcataaactggacacaatgtccctgtctcacctcatcatacaaaccactacttgctcaggcccatgatcctcaggctttagcatagacactcccccagctattgctgcctgtcccat

SEQ ID NO: 46800 - DNA, 1729 bp, Bovine  19866881106926
cttttgcagcccccaactagaaggatcatacccactcaccagggtgcagaatgtcccccatactgcagacacagtcacgatctggctgaaagggaggaagaggaggtgggggggatagtgggaggagctggcccagcctggagggacctggcaggactcagccaatgtgagggagccagttccctatagtcccctgtgagaggccaaggcggagcctgaggctgggcttcgctctgcctacctgctggtccaggctgatcttagggatccagcccaacccagcctctggggagagagagcctccaagggctatcagaggagcaggggtggctgctggcttctgctctgtccactggtaccaggctggggcaggtgccagcaggggttgaggtgtgtacaccctcacaagctgtcaagcctgtttaaatttccatgatgtctagcagcccatgccactgcgctgtgccatctccacacacagcaatcaagtgacacacctacagccatcacccacatgaagcgtggatcacctcagtcaggcccccatcagagacagatccaagtcagatcaagataacatcacctgacacatgccaccaacatgcatgtcccctgcagatctccatcacggtcagtaacagaccaagcatttgtcatcagtcacatcaccatcctcatcaccgtagcccacaagaatgtgctatcatgaccccactctggctctgcgataccccacagctgtacacttgcacaagcacaactacacatgcatgtgctgctgcacacacagacaaaagttcttggaatgttcacacaagagtgagccctgcaagaacagggccctgggggcctcctggggaaagagatggtgaaagtcaagagcaggcacctaggagggggaagccgggtttaccttcaggcccagtttaacagctaagagggctctggagtctcccaccctcgatctgaatcccctagagcaagttacataactactccatgcctcacttcactcattcctaatagagagtaacactacctatcccagggcgggaaattagggggattaaacgagttaattcaggtaaagtgcctagacaagcctggtcccgtgtgagtgctccacacgggtggagtgtccactgtacctacagatgtaagctgggatccatgtagcactcaggcagtggcccacagaccccttcaggcttccctccgaggggactggagtgctgggctgcacacaggaggaaggagaaggggaggggagcggaggagacagagtggttttagggaaagagatgctgaagcacaaaagtgtaggcgagacgagaagaggttaggggcggttggcaggaggtgagagggcgggggtcccgcctggatgtcgctcccaggcgggaagagccagagatggaggttcagcgctcttggcgccccaggcggccccgctggcctggccacgtctgcagcccccgcccgcggccctcaagggaggagctggggtgaggagggaggcccgaccgcgacagcaggcgccgggggcccaggaaaattgtgtctgagcgcgaggagttggggactgtttagcggcgaaggagtcttaagaaaagttgggccctcatcgacgtgtgtgcgcacggcccggcgtctgtgcgccagccggtcccgcatggcccgctctccgccccggcccgggaccccaccgggccgcccctcaccgtccgcg

SEQ ID NO: 46801 - DNA, 1807 bp, Bovine  19866881151860
cccagtgtgctgtccccagtccctgccagctgactatctgctgtcttctcgtggttcaaaaatagaagtcatattaaaaaataaattgaatagttttctctccttctaagcagggagagttcttactcttcatccttttgaacctttaagatttttaatatgttgcctattcaaaaaagcaaattaagaagttaaatagaaaggaaagaaggaagggagggaaggagagaggaaggaaagaaatgccagttagaaaagccattgctggagatggagcagagagaccagagtttagattatgcgattccataaggaagggctggattgcgcgtgaggtgagggacagcggagccaggtgagtggccagagcttcctcaaggcctctaaggttgtgtctgaggtagtccagggctagaagccctgctcttcctgttctcctctgaaatgcagactcagtctgtactggttcagtgttctctctggttctaatgtgtatttctgaaacatgacattaaactgtaataagtaaatttaaacctcctgagcacattccgtgagcattcattagtttgtagtttatatactgacaacatatatttattggatttgtctttcttcccttcacctcattctgaatgggttcagatttttaacattccctcctcttccgattgttagagtaattcataccattgtccagaacttggataatatagaaaaggacaaaaaaaaaaaaaaaaaaaaacccagaacacaaaaagcaaaaacaggaaaatcatcagtaatctcaccatcaagagacaacggctgttattcatgttgacatttaagtggctctggggattgttggtttccattagttggggattttgttagagtttgacattgggctgagtgctcaggactgggaggccgttgttgctggcaggggagcagggcctggacattattgcagatcgtgtgcctctgtgtggctttgctggcagtggtggcgagtgacggtaggacaggaagaaggtggattcgatctcatttcaaaggaagaccaatccatttattttttttaagaggcttggcagcttgtggggtttagtttgttaaggcactgaaacccttggtaggaaatgggcagtgctgaaaaatgatttttttagaacctgtttccaggtagacctgcgggtcttgctaaggggatcagagtgacggcttttagaattcgtcaaactgatccctggtgttgtgggcacggatgctgctgctttcttgcttgcccaggagaaatgctgatcaccagtggaccttggtttctgggaggcaggtgctgaggtgctgccaggttgccatcccacagggaggagcagccctccttcagctgtaagagcctcctgtatgtgcttttccttagggaggaatgggagctgcccttctgtcagatcctgacaaaatcgagaaggtaagtcttgcccttaagaggtctcttcagcgtgcctgtgagctagagctgttgggagcaccttccctcccctcccctgagattgagagaatcactcactccaccagggtctggtttttaaaagacttcccggtgattttgacatgcagccagattcaggaactcctgagccatcctgcagcagcctttggtgttcctgaaaagcccagggctagggacgtgtcagccgagagccaagggccctaagaactcatttagaactacctctatatgcctctcttccttctgagaagatcatgagagcacaggtcaggctacctgtgggttgtggacatgctcagtggccacatgtgt

SEQ ID NO: 46802 - DNA, 1853 bp, Bovine  19866881420698
caggctggagtgtatgtggacagttgtgggtgtccacccttaggggaggggcctcaatagggggtggttttcttcacaacatgtatatacaggcatttccgttatcctctggcctcctggcttctcccacctatgctgttagctctgtcttcaccactgcccttctttgggcacgttgcacacaagaggcagcagaattcgcagctcacctcagaagctcacttcatttctgtcttaactatttttaagtggcacctgggccagcaggccctgtcttgcctgtaatctgtcctaacagcctagcctcttggtccagtgtcttctggagggctctgccttagcctgtccctgagagaggcctccttcgctggttcttgtaacccggctgtctgctgccccctcctgtctagaaccagactggcaatggctgcctgaatgtctcctctgctcttctggacagggatctagtttcttggaagagggctcttgggatcaccttccctctagctttcctggcccaaaatttttgatgagggaagaagataaagatagcaaggtcacagacacacagtgtcatctacccctttcttggtctctgactcttgatctggtgttgttacttccctgacactttcctatgtgactttcttgatctgtctttggagtcctttgcaattaatgtgcaaaataaacccttttaagtaggatgacaatgttgtcttttcctttcccagtttctctgctgtatatctgactccccaaaagggaggacagggcccaggacctgttcaagctctcctgttcctacacttggcagaccctggcacagcactcagggaacatgccttcagacaggaatggagctgtgagccatgtgttctcaaccagtgttaggcctcagaatcattttgaggagagaccatgttggacagagtcttttgaaaacatatattcctaagccctgctcctgaacccggcctttcaggaaagatgaggtggaatctatggtgctgcatttcttaggctctccagctgattctgatgcttgtcctggcaaaggatgacactgtgtcctgcacaggcatgtatgtagacccaaccatacattcattccctcacttattcatttaccaaatacacgtatactgctatgaaccaggtaagggactgctggggctggggctctagtggagaaaaaaggtgagctcctttcttcacggagcttccatgtaggtggtgtgcaacagatgcattcacatggacccatacatggacataaatgcatctttgccagtgggccacacgggtctggagtgaaattcatcggtacaagcagctgtggtgattattctggaagaggcagatgttcttgtgttctcccctaccatagatcctcagcactcttgtgaaagggacgcgcagacctgtgacctgcaagattcgcatcctgccatcggtaaggatggtgtgttacacctgaaggtccattttctctgcagatgttggtcggggggtgtgaatgattcctgaggggacgagtcaggtttggaggagtggggagatctgagcccactttgggagctggcagctgctccctgtgtggctgcagtaaccaccctgtgtggccccatccctcagctggaagacaccctgagccttgtgaaacggatagagaggaccggcattgccgccatcgcggttcacgggaggtgagttgtccccttgctagtgaccgacttgcagggaggtcctcagccattttgatgcttcttcaccagaccccaggcacctaccagcttctcttctatgtacccagcctagctctttgcttagctctttgacccccgctgaat

SEQ ID NO: 46803 - DNA, 2041 bp, Bovine  19866880412900
aaatcccagggctgatctccttcagaatggactggttggatctccttgcagtccaagggactctcaggagtcttctccaacaccatagttcaaaagcatcaattcttcggcactcagctttcttcacaatccaactctcacacccatacatgaccactggaaaaaccatagccttgactagacggacctttgttggcaaagtaatgtctctgcttttgaatatggtatctaggttggtcataactttgcttccaaggagtaagcatcttttaatttcatggctgcagtcaccatctgcagtgattttggagcccaaaataataaaatctgacactgtttccagtgtttcccaatccatttcccatgaagtgatgggaccagatgccatgatcttagttttctgaatgttgagtttcaagccaacttgaaactcaaagagtagaggggattaaataggaaatagggagcaactggtatattttacccaacacccctgaaattgtgaataagaacacttctaatactcttcactcattcattcactcatccattcatccaacaaaaattgacgtaatagttataccccaggcaccctgttgacctcctaccaattggaaatatgtctgtggagatggtaagtccctccctcaagccagtttagctgagactgactactacacagataattgcaaccagatgttcacaggactggggtgaggacaaccgggagagaaacaaggtcaaagagaaggaatatttaatcccacctaaggaaggagtttgaggaacaaactttcccaagtgtcataaaagatgagcagaaaacattgagagacagggccagcaagggagaaaggagactgtaagagtccaggtctgaatgaacagcatgtgccagggcccagaagtgacacatcgtggcgactttgatgaagctcacattctgcatgtcagcccagatgagctagctgatactgcgacagtgtctgcatccaggggctcaccaagaagtgctttctttcttcttgtgagagtgtgcagtgggggctggttgggggccctgccgagattcaggctagcaaagagtttccttctggaacattggcagagcctggacagagggagagatggcatggatggggactgcctcttagagcttctgtctgaaagggacacacctgcctgtgctcaggtttcgttgcaaggctgcacctaagtccagcagaggagacaagcacagtcttcatgcatggctgaaaggaactggaggtatttgttgatgacagtaatgaccaccacagtcagtgtggcaagaagggagggggacaaagatgaggcggtagcagaggagaaataaataccggccaggtcaggaaggcccatgaccgttcattctaaattttttactgtatccaggaagaactattgcagtatatcaagtctgggaatgacacaaggaaatgttcattttagaagcattaagttggagatagcaggactggtgttcattcacttataccacaaccatcctaattggtgaaacagagcagaataaatccgccttgcatttggtgaaggcaagagatagtcaatcaacaggcttaacatgaatttataacatttcagaagcgctaagtaggaaggaaagtgagaatgggataatggcttggagctagtagcttaaaggtgagagaagggggtcattagtcagcattagaaggtacgggcagcagaactgggtcctctcttagtaagagggcaaatgagataagatacatggaaatatctaaggcaagaggcttctataaacccactgaatctgaatttagagttggaatagctcttttgaagcattcagtccccatggacacagatgtgacaccaacccttttcaggagagtggataacagacaagccactcagctggtttattaagagggaaatgttcacaagggcttaaataaagattcaagtcaatgggagctgcctttttaattgataacaggactgggaggtaaaggaaatgtgagatgctcgctgc

SEQ ID NO: 46804 - DNA, 1051 bp, Bovine  19866880620920
tgctccttttttgtttgtgaaaagttgggtctttgtttcttgtctaaacagtgtgggcgataatattttgtcttaataattagcaagtttattatgatgatcaattaagagcactttgtaaactgtcaagtgttttgaaacgtgttttctctataacgatgaggcggagaataaatacaaagtgtagctaattcgtggaaatctctgtactaaagttagaattcttaagacgaattctagcccaaaatatgttaatttggctcctcccgtgtattgcattttacgaatgtgaccacagtatttactatctcatgtagccttcttcagtgtgaccttgatactcctttcatggttgtggggactttatcgtatcttcttgggtctaagtggactagggactcacttgtgcacagtaaaatgcagagatgacttctgaaccaaggttgtaaaaggccaagcagctttcactttgttccccgggaatcttacttttgttgtccttccacactgcagccaccatgctgtttggaagcccaaactagcccacacagagagaccacatggagaaaccctgagaccacatggagaaagcaagaaagtggtcctaggccagccagtgcccacccccaccaccccagctacatccatcctccagctgcaccccagaccccaagccagaaccctagaaccaatccagctgagccctttctggatttctgagccacaggaaccccaggaagtaattacaagccttgttatcatcttgagcctttgttatcatccaagctgtaggatagtttgttacacaaaagataattgaaacatcccatgtaaatctgataatggaaccaatggtctgattatcaatgatgtgttgaaaagactgttgttgcagttaatcaaatgtgcaatcccttccagccccacacacccccacgtacagccctttggctacttacttatccttttaatttcaaatgcaccttctagtaacactctagaggtgattcccttttatgctaataagcaagttctagcttcccagccctac

SEQ ID NO: 46805 - DNA, 1031 bp, Bovine  19866880873916
acaacagaagtctactgaactttgtttaagagggtaggcctctctatctggctcctgtttctttctctagggccagaaagagaagagatggagaaacgggttggaatagcctcagagttaaaagctgctgaactgtcttgtgggtttccttccattgttcagaacaaagaacctctttactctgctaattttcattttctgctcctcattttcctctctgaggctgggaatgatttaaattattttgtaaaaccagaggaatgggactctgaatggtggaaactgatctcagtgagtaacttccattaaaaaggctcagctgacctatgtctgctgaagcacctatttctaaatttaattaatgtttcacccttgtgtatttttatacccaataaaacacttgggggtggtaggaaggggacaattccttgaaaaacttgaagttgcatttttgcagccttagtcacggatatttatgaacgatccaatgcctgggctaatttacaggaaccgtgtctctcctacctcaatgtttgcccagggacctacatcagagtagaccaggaaccctgaattacacctctatacctctagactcaactttcctccctgtcatccttttgacaaatgttgagatacttatgatagcttctaactgtgaagtttcactcattcagtttcactcagccaagtgatgaaagcacccattcttaattctagggtaaaaggtaaaaaaaaaaaagacagggagaggaaaaacatgattatctttatctccaacaaaaatgtgtggggagaaattaaagctaagtgtgaaactctttgatacctttgtgggatgttaatgcacgttggagaaggctatcggtctagagtcctggctcccttattatttctgtggcctggtgataaagccacctccttaatggcagagaagtgtgcacagactgaggtcaagtgtgaaaacagcaggatctgattttcttggccagaaactcatcttagggaaaatttagaaagcctttctgagg

SEQ ID NO: 46806 - DNA, 1015 bp, Bovine  19866881010183
gatatttttagttttggagagcccctcgtcttagaacacattagatctacaaaccttttctgagtgctgcaaaacattccctagtgtggggatgccatcattttagcaattcccctgttgttggacgtttaggtcgtttcccagcttttctcagactcgccctaacatccccacaaaaacacctgtcaacacccaagtcgtcgcgcctgtgcacagaggtgcatcaagtcttgtctgttcccggttccctttaatcagaagtaactgggatgcctttccctttgagggccctcccccgcccctcccttacacctacgcacccttgggccctgtaccagggacctctcccgagcccctggttagacgaggctgttctcttccgtattcacatcaccctctcctcagtgcaccgccagtgcgttaatattttcatatgctctctctgttgcttatcgctgacctgccagaccccagggaatgtgactttttgcacctctatttccccagcacccggcccagggtcccctcccccacgtggtaggcattcgataagagcttttagaatgaaggccattgtcacagagccacatccacaatgggatgaaaacccatggaaataaacagtatatcagcagaaggaaaaattaagctgtcaatctgctgaacagcaaacatttcttttctatattccaggtcttttaacgtgatggaggagagagggagggggtaagggaagctaaaacctaagggagccagggaaaggctttgcttttcataatctggaaagtgattgacacatcactctacagccatcgccccggtgggggacgggcttggcccatcactgtcccccgggtgaccatcacatgctctctgtctcgcccccgcagggaccacggtgatgcggatgacagcctttgatgcggatgacccagccacggataatgccctcctgcggtacaatatccgtcagcagacgcctgacaagccgtctcccaacatgttctacatcgat

SEQ ID NO: 46807 - DNA, 1307 bp, Bovine  19866881306010
cctgtctttcctacagctgcctggcgagtcacacttgacaaagccaccgaagtgtcctagttctcatccctgtgattccctcttctttttaaaacaccaattcccgggaggcagagatcacaggccaagttctaacagtgcttcctcttcaaaggagttcttgaacagaatcttggtttgtatagatacaatcaaatgcccatgacattggatcgagccctaacttgtgactggaaatctgccccattctctgtccgtatcgtcctcctgccccctgctgcagggatgacctactgactcacacactgttagaaagtcagacattcttttttctttaaggaaaatggaaactcagatggctatatctttttttgatttggggaaaaaaaccccaatgcttgctacggctgttataatcttccaggatgtctgtacttatttttggctttaactttcagtgggtaacagttactgcatacttccaatatgccaggctaaatgcctttcataaaaaatttaaaacatcctcccaataatcctgtgaagctagagctagcacagccttccattttcaagacgtggaaagtacagcccagaaaggtgagctaactcactgaagaccacactggctgatcagtggtaaaaccgtagtatttgaaccttggctcctgccacagagcccgttttcctagctgctatgctcagctgcatgattaaatgaaaacaaaaaaaaaaactgtctggcagagctcacaaaaggcttcatcaggagaggtacatttttcctgggctttgaaggatgtgcagaagttttccaagtcaaggggttgagaaggatgctaggggaggggaggggaaagttattatttctctttctctctgtggatgactagaactattttacggtgagacagattttttatttcagtgacacctcagggtccccatcaaggcagagagggatttgcccaaattgaagagagaatcctgactgcttacatgctcggggaaataggatatgtgcagagtccaaaatcccatctctgtggcctgtctgcttcagatgaaacgtctctggtgttgggtttaaatcactggctgctactttagaatttctctggctgctgcagaaatatttaaagtgtatttgtcttgcctgctcaagtgttggtttgctgcagcctctctgccttaattctgtaaagctggagactttctccatttccttttctaaacagtcctgtggtgtcaatgagaaggatgagttgtaaatgcaagagagcaagggcagtggaccagaaaggcgg

SEQ ID NO: 46808 - DNA, 1658 bp, Bovine  19866880244468
tctttgcaaccccacgaattgcagctcaccaggcctccctgtccatcaccatctcccagagttcactcaaactcacatccatcgagtcggtgatgccatccaaccatctcatcctctgtcatccccttctcctcctgtccccaatccctcccagcatcagagtcttttccaatgagtcaactcttcacatgaggtggccaaagtactggagtttcagctttagcatcagtccttccaaagaacacctaggactgatctcctttagaatggactggttggatctccttgcagtccaagagactctcaagagtcttctccaacaccacagttcaaaagcatcaattcttcagcgctcagctttcttcacagtccaactctagcatccatacatgaccactggaaaaaccatagccttgactagacggacctttgttggcaaagtaatgtctctgcttttcaatatgctatctaggttggtcattaggaagactaaataatagtatctaagtatctgatcaggttttggcacagagtttgcaatcaatgaaaatcattttgtactgcttactcccaggtagagctagcagtaaagaacctgcctgccaaagcaggagatgaaagaaattcaggtttcatccctgggtcaggaagatcccctggaggaggaaatggcaacccactccagtgttcttgcctggagaactcaaaggacagaagagtctggcagactacagcccatgcggttgcaaagagtcggacacaattgaacacacagacacacagacacacacacactaactcccaggacagatgaatctacttacaaattttccataagtgtagtgttagaaacttgcttacaagaagttctcctaatcctacaggaagtctggcctgttggcctatttgccctttgctgatgttctgatcctgaccccaagacgatttcctagtacagacacacgctgatctttcctgggtttctggataaatctttatttctcttttcttcagtcttttctgatctcaagacctttactaccacagataactcaggacagattctgagttctgctttctaaaaggaagccaaatgattttccctttaccttgaaattatgctgattcaagaaaatggaccatatgctgagctctctgatatcaattccatcgagcagaggtcagggttgtacccacccatggctcgtgtagttgccaaaagtattattcaccttactttgggttccaaaagggattcaaaggaataatgaaaggagcttgaacaagttggaactcctcatgttaagcaatgtttgagcgtgccatttcttaacagctaagtgaatatcttcttgcccagaaaaaatacttctcactgatccaaaataccaatgtagattcagctttctcattatcataatcagagtaaattggtacaagtttaaacgaggtacaaagcacatgagtttaccaaccatatttttacctttgcataataaatctaaattactggggaatgggggttttatttataaaccatgctatttcttaagagtgttaaaagcttatgaaactcagggaaaatttaagctgaaattgtcaataccccgactaagaccttgactagtgatcaagtcagtgacagggcatggggtcag

SEQ ID NO: 46809 - DNA, 1633 bp, Bovine  19866880404292
cctgagagcagtggttcagagcccctcccaagcccgggactagctctggaacaggggccacgctgggaagagctcctcgggcactggtgttggcgctgcccttccagctggtgtggggactggtagctgcctacccctcgaagctcctgccaccactctgctttttagggcagttgatcgggctccttcattaactacagcaggccgtttccattgcaaataaaaaactgccttcctaaatgcctttcatcctgaggtcaaaggctctgccattgttctgtccaggcacctaaccctgctctgtgctccggctggagctccacaagtgccccccctctccctgaacctccgctcccttggaacccactcagcgacagcttggcgggaagtccctggaaattgaaacagcatctactgcctagatgttcaaatgttgctaactaagatacagtactatacagtatctaaataatagttaataattattgacataaattattcttttatattatacattatattttatatattatatatataatatatatgttaagttaattaacattaacttaatactgaaataatatctaacaaggtcacactcttacctgaaacaggataatagttataacttctgtcataactgttagaagtaatgacactaaagcaaagatgagtagagtctatcatagtcacggagagtttttacagaaatgacttagaagatttttgcatttgcagattacacacacactgtgtgtgtatctaagagatactcaaagatctatatatctttttaaaatttttactgattctttaaaaaaacagcatgtgggccaaatgttaatagtttatatatgtctctggggacataccgaacatcaggacaaagcacagactgaccagatcattgattcgttcctgaaccgcaaagctctgcctggtgaccaccacacatccaggggcttgagcagagctggtaggaggtctaaccccaggtgaggccagaagccttgcccgcccaccccggcagcctggccgctgggcacactcacttcctctggttgtccgtcagggtgatgccctgggccgacaccttgaagtgcacgactgtggacaagggaggtggctcctggactagggtcatgctcagggccttctggatggcttggtggcccgtgagggactccatctccacggagttcaggtaccacacattgcaggctggaagacacagggggaagcggcgttaatgcgtctgccagactcaagggccctggggcttacgaatgacgtgcataaattcatggccaggtgcatctggggcaagtgccctttatttctaattccaaaggtgtagacagcaagtgactcagagacacacacacacccagcactggagtcaaggagacttcgcccactggtcaggatgtgtttccacctctgctgagttattcatacctggcatccctggggggatgaggggactggaggcacctcctcagtctcagtgtaggcctgggtgggacgagagcccaaccacacctgcagttaaggaaacatcccgagaggggagtgtgcagtctggaccctgactatccaccctgcaaggagttctaaaagcacacgcatc

SEQ ID NO: 46810 - DNA, 2888 bp, Bovine  19866880563746
gctggagccagtgttactgaatcccaagttcatattgtttgtggcaaaacagtcagtcccattgtacaaggaatagcaactctattttggaaagccaggagaccaagaagatggaggactagtgtcccagagaaacatcttccctgaattagaattcaggcttcttttaaattaaaaggagagggagtgtggctggttgtaaaattcatggtgctggaatccttcattcttccagcttgtctgcctaggtcaggtcaatatgttcctgcaaacctccaacaagacaaacttctctgttctgcagccttttatctctatacagatgggaaaaggttatacctttaaaggccagagccttgagaatgggctttcctatatatctcaggatatgggcaacattcttttataaaatgttcagagccaagatgactaagcacaggcaacagagcacaagagttagagctaaaggaataaatccaatatggagtaagttgtgttcttctcggttacaccaggagccataaagaattgctgggggaacatacctgggccctattcaatgggtctgggcccacatggaccagggcacctgtggcctctagttctccacttttcagcagaagaacctactccacaattgtaattagtgaagagaggaacagataaacttcacccaagaaacctcatctgacacaggaaatattgggatttcatggaagactcacaagggtgaatgtaacttcatgtgggaggaatgtagtgactcatggccagaggtccaaccaaggtagttttaaatgtgtgtgtggaattctttccatgttttcccttggccctggggcagtctttgtaattgcttcatgggggcatgccagaggtcagttagaggaggccccagctctcctgactcctcttgagttttttctctccttcatccatgaaagaggtgccccaccttcctggtcagagacacagaataaagacaacctagcttggccacagtggccttgtccttaggagcaaaatcaaaggttggtagttgtttaaaagagaaatctaagacagagcaattaaacaactgaccagtaacctgacaggatttccagaaagctatatcaatgccattgaaggggagaatgtgctttttaaaactcctaaatgggattcaagtcttccgttggaaatggcctgctgctgctgctgctgctgctgctaagtcacttcagtcatgtccgacttattgacaaactttcaggaaggaaaagactagttgagatgtactctggtgcaatttctgggctgggggtggggagtagggtccagatacttgcctcacagctcccttggggatgaggactcttttttttttccttgaaattcctgctcctaacacacttgaataggttttgttttctgaaacacccagtttattgattccttgactaggaggattcctttgtggcaagctctttgactctttgggtcttcacttataatttaaaaataaaaatactgacttcccaggtggcgctagtggtgaagaaaccacctgccaatgcaggggacagaagagacgcaggtttgatcccttggttgggaaggtcccctgcagtaagaaatgacaacccattcccttattcttgcctgtagaatctcacagacaaaggagcctgggagacaacagtccacagggccacaaagagtcagacataactgaagtgacttagcacagaaatcacagatttccttatgggatgcccatccagcaacatgcaaagggagcccattttagaggacagcccttcccagatcctcagaacacacacacacacacaccccaggtacacttgcaagaactcaggggcccctgttctaacttttccagaagagacaagtgtgcgggggagcagctgaggggtggcaaatgatggtgccttctcagagatcaagaaattctcaacagtgcccaccttctccctctccaaagggacagccctcatggtttgccacagaggcagaaggaagaaatcaagattccaggagtcaagattttcaaataagcattctttgagctctacaatgggcatgtatgtgctactgtatggtctgatggttctgtggggtgaccagcactccgtgttcatctcaggagagtttggtaagcaacatccaaccctgccaagctaggggagcagggcacagcagactccccaacaaagagaacatgcagagccaggagtctgtgctaaaagagcaaacgacccaaaccaagctcctcagaagctaactgaattgtatcacaaagtgatatctcaccaggatgctccacatttcacggaaagtcatatataatttttataaaatgaaaaaaaaataatgctaaaaccctattatgtttatatggacattttcagaactgctagaatgtgagaagtcatcccactatcaatgtgtatgtaagatgttaaatccatgtatctaagaaattaaaacaaatgaccacaatgtcctgtgcaacctcaaagctttgatgaattcttggcagttagcaaatgcccaaggtggaaagcacacaaatatttgtattttccctgaactcatgagtaatggaacaactactttttcctgtcatagcagtctttgtgtattattcctcatcccaaggactgccatctctcacattctaggctctccttccactctcatcttgtagctgtgtgacttgaggcaattcatcttaccctttccggtctgtctttttctctgctaaatgaacaagatgaccccaaacccaaggggtaatcagttaagtaaatgtgaaagagctctatcctcaacagttaccacaaaatgtacccaaatgccctcggcagatagtctgagctctg

SEQ ID NO: 46811 - DNA, 1789 bp, Bovine  19866880579142
cagtcccgtgggaggaggggcagaaacttcattatcatctttattttgtatgactgcacagtttctacttctttcatttcatgttactgatcgataaagtagcaagatgtttcctgtgcccattacagatgactgagaaaagataaaagtccaattatctccatttccattactaccatttattataactagggggtagaaagatgagaagaggaaagctgccctcccctagagctcacagtctgagagggagcatgtctgctgtcttagtgggctcaggatgccataactaataccacagcctgaatataccacaacagaaatgtatcatcacagtcccagagactgggggtcagagaccgacgtgccagcagggccgatatctcctgagccatctctcactggcatgcagaagctactttcgctcctctccttgtcttccctctgtgtgatttccccttgtaaggacaccagttgtataaggacagggccacccataggatcccattataccttcaccacctctttaaacctagacagcatattaaaaagcagagacaattattttgctgatcaacgtcaatctagtcaaagctatggtttttccagcagtcatgtagggatgtgagagttgaactataaagaaggcagagcattaaagaactgatgcttttgaactggggtgctggagaagactcttgagagtcccttggacagcaaggagagcaaaccagtcaatcctaaaggagatcagtcctgaatattcattggaaggactgatgctgaaactgaagctccgatactttggccacctgatgtgaagagccgactcattggaaaagaccctaatgctggggaaaactgagggcatgagaagggacagaggatgagatggttggatggcatgatcaacttaatggacatgagtttgagcaaactccaggagacaatgaaggacagggaagcgtggtgtactccagtctatggggtcacaaagagtcagacaggactgagggactgaaggaaaacaacaaaacctcttaaaagaccccatttccaagtccattcacattctaaagtcctgggggttgaggtaactacctatgcctttggggccacattcagtccgtagcatccaccatcaaaggcctgagggggccaatggggaatgaaggccattctcacaacgtcatccaggcagatttgggaaggtggtctgtaaaaatgctcctctggggaactccagtgaggggtccaacacaaacctccaaagaattacagactccatgcaaagggatggctcccaaaatgccaatcttcaaggctttattaacttacatgcctccttcaagcacttttccttaactttatcaggcgtgaccctggaatccctaattaggttcacattcctcaggaaactgttctcccactgagagttaaagcccaatttagcctgtctaatccgcatgagaacacaccgccctacaaatgcaattaagccttattggtcccgcctgtccccccacagcccctggatgcaggcgggggttggggggtggtggtggaagagagaaggaaaatcactgggatcatttcactatagtttctcttagataagtcttctaaaaactatttttacttttcccataatttcttgcaagaagcccacgcatgggagaacacccccctccccacactgtgacccaacggcaaggcactttaaaaacactgggtgcaccgcaaagtgacagaggggggctcagatgtcagcggtagaacgaggaagatg

SEQ ID NO: 46812 - DNA, 1520 bp, Bovine  19866880732702
cagatgaggaaactgagacttggcggacttaagactgctccaggatcttaatgagcaggaagccagatctggtctggttctcaggaggtgttgccatgggcatggggttgctgcccgcaggaggtgggtcccgtccactgggcgtgacaggcactgcgaagggccgtgagtgaggccccagctgcgtgccaggcctctgggcgctgggtacactggtagacccagaggcacccccgagcacacgtctcccactcacactgagatccagttcagaaaaatcgttctttctgggtgttgcatctgcgttggccctctctgttcaatggccactttgtgaagtatgaactactccgttctgaggaaatataagcctattcatattagccgataaaccctttcctttctagcattaaggaatgaaatttgactttccaaatgttttctgtggaaacaaattggagagctcatgcctgccaggcaggaaacccaaccctccagtgaaagtcagatcctttcttggtgataataagcacttgtgtgtgtgtgccagacaaattgagattcctgctcacgtcacatccctctggtcagagagcagatttcacctggcggactctggacagaggccacctcacatttgtgcccacaacagcacagctctgtctggaaccagagtttcatgtgccatagacagtcctggcatttttggaaagcgtggagactgggctttttttcactgtaagcttatcattggtactctctctaaatgccgcacttttttctgaatagctgaagtgtgtctcagctgcacgtgttaggcaattcacatgaaaggctctaaactccggggtcctcacctaggaagcagggctgatggctgttcctcacagggttttttttttgacaattccatgtattatcacacgaaaggcatttgcagcatcagtgctggtgtgggctgatgttcatcctgctggtactagtagataagatagtattaagtgctcttcgctaaagtgaagtgacactaccaagatttttgtaacacggttttctgaattcacactttcctaattggcggctgcatagtttgctacttcatgaatagaatgttatgtatttaagcatttaccagtattgcctatccgagttgtttgcagtttttctttagaatttcagttgcttctaatgattttgtacactgaagtatgccctggtgacagattctcatcattacatctttgatcatttttactatttctattttccccttagatagtattcacacaagtagtgtaatcatagggacttttgaaggcctttgtcacacactgtgtcacacacagatcgaaatagacatttccaaatcgctaagtgaagtaagaaaaacattctggtaccagcactaggaagataagagttcataaagatagagtcagtgctaatattatgaatactggtacgatattaacaagcttccctggggctcagatgttaaaggatcgcctgcaagcaggaga

SEQ ID NO: 46813 - DNA, 4063 bp, Bovine  19866881028899
ctgctgacatgaactcgtgtaggttttatgggaatatgaagactttctagcatgaacacaggctggagacatgtagaaagcatagtgacatagatccccattgcggttaaaaaaacctccttccttttagttatctcctcaggataaatgaaaattaagccatttggagttctaaagttgatatatttggattgtcttcattactcttattagaaccaatttcttaaattgtagtctatataaatttaatttctgttgaacattaacaatgataacagccctccttctccccagccctcctccaatggagtgcagtctgggtagggaatgaaatatggattgggaatgaaatatggatctagccaagcacagacttgagttatcttgttaggcttctgttcttgaagacttataggcattagaaactgattagtaacgtagttctaattattaagaaagtttgagattgaagccaactgccctctgctagtggaaaaagtctgtgaacagtttacttcagccccctgcatagattcaatttacatataaactcagattcttagagatacacattgagatgtctggtagtgtttgcctacaaagtgaaatagtcaggaaaatgcttttaaattggatctggtagagtgttgtcagttgaaacttaatattcttaccatttcatgcttcatcataacttcatagcccagtattgggttggttctgccctatcaaggattgatggcaggaagtggtgcctgatttcaatgctgggagcaggccatgtgcaatccatttttccattttaagtgcttccataatcagacacagcttcaattaggaaagttagtataggtttttcattttcatgtggtgttaagtcaaacgctaagggataaaaatggaaaccaggacccttaggggaagcacacattttcatttatcctggaggcactaaagaccaattgggtcactgagctgtttctaaatgtagaagatagttcccaaatcaattatcaggagatgctgtgtgaaaatattggagattattgattgactgaactatatacatttcttccatgaatagaacacagaagtagcctttatgtaatggagtatacctaactagtaaacaaaaaagtatatagacatgtgttagagtaaatttttaaaaaattggaacctcaatccccagtagagaagttctttgtgtggcttctttgcagtcttccatttctggtgcttgcataaacttgaatctatccacttgagagtcaatgccagtcaaccagaaggtcatgatgcatcttaaattctgttatgatgtcaaagttatgggctctggcttcacattcaactgagggaaagagctgtataatatgataaaagatacacactgttagtgcctatagcaaggacattgtgctaatactacaagagaatcacatgagggatttgtgaactctgctgtggagactttcagtgaggagcagatatttgaggaggaccttgcaggataagcttgtctggctacagtccacagggttgcaaagagttggacatgactgagcaactaactcttcttcttctttgcaggataaggggcttccctggtagctcaacagtaaaagaatccacttgcaatgcagggagatgtgagttcaatccctgggacagggaagatcccctggagtaggaaatggcaactcactccaggattcttgcctggaaaagtcccatggacagaggagcctggcgggttacagcccatggggtcgcaaagagttggacacgactgagtacacacacaggcaggcattgcaggataagaggggttttcctgaaagacacaattaagggaagggcattttccacaggaaaaataagcaaacagttaagctatttgttcagaggtgattggataattctctggatagaacatagggtggtattgaaggaaatggcaggaaatgatgtgggttggcagattgggccagggccctgggggattcaagctggtatgtcagacccctagcttgggcagcatccccaaggcatgagttggcaatgcttctgaaggtcatgtatggagggtggatgaggaagggagtgcttttggactattttgttctgtaaagttagattttatctttgccaggacaagtttcctgaggaaagacacaaagacatcacaaaatatcttcatttcatcctatggttccaacagagctaatttatcataaattttctgttttaaaataaaaatgtcataagctctcatgttacatatgtgttgtctatggcttaaaaactatgaaagacatttattctttcattcttttcagtggtgcaatgcatatgtgtttctatttttttcaataaatgtgatttatttggtacataaataaatgtcatttaattttatacaatgtaacaaataaaatttgtattctatggtatgctattatgctatgtatctgtaagtataataacaagagatcttgttttatattgcatacaatttaaaacagttttttaaatgtcttggtgtttagaaatactttcagcagcaaatatgctacacactggtttaacaataaaggattaattttttatctgagacaagaagtccagagaatggcagttgctgtactgatacatctgcttaacagggcatcttggactggtcaccttcttatcctgttggccaattgtgctggtgtctcctgtttagagtgtgattgcctcagatgcagttatcatctgtgggcaagacaggtaaaatgaagaaaagaaccagggtgaaagcctaacagaagctctccctcttcctgcacatctcattggccattcttgactggaggtagtctgggaaagaaaaagtttattttggccacttctagaattgacagtgatgaaaggaaggtggtaggaaatgattaattggagagtcagtcaataagtgagggatcattatggtttttctggttgtacagatggggaaactaaggtttgcatgaactaaaagaattgcacaaattccatacattgccagtgacagagacaggaagccaactctaaactatgacttctaaactgtatttctgataccacgactttttctgaaatcctggctcctaaaaagtattattttcattgagaatattcttgatcttctctccttttttttaaacttagaaaggcatacactaagatcctcagaagagcactcctgaatgcttaagggggcaagactggctactgcaaggtcacctgctggttggaaaagactttcttctgtgatacttgctctccagtgcagatacttctgcattcctgtatccacctatagccagtcttcacttgggctttctgtatttccttttaccttagaaaatactatgtattttttcttacaggctttgtcatatttgccatgtagtgtttgttaaattctgtatttccctttgttaattgatgataagcattgtggatggtctttcatacagggagggttattactggcgagaaattcaactcacctatattctaggatggtttccaattgctgactgtgtcaaggtgatatccacaacttatctagagcctggacattcaaaatggggacaatggtcttcaatacttaatattgaagattattttccatgatattctgctactataactgaaataactttcattgactgttaaatatcaagaattatcatacagaaacataggctttccagttgggcaaaaaggtaaaacgatatctttaattttgtgtgattaaccttaattggtatctagagttccaaacaaactagtcttcaattacctgatctttccaattcaggttcatatcagacacatcagcaatttaaaattgctccctcttctctcctctgaaaggtggcatcagggctacttgtatgttaagacaacagcaatgccaatgtgtgtttcttctgtcttctaccaccatcagctaagatatacctcatccactctagtatatctcttgctattaatgactttgctcatcttcatattactaattcctcaa

SEQ ID NO: 46814 - DNA, 794 bp, Bovine  19866881187690
ctggatacagtttatgtgtggagtgtatactcaattgtacacttcagtttattactgtgtgaacaaagactctattgctgatatgagagctggttggcaacccatttagacagaattacatggactgggcactatgaggtgcctgtgcccaggggttctctcctcccatctggctcatgacacgggctttcactaatttcagttatgtctacaaaaaagaatgatgtctgactgagctttcttatttcccagacaacctagaaaaaaaaaaaaaaacatgtaagtatatttttaaagagcctaaaagtgcagatttttctcttatttgttttttctaggttaatttattctatattggaagttaatgaaagtcaatatattttgcttctaggcaagcatccgaatattttaagaatatttcatttgattatctgcttgctatttattgatcctactgcagtggtctctggacaaaattgtgtgcagtgaggagcacaaaatgggtctgcccttgtttggcagctggtgataacgaaatcaccccacttcttagcctgttttgaaatgtaagtaacagaagagagttacttctgttacttgcaacctagacagcatattaaaaagcagagactttactgtgccaacaaaggtccgtctagtcaaagctatggtttttccagtagtcatatatgaatgtgagagttggactataaagaaagctgagcgccaaagaattgatgctttgaattgtggtgtggagaagactcttagagtccctggactgcaaggagatc

SEQ ID NO: 46815 - DNA, 931 bp, Bovine  19866881821853
tatttctcatgttactatgagccttttcataaatattaatgacttcatatatcctcttgtagatgtaactaatgtatgcaaatgttatccttaatattgcatatgtctcatctttaatgacatttattttataatgaccatctttgtgaatatagcattgctcctattttggttatgtattaggatatattctgagaaacatagtgggtaaaatattaagtatttagaaggcaattttcatgattcaattgatgcaaattgaaaaattaagttccagaaaacattactaatataagtttatattcctgtcatatttttcctgaccaatgtcatctggctataatgacttcactccacttcctagctcccatcttccggtgttagcagggtccagaaagaaatttgcttacacctgtaatcaaaggaagcaaggtggtacaaggtaacgccccatttgcacatggttcttcaccagcagagctagggtggagccagatatctgtcttcatctcaaacgaggcagtgtgttcagcgtctcactctgccagggtgttggcaggccctatagggaaacatcatacacgccagcttggccttcatgccacatctcacacctcagtagggtggtggctgctttatataattgagagttacttttcatgtgaagaaccaggaatatcaggatacaaatgagaaaagacaccaatataaagatgaatcagatgttagaactctgtcaagaatcttaaagcagtcaaaattaaacattccaacaagtcattttaaattattttgaaaaaaaattaaaaaatagaaaatttcaacaaagaacataataaagaatcaaatttaaatatagaactgaaaagtaaaatcacataagtaaacaaataaacctctctaaatgagctcagtgaaatgagcgtcaatg

SEQ ID NO: 46816 - DNA, 1429 bp, Bovine  19866880270865
attgatgcttttgaactgtggtgttgaagaagacacttgagagtcccttggactgcaaggagatccaaccagtcaatcctaaaggagatcagtcctgaatattcattggaaagactgatgctgaagctgaaactccaatactttggccacctgatgcaaagaactgactcatttgaaaagaccctgatgctgagaaagattgaaggtgggagaagaaggggacaacagaggatgagatgattggatggcattaccgactcgatagacatgagtttgagtaaactttgggagttggtgatgaacagggaggcctggtttgctgcagtccatggggttgcaaagagtcggacacgactgagcgactgaactgaaaccactacgagggcaagactccacaagtctctctctgactctgcccatgtgtctacccacacacactgtactctttttttcctctaaataaatacttgcttcactgctttccatctttgtgggaattcttttctgcaaagccaaagggccagggcccttgtcactgaccactggactagtggctaggatctggtgctttctccacagtgacccagcctcaacctctggctgggaacccaagctccgctccaagccgttgcaggccaaggccacctgagatcaataccacaagtaaatcacaccctttcctctctgccctgggccctgtgccagtgtggactatgccctgtcctccaataaagagtggatgcccctccctctccctcccagcccaggggtaaagtgtccacagactgaggctggtgcccagactttcaccaaatggaaaactgttaataacagccaaggtagaagatttaaagaggaactagaaaaaagagtccagaatgtatgaaaacattactctcatcccccaagaaccaggagtatgtcatctcacttcagtgagaaaagacaagaatctgtgcaagattttaaagcagccatcataaaaatgctccagtgaacaattagaagcactcttgcaacagatgaaaaaatgaagacagaaaagaaatagatgataaaaaaattcaattgaaaaatattttgctggaaaaattcaattaaaaagctcattgaatgggctcagtagcaaaaaatgcaaatgaccaaagacagaatcagtgagaaattcccaaacaggatacacccaaagaaattcatgccaagatacaccatcataaaatttttgaagactaaaaacaaagaaaaatattgaaagcactgtctgctatccaaaccctccaatgaatccccatcttattcaaagaaagaaaagtccatacaacaacctccaaggccctgcatgatctggctctctactaaccttccaagttcatcttatatttctcttcctttgactacacactctagccacactggcctccttcctgtc

SEQ ID NO: 46817 - DNA, 2331 bp, Bovine  19866880488445
agggggatgagaagaatgacacaagtttaaaggtttggaacatggtttccctagtggctcagcagtaaagaatccacctgcaatgcaggagacacggattggaaatgtctacccattccagtattttcgcctggaaaatcccatggagagaggagcttggagggctacagtccatggggttgcaaagagttggacatgactgagctactgagcaaaggtttggaacagatgactcatgagaaattctagaagacaaacggacaagtaagaggattgctaggctgcattgagagccccactgaagtcagataactaaagaataatgatattttcctgaattttaatgtctatacatgtacagaaaatattgtcctgcttgcatatgttcctacttccacaagagaaaaaagtttgaaagaaagaaaacctgattgaattttttattaattccagtattaaaatgattttgtaggtattagtgattgaattataaaatattggaaaggcaagcatttttataaatcacaaccttgtgtattttctgcttttatgtgtgtatttctgccttttcacatttggttaaaaaaaaattacaggtggagggaagagcatcaaccaacagggttttgtggatcacacagccccatgcaattaaggtgccattgttaattttcaaattgtcataatccatttgagaatttaagacaattcaaaaaacaattatgactgaatgaaaagtgaattgggcaatcaactgagatgaaattcagcccagagaaacaaaacgttgagaaacaaaaccctagaataagggaagaatgaaaggcatatggaagtgactgattgtaccaggacagtctttaaagaccaaggttacttgacaagaacgtggtaggagtttgttttatacttaatgagatttagctattttgctaaggcagtggatcgggctttttcatatttaggttgcataataaaaatgttgaagcctacccagatgcacatagatagagctatatgttgtttacctaagactgttgtatagcagcaaataaacaaaaccagtctccacagacattctggagcagctttcagcaaaacagaatttcaagtgtttattctgattttatgaaggaagattaatttgtgatgcatctaaatgaattcttttaccctagatcagcaaactcaaatcatcacatcctgtgtcttttattttttgaagttgaaataaatgtaggtagccagatcatcttcatcatcaaacaacctcaacagaataccctggaaaaacctcgcagaaggctaaactaatgtaatctgtatggattttttttttttaattcttgctctctaaaatcttatcttccacccaagccaatagaaggtccacatagaagagtcaaatagtattgcattgtgtgctgtgcttagtcactcagtcatgtccaactttttgcaacccaatggactgtaatctgccaggctcctctgtccatggggattctccaggaaagaatactcaagtgggttgccacatccacttccaggatatcttcccaactcagggatcaaacccagaactcccgcattgctggcggaatctttaccacagccaccagggaagcccattgttgcattctggtttctgttattttaaattcttgctataccctttgtttattctcctccaagtcacttcctcctgtttcaatctttagtctatgctttttttaaaggcattagccgagattcatctctagtctcatgctttcctaagtaaatcacaccccatcatgatctttgtcatggtttaaattccctctgaactcattcattcattcactcactcattcatgcatcattgtgcatctaacatatgagacccccacagcatcgagttcagtgttctccatgcaatcaaagaacatgtattctatgcctccttagggccccagaactatactaggtgccataaaatttacagaaagaagcatatgtaattatctgtttccttcaaaaagatttaaagcaactagctctttaaaacaaattacagtacagcaacagtccacaaaataaaagaaaaaaatcaagtaataaaggaaaaggagaaaattatatcaaaaaaagtcccttgagtttctagcaactaaaagggaaattaaatggatcataaagctctcatttactaatgaaagaaatgctactactgaaaaaagattctaagttgagcaaagataacaacaacatgggctgtgttgggattggtagtgacacaacctcagaatccttctttacatagcattctagtgaacagccatgaattca

SEQ ID NO: 46818 - DNA, 1358 bp, Bovine  19866880558738
aaattttaaagaaaattaaatctgaaatgcattttgactttatctagataatttaggtaaaattggactttttagtctaaattatctactatagactctgcttacttctatgtatgaatctttactttgtaggcacatgctgaataaatcattaagatttaaaaatttcttagagggatctccttggtggtcccgtggctaagacacttccaatgcaccaggcctgggttcgatccctggttagggaactagatcccacatcctgcaactaaaagttcatgtgctacacctaaacatccccagtatcgcaaagaagatggaagacctggtgcaggctaactaaataaatactaaaatttttttttttcttagagatggaaaaagacagttgttgagatatctttttctgggactttcctggcagtccagtggttaagactctgccttcccaatgcagggtgaagattcaaaccctggctggggaactaagatcccacctgccacgcagcacggcaaagttagtctttttctatttatctttctgggcgtttttagttttataattgtagtctctaaaatagcatcatgttcaggtgggcacttaatcataatgccgttgtggaaggcacattagcctctggagaatctgcatgtgatgttacttcagtggagtttcaaagattaaaaaaaaatatgtgagaaaaacaaaaaggtatatttcttggttccattattggaatagaatgagaacaatggtctatttaataacttatcactatcttccttctagattgaattcaaattactttactattctattaagaaaatctttgcaaaaatgctgccaatcattttttatttcagcagcttattaacaatgaaatcaaagatagctccatgcttctgagagataatgtaaacttccttttagaatcttaaagaactaaaaaattgaatgctttgctgtaattttagcttttaatatgtcaagcttgcttaatgtgagtagacctgacctaaatgtctgatatactttttttttttttaaggcaacattctagtagtctcttttagaatgtcttctgcaaaaggcagtgtgcggaaacagtgctgagtatgtgttctgaagtcagactacctgggttcagatcttgagttgaatctgtttaggtttaaatgctacttgctttcatgaacttgggcagatgtaaagttacctgatcttatcctctctgtacctcacgttcctcatgtgtaaattacggctagtgatagaaccataacgtggggttgttgtaaatattaacggagttaattacttaagacccttagaatagtgcctggtacacactcaataa

SEQ ID NO: 46819 - DNA, 1205 bp, Bovine  19866880577506
tgaatatttatttttagagttgaatagtaactcccaccagaaagaattttaccttgacatttttatatttgaagaatataagaaaagacttgggaggcaagggctagaaagcaggacatggatttccattttgggaaatggtacttagagtttccaggtggctcattggtgaataatccagtggccaatgcaggagaaagaggagatgcaagttcgatcactgggttgggaatatcccctggtggaggaaacggcaacccactcgggtattcttgcctggagaattcgatggacagaggagcctggcaggctactgtccctagggttgcaatgagtgagacacaactgagcaagcattcgtgcacgcacatgtgcttagagtttgcattagcaattctcattttaggcaatcccttaaaaatgacttagtgatgtcagaatgtattttcctttgatttttaactttctgaaaactgtgaaataatttatataaaataaagtatacaaatctgaggtgtacagctccacacacacacacacacacacacacacacacacactccttaacatcccagaaggctactttgtgacccctctcagcgtataaattcatcaatttgtatttcttaatctcttgcaacatgtttaaaagaaggcttatagttgtttaattcagagatactgcttagaaaaaatatatcccaatagcttcattttaagaagcaaaagccaagccctagaaaacttgtttggataacattgtttgagtgtggggtacaaggcgctcactatttcaagataattccaagagaaactattgctgtgacctacaggtatctttttactgagggtcattgcaagccacaatagaattccagtggtctcatttgcaatcacactcatcttcaatagccatatttgtggcttcctgagtaatgaggtgatttatcatggtatgtcagccatagagagttcaatataaatgaatttagtttctttaaaaaaggtatttatatctaagcactttcacaataatctgacattgccctttaaaggtaagcacatattatgtggtttgcatatgaaggaagcaggcattactcttgcttgactgactgtcagcttcagcccctgcacctggtagtccccaggtctgtcattgtttccaggatagagctcatttttcaagggttaataacatagac

SEQ ID NO: 46820 - DNA, 979 bp, Bovine  19866880579329
ctctattttctttgcttaaaaatatcctttcttaggtgattgcaaaaaataaaaaaagtcatgtcgcacagcgtacaaatcagctttagaattaatttacttgtgtgaatttatgttatctgtctattaagtttcgtgaaaccccagtgcaaaccaaaacaacagtcagggacaagattatttagatgttgagatcctttgtttcaaaatagtgcagatgtgaaaaacccagtggtgagcatggcttgctacaccaaacaggttttacatttttagtaaaatatccaaatgagcattgtatcactgaaatgttgtcaaaggttatgtttagttcatgagacaggctcaaaacaatgaagttttgctctcatataaattctcaagatgagaaaaatttttaaaagcaaattaagtagaaagaagtaaatgagacattatttctccaaagttgttttattgcctgccaggaaaatatcttcaggagatggactgaaaaggaaaagacttttgtagtgagcatctgagccacagcaaatttgtgggtattattggctttttcagacatcaaaagcaaactgtgtgaaagatgatggaggtgctcagacaagaatggggaatgaaaatgagcaaatagaagatcatgctcaataaaaacacaaaatgataatcagaataaatgagactatcagtgcacaagtagaagaaaatcaactaggaacatctgttcaggtgaggctgaaattaagagaataatcaggttgtgtgcatttggaaaaagtctatgaaagatatgatgagtagaatctcatccttcgcccatgtggaatgatcatatactatctctgtactttcattaaaattgagtttgtgattgtgcatgttataccttccaagaaacataggtttgcataaaaaatgcaatttgatgtgcattgcagattaagaaaattgtaacggtacaataaaatttctcagagaa

SEQ ID NO: 46821 - DNA, 1123 bp, Bovine  19866880592614
agaagctagaatttgaagctgttctaaatctgacaccagctctcaggctgtggttcccagcttccctgacactcactgacatcacattgtcccccaggaagcatgtaggcaccaaaatgacttttaacaaagattactgatacagttcaagtgaaagtgaaagtcattcagtcacgtctgactctttgtaaccccatagactatacagtccatagaattctgcaggccaaaatactggaggcagaagcctttcccttctccaggggatcttccaacgcagggatctcacccaggtttcccacactgcaggcagattctttacaagctgagccacaagggaagtccaacacagttcacaagcaattaaaaaaatatttgtcatttcaaagcaaaattagatttctaggttttttcaagatgtctcaaatctctttgaaacatgtatttggaatagaccataaaatatttaaattgtaagttcccatgggaacaaatcaaaattttagatggtagtgtgaatgaacatgttgtcagaggaccctagatgtgtaaagtcctttaattgccattccagtgctaatttatatactttaattagatgtgtgtagtatgctttgtttaaaaaaaaaaaaaaaaaaaaacggaaccatatggatgctgcctcatttttatctgagtccatccaggggctgtaaaccttaaagtgatgttggaacccagcacccttccatctgctaagaaaggtgagaacaataagtcttggggcaaaggctgaatatacatgagaggagtgtagccctgcactactctttgcttccacgtgccttggactaatttgctttgactaataatataatctgcaaagtaagaaagccaagtgatttttacctatcttgctgattacatggtttggagtaggaatgcttttggtttgaggtagctttttttcatttaccttaaatatgaaacaataagcaataggattttcttgagagagaaaactatcaagtagaccagagagagaagaggaatggattctagtgtgggaaagcagaacagctcaggctctgagtttgagtttgggtttgtgacttaacagcttctgtggttggctgtcaggaag

SEQ ID NO: 46822 - DNA, 755 bp, Bovine  19866880644973
cggcaagtagcattgcaaataaatttgatctatagacttttcaaacttctcagatgtgatccctgacgtctggcctgatgaaggaagccctggggactggaaaaacacaaagcatgctactgtactgacatgcaaaatgtctcataatctgtctttatctttcatgactgtagtggtctggataaattagaccaaattgggctaaacactgttcttggctacactcacgtagctgttttcaaaagctaataggagctgtgtgtgcacatccaaggacaaaatttggccccttttgtctttgcacaaacaattgctttagttgagatgattattcctgactgttttataagcagcattttgcccagtttaaatctcttttcactttattcttcagagtcaagacatttatgaatatggaaacatgtaactcaggatcttcagtttccggaaaaataaaaatctctcccctaaaatctgtgagtattgcaaatgaactgggaaagaggtaaagaaagtcatgttaacggtggcaaaaacagaagtaacactgagaaaaagtgttaacactcattaatggtagcaatctgattaaaatttttgtagcacattcatccttgatcgttcaaaagagaaatgtgttgttaatattttcaaggaaaatatagactatcaatacatttatttattcagatgcaaaaaaagaagttgaaattaacccttaatgcaactttttccttttccatcagtatcatatt

SEQ ID NO: 46823 - DNA, 3163 bp, Bovine  19866880689173
acaatattgtaatgtaaaattaattaatttttaaaaaaagagctctgacattcagctcagatgtcaatgatgatttggggcttgaattgaatgaatggtgtcaatcttgatttggggctggattgaggccatgctaatggtgcttggtgaatgaaatgtagctttacctttatcattgctgttacttggaaaccccagtgaccagagcataagctcacagaggaagtttagaatccaatattagagaaatgggtaccaagaaaaagaaaggctgacatatgtgtattatatattgagtgcttctcctctcctatttgagtaagataatctatcagattagaaattggtaaatacagaatccataaggtaaacaataggactaatttttgacatacatttcacacaatgtatgttcttagcctacacaggtaactccttcatagacaggctgtttatgcactaaagagttcagggaaactaattgctatgtccttccagtaagaactgtctggttcctaaatgctctttctcgtaacatcacactcttcattcttgaacttacatgtatatatgtcatgttaaaataaaaagctagttactcagattattttagcagagaggataattgctggtacctaaaagcattattaattttgcatatttaaccatttattcactctttcaataactacttactgataggtatgcccagaaccatcttctatgatgctgtaagacataatataaaatgatacaggagatggatgaggtctccaagtttcatttaggctatctttactatgggatggtatatgctaaagtgatctcttgatagtatgtgtacacttttacccgatttataaagattttctttatgtcctgagaatcacttgtctccatagggtatcttccgagaaatatcataaatatctttatttctatgattacattacctttagagcacacatgtcatttctaacatgggaactgcaatatcagaaaaatatttctgacaatttcttggataaatctattactcaaaaaacatctaataagtagttgattcactacacagcatggaatgttaaggaaagtaatcataagtttcttcacttggactggatccctcccctgcctcctcagaagtactttcatcactcttgttgttgttagtcactcagtcatgtcctagtcttttgtgaccctatggattacagcccaccaggttcttctcttcatgggatttcccaggcaagaactggagtgggttgccatttccctctcctggggatcttccagacccagggatcacaccctgttctcctgcattaggaggcagattctttaccactgaaccacttgggaagccctgcactctcagctctgcgcaagaaaaaaagaaagaaaaaaatacggaagcaattttccatttcctgagtagattagcataagattgacttgcatgatttgattagtaaagatttacagacacaagagataccaaaatgcaaagatcccagaaatgaaacacttgagcctcctcatctgaaatttgtccattccacgattgcttgtttctcactagtattggcgaggatcccagaattcagaactccaacatgcccagaaagaatatcaggaagttttttccaaaaagaaaatgctttgcctttgactggccttcaagtgacaaaaagctattactccatattgaggaagtgctagataaccaactggatgagaatttccagaagaaatcagaggatttctgttcatatatctttacccatgcaaaacccaagaccctaaaagaaggaatcattgtcaagtggggaggtgagtctcttgcactagagcatgtatctctgtgattcattgtgtgtgatgaacttgtgattgcactctgggattctcagtaattgtattttcttctccatgtaacttggaaaatggatgctcatgccacacatggaaatgcatgtttcttcactaaaagaagcctatgtacatggtttttttgcagtctatcaaatctcttgaaactattacaataatgatataagttaaagatagaaatcttcatggtgatgagatgtctgatgtgataggtgttttgagtgaggatatgcaaagtattttgtgaatttacactaagaagaaaataaatagtagtccatgaatccatgtagttttaccgagagactgagaaacaaatacaaatacgtcttatatacagggttggcctcatgaacatgccgcctgggcagtcacactgtgtcctgttctgagatgagtccttcttattttcatgttttgtgtcactgtcctgaaattctgatgacattttcatcaagatgttttaatttacaaattatgtaaattacttacaagtgccataagttcttcttattttattgcaatgggaaaagtgttctgggagacccttgagcatattgtttgagatgatttgttcaatattgtaatgtgatgagttggaaaaacataaaagatagagtgcataggagacacagtgattatattttaaaaaagtggattcgtacaataaaaaggatgaggatacaagaatgaaggaaatgaggagaaggataaatagaagaaaataaatctttaacttcaaaaaattttatgatttctagaatgctgatctgtaaagctgttttaaaaaatcaggtgagaattctctcccatttcataaatatcatgtatctttcagtgttggggactctggtggaggcctacatagatgctgtcaacagtggaggagttccctgtttggagaatgcagtaataactctggcttagcgtgagaactcagcagccgtgcagaaggcatctgatcactacagtgagccgatgacccagcgactgagcctccacacagatatgctccaggagctgctgaaggttcatgaagcctgtgagagagaaggcattgccatcttcttgagggactccttcaaggatgacaagcggatgtttcagaaaaagctcgcggtaatgtgacctagaatatatccttcctgattcctttcttccagaatgatgcctagccaccccacttttgaccccatgattcctgtgcttcttatcataaaataagactagattctagtgggtgatatggctctacaagctatacagt

SEQ ID NO: 46824 - DNA, 1519 bp, Bovine  19866880740002
tgagtgggcacttctcgtggtgactcccagtctagggttctgcttctctgaggagctgccaagatacacagagaggggctctctctgcccttgtctcgacagccatctcattgttaggaaagagttccctggaccatggcttgttgattccagtctgtcatctcacctaaagtgagacaatgggcttatttctcccatgaaatggaaatgttgctagaagagcatcagtgttactggaagttgttgatagctgagacacagtgtagtgctctgaaaggaaggcccacaatttcttgcagaagaaatacatggagttgccctagatcctatcctttctgagcctccctttagttcttggattctgtaagatattcttgctttcacttccctgcttttgctcttactgctagaattggtttatattatgtgttatacaaagaaacttagctaacagaagatggccacaaccatgcctgaaatgttggaagaaaattgtttatcgggatggcatttattaattcactgattcattcaatagtcatttattgaggacctattgtatgttaatcacagagataggcacacaaataaggcaggaggaagtgtggggaaatagtcctgtatacatataatcacactaaattgaaataatgttctggtagagaagcttataaagtgaagtgggagtacagatcagagtttgaatgaactctccaggtaggttggggaacaggggttaatcagcttggagaaggatataagctaaggactaaatcaaagctatacagaaaattcaatcttattacatgacagtggcagcaaatgaagaatttctacatagagactgaagaccagctgttctcaatattgactcagctctgccgagtggaaactgatttgaacagcagcatgagagacttagattatatgaggaagaattttctgacagtgtgagttgtcagtgttggcagattgtagcatcttctctggaggttaaaaaacaacatagatcttcatctgcctgggatagctttattgtgatgctgtctgaaaatagcaaaacggaagataatagcccaaggtcttttctaacttggagtgtttataattctgtcacttttaagaaaaactttattggatcaatgggaaaataaaattacggacagaaatgtaatgcaaaaaaaaaggggggaaactaacgaaattattaactttcttgggtcaggagtgagaaagaagtgaagagattcaaaagcttcaatatttaagttagaaattattttgaaatcacaaagtcagttgttttagaagtcctttgttggggcttaactgactgttaaccaacagagggtcctgtcttttcctttccaatccagagtactttagtttcccctaattgacttcacaactcgtctcatctcgtagaagattttgtatatattgacaaatttcttttgattgtgaactgaagcaaatttacagaataaaacagtcaagtgaacattagctctttatatca

SEQ ID NO: 46825 - DNA, 1665 bp, Bovine  19866880817784
agataattgctcttattagtttggtgactgttctccaaacttttagaatgcatttatttgtacatatagataatgcagatatgttttgtgtttaattatttttataaagatggagccataattttgagaattttaaaattcaactattaataaatattttattatacattagatcttaaataattatcagaagtgaagtccattaaaacaatgtgattctaaacttgcttaaggtatttttttttttaaagcaaacttattttggtggcaaaacaaaactgtgacaattataaaaataccttgatttctcttttatttgtaaaaagactgtcctaatgatacttagtaaataactgagtacagggagtatgttcaaattaaacctttaagataaatatttcacagaaacagaaaatgaagctctcacagagtaactattttaaaatcacatagctagaacacagcaaggctaggactaattttgattctattgtctcaagcaataatatgtttgcctagcatatgtgagccacccctcccctcgaggtgttctactagtacacaggatagacataagtgatcattgtgcccctttagtgagtggagacagacaaccaaaaatgtaaaaaataaataagacaatttcagatataaataaagtggaatggagaacataaaatataaaacagaatagaatggcctgatttagacattattgatacagtgatattttagataaagtactcaagaaaggaccttcaaagaaatgacattgcaggtgagatctgaatgattaaagggaggtactgcagatataaagtattgcaatgtagcattttattcttgtatttcactggggttaattgtttcattggtactatgtaatctgtactctcaaaaataataaaaagtgtgttaatgcagaataggaatttacatttatctcaaaaaagaagcgtaacaaaacaaaaacaaaatgtccatggcagttagtacagggctaggcatagtctagatggcctgcttttaatttttaaatatgcagggaacaaatttttaatggccgcctattattttgtggcttttgcctcctttattgaaagcttcactatccaccagaactaatgccctatttctttatttgaaatttgaaaatatgacagtactactatctgttctacctctaatggttatggtaagaatcaaataaagggaggaaagtaaaaatgttacacaaatgtcagttgtcagaatacagacaagagataaagattttataataaacccaataaaggtttactgagcttccctgtggtaaagaatcctcctgccaattcaggagatgcaggttcgatccctgggtcaggaaaataccttggagaaggaaacgacaacccactccagtattcttgcctgggaaatcacatggacagaggagcttggcaggttacagtccatgaggtcacaaaagagttggtctcaacttagtgactgaacaacaacaacaaacatttactaatcactggtttatgatttttatattttggaggcagaatttagatgttgcaggtaaggaaaaaagagaatcaagaatgactccttgtgttttggtctgaacaactggtacatggtattaccatttaataagagagaagactagaagag

SEQ ID NO: 46826 - DNA, 985 bp, Bovine  19866880917212
gaagatataattaaacatgaacacagatattaatagtttcaataataccatgtactaaaatctttaacgctatatttgaaaaggcatatttcattcatctaacttaaagccatacaatttaaaaaattcagaagtgattttgaaattcttctttaaaaaaacatatcgcaatagaattaaggaaaaatattatgtgaaagtcaacctatgcatttagtattggctagagaaggaaatgggagaaggcaatggcaacccactccagtactcttgcctggaaaatcccatggacggaggagcctggtgggctgcagttcatggggtcactgacgtcggacacgactgagcgacttcactttgacttttcattttcatgcactggagaaggaaatggcaacccactccagtgttcttgcctggagaatcccagggacgggggagcctggtgggctgccgtctatggggtcgcacagagtcggacacgactgaagcgacttagcagcagcagcagagaaggaaatggcaactcactccagtattcttgcctggagaatcccagggacgggggagcctggtgggctgccgtctatggagctgcacagagtcagacacgactgaagcgacttagcagcagcagcagcagcaagcttaaatgttaatgtacctgtcactaaacttaggttataacacaagttaggagcaactttttggtatccaaatattctcacccaccatatatatttaaatttcttgattgcactaatttaattttgaaattcaaattcaaaccaagtaccctgttgtgttatgtttcagacgataggctataaatgatcaccagttcaaggcaataaatgagtatttgcagtatgcatatttaaggttaatatgcatgaacaagggaaaagacatgctcacgtggcacaatttggtctctagcatctcccttggtgatgtcatcttctcttccggcttccactaatat

SEQ ID NO: 46827 - DNA, 2261 bp, Bovine  19866880958063
ttaattatggagcatcattcatctggtggctaagctggactggaatgtccactgtggcctctctcacaagcctggtgcctcagctggaatggctgggacagctggaaagctttggttctcttccacatggcctttctccacatgatctctctcattctccaggggcctgccgctagcagaaatatcaggacttctttaaatagtagttgagttttcaagaagcaaaacagaagctattaggcctcttgaggcctcttcttgaaacaccctgcccatcatcagaatgttatttccactctactattagttagagtaagtcaaaaggtgcactttgagtcagtgtggaaggaggctacataacgatatgaatatagagaagcaggattcgtttgaggccatttagtaacaatctgccatagcttcatagcaggtttccctgcctttccttgccccgctcaaatctacttttaacacaggaggtcatacagtgtcacttctctgcctaagccctataccatttcattttgaataaaagccaaagtctttttattggcttatgaggccctatataatccttagtcagattgggatttatagttcatctgaaacacaaagtacaaagtaggcagtcttggacttgtgtagcaattcaaaaaagctgtcagtgttctgggctcttcctctgctttgtcatccttgttgtttttgtcctgttgacctattactgtcataggatggctcctgcacctttgcctaggctttgggtgtgcattctaggcaaagagaaatggaaaagtggaagcttcttccaaaatcctgggtgtctctttgacaaggattttcatatgactacttctagctgcaagggagtctggtaaagtaagaattttatctctgcactttgttgcatctaacaaaatggaaattttcttagtcaggaaacaggggctggatattatctgtcagtgctatgagccaggaactgtaccgttgctataaaagcacacttagaaataatacagtcaaggtagttataataattccattgtactgaaaaagaaattgaagctttagcatggttacagtatcagaatatatgcatggccagtctgactctaaatgctcagtcctttctgtcacactgtattcagactgaactttttgttaaaacacatgtgtgttcacatgtgcaccacacatacacacaatatagccaacatttgctgcttctttagattttgtttggtttttgtgtctgtcttccttaataaatagaatacttgaaagaaagtagaattgtgtcatttccattatctgctgttgctgctaagtcgcttcagtcgtgtccgactctgtgcgaccccatagacggcagcccaccaggctcccccgtccctgggattctccaggtaagaacatccattatctagcactcagtgaatatttgaataaatgaagttttgttttgttttgtttcttttaaattaaaagatgggagaaccaaacataatttggcagatgggcaaacaggtacagagggataggataacatgcttgggttgtataactagtgacacatagttggtgttagaagtggcttcttgctttctggtgagagcattctctccttagatgtggaaggttggattaggatgatatgagagaataagaggaaataggtcctgttagtatctctgaatttaggcacataatagtccttagttaatgcaaatcagtaaaataaagggaaatggatactcctctcagaaggtagtatggagtaaaagagcaccaaactaggagttaagagaataatatgctaaacatagccaggtcactttttatttgtgaccttatgtgctttgaccctgctttcctcaaaactaaaatcaagggagttatactacatgatctttgaaatctcttctagctaaatagtgtatgaatcattatacccagtgagtttttatgggttctctaacatttcttggcatctatcaggtcaggctgttttatatttctataatatagagaaagtaacagctttttcacttcttctctgggaacttggccagtgaaaagtaaacatcctttcctgtttctccctaaatgaagtacttggtcataagtgacagacttttttcttcattttgttcattgaatgtgatcctgttcttattttaatgtttttcttaacttcactgtgagtttgttgaaatatagtaaattgaaaatgtcaagtttatgtttaagcctacaga

SEQ ID NO: 46828 - DNA, 2109 bp, Bovine  19866880987589
caggttcctatgcaatattgctctttacagcatcggaccttgcttctatcaccagtcacatcccaccaactgggtactgcttttgctttggctccatcccaaaggccacaaataagtataatttgtgcttctctcatagctcagtcagtaaagaatctgcctgccaatgcagacgacctgggtttgagtcctgattgggaagatcccctggagaaggaaatggcaacccacttcagtactcttgcctggaaaatcccatggacagagaagcctggtaggctacagtctatggggttgctaagagttggacatgactgagtgacttcactcactttcacccaggtctaactgacaagaatgctatgtttggtttaaaatgtttttattaataaacttttgataatacagggttttaaacagtgatatctgagcatgataatacatcaagagtgaagcttcaggtagagttgataaggaccagaatgccatagtgctgttttgttttgtttttggtagcatggaagtagtaatattgccttgtgcttgtttatagaatgttttttcatcttcaaactgcttttcaatcattaattaatactcataatgctacttttagctcttttattgcatccctacttattgtggcataaaacagttaaggcaggaaacctacacacatgcacatacacacacatacctataggagagcttcttctctatagtactgagatacaaacatacacatacgctcatacacatacacacacacatacacatacacacacatacctataggagagcttcttctctatagtactgagatacaaacatacacatacgctcatacacatacacacacacatacacacacatacctataggagagcttcttctctacagtactgagatacaaacatatttgattttatcacgttaatatctagttttaatcttttcatttcctaaagaaatgttccctctagatgctaactactgaactcaacaagagaaactatagaggaaagtgaaaatggggcagaggaccaaatgttctctttgttctttctttatccaaactccatttttggaagacatgtggatttatgatacaattgctaatatgaaggggtgatgccataaacactgatattcagggaaaaggagcaacttgaggacatatctctaagagaaaaagacctgcttaggatcctaagagatatccttatctttttagggtggaagccagatctttagtgaggactgagttgcgttcccccaaaattcacatttaagtcctaatccccagtacctcaaaatgtgactgtatttagagacagagcctttaaatttgcaaataaggtaaagtgagctcacatgggtaagcactaatcatgacacagggagaagacagctaactactaaccaaggagagaggccatggaagctagccaagctgataccttcattttggactcctagactcaagaactgtgaggaaataaatttctgctgtttaagtctgtgatgctttgttatggcagtccagaaaacttttcatatagtatcaaacttgctttattattataagactcctttccagagaaattttggttatatctgaagtaagtcctttaaatacaaggttttgtgtgtgtgcgtgtgcgtgtgtgtttgtgttttcggcttggctggtgtaatcaatcattgatttatttttctaactatactgcacagtcaaatgagatccaagctagggttttcactgaaagaataaatcaagaattggattattttaaacccaatggatattcaggaataattttcactaatactcaaatgtcttaaaacagaaagtgtttttaacttctttcatttcaacatatgggaattcttatgtctatgagaagcaaagggtcacagctgtattcaatgagcatttctatatactcttaaaagaatatatgtgtacactgtcttatagcttacaaagtgctgataaaccattatcccatttgatctttaaaacaacaccaagataaatcaaggcagatggtatattcttgtgttgtcttttttttaactgatgagaaaacacaagttactttccaa

SEQ ID NO: 46829 - DNA, 549 bp, Bovine  19866881029133
cctgaattttatctttttcaggaatgggatatggagacagaacaagcacattttgtggcactcctgagtttcttgccccagaagttttaacagaaacatcctatacaagggctgtagattggtggggccttggtgtccttatatatgaaatgctcgttggtgaggtaagtagtataagatagataaaagggaaagatgattgagagaacaaagcatggcatttataaaaccacttaatatgtttcctgcataaatagaacttaagctttataaatacttacatgcattagtaatgctcatgatcctatgtcaccttcactgtcttttttaggttgttatgtttgtggaatgtataccagtggtttgaaaatagtttatctgagtgttgctatgggcttcccaggcagcgctagtggtaaagaacctgcctgcttgtgcaggtagacataagaaatcaggtgcaatccctggatcaggaagatcccctggaggagggcaaggtaacccactccagtattcttgcctggggaatcccatggacgaaggagc

SEQ ID NO: 46830 - DNA, 1092 bp, Bovine  19866881068180
atactggactgggttgccatttcttactccaggggatcctgacccagggatagaacctgcgtttcctgtggattttttactgctgagccacctggaaaatcctgagtcactttagtaccatttagaaaaattgactgattaaataaatatacttaaagttatgagatttttaaatctccttgccaaaattcatctcctgcatcaggaagaacagactgatttttataaattgaatgagtgtgagatatagttcatggggcttgatttggacaaagaaattcttaattatatcatgactcatttcagcatttttaatcatcatggcatgatgaaattcactgcattgatctctaggggattagaaagaaaactaatttcagtttttgaaagtcattttcaagacctcccaaggaaggtttataaaggacaagaaagggcctaagaattgcatacctcttagtttgattctaagtcccagaattagtagaattaatcaaaactgtaatctccagccccttacaaaacaacaatatgcaaaacacatggccattgtgtagagtcaaagcaatcatatatgtttgcagtttggtcatattcaattaacctcattcattttcttgataacatcattgagtatatcttcattttaactagtacaaatgattgatggtattaagatggcagtagaataacatctttattgtgtattaagagtcacgctatttgggtttctcaatggccttttcaatattcaagcccttgttccaaatcctggagaggaatatggataaacaagacaaatacagagttagaattcagaaatccagatttccatacaattatgttttcttaagtcatttaaaactcttggtactttcttatcttttaagccatctttacacacatattttaaaagattttcctttgttttatttctcactcagggaagtaaggtaaagaaaacactttgaaaattaagaatgctttgcaagtgtaggtgggcctgtcatttttcagatttacaatgtgcaaccatgagaaaatgcactgtgccaatctattcatccttcctactattcagctatccatcaa

SEQ ID NO: 46831 - DNA, 3486 bp, Bovine  19866881114658
ctttgtgccatcaagaatgagcccagtaatcttctcagtcacagtgttcaagtggaagtgtgccatctttgttaacatcaacctgggaacacaatgatgataacagataataattattgaaattttgccttcatccacctccagggattctacaaaactgtcctcaaatatttctgaaactcttcgggatgcatttcatatttgtaaacatccctttaatttcaactatgggaaacttggaaagtgtccattttgagggcactgaagtctgtgtcaggtgtaatttctagtctctctcaaaagctgttgatagagaatgttagtcttgccatttctgctaaaaccagtggtgtcaactcaagccactacccatcctgctacactttaaatcacttcccacccccatctttggtcttgatgaaatcctgatgaaggcttccaagatgccatagacattttagtgaatcgagattttctgcatggtttcttctttccttagggctcacaacaagactaggtgttgggatggaagacaattatgagtaacacaaaccttgatgttctcaaaataaatattctctgtgtaactgaaacatgttattgagtcaagggtacatgcttgactcttagaagaattatttcccccgattattcctcaatcccacaagtgaatagaattcaggtataacataccatctattttcctgaccagcccaacatgtggagatgcaggttaggctcaaagcagaaatatttcctattgattaattaattcattgttttgctgaaaacaatcagcacatctattaaatgtctactacatagaggcatattctgggtcttaagtttgcagctgtgagcaccactgacatgaccttggcccatccaatctaacagctccctcctccttcacattatcagtctgtggtttatgtgctcagtgcagtctttcactggaagttaagttagatcagaatttctctgctaccagttgctgtcagtagtgcaccctagggcaattcaatatttccacaggccaacattactgatgaagttgatcccaagacaaaaagtaaaaatcacccagtcacacattctcaagttaaggagtgtgtctgagttattaggaatttgagccatgaaattaaaagacatttgctccttggaagaaaagctgtgaccaatctagacagcacattaaaaagcagagacattactttgctgacaaaggtttctagtaaaagctatagtttttccagtagtcatgtatggatgtgagaattggactataaagaaagtggagtgccaaagaattgatgcttttgaaatgtggtgttggagaagactcttgagagtcccttggactgcaaggagatccaaccagtcaatcctaagggaaatcagtcctgatgattcattgggaggactgatgctaaagctgaaactccagtactttggccatgcaaagaactgactcattggaaaagaccctgatgctgggaaagattgagggcaggaggagaaggaaccgacagaggatgagatggttggatggcatcaccgactcgatggacatgagtttgagcaagctctgtttgttggtgatggacaagtaagcctgatgtgctacagtccatagggtcacaaagagttggacacaactgagtgactgaactgaactgaactgaactatttgctgaatctgagctgtacttttcctttatgagctttggttagactgaggattagcttcattgtagtgtgtgatttgctctgtaagaactcatcatgtgaaatgctttttaaagaattagttattaaaaatattttattgtggtaaaaatatatagcatagcatttttcattttagacattttaaagtttgtagttctatggcattatctacattcatgttattgtacaatcatcaccactatccattactagaacttttcctcttccttaactggaagtcttaagtcttaagtctccactcattaaacaataactcccattaccccttctctctagcccccagcatccactcttctacagtatgtctctggggttttgatgactctaggaagtcatgtaagtggaatcaggtggtatttgtccttatgtgcccaccttatttcacttaatgtcttcaacgttcatccacgttgtagactgtgtcagaatctcttcctttttaaggctaaatcatattctactttatgtataaaccacattttgtcagttctttcattgatggactgaaaagctttgtttggccttttaggtagagtctcattttgaatatgccccaaatcttgctctagtaaatgttatctctttaaagtagcacatttagctctgtggcattaatgaacaagctataacatctgcagttgccactcgagaagaaaatgtaattttacaaatcaggttagtgccaccttttattctcagtacaggccctaagatgaggattatgaaatgattgttttatgatagaagtcagtttaagaatttttagcagtcttcatgccattaggaatatttaaacatcaagggaaatctttcccttatgtgtttgtgctgaccaatatggtagccagcagccaaatatggggtttaaaattttaatttattaaaatgaaatgaaattaaaaattgaattcctctgtcacactggccacattgcaaatactctgtcaccattgttagtggctattgtattgaactggacacacagactgtttctgtcatcccagaaaatgctcttccacagtgctgttggtgttagcttggattttctcccccaaagtcattagggatcatttaaatgtcataaaattcattgctgcctaacagagtgtgctattcgattgctcctcagcttcactggcttgtagtctgtagttgaaggacaggatttaatcttctgtggagcataagaacagaatcaatatagtcttgctgcttgctcgccattcacctgcataggcacacagagcctggaattcatagaggaaagagaaaaggtgaaattctaataagggtgaaggagcaggaaatgaaagaataagttcactgagagttaatagcattttaagattttatggtttttgaaatttagtttgtagcctgtcaaaccctaagtagtaaaaatgcacatagatggagaccatcaaacaataaagaacatgtttggacctaatgctaattcttataatgggatattttaaaatctatagtagagagaagtccctttgggatggtaaatgggacctgattaggacagggcagactacttaagaccacctctttagagaggtgattttcaactttcttttgcagttgagtttagtaacggtttgtttataattattttgttattttattttgtgtgacatcatgctcttaaaggaagaaaatgaatttcatttctatggtttttctatacctttgacttgttaggacaaagacaactcacagcag

SEQ ID NO: 46832 - DNA, 707 bp, Bovine  19866881135036
cttttcccccgcttttttgctattcgcccttttccggtatgtgggagagaacaataaccataggaagtgctggaaagactttcagtgtaactggctggaaggtaagatgaaaaatttaattgtttgaaaacaggcacgtatcttatttcttgtagagttttttttgtgttgtaaatgcataaatactcagtttacacaggtttttatacttactgatctgctttcttattcagttttcatgtttttatcctttttgagatgtaatcattcttttgaagtaagaaaaatagggtaatttgcttatttataagtaaccaactgatgatactcttttctttgcaatgcttggattactgtatattaattaaaaggagaaaaaataatagctaatgggaagaactgtacaaaaaagatctttatgacccagttaatcgcaatggtgtgatcactcacctagagccagacatcctggaatgtgaagtcaagtgggccttaggaagcatcactacaaacaaagctagtggaagtgatggaatcccaattcagctcagtggctcagtcgtgtccgactcctcgcgactccatgaaccgcagcatgccaagcctcgctgtccatgaccaactcccagagtctacccaaacccatgtccatcgagttggtgatgccatccaaccatctcatcctgtcgtccccttctcctcctgcc

SEQ ID NO: 46833 - DNA, 907 bp, Bovine  19866881202560
aataaaagattctcaaactgatggccagaaaacgtctacattctgggaacttgcatgtgcatgcacacacctgctcagtggtgcccaactctttgcatttgcaaccttatgaacgatagtccttcaggcttctctgtccatggaattttccaggcaagaataatggagtgggttgccatttcctactccaggggaattcgcctcccagaattgaattcccgtctcttgcgtctcctgcatggggggtggatttttttttactgctgcagcacctgggaagcccctgggtccttggagaatgcgtaaaagagatgtcactttgaattgcaacaaagatcactagtgagggaaggcccttcaaatagacccctgactggctatcacacacagttgtattatcatggaagctggtctttggctaagaatactccactgcatgaccctcacactggcacctgcactctagagtctctttttcttgcaacatgagaaagtagaaaattttctttctgggatgctgaatgcgttcatgtttaattcttcatataactaatcaaacatctgcaagttaatagcaccttgaggtcttttaaatttatttttgtgcattttttccctctcttggaccacatattcccttttcttcatccatctgcctttatttctcctactatatctacctatttcttgcaaagaaatgggactcaaacattttcacttgcagcactccttccccagagtcagtgccaacaaactgcaaccattcaccagccctggtgtgctcaaacacttgcgtacatccccactagaaacactaagagacagcaagcaagcatctagtgtggatacagagctaacatccaccacttggcaagctgtgtttggggaggcttacttagctctcatt

SEQ ID NO: 46834 - DNA, 1763 bp, Bovine  19866881270302
ccatgatcctatggagtgtagcccgccatgctcctctatccattggattctccaggcaagaatactggagtgggttgtcatgccctcctccaggggatcttccttgacccagggatcgaaccccacgtctcttgcatcttctgcattagcgggcagattccttatcactagcgccacctgggaagccctgtaagtacattatctatgtacatgtagtatccccctggtggcaggttggttggctgggatcatagatattcacctgcttcctcagcatctgtcatgtggtgggtgctcagcacatactgattgaatcaaatatagtgaggaaggaaaagagtgtcaataaggaattttgaattgcatgcttttttcttctaattccttttcattatggcttccagagagaagggcagaatgagtagaaatagggcagatgtaggggttttgacacttgtttttagaggattgtaaatcctagaaaatcttggtcaaaccaggacagataaataacttgtactttttacctttggaggaatgtagatggcaaagctatccttaaaaaaatttaataaccagggagggaagatccctaattgtttaaaatatctatataatcataaacaatgctttacatgccttatggatctcctacttaaatactttttttagtccacatactaactttatataatatctattttaataaaatgttctgtttttgtaaggaaattttaattgaatgggggaaacaaagacatcattattcattagagatgaattatttgtgaggaaatgataactcacgattgtgtgcaggtttgtctatgaacagacagtaaacatcacagggtatgaatattttcatttgtcagattagcagcaatttctgtctattgctctgtgtaaggggagctggcatctctgataataacctttgaattagacactggtttatattgtatgtggtcgtcatcagttaaccagggtaaccaggcaaacagtactgtgtgggtacattttctgcccatacagaactcagattcctggccccttaaggaggaatggctctcgaaggagattaagtgccataaagtatcgcagaacccagggtttcagacacacagctgcacagtttacctgcttagagcattagactcttgctcaaactggttagtcttattatttttttttaggacaggaaaaaaaccaaagaattttggctgtaaaatcttaccttcttttccatctcttcagtgtgaaccaggagtaattagataaagtatgactggtcagtgtactttccatattgatgaactgaaataaattttgttttttattactttcgagtggcccagacatttctaaaatgtggatgttttcaagtgacaacaagagacattcatttcttatacttaagctaataaattgaagaaccctgtagaatacatttttaatttatacatcagggtaatgtgaaacaggaaaaagcaaagaattctgagggcatcttttcagaaccccacctaactgaacaaatcctaatcataggaaagagaagtggcatcactagagggtgcacccacagggatgagaaagcctgaattttctatgccaggcatggagctgctgggtgaccctggacagtgtgcttcttcatctaaggattggtgggttttaggacactctccatgtctgagcagacaaagtacccttgatgtgggtcaagccctggcattcctatcatgttcctggatgaaact

SEQ ID NO: 46835 - DNA, 847 bp, Bovine  19866881300891
ttgagccccttcttggtacaggagcagtgctaaattcttgattggtcccgtgaaagtaacatggcagataggcaggtagaagtagtgggttgggcaggtgcagcagaaccatctgaagtcaggggttccggggaagtttctctggggaggttacatttgacctaagacctgagaatgaaagcttacagtctgaggtcatcaccagtcacatgtcctgtgttaggtcaagtggcttcaatttaattcttttcttttcaaaaatcttaagtggtgaagcctttatgtcagtttatgacaacttttagaaagcctaaccatcctgccactaaagttatagattctacttacttataggcataatattttattgacatcaatttgcaacagttttaatgcaacataagctttatacctacaccactaaaattcctagtacaggcttaataggaaaagaatcatttgtgaaataaaatgttcatgaacagtttgcacattcaactgtagggggagtgaatattcataataggaaaaattccactgcataaagtgaatataatagttaacgagggacttggaaactcagaaatatcatcaaaatataaatattggtgtattatcaagattgcatattattctgtattattaaatcataaaaatctcgacttttcctgcaatcaggttttgagtgctcaacattttcatgccatttaactagaacacatttttctagatacaaatggatatattcatttccataaaagtgatatctttttacagtatatttaattcagatccagtttctatttccactgaaataattgcttataatacatagactcgattttat

SEQ ID NO: 46836 - DNA, 1698 bp, Bovine  19866881371830
taaaatacagttgctaaagttatacttttagaaaagtaataaagctacattttagaaaatcagctcatgtgactggaaattattttccttttctagtctagatggtgcctcttcctaactctttaacctttttttagttctgtccatgttcttcattcccttactttacttttagtgatgtaagtcaagcctaaaaggaagtatcttaagatattttggttttttaaaaaattgctctaattatctactggactttaaatttggaattaactagaaagagaaacagtagtggtattaataaaggattagacatgataaaggattagtctagataagtagttggagtatttactgccctgactttttactgcatgctattatttatggtttgtctcatttacacttgtttcttttgcaatgctatgcttataatactaaaatttacaaattactttgatacaaagtgtgattgaatttttcagtccaaaatttcaagactagtttcaagtttttatcaaagatttcctcagaattaaaacaaaaaaaagttactcaattgtaccaagttgaaatattgaattagtaaaattgacgtaaaataatttttccagaaagtaagagaaattacaaaatatttacttattctaatggaattcatagctattgcttatgaatatttacttcttggctttgtttgtttttaaaatttcatattatgggttataaaagtaaaaaatttaattttaagctatttcttatatggttatatgcagatgcaattgtgtcacctcataaaagaaagaaatttctatatacttaataaagatcttaaatatctccaagttttttcctaaatgaaagcaggtgttgaacattgtcatctcctaatacattgagattactaaaatatttaattatttaccaggatttgaagtagtaactagatgttttcagttttcccaggatgacttttacatccaaacatttacagtggaaatgaactaagtttaccaccttaacaataacaaaaaaaagcaaataaaacacacagacacaagttgtttcttttgaaccagaattgaaatgatattcgttaaacttacaatgagccttcatactttacagtgagataaggtttccatagccaaaccaaaaataagtttgaacttttccctcatgcttagccatctttattgggatatatttgaagtaatacacaaatttttctggttttaaatatagttttacaatttttagtgaataaatacacctgagctaccattatcgatatccagtctgtagaacagttttattgcatatatttgaattatataatttgagaagttttgttatatatttaaagtatgaaaccatcaccacaaatcaagataattatatacatcatctccaaaagtatcctcatgtgcctctgtgaaaccccttctttctcttttcctgctttctttccccatacctgtccccaggcaaatcactggcctgtttctgtcactagatattagtttgcattttgtagaattctgtattaattgaatcatacagtgtatactttcgtgggggaaatctggccattttcactctgaataattcagaagaattgcatgtatcagtagtccctttctgtttattgttggtactatttaattgtgtgactataccataacttttttacccattcac

SEQ ID NO: 46837 - DNA, 1233 bp, Bovine  19866881397642
ttcacaccttgtcttactatcttcctatttgtaatcttgtcttctgattaaatgtttccctttttagttctaggatgatgctcactggtcagggaagttgctaagtatagcagaaaatatataagtttaccagttagtacatggatctctgcattcagagtctacctctgctacttattaattgattaacttcaggtaaatttcttgacttttaatgacatctttctcaactatcaatggggatataacagcaccaatcttatgggcttttgtgagactttgatgtttgtaaagcaaattactgtatcataatgctcaaaaaatattaaccagttagtcactgctatgagctataaagagaattactatgtccatgaattttatggttcatttttatctttaagctaccatcaaatgaaagttttatttcttgcttctgtcttttgaaaaaggtgggaccaacctccagtatatggaagaatttctatattcaaaataatcagatgaaagagaaaaataaaataaatttgtcttcatatatagaagggtcttatagacattaacattctttctcacacaggtgaaggaccataaagaacacacatcttttcccccatcatcataaaagttgttttctagcccaaatcctttcttttcctattacaaccatactagttcaagatctaggacctaaaccaacacatgcatgcaggctgggatcgactgaggatgaaatgggaaactatttaagagcttaatgcaaacaaaagttgcattactgtctttttgatgtttaatgtcaaaatctgacaaatttcttttagaatttactatctggaaaagtttggttccaggaaagacttactcttatctaaaaagctgttaagtttaattttataagaatcatgtaactaatcccatttttctatttgtctttgttgccatcaagcttggaaccaagttaaggctaattacaatacagctgacccttgaacaatacaggtttgaactgcttaagtccacttatacagattttttttcaacagcaaacaccatggtatatacaatccatggttggttgaatccacttttgtggaaccttagataaggagggactacatacacagaaggacctcagatacggagggccaactataaattatacatggattttcaactgaacagagtcaccatcttgcaacccctgcattattctagggtcaactacatatg

SEQ ID NO: 46838 - DNA, 1254 bp, Bovine  19866881401102
agaaaattgaaataaaatcattaaggaaagccatattaagtcatttaaaaaaataaaagtgaaactttcttttagtgtcaaggtttttacactattaatttgaagaaacccagaatttagtgaatttagtgaataaaatttagtgaataaaaatttagtgaataaaatttagtgaataaaagaaagaagataactgccttgatttattttgagcaataaagtatgtgtgtgttagttgcttagtcgtgtctgactctttgcgaccccatggactgtagcccaccaggctcctctgtccacggaattgtccaggcaagaatgaatactggagtgggttgtcagtcctttctccagaggatcttccctatctagggatcatacctggatctcctgcattgcagtcacgttctttatgaattgagctaccagggtagccacaataaaggataaaataattgattacagtgaccatcagtgtttgttgctttggggcattcaaaaagatcttgagtacaagtcagtacagttgaaacaatatgaaatgtaggtttctgaatcccagtgccagagaaatatcttgtccagaccttaaagcaagattggaacaagagataaatataggaatgtgtatttgaagtttttcaccaaattttttaaaaaattaagcataatatttagaagagggaaacaataaatacatcacttgggagaactatatagatgttttctcttcataaatagtgaattatattaatttactcattccacaaacatgcttttcagtacttacatgctagatactgacctaggagatggggatagtgataaattgcaatatccctgtggagctcacaatctaataatgaattaccatttggaaataaaattcttatagatgaataccttaaaaattgaggttatttccttaataatgatcatagaggcatatattatttctaagtggaaaggtaacactgcctcttcctactgtcttccagtgctaaaacacaaacatgatcaatcagatgtatatgtgagtagtgccttagagtatcatatctgtaaagcttctctgggaattccttacttcccaccataccatgcagtatgaatccagcatgaggaaatcttgaatcttagtagacaaatgaaatacactttgcctcagatataatacatagccatccaatttttattattgttttagatgtagacctctggatagaaggacagcaagaaccttagactataaat

SEQ ID NO: 46839 - DNA, 1654 bp, Bovine  19866881448207
actgtacataccaccctcaattctctgatttagtcaaatgctctagaagaattattaagactcaattggcaaaaattgaagaagcctccaaacatcatggacatcagcattgccattgatccttctaaatctcagaaccatcccttttggaactcataattctcactcttcatagttgtgggatgcccagtgcacttggctccgccttcttttgacacacaatagacaaaaggagaagtgttccaatattgcaaaggcctagttgtgtgcattaaaaatatctgtgcttttgtagatcaatcttttcatcatgattcttgggagacaaagattttaagcatcacaccctataatctcaatatttcatctactggaaaagacattccctgatgactttcatcaacctcactgaaaaggccccattcaggtacttttaaccaacccttgctctgccaagttccaaagaataaactcttggattcatgtgacacacctgaggaaagtgtggagccatgactggacctacataacatatgatgatctgaaaacaaatattttcaagaaatgaggcagatgatatccaatgagacagctttctaaagatatacagactaggcttattgaaagtctgtcacaaaacctttgatgatgacataattcttcagatgatctccagtgtctatgatcttgataatatatggactttagacaaaaatgtacctaacagttcttccttccaaccttccttcttaccagaatttgaccttcaaaggtttccaattggtgctttccctttagcatgggacattgtacctaagaagtttccttccttgtatcaagggacaaaaggattcaaactagaaaacatgactcttgatcagagatgctttcagagaaagatcttaatcaaagggggaaacataaaattaataaacaaaaacctcaaccaaattgaggtgggagaccataaggggcagctcctaggtcctgtcacaatagcagaaaccaacaggaagaagaaagactcttcttccctgtcaaggactcagtcaatgaaaagtcatgtacaccccaatttttttgtttgcattctgtaaaagtgttttcagtcctttgctctataggaacttgcacaaggcataacatagttgttaaccctgaacttcagttttctgttgatcctaagtaaacccagcttcactgaggaaatatctggcagcctatttatttcaggttgatgataggaagtgtaaaagaccattttagaaaatacgcctagcactgaaattggtaactcttaaaaagatagttgactgtcactgctttctaagatttaattcataaaagatcacatagacatagttagaagcatagtgttttagactactgattatagagcaatcgaatgataacattctgaattcaacttatagtgatattccctattctaagtaattcttagtgggaacagactacaagtttaaaaaaaaaataagataattttaaaacctttgccagacaccatagagacagatacacctacttatctcacagcatatattctctatgtctttctttttaattgatgagtctcccatctagagtttaaactcagcacagatccagtgcctccatttcacaactttcctgcagt

SEQ ID NO: 46840 - DNA, 1261 bp, Bovine  19866880351296
gggagcaaagcgcagcgtctttctgacactggtgcccaggcggccagccgaaaccggtcctggagtggtatgggatcctctggagcccagcactgggcgatgtagtgagcgtggaaacggagcgggtcacctgggtgaaggagagaggcaggtagcagtttccactggtggaaagctggaagacactgggacctccaacacggaagggatcgcaatgcatccagccatcactaccgatattgtaaaagacacccttgggcctggggggtggagcaagttgacacattatgtgaaagtgaagttgctcagtcgtgtccgactctttgcgaccccatagactgtagcctaccaggctcctctgtccatgggattttccaggcaatagtactggagtggattgccatttccttctccaggggatcttcccaacccagggctcgaacccgggtctcccgcattgtagacagacgctttaccatctgagccacaaaaacaacaagtaactgaatatattgctgtcagtcaaagccatgaggaactcaaaagggtatcatgtatatcgtatcataaatatccaatgagaagtgactcagactaaaagagaatgatttacaacagaagggtgaaataaaatagaattaaggagttaatcaaatttttctgaaaagggccagatagtaaatattttcagttttgtgggccatgctgcaaatactcaactctgccaatctagcaccatagcatcaactgattaaatgtaaacaaacagagttgtgttccaataaaactttatttaaaaagaaaacctgtcagtgggcctcatttgacgggctgaggggaggggagctatactttgcccccaggttagatgaacctgaccaagtaaagtaggaccctgagtagggaactatacagaaaactagcaggtaacataaatctaaaaaagcaaggcttccaacaattctactcctcggtatttatctgaaaaaaataaaatgaaaaccctaattcaagaagataaacgcacccctatgtacattgcagcattatttacaatagccaagatatggaagggcttcccaagtggctcactggtaaagaatctgcagtatgtatgtattattaaatataataatgtacataacactacaaaatatggtttgctttttattctatatattttctgtgagagttctttttttcttctctttgttcatttactaaactgctctccaaaagagtttgggttcccaagtgtttc

SEQ ID NO: 46841 - DNA, 888 bp, Bovine  19866880576326
ctctgtaatcttctctagtagctcctgacgacgggtctctcgggcctcagctgccagagtgctttgttcctggaagccctgctcttgctggcgcttgaaggatgccagtgcctgagaagtaaactttcctgtaataccaggattcaggcatgccctgccttaggaagctaggaatcctgactctggcccctccaaaccttgggaaatgaacctggggatcctactactctcacagaattccagaatccaggactctcagatccctcccacttcaggaccagtcgtccccggcctctcctcccgcaggtcccccgggaagggcgccccaagtctgccccgccccttaccaggctgtgttgacgggggtccgggcgcggggcgctgaccagggtcactgcaccgatctcggccagcagtcgcgcctcctcaggcatcagcagcagtgggaggcccaggcgcgagttctggcggggcccgcggggcagggcgcccaccgtgcggccccccacgcccaggcgctcccgcagcgcctgcacggcctcggccccccacaccagggaacggccgttcgccacctccaccaccagcatcctcctgcgggaggccaggtgcacagcagtcacccacccggcagcacgcctctcgccgcaggattcgcgacgctgggagggcgcccacagcctggccgggggtctcggcgaagccccacccctgaggctcgtggggcggaacctcgctccgagacgcgttcgccacctgctgagcgggagcgctagccccgccccctgggcgccgggctccgcccccgggcgatcccgccaggccccagggctgacccagacgacgccccgccccgagaggagcgctgaggccccgccggggcgtctc

SEQ ID NO: 46842 - DNA, 1515 bp, Bovine  19866880643061
aatacgtgaaccgtgaacttcctgatgttcaagctggttttagaaaagtcagaggaaccagagatcaaattgccaacatccgctggatcatcgaaaaagcaagagagttccagaaaaacatctatttctgctttattgactatgccaaagcctttgactgtgtgaatcacaatgaactgtggaaaattcttcaagagatgggaatacaagaccacctgccctgcctcttgagaaatccggtccattaaaggaccgcaacaaagggacattcaagagaaaggtgatatatgtataaatatggctgatatgcgttgttgtatggcagaaaccaacacaatattgtaattttcccccaattgaaaaataaattaagaaaaaaaacagtgcagccattaagtaaataaatctttaaaaagagaaaaggaaaagaatgaaaaggaaacccacagaatgggagaatgatattttcaccaatcatatatctaataagcgattaatgtcaagaatttataatgaagttctacaacttaaaaaaaaaaaacagaaaatgagtattggggagaaattggaatctttgcacattgtttctgggaatattaaatggtgcagctaccgtggaaaagagtcttgggttttctcaattaaatatagaattactgagaagtgaagtgaagtcgctcagtcatgcctgactctttgcaaccccatggacaagtagcctgcaccaagctcctccatccatgggattttcaaggcaagactactggagtgggttgccatttccttctccaaggaatcttcccaacgcagggatcaaacccaggcctctcacattgtagacagacactttaccttctgagccaccagagaagtcctgtatgacccagtaattccacatctaggtatccacacacacacacacacacacacactggaaagcagggacttgaacagaagacatatgttcaccaatgttcatagcagcattagtcacaaccaaaagtgagaatgacacaaaatatcattggtggatgaacaaacaaacaaaaaggtttagatatataaaatgaaatccttattcgctctttaaaagaactcggaggtgatggtggcaactatggcagtggtcctggttaaagtagtggagaaggctgtggtggtattgggccagaatatggtaaccaaggtgggaggtatggtggcggtggtggaggatatgctgattacaatgaaggaggaaagtttgaaggtaattatgtggtggtggaaactataatgattttgaaaattatcatggacaacagcaatgaaagtatggacccatgaaagggggaagttttggtggaagaagctcatccagtccctatggtggtggttacggatctggtggtggaagtggtggatatggtagcagaaggttctaaatactcagaagaaaagggctacagttcttagctggagagagagcaaggagttgtcaggaaaactgcaggttagtttgagacagtcatccca

SEQ ID NO: 46843 - DNA, 1387 bp, Bovine  19866880899443
agaagcaggactacgcctttgcctgcgagcagatgaagtccatccggcaggacctcacagtgaggcgggggccggggagggggtcggggagggggccgatggggtgatgccggctctgccctgacgtccgctctcctgccatcaggtgcagggtgtgcgcaccgagttcacggtggaggtatacgagacccatgcgcgcatcgctttggagaaggtgaggggcgggcagggccccacctcaccccgggctttcagccgtccccctatccagccgtgtggggctcactctgccccctcacgctgtgccctccagggggaccacgaagagttcaaccagtgccagacgcagctcaagtcgctgtacgccgagaacctgccgggcaacgtgggcgagtttaccgcctaccggatcctctattacatcttcaccaagaactcgggaggtgaggcgcaggaccgcggccccgggctcccaatgcggcccctcaagccccctgaccccgagtctctggccgcagacatcaccacggagctggcatacctgactcgggagctgaaggcggacccttgcgtggcccacgccctggcgctcagggccgcctgggctctgggcaactaccaccgctttttccggctctactcgcacgcgccctgcatgtctggctacctcgtggacaagtttgcagaccgggagcgcaaggctgcgctcaaggcaatgatcaaaacgtatgtaaagctgagctctgccctggccctccgcccctgtgccccgccctggccgagggcgccctgtctcctccccctacctgtgtgctccgccctcttctggacccgcccccttctgcacagccacctctcccccccctgctgctctctgctctcggcagcctggaccccccacatcatcctcttgtccaggcccccttcctccaaggcctcctgcctccctgaccctcctgaggccgagtccccccagaggctgagcgccctgtggggcagcctgcagagccggccccgccctcagtagctgtaggctcagcaaccgggccttgtgccctcctgagagctcagatgagtttacggccaggtgtcatgggcaagcgacgccggacggcccccaaagagggtgccctctgccctgggcaacggtgtgctcacatctgttaggagggaggcgccccaggtgggctcaggacacccctttttttgtcacagccggggttgtcccggcttctagggctggaggccagggatgcactgagtgttgagcggtgcccaggtcacccccagcagggccacctcctgaggtgacaggctgccaagccctgctcagaggtcccaagggccttgggagccacggggcgcagtctgggtggggatgaacacc

SEQ ID NO: 46844 - DNA, 954 bp, Bovine  19866880916307
cacgtgcccgagcccagcagcaccccccccacacaactccgccccagacccccacgtacggagcagatactccgcgctgtcatggtcgtagtccgtgtcctccgggaaatggttgatcttcacgcagacgcctcttttcaaccctggaggggaatggggggcggggggtgatggtggtgggcacttaaccagttggggaactctgggtgagaaaagacaaccccccccctttcctcaaaccccttctctttctgggctgattgggagacaggaaatactggctcctgaacgtggctgcgcacctgggacaaactttcaaactccctggcctcagtttcccaaccaggttttaaaacaaggacaaaggaaaacatccaacactcactaaaaggccacagggacctttgccctgtaacctggacggggacagtctctccggcctctgtttccccctctgtaagaaaggtgttggtttcagtgatgtcaaggacccttcaactcgaaacccgttgaaaatacgtgggaaaacggagaggcgacagaggacgaaaaggactccatttcccgtgtgtgtgtgtgtgtgtgtgtgtgtgtgtgtgttagtcacttagttgtgtccgactctttgtgaccccatggactataatctaccaggctcctcggtccttgggattctccaggcaagaatactggagtgggttgccattcccttctccaggggatcttcccaaccccagggatcgaacccacatctcttaggtctcctgcactgacaggcgggttccttaccactagtaccacaaaaagttggacacaaaagctctgcattggagtccctttctgaccttgccctgtatgtctattcacttggttagtcctttaaaataaaactgcagttgtgagcatagttttttccccaagttctaggattattctaggaagtattcaacctta

SEQ ID NO: 46845 - DNA, 2129 bp, Bovine  19866881030709
acctggggcaatggaacacaagtggacgtctcttccggccttaggtggagctggaggaagcgagagtgcggcgcagggctgcggtgcggaccctgggccaacaagccaggctgtggtcggtgcgcctgctgctcaacctggtggtgctggcgctcctgggggcagccttctacggcatctactgggctaccggggccactgtggacctgcaggtgcagagggccctgggggaggaaaggccctggaacctaccttcccaagggtggaagagactgaagcctgtgattcttggaatctcagagaggaaggattggggtctgtgtgtgtgtgtgtggtggtggtggtgctgaaggaagaagaggcttggggagggtaatggtaggcatggcccctgcaggaccgcggagcctcttctcttggcccaccctccctcctaggacaagcctcttatccagcggacgccagtactgaagctcgtggtggattaccttccgtccatcttcatctccgtggtcaacttcgtgctgccgcctgtgttcaagctcattgcacccctggagggctacaccaggagtcgccagatcgtttttatcctactcaggttctggactcttggcgtgggctgggtctggccgagggacattggttctaccaaataagagactgacatcgtcaagatatgggatccggtgggatctggattcagatcccgactcctcctgtcactgagccccagttttcttcatctgtgaagcggggagaactgtgagcacgctccacacaggagaatccggggcacgtggtgggcgctccatcagtgttgatgccctttttctcttttccacttgccaggacagtgtctctccgcctggtctccctgctagtcctgctcttctctctctggaatgagatcacttgcgggggtgatgcggcaggatgagaggtgcaaaacctgtggctataattacaaagaacttccggggaggatgcggggactcctgggtccttgaaggaaaggaacaacccggtgggtcccagattcttggtttgggaggaaagaggagcttgtggtgctagaataccttccccatgaggacaggggtatggatttttaaaaagaagaaagacccccgcccccccagataaagtattgatagagtctcatactcctgcaatttggagactcagctgtttgggtctatagggtcctgaggtccttctgacctgttcttcgtccctcagtgctgggagacccgcatgggacaggagatgtacaaactcctactgtttgatctgctaaccggcctggcagtcatcctgctctaccagtttcctcggaagtgagaatccctccccttgctgtggtcccgcccctgccctaggcccgcagaccatgcagaccgcccaccctccacgggtctgatagtcaagattattaactccactcaagcccggccccctagacgcacactcccgctgggcctgggaagtttcgccccgcctccagataggctcccttccgattggtgggcgggacggtgaaggcggggaaacccgtggccggcccgcctctgattctgccggtgtcatcctgcccctcaggctgctctgcggcctctgtcccggggcgctgggccgttttgcgaggacccaggagttccaggtgcctgacgaagtgctggggctcatctacgcacagacagtggtctgggtggggagttttttctgccctttactgcctttgctcaacacggtgaagttcctgttgcttttctacttgaagaaggtgagtggtggggagcagccttgggtctgaggcaggggaggtactggggcttgggtttctggattctgggagaagagagtacttaaggatgtgacttccgaatcctggtgggggaggatgccggggtcccggactacgagatcctgatagaggatgggtctggaggacagacccctggatgtgggaggaagggtccagggcatcccaattgttaggtctgagggaaggaggggacccagactcttgtgtctgatggtggaaaagaactggggttcctggctcctgattgaggagagggggccagggattagggctcctggatggtggaggagagtctggggct

SEQ ID NO: 46846 - DNA, 1993 bp, Bovine  19866881378910
catcccagcagccaacacggtggagtcctcgtcacttcgtccactaggaatgatttctttggttcatctaacacctggggccccgaccagacatgggggcagagagccagggaagacttttgtcctagattctgtgctccagcagggaggcagacctgggttgaagcagcccataatttggatgcccaccatgggtatcagacaggcctgggtcccagtgaattcaagttctgggttgtgaccaagttcaggggccacagctccatttcggggggctgggggtaggagtgtagactttgaaggggtgaagcagacccaccatctacaagaaatagctgttggatacacccaagaatctacctgcaacgccagagatgcaggagatgtgggtttgatccctgggtagggaagatttcctggaggagggcatggcaacccactccagtattcgtgcctggagaatcctttgcacagaggagcctgcagggctacagtccatggggtcgcaaagagtcagacacgactgagcgactgtgcatgcgtgcacgtgtagtcatgcatgcatatgagactgtctggcacttgggagtccttcaggggacttggccagttctcccagagggaaaattttgctgttcatggagggtaaacacagaagtgccatctgccctgtgaaaccagtgaggctggagcacgtgagctgtcagtggccacatagggaacctggaggtcagctggagccacggggcccagcttccccttcctggagacagcctgaccctcccacggtccgggaaaggagtgcacagtcagtccccacggaggtccgagcagaggctgccacgaagaaggtggcggctcccttgctactctgcccacgtggggacctttgagaatgctgctatttattgagcatctcccatgggccagcactgtgctgtagcttcccgggctttgtcctctgcagtcagagtgctgatcattaactgatactgaattcttcagtacgctttagagttccctgattcgtgttcaggctaacggttagatgcacccacatgctcggcacactccttggtgctttatgggttctctcagccttacgacagcctcaggaagtaggtgctgctgttctccccaagagttaccaaggggaaaccgaggcacagaagctgtgggcaggcaggaagcggaggggctggcattgcggcccagcccatctgcctgcagacgccaagcccttgggttgtgccctgtgatgctggatgcaggcctgagaacaagtcccgctaagacgctccagcctggggtggaggggctggggctccgagaggctaaatctcagagagtgccagtcacagggctcgtgcatggcttggtgcgggtgcggttatggtgatctgcctcaggccctgtgctctaaatggcgatagtgaccggccccctgtgcacccgtttcagagatgagcttggctgaggcctggagactggccgtcacggagagcacagagatccaggcagaggcgggccctcgtgggggtgctgtcaccttctgccgtgtcccagtccgggaacctggacacccgaaaggctgggttggctgcttctgcctcacccctgttgccccctccccaggtggctggcctatgtcctcctgctgctcctggagctgctggtctgtctcttcaccctcctgggcctggcgaggcagagcaagtggctggtgatcgtgtaagtccgggtggccttcctggaggtggggaacatcacagggcgagatcccacagtgctcttgtgagaagggcccgctgtctttccaaggctcacgctggtttcattcccttgtcccacagacctcagagagttcctagggtggggcaggcacatagggacacagagcagcccaggagggggctggggcagcagactgtccttgtccagggagtgcaacaaagtcccagaaagtaaataacagtaataatgcttgtgctga

SEQ ID NO: 46847 - DNA, 1814 bp, Bovine  19866881517913
aacataagaagcatactgttctgttgaactatgtatagatataaccaggtgcccaatgcttggcattgttagctctgctgctgctgctaagtcgctttagtcgtgtccgattctgcaaccccatagacggcagcccaccaggctcccccttccctgggattctccaggcaagaacactggagtgggttgccatttccttctccaatgcatgaaagtgaaaagtgaaagtgaagtcgctcagtcgtgtccgactcttagcaaccccatggactgcagcctaccaggctcctctgcccatgggattttccaggcaagagtactggagtggggtgccatcgccgtctccgtgttagttctaatccactggaaaccgattcgcagggtttgaataaaccagtcatagataagacgaaaggtacgtactcgtattcagccctattttcttactccataactcctactaaaggctggatccaatgtcttgctccatgtcttgcacaaccctagaaggaagaacagcagcagctctcctgcgggctcacatacacaccttcgaacagacgccgcgggtctttctcatccagcgtcagcagctcccgggcagcctttcggatcttggccagggtgaatttgaccctccagacctcacgtttgttccggagcccatactcgcctgcagaatgagtgaaaaagctcagtcccatggactagtgaaaaaggattagtgacttcgggatacagaaaaacaacagacaatcccaaaactgggtgaggagggtgaacacactggagatttttaaacagaacgagcacgtgggcggcctcacccatgtgtcagcttccccagcccgggaaacagaaacctagccactcaccgatcagcttcagctcttggtcgaggcgggacttctcgaagggtctccgcggggtcacataggttttgcgacaaacccagctccgggcgaccggcatgcggcctctgtttgcccgtctgcgcctgtgcgggaaggagagctgcccgtgaggactcggcagcgcctgcgcagtcccagagctacgctaggaacctccccggcgcctagggaagatatcgcgagaactgttcctgaagagttttataatcgaccatcatttctaccactttccagttacgctcatttcacctccaactgctttagcgtactcattaaaggtcgaatagcccgcaagactttacgacccacacccaaaataccgaacacggccgcatggctcacctaagcgaacgctctggaaaccaagaaagaggagcatgcgctcgccggccgcgttcttatagcaacgtcgcccttttgtgacgtcatcacgcacagcgcaagtttgcaccaatcagaaaaggccttggcgggcggacaaagcagtcaagaggagagattgggctagagtggcttgctaaaccgggaggactgacgagggattagtgctccgtctggtgcgacgtgagggctcctctccgccctcgggtagtgacttaagtcaccactcagctaacgtcagagtcgcggtataaagttggagtagtcaccgccaccgccgctaggcttcattcaacatgctccgtctctctgaaaagatctccagaggattggacctataagaattcaaagctccttccaagatgctctgttatatccatgaataatttttttaaaaatcatttttcatatcaccatgtctacgcaaggcacagccagaagccaatctgcccttttgaacccttcaacagcccctctgttcgtgaaactttgagcctaagggaagagagggaaaataat

SEQ ID NO: 46848 - DNA, 639 bp, Bovine  19866881979497
ccgaggtcccctaccggcctcctctctgtcccccacctgggtccccagccagtctcggtcccctctcattccccctttccaggccaagggcagggaatctgggccagactagctctccctatctctccagccccccttccctcccagccttaaaaatagcaggagaaattgggacggacgccgagggggtgagggcgggggcgcggcccgaggagggagaaccgggtgtccgggcactcacgtccgtctgggggccctttccagcgcctggacactcgaaggtcacaaactcgtggcatcgtcgatgaaccacaaaactgcagactgaaggtgaaaatcatagaaatccagagcagagagagaccccagtggacagaaaatcagaaagaggggagacccagacagaaagaaacccaggtgagagggatctccatagggttcaatacagagaaaatcagagaccttgacaggcagagagagacagatagacactgagagacagagattctaaaggtggacccagacagagaaacagagatgcagagaatcacagaaacagagaaacacagagcgcccagtgcctacacacagccaaagacgagacagagacacagaggcagagacagagagagagagagg

SEQ ID NO: 46849 - DNA, 2380 bp, Bovine  19866880265545
tatattgtcccctgattatttaaattatatgcagagtacatcatgagaaacactgggctggagaaagcacaagctggaatcaagattgccgggagaaatatcaataacctcagatatgcagatgacactacccttatggcagaaagggaagaggaattaaaaagcctcttgatgaaagtgaaaggggagagtgaaaaagttggcttaaagctcaacattcagaaaacgaagatcatgcatctggtcccatcacttcattggaaatagatggggaaacagaggaaacagtgtcagactttatttttctgggcttgaaaatcactgcaaatggtgactgcagccatgaaattaaaagacgcttggtccctggaaggaaagttatgaccaacctagatagcatattaaaaagcagagacattactttgccaacaaaggtccgtctagtcaaggctatggtttttccagtagtcatgtatggatgtgagagttggagtgtgaagaaagctgagcaccgaagaactgatgcttttgaactgtggtgttggagaagattcttaagagtcccgtggactgcaaggaggtccaacctgtacatcttaaaggagatcagtcctgggtattcatttggaaggactgatgctaaagctgaaactccagtactttggccacttcatgcaaagagttgacccattggaaaagactctgatgttggcagggactgggggcaggagaaggggatgacagaggatgagatggctgaatggcatcaccaacttgggggacatgagtttgagtgaactgcaggagttggtgatggacagggaggcctggcgtgctttgattcatggggtcgcaaagagtcggacatgactgagcgactgaactgaactgaagttgtatagtttctctcaaatttcacatacatttcaactattccattctgttgtttagactttgaggattttgcattttgggatagtgagaaattgggaatgaacactgataattaataagcatataacatttcaccatagtagtgtttctcctaatcatgtgttgctttctcctgaaacttgacctgatgaggttcctttttagtctatactgatgactcctgtatcacagatattgcttaggtgttgtttgggaagtaggtatatgtgcttacctgagtttttcctattgagtcaaaaatgaaaattaagtacttactgcctatctcatgatagactaatacttaaatcacaaaattgaacaagatcgaatatgcagttttcattttttcagcgagtgggataaccaaagacaaattcttcagcttattgctttaacttaaataattctgtaatataaagattattaagattaccactttataccttttgtttataactacacttcactctcttaagtgtgtgcatctgtgtgtgtgcttgtgttacatgactgtgatttccccttaaataaatgaagaaaatctgtaaatctcattcctagtttcataaccccaagattaagttctgataggacagctcactacaaaaggactgttttaaaaaactccttaatggttatatgcttaacattgagctgttattgctttgaaaattacactgatccagatgatccaagggaagaaactagtattttaaataatgtgtaaagttgtttgggaactatgtgaaataaagtgagaagattctatttttgaagtcaggcagggtgtatgtaattctaaaatttctttgaaacatgtttcttaaaatttgcagacttctttatttaatattcttatactaaaagcaacacaaattaaattagtgaaaagagtattagtattctgcaaataaaatgccattagttaaggttatttcacattggctcccatataaagcaaagttaactattacaataatataaattatgctagtgttccctagaaagtgctgcacaaattcatataggatcagaaactcaagcagcaagacaaaatagtaatacacctagtctcttaagaggaattattttaaaaaaaaagaaagaaaagactactaatgatgaaatgagagcagcaatattattaatatttaaataaatgattaattatcttatcacataacctagctgaattgagtataagatgaaaatagcaaaatcattttttgaagaatttctcaaatatgattgaattaatatactgtagaatttatatataaaaagagatcataggatcctaatttacccataattaaaatcatttatacattttatcattcttggaataaatgtcattaatgacagaagctggaaagcaaaatactttgtgatccattttttcatctttaaatcaatctttcttagtctaatatctggcacattt

SEQ ID NO: 46850 - DNA, 1320 bp, Bovine  19866880427247
atcttcgttttctgaatgttgagctttaagctaactttttcactctccattttcattttcatcaagaggctttttagttcctcttcactttctgccataagggtggtgtcatctgcatatctgaggttattgatatttctcccggcaatctttattccatcttgtgtttcttccagtccagcatttctcatgatgtactctgaatataagttaaataaacagggtgacaatatacaaccttgacgtactccttctcctatttggaaccagtctgttgttccatgtccagttctaactgttgcttcctgaccttcatacaaatttctcaagaggcaggtcaggtggtctggtattcccatctcttccaaaattttccacaatttattgtgatccacacagtcaaaggctttggcatagtcaataaagcagaaatagatgtttttctggaactccttgctttttccatgatccagcagatgttggcaatttgatttctggttcctctgccttttctaaatccaacttgaacatcaggaagttcacgaagctgaactgaagccagctgaactgaagccaggcttggagaattttgagtattactttgctagcgtgtgagttgagtgcaattgtgtggtagttaagtggacataaaccaaagagaaatatgttgctacagaatctatcttgtttttattattattgttctatttacatgtttgtttgttttgttatgagcagaatcaaggttgacaaccattcattttgctcttgctaagcagtcagctaccaggctgcctacaagcctcctgcccttgtaatctgccaatttaaattgaactaacagatgtgtagtctaagtcacttatacttttattcaagtgaaaataagatataaatcagacacatctaaataaatatggatacagaaatcctcattttattcaaggaaaactttgtaaattgtgtctatgagatgtgaaattgcacacaagttaaagcaaataagcaataatgtctcctccaaatatgagattctatgacttataacatagacagctttatgaagaatgtcatgcattttatctccaccacatctagcatcatgtgtatatagtagtaaaccatatgggcatacattctcagttaaccttcaaccttcaatgaacttcatgtgtgaactttaactttttacactgcctccctgctgctagagatctctcttttatctttaaagaaaatattccatcccctttttaattgtcatgttgctaaattatcactgtctttccaaactccattcacttcttgattcagcttcaa

SEQ ID NO: 46851 - DNA, 1377 bp, Bovine  19866880429951
aatattcaaagtacaatgctcggtggaagagggcgtattatggaataaccgagtaggatagagaaatttttattgaattatagaaacttttttagattatgtcaagtcaaattcatagtatataatctattaattgtgcatttacgttgttacaagttgaagactgttatctttcaagagttaaagctggaacaacaattggagatttctagacatatcttaataagtcctgggtcatgactttagttttatttaattagaagagatagtttggtctgtaaaacatatgtgggagaaataaactactttatagtttttaattttccactacaattatttggcataagttattgggcttctttctcattttgtatatgtgacttaagggaaatctataccaaagcccaggtgtatgctacactgtagaaacaactgtgaaactcaatataagtaaaaatgtgtggttttttttttgtttttttttttttaataaagaagccctagaagagtttctttaacttaactttcctggacatagtcaatgctttacttagtttattctaaattctttcctatattaattaattttcctgtatagggtgttatgcctctttatgcagagatgtcacatgaaaaatgatgtgactttttttaaatgaaaacttaaacactaaatatagaaaactaatgaagctgattatcccatagagttgaacttacatgcccttcaaagagagaactgacctcattattagccgcttataggaagttccaatgaacaaatgcaaatgataaattttcagattttgtatcttggcactgatgcataatcaagttgaagttattttaatcaagtaactgtggatctggaaaacagagcacaattggtaaagttcaaaggaacactttgaaatttcccacatttaaaacctttattaagctcagatctagactaaacagaggaactcattatacagtaatgagtgacatagaactgcatcctaaggaacacttctttattttattatataatgaaataaaagtcactacttaaagctctctggaatgataattttaaaactttgtttcaaaatgtaatgtcttgatcagtatacatatgtgaagtgtactattttaataaattactattatcaataaaggggcctttccttggtggctcagaggtaaagaatccatttgcagacatggattcagaccctggggttggtaagatcctctgcaaagggaaattgcaacccatttcagtactcttgcctggaaaatcccaaggacagaggaatctgatgggctacagttcatgggctcacaagatttggacagaacttagtcactaatccaccaccactaccattatca

SEQ ID NO: 46852 - DNA, 2414 bp, Bovine  19866880467322
tactgttgaagcctagcttggagaactttgacaacgactttactagcttgtgagatgactgcaattgtgcagtagtttgagcattctttgatgttcccaaaaggaatgaaaactgacctttcccagtcctgtggccactgttgagttttccaaattttctggcatactgagtgcaggattttagcagcatcatcttttaggatttgaaatagctcagctggaattccatcacctccactagctttgttcatagtgatgcttcctaaggcccacttgactttgctccacgatgtccagctctaggggagtcatcacaccatcattgtcatctgggtcatgaagatcttttttgtacgattctgtgtattcttgccacctcttcttaatagcttctgcttctcttaggtccgtaccatttctgtcctttattgagcccatctttgcatgaaatgttcccttggtatctttaattttcttgaagagatctctagtctttcccattctattgttgtcctctatttctttgcattgatcacttaggaagtctttcttatctcccctgcatggatatctttccttttctcgcttacctttcacgactcttcttttctcagctatttgtaaggctcttcagacaaccattttgccttttgcgtttctttttcttggggaaggtttagatcaccacctcctgtacaatgttacaagcctccgtctatagttcctgaggcactctatcagatctcattccttgaatctatttatcacttccactgtataatcataagggatttgatttaggtgatagctgaatgacctagtggttttccccttttttcttcaatttggcaataaggagttcatgatctgggccacagtcagctcccagtctttttttttttctgattgtatagagcttctccgcctttggctgcaaagaatataatcaatctgactttggtattgaccatctgatgatgtccatgtgcagagttgttccttgtgttcttggagggtgtgtatatacacacacacagtggaatgctactaaaccagtagaaaagaatgaaaatttgccatttgcagcaacatggatgtacatggagggcattaggctaagtgaagtaagtcagacagagaaagacaaaaactgtctgatatcacttagaggtgggatctaagaaacacaagaaatgggtgactatatataacaaaaaagaagctgactcacagatgtagtgtataaacgagtggttaccagtgggaggaggagaaacagtaggatgggggagtgggaggtgagacagtgttttggctatcacatctggggggtggtacttctagcacctagcgggtggagtttacagccgactcctacagcaaagaataatccaactccaacgtcaataatcccaagatatagaaaaaaatatgcagcgtttaattacaattttctaacattagtaggagctctgagcatagagattagatgtagcttttattttcttcttttttaaatcaaagttttctaagatttctataagaaatgtactttattgttttatttttttttaattttattttatttttaaactttacataattgtattggttttgccaaatatcaaaatgaatccccacaggtatacatgtgttccccatcctgaaccctcctcccttctccctccccataccacccctctgggtcgtcccagtgcaccagccccaagcatccagtatcctgcatctttgaagcagtttatatttctaaactgtattgtaactttggtacaaaatttcttggatttgttatattcttgggaaaagaaagaaacacatgttttctgtctttgacctttagcaatcttagtgaaaattcaactttttaagacagtaagtcaacatacttaccttcacattaacttatatgtactccacctcaagcctgagtgacattacatttctttccagaagattaaatacataaaccttaaaagaccaaaaagattttggtctttacaaccaaaatcttggttgaaaattggacatttggatgtaccttggtttcatactttgttgtcataaaactcaacttgtctagtttggaagtaaaggaaaactttttcctttgtccccaaactttgcagattttccagtgcatcttaatgtttgtctttctctacaccaccccctacactcatactcatccctgggacttttatgttttacaatcactgtaactaaatgacatatgtgaaaactaaagcaaataataactttagtaggaaatatcacaagcaaaaacacttcctttattctgtacctaatgctgtaaccaaaaatttcctcaatccattagtcttcaattcccaaataatatatattcaagacagtaagactcaagtattctcatt

SEQ ID NO: 46853 - DNA, 794 bp, Bovine  19866880504840
cctccagaactgtgagaaatgaatttctgttgctataagccactgtggctaaggtattttgttacagcagcccaaactgactaagacaatttcctaatcctttcattagtgttttgagtttgaattattcttccttctgagggaaagtaagtagtggtctaatgacatccaggctatgtaccagagatggaggagacatccatctctaagatacatggtccctttccattgaggtgtccctaattcgaacccctccctacctctcagctttgaaggattagacaatgaaaactacacacatacacacacatgcaaaaagtccaaggtccaagtcatctgtcatccctcaggatgtgattttcttcgtcatttaactgtcttcccctgaagaacaaattatgctaccctgaaatgaatgctaatcttttagtccacagggaaaaggcaacaaacagccaaatatccgctcatcacaatgagcttagatgaagcaggatttaagctgctcttatatggacaatccatgatctttattagagtttactttgcataattacctcagggaactatgataagcctagagccatttctgagtcttgcattcattgtatgttgctttgcccaaggaagtaaatataaattagaggattctgccaagctccctagattcctgaattatccaccacaaaaagagaagcatagcatcctggaaccctttgggtatctgagaacacactctgacccaaaggagaaatatacagatcatttctctgcctcagaggaaaacagaaagt

SEQ ID NO: 46854 - DNA, 709 bp, Bovine  19866880741305
tggacactacttagcgactaaaccactaccaccactaaaactggcaaaatccaacaaggtaaaggaaacatgtatttaaatccttcatcttctgactactggtattaaaaactagggaaatcttcatgaatatccagccaccttttctccaaatgcacccaggatttgacctggttttgttatgggtctagaaataatgcatgtaatgtgacctcactctgtcttgaatgtgggagtcaataattcaaatattatttccatctcagttcctgtttgcctgctcaccttatttaaagaatggacacaccaaaggcatagatatcttcagtgtcaacttttcttcaaatctagcactaaatgcttgttcaacgtacaaataataaaggtggctagtatcattttaggcttcgattgcttttaatgtgggttggggaaaaacaaactaagatgcaaaaattgattcttaatttattaaaattatcattaagcttccagtatgtagaatgtacagagatattttaaaatgtgcaactggaagtatttttgccacacagagtttatctaagggtactgaaataaaactgcagtttaatgggataaatttatcattaggggatgaataaggccaagggaatcaattcaagcatttggttttcagtatttttctatgcaactggtttcaattcaaaaattattaatagtctcaagg

SEQ ID NO: 46855 - DNA, 751 bp, Bovine  19866880819265
ttggcacagacttaaaatatgattaagatggttagctcttgggaggctttcaacaaatgtttattaattgaataaatgcctaaaaaaatgctgctttttgttttaatgctatgattctgtcattacagaaatgggatggattagaattgaagaggattttttctctatagattatccatacccttatctcatagccacactatataaactcagaaattgaaatttaactatttggtcatatgaaactcaaaaaacatcctaattttatgtagtgaaagcatattataaatataaactttactaatagcatatgatttttcaagaaaatatagtatgctgatctcattaagtttgcaagaaaattcaccaaaatattaaaagggcaaataattgaaaggaataacaaacttgctcagttttatttacaacaattaaaataataaaaatatgaacatagtcttattctaagaaataataaaatcctactaacttggtaattgcccaacttctaacagttttcagttctttatttttgagcaaaaatttcaatttccaaaggcaaaaatctagtttcatattgttaaatgtttccttctgaattcataaaaaataaaaataattttaatatacataactgaaaaatagctactttacagttacaaaaaattattaatttaaaaaaaagctttatcgctgtctgttgctaagccatcagcattttattctgtacttaatttatattctttaatgt

SEQ ID NO: 46856 - DNA, 1098 bp, Bovine  19866880869771
agccgtgactgatggaactttgttggcaagtaatgtctctgcttttgaatatgctatataggttggtcataactttccttccaaggagtaagtgtcttttaatttcatggctgcagtcaccatctgcagtgattttggagctcccaaaaataaagtctgacactgtttccactgtttccccatctatttcccatgcagtgatgggaccagatgccatgatcttagttttctgaatgttgagctttaagccaactttttcactctccactttcactttcatcaagaggcttttgagttcctcttcactttctgccataagggtggtgtcatctgcatatctgaggttattgatatttctcccggcaatcttgattccagcttcttccagcccagtgtttcttgaacattaacttcaaccatacaggacccaaagtactatactccagaaagttatagaggaaaatagatcagttgagtagctataatcctggaaactaagaactctgaatctggctttcattttctctatcctaatgttcaagtcaatttactattttaggattttttattctttaactatagaaagccaaagaactttataaggctattaaacccacctgcttcttggggatgcagtagtagtgtaaagttctttgaaatggcaagtgctaaatggaaaaatatctgatttgatgttctattcctatttcaatgccaaagttcaatgctgtaagttaaggacagaatgaaatcacttgcaataaaatagttgatgcaatttcccaaaactcaactgtgtctccttatatgagatcctttagttactaggatatggaactactacaaaaagaaatgattaccctgtctgttcagaagataggctgacattcttcccttcactttcttttttttttttttttttttgataggtaagaattggatttatttaaaaaggcaatggcaacccactgcagtactcttgcctggcaaatcccatggacggaggggcctggtaggctgcagtccatggggtcgctgggagtcggacacgactgagcgacttcactttcacctttcactttcatgcattggaggagg

SEQ ID NO: 46857 - DNA, 1873 bp, Bovine  19866880871660
cctgtggcttctagagtagaggcataacagagggacaccataactatctgtcaaaaggcatgaaaaattcctagattatttgttaatggctcatataaatgtctaggacttggtcaataaaattggttgagctgttctatgaaatcacacattgcttcaagcttataagaaaatagattaatattatcacaaattctttacatactaccattttaagtgaatacttattcagaaggtgtgtgtgtgtgtgtgtatgcgcaaagttcttcagtcatgtttgattctgtgagaccctatggactacaccccaccaaactcttctgcacatggaatattccaagcaagaatactgaaatgggctgccatttccttctcttataaaaagctttagtttttctgtacattaaatatggtttatatccaaacttgaggtatatttattttgaaaatttgaatatctggaggtaggggtgaggggagggaatatgagtgaaagacattaaaaggtaaaatagaaaataactgcagttgatgcaaaaagacatagaaattttgaatgacatttaaaatagtgatttattatgtgcatatatatattggtatataattaactctattttacttcattttaaaaaaagttaaatgcttttggagcatgaaataaccaaaaagtaaataatacaaaatagctataaaagatggtagtcttgtcatcagtcttgggattgggatatatattaaaattttcctcatttctttatgtttccaaaaagaaaaaaaaacttagtgaatctcttcagacagtatttcagaaaaattcatcagaatctatttcccaggcaaaagctggaaggttagaacaaatcttacttaaacatctccacaattattactgttcactgtgtccaaatcacttgtgcagagacccatattatcaggtttagaagggccaaagtgaatgggaaaatttttggtcatttagttagcttgtcaattagttatcttgcagatatgtatcatcaggctactaagcactcagagctttgtgggttattctcaatttgtctgaaggcatatttcctggcagggatgactaaacctcatggagtcatctttaatgaacttgtgttagtcattcaccacccttttcccacttgtcattaccagaacaagtatgctttgtaaccttcatccaaattttgttttatttttagaagtgccttaaattgaaaattcttggctgaagagtctatggaataagaatatattttactatttatatgtgacgaatttctatggtgaactctaggctttttagaatgagatcactgaaatttccatatcaaaaaatgttccaaataatatagcattctgaatccatatgtggttcaaaagaaatctgcagacagattctttaccactgagtcactggggaagcccctttttattgcttaattctctgcttccctgatagctcagacagtaaagaatgtgcctgcaagtcaggagacccaggttagatccctggtagggaagattcctctggagaaggaaatggcagcccactccattattcttgtgcagaaaattccacagaggagcatggtgggtcccagtctgtggggtcacagaatcagataatacagtgaccaacactttcacttttactccagtcacaatggttttctgcttgctctttagcataccaaggcttcttactgcaacactttgcttggagctcaactcttttcttggagcacaagatatgtgcatgattctccctttgttaatcactctatagtcttgggttcttttcctcatagaatttgacattaactaaaattatcttatttatctattcactattagtttt

SEQ ID NO: 46858 - DNA, 808 bp, Bovine  19866880934061
caggccttcacacttatgaagttatatacatacacacacataaattgtcaaatacctacttgcccatttctgacaaaagatagtaagaatatggagtaataaaaatttaataacaaaaatattttattattttcagaggataatacaaaccaaacattttcagacatagtgatttgggggaagagttttaaacatacactttttttgtttttgtttttaaagaaaaagttgaaatcacagtgcattttagaccttttatcccattagctctttttccaatatttctttggaagaaagtcttaataatgatttctgtactgtactgggaaaaagtaagttctatgatacactgctaatatgatacagctagaatgcttaataccataagtctttcatactatttcttatcacattaacacagggacagcatgtctttcctggccagcttagtttctcattgcctgcagctattggagattcatgaatatttaaaccttgtgaaaataagtgcatgttgactctgtgatatcactcaatagctaagattggctttttttcctccaaaagttggattttctcaagaagattctgtcacctgcagagaagcacaaaacctgagagaaaagcataggcaaggattctctgttctgatattttcttgtgtcatccagtcactacacagagccaataggctgcatactggcagcaaaagcagaggtatgtatgttttatgtttcttcattgccaagtttcttgctgactttcttgcagttgtggatgtagtaatttagcagtttactatgatctc

SEQ ID NO: 46859 - DNA, 1473 bp, Bovine  19866880939225
tgggacagaattcttgtgatgcacaacaccagggggaccaccaggcacatataccacaatgtgaatgggactccttggatttatgtgacacaatggctgtggagtatacacaaagaccatgggtttacaatgctattaaatgcaaatttgctgatgcctccaagtctttgcaactttaaaaacttaccactagagaatgtaacttggtgcagcctctatggagattcctcaagaaatcagaaaaagagctaccatacaatctaggaattacattctggatacttatctgaaggaaaggaaaacactaactagcaaagctatatgcactaccacattcattgcactgttatttacaataaccaagacatggaagcaacctaagagtccactgatgaatgaatgagtaaagaaaatgtggtaaatatatatataatggaatatgattcagccataaaaaaagaaggaaatcttgccatttgtgacaatatggatggatattgagggtattatgctaagcaaataccatatggtcttacttatatgtggaaactgtaaaagagataacaaatgggaatttgctgtatgtctcagggaactcaaacaggggcaccgtatcaacctagaagagtgggatggggagggagatgggaggcagcctcaaaaaggaagggatatatgtatacttatggctgattcattatgaggttggacagaaaacaacaaaattctgtaaagcaattgtctttcaattaaaaaaataaataaatttaaaaactcaagctcatagatacagagaacagattggtggttgccagaggtgagtcaaaatgggtgaggggtcaaaggcacaaattttcagttatacaacaactgagtcctagagacatgcaacatgatgactaataatatatattggtgtttttgaaagttactaaatagtagaccttaaaagttctataataaaaaaagtttgtaactatgaatgttaactaaacatttgtggtgatcactggcaacacatgtatacaaatactgaatcattatactgtacacttgaaactaacatagtgttatattcaatttcacttccattttaaaataataacatatattttaaaaggaaaacttagtactgtgcagtttgcttatggatcaaaagaaaagttttccaagaaaataaaatgaactgatctctcacctcttattctttcctcaataacctgagacagcagagttatcaccaccttatctggaactcctgtgagaaaactgcatcagatgtccccctctaactccgttcctttatgacatatctctttcaaacaacaaaaccagcagttctacccaaagcattgaaggcctggaaaatggattacagctgtcattttgctcgagtagaccaaaagtcaacttccaaatgtagtagtgtttgcaaaaacagtaaattgtggcactaacattcataaaatgtgt

SEQ ID NO: 46860 - DNA, 1800 bp, Bovine  19866880963663
ctacaaatcttacattgtgttcctcctcccttttaatgtaatcctttgcaacatattttataattcaatgagtccttcaagtttcatttttaacattttgttagaacttagcagtcctttatgggtcatgatagtgggtttcccaggtggtcctagtggtaaagaatctgcctgccaatgcaggagttgtgagagatacaggccagattcctgagtcagaaagatcccctggaacaggaaatggcaacccactacagttttcttggctggaaaattccatgaacagaggagactggtgggtacctatagtccacggagcttcaaagagttggacatgactaagcgactaagtacacatgggtaagaataaactctgctattaatggttcctagagataagaccagactctggtaaagctggagataagcttggtgctgatgagggggactgtggtcattatagaaaccagctgtcaggctcacacacatgtcgaaactggttatggcagtgtttgaggcagtgtggtttgaagtcagaacatcaaagcaagtcatatcaagaatggaatgtgctacagagtgctgcccatggcccagcttccagttaactcactaaaggaacagtatcatggtggtataagtggagtggctcagatggtaaagaatctgcctgcaatgcaggagactcaggttcgatccctcagtcaggaagatcccctcgagaaggcaatggctaaccacttcagtattctagactggagaatttcatggacagagaagcctggcaggttacattccatggggtcacaaagagttaggtaagactgagtgactaacactttcacttttcacactttcattggtgtatctaccccctgggaactgtggcttcaattgcaccttctgaaccagtttaactgcacaggtgtttcacattataagtagagcctgaagagtagaattagaattcgtggctaggatgaacaattgttctgttttcctcaggatgagggggtttccaggatgcaaatttcagagttagaattgagatgatgctaggaaaattgtcctggtttcttctagaccaatgaattacctgggggttaactgaccagactggtaaggatcatggcaaaaccaaccagggatatggatgctgtataataactccctgcctcatttttgtccatcaaagtgggtcagcttctttctaatctctttcccttgaggctgttttgtcagaccgtgtggggcttgttttatcttaatgccatggcagaggaagcaggatctgtactattggcttaaccacttcattttatgcagagaagtaacattaatacattagggcatccatctggctggttttcattgccagtacaaaattaccttttgattcatgatgcattttgatctaaaagacacccaccatctaaattttgatcagttctgtgccctcagtctgaatctctcagcaaaaggagaaaataatacctgtagaagaaaatttccacacatatgtttcacctttctcatcccaaatgtaagtctgcataatcaccaataaaactttaataaatattgtctgaagttgtcaggcaaacaagggtgaattcagagtcaggaacaagaatgccaaggcaggaacaaaggtgagggcagattgaaggtggcagtcaaagcaaaggtgagtcacccacggattctgctgtgcatgtttactgtgtgccatggtttctgttgcattttattccacttgctccctgagtggcgctgatgcccgtgaagagtctgctgtgt

SEQ ID NO: 46861 - DNA, 1740 bp, Bovine  19866880976783
aagactcttgagagtcccttggactgaaaggagatcagactagtccatcctaaaggaaatcagttctgaatattcattggaaggactgatgctgaagctgaaactccaatactttggccctgatgcaaagaattgactcatttgaaaaaaccatgacttggaaagattgaaggtgggaggcaaaggggaagacagaggatgagatggttgaatggcatcatcgactcaatgggcatgagtttgagtcaactctaggagttggtgatggatagggaggcttggcatgctggagtccatggggtcacaaaaagtcagacatgactgagtgactcaactgaactgaactggtagttattgaaaatttaacttttgttaatcctaagtttattccttttagtcatgaaacatggccctaatttctattgatcatttctgtaaataatttaggaattttttgttttgttttgtttttaagataagaaaggccattcccaaattttctcaccaagtgtttttacttcagagcatttacaacttctgctgctgctaagtaacttcagtcgtgtccgactctgtgcaaaccagagatggcagcccaccaggtttccctgtctctgggattctcaaggcaagaacactggagtgggttgccatttccttctccaatgcatgaaagtgaaaagtgaaagtgaagatgcccagtcatgtccaactctttggaccccatgaactgcagccttccaggctcctccactcacgggattttccaggcaagagtactggagtggggtgccattgccttctccatttacaacttctagtaattacttatttcatagtattttcacttgcttattatgtttcccacactatgttattagctccataaggataaagttctggatgcctgctattctcataatggattcccagaatctaactatatatttctattttcagaatgaaagaagtaagtaatgaaacatccaagtaatgaaagaagtaagtaatgagtggccacagggtgaagaaaggaatgatggagagagatggaaagtggcacagttgataataaatacacccaagagattccatgatgaaaagtcaatgtcagctctaagtgagagatattggcattgcttgccttctgcttggattggacaagctaaggaaagaagacagagcattggcatgtttgaatatcaacttcctgactgggtgtgctgtttcatttcaaagggcaaattgtgcataaatcatggattgatttttcatttgtttcttttctctccctctctgtgttgttgatgatgatgttttgttttgttcatctctctctattgacattctctagtttttaaaacttccaagtctgccaatcaaccttattgctgcaagttttaatcttttataagctttcatcagttttctggggtcttaataaatgtctgcagagaaaatattagaattcctggcccaatcctgttttaacctgaaatctggatgctgcttcttatggttggaattgctgcagtgttagatttcagttaatgaatttgttctctcataaccacatgccagttacagcaccatgctgtctttttatttaacagcttccacaagcacattattatccacaaatttggaaaacttattttggggggaaccatgaaaaaattctactgggtgaggtgtcattacttgttaccactctttattcattaaacataattgagaatg

SEQ ID NO: 46862 - DNA, 1202 bp, Bovine  19866881031167
gtgaagagttgactcttggaaaagattctgatgctgggagggattgggggcaggaggagaaggggacgacagaggatgagatggctggatggcatcaccgactccatgggcatgagtttgggtaaactccgggagttggggatggacagggaggcctggcatgctgtgattcatgggatcgcaaagagtcggacacgactgagtgactgaactgaactgagatctattaggaagctgaagtagagcaattattgcaatgcttacatctgaattgaggaaattctaagtactatgtatccatctcattaaagctgcttgcagttcagaaacaactaacaaaaaatagaaattaaggtaataaggttttgacccataaaaagatgaatgaaaattatgcattaatgtgcatctgataataattagcaacattcttttataaaatagatgtctatctgctctctacaatgttgtatctgtcttttgccatctcccagaaataaatctttgatttattattgccccgggctaactgaagaaaatgttaagtctcagctttgtgattcatgcatattgactatgcagtcagtgaagaagaaggaaactagagattttgtgaaacaagggccacctgtgttttattttggagctgattaaacgtggtgcaatctatggcaaaattacaacagttatggacttcagtatgcaaggattaaaaaataatcatatttaagagtttataattgtctaataattattttccaagtgtcattatgccttaatttccacacacatcttttggtcatagccacagtactagtgagggcaacatttaaaggaaaagacactattatttctactatggaaaaccttatacaaatgcttaccttttatctaaaaaattatgtctttccttttttttaaacacaaattcgctttaatatagtacaataatgtatgtacaaaatcaggtgttatctgtatttattatgtagcatatagtgctctttattaatgaactagccttacaatagaaaatctaatttttggtattataaactgccgatccccaatctctttggcatgagggaccggtttcatggaagacaatttttccacagactaaggtgagggtaagaatggtttcaggaggattcaaatcattacatttattgtgcctttcatttctatttttattacatcag

SEQ ID NO: 46863 - DNA, 2290 bp, Bovine  19866881172091
agtttttcaaccttttaatttctctaaggaaattctgattcttgcagataaatggttcccagtagtacttttgtactcataccagtgtgtccccaaatagggaggggaaagaaagatttttttaaattagaaattaaactacccatgcacagcatcttaaaatgaaactaatttataccttcaataattttgagttattatatatattccattttagcattttcatcactaagatttcttactttttattttttatgcaagtttgactttactactttttttttgtttgtttgtttaaataatataggtatccctccactcatagatttaacaagggcttataaaatcaatattttaaccttggtaactttgcatcttatcaactgttttgaagtcaacatggctgcctctttttccagggcaaggaaaattagtggtatttagactttctggcaatacatcatttgggggaactccatgtatgctttcaacaaagaatgttaccttatgaaaagttatttctttgtagagttattggtaatttctagggtttttaaaattttttattcatatttaaacactggttcaatcctaaatttctttcttttatttatttatttatttttatttttaaactttacaaaattgtattagttttgccaaatatcaaaatgaatccgccacaggtatacatgtgtttctatttgcttttaaatttgaagagataatttctttggcaaaaagtcaggagagaattaattgcatttacaaatgtatgctgcttgtttttctgttttatgtactaccagtggtgggaggaatagtcattttcctctgtccttttaagttttgttgagacccctcctctgtaataaaaattcagatggattaatcaaagaaatatgcaagctcagtaattatcaatctgttcatcatatcccattgatccatctctgtcttctaacatgctctagttttttcccactagttgccctggcactgaaaaaccctctcccttttgttttcgtgaagttaatttcaaattggattctgtcctctttcctctattacaataactttgtatttcagtcagctcatgccatcataagaaaatgtactgggtggcttacacaatagaaatttatttctcatggctctggaggcttggaagtccaatatcaggggtccagaaagtgagttattgttctggctcacaactggctgtcttcaaccttgtcctcacctggcagaaagaaagagcaagcaagctctctgatgtttcttcttaattcctttttttagggttccatccttatctaaacctaatcacttcccaaagacccatctccaaatatgtcacactgagattagagtttcaaatatgaattgtaggtacttggaataaaattctgttcatggtactttgaataaaatcttatctgtttaattttgttcagttcaatttttgctttgatacagtcaactggcagaagagagtgtttttttttttcccatgggtaaaaataatccttcactacttattcttgatatctcattgagcagagagtaggcaaaggaaagagaggcactgtggttttctcaggcattttatattttccaaaggtcaggcaattcttgactaaaattatgaagaaaaattttctttgatgaccattcatctctcctctttattctgctcttctgttgtattcactccaagggcagggaggtgagaagtcagggtagacctcccggaaataatggcatttatgtataacaacaatgggagaacaggagcagagtttaggggtaacaaaacagctggtataaggaagaggcatgaactcatagtgataacagcaataacaaagtgttacatttatttaatttctactatgtgccagctttgattctaaacacttgatatgtattaattaatttaactgtcatagcaaccttactaggtagatcctataattttccctattttacacataaagaaattaagctactggcaagttaaaaaggttgcttatggtcataaactaataaatgatagagctggggtttaaattcaggcattactgtccatgcattgaatctcaaaactgtcactaaatatatgtcatctctctttagagagcatgcatgctcagtctcagtcatgtctgacactttgtgaccctttggactgtagcctatcaggctcctctgtccatggaattttttaggcaaaaatattggaacaggatgtcatttccttttctaggggaacttcccataccagggg

SEQ ID NO: 46864 - DNA, 1146 bp, Bovine  19866881283028
agctctattcagagcattatacacttgtgtggaccctaaaaattttatttaccatccagacttgaatcaggttcagcaatttaaaataatggaaacagtgatgacacaaatagattagctctgggtcaccccacctgtttaggaagcttcaggactcttccacaccaaagaagaagccttcatggctgagaaaattattttccctgataacatcaattttagttgggttgcccagcagactgaatgctgcctttttggttagttgtttggcttatgcagtggttctttaatgtttgcagtttgtatgatattagccaggctcatgttctccagttccccatagatctcactattacacagagccataagacactttctcaggacaagggggcattttattttataatttttcatgcaaagggtttgaataaaattagtgtttccttggacactatgagaatatcttgggatctattttaaaggggaacgagataacgggattaatatttattgagctgctactttctacctcatagtttatttgtatattattatttcatttaaaggagaaggaaatggcaacccactccagtgttcttgcctggagaatcccagggacgggggagcctggtgggctgccgtctatggggtcgcacagagtcggacacgactgaagcaacttagcagcagcagcagcacttcatttaaaacccacaaaaaattttgaataagaccgttatcttccattttacaaatgaacagactaacattgtacaaatagcccccctatacttagcagaatgtatatggagaatgatctttgaatattgtttctagaattttcctttcttcagcctctgactcatagggtttatgggatccacagacagttgcatgccaatcgtgttaaatgaaaattgacattaaataccaataatgtgagaaacgaaaatatcattttgaaactagaacgcaatacaatggatttttccttcttttcttgaacaaaacactcactgatttcaagggcacttttgtggttgatgaaaatctgggaggtaatttcctagcccttgattatgagttaggtatgtgtgggggggggggggtatatatatatatatatatatatatatatatatatat

SEQ ID NO: 46865 - DNA, 1276 bp, Bovine  19866881372654
tgtttctcctctctgtatttacaattttgttctgcaggttagcatggcatgacacctgcttactcttgttagcctctcacagaaaaacatcatcctgtaatcttgctcttgtctctttttcatttcatatataaatattatgcccagtcggcctggagtagcaggagtataagcaagaatatattcttgttccaaatcactcaatgctattttgactggagggactttaattttctcatgtatggtattatgaaatataccacacagattaattatctaaaccaatagtcttagtgagattattcagcatctttgttattctgaaaaatatccacaatattatatatatgatacttcatagataaactctgaagtgaagaaagtgaagtcgctcagtcatgtcctactctttgcaacctcatggactgtagactaccacccccctccatccgtaggattctccaggcaggagtacttggagtgggctgccatttctttctccagaggatcttcccaacccagggatcgaaccctgggtcttccgcattgtaggcagacactttaccatcttaccaccaggagagtcataacaatagatacatgatacttcacagataaactctaattagactaattacaatgcagggggaaaacagcctttggtttttaagtgcctaataaaattgagcattccaaatgcacacattaggctttggttaaacaacaagtctctctgtcaggttatttacagagaccaaaagaaacagccttcctcagatagttcctttggcataattctccaacttggacacaaacatgtaatggctaaacttaaaatttaaacaaggggagaagcaaaacaaattcatttctatgtttatagaccaagctaatttttcttaattatcttggacaagattaatcaaataaagtcactattttatactatgaagaaccttacctatctatataaagacaggcttgggttgaattagggagaagtacaagaagaacatcagtagatttttataagctgctccaagaaagctatagagcttgggaagttgtatatatcaccttgaaagtaataggacactatctggaaagagagagaaaaaagaaaaggaaaataacagatgacatacaacagtgatacggctgatgatgatcctgtgatttcaaaatcttctttttagtgactgtattatcagtcatgctgactatgcattaattgaatattagtcatactggtcatagaactaactagtaaacccag

SEQ ID NO: 46866 - DNA, 1300 bp, Bovine  19866881598596
ttgaaatctgattataaattgagtgaatcagtattgtgaaatgtttaaggaaattcagttatttttctcctaattatatatatatatatttggagtgaaacatcaagtatgtaaaggatccatatttatttttcaccttctatcccctctttcctttcttgggatattaatctttatgctagcagctccatcagggaatttttcagatgaaagaagaggtattggaatttagagaagtccaattttatttgttaataagaaggaggttgaaagtaatggttaaaattggatttttaaactaacagtgtatataatttattccatcatgcaagtttcccatttgccttctctttattgcaggtaattgagaattagtcatgtttgttatttttagcactccattttttgtcagaaatggaaacaaaattacaaaaggaggtaaagaaaaactatcaaaaatattaaaaaaaaaaaaaaacccaacatttctgattcaggaaaccttggaaaataattgttaagatgctatttgttttatcatcaatgcttgattttgaggaactgaatttttaaagcttagggatagcacatgttacttatttttttcttccttaaccctgaaattctgcctattaacacaaactatgtttttcagaaagcaaaatattctagatgcatttaaaactttgataatcagtaagttaaggttagtctgggaaaaatgagaaagaaaaaaaagacagttttatactccaaaataccttcaaaatgaatagaacttctaatgctatttctttgtaatgatttaaattcacatacagggtgttcacctgaagggcattttaagtttgagttataatgcattagtcatccttgaaaacccaggcaattcatatacacaaatacagaattccctaaacataatttttgttcacatctcatttatatatgcttgtgggaattattccttgttaaaatgcagattatcaaattcttgactaacaaaagaaatcaccctgtcattttatactgaaagatgtcaatgcaaagtactgttttattttgtcttttcaaaatacaggtttggcttttaatttcaaatacttagtgatgctaggattcatatttccataatgagaagaagaaaaaaaaagttaaattttaagcttcactatgccagttaacttcccaggtgaccctagtggtaaggaccctggtctgtcattgcaggagatataagaatattcttgcctggaaatcccaaggacagaggagcctggcaggctacagttcatgaggt

SEQ ID NO: 46867 - DNA, 835 bp, Bovine  19866880264231
ttgctcagtcgtgtctgactgtttgcgaccccatgaatcgtagcacgccaggcctccctgtccatcaccatctcccagagttcactcagactcatgtccatcaagtcagtgatgccatccagccatctcatcctctgtcgtccccttgtcttcctgcccccaatccctcccagcatcagactcttttccaatgagtcaactcttcgcatgaggtggccaaagtattggcatcagtccttccaatgaacacccaggactgatcttctttaggatggaccggttggatctccttgcagtccaagggactctcaagagtcttctccaacaccacagttcaaaagcatccattcttcggcgctcagctttcttcacagtccaactctcacatccatacatgaccacaggaaaaaccatagccttgactagacagacctttgttggcaaagtaatgtctctgttttttaatatactatctaggttggtcataactttccttccaaggagcaagcgtcttttaatttcatggctgaaatcaccatctgcagtgattttggagcccccaaaaatagtatgacactgtttccactgtttccccacctatttcccatgataaatctaatctaactcccaagataaattagacctcctcaaatagagcgaagtgaagaccatggccgtttcagatatctttggcaagatatctttgcattggcaaaaactaggtatccttagagaatgctaattatgggaaacaattactcgacaagttgcccttcattttaactgtcagggtaacaatgtaaagaaaacataaaacttccagtctctaccagtt

SEQ ID NO: 46868 - DNA, 669 bp, Bovine  19866880456568
tggtatattattagtttcgagtttgctaatccttattttatgagatttaattttcatgacgtttacttttccattcagcctattgtcagaaaaaaagaatgctttttgtgttcattgaaaagataggccagagactaatgaatgtgtgatctgcccttgctcagataaatgttgtagttataagaagtcatggcagggcgtgggggcccttctgtttaccatgataaaattaataccttacagactttctgagtagtttgtaagatgtcaaagatttatttttaatataattgcaaagttggaaagctaagaaccatgaagcctaattcttgataaattcactgtcagtaatgccatattcagaacacaactacatattcggcaagaatattattccataatattttattatcactctgagactgtacattataatttgcaaattattgaaaatatacctgaagataagaatcctctttgaaagtatgtggaactttttgtgtgattatttagtgttctgtcttatttcttgattactatggtagggaattgtagtctatgtggttttataaaaataaagcaaatcacagagttactgagctagaagatgctctgagattgtctatgaaacctgggttccctttttaaaggtctctggggatgggattg

SEQ ID NO: 46869 - DNA, 4527 bp, Bovine  19866880532831
gggtggtggggtgggggctggtgctcttcggccacttctaggactcacctctcagacccaggacgcatctgtatcatggcggatttcacgtcggtatcaggcaggagccagagcatgcacttacctctttattacaagtgcagttgacagtaaattaggagggaaagacacaagctttgcaaatctcctttgaaaggatttggggatcagagacacgggacagctgaaatcacctgaggcttagcgtcacaaagcgggaagttctgttctgttcgcagaggtggggacggggggcactgttccacaggaactgctggaccctggacgcttctggctgctatgcagatgaggcccaggcaaaaccaacaatgaggtttaattagcatgaagatcttcctttggatgcttaggagggagaacatatagtgaatgacagcatttttcttttttagtcttatgaggttgatcaccaatttaataactagattccaataagaaatgacaggtctgaggacccttttatttttttcttttcagaaatgctttctaatatgttgctatcgttaactgggaccttttcctcaacagtgtagatctcaccaacattttcagtaacagtacagaatcttgaagccctctgagccacttccaaccaacttgaacttgaaggtctatgggaagaccacagccactggggcactctggggttgagagtcggatgggctgaagactgagctagcaggcaaggactggtagttttgtgtttagaacttgaaaaataaaactgctgttcagctcatttcctggcagatttgccttttggaagttgtttcctcggtttcttttctttctcatgccagtgccctttcctgcctttatagaatgatgtcgttaatgaatgctgtgcaaagttgagactcctgaagacggttcaaatgaaggatcaatgacagtgacaaatcttccattaaggattttttttttttttttttaaaaagctatatttgttggaaacccagcagagtttcccatctagaaaatgcaatgatagacaccgagaacaaagttatgggatgcacacattagggtgccaacatgcataacttaagtcacgaatagaagattctatgacatcctaccaacaagtttcacaattaaagtaactcatggcacctctgagaccatgtggacaggtggctggggtgataggaagtgaccctctgcccaagatgacagagaaaacaagagaaggcacaggcagaaaggcaagacattgaactcgagactgaatggggcacgggccccaccggagagagggctgagagccctgaacccagatctgtgtcatctgcaggacagctcagtgatgtggtcgagattttgccttgggaaagtctggtctgaaaataggagacttaagttttttgctgtggtctatagcttgaccctcgcttagtgcataattgttgtatactagttacaataagccagttttataaaactagatatccagaggaaaattcttatcaagcccttataacgtcagggatccagttatagttcagactgactcacaccccctaggaatctattgataataactctggccctcctggtaataagaaaacatgatgatgcaaatgtaaattttgttcggcattagtatcacaaggggcatgagattcactgtgaagccagactcacaattataacattgtctatctgaaagattcttttttcagccaccttcattcatgtgtcctggccttcactctgaaatgatgcgctggaaaccatttggctacattaggctaccctgaaaacctcttaagagaaagtgttcgctccactggtaaactgcttcgaggctatacacacagcctggggctgagtgaaggtgactgatccatgggattctccaggcaagaatactggagctggttgccatgcccttctccaggggatcttcccgacccagggatcgaatccaagcctcctgcattgcaggcagcttctttactctctgagccgccagggaagtcctacagatcccagggcagtggacatcctggtctcagagatctagtctggctgatgctgaggctcctggaggttcacttgcagaggtcaagtgcacctccgggaacccagtgctgccacggtcttccagttgcttcaagtgtgatcgaatagactggcttgcagtggccacctgtgagtgtttgcctcctcccaccctacttggcgattttaagttcctcaaaacatgaactatttttttttttgcccttgatgtctgatttaaataacgagggtggtattcattgctttgcttagcgatgtctgctgggacataaggaagcatggttttgcttagcgggagggtggggcagacgcccctactccttcactcagctgtgcctgctggttcgagccacccatgctgggcaccggagaaagcccctgacctggccccgtgcatcccaacagttgcccagacctcacattttaagccctgggccagccctcaactgtcagtggaatggaggttgctgcaggtaccgtgggagctcctgcactttcccgccaaaaggcaggatcttcccaggtccctcctctaactccagcctgggggggacccggagacagggtgggaggggacagcgcctcttctcccccatctgccctactgctgcagggctgtttctaccaggtctgggagagcatggaggccccgggccagctctggatctcccggcttgcagctgacaaccccaggcagccggggatcaaggctcctttgcgtcaggttatttgtccttttgctccctagtgtcagcagtcctgggaacaggaaacagttttgtgcaatgggaagtgacaggaaactggtgaccgacgacttttgagctttgcagatacagtttcaacgtgcacggagatactgacacacattccgagacacatgtgcatggataaataagagctaaatctagaccttactctgctcaggttttaaggtggtgctgtttattgacagcttcctgtgctcttgggactctgctaggcccttcagtccttcacagaatcctgacaacttccctgggttccacggtccgcttttacaggggagaagagagtccgaggcagctgacgtagtcgctgctaagtgccaggacgtcctcggctcctggtctagacgcctgtcctcagctgcctcctctaagggctggcaaacttcaggctgaatgttctggggcgtgttgcactgcataggggtgaaagaattcctccaaatcatccgtgagaagagcgttcccgtggctcggcaggtcactccatggccgggcaaggtattgtgatttcgtatgttcactgtgaagaaggaagtacttctcaggcccccactggcatcgtcttgggtctagagatgaaaggcctctatacccccaccaggcccggagctcacagcccagacagggagatggccagctcctcccattctgcttggtgtccgctctgaagctccagctgagtggccaggccgtggtgattaagtgaaagcatgccttcctggaatcaggccctacacaggctgaaatgcagagacctggtcagctgcgggggaggagaaagtcaagtccggccatcggtcctggaggtcaaggagcctggtgcagggaaggccctggggcttccactcaccagcagccaggcggctggagaggaggctggtccccagggtgggtggtggatcactgctggcctgtccactgatgggacagcttatgagagtgcctctgaaccccgtgaacccgagtctttcttccctttcctcatttcacaatttaacagtttcgtgttctcgattccctccttatattctctctgccttcctgacagcattacctggatggggagatgacggaagccccgcccactgtgtgccaccaagccggccggcaacttcctgctcccacttcattccagacgcagctagaaactggttttagaacttcggggacaaaacatgttactcagttcactacgctatgttttatttccacctagaaatgatgcctcctgccagtggatatgaagaaaatgtcactgtaattaatgccagttaatcaagctggtggcccttgaagatctataaaagggagctgagacacagttttacacgtgggatttgaatagagtatttaggaaacagtaaatgctgtcatcatcagcctgactttggacagtttagccagggtatgtgaaatggccctataggactggggagaaagccaggcagccgtacttcttttggtgggaaatataaagagttcaccataaagaggatgagtcatcatttttaatctctggaaacctgtttctgcaagcattatttggtgaaaagtagaaaataagactgaagactttggtatttcattgtaacccagtaaatatgatttctagaaatcttctaattttggatatgtgctcaaagaacttatgcatattttagacaaaagaact

SEQ ID NO: 46870 - DNA, 1304 bp, Bovine  19866880578323
gatgtgaatgacctgccctcttccccccacctccaaaaacagtatttctgcacacagtaaacaaaaatctctagcaacaccagcagacaaaagttgacagaaccatattccacaaaggaggtttgacttaggctggggctgtcaaataatttttccccctttagctctcaaatggttttctttaaaggaaaagcgtttcacaaagcccgaagatataaacaacactcttacctcaaaactggtccccaacggtgtgtgcagctaactgctcaacaacttagaaccagcaaacttatttatgaacttctacgaacttccttcaagagaggacccgtttcggaaagaaaccatcccgcccttgtcccttcgcgtccagagaccatcttactttgccacagaaggagcaggtatacttggcgtgctggctgatttcaattttcttcaccattttcctgagggaggcaccataacgggtcccgtatttgcccacgattccgaccttcttggtgcgtttagcctgttaagaatgagttaagacagaaaacagagatattacaactctggaacggggacttcgcctctccatcaagttccggcgcctccacacgcctttcttctacctgcccacctagctctcccactctccccaccctatccccgtaaacccagggcccacggtgggcctggtgccccgggagcacccggtgaacccagactggacgcgccagcccccgccaaaccgccctaatgtgcatcccagaggacaggcgagggtacgcaggccagagcgggcgagcagagacaagttagggcaaataaaccaaaaaaaggggcagatgcaagcggatagacgtttaggcctcatcctgaacaacactcaccatgttaacgcaacctagatccgagcccaagaggaagctggaaagtgcgcaggcgcggttttaggccgacaccaggaagtggtgtatgcgaggcccagataggaactgaactctatggtctggaggttttctcactccggtgcctccagggtagtgtggtcggaagcctctctgacagagatacggtgatttacaaattgtagcgacaaactgtgtagcagaagctctctcacatatcgacattatcgttcatgtatctcacgaaatcctgcaaaggaggtacgatttcctccatttatagacaagattcagattttaagtaatttgctcactcattggcacttagagaagtgcttaaaatatgatttcagatctcaccgctttctacattatgccttctagtagcggcaagccctgtggttg

SEQ ID NO: 46871 - DNA, 1765 bp, Bovine  19866880603363
attattgaagactattaaaaaaataaaaaggaaagcattaacagatcttaagacctggcaatcctttgcatttagtattaagccccctgagtgaaggaagcaattataacacagaattctgcagagaagagcagctttggacacagaccccatgtctcagaggaagaggacaggagctaattcagaacctgcatgaggaaaaaaaataatgtatagaataaaaaagaaggtatttcccccatcacttttggctaagggtttaaaaaatcttcagtgacaatggatgggggaggtccgaacaccacactaccccaggagctacagctgaaagactttcagttggtatgcgcctgtgggtgtgtgtgtgtgtacatgagcgtcaacctgtgcagatgccacaccccacttcttccctcggttgccagatgcttgtgggagagttctgactggcctctctccatactgaaacaatctaatctgattactatatttggggtgcagggggtttatctggcagagatttaggaaaggaaataaggaggcttccggccaaggtcacattttgacaggagtgaaatttgacgatggttgctctaatgactacccggcacttagtttactatttatctactgctctctcatgttcagaccctttggctgaaaattctaatagaaagatggacgagtaataaattcacgcctccaagccctagcccaaagccataactaatatagggaaataagaaattacactccaatagcacagaatgagaggtgaattggcagataaagtctgagaggagagattacagcagcttgtcttattaataaaaattcttaaaggtaacaacattttcaagggcagtggaagcaaaattaaaaaaaaaaaaattctctgaactatttgacaaccaagccttcacctgagcatttttttcagtccctcatgtatggcttgatttgtctgatttagaatacaaaacaagtgtgaaacagtccattccaatattgagtttatgcaaatccttaaaataatcaatatcgctaataggaggtctaacgtgaaagtgcaccagcaggagcaccactcatttgtaagcaataaaatctgtttctagcttggtttcgttcatcagaaagaaggtaactcgagttacgagaagtctaagtgtggtgagccggctctgctgtctgcgactgactgctgctgctgcgtgcacgctcagccatgtccgactcgttgccaccccatgggctgtggcccgccaggcttctctgtccacggatttctcaggcaataatactggcatgggttgctatttccagatccaggggatcttcccaatagtgggcaataacatgctggctaacctttcttttcacgcacagtgtttggccaacatatcaaagtgctttaaatgtggcctaataatcacatgttagtcactgaaagttttggcgccaaattgggtgttaagccagttagtatctaggagaacattcagcttaacattcagttagaagttagcgttaactcttcacaggttgattataatgaaatttagcacgttttggctttagtgcatttaatggcattcagttagaactgggtatggaaaaacagactggttccaaatggggaaatcaggaaaggagtacatcaaggctgtacattgtcactctgcttatttaacttaatgcagactacgtcatgtgaaatgctgggcggataagcacaagcggaatcaagatgccaggagaaata

SEQ ID NO: 46872 - DNA, 1064 bp, Bovine  19866880747002
taaacaaaaaaagactgttcatagtccacagtcaaaatataaaggttaacttggcataaaattaaaatgctcactctaaagcattcaagttttaatcaaccaaacaaaatctagaacccagaaatccccaatgtgtaaccgagcaaataaatattctcaaactgaccaggaaatttgtttaacgcttttgaaaaatatttcaaaataaaattgctactcattcaaaacttccaattatcagaagatacaactactgtcagtaagtacaatatcttgattaaactaatcactgaaatgaaatttagttttaaataaatttaaaaagaattcctcagccaatcatatggacaaaggaaattataattcctaaccacaaacaagtagattaatttgttttggacaatgataggccacaaaggagtaaaggacaacttgccaaattgaaaatccaatccagcacagataaaaacgtgatgaacttcagaaaccagtatttttaagtcaaattaagtttataataaggctaacaattacaggaagcagcttattccacactaaggaataacccccttccctccctgtttgtactggtctgataaaaaacaatcaaacttcctagtcattatgctgtccctttttaaacatcctagctactatacaggagcattctttatgctggggagttgaaaaggctaaaactcaacagagactgagacagagatgaagtaaaccataataaaaataaaaaatatatattacttagactgtttcctcctcaaccagtggtttacaacatttaaaactcaaacgattactatttccaaacagagagaaacgaacaaaccaacctttgttagaaataatggacataactggaattctagatttagaagattaaaaattatcatgccagagattagaaccaacttcaattaccatttagagatttcagaccaacataacactacaaatctttcaaaactagtcagagaaactcagaattatttacttcaaatagtacaaatgaggagaaaacatttgcaaactttttataatctcctatg

SEQ ID NO: 46873 - DNA, 1168 bp, Bovine  19866880764574
tttagaaataatcctgctagtttttatttaaagactgatgggaagtttgtttgagattgcactgaattctgtagatcaacttaggggacagttgccagttccaatccatgaatatggtatattttcagttatttagttcttatccgaattttctctggaatgctttctgatttttggtgcatagtcatgaatgtgttttgttattcctccatattttgtaatttttacattaatttaagtaaaagataaaattttattttccaatattttgaagctaatatattagaatataagaacttatatattaaatcttatttatttccttctgtttgcattttatatgctgaaatacattgaatgatttccagtgttaaaccaaccttgcattcttgaaatgaacccaatttgttcataatgtattactctcttcatatattacagtattgttttcttagtttgttaagaatttttgtgactatcttatgagaaaatctatagttgtctctctctgaaacatttttcgccagattttggtattatgttatactagcctcctaaaacttgttgggcagtgattgttccttctctgttttctaaaaatattcatgtaagtttggtattatttttcattcagagtttgataaaactcagcagtgaaactgtctatgcctggggttttctttttaggaaaagctttcataactcagattttctgttcactcacagacaatcatgataacttgtattattaacatctgcttcatccaacttgtccattttttttgagataacaaaacatcctgaaaatacatagaaatggaatatatttttatttgtaggcttccacttctgtgtaatcattcttgtaatctttaggaccgtatgccattctttaaatggtaaatgtattgacaaggtgcaaattttgtgctgactagttatgtaagtgatttaatacgatgatcagtcttttaaacacagacacacaaactattacttttccttgtcattttgttagactctgtaatacagtactttttagactagcagatattccaaattaataatgatcaataaattagaaatcaatttgctcctcattgtagaaggaagccagttgtcataggtattatttattaatctttctggattaaattcattaagaaat

SEQ ID NO: 46874 - DNA, 1187 bp, Bovine  19866880774723
ttacttaggacaccatcgtccaagaacaaaaccacctattatttaaggttctgctgttactaaacagcactgcaactttacaatattcaatcgacttgctttcaacttttcctggtttaattaaatccttcaacactccatataaaaacaatgatcatttctatctgccgcacctatagcatttggttccccgggaggagctttgaaatacccactagcattccactaacacaactgtgcaaatgaatcttcccaatttcattcaaaattagcactaaaagaacagggctcagggcacaagtgtgaagggacagtcatagggcttggtggtgtagggtgagctcactgagtgaggcctaaccctcccctggggaagttagggctgcaaccctttgggtctaagcataacgctggaaaggcattatacaggctcccagccccgagtggcagctcaaactctggaaatccacccacagcgggtgcagggcttcccagatggctcggtgataacccgcctgccaatgcagaagatgcaggttcagtctcagggttgagaagatcccctgggccaagaaatggcaacctactccagtatttttgcctgggaaatcccatggacagaggagtctggtggacttcagtccattggattgcaagagtcagacatgacttagcaactacacgacaacaccagcatcagccagccagccctaaaacagtaggaaacgagcaggaggccatgggctgatctacgtggatatcagagtccttacaaggaggcctgggtgcagggagaagcccaatcacagatcaaaacggctgtaattccacacctgtacagctcaagcaggcaacgtgctgtctacatgttcctggggaggtcacactggcaccatcttaaacaactctttcattgctcatctttactaataaattagcttcctatgtgcctaagaacgggtcacaagaattaccatcccttcccaccagaaagaatatatatggcttccctagtgaatccgatggtaaagaatatgcctgcaatgcaggagtcgtgggttccatccctaggttggaaaggtcttctggagaagggaatggctacccaccccagtattcttgcctggagaactccaggggcaagggagcctggtgggctagagtccattaggttgcagagtcagata

SEQ ID NO: 46875 - DNA, 1865 bp, Bovine  19866880783041
ttccagtccagagcaaaccccaagctgggagagaggagaatacttgaaaggtagagggagtttccagttttgatcagttctattaaaagggattcgaagcactggaattacgcgtgtgactcaaaagtgcctgaggaacctctgaagtgagtggaataacacgggccttgctgagttttatgcagtgtcagggcaaggctctcccactgaaggaggctttaaaaaattttctttggtctccaacctgctttgaaatttgccttttaattatgtcatgaataacaaatattcagtgcaacaattacactggtgacatttttatttttctctgcagtgcccacatagagacccctaaaaagccattctttggctctcctgaaagattttcatataatggaaaacgagaatgagaccttaattatccgcaaatccagaacaggtgatatttacgtgacttaaaaagtacaaagtatgatccggccgaatataggagattccttaaattaaagctttaaaaatcattatatgctttcttggtccaattaagtaaaactttctgttgcataaacagaaaagaaccctttttttcccccctcttggattagtatttgcatgcttgctcaccggggatccattgtgagtttttgtatacattcaagcatattacacagatatctggaggcatatctcaaaggccgtagctgaactggtggaatctcctgctcaggaaggtgccagtgatcagtggggggctaaggactgggaaccagctggcatcagatccctcagtccgtaggtctctgtggagtactcagagggggcccggtggctacaacacacactgcaaacagagctcagccgataggttaacaagtggccggttgtccccgctgtctccctgcctctgggcaggccaggaaatagaatccagccggcctgagagaggtcaggaagacctacagaggaggacgctgttctccatgtcagagcgggatcccggaaggttcctgggaggccggctgtctcctcggagtcttcagcctgggctgaggctgggtctcttgaggtcaaggaccagggtgtgggccacggggcccattcgagtgagcaggcagtggggcacgggtggcccctcagttccagccccccgtcaagcctttctttccgcacaacctgcggccctcttttgttgttcagtcgcaaagtcgtgtctgagtcttggcaaccccatggactgcagcacaccaggcttccctgtgtatcaccatctcccagagtttgcacaaaatcatgtccatttgagtccatgatgccatccaaccatctcatcctccacttcagtttagaagtgatgaatggaaattgatttttttatgattaactaaaaatgcacattgttcttgatccagtaaacttgcctttgatccaggactatcaagatgtgcctgggtgctgactttgtctgcagttcagagttcttctgacagtctgatccctttaggtgaacttacatggtgggagcagtggtgggactagaatgatggagcaaatgcaggatgaaacctggagactaagcgttgttaacattcatacagagaaactacaaacacaaaagctatttagacactgaaagcagtgtctgtcttggaaagaggctccatcggggcaggcagttcctgatggatctctggtttcccaaggcaaagccctttgattaaatacttctgcctgcttctgaagtgaactgaggggtccaaaggaggaatgagaactatcttctgggggagggagagctggacagtaaaagtttatctctgatggaatatctctgcaagcaggaactattagcatctagaaaacaaatt

SEQ ID NO: 46876 - DNA, 2525 bp, Bovine  19866880912555
ttgtgaggattaaatgagtcggctcgtgtgacacttctggcactgcgtgaacatttgatgaatgctcgccattatcgttggtgtgactgaaagcatggctgggtggagactgacccctggctcagagcacagttttagatcctgtatgtaaaggcgagcaggtgggctttcctggagtcgaggggcatgtcgaggacggggtgaacgagtctgtctgggagctctctgtggtgtagcagtggctgttctctttgtcacacgtgaaatcctaggtttttttttaggatcttggtgggttaattcaacactgctaggggataaggctgaatctctattttgcgtttagaaggctggggaataaaatgacactaagaactggcaagcaaacagcaaaacagaaccagggaggcgcagcttggggagcacgctccaagagggcggaatacattatggtcagtatgcattctgtgggtcatggatagtgatgagatttaaattcatctccagaatctctgtggcattgcaaagaatggggagactcacgaataaggcgtagggagagactataaaaggcagctcgttaaatccctgatttcagtggggatgacagacaacctccctatttcatgtttcgaaactactgctagttttaaagctatcatgaaatctctttgcttattttttttttcatctcaaaatagtccaagtgaaaaaatatcctcctcttgcatttgaaaggagagctataaacaggagcagtgttccaactagtcatcttctgaaacagtgatgtgtccaaagccttaatacttgagactttctctgtaggtgctatttatagactcattttaatattatagtaattatatgttatactatatggttatattaaaaagctgaggcattacttcaccaacaaaggtccatctagtcaaggctatggttttcccagtagtcatgtatgaatgtgagagttggagaattgatgcttttgaactgtggtgttggagaagactcttgagagtcccctggactgcaaggagatccaaccagcatcctaaaggaaatcagtcctaaatattcattggaaggactgatgttgaagctgaaactccaatactttggtcacctgatgcaaagagctgactcatttgaaaagaccctgacactggcaaagattgaaggtgggaggagaaggggacaacagaggatgagatggttggatggcatcatcactcaatggacatgagtttgagtaatctccgggagttggtgatggacagggaagcctggcgtgctgcagtccatggggttgcaaagagtcggatatgactgagcaaactgaactgaactgatagttatattatctagaatacacattttcaatctatttaagatattttaattcatcacatatgattctctttaaaaagtactttgctgaataaattactcaaaatcaagtgtgtagttggcagaaaatagattttgcattagttcattcagtaatccctaaactggcaaaaaatcaatatgtagtaagacaatttcagttataaatatataaacctagattatgtcataaaagaaacctaaagattgtagtaaacagaaaagtattttctaaaagtgaacttcacactaaccagagctgtgcaaaatctttacagaaaaaaataaaacatgaataaatccagaaagaactaaagaatagcatcaccaactcaatgggcatgagtttcggcaaactctgggagactgtgaaggacggggaaacttggcgagctgcagtcatggggtcacaaagagtcagacacgacttagcaactgaatagcagcaacagtttgtggatggaaaaattcaatcacttaagcatgtcaatttcccacaaattaatgaataatgaattcaaggtaattctaaaaattatcccagcaaggtttttcatagatcccggcaagctgattctcagcagcacagaatggagaataggtcagataattttgaggaattagacggagggcacataaaccaacagtggttaaaacaagagaggcaggaaacgcgtgtgcacggagagaagccgcgtatgcaactgagggcacggaacagatcgatgggtcagggaggaggcattcaatacatgatacttgcacaaatacattcccgtgtcaagccattcaaaaaattgtgaaataaagattaaaatgtgaaaaacaaaactctgtgtctttggaaaacatacacaagagtattgtcttaatcaagatcaacagcctgaaatcacaatgaaaggatcaatggatctgattatttaaaattattctcctatttttgcaaaagatctcatggataagggtgaaaattaaatgaagtcgggaaatacatataaccaagggggtagtattcataatcaataaaatacaacaaattgaaaggattcatggctcaacaaaaaatgagcaaagcgtttcaataggtaattcatagaagagaaatttgatgagctgacaagaaaaaaatg

SEQ ID NO: 46877 - DNA, 722 bp, Bovine  19866880921755
cgtgtgtgaggggcaaggtcggctgccggggttccgaggggggccctgaagaaggccagcgacagtgtctgggctggtccctgagggccccccaccccgagcccggatgacattcctgttgaactcccctgctcacgaaacaggtggacttaggggggagttgacaggatgcaggtttgcacggcctgctgagccctggcaaaaatgccccaggcgcaggtggcgagtgtaactggtgatggtgctgagttgtgacagccttgatccagttcctgatggacaaagacacgtaaattaatcaccaataaatggcgccttttgttggcctgttagtcaaaaggtcaaggactgaatagatcacgggacagacatattttcctggtgggggcagagaggggtgggaaagtctgcacacaacggaaagcttaacacgccctgtttgtcccactgcctcccagaaagctaccatgacaagcagcgctttatttcaatagtgacctattcttatttcttaaaaaatatgtaactgtaggagtaagaaaactatgtagcttttttgtttctcagcagtgcataaaccaagtgataaaaagaacagagcagaataacagttgcttattcagaaagggagttggagttggaatattccgtgattgcagaatgtgtatccctgggggaggaaaaagctcaacaaagaagcaccgtcccttcctttgggcatg

SEQ ID NO: 46878 - DNA, 592 bp, Bovine  19866880926222
agttggcttgggcccctgcatccatcatggaccaagaagccacagagcattacttagcattcctttcctttactaatggaactccacttcagctcaagtgctctggccaagttagatttgaggctggacgtgaacttcactccctgcggaacagaactatttatctatttatctatcgaaccactcaaattctgctggtcaacgcaagagttcccctatgttatgctccaaattcactcattaaaaaaacaagaaatttataggaaagatgtgactggttaaacaaataatcttttgtcatgcatctacaatactctacaatacattttaaaaatatatttaaactaagataagcagtaaatggcaaaatatgtcaagactgctgaaagaaattctacaagactaacccataagcatttccagtgacactaaaagtctcctaaatatactgatagagactgacagaataaaaaagatagatatacagacacagacatacaaacaagattgtatttgtctccctggatatttcttaccaagactgaaaagggtaggtgtcttcccataattaggtttcagaattgtgttattt

SEQ ID NO: 46879 - DNA, 1863 bp, Bovine  19866880966129
aaatggtgcattttaaaagaaatatgtgggagtggatttttaagggctcaaaagtataaacataactttctatgcattcattctgaagaatattgttatataacacatctgtaaatttctgacatatggatttcatttcatactccattctataaatacagttttgataataaactaagaaaaattaaggcttatgtatgtcattttccttataccaaagggtaagtttcagtggtgaactcaaattttattcatgatttcaatctaaagttattcatgtgactgaattcctgcctactgatgctgacttatgtaaaatgaaagaattgcatctggaataagcaaaccttttttttttttttgcacattttcctatttaggacaaataataaaatgcctctctgcaataccatacaacacagcacagatacgtgctaatcttcaggaacaccaaagaaaaacacatcctttggagagcttatttgttccgtgggaggctgtctttttcaggcctggaacaaaaccctgtggataaggattagaacatatgcagacatcattatgtgtgtgttggtgggaagggagggtgggggggcagcccggttccacaccatggaatttgctatcacattttctccttggtaccacattaaaaaagcctaagaattaaacaaaagcctaaagagcaaggcatttaaaagacaacaacaacaacccagcccaacaaatgttgcgttctggtgggatacaatggtggctgaaatgctctgccaaacacgactttgaaataaagattctttatatttttttgcaaataaacgtccaaaatatttatcaaattgcagctatgttaaagcaaattgagcagttttcagttgtcgcatctttctttgggatgtaggaaatttttcaaaaatccatgtattgttcaattaagatttctcttagagaacaagactatttgatatatttaaatcttatatattagattctaatttttaaaaatcattatttaggagaagatatgaaattgtgttttcaagttactagataggaaaaacatcctaaaccaataatgatataatcaaaacccagcagaaaaacatgctcctcggctctttaactaaatttgtaacttaaattattcaattcagccaatatttatgtactgcctcagtcagttcagttcagtcgctcagtcgtgtctgactctttgcaaccccatggactgcagcacgccaggcctccctgtccatcaccagctcccggagttcactcagactcacgtccattgagtcagtgatgctaccagccatctcatcctctgtcgtccccttctcctcctgccctcaatatagcacctactgcatacccttcactggcctaggggattttgtgacagctgagtccagattccagtcggggaggccaccgtccagcagaagagacgacactgcccttactagtgtcgcgtcgcatcctgacccaagcacgaccgggacacagaggtgcagataattccaccagtttctcccttttagcgggtgggtggagggcgatgtgagcctggaacagtccctaagacggtgacattgagctgaccttgaagtataatggtagtgacaggggggcaggacattcccggcagaggagaccaggcgccagaggtggggtggcaaactggatgagagacagcctcgggaaggaggctggaggccgcgtacgctcacggcctacccagcccagctggtgtgctgactcagctccggggggcaccctcagcaggactaaggggacccttgggctttccaggtggttcagacggttaaaagaatttgcctgcaatgcaagagacacaggaga

SEQ ID NO: 46880 - DNA, 1386 bp, Bovine  19866881017050
ggacaggggagccgggtgggctgccgtctatggggtcgcacagagtcggacacgactgaagcgacttagcagcatcagcagcactctgaaatactgtctttgatctggcctctttgccctttatcatcttggtccatacccaagaaatgggtgatacattgaccaagaaatcaaaagcagagggaaagaagagcttctaacctctttgtgtgtgtgtgcgcactcagtcgtgttagactctgcaactccatggactgtagccagccagctttagaaaacaaaataaatacattttgaatcaaactaatttagttttgaatcttgactgcttctgaatgaccttaggtaaagcactaaaatacttccattgtttgtaaactggtcttaatacttggtagttgtattactacttaatacttaataatatggtaatcatgagaattaggtgatgtataggaaaattccagagagtggatggtatgggatattcattctattcacgacgattgacttttcatgtttgagatagcaattgcctcactttgcaagttgtattagactcaatatacttcatttagtcactttttaaaatttttttatttttacatttctgactcaggactaatagcatgtcatagtttaattggaaacactttttatttctcatggatgcataaaatataaaatatttttaatacttgattacattttagatttaatgaaatagttaaatgcttccacatttattttgaaatgtgctctagggagaaaattcgttctagaaagatctggtccttaaggtgattagactatgtacactgtttttgttgaaaattgtgagaagaaatgccactagattaagaacatacatctgaatcccttctggcaaaaagagtgaagttacactagagattcagttagtgctctatgtttgacgcttttaatcaggtgaacttgcggctagcttcctgtattcgaagtttttctcaagctattattgatcactactccacaaaagaaattgatacgaaaacatttttgctttatactgcatatgaatttgtgggggagattagcaacagctgcttttatctgacagcacataataattgttaaagtggatcaatgaaacttccctttactttagtacattaaatgaaagaaatctgttgctcaaaacccctatttctggcaaagcaatttacattttcagagtatctgccattcaggtttggatgtaggatctatttatttttgaggctttggccgtggctcatttcggtcatatgaccttgggcaaatcattgatccaattcttagcttcttcatctgtaaagcaactatagcaattccaaaaacaatacttccctgtcctttctattctgg

SEQ ID NO: 46881 - DNA, 1419 bp, Bovine  19866881032160
aacctagggtctcctgcgttgtaggcagacgctttaccatctgagccaccagggagatgagttaagggacgtataaaggacaaagaagaaagactggtagaaatacagaaagacaacattttggggaaggtttctacatgagggattttctgtgaagtctacatattctataaaactgagaaaaactcagattaaagtcaatcgaactcaaagaagaattattcacagtataagaattaggactgaaaatccttgaaggtgggtgttgaaggtgtttcctcttaagatgtccagtggtaccctgggatgaaaagacttgtcaagaccgaaatgacagcagagagagtctatgtccaatcacttcttccttcattatgccagcacttgacaaagatttcctctcacagaaactagatctaaattctgttctgccctggtgtttaaattcttccccctgaaagtgatactgttataagcagtagattcaatcaaactaacatcgtatttgtctctacgcaagacgtgagttttgcattctggagttgatcaaatttaattatttacttactctcttacatcaaattcacctgctgaaacattttcctaaacaaatacctatttctctatgtagtacactggaataaaagaggacacatggtaagtctgtatcatttaaaatacagtacattcttgtatattaatagtaggaatgtgaagatttttggtcataaattcaattgtagaataaaattaacttctgatattagtctgggtaaccaaaaaggaagtgcaattgcaatcttacataacaggtttggtacatacccgccgtctgcagctgtacttaatacgtatcctttatataagtggtcaaggaaaggcccaagggattttggcagcatgtaaaatgcacgtatcctgtggcatgaataaacaacactgacaaatattgatataaataaagcaccttctcactgatgtcaaacgggaccatggtagctggcaactacagtctgttcctaatgacttggctcagagtcccgagaaaaacacacaggaatgacctattaaatagtgtgagcaattttgtgacagaattgctacaaagaaagagttttcaagggaaaataggttataaagtgattaatttgtgaccttacactaatgtaatttatggtgcttcaatttcttttcataggaactatcttatgagaacagaaatgtggcttttgagacagtaactgggatgacaaagagaccagtccaacttactttgtcttaaaagaacattgggttttgaataatgttactgatggccttacatttgttctcaaccaaagttgagcatttttatttagctcaagcaaaagacaaaagacaaaaaaagttaggtttttcctctccaattcatcggtcaaa

SEQ ID NO: 46882 - DNA, 1660 bp, Bovine  19866881045223
gttggatctcctctcagtccaagggactctcaagagtcttctccagcaccagttgcatcagggagttccagtcctcgaagtggacgcgagggaaaggtgtgagacagccagaccactcccttgcttagggctttggggcttgtttgcagccatttgcaggcgagtcgggaccggagagaacacggccggagacctgggttggtggagggaaggacgattatcaagtgagctggcttctctttagagctttccctttttcctactctccccctcctcttcctctctgctttctcttctttcttttcgatcgtcattttttctcttcctctaacttttctcctcctgtttccttattttctcccagtctttgttcttatttccttcccatttattaccctctatattttccatttgatatattctattaacttatacataacatactatagaatatatctgaatatatttatagaatatataaatatagatattctgcactatacatgtatatgatatatacctattctatttgtcaataatttaactgccttgaagagagagtttcctttttttttttttgatgtggaccatttttaaagtctttattgaatttgttacattgcttctgttttatatttcggttttttggccctgaggcatgtgggatcttagttccctgaccagggattgaacctgaaccccctgaattagaaggcaaagtcttaaccaccggaccactagagaaattctggagagttccctttaataattattagcataataaaaaaagtcacacatcttgggaggattattttcattaagctgactctaggatgaactagaaatgcatgtttatgatctgttatattattgaacactgtcttatgtgccagggttttattttatttttagttaagcagtattttaaattcataattacatttaagttaatttataaaatttatttagtgcctgctgtcagtctttttcttaaattgagagccatgcaataaattagttcatactgctaattttattttctgaaattattgaagcaaatcaaaactagaatgtcaaagtatttctcaaatgaagctgaacccaactcataatttaggtttgttgctaattctaggtgcatgtaagccctccttataatggatttctgtacttcttctggaccttggatctggagctatggaatactgcaattaaaaaagcatcaggagcaaacctttcaagaatctcattgtacaggaatatatgctagagctcagggaggtgccctgatgggctgaggtcagagagcaagctagaagcagaggtgggtttggagggagaagtggacagaacgcaaacttaacacactctgtccgctacattccaggcaaggcagggattcgatacatcctcccatccgctctctcttgtaggtttttctctgtgtgctctccctgtctttctctctttctctttcagtccagaatgaaggaaagagagcaagaggactgcttctctaaaaaccatctagcatcagaaagaaatttgttccttcacaagatgtgaaagtctcatctaaacctcctccctgctcaaccccacgctggaccagtcaccagcgctctcagctggcttcattttttctcatcagcaggacagt

SEQ ID NO: 46883 - DNA, 1262 bp, Bovine  19866881077864
cccactgcacccccatctccatctgggagaccaccggctccaggcgcggtcaggtttccccgctgtccccgctgcacgtggcctgccctgggcctgcagggtctcttcatttccgtttcaggagcagaccgactaggagatatgcttacctaacggtaggattccaggcttaggagggcacctggtgaggggagatagttttatgctacttaatctcctctaatattactctggccctgataacatgcaacgcatttctaaacaggggatgcggttaagagtgatggggccgggagacggagaccagcaagtctaggtccgatttcattctgcactcatttgacctcagaccaactgcataagctgtttggggccccggcttcctcgcctgtgaaataagaagctgtggatgcacaaggctggtccccccaccccaccccatccactatttctaaaatctgctccaagttttagatagacaggtacacatttgttctggaacttgaaactgctccccgccccccaaccaatttgattttattacaagacttttacttcttagaaatatcacaagtgctcatctgtttttcacatctgatttctttggtgttttccttctttgtaggtctttaaatttgactaggccaagctagtaacagagaagaaacacacacacacaacgtgatgtgtgaggtgattctatcacaatttactcacaatttactcactcacagtttcaacgcttaccctttatttcctttgtgacccgtgctggtttttaaaatgctggcttgttttgctaggacccagatactttgttaataggttaagagcttctttgtgagcatctgcggaaagctctgatgaattactccttaggagataaactagaggatgatttgagaaacacatcatcttgttaccaatctctaagtgacaacttgggagcagaaagatagtggtcacagaattgacacaactggcttatctctgcagtattttcagctacatatgagaaaaataggtatttggtgaattcctacgctcttctcatgccactgatttataagaagtcaatctgattttcttacgagtgattctcacgttttatagcttctgatttgtgaaacacttggtgctaaagaagctacactgcacccagtccaccagtttttactgacaaagtaaactcatgggagaaagacaaagatcgggactcggataagtgttaacggatccactcatagtaagtaattataagt

SEQ ID NO: 46884 - DNA, 1776 bp, Bovine  19866881148708
aaatgaaagaggaaaaactaggataagcctgggccagggaaattctcacaaatgaaaatcatagagcgggagagttttgctttgtttcgaaatagaatcacttgatccctagttgacatcacagcccagtgtttggcaaatacgtgaaaatctaactaaccataaccagctctcaagctgtgctaacctaagcatgaccagctcggactccaggcttggtcccgagctctctccgtgtctcccaccgatatgaggatttggtttctccctccccgtcgttgcgtgtgtccgcaaagactttgaaggagatgccgcatgctcttctgcctttcctgtcctgttgacagagaaaccgtcctgtcagtccctcccagatgagcctccaccatctgcgttctgtcctttctgagatgtccgtgccttttggcagcaataggcatgttgacttcagctcgaacacaaaacccactttgcctggagaccacactcattcctggttgagcccactgtgtggcccttgcccagagatgcctgccctctctttgctcactctgtccttcctggtctctgcaaacgccttctagagtttgcctcccgcatcacaaaaggctgctttcacttccctctccgtgcacccaccgcacttctgaagggctccagcttaaatctatctcatggcttccctgcgggctcggctgtataactcggtctctggcgatgcggtttacagatggcatctgatgtccttgaactctggagagacaggagagaggagcacgtgaagtaaagggtatgctgaaaccagctgatgggcagagggggagcatgcagcccaggcagaagaacacagcatctcttcccgttgaaagtcaagtggacgtgaacctcctgcaagcatttcagaatttatgtctgtaactgcacatttatatcccagttactcatcaccaggggaaccaggattcttgactgacatgtttaatataataaagacaaaaaaagaaaaagaattgccaagatacagatcccctctgggggtaggttattttctcggtggtgatgtaatgaggtgacgttttccaggaatggttcatattcactgtatcccctgcctgaccaccagaccttagtttggtggtccttcaacggatgggcttcagaaggacctggaggcccgtgagaacccagaccctttggacctctcccagaatttccatttcagtgggtttggggagggtccgggaacctgcatttctcacggggctacagatgcagctgcccgcgaccacactttgagaacggctgcttcactcgcaaggagcagggcgctggagaactgagattcctcactttgccaccgcactaaactccctctacagcctctcatggggaagcccttacttggtttcctcttcatgtgagtgttcgaaactcaaggacttaacaaaatgacattccagccaaggaaaacgttgctctgacaacattctaaatgatctcaaatagacccaccacgtatttaatttaggtttaacagggaggtttcacatgttaattaaataccagctgattatgcaaggcatacccactgaggattaactatgtcagagacgcagacttctgacataactgctaaatctaggacttaacgggtaataacaagctgtctcattagaaatcaaatggctatggaagaaaccatttttatgggtattttttactgtttgacttgttgatacatagcaacaaacagactgatttgggatcaattttcca

SEQ ID NO: 46885 - DNA, 4159 bp, Bovine  19866881149546
taacaccaagagacacatacaccccttaaccatcccccagtgttatacagctgctatgtctcgcacaactgcattccgcctacgaagctgattgctgccatcagttgacctcattcagagttttcagtttcacaagcacacagttgtgtgtacgtgcatatgtgtattcagttccataagagtgcatcacaagggatccttgtgatgatgtgttctgtatcttgactctgattgtcacacagattaacacatggtaaaattacatatataatgtttttatacttctcacaaatacgtccccctcatggtgtctagtgctgctgggcacaccataatcgcttaataaatgtgtgtgtgtgtgtgtgtgtgttcagtcgtgtctgactcattatgaccccaaagactgtagcccaccaggctcttctttccatggaattttccaggcaagaatactggagtgtattcaccccctccaggggatcttcccaggctagggattgaacccatgtctcctgcatctcctgcattgcaattctttaccactgagccaccagagaagccctcaacaaacatagtgttggtaatgcatatcttattccttagagaaaacagcagtgattcagaaagcatgagccctggtctaacgctgggccttatttgagagcatgaggtggagtgaaaataaccatggatctgcagcagaagacttgagctcagagaccggttttgctccattccagctcagaggatttactttaaacctcagacctcggagtcttgatctagaaaatgaggaagccggattagtaatttttatggtcccttccaaatttgaaaactagatgcatctaggaactgtgacatcctttaatctctcagttctgaatttctctccttaaacatttctgtcttgtggtttgagtttatcagctcagagtttgtttcattttcaagttttaaaccgtggacgaacaataatcttctccttgatttcttaccgactcaagagatgacctgaaagatctcatttgcgtgaagattcaggagacgcagagactcttggctgcgtccgtggaccgcagcccagcctgggcaacagggtgccttcccgagatgtccacttgctgagagggtgtgcaggacgtctctcctgcccagccctcagcaaagcaggtcctgcatcccacagcccaggtgacgtcttgctgccatgagaccagcactagcatctccccgccccaggaggcactcccctctcacacacggtcctctaacagccttccttcccaggtaggtgtcctccttgggggctggtgtgacccatctatcagaccctgtccctagcctcccaaacgtgagccagaaagtgaccaaagggaaagagagagaagccgaacatgctggccaatcagcacgtttggctgagcctactgtgtggagcgggtttgcaggccggggacacagcttgtatccaggctctgctttgtaccggggggtgacttccggccgctcccagtcctcccctgcctcagtttcccaatctgtagaatgggaatgtcccctgtctcaaagggttgcagaatggttaactgaatcaatacaggtaatagcttggactggggcctccctgatggttcaagcggtaaagaatctacctgcaatgcaggagacataggagactcaggtttgatccctgggtcaggcagatcccctggaggagggtgtgacaacccactccagatgccgggaaaatctcatggacagaggagcctggctatggcccatgggtttcaaagagtcagccatgactgaagtgactgagcgcacacacacacaagagcttggactagtgtttgacatgtataagtgcttggcaaatgttacctgtcttcatgtggtcatgctctttaccttctgacttggctgtccatccctggacacaaaatgcctttggcccctcatcctgtatgattgcaggagtgtctggtggcggtactttggggagaaaatgtgatgattggcacagatcctgtctggccaagtcccacggagcagcaggggctcacgcggggacaggcgtgcacattttctacaaagctatggaggcaaagcctgtcctgggctctgacctggggaggtcctctctcctaaagacgaagcctcggaacaactttgaaaggctggaacccagagcaaagggctttgggcagtgggcctgcaccgtctggaggaaaatgaatggggtctcaaaagccgccttcagccatctgaggaccccgtgctcttaggtgagccctgcagacacgcaggcggccttcacacattcagactctccgaccaaggcttctcatgacttgtgcattcatacattgctgctgcaaggctatgcattttctgatttttgtcacactctgataagatggaaaaaacagttttgtgtgctcttgctgactgaattgcaggagtaatttctcatacgactgaaatctcagatttggtagatgccttgcccagtgggacaggaagcaatttatcaattcccattagcttcagtcaccaatcaggagcttgctctggcctgctttttttcctgctcctgagcagctcactaatttctctggctgaacgagctttcacagagcagttccccttgacactgagcctgcggcccctcatcagacaggagctcttgcatcaggtgggaaatggagactcattgtgcgctacaggcctggcaggcaggctgtgtccaggaggagcgaggtcttttaggatttgatcttccccttgaagaccctgggaccttcccattttgctgagctcagaaacacccaagaagaagtctcctttgtctttgaacttccatttgggaaggctttgctcagaggctgtgtctgtgaattttgagtttgggtccccagagtcgagagatcttggggggccgggcacctggcctcatgttctccttgcaggctctcctttactccttctctgcatatttcccttcaaaacaaatcctcgtggtaacagggtctctgtgagtgcaaatgctgatgtgagcagttttcctgaggggaaacatgagtgtctgaggcactccagctctgaggccctgggtctatggatcgttccctccaaggaaactgggagagaccacatgctcaccacacctttccagggggctcagatggcaaataatctgtccacagtgcaggagactggggttcaacccctggattggaaagatcccctggaggagggcatggctacccactccaggattcttgcctggagaatccccatggacagaggagcccggtgggctacagtccacaggttgcagagttggacacagctgagtgactagcacacgtgtatttaccaaaacacagaggctttaaaacagcacagattggaaactctctctttcatctccagtgcttctcattatagaaaggaagaccaaaggctatcccaagagagggctttgatggagaattcctcccgtcaccagtttcagtggaattcagctgggagctgtcaccaggggcccatggagggggtgacacatgaaggggtgttaggacagttgtcttttccagcaggggcttccagtctccagacaggtgggcaggtccacatgctgctttcaatgcattaaacagaatgccctctgatttgggcaacaatacagagacatcagctgcttgaggcaggtgtgagggatactgtaggccatcattttgatggatttatgtacatttatatgggcttccctggacacagcatctctggagctgcctgtgagtctggctcaaggtgtgcctgaagaaggcagggccctgagggtgggcagacccggccccttgcatcactgccgaccgggcgcttgcagctgcccagggatgaagcagcagcctctgtgcacggtcacagcactgatgtcagagccgaggatgcaggatgggtggggatacagggaggcgagggaccaccatggcaggggccgtggactgcctccaggcccagtggagggcaagaggagggttaggaggcccttgggcccggaggtggctcaggttggagggagtgggggtggttgggaaggggtgctttcctctgcccggggcaggtactgctggggacggtgcagggagca

SEQ ID NO: 46886 - DNA, 945 bp, Bovine  19866881185772
gaagtaaacatataacaggtgtagatggacattccccagtcaaattacttttacaaaatacttaaccaagaaatacaactgatcatctcggatatctagaacacggtgcaaagtgttgagaggcacaggaccagagaattacaagacactggccaatgaagcctgaaacttgtaaaagctatacttgacgaatttattataaaactttaaaaatgaaaaaagatgattttgtacatatgaatccctgtgaatgtgtgtatgatctagtacagtaataagtaaatatgatatcatatactcaagaaattccaaagagaaataaagtatatacagaggcatccttcattactgcttaaaagtactaacttttattttatacaaatgttgctgttctgtgtcaatagtcactatgttatataaattctaaattctaaatatataattataaattacaaatacataattttaattataatttataatttaattttaattataatatatataattttagaattacaaaatacatataattattattaaattcaaataatatttaatgttcatgtgaaaccaccaaataattctacttaattttgaaatcaagttgtagttttatcatgtaaaataacttttatcatgtaaaatatcttaaaatacaaagtgcaagacacatgagatttggtaatggatttactgcttttctcagggactatttattcatagataatttggtttagaatagacaatctgtgaaatatatttctctgtggattctgttctaactaaaacccacaaaaggaaggtagctagccacgatctatcctatattcattattttatttggcatttattatataatcatattttttctattctgtgctataacaatgacattaatttgaattgctttagaaagatacttctgaaatataaattatttat

SEQ ID NO: 46887 - DNA, 4233 bp, Bovine  19866881204411
tcacccaatccaatctcttcatcttgtaaatgaggaagcctggctctttggaattggaaactcatggaagtcttaaaatctgtgataggcagaggaaggatgagatgctagatttcaagctcctggtccagccttctgccttccgtcatcctgatctatccccacacagggctcagagccctcatgatcagacatggccacagagcaaggggaatacagatgtgtcccttaggaaaactgtgagtcctctggttgcagtacagacacaagatccagttacagtgcagactgagcgacaggaagggaaagggaaagtgaaagtcgctcagttgtgtctgactctttcagacaccatggactgtccgtggaattctctaggccataatactggagtgggcaacctttcccttctccagggaatcttcccacccagcgatcgaacccaggtctcccacattgcaagcggattctttaccagctgagccacaagggaagcccaagagtactggagtaggtgagacttttccttctacagaggatcttcccgacccaggacccaaaccggggtctcctgcatcacaggcagattctttaccagctgagctatcgggggaagcacaaatacaggatggctcccctttatcggcagctcagagaggcggggactttcagagaaatgagggagcttcttcctggacctaatgaaagctgggcatagcaggggttaacaacagaggcacgtggaagcccccgtcccaatccctagtgctatttgtatggagaagaatgattgtttttggtgttggtgatataaaaaactttatccagtaagattcactttggagacaggttactttccttttgaccagtattttctagtaaagtattggccccgtttctctgcgcctgtgagatctggggtacaattctggaggacgatgcaccgctgccgtgaacttccaatctcaagaaaggtgattgtgaggaaatctgaggctgccacatcttagtggtttctttttcccgttgtgtataaattctttgggtttcgacactggtttcctcccaaggcgtttgggaagctcacttacagatctttgtaatactgctgtggttgtgagcggggggtgcatcggctcgttgctggttctttatctataatgagtgacttcacaggttacacagattgacagtagggcccatgatccatattttgtaaagggcagaacagcagcccagataggtaggagacacaggggtccacaaatcagtatcagggctccagacagaagttcgctcctgttactgcttgtgcgattctttatttacctgcctttcctctctaaaacccatgtcaagtacaactcacacataaaagccttcaccaggaatgctctgcgacagaaaagaatgttcgggctttacaacctgaatgtgggttaaggaaactgccaagacaaagtgagcttgcagaacagctgcggggactggaaccaaactatcagttttcataatcaagtaagaatgacacccacgtctttacccaagcttgctcttcagtgcggggatattgaaaaacgggatgcatttacaaaacccacagcctccgaaacaatcactgaattacggcaccaggacaccctctggttgattgcttcagtgaagaaaatatggcttaggtgacagggcaatgccggtatgaaattttgttttatgctgtaatttttacctgtttggggtctgaattgtgatgagaagtatttcactcctttgatttacagtgttcagaacaaggattaatgacaggcaactttaactctctcaacaactttcaagagataaggggctgtgaaaagacaccatggatgctccaggattgctcacaaagttgttctgaaaagaccactaatgagaagcattttcttaatctgatgtccagctggcatggttctccttgggtgaggaagtggtgaggggtgaaaataaatagagaaggatacgggttttgaaacaatataagcatattgtgctggttacaaacctacaaatcctcaagaaaatcaaccctgaatattcattggaaggactggtgctgaagctgaagctccaatactttggccactgatggaagaactgactcattggaaaagaccctgatgctgggaaagattgaaggcgggaggagaaggggaaggatgagatggttggatggcatcaccgactcaatgaacatgagtttgcgcaaactcagggagatagtgaaggacccggaagcctggtgtgctgcagtccacggggtcacaaagagtcggatacaacttagcaactgaacaacacaggtcagcaactctatgcttcactggtagctgagattcttgccaaatgagacaataggaagcaggtgagccactgcaggttcaatgcgaccagcctacttcaaggtaaccctgtgtctagaagcttgactatatgccccagacatcgctctgaaataccaatgggttcttcgctgatactctatgcaaactgggctcacttatcctctcattatccctcagccatgtgtggcatttcaaggcactttggggggcaggtggcttctgcacaacctggaggatagctccgaaacagctgaagatgtcagagctggaggggtgcctggtgataacctgctctcaacttcttttctttcagaagagaaaactgtggccatcctcacgggaaatcgaactcacatgagaaggaggcatgtacacggcaccatcccctgccattcactcattaactcagcaatgccacgtgcaagcttggtgcagggcactgtgagtcagggctgagcagcacaggcgtgctcctctgtcctcagggagctcactctcctttggaagacatgtgaggaatggagtattcccagccgtatcactaaagaaggatgccacggccatcagcagttctggccttccaaatgtgaatttttgagcccaggaagaagaatgtgtactatgcagaagccatcagccactccccactgtgggcactgaggactcctgatatgtgaaaaacacggtataccggccccagatactgagatgcatacgaaaggaatgatttcagcgagcccagactcatgcatcttccttcaaagagaagtgctacactccttgagatgcctgcatgcgtgcatacatgctgtccaactctttgtggccctatggactgtgacccaccaggattctctgcccatgggattctccaggcaagaataaattaacaataatctttggacattcagactacctgccccttgttacaaacttctaaacaccctgactcctccccgcccctgcccttcactcttcagaacaccccgctcagagtcactcgagaatgctggctcccaagcttgaagtcctaaaactttccaccaaataaaacatagttctcaactttagggtgtgactgttttttaagtccacaattgcaacaaacaggaaggcaaataatggccattagtgataaatgctctaaagcgggcacttctggcttaattcatagcgtttaccttaataaattgcaactgagattaaaaagtagggacagaaatggcaacaactaaccaactaagagggctgagaaagatcgtttcctttcagaggaggcacatttaaggtgagatctaaacagtgggcaagagccagcactttcacacagagagagtggtgtagaggtccccaggccttcacgaaggacatagctcagagaatccaaggatggaaataacactgaatgggtagaactcagggagttagaggaagccagggtccagaaaagagcttggtttgttgaataagtatgatgaacagtcattgcatccccaccaacagcggtaggagggctcgcttctctccacaccctcaccggcattcgttatctgtagacgtttctgatgatggccattgtggcctgtgtgaggtgatacctcatgtagttttgatttgcctttctctaataattagtgatgatgagcatctttcaaaatagtgccctctgcagagacgtgactggacctggagactgccacgcagagtgaagtaagtcagaaagagaaaaacaaatatggtatattaatgcacctatgcagaatcttcatgggaaatagatggggaaacagtggaaacagtgtcagactttgttttttggggctccaaaagcactgcagatggtgactgcagc

SEQ ID NO: 46888 - DNA, 3156 bp, Bovine  19866881216971
taaaagataaagtctcatgtaataatctactactgaatgtgtgcaggacatcctcaggtaaaaataactgctatctatcatctcttgctttacctggttttgaattttatttatttatatatttactttggctgccctgcctggcatgtgggatcttagttccccgatcagggatcaaagctgtctccctttcaatggaatcacaaagtctcacttaaccactggaccacgagggaagtcacttgcattaattacaaatgtgtgacatgttatctgttggagagtttactctgggaaatagaaactgacttagaagtcagacttttaaaatgaggtcttgcccacctccctcccccacagggagggcaactagcttctctgtagctgggatactgaaaaagggaaacgggacagaatgtattttcctctgttaaaacttccacaattgcttaattgctctgtgatttgttagcagctaaaatacttttgtttgctaatgctgaaaatctcaagttctgcaccattagtgcttggaaacactgggctgtggcactgttcgcttttactatccccaaagcttagatcaaagtgaagaattacattggcccctgaatgagctgctatctttggagcatagatgttttgagaaccacagcaatatttcatgctgtcctaaattagatgcttaaagtcacagtggtctgctggacttttaatttccagagttagagtcggactcactgctcttgaacggatcagatggggccttgaaggatgaagtatagtcagggccgggcattcttctctaaaaatggaagatgaacagcatggaatttctttagtaaatggaagcacatgacaaaggaaggcaggttattcctatgacaagagggggtcttaaataatttttacaagagcaaggcactgcagtgttctttcagtgtctaaaatgtgcacatttaaagtccccttggcccaatattatagaatgttaaagaaaatactagatgattcaaagatagacttttggttaagctcatacagaaaagttccataaatcagctcaactaaaacaaaatatatcttaaaaaattaaggaagagatctaagaaaggaattttccttgcagaagaaaagaaacgaaaaaccaccctctgaaaacaatttgaatttatagtattaaatgaactagcctatcttgttctataaaatgaaatggaaaatatatttcagattaaggtactttgaccttatttgaaatacaatcacacatgacagtaaaagcgttgaccttgacgtcgctcagtcgcgtccgactctttgcgaccccatggactgtagcccaccaggcttctccgtccgtgggattttccaggcaggagtactggagtgggttgccatttccttctccattatactatactccataatactaaaagcattagcctttgttaattactgaatgaacacacaaatttggataaagactttacagaaaaaaaactcaactatagtcaaaatcagagactacagatgtaagaacgctttgatagatactcagatattaacatatgtttgcttagtctctgcttactctgactacacttaattttttgtacagactttaatcatgagccttgaataagtgtaagatatgtcctatagcttcaggtactaattctcagtggctcagccttgggtgcccagattgaatctctatttttgtaaacattaacaattaagacaagtatttatcttaaattagatataatcaatttttgaacaagttagcatttcaagatttgactcaaatttttttttttttttgatctctaagcatcttcagctgttttggaggatgaacagatgaaaccagatccagaactcagaggataccactggggtggattagatggggattggaaacccggggaaggaagagctgaagtggtggcccagcaggcccacctggccccaggacacgtgcacatagattgcagctatctattcagtcttatagattaaaaaggcctatttctccaaacacagagagaaatttgagagcttgttagtgaagagataacagccccaaagtggagtcccttctgctcaactccacatccgcaaaccaacacttaatacctaaccaattgtaatttccacctcttccaggaatataacctttaacaagtcaacctggaattacctggtcagtactagtggtgtaatccacatgagatacccctccatcctcaacaggaaggtgatcttgcctgaaagcaacccactgttaaaacttccatttcccactcccttctgcccataaagaaagaagtgaagtcactcagtagtgtccgactctttgggaccccatggactgtagcctaccaggctcctccatccaaggctccaagtctcctccttggaaaatcttgggatcttccaagcaagaatactggagtggattgccattcccttctccaggagatcttcccaacccagggatcgaacccaggtctcccacattgcaggcggattctttaccagctgagccaccagggaagcccaagaatactggagtgggtagcctatcccttctccaggggattttctgcccataaatgccttttgtttcatacagctctttagagctttcttttttctagctgctagatgggatgctgcctgaattatgaaccaatgaataaagcaaataagatctttaaaatgtactcagttgaattttgttttttaacagatgtggtggcagaaagacactgttgatggctttgggtcaaaagaaactcaggcatggaacctgtaaaccctttttgagctctctttgtcaccatttctgagggccatgagtaagttcctctcagttctctttgcactgagctcccgatacgactgggtttccagtctggggctggtcagcttgagtgagtagccagttccacttggaacccaagctctagtccttggttcaagccactattccccatttgactggaaaccccagattcagattcagtcccaagatttcatgtgggacctgctgtcagttcagcctgcagttccctattgtgttgagccccagcctggagtcctcgtatgttgaggtctgctagtatactcctttctccagtcccgagt

SEQ ID NO: 46889 - DNA, 653 bp, Bovine  19866881234091
acctgctctccttgagaagcagacaagaaggagagctgcggaggcaggaccagtgtcaggtcagctgtcatggcgctgacaagactgatagaaaacctaatttacagttttaagaagcacatccattatccttctgattttaaaatagaacatacatcagcaaaatgatagaagaaagcgcttaagaattatgaaagtcaaggactactttatatcataaagtcacaaccctttttgaatattactttaaattatagcaaagtctaatgatatccatgtgtcctgtttgctgaaagttagcatcacagtattccaactgctgatgacctaatgatcatggatttactattaactcctttttacgtttaggtgagttgatttatgtttaggtagatgatgatgtcaggattgatgcaatagatgttcaccagaatattcttagaataacttagtttctgttggtttacattaaaagctcagcactgttttaatgtttattatatgttgaggtatttgcattggtgtgttagttttcagtgtataacaaagtgggttttttcctaaaaatattttttctgcctttaattctctgacacagctactccaactttcttctgtttagtggtttcctggaagggactttaaatctttta

SEQ ID NO: 46890 - DNA, 1045 bp, Bovine  19866881306604
tttgtcccctttaaaaaaaaaatgacctaattcaaattgtaaagagcagaatctggtttagattgttgagcaaatcatttttgtataaatggagcactgatgatgggattaggcatgagccagacttgtggcttttggtattttccttatttttctgttatggccacagaagtaacactgagtcttagagagggtttctctcagggtgatgatacaaggactccaagtcctttgctctagaaggacacatgaacagataagtttctatttagagtaattagaataagtagctaattaaaggcttcttggcacctaagtacagagaacagactgaaatggctctgctgtcctcaggcttgaagtactgccaatgtgaacacatcagacaatttttgatgctaggaaggcagtcatgttgggttctatttaggtctgggaaataaaaccaccttgccttgtaaactaagcaagaataaagagaaatatttcatttatcttgaatgaatgcagtgtgtaactaggtatttgacttccaattttgctttaaattttatttttcttaagtaatattaacattggtaatgcaatagtaagattaatttatacatgatatttataccatagatggataagagcaatctccttagctttaaattcctaaggacccctgacttttattttttgggttggtattataacatttattaaaataatactatgagttaatagaaacagcaaagaaccaaagaattaaaatgaaagttatataaatcccaactaaaacccaaaagtgaaagcaatgggcaaatcgctatcaaaactgctatcaattatcaaaatttgggattttgcattttgtatccttttctcagtcaagaaaaacattctttttgaataatatataacatacatataaaataatatataaaaatacattacaaacttactataaatactaaaacttactaaaatacttaacttactaaaaatactatcaacaatggctgtaaatacattatcttacatttttcttatagtcaatagg

SEQ ID NO: 46891 - DNA, 1416 bp, Bovine  19866881308903
ttttttctattctcctatagaatctaaaatttccaagtagcattttgggtccccagccttttcctcactatactgaaacaacttaacacgcatgtgcgcacacacgtgcacacacacacatttgcccacacacacacacacacacacacacacacactttcctttagaaatgtttgacagtttccatcgacttaactcaaacacttgattatagaccaactttgttgacagcctgctgctgctaagtagcttcagtcgtgtccgactctgtgcgaccccatagacggcagcccaccaggctccgcagtccctgggattctccaggcaagaacactggagtgggttgccatttccttctccaatgcaggaaagtggaaagtgaaaattgaaagtgaagtcgctcagtcgtgtctgactcttagcgaccccatggactgcagcctaccaggcacctctgtccatgggattttccaggcgagagtactggagtggggtgccattgccttctccatgttgacagcctagatctctctaataatcgccatacagattgttccattggttcaatgaccatatctggtttgtccccctggcatttcaaccataacttgagaagaacctaattccaccacagggtcgaatatggtttattcggaaaggtttcttatgagagatgaggctggtgcttagtcctgaaggtggttagtagtttcaggagaaaaaggaggataaaaacaagtaaagggtggagagagaatacaggttgatcagaagcaggatgatggagacccacgagatccgggcatgtctgaggactgccggtgtttactataatttttgcccaggcacttgtagacgaatgctggggagagcaacagtccgcttgcaaaggtctttgtgtagcatgtcaatgggaaatcatttatggattttaagtagatgagagatatgatttaattagtcaattaaaatattcattgtgcagcggacaaaggagtgatctaaacaaggcaaagctggaggtaagagagcaagtaaagagaaagagctttcctgtaaaaaatttaagcttttaagtgctaaataaataaaaatgaaaaataaaatgataaggagatgtttattgtaaatgcaaatatggttcatatcttttcatataaaaagctcacacaaattgattttggtatagaaaatacatgaacataccttcgcaaacatattcatgtagcatttgtaccacagtgtgaaaatgttcatcctcacttgttaaacatcataatccaaactgatgctatggacggaatgtttgtgtccccaaatttttatgttgagcccccaacccccagtgtgatagtgtttgtaggtggggccatcgagaggaaattaggtttagttggggcttcccaattaaaccta

SEQ ID NO: 46892 - DNA, 1227 bp, Bovine  19866881434035
atgtaacaatagctattaggaaaagatattttatctcattgcaaccccaactgaattaacatgattgtgataactgtcaatgaattgataatgactcacaataaaatgcctgaaatgttactcttaatggcatctaaaatggaacagtgagtcatcctaaatgaccaggtaatggctctaaaacttctgcaggagctgtgaaatagagccagggtacgaagcttccagtggtaaagaatctgcctgccaatgcaggagacgtcacagacatgggtttgacccgtgggtcaggaagatcccttggcggagggcacagcaacccactccagtgtttttgcctggagaatcccatggacagaggagcctggcgggctacagtccacggggtcacaaagattcggaaatgactgagaaactgaacccacgcgaatgcactataaagccccttaactccacccaagagattttctttttttttaatattgtccattcccatgtcagttcctctatttctcttcctcattctcatgaaattaagaaataccattaaattggaagtctttttgttcttactgtcccaatagaattaaattaaaaaaaaaggtttctttggaaacaaaggtcttttcttttgaaaaagtatgttaacagatataaagagactatgattctgtagcttgaaagagaagaaatgtgtttatttttgtgttgatgggtctgaaagcaattgtcaagatgtaagcgaggactttgaacttgagatttaaggttttgaaaagggtctagcatgagaaatcgactgacattatagatcaaccaggagaacctttatattcagaaaattggatttctattgtaccgtttactgctttcaagtataatcaacaagacagagcttccagatatatagaaattgttgaagaataagggaaaaataatttaaagtcaaagtggtaaaacgtattcatcttagatggttataagttacatgtatgattttctcaagcataaaacccattattgctatgacttttttgcaagatgagaacattttctactattagatatgattcactactgcagatcagatagaaatatttctatttcttttaaaattggatacaccacacaaaatgcaaaagcagacaacaaattctaaaaaatctttttgacatatgggataaatgttactatcctttatatacaaatagctatcacaaaccaaga

SEQ ID NO: 46893 - DNA, 1611 bp, Bovine  19866881492502
gaatttgggattttgagctttcattttacttgttagatcagtaatgtttgggctcctagttatgtagttttctatagaatccatccctggtttctggacaaactccaccctgagcagggactgcagagggtgcagacacgagcagccctgagatatatttcacgtgtctcattttaccttggtctttgggagagggtaatgagtagacctgctggtcaataaatgcttctcactgatctccatcaacagctttctttttcttaatctacagcattacatcttataacaggctgtaagcacagaaaaagtaaaagaaatacccagatagttcacaactaaaggtcagatgtactaaaaaatccaccaaataattacatttaccctgattaattgaatggaatgtccgttatccatctgaccttgcactggctccatgctaatcaggctcaaagtcctttcgtaacatttacttttgccttaaaatctgctgtccatgtaatatgcgactttcttccctccagaaagcttcgtttcattgttgagttggagtgagatgtaaagactttttttccccttgttattcactaaaaagggcccgcaagttaatcatctgacctcaacacaaaatgaacacaactgtgcttatttgtgcctaaaagagatagcagtacgcccactgaaatgcgtctccagccagaggtcaccgttaaggttattggcatggttttgtgaggaggctcgtgttgcagctgtctgcactgtccctagcctgaagataaatagcagacttcagtttccactgctactagtctcttaaccttcagtaagaacaaatgccccggctcacctccgcctgcttcctcagaatttacctcacaacccctgcccagcctccagcctgggcttcctggcgccacttccatcctttggggtgccccatgcagtgaaaagcggagaaatgccagcacaaggctaaaccggttgtagtaagtcacacgttcaacgtgtcacaaattaacgctttccacacacaaaccaaaatagcgacagttttccatgtggcctcatttgtaaataatccaatttgaaggtgactcccaaagtcatgatttaaggcgcgtgcatatgagagctgaccaaaccacacacgtggttgtgcctgtgcctaccctctggtggggaacggagcctggccctccacaggatgacccaggaagccagggctgggtgggtggcggtctggtggatgggtgctcacaagcaaggagtgcaaagattttttagaaatctaaccattataaatggccctccttctgaaggtgataatcaattcaattgttgctgttgcttaatagctcactcgtgtccgactctttgcgatcccatgaatcgcagcacaccaggcctccctgtccatcaccaactcccggagttcacccagactcacgtccatcgagtcagtgatgccatccagccatctcatcctctgtcgtccccttctcctcctgcccccaatccctcccagcatcagaatcttttccaatgagtcagctcttcgcgtcaggtggccaaagtattggcatttcagctttagcatcagtccttccaatg

SEQ ID NO: 46894 - DNA, 1111 bp, Bovine  19866881514995
gttgtgaagattagatgagacgagatgaaatacacagcacagtacttggcaagaagtaagcactcagttaatgaaaactgcttttatttttattcttcttgttattgtttgactaggacgtgcagataaaagacttggccaagaaaaataaataaggtgccttttttttatatatattttatgagtcccaaaaataaaagatcaggaaagcaggctttttacatttccaaaatgattttgattccaaaataaagaccaacacttgaaagctctggaatattgtctagcaaatttgggaactctgaaaaaagagatgagaacagctgacacactacagcttaaatataatcagtcactgaaattgctctgcaatttgtttcactgttttttctgtggatttctttttttaaccatacatgtgtcctaaatatataattatatggcggaatataatagctcatttagagttattgaggtctattatataatccagtagtatcatggggcggggtttggcgaggagtgatggttattagcttgaatgaatactgaacacaagcccagatagatgttaatagatggtcttagtacttttcttcttgtctttgccaaagtcagatcattttcttgcccaaaaccaaattgttttaaattgatgttacatgttccttcaaaaggtcaagaaggcgtctatgtaaaatgtcttgagggcagagtgtaagtgtgggtctgtgtgtgtatgcatccatgtgtgtgtgtgtgtttctctgtatgtgtgtctgaagtctgtgtttctgtgtgtctgtacggagcgtgtatgtttcaaaagttaaaacctgcgtcttagacataacagacaacttttcaaggaataaataagtgatgcaaattcccccctccccagacaccttccctttgcaccagcctgagaaatgtgagtaacttttaggccaaacaggaacccacattcctcctaccacactcactcagattgcaaaaagaatcagccagagccgtgatcttccaacagagttaatcattttgccaatatattcctgttgattaaccaatggattcaatgcaggcttttttgtcaatttccattcctatt

SEQ ID NO: 46895 - DNA, 1264 bp, Bovine  19866881724625
acaatgacaacaacaaactttactccacggcagtggatgctacaacaagaggattttaggggccagaaaaccaagatgtcagcggagtggataaagggtttgagaggaggggatcatggcagagcctcgacccatatgaacaatccaggacccctggttccctgaagaccatcccagcatccactgccttccctggactggggaagggaaaagagaaggacagaggtaggttagtttttacttcaacaacacttacatctactggttcaactcacacacaaatactgtgcctgcactgatgttagtaaatgtaaattaatagtaaaattattatgacataaacaaataggagggcggagacctggatttaaaacaacaaccaaaaaaccctgagattttattattctgtgatataccaaagaaaatgcatttttaaagcgtatcaggacatattttggtctacaacagccacagaacgaccagacacgcccctagaactttcatttatgtttttaaatattgaacgaaatccttgtaaatcatttccttcaaaacaatgtcttagtgattcccgcaggacccactagtcgctgcaaccttaggataagatgccagtttctcagtgttttactcaattaacttcataagctttcatttggcttcacagcagcagacttaatgaaatgggagcttgtgcccagatagcaattggccgcttcctgcccagacactgtggtttcacatcagcccttcactctgctaacacgaaatccccattaatgtgattgctttaagtgatgctgcagggagcctggagcccagggtgcccccagcccccacccccagctcaccatgtccttgcaggggtaagtggactgctggccaggagatggtgaaaatagcaacacacagttgtcttggaacaaagctctcagtgtggttagcaccaggctctgttcaccatccacaaagcatgtccaagctcactgccccctggacgttagcagatttgcagtaggtcatacctgtctgcccacttccccagatctcagctcccaatttggagaataaagtcgaatctgccttgatattatgcaacctgctgatacctggccctcatgacaggtagggccaagccgcggctgtggcctttccagcagccgggataataagacgcccactgtgaagagccatgtcttttcgggtaattcaggaggaacctaaagaagagccctgtctcccacctgtacacatctgctaacac

SEQ ID NO: 46896 - DNA, 923 bp, Bovine  19866881844186
tatggagccaagagactgaatcgaacagttgagggtttaaagaagttggagcatcgtagccattattataatgaagttcactgatatataatcatgggtctgggtgaccaggcacgattcttttaagtctgagaaattgtaaatgatgcagaggagttttttatggttaccaactagcctccccaaaacttgtggtcatgaccaaccgtcctcaggtctccgatctgggcgggggttgggggggcacacctactctcaacttcatcactgggtctccaacacctctgtcctgaagctttcaaacccggcagatgagaagggaccttctcctccccccgccctgtgggcgcaaggtcccggagaggccgaggacggcaggacagtaagaggaacgcgctgctggcccctcctcccaaggcctgttcatttgtctatctcttaagtttggttccgtggcataaaaaataggatttatctttctccacagatgccacaaacagatgctgagaaccagagaccttgcagagtcaataaaagataagttataaaatctataaaactgctgaaagaaatcagaatttcagcaacttccagggtgctatttttttttcccccagactgctcctttgatcaactatagggagaggggggaagccagccgtgcattaattccatctgctgtttctcatggcacgcgtggggccggaagaggggcccgaggtcacagtgatgctggagctgaggtagtgacagagtagaaatggagaatggtgcccttgatggagacaaagctgtcataatcagttagcatttcacttttgtaaagatctcggaggtgatggattccttagattttaatgtacgtcttcaaagtaattttgtaagctatttaagcgatgctcccttttttacaactctacata

SEQ ID NO: 46897 - DNA, 981 bp, Bovine  19866881885244
ttatacgtttggtttttagtagattttattttctaaagacttctcaataaagataggagggaaaaaaaaaaaaagaaaatataatctgtgatttgaaaactaaagtgggaccatgaaaggaaaactagatgcttgcctcttattggtaagatgcaaaattgtctccagttttctgtttggcatgagtcactctgtaaacctccaaacacggcagcctggcgtgcaccccaccgctgcctacacgtgaggtgggatggctctgattccaggctggtctggagtctggggtcaccacacgtagaccctctactggagaactgatgagagaagatcaggatgagttctcaccgagacccgcctggacctggcacccaccctctgtgatgttccctgcacattccctacagaacctctaccagcccactgggcacctttgtgaaaattaggagaagacatcctttcattcaagtggacgcagcccagggcccaggtagagagagggcagacgtcagcccaaccagctaacataaccaccatctgcacccaccagctaacataaccaccatctgcacccatcaaaaggagccacgatgtcactgcccacacaggattccaccgaccatagaagcccttcccagctccctcctctgccaccaaattctcaggccacttagttcaactaacaatgcaacattgcaattatttgttggtgagtctgtttccccagataaactctgagcattttatgatacatttaataggtagaataaattatttgattgacattttatggaattgaatacagcttttcattttaaaggacagattacaccaggtttgactgttattttatttccaggggaaacccttcaggctttctgagcaatttaacgttttccgagcagatttacccaaatatgaaaatagccactgtctagaagcgagcactcaccccagcgatcaggtgtgtgactctcatgt

SEQ ID NO: 46898 - DNA, 1045 bp, Bovine  19866882021275
cattcccacccccacccagcagcctttcccctgaggccttcgagttattcaagaaaccgagcacgtagcagaacaatcagatgcctccccctcagatggcttggctaatggccacttcctgtggttgtcaaatgaaaagagaaaaactagcacatcccccgatgacttactgtatcgcttcccgtatctgactctctggcagccggcggtaagttcacatcgcttgtaaattaagagccttttggcgtgggtgccgcagctgagccctccgccccgttatgctgattataaggaaaccctgccaggacttccattacgaatagtcatttcctaaaatgtggctccaacagccctgacatctaatcgtgcgttaaatgactgaggagctgctctgtgcacccctgtagacccccggcgcgcatcctcaagaagaaaaggacctcttcaggattcttccaacacacacactgctcacgggatctgctcttcaccacgacccccaggccttctgcctcgcagcccctagacctccggcctccgggccaacccctgcactcttctgcatttctgggcttgcccagatcttaccccacatcacagcctggcctgcgagaagagtcagcttgaggtccagagctgctgaggctggaccgcttcatcagggccccgccagcctcatcaagctcgggcacacagctgggcgggctccttgctgtccatgttcacagagatgtctttgctagcctgactgatgcttgagggaaaaagactctcctagtgcctggtagctcagttggtaaagaatctgcctacaatgcaggagaccccggtttgattcctctgtcaggaagatcccctggagaagagaatggcaacccactccagtattcttgcctggagaattccatgggcagaggagcctggcaggctacagtccgtggggttgcgaagagtcagacacgacttagcaactaaagagagaaagagagagtgcctagatggtatggtgtgtgtgtgttgtctggttgctcagagatttttttct

SEQ ID NO: 46899 - DNA, 944 bp, Bovine  19866881032336
tgagaatatttattcgttggtaaatattttaaactaaatgtgtaaatgtataatgttaaacatagaatttcggaattaactatataaatatctcatatttacacttagtacagctttttatttgatcaggtcggaaatacttaccactcagaagaacatggctatgcataattatacctgaccatgggaaaaataagtacctcaaatgcatgtatttgcactggtgattccaactgcacaaacctttgtgccatctgtgtgtatatgtatttttcacatgaattgacatgcacaccattttcattcagtatgaaccttgaggctgctgccattttcccatttaaccaaaccgatacctgtgtaaatagcctaaaggtgatccttgaaaacttgtttcatatatatttcagaagttattttgcataaatattaaaattccaaaaagctgcagggtaacttaatgtataaaatattacaagtatggattgcagacttcatacaatagatgatagtgtataaattctattgaatgcatgctttctgttttaagcatgagactgtacacgtttactgtaagtccttgcatctgtggtgctaggtgagtgtgagaaggtgtcaaggactgaaaaaatattttgttgcctaacaaaaaaaaaaaaaggaaaaaaaagttgtctgtaggcatgttaaatatgcttaagtgtgtctctctctacctattacacaccattgctttgtggatttgttttatgtatgtgcgtgtttacagtagataaaaccctgtgcaaaaaataaatgtcctgaattctcattggtattctttattggttaatgaatgtcatgcatgtaatttatttagaaatgtagaagatgctactatatgtgtatgtgtattattaggattatacaagggtttcttttattagaagcagattgttttggca

SEQ ID NO: 46900 - DNA, 1783 bp, Bovine  19866880036615
actttatttttctgggctccaaaatcactacagatggtgactgcagccatgaaattaaaagacgcttactccttggaaggaaagttatgaccaacctagatagcatattcaaaagcagagacattactttgccaacaaaggtccgtctagtcgactatggttttccctgtggtcatgtatggatgtgagagttggactgtgaagaaagcttagcgctgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcaggcgaagatttgactcattggaaaagactctgatgctgggacggattgcgggcaggaggagaaggggacgacagaggacaagatggctggatggcatcactgactcgatggacatgagtctcagtgaattctgggagttggtgagggacagggaggcctggtgtgctgcgattcatggggtcccaaagagtcggacacgactgagagactgatctgatctgatctgatctgatgtgcattttcaagaaccatttctggctgcattgttgtttcgccttttctctaagtaacttctctctgttcactctcaatttatacaacatggttctgctacaatttgctgccagccatagtctgatttgtctctttattatagaggccagaatgtgagaacaaacttcattttggctctggcaagccagatcttgatatgcagtggctcccctggtagtaattcaaacatgtttcagtgtccttccatagtatgtgaatataggtgctttatacatatttttttcacctgtggaaagtagagttttagataatacttttctcttggtaaataacacatttcatatgaccagtttatgctcccatatgttattcatgatgatgtctttctattagggacttcctgagcagttacagccctgcttcatcaataaacacagatttatattgttttcatgagctctaaagtagtaaattttctctaaacaaggattatggtaaatataattgaattatagattcaaaatacatatttataaaggtcctgtgttcctggaagcccatgcaaaatgtaactgatgatcactaatagaatatttcccattaggaacagcctcaccagcctatatttctgcctgatcctaatggtgacactctctgctttcctgtatataacttccaaaaagtaagactttaaaaattaaatctcatatatttctcctttatgttttagctcctcctttgccttttgcttcaacatgccactctgtgggatctgttaatatggaggattaggaaaagagtccctgttgatacatttcaagtctgtttaaactataaaacgaacagacagttttatttcattccttgtgtgaagctacacagtctaatatgaaatgtaattcatataattacatataattacatttataaaaatatagaacagtctaatatgaaatataattgctctagtaatccttgaaactgccctataaggaatggcatttgaagatctcagtgggacattaattcagttgaaattgttgtatttttcaggtccgaccctaacctcccagttttcctttagtgatatagtatgacactatggaagaatgtccacaatcaaatttccttttctaagcagatgatacagcaagtctttttttactcataggt

SEQ ID NO: 46901 - DNA, 1881 bp, Bovine  19866880216374
atactaacgcatatatatggaatttagaaagacagtaccaataaccctgtatacgagacagcaaaagagacactgatgtatagaacagtcttttggactctgtgggagagggagagggtgggatgatttgggagaatggcattgaaatacgtataatatcatatatgaaacgagtcaccagtccaggttcaatgcacgatactggatggttggggctggtgcactgggacgacccagagggatggtatggggagggaggagggaggagggttcaggatggggaacacatgtatacctgtggcggattcattttgatatatggcaaaaccaatacaatattgtaaaattaaaaaataaaataaaatataaaaataaataaataaataaaaatgtaaaagatagactcataataggaaagtagcatttactgtgaaggattctaagcaactacttagaagcaaaacgtggcctagtgacatggcagcccatgcatacatgttggtagcttattttccaagcccttctttacaacttcttccactgatttcttattttggatctgccttatgctagccagagaaagccaggtggtcacagaatagacaccatcaccatatcccaaagctctgtgaacaatatgcatattctgaaaccaatcaaactctattacaagaaaacctgaatgaacctttttgtaaccctcagtcctcatacaccctgatcttttgataaaaggtattatttttcattttagttgctgatgatctatcaaagatggcaacagtttccacagttttctctttgatcttctctgcagagctagaattctagattaattctaccaggtaccacgatataaacccagcattattgagtcataagcattaccctttcatttctaactttccatatggggaacatatatcttttcttgcaatgatttaaagttttgatcaaatgcatgccacattaaatgtttgcagccatatagtgaacgcattttggctgtttaaaactcagccaagatttacaggataattccattgctgaagttatccgtgacaaagtcacagcaaagccaaaactcctaatacatattgtaaagtgtaatttattatggttcatttagactttcaaatatgaggtacaatagggttctgggtggtgggtgggggtacaagattttgtagttggcaatttcttctggagaatctatgatcttaatatattaaaaaaactcctgcttctgtctgtgaatgttggcacaactgtcagggcttgtgcacaggcctggaatgaatgtcccacaactcagatgatgctataagcagcatcaggaggaaagtcagtttccttccgtacattacgagagtacacaagctttgtctcatgcttagagataacagagtttgctctctttaaattatttatcaacccactaaagaaggaactaaaaataacttggggttgtatgttcctgtaaagaacagtgactccttttatataataatggctatatttgaaagcttttcattcatttacagatatttattgaacactagctatgtgcagggactctgctagacattaggaatataaagaaaaaattcttcaaggtcttgtttaactgtttgtctttctgcctgtaacaggcagcctatgcctatttaactcatttaatgtttccatcaaaatcaacttctcaattgattttgttttccattcttgagcacttttgcctttatggaaatgtctcccatgtgtagatgcctggaacttaatgtcaaagggcaggtgtgttttctgttttggccatatgccattcatcatatgggcacatccatatttcatcttggacatccgtattatacgatatgctca

SEQ ID NO: 46902 - DNA, 1211 bp, Bovine  19866880386467
actattatcaaaggcagtttaaataatagtaagttactatgataggctattgtactgaaaccttaattacttgaatgaatgcaggtaagccaaagagtagaaagaaaaaggacctcttcatcttttgtttcactttggtgaacatgttctgccccacaccattcagtacttgattataaagtacttttatacctgtggtggattcattttgatatttggcaaaactaatacaattatgtaaagtttaaaaataaaataaaaaattaaaaaaaaagagaaaaaaaatattatctaattggtgcatatatatttgttctatctcaaaagaacccactttctaaacagtctctgtttttaatatgatgctgattaaccagttgggacttccctagtggctgagatggtaaagaatctatctgcaatgtgggagatccgggttcaatccttgggttggggagataccctggagaagggaatggcatctcactccaatattcttgtctggagaattccatggacagaggaacctggcaggccacaatccatggagtcacagaaagtaggacacaaatgagggaataaaggacaagcactttcacttttaagcagttgtgctcttgcttgctgcaaaagaaaaaaaaaaagagaattggctatgtctaattgtctatctgtaggtgtgtatctttctttatctatgatctatctatccctatacttttatatgaactatgatatctgaaaataaaacaaaagtaatataccaaccaaaactagttttcataccttcgaaggcatactcattggtaagtttgataaataatttaattcccaggcttctcacttagaaattctgatttggtaggtcagcagtggtgcccagggctgcatttaataagctaacctatgattccattgcaagtgtttcttctaaccatgttgataaaacattgatttagagaatctgtgttaaggatgattctggtttgagtttatcaattttctagctattcaacttatacttccagagctggtatttggctctgactatctgaaacccaagtttatcccagaagggcattattagcctattctgaaccccgcattcaatcctactttcttttttattgactcttgcttgacccactcaaaaataactattatttggtccagtgaggccccaggctgttacatatttagcacttccttct

SEQ ID NO: 46903 - DNA, 884 bp, Bovine  19866880437342
cagtagtcatttatggatgtgagagttggactataaagaaagctgagcactgaagaattgatgcttttgaactgtggtgttggagaagactcttgagagtcccttggactgcaaggagatccagccagtccattctaaaggagatcagtcttgggtattcattgaagtactgttgttgaaggtgaaactccagtactttggccacctgatgcgaagagctgactcatctgaaaagaccctgatgctgggaaatattgagggcaggaggagaaggggatgacagaggatgagatggttggatggcatcaccaactcgatggacatggatttgggtggactccagctgttggtgatggacagggaggcctggcatgctacggttcatggggttgcaaagagtcggacgcaactgagcaactgaactgaactgaacagaatttaagatgaaaataaactttaacagatactcatggtggaactaggagaaagaatcttccaggggatcccaagctctccatgagaaggtactgagagagcaaggtgcagggagagaaaaacagaggtatggctgactccagctctctatcaagcagctggttctttgaaattcctacagccatggatgtctcacaaacacaatagaaggcacacttcctgagtacttctgagtatgattggaaagtattgcattattctaccaagcaaagatgccactttcttttctgagagatctactgaatttagagatcactagaggaaagttttatatttgaaaagatgttccaagccaaagctttcactctctgaaatactgtatctaccctggttcaaatggaagaaactccactgacctccaggaaactggatatgtctcaataatttga

SEQ ID NO: 46904 - DNA, 1579 bp, Bovine  19866880479605
tggaggaaatattctctgttctgttaggatgatcagtcaaaatttagtagccaagtgtataacatgccatgaaaatgtgctgctcaaaaagaaggacatccaagtttattttataaaagcctctgatgaccccagtgatagttaagaggctttcggaaatgaatgcttttaataaggctaaacagttcacaaaagtggacagctattattttgcactttgagttatacttaatatcttctgttaaaaagaatttctatgaaagttacatttacagattgacaggagggggctcataacaattttttaaaatttatttttaattggaagataattgctttataatgttgtgttggcttctgctatatatcaacatgaatcagccataagtttacatatgctccttccctcttgaacctcccttccacctcccaccccatctcacctctctaggttgcatgacatttttttttaatagtacttataacccataaatattataatgggatgtgatctacacttgcaagtcatattatatggtttagctatagctgtggggaaagaatctaagtgcctctttttccttgatgaagaatttagctaacgttccgataaccttggccaatcaggcatactgttctctgatcatggaattgcagttactcaatgttctactgaaagagagcattaaaaatcgtcttgtcaggaaactcacatagctgagaagaaggatccttcatactgaatggaaaggacattttttctgacacagtctggaaaccaagttacagatgattgtaaccatagtctcacttaaaaagagcttgccagaggcagcatatattgactgatttgcttcttgttatcctgaaatgggaatttgactaaagttcaagtacttttgaaattttgtgcatcatttcttccttcaaacttgttgaattttaagcagataaattgttgaggaaatacaattcttttgcttctagccacttactaaaaagagtaaatgaatcctgccaaaaacaaaacaagacagagtggaagaaaagcagaacagttaaaaatgaaagaacaccaagaaaatctcaaaatttatgttatttgtccttcaacacctatcagatactggtgaggatttagaatatttcattggattttagtcccaaagaagtaggactttctctgttctgaaggagagataatgatcaaaggctaaggaagatgtttctcttttttaaaaaaaaatttttttaagaactttttgtaacgctgctgctggctaagtcacttcagtcgtgtccaactctgtgtgaccccatagacggcagcccaccaggctcccccgtccctggggattctccaggcaagacacctggagtgggtgaccattgccttctccaatggccagttaacacacaatgttatgatagtttcaggtgaacatcaaagggactcggccgtacacacacatgtagcctttcgcctctaaactcccctctcatccaggctgccacgtaatattgaatagagttccatgagctatacagtaggtccttgttggttatgcattttacatat

SEQ ID NO: 46905 - DNA, 1329 bp, Bovine  19866880568330
tagtttttctgtctatattctctggcaaatagtaaacaaaacaattatttacctgtattcagctactgatgcctaactagttctactaatatgatttgttcaaacttttactataaagatgagtgaatgagtataatataacaaaattttccatattcacatgacattttaaagttcctttgatattgaattttctccatttttggtaaagactgctttacttcatgttaagaaatatgtaatagtttattctcaattgcaaacaattatcttattacttaatttttttttgccttcagatataaatgaatctcttaagctggaaaataagtaatttaaagatcctatatgaatatttaagtaacttttttctgccttcatcttttttcgtgccatttagtctctttcacaaacatctaatttgccttgatttgaactaagcaggcagcatgatttttggtacaaactttggttttaatttttccatcatcttctttagaactttagagtattgctttactgcattgcaggttttaaacatgactcttactatagccaaattttcatatcatgctgtccacttctagaattctgtgaataaaataatgctaattgtgttctggctactaagtagtaagtaatagtaagtaggcaaaagagaaccctaaattttacataatatcacttttagctctcatcatatttaccacagaatgctgataagttgatatatttaccctacctgtaggtattaattaatacttacaagttggtactctcatttaggtaaaatgttgataagttgatgacagttcagaaataggtcattgctgccgggagagaaagcatttttttttttttttcccaaagaaattctctaagaaacacttcttacctcaaacccattattgaatgggcacagctgcaaaacctcagcactcacgaggggctttgctcattactccatttctcagatgtcactcacagagctccccgcacagagaaggcactgtaatgactctcgccttcctgaaataagtactttgtgcaaacagtggagcaggtgtacttaggccactgacatgacaaagtacaaggaagatgccctgttcaaggatgggctgatttgcacacagggaattgatgccacttaggagtgcacattggttgagctaatccaattgttgtttctccttgaaaagattcagaaaaattggtggaaaggatgagggctttgtaagagctcttggacagtgtcctcacacttaagtaatgggcagagcaagtggaagccatagcaacatctgctcctgcaaaccacgctctagt

SEQ ID NO: 46906 - DNA, 927 bp, Bovine  19866880602793
ttttagtagcattgtaatatgaagtcttttagagtaactattctgtttccttcactgttagaaagtgaagtccaagttcatggtaattgacttcatagctcctttgtatctactgactaataccgttcattaagtagacaatgaaaccagcagaatagcattacagctctgtgcgtgtatgttgtggaatgtgttaacatgtttttgacttaaataactgtatataccactttggagaactaaagttgatgaacttatttgtctggggactattcaaatcctgaaatttttatctgctggatataatgttgtgggaatgttaagatagaggctgctgctgctgctaagttgcttcagtcatgtctgactctgtgcaaccccatagatggcagtccactaggttctgctgtccctgggattctccaggcaagaacactggagtgggttgccatttccttgtccaatgcatgaaagtgaaaagtgaaagtgaagtcgctcagtcgtgccggactcttagcgaccccatggactgcagcctacgatgctcctccgtccatgggattttccaggcaaggtactggagtggggtgccattgccttctccaattccattatacatatactcaatattgtggtaagtcttaaggtggaaaagtatagaatgtcatgaaaacaaatcacaagggcaccaatataaactaattcctacctggatacttcccatctctttatttggttcagacagtaaagaatctgcctacaatgtaggagagctgggttcgatccttgggttgggaagatcccttggagaagggcatggcaacccactccagtattcttgccttgaaaattccatggacaggggagcctggcgggttacagtccatggagtcacaaaagagtctgagaaattaatacttttcatct

SEQ ID NO: 46907 - DNA, 1875 bp, Bovine  19866880638891
gctaaaatatgttttcaatgtgatttatttttcttccttttgcatccctttgattatttggacctgacttttaaaacaatgaaataggttctctttattgcatctcctttacatagctctgttaaccattttctgaaatctggcaaaatagtgcagataagcatacagtagtgtgggaaaaatattttaaagcaatcaagaatattttatcaataatattagtttatctttttccttctcatgcttaattactgcatactttgcaatatataaaaaattttaattccatttaattccagtggaaatctgtcaactgccttcagagatttcttaataggaaatctaataggaattcatttggaaatgtgaaacataaaagactcagtgatattctcctaccaaagcaagactgacttttgaacagagcctctgggaaaaagaaattttaaaaaattcacaaagtcttctctttctaattctagataaacagattgggataatctttaggatcataattaatgtcatactaactttaaaaaggcatacacaaaggatgctagttatcttttaagttaaccacttaaaatatttttcaaattctagtaagagcaagtgatagtaaaataaatccttatattcaatattaaaattttcactttagtaattttcttttagatacatttattctctcctaatgacaactataaattaatattaacttgaaaaacttattgcctgtttctacagacatcgactaacttgtccatattaattagctgattgttttttaatcatgcataagtgagttgtttaaattaaccataatatgttgagagaggaaaccatataattaggaggcaaaatgagattcctttaaacccagttgtcagttgacataaaaagtaaaagattatgattgttttaattttattattaaaacccgtggaagagcagaacataccccttttagctgttagactgttttctcttaggtctccacaggatcatcaaaacagcctcttactcaaacaagagagagcagttcaaggtggtatcatgtataatgtctataggtagttcaagaaaggtgtttctgtatgaagtggaatggacagatcctgattgcaattgtgcagatttttagatgtaatagtttaggactcgtggacacagccaggagagagctttaaaataaaccttcaagatgaaactgttgcttgataaacccagctgaacaatctgttgtctgcaaagggactattactctgatgaggcctactggagtggctcaggtaaataggttgcctgaaatttcctgaaataaacaaaacagttatttgtaatttcatctttctgggacagacattaatattattagaatttgcatcaataaacttgaagttctattttctaattagttgattactatctaatagttgtcatcactaataaagattatctaataagatctatcccagatatatgtatatatggagacatgttaaccaaatgaaagactacaaataactgcacatagtcacagatacagatttatttatggtttgggtggaacagtgtggtcaaattttgaacaaataaaagaacttaaagtttttgccaccccccaccccaccttagaatcttttagccactagaaaatgtgaaatgaagaattatccctgttggtcacttgaaaagtgattttctttggcccaggttgaaaacctgaagttagctaggtggcaggacaagaagcgggtataatataaatcttcagtttttattttaagcattgagcagcagcattcagcaagtctatgacttaatattatgtgtttaatgttatgtgctgcaccacctgtagcaacgtagatg

SEQ ID NO: 46908 - DNA, 1440 bp, Bovine  19866880649148
aatatggagcttttgacacaactagtaaatccatttatgcctgagatacagccaacaaactgcaatatatagaagttgttcattctagcataagcctgggattactttgtgattttttttttaaattacagaaatcataattactaaatttgcatcttggttactctcaatctgtccatggtataaattaaatttgccctttgacttgtgtctaaatgaaagagcaaattttagtgaggagcagctctgtattcagaggtaaacacattcatctttgcattagttctgatgaaatctatccacaggcaggttatatgccaggacactgatatatgccacgaggatgcactgctatgaactctatctcagcaaagtcctccagatggaaaataaattggaaagcttcctccagagaaaatgagctaacaggaaagatttgagtctctgagtttaggagctttgcctagagttagttcctcttggggaaattcagtgaatgtgttcctagcaattctaggaagtcttgagatcttttaagacaaacattatggtcttatgtaaattcaagtaaactttctttgggaatatagcccggggaagtaaacttgcaaataagtttgaaagagttcattgcaacttgactattaaaagaaaaatatatgcatatttactcttccttgctttagatgaaatctaactgggagtacaggagacatgtaaaataaagtgaagaaaaaactggaaattgtcttcaagttttagaaatacataaaagtagcaacatcatgaaggatgttctcagagacataaagaaggatgtgttagaacaatatttacaccctccaagtaggatccagagacatggcctaaatcaacagttacccatgagcaaggaacccacaagcatgtcattctaaacgagtgattcctaaatgtgtcaaagctaaattcaagcaatgacagtcttttagcaggagcatgccatttcccctagtttttcattaggctgataacaaacactacttcatatatcctctcatgtgctatctgactcacacagactcacattaggagaccacaaaccaattatctctatttccattcggcaaggtaataaaatgtctttatcctcagaaataacttaacaatagcatcagcatcaatgacatttttcatattgactgcagcataaattcagggcattattaacaaggcataaacagagatttaaaatagcaaaaaaaaaaaaccctttcaataaaaatatattaaaggagaaagatgttgcagacatactttttctatatttttattgctaaatataactacaaatcctgcacattgtatataacacaaatataagaagagtctgaaactggagaaagtagacagtttatgcatctcagggccctgaaatcaacacaatggtgtgctccccag

SEQ ID NO: 46909 - DNA, 1417 bp, Bovine  19866880661038
aagctgacttttaaacttctcttactgtcccaggccaatgatcacaatgcattacctttaaatgaatgaaactgcatataataatttatgagaccccccattatatattgtttataatactttggatagataagctggaccagatatgtcttctgagtattctgcaaaggaaatgtgtcctgtaaaacactattacataagtagaccacttgggagatgtctaaacaatgtatgaatgtacaaatactcatgaagcacacaggataatttataagcttttatttctaatgcaattgctgaaagttaatgtagaagccattcatttgagcaaaccctttaggaccattacatgcaacagtaaggtgaattctgcctactatcttctgaaggaaagttcagttgaaacaaacagcattatgaatgacccccaattcatggtgaaacagatttccataaagactttgggttctgtgtaattctcacacattgatattatgatttaatgcatttcatgtgtatctagctttggtcacactatctttcttttatttttattttcttctctgtactctcctctcctttgtatgttttactccgtatatgtaacaggcagattctttaccactagcaccacctgggaagccctcatacctaaatcaccctaccccaatattgtctctgaattggaagtttccaaatgaggagggactagtaagcaatctctctgctgggaatctttctttaccagtcttagcaaatagaagcttgctttctttctttcctgctatctatgtgcagcacaattctgttcatgaaataataaaggattctgtcatggttatattgtgatacaataattttgatggccatgaatatgcacaccatgatataatagtgttcagtagggttgaagttaataaaagtgatacatagctacttcacaatggcaacagctacaaggatttctctcttttcaaatgatctcccaactgtagtcctcttgaaggtttaagggaactgctctgtaggaatctgttcagtcattctgacacactcttagaaaaggagactggtgatgatcaaacctgcctgctagatgataatagcaacttctgcctgttctccagaggcctatgaccatcagcagaagcatttggctttacgagctatcaatattgtgtcatcctctaaagtcaaatctctggaagatagactcacacctttttctcttacataaagtttactgcatggagcaacactaaaaattattcatacatgtccaatgtcacattattaatatgagtttctgaacccaagaggaaagtgttctgtcatttagcttgaatatgttttccattgctttgcaagaattttaaagttactcagtgggaattcctttgggaatcatttcatagtt

SEQ ID NO: 46910 - DNA, 2818 bp, Bovine  19866880696721
atatttaaataatatagctgagagttgagtatgagaatttggcataagcaattgacatggaaagacagggggtgggattgggaaagagtataaggaggtcagtttggggcatgctaagtttgagatgaccatgatttacccaagtaggaatgtcaagtacacagttggataattgagtctggacttcagggaaaggtctttgctagagagaaacatttaagaatgactatcatggagatggtagttaaatccatacaattggatggcttcctttcttaactcagagtgaaagccaaaatcctgtaatcaccaaggaaaaagttataaatagaaaatgtttacagacaagagacattttggaatctaaagattaaagatttgaaggaaccagagaaaagactgagaaagtgttagtcggtcagtggagtctgactttgcgtcccatggactgtggcccttgggctcctctgtccatgggattctccaggcaataatactggagtgggttgccatttccttctctggggatcttcccaacccagggatcaaaccctggtctcctacattgcagacagattctttaccatctgaggcaccagggaagcaagaatgagaaggaactgccaatcaagtagtgttaattgctcagtcatgtctaactctttgtgaccccatggactgtagcctaccgtagcctaccaggctcctcttcaaggcaagaatattggagtgggtagccattcaacaaaaccaaagatcagtgtcctaggatagtgattaaggcaagttagtcttaagtaataaaatgacaacaaatatttaatggttgaaacacagcagagatttgtttttccattacctaatgatttaagccagatgtcctggaatagggaatgcctttcttacatgaaatgagtcagctattcaggatttcactaacttatgcctggtgccaccatcccctggggattcactgttattttcagttaacagtttaggaatattgctagagaatgtatatccacttcttactttactggacttggaaatggtatgtacctttcccacttatgcttccgtatcttattactcagtcttatggtcacacctacctgcaagtgaggtttggaaatgtggtattgctgtgtgtaccataataagaaatcgattttttttttttaatgtatgaatagctagcagtccatgtcatcaccaatgtagaaatttttccaagttgccactctctgaattttaattttccttcaattgctattttcccaaaatggagtaattgacagcatttattttgtatccctgatggctttcacattgactaggcacttagaagttcaacaaatattgttgagtataaaggtgaaggcattcgaattggaagatgtttatagtttacaaaataaatgagtaatcaagtacagtctccatttctttgggtaatgtgaggctcagagaagtgtctggctaaaacccacatagctagtaggtaatggatttggcccttaaactcaggttctctgatttcaggaatatgaataactttgatcgtgcttctctgttttgattcagttgcaggaaacctaaagtgaaaatgaaatatttaaatagctaactctgaggtgtaatttagtgagagttttactctaccctctatataagtattgatcttggattatgacacagacaatgagctattctgtttctctaatgacattatgttgagcggagagtctggtggcacagacattggcattaaaatttaaaattactgaggcaagctggaaaagaaaacaaatgaaattcagcagggacaattcaattaaaggactacagtgtagaaggaggaagaatataaacagagaaataatcttaaaacaaagtagaatgcaatgcctaataagagaggttcatgtgaagtgtcaggaaagctcagtggagaaaaactacatctcaccttgattcaagtcatgttatgctaaagtcgcttcagttgtgtctgactatttgcaaccccacggactgtagcccaccagactcttctgtccatggcattctccaggcaagaatactggagggggttgccatgcccttctccaggggatcttccccacccagggattgagcccgagtctcatgtgtctcctgcattgcaggtggattcttcactactgagctaccggggaaggcccctgattcaagtcaaggctgcagcaaatgctgtgctactggaggagcgcatattccagtttttgtttgtggggccacgagtgcctttcacaagaagtatactgggttctgtttcaggaatcaggaaaacttttatgatggctcttgaagtatcagtagtatcttacagggcagtgagtatttttcaattataacatcattatttgcaagtgacagaaaacctttcttaaagtgatttaaataataaaacaagataatttgctcatgtcattaaaaagcactgaaacaaatgcttgatcaaagtctcaaagtaacctcctcattttagtcttgcttttcatggatcagtgttggctgcaggtaatcagtctctcttgtggtggttgagcctttgtagcagtttccacgctccagatgtcattcctcagagtgcatagcagaccaggacatgtgtcctgagattccttgcctaaggcctgggattccctcagggtgcctgctgggatcaaatgtttgactcctagacctcagggaggagccccatctcttgaaccaagtgatacccaagtggaaataatcagtgtttaaaagtaagggagacgcctcagagtccaga

SEQ ID NO: 46911 - DNA, 1262 bp, Bovine  19866880771477
gctccgccgtccctgggattctccggcaagaacactggagtgggttgccatttccttctcaaatgcttgcaagtgaaaagtgaaagcgaagtcgctcagtcctgtcaaactcttcgtgaccccattgaccgcagtctaccaggctcctccatccatggggttttccaggcaagagcactggagtgggttgtcattgcccctgagctctgattaaatacacaggtaagctcaaatggtctaagtgaagacttatccaaggtggagtaatttaagaaagaaggaaagggaaaagagataattgggcaggtgatttggaaagtgacggggacagaactaataagccagcatgtgttgaacatgatgtggttcagaactagagtggaagcacctatttggaaggaagcatacaagccagggaaatcaaatgggcagcaatgatcccactcagcaaatgctgcatggaggcatcctgtgccccatgaggccccagtgatggcatcatgcagatgtggcccccgggtcccttctatttcatctttgtcaagaaatgtcaagcatttcctatggagtcagtataaacagatgcaaggggcccatataaactcatctttcctttcctttttctccttcccatcctttcctttccctccctttcccttttcttttcaaaatatgactgtctaaacaaaatctgtgcctttttgtcttctgaatgaatctcctgtttggcattttgacagatgcattatcttttgccatgtcagccttgcctgttctctttgccatgcccttctccattcctcttttaaatacatacttctctatatatattttataggggaatctgggtagaaggaaatcagggctatttttcccattggcatgagtttggacatttgtggttgctgcagttgagactgtgtcgattattgaattgtatatcagtctcttttaatgtgatttccacataaaactgtccacccaaacatatacatttatatattttattttatatgtagggaataaaggtctttcagctctaaagcaacaactggcaggttatggttgctgcctgcctactgaatagttcattgagagcacagttagattaacacaagccttgtcataacactgtaatttatctttggaacaggattcatgatgtgcctatcatttccctcctcccactattaaacatattttcattctgtgaagctcactctaggcttaattcaattagtaacttggacatgacatcatac

SEQ ID NO: 46912 - DNA, 838 bp, Bovine  19866880800818
agagaatatggcaaataataaaatcatcccagacagcagagaagtaaaattgcagaaaatcagcctgaaataccaaaacctgtcaagcagagttgagaaagctaggaaatgcctacaaaagaggatctggaggaaaaatgaaggctgaggataatacaaaccattgttcagttgaaaggttttgcaaagcaagtgtgctggctggtaagaaaatattaagcttttccagaaaattgttacttcctaatttctaatattttagttatgtttgcttgcgataaagcaaactttatgtctttgaactgttgggtcccattttattttgataaaagaatagacttccaagagatattcaaaacaagtccgggtttaatagcctttaatttgtcatttgggatatattaaaagttagaaggcaaataaacatagcttggcaacatttacagttaataaagttcagttcatttttaagcagttgctaaggtgattttgactttgatttttcagaggttactattgcaactctagcaatcaaatgtaccaagctcctccaatatatattaatagaaaatcaaggagaaacaggtatatatagaaattttttgaagtgacctaagcttcatctaaggaatgaaaaggcaaattaaaatgagttcatgttttaggctgtagaccatctctattcccactccaacccctcctcacattcacaattctatcctaaaagcaatattgaaggtctctcccatatccttaaaagctggaagatgaaagcatggaagtaaggtatttgccaaacagatttaaaagtgtgtgtgtatgtatcttttattaaata

SEQ ID NO: 46913 - DNA, 1385 bp, Bovine  19866880853879
ctgttttggatagattacttagcgcctaaccacacccctctgcaatagactagtagcaagatggtgagtgagagaatgaaattcttttccccgctgcgacggatggagtgattttcagaaacaatgagattatcacccgcattcccaaatctagctttcaactgaaaatccgaatgaagaaccaacagaaaaaggtagatccttataaaaccactttagaacgtagcaatcagcatgtaagctttttaacagttttctgttgtacgttgccactcatgctgatgagtctttatagttttggtgcattgggaaccataaaataaacataaagagttcatgtgattattttggccatatttcaatctgtccttttagtctgcaggctgtaggtggtagagctgtcaaattaagctataccagcaaatgaggaaatgtaatacaggtgtaagaagaaagaataaatttcatataagacagtaattctcaaactttttagtctcaggatctctttaccactcaaaaattactgaggacctaagaacttctgtttatatgggttatatctttccatctttactgtattagaaatgaaaccagggagatttaaaagtatttatttgtttctttttaaacagtattacatttgttacatgcctaagatttttaatgaaaaatgaccattttccaaaatgttcctaaaaaaatcagtgagaagggtgacattatggatttttttccttgggtttgtgtgtgtgtgtgtggtaaaatatagataaaatttaccattttaatcatctttaggtgcataattcaggggcattgagtgcattcacattgttatgtaaccatcgccactgttcatctccagaacttttttattattccaaactgaaactctgcatggggattaaacaataacttttcattatcccctcttccagtctctggtaatcactattctctctccctctttgaatgtgactattttaggttcttcatactagtggaatcttagaatatgtgttcttctgggactggcttatttctctcagcaatgtgtctttaaccttcatccatgtcgtagcatgtgtcagaatatccttttttaaggcagaatacattctgtagtacggatataccacgttttatttgtccagttgtccatccatggacattggggttgtttctacttttcggctatttggaataatgctgccgtgatcgttggtgtgcacacatctgtacagtgtctacctttcagttctccagaatgtgtgcctagaagggggattactgaatcatatggtaattttatggttaatttttgaggaaccagcatactattttccacagcagctataccattttacactcctttggcaaag

SEQ ID NO: 46914 - DNA, 739 bp, Bovine  19866880868442
ctcttcttttggtgctaatctcagtaggacatattaattgctccataaaaattctgctttgcatctttggtctcaacaatgagggagatcctattgtaggttgtgagaatttcctggaagtcatatctataccacggtggctaggaaatgctaacatatatacttggacatgactgtgatccatatgcgcagatataattaaatcagactcaattgttcccagctcaactacttcatagccactccaaatgtgatccgacatgagtagaagtatgttggagagtaaactggaacagaaagtgacaacaatcttacctaattttggttaaggtgccttgtgtttgcaaatcctacaaaaacatatagaatgtattgctagaaggggtccatgcaaggaggagactctgacatttcagcttaattaccatgttggttaattcacatctgaactaaaggcagacatgaaagtgacttgatatttgacttgatatttgaaaccaattcaggcaagtgtaaatgttataaaagaagatcgtcattaccactcatattaggataagcagatgtcctcagaatacacaagatgaatctttagggaaaagtcctgtgcaattttgtaaattgaataatacacttagggagtttacattaatgttcataattttatgtgagaagtatttacaactaattatctttggtagaagcaagaataagagaggaagtcattccctcatttcaa

SEQ ID NO: 46915 - DNA, 938 bp, Bovine  19866880881344
cattgaatggttgtatgtgaattcactttcagaaggcagcatagcttctgaacttttggctcatgtcactaaaatgaacttaatctattttcttttagcacaacatatacaaacccacagaaaatttactaaattcatttggaacatccataatccaatttaggaaagtagtgcttgttttttactaaggtatccaatcaaattatatactctaccccagattcagctcacttaggctttttagaatgtttctcttagaatccatttgtgctatttatggtagacatttcatgccaggaagtagggtggaaagaaatcaaaagagatgaaagaaacattttttctcgtctaattaactgaatttacaaatagtttcatgatggtctgatgtgatctagtcccttttgttaggtaaccaatggacacagaattcgccagtgtgatgaggttcttgtctaagtactggtgattttcttatcaacagcctgttgacagaaccctaaaaggtctcaggttgcccatgatctatgatctggctgttatgagaatgcaaaatgtactttctaaactcaggaggtcatgaggcaatggtgggcagagttattttgttggagtatatggacccatttcttagaaagctacagatgctttggggaagaccctagatttgcttcctgaaaacttttcttgtgttcattcagatagtaagggatattgaggaaaatcggtgtggtcaattttcccatatgtcttttcataaatatgacttctattttcttgctgataacttttacatataagaatttatatgatatgcatgcctagatgatacacagaagcacacatacattaaaaacaaagtcactttgttttgtttatggtttcctttgctatgtaaaagcttttgcatttaactaggtctcatttatttttggttt

SEQ ID NO: 46916 - DNA, 1229 bp, Bovine  19866880931870
aagggaaatataaaagacaagacaaaagtctgtaaaaaatttctttaaaacactacttttttctataggtcccagtttcttaataaaaagtactgagttatgcaaccaatgtgagttgtttttttattttaaataatacatgtaaagccaatcacatttcatcattcccctgctagcagataaaagtctgaaataatatctaaccatccagcaactttaaaccaagaatctagcaataagcagaactgctgaaacattaaaatgtctcaggtttctttttttttttttcagttaaaaaaataggttgctttttatctgaaaatgtaatggagtacataatcaagcataatttcctaaaaggaaaataatgaaatggcatatattaatcctagagaagctataaaatatctttagttggtcaagacttgaaaaaggcactgcttgtgaaaagagaaaaataagtctttaagtaaaaaaacacagaagaaaaacaccaccagaaagtagcaacactcagatttatttattttattttattttaaaactttacaatattgtattagttttgccaaatatcgaaatgaatccaccacaaaacactcagatttaaatgcagtctcctgtctcacagttcggatctctttttaccacatcacaagtggaaaataaggctggaaggatggtacaaacatatgaaaagtaaatacaaatagaagagtcttaattacagagaaaatagcattttgaacaaggtttttataaggagaggtcaggatagactggagaacagaagtcaaccttgaccagtacctacttgatacttttatttaaaattagaacttgaaataaaaagaggccacattaaaaaaaaagattttgaaatatatgccagtgtttttcatccatgaagagatctgggagttcatgaaagtcggcaattactatttgtctgagacttgaagaaagtactctagagcttatgtaagaagtgccttttgaaatgaagttgagtcaagagaagtaataacttgcaggatccaagaagtcctcaaaagacatattaagaaaaatcttttgtaacagaacataaaagagactttcttagccaacagataggacaaataatatttagagaaaggaagaaaagaacaggattatttcccatcattttattacataaaggatataatatcatgtagtctagccaaataaaaaatgtagttccagag

SEQ ID NO: 46917 - DNA, 1277 bp, Bovine  19866880988202
agacttctcttttcctttctttctgtggcatagttttgatcgtgccccaagaactagatgatcctgaagaaatctctatagacttggaaataaaatttaaactgacctctgactcaaagtctcgtgcaaagcaaagatgactttaaacttcttctgcattgaatggagtactgtattgatctccgcaatgaaatataaatggaacccaatggactgctattttaatgcagcagagaaaattcaatgaattgtccaattctctcaggccctttagaaaactacccagtgcatggttttaatggagaaatggcgcaaggaaattgagtacagggtctcccagtactcatccattaagtccttgacatctgaatcactacggtaaattatataggcccttaataaaagactggagtggcatctgatatttaaaccataggttatagatgcagaacaactcattctgccttggaaggacatctgcatccagtatacctgcctcaaatctttgtcactgaaaaacatcctatctcaaactcaaaaccaagatcaggacaagatgagatgaaagaatacagtgtttgaaaactagctgattccttaatatattgtttccttggtttcaggcctcagttttgcccagtgacctattgatccgcttgtgaagatactcaaatcccttaagtgtcagaatattccatacagattattctcatactctgtcactgttgaaaacatacatagcaaacttgaaaggacagctagctttggggagtcacctttggagtgtcaggttagtatatgtgggcttgtgttagtcgctcagtcatgtctgactctgcaaccccatggactgcagcctgccaggctcctctgtccatggggttctccagacaagaatactggagtgggtagtcattccttctccaggggatcttcctgacccagatatagaaccccagtgtcctgccttgcagacagattccttaccatctaagccatcagggaagccccatatgtggacttactttctatctacattacagtactcatcaacttagaccattcagaggaatggaatgagtacaattctggccatctaacacaagagtgcattaatttggtttagcatccctatgatatagcattttaaaaacagctaagatactatataattgattaaataatgtatgtgtgtctggggatttgatgctgctcctgtaatatgctacaaatgccttgaaagtaattatgaaaactgcatatgtttattatagaaa

SEQ ID NO: 46918 - DNA, 1736 bp, Bovine  19866881031809
tactgttgaagcctggcttggagaattttgagcattacttttctagtgtgtgtgatgagtacaattgtgcggtagtttgagcattctttggcattgcctttctttgggattggaatgaaaatggaccttttccagtcctgtggccactgctgagttttccaaatttcctggcattataaatctactactacttcaatttaaaaaaaaaaaaaaagttgagtacctctctaagggatcagtattagagacaaagccatagtaccaaaaagcagtgctgctaacatctctggtttcaagaacaaattatagctctagagtaaaggcatattcaaaacatttatttttattctttctcacagctgcaacaaatggtttctctctgaggaaattattactgagagtgttttaaaatctcttagatcctaagagatgtgtactgtaaaatatctgaataggacacccatctttttaaaatatatggacattggcttacttaacattaacaaccagttgttcaaaaactggtatgcaggttaatttttgccagagcttaagtgtctggttcacagatttggccttcagaatcatgtggtgcttcacttcagaaattgcttttatttataagaaaaagactaaagatagtctggcagccagaaataattggtttaataaaatttcaagtgtatattcatggtatcttcccacagaaagacagaattagtcaattcaaactgagtctccgtccaatgatcctttaggaaagtggagtctcaaaaaactagactttaaaattctgttggaattttggcataaaccaaatgcagactataaacacaagtcatctgccaatagtattttactgcttttagagaactgctagcatgttgaatgaacaattatcacactgatgacaagtaacaagtgctttcttgaaattttaaaactcgtgcatctagtttaaagctatctgttccttgctcccttcttccctccctctgactctcaacccttcctacccaatccttccttcctagctttcttccttccttccttgcttctttgctttcagataggaatatagaagtatatcaacaaaaaatattttctgtaagaaagaaatggggagattaccaataaagttgctaactgataccagctaatctactggtgtggttaagtaactattgagtaattggttttttggtttcatattaggccaaacagatgggagggcttgtcaactaaacacatatttggattaccttttaaaggcatgaatttatttaaattttatttgtaaatagtctccatgattctaatcaactaatgtctaaaccatgctttcaaaactttagggcacttatttatttctgacaagatactcaataaatctctaaatatggcctctcgggttatgaatatctctatgttcttgtcaaaacaaaacctaaattactgtgtgcataaggaggggaatagcaacaggagtacacagagatgattggatttagaaatgtgtaattattttcttgcttcccccctcttctctaaccagaaccaatatgctaaaaagtatattgtttgttttttattttccaattaagttagaagagctttctgctcctcagaaccactgctttctataagatatgaaaatgggatgcccaatcattttattcaagcactgggaaacctattactgatgaagtctaatgttaaaagccaagatcgcagta

SEQ ID NO: 46919 - DNA, 1263 bp, Bovine  19866881032426
ggaaagtggcattcactcatcatgtcctaaccattctgcagagatggttgtttgattccctggtcaattactgaagacaccgtgaatcagaaatctattgtcatatgtcgtctcactatggtctatttgtatattcagtctcagtactgattatttaatagaattatttcttagaattcaaaacaaagtacttaggctatgattagctgtataaatccaataatatgcacaacaggatgtatttcttgctatattttttcccatttacattcccatgcttatggcaatctttctgaattctcctgtctttgcaaatttccaactcctagtcctttgtcatcataatttaatggatttctgagtttcctatttttctgaggtgcaattagagaccatccagaggttcctactactttccctccccaccttcctgcctatgcagccacacattccgtgttctctcctgttactttcaatcagttgtccatgctgacatctgaggccaatcctgagacttatgcccctgaatttcattccctttcacctactcaaggatatctcttcaacagccctaccccttcctctcagcgtgcattttccatctctgctgtatcatgtctattagcatactaacatgctctaatttctcccatctgaggacaccctatcttagaccttctattacccttcagcagccccacttttaagatcctcattatagcaaaattgcataaagaacatttttttcctgcattctatatcttaccattcacattttcatgaaaccacatctatttgatttttaccaatgagtgctcatttcctgaggttacatggttaaaaggccacttgtgtctttgatatacacatcaatgaaatggtatagacattcttagttctttcagaatgtaagcagaaaaaaaaattttaatcagatgtattaaaaattagattgattatgaaccttcttctctccagttattggttgttttttattccagtgtacacatagggcctaaaattatatatcaagtggaagatgttgaacaggttggaaatttctgatattctaggagagtctggagttcaattttttaaatgtactttctctaaaatatgagaaacatttccaacaagttttctaggtggaaagcactagagcatgacaaaacacccaaaagcatagagatggtaacaatttattatattccctggggcttgacatcttattagattcattttccatgtaaaggactttaaaaa

SEQ ID NO: 46920 - DNA, 1435 bp, Bovine  19866881049332
tttctgtgctctctatgcaagttatggactacgtgattgctgctgttgcatctcactcattatttttcagtcattaaattttgctttctactagagatatagtcttaacttctggcttcagcatggagtaatttaattttctcagagtgtctgaattacaggtcagagttgagaggtagtaaataaaaacgtgtgtgctctgttgctcagctgagtctgactctctgcgatccgtagactgtagcctgcaggctcctctgttcatgaagttttctgcgtaagaatactggaatgggttgccatttcatactccagggaattgtccccacccagggatcaaacccgtatctcccgcattggcaggtggattctttacagctgcacaatctgggaagcccagtaactaaaagacggctatttaaatatgtttaccctttaaaatctcctctttctatatttgaaattgtgatcattaacatcttcctcttactgtcttcgttcttcatctatcttattatcatactcttttaagtactcttaaattttagactgttatattaaattcctgacattttaatgtttgcctttttcatctccttttctaaattttatacacagctctttatattcatttctttgtttcagtctgaagacacaaatggtttattttcacagttttcctcaatatatttagtattttccattgtttaatgaaagaatcttaactaaacatcattatttagtttacaagataatcatgaaatgattggttagatcacaaataaatggtctttaattttgttggtcaaatgtgtttccaatcattttggtatgttaattttttggggtctattgtgtatgtagcatgtttaagagcagcaacaaaaatggcaaaaatttgtctttgctgtaaaatagctggactggttggggactcagacaattttttggtgctggtcagtgtaacacctaaaggacttcctgttgtttactgaagttttttctttggaattttatcctgtctatgggtcaccttggagaaggcaatggcaccccactccagtactcttgcctggaaaatcccatgggcggaggagcctggtaggctgcagtccatgggatcgctaggagttggacacgactgatcgacttcacgttcacttttccctttcatgcattggagaaggaaatggcaacccactccagtattcttggctggagaatcccagggacgggggagcctggtgggctgccgtctatggggtcacacagggtcggacatgactgaagcgacttagcagcagcagcagcagcatgggtcaccttctcttccccttttaaggtaatgtgtgagacaccaacttggatatattatgcccttcagaagagaatgactcctcacatagtacagttaaatacaatgagttgctcttgt

SEQ ID NO: 46921 - DNA, 1163 bp, Bovine  19866881050637
ggatttgatttaggtcatacctgaatggtctagtggttttccctactttcttcaatttcagtctgaatttggcaataaggatttcatggtctgagccacagtcagctcctggtcttgtttttgctgactgtgtagagcttctccatctttgctgcaaagaatataatcaatctgatttcagtcttgaacatctggtgatgtccatgtatacaaaatgataagttaaggtgatcaggaaaacaaaaattaggatgtaagcagtagggagatggggggaagaacagtctagtctttgaagagtaagtgaaagtctttaaggaagatgtgagcttattgtgttcgaagaatggcaggaaggctatgcaagaggcgctttggtaggatatgagttgagataagatagtcaggggttacatatcaaggtcttacctggtttgtttattagtgtcttcccatcatgggttacggttgaggggttataaagagcaggagagcataaaaggattgacacaaagggtgggatggctgtggctataaatcagccaagagaagatggtagtttgtggaagaggatcagagactacacaggtattcaaggtacagccaacaatatttgctgatggattaggtggagaatgtatgtggagagaggatggaaagcaaaactaaccttgttctgggtctctgcagctaggtgaatggtgatggcatatgctgagatggaaaagattgggaaaagaatgggtttgaagagaaattaagtatcttatcatatcatattttgagcattttaccatgtcagggtatgcattcagacgtgcctgttaagcctccaagtagagatttgattatgaagttgggtacgagtatggttgcattttaaaaatctctgtctttgacacagaacagattgttggggaagcactcttatctcacaccctactcttagtaaccaaactgtagtcaaagtgtgatttaaatacacatacttaaaggaggaggtggtttaagaaggaggtgtagtcatagtgaagagttccaaacataatttgggtttcatagtggagttgggtgtgagggtttaaatatttccctaggtgttagctgtctgccaaattaattggttcttgtttcctgaggaggaggaaaatagacatcctccg

SEQ ID NO: 46922 - DNA, 1565 bp, Bovine  19866881051379
ttgcctggaaaatcccatggacagaggagcctggtaggcttcagtccatgaggtcactaagagtcagacacaactgagcaacttcactttcacttttcactttcatgcattggagaaggaaatggcaacccactcccatgttcttgcctggagaatcccagggaagggggagcctggtgggcttccatctatggggtcgcacagagtcggacacgactgacacaacttagcagcagcagtgtgtgtgtgtgtgtgtgtgtgtgtgtgtatgtttgtgtgtgtgcgtgcgcgtgctaagtctcttcagtcatgtccaactatttgtgaccctatagaccataacccgtcaggctcctctgttcatggaattctccaggcaggaatactggtgtaaatagcctaccttattccagtaaataaattcattcttaccttcttctaacaagtttataaattaaatctttacaattaaagctttactgcatctgaaatgtatttgggtatattaagaaagacatatataaaatgaggtagctggtcatttctctatcctatgtatagaataatcctcatatttccccacttatatgaaatgcaacttgctcacataaagtacattcatatttactgtcaggaacaagacatcaatccccattgtgtccccactgtagtttaccctttctagaagatcatgatggaacttgacaagatacagaaataagaaatataaaacttatacaggagtataaaaaatgttcactttctctcagataatttgactgcaatactagaaatttccctcataaaatcaactgaaaaactattcaaaacataagaatttagtaactggcatggtgataacattagtagtagtttttcaattgcctcattctctaaagtattgtattagttaccactgagtgatcttttcttttctttttttattttattcatggcatgaactttaactggccatgatatactgacatattatacttccgcatcatttaattcaatttgctaatacaggcatttctttatctgaatgaattctgaaaagtcattgaatattaaattttgaataacaggagtctttgttctattattttaaatgtgaaaaatattttgttccaaatctatttcaaaatctcaaccaattttccccaaatactacttatatatcctaagtacttccataataacttactgagaattccttcactgtgtaatacatttaaaacactgattatccaattattcaataattaaacacacaaaggcatatatatgtgggagataaaaattctgtttagaatacaataatacaactttagatacaaattatgttttgagttgataaggaaaaaataaaacctttgatatgtaacaaaaatttacctgaatttattgctagaaaaagcaggaaaactttaatacaacacagaagggttagaccttgtatgatgaggttttcagggaaagaaactagtaggatttttttttttttttttttagtgaatatctcctaagcaaacttaaatcatattaggtctggaatatcactt

SEQ ID NO: 46923 - DNA, 1934 bp, Bovine  19866881118675
aaggaaataagtcctgaatattcttggaaggactgatgttaaagctgaaactccaatactttgaccacctgatgcaaagaactgactcatttgaaaagaccctaataactgggaaagattgaaggtgggaagccaaggggacgacagaggatgagatggttggatggcatcactgacatgattttgagtaggctccaggatttggtgatggacagggaggcctggcatgctatagtcaatggggtcacaaagagttggacacaactgatcgactgaactgaactgaacatttttggaatgttcattatattatagacacctgactgacaattgagttaccaatttccatccttctacagggaattattattcccattttaaagatgggggaaaagtagtttcagaggagttaaggaacttgttcaaattggcaaagcaggcatgcaagcccgagtctgtgtcattacatttgataatgtagtggaaggagcagaaactcaagagttggtattatactgagtctgaaattgggtttctggggttgcttagcaccacagggcaggctgaggtggtcttcaggctctgcatatgcctagagagctaggcaccctggtctcttgcaaggtggaccaaggagtaatccaaagcccccttcgtcatcccaagctgtgcaagactcagagttacaacctccattcgcctgccagtgtcttttcttctgcaggaagctttgccctgcagggccaggatcaaaacttggtctccacaggcctcctcccacagattgttaccaagaaagtaaacaatctaaaataaaaaattctgccctggaggaggcaggaaagataagaggcctgactacgcttgcttattgcaaacaagacaggttgggctgcagctggtgcatgggaaactcattacagccacttgaagccttgacaaatgcagtgggtaacctgagagcccagcacagagcctcctggcccaggagtcagtcagcctgtcggcaggtcaaagcagacagctcacaccagagtgaggcagcagattaggccccagcagtatgtatggtcagctaagtaggaaaacagggctgggtcatgatcagcagcgatggcagaagcagctcagcacagaatgatcatcaatttctctgaagcagagaccaggtttgatgaagtacccatgagaagggtggctccattattaataactataataactatgacaatgataataataataatagtatcaatacaataagtactttacagttattagtcaagaccctggcaataaacagaactctgatcagacagattcatcaaaaataaaaaatataagggcagatttaagagaccctcaagtaatgttgagatgcttagaatttagtaagcctgaaaggtaaaaggagaaaacaccgtgctgctagggatcagtgatagctcaggggagctatgattgtgcaggaagcagccactgtcaggactgtgatgctcaaagtgggagggagtaaggagaatattccccaacttctttttcctcccatggactgaagcaacccaaaagccacaatggaaagaaagtccagctgatgcaatctgtgcagatgagctgctcagagatgggcatacggtgtttctgagtgagaaaacacattactcatctaccatgataaatggttcggtttttagaacagtggcatcaaaggcaagtatcttcagaggatacacaggtatgcaaacaggaagagaaagcagcgtgggtcagtaaagggctactgagtgtgttcatctaagagtgtatggataccatccacatcactgccttccagcctcagggtaatatggatccagcactgctagaagatctaagatctatttttagaagtgaggcagaaagtccagattactgtgtgaaatttccctactttt

SEQ ID NO: 46924 - DNA, 1380 bp, Bovine  19866881251516
ttgtgcccgactctgtgcaaccccatggacagcagcccaccaggctcctctgtccactgaattctccaggcaagggtacctttatagtctggttctaactaatattctgctattcctgtggttactttgccttccaggcatactaaacttttcacattctttggcatatcatcctctctctctctcttctatgcctttgtggttttcactacttagcctgcccactgccttatgtgtttgagaaactcttgctcattctataaaatccattttgaatattttgttccctagtagaggctgtaactccatcttttatgcacctacaactctttgtatttctagcatcacatttttgtgcattaggcaattaagtattggaggaaaagggaatgacagaggatgagatggctggatggcatcactgactcgatggacgtgagtctgagtgaactccgggagttggtgatggacagggaggcctggtgtgctgcgattcatggggtcgcaaagagtcggacacgactgagagactgaactgaactgaactgaatcagattcacttttagattttgaattctcaaggatgaggatcatttctgttttttaacctttctaagtattggatttcttttctaataaaatttattatatttgtaacaatctgctatactcaagctttgaaagtactttagatattttatagagagatgaatgctttccatagtatataatgtgacttttgcacacttactcccttaaatgtgtctatatcttttaatttacagtacatttttagagctttccaaaattatacatgtagcaaatcatgagttcataaatctcagtttcgttcattaaaatacattggataaaaaaatatcctttgtagccttgagatacctgccagtcacttgttatcactcagattcagtttgcaagttattttgaagagatatattatttcttcaaaagttcctttaagcagttgttttctattaatgaaccttgataggatccatcagagatccattctttcattaccttttctcccagttgaaccaaaaccatttactttttataagtctgccaagaaggagagtctatggcctgaatcatttctgtaattaacaatagtcactaccaagacaattttatgtatttttaatatggctcattctgtgtaaatccattttctttattcttgttttccaggactttctggaaaacaagaagttataatcctctgctttaacagtctccagacatagtctcagtttctttagctcctgaaacggctcctatattccaattgtttatcatctgtgtagctcttctctgaacactactctgacttccttaacagaaaggaagttttttgga

SEQ ID NO: 46925 - DNA, 1713 bp, Bovine  19866881267541
aacttaatcttatattagaaaatcagttattgcttcctattcccattgaaagaggttcagatacttacttcagagacaggctttctctctctcataaaatagattgttctgacttggggcttcacactgggctgtaacatgggagtagttcaaagaacactctctttgttgctttaaccttgacttttatcactgggtaacccttgcaaagccacttaagttctccccttttctataaagaacagtataaatgactgtcagaggcatttgggaggattaagagaaataagagctgtctgaaatgatggtgtcattgtgcctggtatatcttgagaaatcaatacatgttagttcttttcccatccatctgcctcatttctgccacttacctttcttgactctgagtcttcatgacctccgcctccagaatatttactagcatttaagccacttctttgccttgatctcttgtttcagtgtgattttggctgttggtttctgaatctttcctcttcttgccccattagttcaaatgaactcacaactttgacaccactatactattctcattgagtactgaacttaagttctgaatttgacactattcatacatgccaattaagaactctttagatggaattatagatccaaaaaccagagtaataaaaatgttatttactaaaaatctctattgttctgtaaactctattctacattgtcttaagtaggtctcctgtctagtggtctatttttttctgggaaattaaaatataatttaacacctctttttggtcttattcttaatcactgcttaacaaaaagtatctcctgcataaatgaagggaccctagtattggtcacaatgtcaacttggttcagttctctcaaagcccaggttactgcttcccccaaagaataatgtaaacacttataacctcttgcctcctaagagttaagcagcttctaaacagaacttgctttcagggagtactttgtgatcagagaaactagttcattagtttgaagtgaaagcttacatttcaaagtataaagacataataaatctatttttggtgtagttgagtgctcctaaagaaagttattatagagatgctacattgatttcaagactttaaaatgcaagtgtatatcatggaaaatgccaaaaagcattgcatgactaagtcccctctgctcagaagctacaaattatattgaactaaacaatcacactgtattgaagcatggggattttcatatctcaaatcttctaaatagatctatttgggatgcttgttgaatctgaggtatataatatgacatttataaagatacatgcacctacctatgtgcctatatatgttgataactgtgtggataaatgatttgattattcaacatcaatgcttttattcacccctgcaggcaagtatcacatgctggttacgtgccaagaagtataacacgtttttcaggaaatacaagaaagtaaagaaattcaagacatacacattctccaactctgttgatgaggctgaaacttggtacatttttgcaggatgactgggcagaattatttgaaatgtgtatttcttttattctacattgccactgccatttctggatgtttctttgatggtgaaatgtgtgtgtatgtgtgtgtgtgtgcatgtgtaaagagagaactgaattttaattatatcatgtttaata

SEQ ID NO: 46926 - DNA, 1274 bp, Bovine  19866881291416
ttggagaaggaaatggcaatgcactccgtgtgttcttgcctggagaatcccagggacgggggagcctggtgggctgccatctatggggtcgcacagagtcggacacgactgaaggcgacttagtagtaagtagtaggaatgcttaactgtatggttgactttctaggatcaatagccattcaaaaatattgatatctgtagattttacagcctctaattaaagagaagttacactagaagacaaggttggccaaataatgatcaaattttagtaaccaactaaaggctattattcttcaaaaaaatattaaaaatgtttgtgtaattttttaaaaagtaattattttatttttaacctaacatgatgggttggaacaatcacagctttagaaaggaaaaattatagatataaactttcaaagatggcagtggatagaggtctctcttgctttaatgcattacagtatgtaatttttcctttaccaacatagcaaatgcattaaactgtcaaggaacttaaatgtatccaagcattacgtttcacttggagcttggatggatgaggatgaaagatagaatgtgtttatttgaaaggactatatttatttactcttatttccaacaatgtttttatgaaagcaggaaatgtaacctgtctgtggattgtggtcaaatctttgcctcctctcagggttaaatttctgtgtggatatacctgaaaacctgtatttctatattcatagctcttactgctatctctagaagtccaccatattcctgtgacttttagaataaatgctagaaagtatgaagttgctgttctttgctccatcaccttctaagtctccatcatcttgaatcctttaatctgcagcatggagttcactgccagctaggagacttatgtttctgtgaccataagcaatgatctagtaatttgcccattttcctaagcaggcaggtagaaactatttctgttgtaaatggcacctgtaataaataataggatttattcaacaaatcctctttatatcctgcagagtaaagcagaactatcttaatgcagggaataagggggtaattttgttggcagagtcttgattttattaccttgcactctccttagattctctgagccatatccagctgaaaaataatccttttggttcagagcttgcaaaatctcagcgtgccaccttagcacagatgctctaaggtgagggatgaagatgcctgctgttggagactacacaggttaaaggcggcagattcta

SEQ ID NO: 46927 - DNA, 846 bp, Bovine  19866881320114
ttaagccaatggtcaaggcttgtaatcaattctctggagagaaacaatcaatagcccagcttctacctggaaaactgtaacttcaattaacatgattctgttcatagaaaggaatggataagaacaaacacttcatttaaaaaaaaaatagtgtgggttttgtttatatctaagccgacaacaattgtgtaactaagataatatttgtaatttctttttaattttcatgactgatgtacaattccctaggttcttctcccctccagaaaataattgactagtgagagattatcttttttcctaacaattcacattttgggttctggtttgctaataagatatgtaccataaagaattcttaccaacctgtaaagaggttttgagacgtatcaagtattaaatttcaggcatacttctgtctttccaaagcaaaaaattaatgttagagaagatatttcttagaaaatctcaacaaatatcttttatattttacatgaggcaaaatttgcatatgtatggacacttatcatatagacatccatgtgttatacttcaatacatttaaaattaattactggtgcttaaataaatagatatatttatttacattctgccttaaaaatcttgaggtgattttttctgacttatattcttggaaattactcttttgcttgttttagtcttgcagaaagatttccttaagtcctcaagtatttttgtatgtgtctgataggagttttaagaaatgattgttaatagttttatctctcccacatatgaattcgtattaacttcaaaggaagccagtttacatatagaagagataagtcacagagggagcagaaa

SEQ ID NO: 46928 - DNA, 850 bp, Bovine  19866881354793
tatgtgaagagttgactcattggaaaagactgtgatgctgggagggattgggggcaggaggagaaggggacgacagaggatgagatggctggatggcatcactgactcgatggacgtgagtctcggtgaactccgggagttggtgatggacagggaggcctggcatgctgtgatttatggggttgcaaagagtcggacacgactgagtgactgaactgaactgaactgaactgaaccaccattaatgtccacaaggaatacttgtcagacaagcattttcatgtgatgaaagtgaacagtattcaataaagtgtaactatgcaagaattcttatttttttaattagtaagacatatggatacaaacatttcacgtattcttttggggatgaggaaaagaggatattccttgtacatgttattccctagtatatgaactgtgacacagcaataataaacaggataacaaagggacagggataaaatggcacaaataatgtcactctcccttaaatctgcagtgtatcaggggtttttctgtctgttttctactctgcagagatcatgaaaatcaatttctgataattatttaaattaatattctcatatggtacatggctaaaagtggcacccaggggtttgctgcctacggaaagaaggaaagacatttgaaaattaatagtgtcattgtatagtataaaggtaactgaaaagcaaagttgtttacataaaaatgggcattttaaggggagaaaaacattaagcagtaataaaagcagatgcatctgttcttatttttccttttgaatgtgttcttcctaccagtttcaacaaagaagagaaatttttca

SEQ ID NO: 46929 - DNA, 798 bp, Bovine  19866881409791
cacatgtcctctgctctcagcatcacaggatggctgctggatttccagccatcacatccattttctaggaagtgaagggacacaacaaacggttctttcagccaagtctgagctctgtaagagttattttgataaccacattcaattgctttcaattatagctcattaatcactcttcaaggcaactgaggtgaaaaactataatcttccacctaacacactgctgttccaaatgaaatcaaagctctattactgcattttggagggcagtttatgcccaaatgggcagctctatttccaaagtaccagtttattaacagattcacacaaatctgatgtctacattttcaaaagccaaattctttttactagtcttaattgtaattgcattatactgcaattaatatggtctaatatagatcatagttactttataaacctttacttaaagtttataatttgagtttgtcacctaagtatttgttatgtattctctttgttatcaaaacagtgtcatctatgagttttagcaaactggatggagaaatttccagtcacttacctctctttcttatcaccacaggaacacacacagacacgcacacacacattctctactatatgcatgaatctagctagtgagtttcaaatatgcttagggagatgcaaattgagaaaaagtaaatagtttagagaaactaatatcaaattggcatttgagaatgctattttaaatatatcatcagtttaactcaatttttgcaagaaaattattttccatatctagagtgtccaggg

SEQ ID NO: 46930 - DNA, 2016 bp, Bovine  19866881413722
attgagaaaaaattaaattagatagcaacaagattaaaaggaagttgaagtttaaatacactggtcaggaaaagacatgagacttaaattatataccatagaattggtcaatgagcataagaagagtgaaaatgatgttaaagaaaaacagattaaaaattgagcaatcaaatgacctgtttcctttaacacagtttcccttttatcagaggtgtagcaaaatcacatccattggcatttacaccagattgggcagctaggtgggttgaaagcactacgggagtccagtttctttccatttgagatcataactcttagtagaacactgtgcaattaataactgcttagaagtacctgtttatttgatctgagaatgttactggcatatgttgccttctctcttttatgacaagaatagttttacaataaaacacatagcctaaaatcagtacactgaaagccacagggaccattatttaaggcaagtccatggggtcacagagttggacatgactgagcacatatgcgcaccatttcttagcctaacaaacttgaaggtgtccctttgagcagcaagtattaaagtgggaagaaatagcttcatactgtaactttcctctagaaataagaactgtccttttagtgaagcaggctgctctgtctcacgggatataatttgggcctttgagaaggaatgtaaggctgctggtctggtttgaaatggttgtgtgtggttgtccaaatccctgaagaaacttttaagtttcttgccaaggccactgctattgaaaacagtaaatatattttcagaaagttagagcaatggagaatgaaataattcacctgtcgtcttttcaaaatgttagtttcctactgggagcaggaatttggtcttttgcctcatttgactatcaattttgagttgcttcattaattttttcactgggtgagggccaagttacagaggaggaaatgacagagaactgaaagggtgtaggctacttttaaggcatgttttcctctttacatttggagtttaatgcattttagggttttgaaaaaagagttgcagtacctgcaacaggacacttctaccatcaaaaacataaaataattcatgtataaattcagggaaatttttatttatatttttatataccactgtaatcgttagggtaaagagctagttggcataaacatttagtttctcaatctcaactttgcaagttgagctgcaactttgcagcttagctagtacaactctgatcattctctaaaggaaatccaattatggaaattcattggcaaataggatcatacattacctgtgggaactgagacagtttcagcctacacactttacttcagatattggtgtataaatcatcatcatcactatcatcattatcattgagattcatatgagagtatatgtattctatgaactattctaagtgctttatgtgtgttatctcatttgctattcatagtaatgttaggatgtgatcattttatggacatcttttatggatgagaaacacaaaggcttaaatagtttcagtaacaagccaaacttccaaaaattcccaaggtgtttgcaagataatttttggtatccattaaatagccaatagacagattcaaagccaaaggtaaagtaggaaagtttggctttcctttatgaatgcctcctttgtcccttgatagtctctattcattcgtttgagcaagaaactaatttggtggtcaacttaaacatattctctaaaaatatcaaacatttattctttacaattgctttttattagaaagtccattaaattcatttggcaggatgtgcactatggttatttttccttgtcaagaggaaagtggcaagttgtccttcctttttaaaatcacagaagaataccagaagctcaaggtgtcagcagtgtcatttctgaaaatgtgtacactgcagtcccaaagttaacatatggaatccttatcaagtcagaaaggaacagctgagtg

SEQ ID NO: 46931 - DNA, 815 bp, Bovine  19866881440551
tgcaaaatctgaaaaggatcaaataaaaatctccagtctcccaaatttccaataatgctatatttgtgattttaaaaaatgaactgatctactcccttaaatgcaataacaatttaaaacacaaagcaaaattaaaacctcacacactaaaatatactgaggccattttaaaataggcttatagactcaagttttgcttagaatatgactttgcaagaattgaagctaattgaatttgggaagtgtcaggcactatttataagcaaaaccaaatggtatgagcttttcaagtttaaatctggtttaagcttcagtgaactcaatttacaaattcactttttatttgctgaataaaatgcatatagggtgtgggggacatgatttcatcagcaacttattgggagtttatacatcctattctgttttttccaaattatagaaatactttttaaccttgaagtaaagatttgaaggggagggatgtaaaaaagcaaatcaaacatgattcgatttgtctattagttggaaatatttttcaggaatgtaaatgggggaatgaaactctttgacatatttttcttaggaagtactttaggccatgactgccaaaatggttgatgcacctcggttgttaacctattcagattgcaattagaaggtgtcactatcatgaattaagatagtataagcaaattcaaaggagtcttatttctgtccctggacatctggctccaaagagcaaaggcttaggaacaacaccattcatgacgggcaagcaaaataacaggattagcaggagcccttgggcccacagt

SEQ ID NO: 46932 - DNA, 944 bp, Bovine  19866881784036
ggaacttagttttagcatcctccttcaatgagttgaattcaatctcctgctttggcaagtggttcttaccactagcaccacctgggaaacctggagaatacagtgaaagttaagtctctcagtcgtgtctgactctttgcgaccctaccggctcctccatccatgggattttccaagcaagagtactggagtaggttaccaatagtaggaatctcttaacaccaaattttaaaacacagcaaagcaaaacactttcctaaaaatatttctcaaacttagatatgtggtttttattgcacagacatttctgttacacatgaaaatctcatggctttctgattttgactcagattcaaagtacttaaagaggaaaagccagatataatgggatagagtacaagagattacattattattcacatgcagataactgcacagtgaatggactgttaatgctaaggagtgctgtaaacttcttctggaagcttcatgggttgaattggatggaagagtttatgaagcaaacctggatgcctgtatacattttaaattggcagaacaaatttgaatattttcctgatgggaggtgaataggtttatctgtggaaccttttatttatctctagattatgcaaacctatgattctgtcattagacactttctgaataattactaaaacataaaagctgcatcatgattaaaacatgaaacatagaagatgtttatcagaaaaattatccagatttctttgaacttaaaattccacaagagtagattcttttgagattacctcctggggaaagcatgactatctaatcataataaaagtttttctttctctgtttacagaattgactgatgtggttttcagaaaatcagacaactcagaagtgagaaaaagacaaaaaataaagatcagttgtaaaaggcctaaactttttca

SEQ ID NO: 46933 - DNA, 1171 bp, Bovine  19866881820448
ctgcaggctagcccctgtctatagtcttccaaagtatattgaatgatgaacattttcaaattacatggtctgcagttcttggttccactacatttacacctgctttcaaactcagtgaactgcatttgatgaggctgcatttggtccaaaatctttctttgggtaaataattgaaattgctctatcaaatctgtttcacttaggcagtctatagtcacatcattctgtcagccactgagaaatacctgtactgccccagacacttagcacttgtgttgaaatgccatttaatctctcttctagagcgaggatgacattcaacccaactgttcagtgacagttcaggatgacaggttccatgatgaaaaactgaatattctaatggctgaaatctctgggtattatgagtaagaatacagacatgaggatgttgcataagaagaaatatcaaatgctggtgtccaatttcaaaaaccagtgtctataaagcttaaagcgaagactaccacctgcccaggcagttacagctctcaactatttggctctctcttcctccaacaaagatggaatgaatcttcagagggttaaagagttgtgtaaacagatactaagtacacgtctttcaactaaatttttatatatttttactcatctacttataaaatgattgatgcatttctctagtcaggcacagagctataatggccagcttgtctttttgtctttattctatactggaagtagatctccctctaggctttcttcagaagtatacatttacccaaaatgaaaaaataatgttaccagttcactaggggaagtaataacagtgaggacatgctgaagcacaggacagaatgtttgttttgttaaggtggatgtcagggtgcatatgaagaaaagtagaccatgaccttaggtgagtacaaagtaaatgaatgaaaaatgggtggaagttgtccaatctttctttagaatgcacctaccatcaatgctaagaacatctcagcagagcctctggtgaaaatgtgagccgcaggtagaaattatttctcttcagttttcatttagataagggcctctgagaggtagtattatctttagtcatgataaaagcatggagtctagaaaagcctagagacatggcttctagacacggcacaagagaaga

SEQ ID NO: 46934 - DNA, 697 bp, Bovine  19866881934138
cgctttaattgttggcatatgaaagtctctaggacttacagaaactcattaatttctatctagctttcacaattggctcagctctgtacacgcagcagccgtatttgcagcatctaaaacttctatttcgcagatccaattatacttaattagattcatgaaaagaaaaaattcaattctcatttgtattccatatgtaaactgaattactattcattatacatattttactaaattttagttaaaaatactcatgggaatgtatattgttacaaaattggtactttaaaaaatgatactatgatacagtttatatagtattattttttccacagatgccatagaatatggaatatgaggtgcttttattgatgcaataaaaagcaaactttttaaatggagagaaggggattcatttgaattttatttgcaaaatgtattttagtgagttttcacaaaataaatttctatgaactacccactatgatattacacatgtgcttagtcactcagtcatgtccagctctttgtgacccccatggattacagcttgccaggttcttctgtccatgggattttactccagatgaattctggtcattaattttttaaaaaaatgctatacaaatcagaggtatatttgttttttaatttttggttctctgtgctagtgctaagtcgcttcagttgtgtctga

SEQ ID NO: 46935 - DNA, 1355 bp, Bovine  19866880356014
catacttaaaatgtggcatttctaaatatggtttatgaagatgtgattagttaggataagttcacaaaagtgggcctaaatccaatatgtctactgtcataaaatggggaaattaggacaaagaaacatgtatactgagaggaaaccatgtgaagatgaagacaacattcagttgatgcttatatagtgtcaccaagaaatgcgaatatatgccatttggctttaaggaccagaagctacctaaggactgcagcactccaggataacaggtccttcactgtctcctggagtttgctcagatttatgttcaatgagtcaatgatgctatcaaaccatttcatcctctgttgcctttttctcctcctgctttcaatctttcccagcatcagggtcttttccaaagagttggctcttaatatcaggtgaccaaagcattggagcttcagcaccagtcgttccaatgaatattcagggttgatttcctttaggaatgactgatttgatctcctttcagtccaaggacacccaatagtttagttctgcgtatttgtgaaatctcttcttttttttttctttttcttttgtacatcaaattatatttcatgttacctgattatataaaaatgtaaagtgaaaatgattttcaattctctttaacattactagtaaatagttcagcaggaaatatgaggcacaaaatcttagtaaaatgtgacacaggaaaagcaataatgtaattctcacttaaatttaacttgtcataatctgttgtgaatatacaaagacaaacttttaaaacgttatatttactaagattctggcaagagttttatgtaacaagacacagcataccaggcctgccactcaacttattaatggtaagtctcagcttcaatatgaagctgttaaaaaaaaaaaaatcaaaaacctgctttttacatgctaaatagcttggcaagtatgctgttaaacacagtaaggaatttaagatagcaagaataagaagttaataaaaagctaaacattacagcctaaacaaaattcatacaaaaaataaaagaactatcactggttacataaaattttcctgactggtgaaaacttaacagtataaaacatgcattttagaatctttagctatcaagttcaaaaagtaccagtgtctatctgaaatgatttcttttcaaagccaaagtgtagtcaaaattagttcaaatgttataacacattctaatgctaaaaaacattcagtattatcgaagtggaggtaaatcccagagcttttggggcattctcatgctgcaaaaggctatttctctggttcactcaaagtagcatgggacagagtccaagga

SEQ ID NO: 46936 - DNA, 2056 bp, Bovine  19866880359869
cacaggggaggtgatttttgagtcaagtcttgaagaataagcaggagtttgcccggcagacaaaagagaaaggttttgtctaggtaccataccataccacacagcagagcatgtgtacaaaaaagtgaaaagtatgtgggttggtgagcggggtgtcttgggagaacatgatcaaactgcttctttgtttttgggtttcgttgttttgtttttctctctaaagatcactctaatgcaatgtgatgaatgaattgataagaagctttggcatacattaagaaatttctggcagagagaccagtgtggaggctgttttaggagagatatatgatgagaggctgagggaaggcaagaaaaaaaggagatagaaactgtaaatgtagatacagagaaaactagggaaaacacatcacatgccgaagtctgatatgaaaagtaggagtgcagtgctcagtcgtgtccagctctttgcaagctcatagactgtcgcccgccaggcccctctgtccatgggatttcccgggcaagaatactgaagcgggttgccatgtcttgctccaggggatcttcccaacccagggaagggatccacatctcctgcattgacaggcgagccacctggaaagcccctggtatgaaacttaacttatgagaaaaaaaataaaaaggaatactcctttaaattgaaaactatccgtggtcataattctcttcgtagtatactgttgtcgataataatgtagtacacacgcttaatgacgtagcagccaatatcagtgtagtcattgccattgttattggcaatggtataaatatgtacggtagtttctctggatgtgatgagcatttccattcaaagtggactagaccatgccgtggaggacctgcataagacatctcactagtaattgtgtgaatcagaagttttctaatggtttaatgtatctcccaattgtcatttagatgaatctatcataaaatgactttttttttttttttttttttaatttacaaacagagccttttactgaaactttgtcttttcatcaggacttaagtgatacctgctttagcttattgggccttaaagacccagtacatagttatattgtatctaattagtcacctgtctttctgtttcaccttttccattcccataatccagtttttgctgaagttggcaaattacatacttcacatgtggtcatgatatgactaaaccctaatgagggttatgttatgtaaacagccacaaaatgcccataatttactcttttcattagacaacaagcaccttgaggggaaaaaccaggcatcacacatattatgctcatggaacagtaattggtaccgatatgcttttaagatgtttatgtccattataaaagtaatacatcctcattacgggcaaatttgtgtggtctcgttttatctccctctccattctcttggtccagcttgttcatccactaaaaaaaaaaaaaaaaaatggtaccatggatttattttgcagtttccaatgccagaaagtcaaagaagaatgaagctaataaataaggggtaaaatgttttttcagccttttgttagctagttctcctctttggacgctcagcttcagccttcttccttcactactcctgtggaatagcaggtttagaagttagatattggatgtcattccaccaagagtctgtcaagtttgagaattattttcaaactttaaataaaaatttcagcaccacatgcccccgcttcctccaaatactatacacttgaaaatggccgtttctcttagaaagaccagtgtcatttccttgaggctcgatggtaagtcagaagaatttgagcagatagcagaactttggaatgtaagcactgtatgccccactgttctttcttatattgcattggtttatcatgtgtgtgttttctatatctcaccaggtattggtgaataaatagttcacaccctcccaagagaataaggtctttcttttctctaaacagtgactccattgatcccgtttcagaatttcttcccttggttcattcttc

SEQ ID NO: 46937 - DNA, 2044 bp, Bovine  19866880381088
tttgacttttactttctgcattggagaaggaaatggcaacccactccaatgttcttgcctggagaatcccagggacaggggagcctggtgggctgctgtctatggggtcgcacagagttggacacgactgaagcgacttagcagcagcagcaggaagctcaatatcaaaaaaacaaacaattcaattgaaaaatgggcagaagatctaaacagacatttctccaaagaagatatatagatggccaaaaagcacatgaaaagatgctcaacatcactaattattagagaaatgaaaatcaaaactacaatgagggatcagctcacactagtcagaatggccatcaccaaaaagtctccaaacaataaatgctagagaggatgtggagaagaagggaaagaggggagagatgggagagagaaaagggagccctcatacactgttagtgggaatgtaaattggtataaccactatgcagaatagtttgggaggtcccttaaaaaactaaatatagaactatcatatgatccagcaatcccactcttgagcatatatcaagagaaaaccatacttcaaaaagatacacatgcaccccaatgttcatagcagtactatttacaatatccaagacccagaagcaacctaaatgtccattgacagatgaacagataaggaagctgtggtatacgtatacaatggaatattactcagccataaaaaggaggcaataatgccattttcagcaacagggatgaacctagagattgtcatactgagtaaagtcagacaaattatcaaatgatattgcttatatgcagactctaaaacaatggtacaaatgaaattattcacaaaacagaaatagagtcactattgtagaaaacaatctatggttaccagaggggaaaggagggggaggaatcagttgggagatagggattgacacaaacacactactatatataaagtagataactaataaggacctatttatagcacagggaacgctactcaatactctgtaatgaactatatgggaaagaatctaagaaagagtagatatgtgtatatgtatatacacgttactgcacaccttaaatgaacacaacattgaacacaaattaactatattccaataaaaaattctaaaaactgtaaagtcatgcttaatgaacagcaaacaaaatctgtcacactgttagctacacaaaaacacagaatccacacacataagtagtaaatctatttggctaatttaaagtgtaaccaggtaggggtgtgtgtgtgtgtgtgcgtgcgtgcatgcatacgctcaatcgtgtccgaatcttttgcaaccccacagattgtagcctgcccggcttctccatccatggaagtttccaggcaagaatactgaagtgggttactcctccttactccaggggatcttccccacccagggattgaacctgtgtctcctgcactggcaggtgggttctttaccactgtgccatctgggaagccccgtaaccaggcatagtaggtgagaaagagtgtctgtcgactgctaggacatttgcaataaagaccaagaatggaataaaaactctctttcgtgaggggagagttttttattttttactaaagtaaaacttttcttcctgatatcatgattctgccctttttccacccaactgacagcaaaaattgcagttttaacacagtgggagatggcagcctggaaatcaaatggtagggtgtctttgtaattgcttgacaaatattgagataaaagccctttgctcattcagagatggagtatttaaaatatttgagggccaaaatgagtacacaggccatttgctgataagctccaatttcagaggaattcaagcttttgagaaatcccatccccgtagcttttgagtattcttttgggttgccggtttgttttcatttgtaattgcacattaaaactccactctgtttcacttagcagctgacagctgagaccacagatgacagaagatagatgatgagggagagttggggaaaatccttcta

SEQ ID NO: 46938 - DNA, 1317 bp, Bovine  19866880447325
ctgttagataatagatatgggagttgcaaaatggtagaagtttattttcctaggcagatagagtccttcacatacgaattttggttagttctgttttgtatttcaagaagctggtttaaacttaataatattaatctaaaagcttcagaaattagcagtttttctcagaatttcttcatatcttttgaacagtttattaacattctacttgttgaacgtatcagccatcatagaaaaaaaagaaagtgagactaacacacaaagagtttgtttttctcttgtgcaaagaagtttggaggagctcacagtggttagaccacgtaagcacgacgcaggccccttcgatcgttctctctgtcacctttagcctttgtctcctcctctcagatgcagggtgcttacggtggtgatagacgtcacatctgcatcctttcagcagaaggaaaggcatcttcttcttgcagggtttctccaccgttcagttcaggagagaaggcctcctcttgggttgctgatggtaattcgttggccagagtgcagccacacacatgcacacacagctccaagctgggaacagaggatcccgctccctgactacagagtttgcttcacaggaagcaggagagaatagggttggaatggttatcaagtgagctgaattatgctctgtgtatcactgggcatagaaaacaggagcatttaaaactttgccatttgtatgagtttttcttcaggccacaccatactcattgtatactgtaatgtcaagtcccaaacctgtgcctgtgaccatcgttttactggcaagataaggtattaaaataagaatgttaagttcaggtagtagaatatcgccactgtttgtttcctttcctctggcagtctgaagacgtaagtgaagaagacataaaaaactgtgttctactcatggctgcagcagtctgccactaccgcagttcctctcatagtatcagaggaggagtacattaaactggaaatgaaagatggtaagtatattttatttgttattttcatatttttcctattaaagaagtcggacaatttttcattgtttttccatcttgtgataggtatgaacaggaaacctaataatgataattaaacagtagattttatgtatcaaagaatccttttatttaaatgtaaataaatttaaattttaaattatttcatctcagcttcagtactaactacatttattactttctttttaataggggtgaaggagttttctctgaatatagttcattcttgggaaaaggaaaaagaagaaaatatttttctattagtaccaat

SEQ ID NO: 46939 - DNA, 755 bp, Bovine  19866880466184
ctgcctcggtaaatgttacaggaaagagttaaatattcactactgtaaacccggaagatacgactaaaacacataccccgttttcagggagctccaacagttgaccaaagaggccgcgagagtatctgctacctgagtaccggcgttcctcacactcatctccagcaaatgggtgtgaccgcagcctttcaagactttatttacattaactaggcgtgtgaagctacagctcacataaagctaccgacgacaacgaatgaaaccaaaatcactttaccttcacagcgcgaggccgtcggccctcccgatacttggctctcgagtcacacacagccctttggacgtggtgatccaatacgcccccaatttgccctccactcgacgccatcttgccggctttggccctcgcagagacgacaacatccgcctgttgcccttctgattatccaatcagagagagggatgggtcaaggcgcgccgagattggctgaaggagcgacagggttggccatcgtttcctgtgagcaagtaggcggcgagcgagctgccgccctccagcggcgcggcggagaggcccggcgagccggagtggacttgcttgacgctcccgctaccgaggcgcgacgggcgcgaggggcgggacctgggggcggagccgatcaagcgtatctggcccgcacgccctcggttccgcagttagcccggtccgctggggtgggcctccggcggggccctggcttgcggaggatgtgggg

SEQ ID NO: 46940 - DNA, 2852 bp, Bovine  19866880485764
ccttttttctgtatatctttcctattaaaggacatatgtaagcatatgaaagcaccttcctctctgtagaagtaaaagataacaactaaataggaaacatgggaagactgttttgataattatatggattacaaaaattcacttggggatttttttttatatgaaactgataagactcccaaaatttccatatttaaaatcactccacaagaattagaaaaaatcccaattgcttacatcatctccttacgcctctggtgttttcctcttccggtgcccacatgggtagcaattgcatgcgagcatgagtgccaggtcacttcagtcatatccaactcttcgtgaccccttgggctgtatagtccaccagactcctctgaccatgggattctctgggcaagaatactaggggtgggttgccacactctcctccgggggtcttcccgacctagggatcgactctgagtctcttacatcttctcctttgtcaggcaggtcctttgcgcctcctcggaagcctgtgggtagcgcttagtaaacacgaaagaaaccttgtggattcagaaagtctttgataacccgagggtagaaagttaatggagttgtgacattcagtcagcagatcctgatcgctttccacgtgccaagcactgtcggtgaatccgagggaccgtggggagcagaagtggacgaggtcttgctctcatggagctcaaaatggggaggcagatcttaatcagttagtcatgccaagaagtgtagagttagaaacagagaaaagtgcaacaagggagaagggcagaatgctgcaaagcccttgggtcagggaagccctccccgctcacgccctccaggatgggagatgctgagaggccgccagcatcctccctgggtgcaggccccatggaggtgcccgtcctgcactctgtgctcattttgtccgtttctgtttgggatagctcactcgacagctggcaccacgaagccggcaaagggaagccagacccaagatcagagaacaatgtcatcttttacaggagaaaataaattgtttatgcttgtttcctctccgtgcgtgttgtatttactatggagacctggcagggtctgtgcctcctcgggcagccgagttgctcccacagaagcctgcaaagcctgccagtgcatactgagtaaatcagggcaaaggcgtgaaccgagtataatggaaaaaacccaaagcctgtcgccagggcacctcggcgaaagggcaggacgcacctcgccaggctcccgtggctcccgccccgttcgacctccgctcgccgagagacagccaggtctgttgtgaacgcctccagtcgccagtgcgtgtttcccagctcacaatggagcgcttgtgccgccttcgttttcactttcaccagcgagggaagcggagcacaatggggcagtgcccacggcttgggaacaggacacgtttttccttagggttcccagggctggggacgtggaaaaggccagagccaagacaaacacgcgaagctggccagatcctccgttacgctttctcagtggcaatcaaacacatttccagttaccatctgatgggtagtctctgcctgtggggtaaaggcagatgctgttgaccacggtgagcaccttccctgaagaaagagcctgtattcctcaccgtacaggatgccgccgtggcgtgcctgcgggtgcctatcgcatcgcaccaactcttcttgctcagtccatcaaatgactgctttccttgtttgtaaaagatagacgttcatttgattgcagctccttcgtaagcgatcactgctgaaaattagttctggacaaaaacagtttaactgtaatgccactgcctggaaagctgttttgcttcctccatacatctgttcggccccctcatcaaggtatgatatagacagggtctgcttgtcacctggttatctacattcatcctgcccgtgtctaccctgtggtgaggccattcaggcctcagaagtaagttgaatgatggcttaaaggtgagtcactcagtcgagtctgactctgtgacctcatggactgtagcccgccaggctcccctatccatggagttctccagacaggaatactggaatgggttgcccttcccttttctggaggatcttcccgacccaaggatcaaagcctggtcttctgcattacaggcagattttttactgtctgagccacaggggatgcccaaatctcagaagctcgaggccaggtttgagtgtaaagaccaaccattgttttaacgttttggagtccaagtgctttagagaggttttgcaaacagagggtttcttagggatccagaagctggaaacatttcgttgcctcttccatttaatattcgtatgggaatgattactccatcgcccctaaattcccttaactcaagtgtcctgtcatgtcccttcagcagagtatgagacgcggtccttagaattgagtagaaacaatgtctctataacttggattttcacatcctctctaattcttaggatatgtcacttctggtgttttgcagataccgctgcttgctcccttgtaaggcggggaaagataggaatatcttcagtttgcttgggcttggctcgtctcctagtacaagttcctgagttgagaagtgtcactgaaattctgttacgttgaacactgccgtttttattcactcgcctgcggtgttgcactattttagagtttcctacagtgccctcttggcccatggtagtcacttgataaacacgtgatgaatgaatgaaacaaatcctcatgattctccattgtctaaagaattaattccaactcggtagcatggcacg

SEQ ID NO: 46941 - DNA, 2585 bp, Bovine  19866880501869
ttaccattgctacatcatttaagacctcttagaatgctaacagaggtccctgtacaagtcatccagtctaaatgtcctctatgacggataagaaagctgagaaaaagtcagcacccaccgtagtttcttcatcagcaaactggatgcattagtcaggttccagcaggaaatagatggcagactcaaaataagacaattcaaggaaggtttgtttacagagagaagattgacaaagaagtgggtttaggggaagcccagtggatggtatgaacgtgagtctcacttgcatcaagctgttaccattcattcccaggcttgaagggtgatggggagcagttaactggagttgggtggagtgggctgcctgggaaggacattgactttgtggtgacagccctgccagctctgcaccaccttgctgggaggaaatcaaggggttaaaaactcagcttcactgttctccttctctctgaactcctgccttggcttcccattggccaaacccaataagaggctgaaggcaaatggtcgacacaagtccacctcccaagaatggggcccctgtgcagagaggcaaagggaagctggcccagcacgatgtacttaccgtgcttcagtgctctttaagcacgtagccatagattaaggatgactcagagaatatctgctaaggttttcgggatcttggtgaaagggtacatgaattaaagactgcaaaatctaatattaagtaagaatgctttactctgacatgtattttgagtcagagttggccttggctctactttatcttatactgtactgaactgtttcacaaaattgtgaatagagatcaaagcagtttaaacagatacatccacttgtgtaaatatccttgaactccccttgtctttggctccccctcctattgccaaatccatccagcacctctagaggctgttaatacatgcagtgattgtaataaacatcatatttgcttgggttccagctggctgcaaccaccaaactctgtccatagttcctattgttatctttgcttagtagacaacgtcattgttacccttagaagccacctttgtcttagatttctaaatgttgatctttatacattgtactgattgtttacacagcatgtcttttaactgaccattatgttttgtttttaagggtatgtagaattattaaactgagagaatatgtgggtagaaattaattgattatattgttgaaagttttctatgttacttcatgcattaaaaccttgaacaaaacggatttttttaatgttttgtcattctttataaaactttctattaaaaattagtaaatctgctttcctgtgacttaaactggttttaagtgaggcagtcttccatcagaaatttttagaggtacagaactgtagtagttccttaggaaacagaatttatactttaatgtcagggaaatttgttacaatttgttctcagaagcttggaagttatgtatttgaaatcctatgaaattacagaagttgtcatcatttcagatattttaaaattacagtgacttaaagtgaggattgggagaaggcactggcaacccacgccagtactcttgcctggaaactcccatggacagaggagcctggtgggctgcagtccatggggtcgctaggaatcagacacgactgagcgacttcactttcacttttcaccttcatgcattggagaaggaaatggcaacccactccagtgttcttgcctggagaatcccagggacgggggagcctggtgggctgccgtctatggggttgcacagagtcggacatgactgacatgacttagcagcagcagtgaggattgaaggactatgggtcagaaaatggaatggccacatgtattcgcaaattaaaactagggaagcttacttgatacatgagctaatgttacataaatagggaataattgttagatttatatctattgcaaaaggcagtcatttattattttaaatgtaagttctgaataacatcagagaaggcgatggcaccccactccggtactcttgcctggaaaatcccatgatggaggagcctggtaggctgcagtccatggggtcgcgaagagttggacgtgactgagcgactttcctttcacttttcactttcatgcattggagaaggaaatggcaactcactccagtgttcttgactggagaagcccagggacgggggagcctggtgggctgccgtctatggagtcacacagagtcggacacaactgaagtggcttagcagtagctggacagcattagggttattttcctggagaatcaactagaaatgtatagttcatactttttgacattcatgcatttgaattttataaggattaaccaaaaagatagctctttagataaatgttgatggttcaaaaagactataaacataaacccagtgaatgaatctaattcctctcaccttgttacaatgatttaaacatagcccaattaaaaatctctaagacataatagagagttttttaaatcttaactttcactgaagttatcaaatgggaatttggtgaatacatttgtaccatgca

SEQ ID NO: 46942 - DNA, 1490 bp, Bovine  19866880534440
gggaagatcccctgaggagaaaatggcaacccagtccagtagtcttgcctggagaattccaggaacagaggaacctggcgggctacagtcggtggagtggcaaagagtcactgagcatctgagcagcagacagtctctaggctctaatgagctatccctcatggcaggagataagttagttttgtcaccaagccctaggtagatcctgccgcccccgtgctctcagtcagctctgatggaaatttaaatcatcacctcaggagtttattggaaacactcctcacctggtgagtttataggagtgcttccttatagtaactaatttgctcctagaatgtgggtgctgtatgaggtttaacggtcttcatctttgttttaaattttaagcctttgataagtatttgcaagaattaattcatggatatctttttgaaacttaaactcccttagccttggaacaaactgttgtttctgtctagcctgtgtcagaagactaggccaactcttctccctaattataaaagtactacatgttatgtagaaaatttgggaagcatggaaaactataaacaagagaataaaaggtacccataactcccaaacctagagataacaaacgttaacagtttggatcaaatcttccagttttgtttcaaatctttgttttatttcagatctctatttttaacagaaatcaaggcctgcacacactggtagttttgtatactgatgttttcttacagtcttatgagtgttttattttattaaaaggtaattgtcatttttttttttttaaagttgctcagttgtgtccaactctttgccaccccatggattatggagtccatggaattctccaggccagaatactggagtggggtagcccatcccttctccaggggatcttcccaacccagggatcaaacccaggtctcctgcattgcaggcggattctttaccagctgaaccaccagggacattgataaattttaggttgattagtgttctgtcataagtttgccataatttaattgttcactggttgaacgtttatattgtattcaatttttagacattaaaaatgatactataattatattttaagaaaaagttaaaagtaacatatctttgtgtaatatataataaaacattgttttattttctggttaaaataggctttcagaaattattgagttagaaagcataatttttaaattgtttatttatttttggctgtgctgggacttcattgctgcccgtgggctttctctagttgtggcgtgcaagggctactctgtgtggttcaaggacttggcatctaggtggcttctctcctctcctgtggagcacaggctccggggcgcgtgggcctagctgccccatagcacctgggtctacccagaccagggagggagcccgtgtcccctgcattggcaggtggattcttaactactggaccaccagggaagcccccatgagtaattattaag

SEQ ID NO: 46943 - DNA, 3354 bp, Bovine  19866880534695
tgcaaagtttgatcacggtgatgaaactgtgttgctatctgaggacatactgagatcagttggtgtggaatattctagaaaagctgagcaggaagcatgtctgaccctctggggagaggtcccatctgccagtatgactttggatgctcagaatataactgttggagccaggaataagtgaattgaggaggtgaaggcagaatttagaatttaagattcttctgagacacatgactggaaacacacacaaatgctgcatgtttgtggtcactgttgtggacagcaaaagggagcttgccagagacccagagaaggtggtgctgaaagctcaggtggaattggagaccaggacaggtgaccgttcccagtcttaatcgtagaagtcgggatgggcaggtgtttactaaggtgaggccttggaggatcagtggaagataatttttgtggttcctggaaagagaatgatccagaaggctaactgggaattttaggtgggccaggaaaaaaatttaaagactagaggggtatgttcaagactggcatcctcacagtgagggagggagaggatgggatgaattgagagcgcagcactgacgtgtgtgcgctgccttgggtaaagtgtgggaagttggggagttgctgtatagcccagggagctcggcatagcattctctgatgacttagaggggtggggcaggctgggggtgggggcatgagattcaagaggcaggggacatgtacatacttagagctgattcacttggttgtggctcagtggtagagaatctgcctgccaagcaggagattcgggttcaatctatgggtcagaaagatcccctggagaaggaaatggcaaaacacttgggtattcttgcctgaagaattgcacggacagagaagcctggtgggctgcagtccatggggtcacaagggttggacacgactgagcggctaaatcaccaccttgcgttgtacagccgaaaccagcacaacagtgtaaaacaattatcctccaattactttttttttttcctaaaaataataataaaaaaataaaagaccatgatcctgcatttaggggagaggcatccttaaaccagaacaacacttgctgtataaaatttacctgtgcttagtacctggctgctcccaagactaagcttcctagccttggtgccacccatctttccctagacaattcctattgcattggctactttaacactaacttgctgaattctttgtacagtaagatagtcgttagattctgggtgttttgtttacttttgccttggcgaatgctcttctgttccctctagcctaaagatcccctgttttctcttggcctccctgcttttcgtgtctagatatgaccacccagagtctcttcttcctgtccgtggacgaacttactagccaggagcgtttgttcctccttcccctggagatgcatttgccgcctctctcctaacaggctgccagcttaaaaactcagtccttaaaacaacacgaactagcaactgctgaagcgccgcctcttctgagcccccttaaacagctgtgcacgcggcttgacccagaacagataacacacacagatgtgtttatgggaaggaggcacgaacactctcagggtgttgttttcggcttctcaccactgcagggatttcttctctttttcaaggaagaggtacattgtggtaagcagtgttttatgacctataataaaaacccttgtaaagaccattttttggacccagagaagctaagtgttcttttcactcctctccgcctctctgtattgaaatgcacgcagttcagcattaatgcataacataagggaacaatatcacaaattctcattcttatttaagctgggaaagcaaccaaagttaattatgtaagaaaatccattaggaatgtgtttccctacttagtagtagcttctgaacaaatatgttgattgagtaaaaagctatattgcattttatagcatattgttattatctcatggaaacacccttttgagagaatgtcaacagaaaacagtccccgggaacaggctaaaaagcaacctgaagccaccttagaaagttgggtcttatacaaaaaagggacatgcaaaacattcagtgaacagtaacagatgatttctgaggacgcttcaggacctaaaatgctagcaatctttagtctttcaaaattaagaacaggcaacataacacttgatgtaaataaagtaataactgctttcaagatgcatcctctaggatgcacgtggtagtgtttgttgaccttggtggctgagtggtaaagagaccgcctgccaatgcaggagacacaagagacgtggctttgagccctggattgggaggatcccctggagaaggaaatgataactccctccagtattcttgcctgggacatcccataggcagaggagcccagcgggctgcaggctccagagtcgaacacacctgagcaactgagcgccaccaccagaatggctgtttggaaagttggagattgttcatgtcccagctggagaaactagatgagtctaaacctagggtgttgctggacaccactgctaatggcaggtcctctcttgattccatggcaccagttctgaacccagtggacaagccaggaaattcagtgtttttcgttctcacagccgccctcaagagagtgttatccccattttacagatgaggaaaccaaggctggatgcgagggaagggaaggtaggcgttaagtagcaggcccaagtacacccattgtctaactgggagatgtagcagagtcctcagaagatggccctgtaaagttgacctctggaaataagcattaacagattgcattcgtctcttggattgtctttcccctcttttcttctttagtgttctggttcagattcctgttatctcatgtcttacgtcttttttcccccttgtgttttgatttttccacatttaacagtgaatatgcgtgacacttctaatcagacacttagaatatctttcctttttgaagaacagtgaagaggaaggagggatcccatgtgaaatgccgaggcaggactcagttaggagtggaacttcttggttgtggcgagtcaagtgcttattggtgatcttgcaagagccgttgtgttcccattcaccgtttggatgtggtgtgggtggggaatgagaaagtgtgcaccctgaagaccggtggccaaggaaggaagggggttgctttggttgttcatggtcaagggacaagagaaggggaagtcccagatacagtaggaagggcaaggtagagtgagggcaggacttgaggaagcggaatgcaggcaattcagag

SEQ ID NO: 46944 - DNA, 810 bp, Bovine  19866880551134
aattgactggtttcatctcgcagttcaagggactccatttagagccagttcaacttgaaatcttgagaagttgacaaggtttacctagtagaatctaaactaggtttacctagtttgaagtgtccaaaaccagaagaatcattgttaacctacttgagcagccatttataatagcttgaaggtatcacttatatacaaattagggaaatggtaaaattctcaaaattagaaaataccttggaatgtcgtctagacattggacattacgtttaaggatgtgagttaaaaaaaaaagatgagtaatgtgctgacagtcatgcaatttggactagtcctagaactgtatcccaagccctggtattctggtccagggggctttccaaaaaccatataactgtggttttgttcttatttctaattattcactattttaaagacctatacttaaaacattttgttgttggtttggataagttactgtacttacttgcacattcctctaaaagcagtgttagtttgaactttgcccttgtttttacttacctaaccccagaatcctggaatgctttctttgctagaactttcattcttaacattttattctctttaaatacagcctcattccacatgtattttttttttttttcctctacggagagttggaatttgtctacctatttcatttcagtcatgttcatgtgctgtcaaaatccttgtcccttattctattttcctggtagcttcttgcgcaactacttacatatttgtcaagtaaggatatatgtcaactaagctattcaatccaataaa

SEQ ID NO: 46945 - DNA, 2070 bp, Bovine  19866880571876
ttaaagaaattatcttcgttttcttcccctctcaggaatgcatgtaaaacagttcctgtctcgatgcatgcctaaggcaaaaagttcagtgctcaattacctgctgtctgcagtctcgtattttgcagtgagccagtgaaacagcattttaatcagacgtcttgacccatgctcttctgttttcctttgcagccttgcaagctatttggcatatgaaggtcctgacctgagaaaaccatcttggataaccgtggcaaggagaaggaaaaatgcaacagctaggagatttcggtaaacagtagaatcatgccaacctaatctgtgttaaaatgcttggaatgtgggagccgctgatgatgcctgttgtctgtgtgtctgactgaatcctttcttttctcagagcagcaaagcaaagcctgggaaccaggccaaatgcctgccacttaccttaaattgatcagctactttgagattaaaacccctgagagctgccacaccgtgaaaacaaggcctccttcacattaaaggcaaattgcgactttgggtttgctgtgatctttttttccattttatccagtttttcacagtgcgcactttttttttttttcctttccatttatgctccaatgtagaagccaatagttacagcatcttggccaagcattcattaaggtttataagaacaaaatttatggttatttagcagttggcacaaagacagacttgctgaagaaagaaaaaggaatacaggtgggaaatataagccccaacaaaggcccatactaaactgcagggctgtagtgtgcgagctgctcagaactggtctgggagaaaaattatatcatattcaaaagcagtcacttctctattctgaatccatcccattttatggctctgtggatgactgaagcaagtctgcagatcattccaagagatctttctgtcttgtgtaactgctaccatttacaggagctggcagttgtagagataaatagattcgtgttaatctgggtgataatctgtcagtttggttaatagatgaggtacatataaaaatatgtatgttatggatcagaagaagggctctcccatgaagaggagagtcatgttagccttgtgagtagaccttacataatggcaaggcctatgttcccaaaaatgtagggtgtgggcaaaacacacccttaatctttgaattcaggcagtaatgtggaattctggcaccatctggaagtctatattcttcctcaggaaacactgttaatgaatcttgggttttgtgtggtgtgtgtgtgtgtgtgtgtgtgtttaatattctctgatttcttgaccgagggggataagaaagcatcgtcttctgtcatttgcactacttgtaaaacaaatattttacgaatatatttcagttttttacttgttgtttagggagtatctgggagtacttgcatgcattgaaaaatatacagcttcagtgtttcatgatgtagactgtttccaaaatatcatttgttttagctatgccagtaacttgctgtatgacttagggaaagttaatttaaatgtctgttgctgctgctgctgctaagtcgcttcagtcgtgtccgactctgtgcgaccccatagaccgcagcccaccaggctcccctgcccctgggattctccaggcaagaacactggaatgggttgccatttccttctccaatgcatgaaagtgaaaagtgaaagtgaaagtgaagtcgtgtccaactcttcgcaaccccatggactcagcgcaccaggctctttcacccatgggattttccaggcaagagtgctggagtggggtgccattgccttctccaatctcctattatcaaatgggaacattaatactgttacagggtccaagcttaccatacaaccgggcaatgaatcagagacaggtgttgaggcaaggaataggacttcattaagagagctggcaggcccagaagatggcaaactaatgtctcaaaataactgtcttgtcagggttggatgtcagggttatcttatggattggagatgggggaaaggtgaggaaacaatgta

SEQ ID NO: 46946 - DNA, 679 bp, Bovine  19866880600120
ttggaagacagtaaaaataagcagaaatagagtataaaagtaagcttaaagcactaagtgaagagcttcatcatttgcgaagaataaacccaagtatagtgaaaatgaaaagttcagtctttgacgatgacaagacttttacagcagaaccactggaaattggtgaggttgtcgagaaagatacaacagaacttatggaaaaacttgaggtaaccaagcgagaaaagttagagctgtcagagagactgtctgatctttctgagcaattaaaacagaaatgtgacaagataagttttctaacggaagaagttaaatctttaaagcaagataaagagcaagttttattgagatgtagagagttagaaatcataattgaccacagtaggacagaaaatgtaaatgtgcatgatgtccatttaagctctttgaaagatggagtttcagcaagcagggatcctggagggtcagttcctaaaataaataaagattttggtaaagaatcaaaaataatggaggtaaataaaattccttttgaaaatatgactctggaaaaagaaagcaaacaagaacagttttctgctcacttgccgtcggtgacaaatgaatcatcacttgggattactgatccaggtgaaaacgataaacttcagcaggagctcagtgcacttaaatcagaaca

SEQ ID NO: 46947 - DNA, 1189 bp, Bovine  19866880636998
ccttgactagatggacctttgttggcaaagtaatgtctctgcttttgaatatgctatctaggttggtcataactttccttccaaggagtaagcgtcttttaatttaagaaaagatatcaaactctaaatattttctaatctaaggtcaataatttggtattaaagttcaaattcatgggttctagcatcaaacagagacggagtctaatctcatttctgccagttcctagctatataacccagggcaaccactctgcatctaaatttccttatctgtaaaatgggtataataacagcattccattcacagcactgctgggagaattgaatatctgaaaattttgacaaggtggttggcacacttcaagcacacagtaaatgtaaactatcaccactgtacacatttttaaataaataataacggtatcaaaaatactacttaaaggcatgactcagagtataaagtctctttaaaaactgtcagaaaggtgactaggctattccaacttgtcccgtactgaccagcagaagaggtgtcctttcccacagtccacagcaggagctctgagcaaggggaagctgagcgtatcagacccagaggtgtctgatccttgttttgtcagtctgactgctctttcacagcctggagtaggacaccatttaatggcaggattattttcaacaaaggcctgtttaaacagcaataacaaaacataaaaaaatattttaactctcaattctaatagagtgtaaatgtcaatttacttcagaatgaatgaaatgaaacagaatgaaatgaaaaaacaaagagtagtcagtttcaagaaatacttaaaacagtactggaatgtattaaataagaaggaaaaaaatgtggcaattaccttagtaataatttttaaaatttatgtattcttttttttttatttttaaactttacataattgtattagttttgccaaatatcaaaatgaataatctaagaatcaagtagattgatgacggagtaaaaatgcaactattcatactgaaatgtgtaatttaaaaatgttttctcacaatatgctacttttctgatggaaaataattagtaagtaaacagaattttatttgaggattagctgtattagaataatgaatttctacagggtactttaagtaatacataaaaatcaatattacaaacaca

SEQ ID NO: 46948 - DNA, 1419 bp, Bovine  19866880657349
ctggtgtacacattctgatgagagaggtgagaatgtatggctcgatccacaagcatggtaaaatctctagccacaaatccttcggtttctttagctatacgctgcagatcaagaccggtgaacctcttccatgtcacagtccagtttattttttattatagcatgcagaatttcacatctttgatcctaaggaaaaaaaacacgaaattcagatttataattttacttgagtgcaaacttttgtacacgtattttgaggaaaatccggttgccacaatctgcagggacagaaagcagactgtttgctgcaggcagactgggggaggggtgaccgcaaaggccaaggagacacctggagggacggacgcgtttgctgccttaattgtggggatgcttcatggtatatgcctatgttaaaaccgatcaaattgtacatttacttttgtatgttttggtcgcaacacgtggcttgcaggatctcaattccccaaccagtgactggacctgggccacagcagtgaaagagctgaatcctaatcgctattccaccaggaaactcccaaactgttcactttaaatagtgagtttgctgtcttcgatttttttataccttaataaagctgtaaaaagaattacattgataaatgatggctctttctttctccagtaaaaaggtttgtattttggctcctttaagagtattttgttgtcgttattcccataaaacataattctaaaagcatttagtggtcgataccgctatgttctgttatgtttaataataggtatatttttatccttttcttttccttcagctttgagatataattgacaaataaaattataagacatttaaagtgtacaatgtgatttttattttttaagtaaactttttatcttgtattggggtatagctgattaacaggacaatgttgtaatagtttcaagtaagcagtgaagggacacagccatacatacacgtggatccattctccccgaaactcccctcccatccaggctgccacacagcactgagcagggttccctgttctatacagtaggtccttgttggttatccattttaaatatagcagcgtgcacacgtccaccccaaacaccctaactacaataacagttaattagcataggggctgagtacttttagcgtagatgctaggtaagaattttaaacagaaagttaaaatacggttgcctgtctggaaacattcctggagtgcactgccactaaagccatcaggactgtaagcccccaaaaggagacgatgcattgtatgtgcttatacacatttggtctttgtcacgcttctggcacagacctcctaaaacccttaaaatgtcccaaatgataagagtgataaacgtgtcttgacattcctaagaaacccctttcagccacat

SEQ ID NO: 46949 - DNA, 1061 bp, Bovine  19866880670531
tagaaatcactgaagagaaaaaaactattatattaaatgactgaaatgacataaaattacttaaaataggtgaaaggatattaacccccccacaaaatattaaaacactgaggaaggagaaatttaagctacgtataatatttctggaaattccactttttcatgtgactgaattcataaaggttatttacaagttgtgtggataacagacttttatagaggcaggtatcaatggcagcgtaagtatatgaatcatctcagtttcttttccacatcaccgaacaaccatggtcccaggactaagacaactttatttaagtaaaaaaaaaaaaaaatcccttcaacttcttagatggtgattaaagaactctgaagttttaaaaaagaaaaacaagaagcaaacgctcaaggtaataagtgctttcttgttaccagtgctcatatcccagggcactggctggagctaaaggacaaagagataagggcaatattgctagttactaacaaatggcagataaaagagctcttctgggttctgattaagtgacagcattctacacattcttttgacttgagaaagacaggctaagagcagcggctaagttccatgtgaagcaccgctaaataagcatatctgcatgcttccacattccagcaggatgggatctctttcctttccccgaacagaaacacgttctctgtgctcccagcaagaacgcgcctttgcttcagcttccattaaaaaaaaaaaagagcataagtgtatatgctgaaagcacagagaagttttgtgctgtgggacgtggtggccgggagccaatgtttacaatcccctgggtgggaaaggcagggtgaaaggctcaggacggcaggctttaaaagtctttgctgttgccgccggtgaccttcgcctccgttctcaaagcagctctcaggttaaccccttggatactgtgtgtgctggggccgcacaaaggaaatacctttctttggaggataccactctcaggcgcatcggtttctgattttggctgaggcagctcagaaacactgggctgaca

SEQ ID NO: 46950 - DNA, 1451 bp, Bovine  19866880761691
caggtgaaaatttcatatctaagtaaaacatgcactgaagggttgatttttaagtcttaagatcacttaacataaggcattacattttaataaagttataatcattaataaaattgataaataatttatataaaaggggacacatttcaatactcttcacaagtagtagttacctggtcaggaggttgaatatgctggacacactgaaatatgtgaattccttgagcagaaacaagtaaaggatgtagagaatgttgtgactggcttgtagcaatcagcgcaaccaaacttcccatggaaataaattctttcaccagatcgttcaaagctggaattaagcaacacagtgtaaaagcttattatataaaagtgaaattttaaaatcatacactaattaaaaataataacctaaacttggcctttaaagtagagtataaatgatatggctcctctttacctagactgaggaccgaggattggcaggttccagttactctattagaggcaaaggaagcaaggcaaatgctgtgtactcagaaccatgcctagtgaggttggttcttacgaggtaaacttctgaatcttaataggtacatgaaaaggagtctctgaaataagtattatagaaggatgataaactttcaaattgttgttctactgagcaagcaaaatacagcttatatacctatggctttctggacaatctctttctaccctagctcaagaaaggtttggtatgaggtaagaaatgaaacaggcattaataacatatatctgatcctgacctagaaattcaacacgagactagcaagtctttcagacactacaagattccaaatgtgaatttaacactaatttatggtaatccagccattatggttgcattctgtattcatctcttaagaaccctgatgcagatgaatgctgtcaaaccctccaagccctgatcccatcctctcctagaaccccaagctccactggaatttcttggacttctgcacctttgccggaggatcacacttccttcgtgccttcattagcctgaagctgctccgtgccaattgctactcctccatcaaaactcatcctagttatgaacagctctcagaaaccttccctgataacttcttacccaaccacctccagtttagtgtatgtgctcctatcgcaccctgcacacacttccagcagaacatacccacccatctcctagttgtgtcttcctgggcaaattacatcaccttgaatttccacttactcacctgtaaaaccaggagagcatctgcgtggggatacaaagcaacccttgcagtcagcacatggtagctaccataactatgagtcttctgtactaacactgtctgtttccttttatttcctctccaagactctgagactacagactgtgcacgagcaatagagaagtatttgtcaaatgagcaagagtaaag

SEQ ID NO: 46951 - DNA, 1842 bp, Bovine  19866880810385
ctagctgctagtcgtgtacctcaggattacagcaggcactgtcccttcactcatggagctcctaatctaatagggaaaaggggaaaaaaaaaccaaacatgtttccactgaacatgtctttcattcctttctacattctcaccatcactggaattgaacattattaagcaccacagtgaccacattacttcattgatgttccttagaagcagcaagcaatacagttggttatggttgatttcatggtttgcctgtgactgttgagaagacatgacagtgttttctaaagcatttcgtgaatgctgctggcataacccacatatgggttagaaatgctgagatggcatttctgattaacctgagcagccaacagtctttgataaaaggcctctgatttctaaagcagggcctgcttgaaagagcaaaactcttcaggaagtgagcagtctaagacatttgcttctggggactcttcctggtgacataacaggtcctttccctctagagctcttcctctgtgaatgagagcagagagaaacagcagaagaatggaggagaggaaagagagactaatgcaaaacagatcctgcggtatgtgagcgagaagtagaggagagagtgaggaaaggcggagcttaggagaaagaggaaaggagggctggggagtgaggggacgaggaaggaagggacaaagggagggcgggcggaaggaaggaaggaaggacgggaggagagaggaggggagggaaaagaccgagcttttgtggagcacaagtagcaagggctccaagggcgtggtggccgtacccgttggacacacagtactgtggagtcagtcccgggccgggtcccaggagcaaggacagtaaaacacttaagaagcgacagctgttttatcaggaggaatattagcaaaaattgtagctacttgcactttctttgtgccaatcctgtaagtgctttacatgaattatctcattagatcctcaggacaaccctagaggcagagagccttaacccggataaagaaactcagagcagttaagtaacttatccaaggagacaaagctgacaagtggcagagcttggatttgaaccaacatagctggccttcagcgcctctactctgaagcaccatgactgctgctcattggacttgcaagaacctgctgtaataagacggcagaaaggaagtgtggtggattgggatgtgaatctgaatcggggcatttctggttttcaaactgctcccctctctttatgtgaggagagacaaatattttaaacaaaacaaacacttgttacacacacatttcagtgtaagagataattacaattgaatatcctgattttatagtcttagtgattttagatataatttaacctatggtgcatgaatcaaattacccttaattggcacctttgtgaacaatcccagctgaagccccctaacagaatgttggttggtcgtgaaataacctaaatttaggaagactgcactaatgtatgtgggtttcccaggtggcgctattgctaaaggatctgcctgccagtgcaggagacacaggagtcacaggttccatccctgggtcgggaagatcccctggaggagggcatggcaacccactccagtgttcttgcctagagaatcccatggacagaggaacctggcgggttacagtccattggggttacaaagagtcagacacaactgaagtgtgtctaaggtatgtattatagatagttactcttaatgagtaaagttaatgaacccagcccaggactgactagttgtaagcctgggtaataggaagagagttcattttttcattcaacaaatat

SEQ ID NO: 46952 - DNA, 1918 bp, Bovine  19866880820824
atattgggatcgtcttctccaggaactcgagcctgaggcaaaagaaagtaaaattacttcaaaatttaaaaggaaaaatgattgaacccagtgaggtctgccactgttcttttaccaaacagatgattaatagtacctctatttatacagaagaactttttgacctactagaatcttattttaattttctccttgcccatgctaaagagaaaataaattacttaagtgtaaatctgaaatagaaaaatctttccctgtagtacagctctgaagcaaagattgtagaagggaagggagaaaaaggagagcaacagaagtaaaaataggaagccaggctcaagggagaaagagcaaaaggcaggggcgacgaagttgcccagaaaggctacctgaagagagtcctggttctcggagcgactggcgggtgtgtagtcacgcagggaggaggtgtgcagcgcactcatagatgcagaacttaccacggaggtgcctggcctgcggccaccgccaccttctgggagatctgtgtcaaagcaagcagtgccagagagtttagtcacatcaggcctcgtacatctttttaactaaatcaatgacttctctttgagcgctggtgaaaacccggggccacaagttcacttcatctttcagagatttttcatccataatgtctcaccacaagcaacaatatatatctaacacaattatttcaaatccatgatcaggctttacaactttagattatacatcgttctattcataaaggcaagtgctaccaagtgtttgtttttttccccttaggcaacaagaaaggtgttttagttttcagagttcttaaaactaaagaatttgcaagttacaatagcccccaaagctaatctttaaccctgtcgatcctgatatattaaagatgagctgctgacactgctgtagttggaagattttcaattaacaatttaatatttaaaggatgataaattatcttcactactaggaattttaaaaatgttgataggaaaactgaggttaggagaaaaatatttcaggaacacactaagagtaaccaacagctacaatctatcaagtgctcgctgggtgctattcgtatttaagggttttacagacactgcctcatttaatgctcacaacaagcccacaaagcgacactactgctgttgcttctttagaaggaggagaccaaagcttggagaggttgggggactaaagcttcacagtgacatgcagcagagctggaggcatgagctcaggtctgtctgactccccagtccatgtttttaatcgccctggttttctgcatcctgtgacattagaagcacctgcatgctgactgtatacctaaattacaaactctttcacaacatttagattcgccacttttcgaagacatgcaagagaactaagagattacaacaaacgcaatgcaaggactcacctaaagtgctttcacttggctcgtcggggtctggagggttactcagcagactgtgcacgtctcctcgccggcgctgttgtctgtgcctcctccgatactgaaattcagcatattcctgcataaaccacaggttataaaacacgggagagcatgcacattttaaaatgcaaataaaaccaaccatacactttttttccaggaaaaaaatgtgtgattttatacacagattataaaatcacttggctttagaaaaagaaacttcaggttttgccatgccaaggaaaacagaaaaggtaaaatggaaaagaaaaattttacatagccactgtagctgtctgaataaattcggaatacttgcaagctccaatgctagatcgtaactgagcctcatttcatatgcctggaccttgtcatctgaagttataactaatatcagaaagattttactgatatgagttaggccct

SEQ ID NO: 46953 - DNA, 822 bp, Bovine  19866880839851
tttaattaagccaactgacatgagtatagccaacccaagtatattatacattcctctttttttggagtaaccaaactttctcctcttgctacggatgtttttatcatccgtttaaactccccctctactaatttatgtcttgtatttctttcgatgcttgatattcgtattctccatgaggtcttccagacgtaaccccagatcccaaaggttttgccttgcctcaccttccttcagtatttacataaagtctatgccatgtggccttcacttgcatgtacaatgctttgaattttattagttctttttcacacaggcaagtttataaactttttttatacagctgcggtactcactactgctttgtaatccataccaactacattgctataaatgcctgttgaatgaatggtgttttcctaaaatttacaaagtagaaacttgttaaattggaagttattatgataattggattactttctgatttcaaaagagagttagatttaaccagatagatactgaatttgctattgacttacccatttatcctataatttttttgtttgttttttcttaacatagacagacctagaaatggtcactgaagaccttgcccaaaaagtcaataggccttaccttcgcacaccccgccacaagatcatcaaggcggcatgccttgtacagcagaaaaggcaagagttcctggcgtctgtggctcggggagttgctcctgcagactcaccagaagctccacgacgcaggtaaaaaagatacacactgtaacctcacccagcaccagccacagaggcagcaagtgtattt

SEQ ID NO: 46954 - DNA, 1407 bp, Bovine  19866880869868
ccatctcttttgtgacaattactactgaaaattatagtgatatggaagtatatctcaattcttcctattattgattatttattattctattacttggggaactagttcctactgtttcacatacacatcatatacttcagtacctgtttgctaaataaatgattaaatgaagttacatgcatgcttgctaagtcgtaacttcaccatttaatcatttgaatattgtgctaaatcacttcaggcatgtccgactctttgcaagcctatggaccatcacctgccaggctcctctgtccacgggattctccaggcaagaatactggagtgggttgtcacaccctccttcagggaatcttcctgacccagggattgaacccatgtctctcgagtctcttatgtctcctgcaatggtgggcaagttctttaccactcagtgccacctgggaagcccaatttctggtcattcagaatatttgaaaaggtttcacaaaagtggatggccttattaagcaaaaattactacctatataatctgtatggattgatattagaacataaaatttaaaaagtcacaattatgttaaacatatgttatctcttttgattcaaaaaacacttcatgatctttaagttataaaattaggtccctttctccatcagtctgaaaggatgtcattgttgggccatcaaggagaaaaactaccatatccagttcttcgacaaaacctcagatgcatggctttctggccaagcatctgcaatttcatattgttggaacattcattgtctccctgggaactgcaactttctgtaactttgctatagctgaaccaggaaagaaagcatatgcagatttctatagaaattatgactccatgaaagattttgaggtgaagaggaaggctggtatctttcagagtgcaaagtgatttgaaatataaagaatttctttgcttgagttccatggaagtttgacacttacctgtgttcctgaagcatgaaactatgaatatctgggctgaagaatagtttctcaacaaataaatgatgagcaaatactgtgggcactaaaaaaaatgtaaaagaaaccaattaggcaccccaaaacgtaacttaatctatttttggtctacctgtattttaccaagactttaaaataaacctgctttttcaagttgtttagttgaatggattctgaataaaaagcgattttatattctggttggaaagatttaaagaggctgaattacctgagaaagacagtataaccctaaaccaaagtgatagaactgtcctttaatttttctttaatacatttgtatctcatcatattacatttctagaccaaaatggtttgtacatttctgttggtcgagcaggaggaaatcattataataaaagaagtta

SEQ ID NO: 46955 - DNA, 902 bp, Bovine  19866880921312
ccttccctcctgctggcaatcagattttcaccagacaaatctaccccaaagcacagaatgtgcttacaaaggttagtcaggactctatttgcatcacagcagcttaatcatttcaatctttaaaaaaacaaaacagaacagtttttggaagcctctaatttattttcgagtttcttttctcatcttggactgcccttctcctcagaaactggttctcatttcccaaaagctcttgcttgtgttctaaaagccgccatcactcttcggagaagacggcttgacaaaagtcagtcagcaagatggatctctttggaaatggaagccgtctggagtccaccgattttaatgactccggtttgaaccgaagaagagtttattgccactctagtccccttccctgtgggcagtaaattaccaacgattaaagagccagtttcccctcaccctctctgcccccaccaccctgctctgctcccggcaaaaacaaaaacgaaaaaagaaaaaaacactgcccgggaggacaaaacctgccaccaaggcagcagcgctgcggtaatttccccaggcattatgattgatgatgatcagcagagcgtgggataatggctccccttaatttaccggtccctttgaagggttaaaatatggcagatgttgatagctgacactccttgctaacaggaaagacgcatcgctgggggcccccttctaggctttcccttccccgcagctgtctgtgtagagcaaattgtatccacttgtttaacctcggggaacgtctggaggggacccagtgccacaagggtacctttttttttttaacggtcatttcctctctggtgtaacttgcatgacagtatgtgacaagcagaaattaatggggacactgctggccaattcct

SEQ ID NO: 46956 - DNA, 1432 bp, Bovine  19866880950042
atctggctatgaagtatatgtgtggttgttggtggtgctcactccatctgatttaacttaattatagtgtttaaagtttactttagatttagagagaagtaccaaagattgtggagcccatcgattgctgaaatgcagtagagtggcatggtgaaccagctaggcattaaaaatttaagtggtaatgtacaaagtggctaattgtgagtcaactctgcattatagtacttgggttacacacacatttatagttaatttctttgaagaaagtgttgtttcattttaaaacttgaaagaaaataatagaatagaatttttattagccttttcttagtatttatatacattcttgtcctgaaatttatttccagcttgtttatgtgtggtgtgtttaattctttatatgtttggtgagcatctcatgtcctcccctgcccccccccccccacaatgatgtcctttgactgttgaaactaaaggaggatcagtcctttggcttgaaaattcttttgattactgaaggctttgtttttaaaacaaatttggaattagttgtaggattttatgggataaattgaattctcccatcaaaacataattataaagtttgtcagtctgcctttatcatcttagggcagaattagtttgccaatgcaatgtctgcatccccctcaaaaaaaatgaaaaattcacaatttttattagcatgatatttggagttttaaaacaaagaattcatgccctttccagggagatgactggattgaccaggatgagaacactttcttagaaataaaccagatttttccgtattccattttaattactttcatagacatgatttgaagaccttaaattccaggaaaatctaaattgcagagtccagtgtccttaaagtatgcttagtctctgtctcttcaataattcttgacctatgagctaagaaccgtgttttttatggaggctgcagtttttgaaactctgtccagcagcatgttctccctaagaccttaggtaaggactctgcaagcagaccttctcgcgcggctttcctttcgccgtggtcacttttgtcaccagggaaccaagtgctcctctcctgagctttcacgttaaagggtcagacccaggtggcgttagtgatacggaatctgcctactgacgcaggagacacaagagacgtgggttcagtcactgggttgggaagattgcccggagtaggggatggctgcctactccagtattcttgcctggataatcccaagggcagaggggcctggcaggtgacagtccatggggtcccaaagagcaggacgcaactgagggactgagcactaacaggtatccttccatattatcacaaggaacgatccaatctagtctttccctccgccttaattttgtgatcaaaggatatgtgtcagacttactt

SEQ ID NO: 46957 - DNA, 1508 bp, Bovine  19866881033853
cagagaatgaggacaatacagcgcaaaggcacagaaagccatccgaaggggctcctcctggccggacctggggcaacctgagcttcaaaacaactatttgatgatttttttaaaaaagtaaaaaatctgaaatcgcaatataattcttgacacctcaattcaaaggatacccttccacacaccaactatattttgccaacagtaaggtaaagtgaaagaaacacaccaaattcttcatgtaagtacaaattctctacaaagccagtaccccaattatggtacacttgactaaaggcaaacttctataaagttaaactcaagattttcaaaaataaaatttatttttaaggttgaagctgacactggactgctcgcatcgctgtaagacgccacagtaacagcctcctccgatactcacttggagcccgccggtcagcagtctcccgtgcagggcctccaactgggcgccgtaaaggagcgctttcagatcagcgcccgtgaaggagtcggtcagcgaggccacgtgctgaaggtccacatcgtctgccaggggtagagactcactgagcacgtttaagatttcaagacgtgacgcctgaagggagaaaaactcaccgacttaacaaataccattgaacacaatattttcaactgtgcatcttacaagattttccttatacattcacttcatgtatctaatcagttttacagatcagttgagcaatgtaccgccaggctacatctatcctccttggtccttttgtcgaacagaaggaacacagggaggaaaatgagtgaaaatcaacattctcaactattcagtgtagatcattgcttagtgcttatcttctagatttgggcaaaggagccaagaaatgtttcaaaaagaaaattaaaataatcgctacatgtgatatacatttatacctgtgactattgatctgtctatttcttctttcacttatccattcgtttctaaatttgagaacacaggactagagtggttaaaaggcatatctctacataaccagcatggatgcttcctacactactatgcttgattctgtatcagtcttctgttaagataatgagctgtgtgatctctgaacacagggaacacggacagcaatacttggtttccctcccttttttccatctggctaacacaaagttttcagatgggagtttgcatgggatgcctgggccaaagaaaggctttgcatctaattcagaatcttttcacgctgtaagaaaacagtgactagggcctgtgccgaaaactggtcttctaaggacaactgctgttacctggcagaagtaaagctcacaagcaaagagtggagcgtttgtaggtatatgaaactgtcacctggtcaggaggaggacagtatacacatttatctagtcggccgggcctgagcagggcagggtcgatcaagtcagggcgactagtagcagccagcacataaacacctgggggggaaagaaaacacttactaaccctgggg

SEQ ID NO: 46958 - DNA, 817 bp, Bovine  19866881171493
aatcgaaggacgcacgtgtgagataactgcctagggctggagctgcaggcttctgacggggagtaattttcttccatgaaagccacaggtaaattccaaaccttggtctgcatttttgctgttgtttagactctcagttgtatccatggtctgaacacttctttggccattccctatagtggccaagaaagcatatgccattcacagtcatttatgatttggggttttatttccatataaaaacgaggtaatttttaaggatttaaaagtcctttggatcgtgttagggtagtaatttatccctgccagaattagtttactggaattcttaagtaaataaccgtgaagaggagatggaggtgaaaaccgtggttgtagaaaatctgggagagaagagaagcaatcctatgtaacactgcttgccttaagaagagagagagaaaaaaaattgcaccagagctttctccatttgagcagtcggttttgttccctgactaggctccccacatatctaagtgcactgagtacattcccaactccgactgccaagttaaaatgaaaacgttctcagtctagaaatgattgaggtggttttctttaatcaaattagagcggccaaatgttcctttcaaaggtaactgtctactctgcagctgtatgcaaactaccacatcaaatgagagagggggaaaaaaaaatagcgatagaattgtgtccttacagtacagtgctggaggcaagggtggagaaacaaaagcctgagtacagcgaagaattacactcacagtgagcttccagaaatatgcgacttcacaaa

SEQ ID NO: 46959 - DNA, 1737 bp, Bovine  19866881258724
tttttcaggggatcttcccggcccagaaatcgaacctgagtctcctgcattgcaggcagattctttaccatctgagtcatcagggaagctataaatgatggctatttattactaatataaatatgatttctgttacagaaatattaggttaaatgattttgaaggtctttgctttgctaatgctaagatataattcttacgacgtgtactcagtcactctgtcgtgtccgaccctttgttaccccatgaactgtagccttagaggctcctctgtccatggaattctccaggcaagaatactggagtggttgccatttcctcctcctctgactacatgttggtgtgtaatcagaatgtgccccctttcaagttctaagatgatgaatgatttataagtattctttgggccatctgccactaaatgctgcccttgtatcttgggttggtcttaatgcagcagttttgatcattagataaataagcatttgaaaatccattcattaaaaatgtagaagaacttgcaaagcattggggtaaacaactgttcctgtcctcaagcaagcccaatttttaaaatataaatagctgttactattcaccattagtttcaatctctatataactatcaaagagcaattgctttaccattagtgataatctgtgctcagagctgaattcagttgtcttatgcataggaacactctagttattctcctaaaatggtttactaacttactctgtaagtttctgtgtgtcagacctaagtatctcttggtcttagagtctgcctctgctcccttctgcccaaataaggcatgtggctgccaaaccttttatggggttaagtattaatatggactgaattgagttagtctcatttggtggctaaaataactgacttaattctacagttttcttgagcctttttgatagcagttaatttaacataaaataagatttaaaatgtggattctttcccttcctctcataactcttttatgctttatcaggagataatatttggtaggaaatggctccttatagccttcctctgggaaggatagttttaaagtgtttagtttgaaaatgtctggaaaccacgcagttatatctggcttagagaaacccctttcctttattttcatggctcacctgttttaagcatgcatcctgtagagcttaatccagcagtcttcattctctcttgacaaataaacatctatatgaacagtatttttctctctccctttgataattttgatatcaaagatcacaaacttagaagagcagttagaacagttcagagaagaactggaaaataagaatgaagaagtccagcagctacatatgcagttagaaatacagaaaaaggaatctactacccgcctacaagaacttgaacaagaaaacacattatttaaggtaattgttcaaggaaaactttgcctctaaatagttcattggtttttgtcttgtatagtcataagtattaagcatttgctaaatccagctgctacataatgcttaacagaggaataatagctgcaaatggatttgcatagagtttatgttcaacccaacatatgaaaaattttggagacctgtatcaaaacattttaaaatttattgatttacaataattatatagtagctttgaacatttttggggtgctgtagcttggtaagagttaattgacagaatggtctaaagatcacatgtaatgctctatccactgg

SEQ ID NO: 46960 - DNA, 1352 bp, Bovine  19866881274274
agtctccctgtagtgatggagaagaccattctgctcagcagacatcagagtcttggctggaagagagaagagcttacctcagtacaatctcatctcttaaggatttaattaccaaaatgcaagttcaaagagaagccaaggtactcaaagactattgtgcatctaagtagctttatatgatttttatcaataataaggcactttgtttgccaaattaactgttgtcttttatgatgtttttcacataaatttctatgtattgtttaaatgctccaagttgcacacttgaaagtaaatttgtatcctcttagacttgcaatgctgattctggttagcagacagataccttgaacagatacctagaacagttcttagcttatttgaaagctaacttttgttttttgtactctgccaggtttatgatagttctcaacctcatgagagcacctctgactggcgaggtgaacttctgcttgctgttcagcaggttttcttaaaggagcgcagtgttttcctagccgcatttcagaccgagctgacagctctaggtataggagatgcggttggattattaaactgtctggaacagagaatacaagaacaggtatcaaaatgagactgtaagaaaaactttaaaacaaagaatgctttttaatagtaatgagaaaatgagttatttattagttgtttattagaaatatttatagttatttatataaaatgagttatttattagttttagagtaaatcttaaggttaaaattttaacaggagccactaagaatatttaggataaaaagtattactacagatattttctcttatgttagaaaataagcaggactaaaaattaatgagttaatcatccaatttgggaagttagaaaaagagtaacaaaataagtctaaagaaaacagaaagaataaaataccctcagttctcttcatttgcagcagtaagactggtaaagctgttgtgaataccgagccattgccagcagggaaagcctgtgagtccctggcggtgacatttttgtcaagcagtcaatgtgtaatcttgttttatgtgcatttctgtttaaagacaccctgttgattatgtattgttgaatctttaacattgaactcatggccagctgcactgtaacttaaaacttttctaacacatgcatcttctctgtcatgtgtctttcagccctgttgtgcttaggcatactggacagtacttcatgtctgtgtttgggaaccattttaaacagcaaaatcatcagtaaaaagcacaaatgtacccaaaatatggcactaaaaggatgacagaaaggacacttgtttacagcataagaaataaaaaga

SEQ ID NO: 46961 - DNA, 955 bp, Bovine  19866881278418
ttaagtactgctgatctaaacagaggactgcattttcttcgaatgtggaatctaagctatttattccatttgtgttaatctctccagctcttctgtttgtcagcgtaaaggggaaaagctatccaattaaatatagaagaaattccctgtcaggttaaaatcagaaatgaagctataccattcaagggaactccttcacatttaatcctaatgtcagtggtttataattagttggaattaagtggatcaagtctctgtaaagcatactccactagcataccatctgtacctgcaagtcactagagccccgagatgtgcagttcatactaagtgtacttgttcaggccagtcacttgaggtctgaggtgtctgacttgaaacatcggaaccatcccccttgctggcggcctcattaccactgtcgccagcttgagatgctgcttccccagccagaatatttccctccaaagcattttcttctcctctttgggttcctctaccttcactgatcgcagcatctccaaacactgaatcttctggaggcatcagttccacatccctcacaccttctgactcgtctttgacacaggggagctgagaatctgcactgacttctgtagctgctggaggaatcagagcaatactttgagggttcatgtcatgaaaccaagccatgatattgccaagaagattgtcattgatgttggcgtcctggctggctgagtcagggtcactggatgaggggaagaattcacttctcgcctcactgggagggtgggaactcagggtgtcagttgaaaatgggtctctttctgctcctagtctcatgaggctgtcaccaagttccaatagctcagagctgctcaatgcagctcgagggctatctgtgttcctgggggacggagtccagtctggaaggtaaagaggtgcctattgcccctaaggatgcttcatt

SEQ ID NO: 46962 - DNA, 1204 bp, Bovine  19866881311773
aaatctacaaaccaaatacctaatgagaatagaacagtcagtgggaaaatggacaggtgttaaagtatgtgctcatgaaagaaataaaagagtatccaataaatatatgaaaagatgctcaaataaaatgtgctatattattcatagcaggcaatactacatgacactgaaatgagtgtgaagtagagccaggatggttcaccaatgtatccagtgaaaaaagcaaacatgaatacagtatgatgccatttatatgaagttttgaaacacgtaaaacagaactgtgtatattttaggggtgtgtgtgtatgtagtgtattacacagagtgcatgagagtagcaccagacttagaacctagttgtttcttgagcagatggtgcagaggaccgtgtgttcacggagttgtgcccgagggacttcagctgtgtaggggctatttcttgggctaagtacatgcgtgttcattatattactcattatattttatcgtgtgtttaaagatttttgaaataaatgcaaagactaataatctgtaaagtaaatcctaatgatcaggaagagaaaattagtaacttttcccaaaattttagcatgtcatacttcttcagacttcctggtttgttattgtctttacaaccctcttgactttttcttttacagggtattgaatatcaagcagctatggaatgcctccaaaaagcagacagaaggagtttgttagctgaaattcaagcactgcattctcaaatgagtattaagaaaacgactctgaaaagagagcaagaaattgatcagccaagccaaggtatgctataggacaggctcatatggtgacataaatgggtgaaagaaactgtttcattttgtttctcttgttattattcagttaaaacacatttcttctttgtcacattttttcctcattctcctatcagtatgttaatctgcattaattactctagggattaaagaggtctccagtttgttttaagatatatgtataaaagatatatacacacacatgtataatactaaaaatattttttagaattgaaatatatttgtttacatagggttttctagccaggcaaaaactcatactcagctttgggaatgagataaaaaatgctcagttatgctatgccatctaagcttattgctccatcttaaaaaaaaaaaaaaaaaaagcgatagttcttgaa

SEQ ID NO: 46963 - DNA, 1331 bp, Bovine  19866881367273
cttttattactcatctaataaataaatgctaacgctttttattgattacgtgtttctacttatttacctattctttactaaagtagtaaatttatagcttatttccatattgctagacatataaagatagccctgagttttcataattatagaaaatactgcagggatatgttctggtgtggttttttctttgactcattaatcctaaataagtcaaaggctatctcagtgtactggctccctgctgctgttgccgctgtgaactctggagtggctgaatcagtttatcctgccattaaggacatacaggtattggtttcacccatagtatcgtcacattaggaactggaaatgattacagctttaaatgctgtgatgaaggtggtcacagagagctatcagctatctatagaactctttttgtacatgtgcattgcagttgtagtttatcttttctgtgaatccagagaagcgtataaaaactttcaaaacctttctcccccatttcttatttcttgaataaatagaatcaagctatagaagtagcctggggtcaccagcctgcattcttgagctgggtggaaggcagacattttagtgatgaaggtgaaaatgtggctgaaattaacagacaagttggtcagaaacttggactctcaaatggggcacaggtaagcacaaactgtaatgacagtgactttttaaaatgttatatagcaaaagaagtaaaagttcagatgtaggtcttagggaggtaagatgacacctaacttgtgagctactgcaaccagcataagatatccaagttatgcatactacctgtcacgtgctctgttaagtcagcatctaatagtctcccatgctcactagctgattttctagtctaccttttattgtactcagtttccaggttcctgaatttgttcagttattctttatgaattattcagttttacttactatgcttaaattgtaaactccaaagcttaaggactcatgtctgtctctactttatcatattcaccagtttatgtttttaaatattttaaactgcagaagtaacacatattcagtacaaatattttacaatcgaaagtaaaaaatgtttttccctttctctaaccccagcctcggaatgagtgtgtactgtggggtctcactagaccgttaggagttaaagaaggagatcatacatattttctgcaattttccccccacaaactgtatcagagatcctttccatatgttaagataatatgcattgagcatctctgtatatgtagaaagaaaaactttttttcggtgggggggccacagggagcacggggacc

SEQ ID NO: 46964 - DNA, 1090 bp, Bovine  19866881396537
aatttcaatattaaatagcagattaatccagttagctactcatatgacatcagtgcttccctaaagaaaaccaccacgatatttggtgatctacttcctacaatgtaaaggcaatattacaccattgtgccaactcataaaaatatagcatgttcttaataaatcaaacaactaataccagagactgtcccttagtctatgcgtccatgtgtgtatgtgtttgtgtgccaggaagtttgtataatttacttaactttaataatacaaattcatttctgggtctggaattgcatcaacagaaaacaaactaaaacttaagaaaaaattcacaggccctgctattttgaagacagtgaatgaacctgtctagaatgagtccctgaaatccttgtttttaagaggtactcagataattatgatgcaggagtttcaataactataatagtttgagatatactagcttattttaactaagtatcttaacatgtgaaaaatgttcaaagattacaaaaacacattttaagtaatagtgttatatatgctttaagtagaaaacattttctttattcagatgttgactttctgtatattttgaaatgacacacacataaagatatagcaaaccctgtatttttaatttcatcatattcccctctaaattctttatcatttaccaaaaataacttttttaaagcttactgttttgtctaatgttatacagactatcaatctacacatttttgtgtgtttctcttaaaaattaacttataaggatattatataaaactaattggtatatcacacaccaaacatgagtacagattctgtacaatgtaatagtatatatatatattacaagagactaaatgccttgttaaaagtaaggttaagaaatctttcatggaaaaaatctacatcacaaaatgtggtggcttgagtatcagctggtttcctctcacgaatttctttccatgggcattaactgtccatttagcttcatcagcagttttaccacaaggccggcctacaaaggaaaatacatgtcaacaataaatttgaaacatataaaaatgtgtaaatgacatacacg

SEQ ID NO: 46965 - DNA, 920 bp, Bovine  19866881425843
aacagagaaaaactggctctccagaaatccttgaagagggcagaagctgaagtgtacaaactcaaagccgagctgaggaacgaagctctacttcagaatctgagccctgattccgagcatgctgctataaaggtaggagacatcctccagctaacatacaacagagtcggtcctctgctcttgccttatttcatctctcactaaccctaatggtcggactaaagaatttgaggtcacactgaggtggtttctccgggtgtctcagtctgtcatgaatgaggtctctagctagtcacaaaaaaactgtggtaaagcatgccgggattgggaccaggttaagctcacagaggtcacagaagcagccccctgagctcatggtccccattcctacagtctcatccctaataaaccaacagaaagttagcttttcaattccgtatagaagctctgctactgtcaatattagaggatcatgctctgtaatggtaagccctctaaatagcgtctcttatgacttataatgaatactgtattaatagtacaactaccttaagcagttaacttaaaatccaaaaaaagaaaacgtttgtaatatttattccaactatggcatgaatgtaagtttatgactcttaaagagatagaaaatattaacattgaaaaagttaaatgtgatgataataataaaagtagctctgtactattatactctatactgtaaaagctttatactatttttggctaagacaaaaatatttgcgttaactatgattaataggagctaaaattcattgactaaatggaagtggaagtatcaaggtctagctttacttttcactttgctggtaaaatagaaaacagcgatgaggtaccagccgttctactcctgctactaaaaataaagtctagattatcttccc

SEQ ID NO: 46966 - DNA, 629 bp, Bovine  19866881533805
ctttgtgaccctatggactacagcttgccagtctcctctgtccatgggattctccaggcaagaacactggagtgggttgccgtttcctccttcagtacattagtgataacgggtagaaaatgcgctttgaatcaacagttataaatactaatcttaggaattttagaacataatattttggatgctttctcatctacaatgactctatctggaatcagcccaaagcaaatagtaatcactttggtgagcaataaagagaagatagatgctttaatataacagatcagactcacataaagcaactgagctaaacaagaactgaaatccctggtatttggcaggaggttaacaatctgtaatatatttatataaatcaataaggaatgtggccaggctgcctagagcccctaacacttgcaaaacaaaagggccagacaggtctgaacacttgaacatacagcctgggaaacaacttcagctgtctgatttcttgtgttgatcaacatctcaaggctttctaaacctttaaaaaaaaaatctctttgctattcagtaaactgacaaaaataccatttcagcgattgcataactacagggctgtaagagaaatataatcacactgtgtcgaa

SEQ ID NO: 46967 - DNA, 722 bp, Bovine  19866880233796
agttggtaatggacagggaggcctggcgtgctgcgattcattgggttgcaaagagtcggacacgactgagcgactgaactgaactgatgcatagtttaaacactgtggataagagaaaaaaaagaagggagaaaaggagggaggaaagaaaaggaaagaaatgtccttagctttcaaaagttagcagcctaactagaaacacacacacagtttatttgctatggcagaaaccatcttggcaaataaattaactttattgtgtctcagttttctctctgtgtaatgaggaagttgaataagatgattgctgagattctttaccgctctaacatcctataggccattcaacatttactgagcaattgttgcatgtgaaatggaaagtattttcctagaagaaacaatatatacagcctgagtaaaactctttgggctttaaagtgattataatttactggccaaatgcaaacaactaactgtactagaagatggcatgaataaaggtgctggggacacaagaggaagacttgatacaaattcaggacagaaggggatggaacaatgagagaccagacaagctgctttatggacagcagagagatgaggctaccctagtatgaagggtaaagtgtgttaaaggaaacagcaagaacagtagggaaggaaactcagaaaatactggctattttaaaaggtcagtaacaagctaatcaagctcggtt

SEQ ID NO: 46968 - DNA, 815 bp, Bovine  19866880512460
cccctttctgctttgctaacataagtttgtttcctatatcagtgagtctatttatgttttgtaaataagtttatttgtatcattttttaagatctgctatgaatgattcatacgatatttatccttctttgtctgaattacttattatggcaatttctaggttcatccatgttactgcaaatgtcattaatttttatgactgcataatatgtatatcacatcttccttatccatccgtcaataaacatttagtttgttgattgtctgggctattgtaaatagtgctactgtgaacactggggtacatgtatctttttgaattcaagttttcaccttttattatatatatatattgcccaagaaccagatcgctggatattatggtaacttagttttttaaggaacctccatactgttctctatagtggctgcaccaatttatattcccaccaacagtgtaggaaggttctcttttctccatcatctctagcatttattatttacaggtttttttgatgatggccattctgactgatgtgaggtgatacatcattgtagttttgatttgcatttctctaataattagcaatgttgagcatcttttcatgtgcctgttgggccatctgtatattttctttagacaaatgtctatttaggtcttctgtccttttgttgatttttttttttttatatggagttgtatgagctgtttttgtaaatatatatatacatatatgtatatatatatatatttatggatatattagagtttacaggacaggacatcttttattaaattttcacataaaaagaaa

SEQ ID NO: 46969 - DNA, 1384 bp, Bovine  19866880620940
gtaataaataatactgaccaattctacttacacatataggaaatatatacacaaaatatatagttatacaatgagaaatgtaaatagaatttttactaaaataactttctataaactcatatataaaataccacgtaagatatctactattattgatcttttaaaagattccactgattacacaaaccattcaatttccattgtcatgggtattgccatgtactcagaactcactattgtttcaaaagtcaaactggccatataagcatatatgtgattattttactgaaactggtgacaggatgagaaggttctagacaggaggcaaggccctgaagacttaagacatggcaggccactgagaagaaaagtaaagctcaccactgtttggaaattcagtctgagatcctatgttgtttcttaaaaccagctgagaaaagaggtttgaaaatgtcactgcttttgagttaggtccagcttagaggttaaaaagaaaaagaaaatgtggcattttttaaaaacaaagtattggaggatgaaaagtgtgacttcttgctaacaagatatagttcctgtagctaaactgtccagaccagggttaatacaggcacagttcactggtttgttaatagagcaaaagtctggtatcatttgctcaccactctgaagaattctggtctaattaagtgcatcatgcttggccttcaaaggtaattttcttaataaattctttattttaaggtgatcctaatttgagagtgaatacagggttacctagttactttaacaactgtaatgggactaggggagttgtggagaggcctggagcacataaggagactgtctagtggatggggaggagggaacagaccccagatgggcctctggagtgagctctccacaccccaccattttgtttatgtttaccagcaaagacagagctgaatctctgaggaccacacaaaatgtggacacttcaagaatttctgtgccatctttgggcaagggccatggtaatcttttcagtatcattccaattttggtatatgtgctgttgaagtgagcacaaacataaatcttttgacatgaaaaaatattgagaaatagaaaatgtagtctttagttaaatctttattcttttagtcagctaatatagccatattaacaatgataggaataatatgaaatagcaactaaccttcctctgaattaacatgggcagcgaggtgaaaagggaacaggtgtaaagcaatgagaagggacccctcatcctagcagttcaattcccagggcaccctcccatcttcaactcagagaaggagacaggaatggacaaatagccataggcacacagtttacgaagatagtaaacatggaaaaaaag

SEQ ID NO: 46970 - DNA, 894 bp, Bovine  19866880663748
acactagccgagctcgtccccaccctacaacaccattctggatgagcattgttatttaattaaggtctctccaccttgatctaagtaacacaagtttgtctgctgtctgtatgaagttctgagagcaaaacagttggaggtactgtcatattcatgatttcactttcttgagctaacttgtcagatctcttgagacctctccctgtctgcctaaatccatgaaattcttctttaacaatcagatggcagccattcaaggaaagaatgaaagtctagaaaaagtgtcctccttgactgctcagcttgaatccaccaaagagatgctccgcaaagtggtggaagagttgacagccaagaagatgaccctggagagttcggagaggaccgtgtcggacctgacagcttccctccaggaaaaggagcgagccatcgaggccaccaacgcagaaatcacgaagctgcgctcccgggtggacttgaagttgcaggagctgcagcacctgaagaatgaaggggatcacctccgaaacgtgcagacagagtgtgaggccctcaggctgcagatggcagagaaggacaaagtgattgagatcctgcgacagcagattgagaacatgacgcagttggtgggccagcacgggcggacggccggtgctatgcaagtggagaaagctcagctggagaaggagatcaatgataggaggctggagctcaggaagttaaggtctgtagagtgtcttggtggtttagcttctgaaatatctttttttctcccataagtctgacctaattgaccagaagtaggttctgtaaagatagttatagacactccaaaattgtttgcaagtgtttttgtcagtgtgcatgtgtgcttttgtgaagaaagtttccaca

SEQ ID NO: 46971 - DNA, 786 bp, Bovine  19866880700287
tgctcagtcgtgtccgactccttgcaacaccatggactgcagcacgcgaggcctccctgtccatcaccaactcccagagctagatacttgtcataaaaagaataatatagacaaagctaaaacaaaataccaaatgtgagtgttgaaaatcattaatttttagaataattcattattaggcaaaatctgtatcaaataactatcaccacattctttctataggattgaacagttaataagtgaacatgaagctgaaataacaggactcaccgagaaagctagcagtgctcggagccaagccaacagtatccagagtcaattggaaatcattcagtatgtgtgtcctggtggtttgaagttgatagctatttatcttcattttattttttgatttttgttctaagatctttttttaaaatgcttaatagttgattctacaagaaggtgaaacttttgtaacattcaagtaaatggaaaagattatttaacatatggataatactttataaccatatcaaaagtattatggcaagtatttgggcctcttggggtttggatgttttaatttttgtctacatttcaactgattggataaaacaaacacacactatatatctctgtgtgtgtgtgtgtgtgtgtgtgtgtgtagatgggcttcccaggtggctcaatagtaaagaatccacctgccaatgcaggagacacaggaaacatggggtttgatccctgggtcaggaagatccactggggggaggaaatggcaagccattccagtattcttgcctg

SEQ ID NO: 46972 - DNA, 1819 bp, Bovine  19866880727966
acatttgtattaggttttgactcttaaaagatttggtttggggaagtcttgcaagttattatataatattcctttgttaaatttgcatttgagtagaatataccttccgagtgatatgaaattggagtggatttttattttgagtggaatacgtcttccaaattattaaatatctcttcaaaatataagttcaacagtcaggcccgttttcctggaattcttggactcctgcagtcatttttttcccccatttttcctgcatctttcattggaatttcatttgattgtctttgtctttcctgagagaaacaaatcttatacgaacagcagcaacctgtcttgtttttgaatctgtataataataataatgtctttctttaataaactgagcagattaggatacatttctgtaagataatgtaattatagtaagaatccccagttctttactggattttttgagaaatgaccagagcagtttaatgtattttcaggtagcactgacttctaaaatgtaggctagacatctttgcactaaaaaagataattttgaagattttgtatctatatagatcatttgaagctcattgaaaattctgcaaaacacaaactataatatgtgtgtctatatatatatatgaaaaaattttaagtaggtctctgtaccttgcatacaatgaccctatagaaaagtcttgttcttcagctgctcgtatatgaatttattgttcatattctctaacatatgccacttatgcccatgccaattatatgcatttggtaatcatgatttattccctaagacctatttggaagtctggcattttgtgcagtcacttgttactgcaatgtgaatatgaccttggcatttgatttgaaaacatttttgaagaatacttgagtattccaaagattaaacaatcagttatcattaaggtatatttaaagtgatcacatatcactgttgtttggtatgtttacttttccttctttgcttaaaattggcactgggtaaaacagaaacattattctgaaatttgtgtttccaaacaaacccacccagcttgtaactcaacaacaataaataaaccagttggtatttgcttgatttcatgttcatttggagttgtcactgttaagttttgagttgtgataactgttttaactacttctacgtacgttcattaacttagtcttcagcaaaggattgattgaaattcttgtttactttttaaattttatatcctggcagatccattattattaataagtatttttcatattgtggagcatgttaagataccagtgcttttatcgtatagccaattcagactatatcttagtttttctgtgacacttagaagtaatgaaaaagattaggaacaatatttagtattttaggtgatttttatcaaaatgtttgcagtttgcagtaccacagtagaatctgcaaataaatagagtatttggttgtacctggatgcaacatgtagtctactcttgaataattttcccagtcagaatcatatgatgactatcatgggctgtgagttttttcctttttgtatctcttatattacagtattaatgaatctctgtctcttatgccagaaatatatgagattgaaaattagaatcccagaaagtctgtagtataactcagagaggactaatggttcaaacatctgtcttaaaagtcttttttggcaatctcattggtaatcaaattctgacagtaaggggagaaaaagcaattttagattggctagcattccactccactcatatgtcaagttgcatcggtaaagattaattttgt

SEQ ID NO: 46973 - DNA, 2659 bp, Bovine  19866880783101
tcccgttgaccctttgcctgaaaggagaaatagcctgaggagaatgtgtcaccaattaatggtcagcagctgatggcttagcttagaagccagagacttggaaggatcatgaatgcagggctggtgacaaggaggtttgggagaagaggtatatgggggattgcacagaatggatcagagtatgaggggatttggttctttgggaatatgcacccaaaagactccactatagaggaagcactaaataatcaagggaaaagtttaacctagcctctgcatgccagcccccttctttctccaggagcaccaaggttgcccagagatgtcataagcaaagtgggcatggaggcagaaatgcagactccggatgaaatatcttaaattccgttcagtaaggttgatctagctacagcttctgcagaatagttgtctggcaattaaaaccaaatttgagtccctggtataaatcaggcttgaatgtaacaaagccaagaacaatgtgtccagggaaataagtgaattctctccagaccacccccaacacctcctccactcaacacttgaaagtcagaattatgggactgaatgccaaaatcctgccccagcttgcctagtacaactggaagcctccttctctatgcttgcaggctgagcagctctcccttcatggctcccatgggctacgatgcaggaatgtataatgagctgaaacatcaagggagtctgggaaaagtggccttgctagaaaagcaactaattctggagttggatttgctttcctgcttaacaaacttctgcccacaccaacattcacagacttcctgaatgcttattcaccactgtgggatcccactcaacactgaaactcatttcacagcaataggctgacactatgggctcactgcttctctcatatactccatcaccctaacacgtctggacacataaagactcatttacagctacattattgaaatgggaccatgacagtcccagaggatgaaaggtcatccatcagccagagattttggatttgaagacatatatagtaactgataaaactttgggaaccaatatcctttttgcatttttattttttgactgcaccatgtggcttgcaggagatcccaaaccggggatcgaactcaagccccctgtattggaagtgtggagtcaatcaccactaaaccaccagggaactccccaatagccttttaataaaccccttttgattaaattatctagagagaaagatctagaaagatgcattccaatgactaaagagtggttattgcacactctacagaaattctttgtattttttaatgttcttttcgctaatctatatttcctaattttccctaacataagcattaacatttttaataaaaatatttttaaaatttaatcttaataatgttatcttgagtttccattaaactttatgatccatgaccttatgagtacacatttattatcaagactaacatgccaaaaaatggggaaaaatcctcagtaagctgaattcaagtgaaagaagattatattgtaaagaaaaagtaaaggagatattcactgaaagccgggaaaataatactctggaaaaatgcaagaaagtaattcggctttcttaaggttttatttatttttacaaatagttgataataactctgtaatattgacaatgctacaaaaatgttagaacaccaaatatgaatactgatctcatagttgataagatatataaaatattgattaactgaagcagaagaccattctgaaatgtttacaagtattagttataaattttatggatgctgccaagtcaaagttgtacatttgtggggggacattcatcatacattttgtttaatgtttaacaagagagaaatagctaagtaaatgaaaactgtctaatcatcttcccaagattcatctatgcttgagttattttataggactgtctctggttacactcacgtttacattccttcttcatatacatcttctcaaggaactaaaaaaagaaaaaagaccagagaagctaaaattggcaaatgaaaattgtacagtctgctcagaaccaataccatacctgaattcacaatctcatactccactgtatatccttatagtactcaacatctgatgttgatgactagaccatgctagatggtggactttggaaggtagttgcatatcatcagaaatgccgagattaattcacactcattttatggctaagtccagctcagcccagctcagcacagccttgtactgctcatctctgctattaaaggcctggacctctgtgtagctgagggaatgaagctgtcagtaatgcacagagcagttaatccagaagcagatactggaatgtgtatgtacctatgttcatgtaacatatatgaatgtgtatatacacagaaattaggggagtgaaaagagaataaatgctcacatataaatttaagcaatgactaaaggactatatatatatataatttacaataatagagttcctcctctcttttagttgaaatcttatggataaaatcaaggatataagatataagaaagggagaaaatattccagggttttgacatgcaggtgttcgcatgggactcagctatagccaggggcatcatctctcttcag

SEQ ID NO: 46974 - DNA, 1003 bp, Bovine  19866881145817
tactgtgaaaatatagatgagaggatacaaaaatatgagtttacaagttgctctttgcaattaataaatcactcctaaatagctaagtggtggggatgttgaaattctatctaacgttgagatttgatgacccactcagcatgacttgttagcaagttaccctctatagtaccaaagttcttcctgacccaggaatcaaaccggggtctcctgcattgcaggcagattctttaccagctgagctaccagggaagcccgtagctaccagggaagcttgtaaatgtgtttcccacacatttacaactaattcaaacatccaagtgcttcataaaatcaaatctgatgaccaatatttttactcaagcacagtcatacaactcaaaatggggaaagtgtggcagctagctcaagcttgatagaacattagagctggcacaaactttgaaagaaatctagtctaacttcctcacttctcaacggggaaacgaagttccaaagaggtgaataagggaaccagtctggctggaggacttgcctcactttgcctctcatagctgataaacttgcctctctgcattctgttaagttcatgaaaatttttgcttaacccagaaaataacgcaagaacatttttctaagcatttactattttcacagtcactatatgatactcggatatttccatctttaagaactgcaaaagagtattgggcatttatcctaaagaaacgaaaacttatcttcacaacaaagtctgtacacaaatgcttataacggctttatacgtaataactaaaaaccagaaacaaactgaatgtccttcaacaggggaatggaaaaacgatggataaacatctgtgccatgaaatatgactcagcagtaaaaatgaaccattgatgtacgcaacatctgggatgggtctcaagggcttctgcttaatgccaaggaacaaatctcaaaaggtttaatatctttataaaagtattattctatttatctaac

SEQ ID NO: 46975 - DNA, 3331 bp, Bovine  19866881406138
aaaaccaaggttgcaaactggcaacacagtctgctgatacgatgtttatcacactgtcttaaaaatatttgaattagttgcaaaaaattagttgaattcgggtttaaaattatgtaaatttcacatttaaaaaatctaaatttttctatttctcttggggaaaatgggaacataaaacactactcaactaccattctcctgtagcagtcatctgttggaatttaggaactgctgccttttaaaaaaactgtccacattgatcagttccaccaatcagtaaacacctagcctatttcattaatattaacagcctgtgtcttgtagacatttgaatttgcaacccctgctctaaaagtacatagtcattttagtgtacacaaacactgactaaataggcttattaacatgttttcttagccataacttaatcacctctttagttgaaaggtatatattgcattgtggcaaatacttacataatttggaaaagaaattacctcgtatgtattcaaaaattcttcatttctattttatttatgcttttttaattaggtgggtttggaggatttgggacaacgtctaccacagcgagttctgcattcagcttttctactccagctaacacaggcactactggtaagaagatatcttatatcatttgtagaagaaaatgagctacagatcagatatcttttttaacttaaaattgctaatttttcattcaaaggattctttggtagtactcagaacaaaggttttggatttgggactggttttggcacgacaactggaactagtactggcttaggtactggtctggggaccggacttggatttggaggatttaatacgcagcagcagcaacagcagcaacagactagtaagtacaagaggttttcattttcagatatgaaaccataacaacgtagataatattatttagtcactgttcaaaacatttgagtagataccttttttgggggaggagttataaatatcatattccataggattccaaaagctacttctcatgttcaaatataatgatagcaactggggaaaagacagattggcatgattataagacctctgtgtttagtgtcattctattaaagtttttgttgttcgtaaacatgacacaggtatgtaaagctgtacagaaatacagcttcacggattgtttataagatgaatgccctttgtaaccactgcccatgtcaggaggtggaccctaaccagccacttcagaaaccctccacattctcctagtcgtttccccatcagaggaaatagttttgctttttatgttgatcacttccttacttttctttatggttttgttactcaagtgtgtgaacagtattgttcactttgatttgtcttaaatctctgtaagtccccctttttagttttcttttttatttttcaatttgttgatgaaatcagatcatttgtcctatagaagttgacagtcaggactttatgattgcattccttttgtatagttaacatacctttgtcctctgtatttcttgtaaattgggttggatgtaaggggttatttatattgatcattaagttttttgtttgcaagcctactttataaatagtgttatattttttttatcaagaggcatataatgtctgattgtctctattttttgtgatgttaccagtggccattggtgatgattaccaagatccattaattcattaggggttgccaaatggcattccaactgtgtgcttccttttccctctatttgttgaaatacttctgtaaagagaaacttctcctcatctactatttgaataagtatttccctttattcctaactttcaaaataaagatttggttccctattcttctccaaaggtaaccttttttttaaatatcaggaactgaagtatttaaattatttgatatttttaagtccattgctattttccatattgatatttaaattgttccatctttagccagtgtaagcctcttcaggttggttcccaagtcatgttggtacatgtgtagaattagtctttgataacttccttactagctggtgtggcagtatgttccagggttatcttgtatgtatgtatgtatgcttatatgcttagtcactcagttgtgtctgactctttgtgaccccatggactgtggcccaccaggctcctctgtccatgaaattctccaagcaaggatactggagtgggtagccattcctttctccgggaaatcttcctgacccagggattgaacgtgggtctcctgcattgtaggcagattctttacaactgagccaccagggaagccctttatcttgtatggattagtatatttaattatcacaagaactctatgaaatagaactcttattacctccattttatagatggagagagataactgagagaattgtgccttgtccatacgtcttctgagatgttgtaccggaaaacagatacaggttccttgacttcgtctgtaatgctccgtttgcttttttgcagttcgctacctcctaaaatcacttctgtttcatttttcttaggtgacttgattgattggctagaattcactctattcagtcattgaagcttagtaacttattaaatatgaatttcaagaattattaaccaataaaatgaagaaaatagaatttttcattcttgtgttacaataaagtaatatatctttcttactctcctcctgcaacaataggaagttaggtggaaatccaaatagttaagaagaagaaaggaaaaatgaagttttttctttgtttcttggcatgaagtctcttcaactatgttattatagttacacttatttgtctttggaaaaacaggagtttgaatctggtgctattcattttcagaatggaaagggctcattctcctctaagtgtgtgttgttaggtcaaggctctgggtatatagggtatatatactgggtttataaggttgctcatagtctataaggagatagagtaacaaactttcaattagattgtctaataaacattcagttataaaaaatatgtgtgtgaaagcactaaaatacaccatacaaagtgctttggaatgtagaggaaaaggcgactcttaagggacttagatggctggataaagtcagaaaagggtattctaggcagagggactaacattgacaaaggcatgaatgcctggcacagtgtggtgaatttgggacctgctgttgtaaggagtttgagtttactctgtaaagattgtgaaactttgcatcattttttaaaaactcctgtttgtacaaggtgccttgctgtctgattacactgcctctgatatg

SEQ ID NO: 46976 - DNA, 704 bp, Bovine  19866881956331
gagattctaacggggagacccctcggttggaagaagtggggccatacacttacaggtgagtcctcagcacctgcctgccctgccaaccagaaaacgcagcagcaccccctgtggcctgagcccccgtctcttcccacgggcctcctcagtgtgctgcacgggaagcacaggttctgactacatctgtctgaagcgctgctggtggtgggcacatagctgtgaatgaatggctttgtggatgggccagtcccagcctgttgtgtttagaaatgcagctgcttctttctgagctggagaatgtggttactaagccatgaatagctgcttccactccctacccttttaaggtggcccctgattttctatggcttcccgggtggctcaatgggtaaagaatccacctgcaattcaggagatgcaggcggacatgagttcgatctccaggtctggaaggtcccctggaagaggacgtggcaacccactccaatattcttgccaggagaatcccatggacagaggagcctggcaggctactgtccatagggtcacaaagagctggacacgactgaagggactaaacacatgcatgtgattttctatagtgacctttaaggtctttcccttgttctctccccacatacctagtcttacgccagctcccagaattcattggttagtctgaagacaggccctttctgtctctt

SEQ ID NO: 46977 - DNA, 1927 bp, Bovine  19866880373610
tgttcttgcctggagaatcccgggatggcagagcctggtgggctgccgtctatggggttgcacagagtcggacacgactgaaatgacttagcagtagcagtagcatgactatttctattgtatctgtctgataatgtacttaagataaaaataacttagagcttaacatcaaaaaaagttgatttagaaaatacttcatgacttaaaacttcagtttaagtgaataaaaatctctttaaatggaatatgtattttttcagttcactctttcttgcttcatcatttaactaaatgggcccccacacccactgtggcacagatgatttaagttttttgagtgctgaattacagttgtagcggttttagataggcaattcttttctgcctatctggaattagttcccaagaggccagtttctacaagcaggtctgaatggaggctctgtttcacttgcctcataagcactgactttaataaacataaattttaagtttaatcactcttcccaaagtaaataattttaaagaaaagtatgttgattgtaatttgttagagactctcaacttccaaaaagtatttaatctcaccattaaaactgtattgactttaagtaaatattctcaatttttggcttatgaatcttaaaaatgcacctaacagtttgagcatatcatgaacacattctccccaacttcaccgaattattctaacactgacttacacaaggaccacatgctagagcaacatgaagaagttcaaatctggtatactggaatatatttattttaattctcacttgagttcttctggagccaacaagaatctcttcatctctaaaaagcctgaaaagatgcactttctacttattcaagtacatttcaagaacatttcacttaagacctttatgaatctttaatgactctttctaggaccgtgtattgtatctcacagccttcactgagttacttcatctcccaatgtgtctattttgcatctctgtattgcagtctaaaaacagatgacttatgaacaagcttcacatcttagatctctgttgggcactgagaagggtgactggcataaatcaatgatattctaagagatctatggtcattcaaaacccaactagactttcattcctataaaacattccagtttacaattagagaaaggaatacaacagcaaagaactggttgctgtttctttaaggctaccatgagctaccactgacaccaaagctaagaagtgacttttcattgagtttgttcttctgatttatgctgacttctccacctcttgattttcaatcttcaaaaatcaaagatagtagcaccgcaaactacatttagaaaaattaaaagtgaaataagtatacataaaaggtccaatcaaaaccacaccatttcaaataatgagaaaaaagcttgtctgttttgtttacaattagtagaatatgtgctttacctgagaagatctacaaaatcccaagacagagaagcactttccctccgatttatacttcatttgttcctcatccactttagagaaaggaatgatatcactcccatagcggaaccctggagaacaagagaagagcatctgttaagcatatggggcctcattttctacaagctgaaattggccccacatatacattaacaatatatgcacactccggatcaagcctctatatactgttccctggaatcaaatttctgtcccttgtgatcaatgagggaaaggaagcagcagatccacaaacatatacaatatagagataattaaaatctaattatatttttttaagtagcatattctgccatctagttaccttgatgattatccagcctagaagaaagaacagcagcaaatgcaatgtactagttaccaaccaaatataaaccatgaatgactataaagtataa

SEQ ID NO: 46978 - DNA, 1253 bp, Bovine  19866880384772
ctgcattttctcttttaatcttccagcaagcagtgaagtaggcactcttgtccccattttacagataagagaactgaggctgaaagacattcattaacatgtgcagtatcacatagttaacagctagtagatttgaacccagggctgcaagagtctgtgtttctccatactattctgagttaggaagggttctgaatgatacactgaagagttgatgcttaattttgagagcagcatgaagctgtttataattttgaggagcagaatctcagagttgtgttttaagatgattaataggacatatggatgtaggatggattggaaggagaagggactagacatgagggtgccaattcttttggttgcaagcaaagaaagcaactctggtttatcttaggcaaaaagcaaattcattgatagagcaatggagaggaaagagttaaatatggtttaagtttaaagagtataggtgagtagcttttctctcttagctttttgcaattacccacatgcttcctttgcctgtcccctactctctacccgctaataggtagagttctctcttctagatagagggattagttaatacgagcaaagacttgtcgtatttgtagtctgttctctacttttggccatatacaaaagttgcagtacttgatttgccctttaaaagatgaaccagaaaacatgacacttttaacgagaagtttcaaattactcttaaacaattcaagtaagatgtctgaaaaaacatgtactactcttatgtgccatgtatttccctcttaattttttgttgacatttttttatcattagtttttattaagacatatagaaacgtgtttctttttaatcaaatactttgcatgaacagagtgagaggggctaataaataaacattggatcacagaatctgcccacagacacacacgtttctttgtttcttcgagtgaagatgcacgcatgtgcttttcctttttatccgcccaaggtcagactccttggattttgatgatctttctccctattaaacatacaatactatatagtgaaagggctcaaccgtacatagaacaaagaccctgaaacagggttggagtttttttaaggagccaagagcctgtatgtgtatgaataccctaagtaattaaaaatatatatatatagacaatcctaccccagaaataaaataaatttaaatgcagaaaaatatccagcatatcaattgaatgtttctgaatagaaaaatttt

SEQ ID NO: 46979 - DNA, 1891 bp, Bovine  19866880605095
tggtcttagtagcctgtttatcatcttccagtttcagaatactccttgtttaaattattccttctctccccactatacactgttcttctggaaaattttagcccacacttatctgtcgtaccatcttgttggttttcgggagggcaggaaacggaaaaagcaatttgtgcccaaatagtccatctaatggataaactcttctttgttccttaccctaagataaccctttatctgagacaaggaagttcaggtgtgcaacagttcaggaacttgaaggtattcctggtgcctggaacccaggttagtatgtgactaaatgtgacagggagactaaggaggctcagggaagaccaaatccactaataagataatagatagtgatggagtgaaacatataagaagcagggttgctacagtgtagcagaatgtaagaatttgtgtgtatcacttagattttgatttatatcttaaatataatcgaagtccaaatagcagtagtttaaacaagacaaaagtctgttctttcttgtacagaagaagtctggaggcagaccatcagggaaactgataaagtcatcagagttccaggctttctttttatttcccaaccctcatcgcctttatcctcagcaaccagcgctgactacatctccagtcgtcccatccatgtttcagacagaacagaggacagggcagagaagagcacatacactctccctaagctaaggaggtttcccaggagtccctttcaacacttcttctatctcattggccaggccttactcacatgacctcatgagcaaaagaggctggaaaatgtagtcttttgactgggcagctgtattctaaatatttggattctgctaatttaagagacaaggaaagaatggctattttggtaggcaagtaagagtctctggcttacagtaattatttaaatacattcagatcccaaactgtgaatacagttctatttatgtatttatttatttaagcctaaatcttacacagagaacttatacatagatactagctacatatactatgcataaaccacacagatattagcaactcgtgtgttgcaattaaatatctgtaatgccatatggtttcaggtgttttcaaaaggaagagtggatagctgagtacaattgtatcatgtacaaattatagtagcatagcttttttccaggtagtgaagatggactgggtgatgatatttaatgtaatgtacagatgaaggactgggaagagaggcattgcatctgtcagacattcccccgcccccgcccccgctccacaacccccagcagggtcagtaaccctaagcaaaagaagatggagtcagctttgggtgtgtgtgtgtgctcagtcatgtccaactccacaaccctatggaccgtagcccaccaggctcctctgtccatgggattttccaggcaagagtactggagcaagttgccatttcctccaggggatcttactgacccagggactgaacctatgccttctgtgtctcctgcactggcaggcggattctttaccactgaaccacctgggaagccccagcttgggatggtttgaccaaacctcactcagaattttctggagttcatcaacaaatacaatctttgctgagaagcttggatctttgtgggcactgagggtataaaccctagatgaatccagactaatacattctgaacttaaaaaaattcctgagggatccctttctaataaaaaaaaaaatcgtatgcgggtcacacagatttttaaagtttgggtccttacatgaagagctggtgtccatgttcatgtttcaggaagaagctgttgaaagaactgctgtgaatcaaacccaatgggtcaggtaacactgtgccacagaagg

SEQ ID NO: 46980 - DNA, 1280 bp, Bovine  19866880824068
cagggttatagtccatgggggtcgcagagtcagacatgactgaagtgacttagcatgcatgcacgcttaaattagataactaatgagaacctactgcatagcacaggaaacgactcagtgttgacctaaataagaagaatatccaaaaaagaggggatatatgtatgcatatagctgattcactctgctgtacagtagaagctaatacaacattgtaaagcaattatgctccaataaaattttaaaaaataaacagaaaaataaaaatggtctcattaattacttggatagagggtgacatgggcaagagttaattggttataaataaggattatttgggagaaacaggaagacttttcactggacagctagtggtttatgtgacagagggcatgggagaccaattccaaatggaatatgtatttggtgatacaaagccattgcttcttaaactgaattctgccctatagaccttggatataacccattcaaactcctggccagcctcctacactggcttagtcaacatgactagttagttctaatacaagccagttaaggaaacatggagggttgcaagagatggactccatctgatattctgataacgctgatatacttgagttcatatatttgaatggggacatgatgtccagttggtatagaaaaactcaaatcagcaaagtaaaaacaatattcctggcttctgttgcatattttgaatcattctgtttcttttttcatctgccctgactgaatcacacatttatttagagtttgtagttctaagcatgactcaacagaatcaccttctttcaaatgctactaattaccatggacttaaatagcaaagattttttaaaaagtcatttctatgggtgattcagagtagatgttaaccagaattccttaccctgtaattttaacactgaagtaagagctatatatcaaatctttgctttgttaggtttcttcagttccctgttaggcttcttcagcttcttcttaaaccaagaagtatagtctatttcttcctgcaagaagattcacttgtgaggcattgagtgtgtatttggggttagtgggattgactgtggcgagaagggaaaagtgatggagcagccttctcttctacatcgttgagatggagattaggggacctcagagggtggctacctttatctgattcttactaattagttcttactatttcatttggaggaatgaaactacagagatttcagtggatacagaagagtacattttgccgaacaagcatg

SEQ ID NO: 46981 - DNA, 1022 bp, Bovine  19866880487360
ggttagatatgttagtgaacatttttgatttcttcacccagtcaaggtcccaacatctgggtacaacagttgcttctccccagggtgcctgcatcttgggtaatcagtgggaaaattggaaccatgagattggcagggggctctgaggatgcttgcagccagacgtgatgtgggtgtggatgggtctgaaccagcccagtgagaactgggcccaagaggatgcccaggccacagtgtctccaggcaggcaggtcgtagtgctgcgcacccccagatgcaaggcagaagacgggcagcgcggcctggggggcggcagtacagttagaagggcttcctgagagtgcgagagcgagagggaggcagcgggatgcatagctgagaggggccctgctctggcaggctgaggattgggcgagcgtggaagcaggagctggccacagggctttgggcgatatgggcaggggtgccattttccgacatggtccccatcacagcgagtgtgcgtgtgcgcttgtcgggtgtgaagaaccgctgcttcctctgttgcagacagaggagggggccctcctcaaggttaggggatgagtggagccgatgggggtctcttgggctgggagggggtttcagcagagcaatgaagggaggccctcggactctgaacccaccaaccttccggaatggggtggccttggctgggggaggcagatgggccctccaaggtgctctcatctggggtcttgtgtgggcccccagtaaagtggctgtccctatttctgggaggagaaccaggcctggcttgttggctgtctgtcctggggaccccactctgaggaaccccatgttttttgtgttgtcctgctgtctgtctcctgtctgtctcccaccaatgtttctgtcccttcagccccagctcttgacccagcaccccatctctgtcctgcctgccccccagtcctcagggacccccaaaggggcagctccgaaggctcttccttgctctgtcccagtccccgcctgccccc

SEQ ID NO: 46982 - DNA, 1415 bp, Bovine  19866880592867
cccccccggcgggcccccgccgccgcacagcccctactcggggccgcccagccgcggctcgccggtgcgccagtccttccgcaaagactcgggctcctcgtcggtcttcgccgagagccccggaggcaagacccgcagcaccgggggctcctcgacggccggagcgccccctcccgagctcttccccgggcctggggagcgcccgctcgttgggttcgggccgcctgcgccagccaaggacactgaaaccaggtgagggagctagcgaggctcggggctgcacggtggggagaggggagacggcagagtctgtctgagacccgggagtccttctagacccggagtatccttgaggggtcaccagagtatcttggctgcggcagggcaggcatttcatctgccagccccaagggaccgatgagagggccccagacaaggggcctggagacctgggtttgcatctggtccctgagccttagtttccccaactagagttgaggctagagcacaactctttatttaatgcctttcctgctcaggcacaaaacgtgccaccatgagagctgtccagcacaaggccggctgaagtccactggggagggggtgcttgtaagaagtggggatgagaggggcacatttctttaagtagcctccgagttggggaactcttgcctatcatccagcttcttgctaagggtgcaaggctggaggaggtaaccatggcactgacctgcccccctctgccctcaagcagcaccactgagaggtgaggagaaatgatacattcacatagctttcttgtggcctgtgtgccaggcactgcactgggcactgtttatgccaaattgggcaaacccagctcctgccctgtctagtgggggagacacagtgaaaaaaaacaaacaaaaaaacttgttcttcccttgggagggtgtactcctaaggtagttgggtactctgggatgacttcagagaagaggaagggagaagggcgtgcctagcaaggggaatacatgtgcagaggtccagagaggcctgggtggggcccattagggagctagtgatgaagagatgagtctggagagggagagggtgactgtcaaatggggaagggcatttccaaagttatgtgtgtgggagggctgtagatttgatccttaggtgttgaggccctttgaattgtctatgtgctgaggaggaaatggttttcctctaattatcaatcttaggagaggggggctgggcaggagggaccccatgcccagcgatggggttgatcaaggctactgtcttccctagggagcgcatggaggccatggagaagcaaattgccagcctcacaggcctggtgcagagtgccctactgcgaggttcagagcctgagacccccaggtgaggttcttttcccaacacca

SEQ ID NO: 46983 - DNA, 3101 bp, Bovine  19866880635774
tcttaatatcttctgcttctgttaggtccataccacttctgtcctttatcgagcccatctttgcatgaaatgctcccttggtatctctaattttcttgaagagatctctagtctttcatatatatatgtatatatattatgtatgttatcatatatatattatgtatgttatcaactgcttaattatatatatataattaagcagttgataacatacgggagcttgagcacaaataaagcccacaatggacatctgtgtaatgtatatactaagaggttgattttgtcattgttacatttgacagcaagaaaaaattaatttgtttctgttcattgctgtgattaaaccaagagttggttttctttcagcttcaaagagtggatattctgaatgctttttatttgcagcatgtgatggaataaatttccaagaacatggtaatactgtacccttaattagaaatttgtcaaaactcaaaattataccacccagtattaaactactaaggaggattaggtaagaagcaattactcaaatataaaaggctaatgtgtccattctttaagatgctacttctacatttttctgaactatgtaaagtgatatgaagaggccaatagatgtcagcagattatatgttacttttttccagtctttgataagtgatttgtttttttaagttcatttgacatagtgtgaacactagccatgagtactgtgatataccacaaggtagagattatttttttctctgttggcatttagtaaaccaacccctgtgccatacaaaattaatctcttcaatggggtaaattcaagactagttggtataatacagtaatgttgatggccacaatcaagagtttatttaggggaaaaataatcaagagctgtgatgctataaatttcacaactattaaggtaaaggaaatgttccattgaactccatactcagttaaatgttactgagatcctacagatcttataataattaatcatcccattcctaggaagactaatggccatagtacagtgacttcgtaaaataaaatctggaccctttgtatattttcttctaatctttggagaaatcattgcagtcctcaaaagaaatcttcctatttgaaaatccattgctcctattccatagacaccaattttgggaagtcttctaggaaaacatgggaagtctatagccaaaatggcaacagcagtaaatgcactgtcaattacatgaaaacaagagatgcctggaatgtattctgagtccagactgactttcaagaatttttcaagaattttccagacaagcattctgacatatcaaattttcttgcagtatattttatagaacagcccggccccaaagataattacaagatgctcaaggagaacaaatgtagagaaagtggtcaaaattgttaccaggggaactatcaagaaagcaaagtcaatgaagaatcaaggtctccaagtgtgtgaggaaaaagataagtgctgtgagaaaatgatcccgagccctctgcacaggataaggagtgtaggcaaacccaagccctcaatgatttccagcatgcttgttccattgtggtcactgacaaaagattccttcatctgcttttgagaatttttcttcttctccagggtttcaaaatactttgtccaccagagagcccccaattctggatccgcatgtccctgatgagtcagggatgccctgtgctgaatgtgtgctctgccccaggagaggagctgtgggttctggccacttagccagagtgtcagttcatggctcaagtgtctcatgggtcttaatatactgatcttttacctccttggttaatttattcccaagtgttttattctttttaattttattgtaaatgggattgttttcttaatttatttttctaagagttcattgttaatatttggaaatgcaactgatattttgtatattgatttttgtacccttcaattttactaaatttgtttattagttccagttttttggttgagtttttagggttttctatatatacgattgtcatctgcaaatagatacagttttacttcttttctaacttagatgcctttaagtttttccttatctaagtgctctggccagaaaacttcaggtactatgttgacttaaattgtcaatagtatgtatctttgtcttgtacctaatcacagaggaaaaactttcagggtttcaacattgagcataattttagctgttgatttgtaatacactgcctttactgtgttgaggtatattccatctgtatctaatttattgagaattttttccttgtcatgaaaggttgttgaattttgtcaaaggccttttctgaatctataaagatcatcatacaattttcaatttttattttgttaatgttgtgtatcacatttattgatttgtgtatgttgaaccgtctttgcgttccagaagtaaatcccacttgatcatggtgtaatattcttttttaaaaagtaattttatttatttatttttggctgtgttgggtctttgttgctgcttgggcttttctctagtagtggctagtgggggtcactcttcgttttggtgccccaggcttttattgcaatgacttctcttctcgtggggcatgggctccgcaagggtgagggcttcagtagttgcagcacgtgagctcagtggttgcagctcgctggtcttagaacacaggctcagtagttgtggtacatgggcctacatgtgggatcttccgggaccagggatcaagcccatgtctcctgcactggcaggcagattctttaccattgagtcaccagagaagccctgtgtagtattaacacactattgaattttgtttgttcttattttgttgaggaattttgtatccatgttcataagagatattggcctgtggttttcttttcttgtagtgtccttgtctgcctttggtgtcagagtaatgttggcttcataaaatgagcttggaagtgttccctcttcaattcttgagaagagttggagaaaattagcgttaattcttttatacatttttggtagaatttatcagaggttttttttttttttttttttaat

SEQ ID NO: 46984 - DNA, 1965 bp, Bovine  19866880643889
agggggatcagagaagatgggaccatgtcgacctctagtacagctttgttgcgtttataggtacttgtaaatctgtgatttcatttcatttatttaatcgtttattcatttatccatccattccttcattcaatacggacttattgaacccctttctctgtgccaggcactgggctaggctcagaggccaacagtgacaagacagcgaaaggttcttctgttgcttaagtggtgtggggatacgggttaaggggttggcagagttcactggctgtggggcctgaggctgtggcctggccagctgactccaaagggcagtgacccactgtccaccgatgcccatccgcccctgctccccctgctggcggctgctcctcactgcatgtctctgttgagcatcccaatggcactcctctcatagcgtgttcctgccaagcaggcagtgactggacgtcccaatccatgcaacctggggactgtgagcagcattgttgggccagagcagaggccactttagagggcctctgggagcccacctccacttctgtgcccgggaccagcagcctagggcactggacttgagagtcagcctgatctgggttcaaatgctcacttaagccatgtctgagctgctggccttggacaagccactttccctctctgagcctcattgtctttgcctataaaatggcaggcttgttgagaagagtataggaaaagcagcagccggaccagagcctggcccgtagcaggggctgccccattgtggttccctttctgcacctcccccagcccctccctggggtggggcagctccagccgggtactgtctgagtgctgcccctgtctcaccttgaagaggggttgcagagtccctgtcttggctgtttgcaggctccgtgtcccccagcccttctccactctctgaaggatgcttcggccccagtccgggcaggcagatggggcaggcagccctccttgccactgtggctgccgccgccttgatggctttttaataactttgctcggagacaatctgcagagcctcgtttgtctgcctcttaattaaaattaccgttttcctaaaagagcaacgatgctgctcccctccctcccctatcagtggctgctgccaggagaaggcagaagtgacttgaaattgctgcctttcccctcggcccctgtcctggtcacacaagccaccacccaccctgccccacttctcgacacaaacaggtgggccaaggctgagtgtcaggaactaggaaaggaggaaagagtgaatgtcttcctctttcacttacactcttccagaatactcccagagacagggagctcagtccctctcaagacttactttctacatctgtaaagaaccagagcaacccctgtccggctgtaccacccagagtggaataacatgtggggaggggggtttaaaatgtgctgtgaagggttattagattgtttgtggtggggcaggcgtcatctggggccagaggcctccctggaagtgggccctgtggggtcagctcctctgcctactctagttagaaggtacatccacattccctccgtgattcagcgagagcaagggagtgcagggctggaaaggtatggggggttcgtttagtcattactgagtttgggggggaaagtgttcctggtaataataaaaatacaaatgactaatatttactgaattttgctcaaaactgtatgagccatatgctggatcaagccctgtacctgtgtcccttcatttcaccctcatagctgtcacatgagctccatgctgtaatctctatttcacaaaggtggtgacagaccagagagcttaagtaacatgcccaaggtcacacagatgatccacccgtggtaactgcagcctactccccctcctgccgttgtaccttccacctgaagtcttcctgaagtctagcctctgtccctcatgctgcatgt

SEQ ID NO: 46985 - DNA, 1294 bp, Bovine  19866880687584
ccttcagccccggagccccccaaggctgacctctttgaacagaaggtggtcttctctggcttcgggcccatcatgcgcttctccaccaccacttccagctcaggccgggcccgggccccatcccctggggactataagtctccccatgtctcggggtccggggcctctggaggcacccacaagcggatgcccacactgagtgccacccctgtgcccgctgaggagacccctgagacaggcctgaaggagaagaagcacaaagccagcaagaagagccgacacgggccaggccgtcccaagggcagccgcaacaaggagggccctgggggcccagcccttccctccctgcccggtgcccagctggctggcttcaccgccactgctgcctcacccttctctggaggttccctcgtcagctctggtctgggtggtctggcttcccgtacctttgggccttctgggagcctgcccagcctgagcctggagtctcccctgctgggggcaggttagtgacccttggggaccaagggtgtcttagggcccagctagtctagtgaggggacagagacataattatgcagttagaaggaaatgtgacagaaactgctccagaagacaaaggatggaggtgacagtcacctttgagacactcccccacacccatctcctgcatggttgtgatgggagagattgccaacaggacttaaccaagtgtgggttggggaattagaaaaactgggaattcttcaggcttgagcagggcagtagaataagcaggcttggcaagtaggtgtcactaaggcgagaagtgacatctttgcagcaggagggtgagactggtgtgtggcaagatccaggggagtgttggccttggggagtggctgctccagccacctgactgaggaggggcagaggagaggcgactctaagcgtccctctgtgtccttctcgtgcctgtaggcatctacaccagtaataaggaccccatctctcacggtggtggaatgctgcgggctgtctgcagcacccccctctcctccagcctcctggggcccccagggacctcggccctgccccgcctcagccgctccccattcaccagcaccctcccttcctcctctgcttctatctccaccactcaggtgaggccttgctcctgggctcctccatccctgggcaggtgggggacagcctgccgaggaccccagctttccgtgggaatttgagagattgggcttgatcaccaccagaacgtctccctctttctggtcctttctcctccccagcacacctg

SEQ ID NO: 46986 - DNA, 1543 bp, Bovine  19866880735930
aattttccagaatgctcaacattttggatgggtaatgtcctattctcacaccttttactgacacagagagacccattcatgtatgcatcccttcccctcccttcctctcactttcccttcttgcagggcaggcacatggcatgtgcccagcacttgctctgatttaatcctatcatggtcccaggagctacggaccagtgtccccaccgatcagagaaggaaactgaggctcagagaggttcagtgacttggcttgccgctcacagctagtgaaatggtgaaggtgctgggcccagcatttaaatgtgaacccccagaattactgctatgctctcactaccatctgttttatcagtgaggctgggtgagctgtttctagtcttcaaaaaaacacccccaaaaccccttgtccatccagcagcctgtttctgacattggctgttggtgaatgcactcattcgctttatttatttaagattggcatctcagctccttcaagaaggattcgaagtggctgacaggtaaattgccctgtaagataagacactttcatgataaagtagaaagcttaaatgcattcagagcccagctttggttagattaccatgcttggaccactcactggcatcttaaatcttctggccgctgagggatgaaggcacccccagggtcctcctgcgtgcgacgtagctgctgcaaggcctctgtgcatcgcagccccgggtctctcttgcaggcagaaggcagaacgtgtgaggacttccaggacgaggactcctactcgtcctcccccgacagctccttcagcccctttgacggagacttcaccaccacctcctcctccctcttcgttgacagcctcaccacggaaggtaagggtggggaggagccatggccctggagcatcactgcccctaatggggattatctcagggaacagggttgttgcatcctatcacatctgaggctcccagagcagaggtcacttgctagtgagatacagagctaggtttaggacgagtggactccacacccacgtcagagttgtggaacagaattcactgtggcagtgggaaaaattactgtcccagcacaatgccaattagtttacataataacttgattcatcttaatagcaattctcagagaacctgtgagatcttggcatcccgatagcaggtatgaactcagtcccacacactcagatgtcagagaaagattgcataattttttctgtgacttcccttctggttcccacccctcattgggctggtgtggtgggaagttccaccctcgccgtgctggggcttgactttccactcctgtgatgtccagggggcagagggtagtgcaggacagctctgaccatctggagttgttgctgaactgcttcttcaggcctggctgtccctggggccttctctgccatccccatgttactggtgcaatggtgattcctgggttcttgtcctcacaagggaaagaaatcgatctagagacatagaacagttttaagcagcaggagttttaataagcaaagcaa

SEQ ID NO: 46987 - DNA, 1091 bp, Bovine  19866880764515
cagacggtgatgatccctggggccccagctgaaacctggggaagagtatgaagagctgcaaagagaggcccataagcctcagctagcgtgacggcaagaatgattcctggggtgaagcatgggtgatgaagcagctggaagctgtgaagtctgggtgtccggaagctgtgaagtcacctgtctttcttcacgctgtagaaagaactgcctttgttctctcttaccctgcttgggtcttttaagcagtcttatcctcaataacaactgctgctggttgggccctggtgggttggttctatgcacagcaatggctctgcttctttttttccatcttaaatctagtttctaactccagatgaaagatggtatgtttcagagaacatgataccagcttgcccaaagcaagaactgtcaggagcaaactggcaggactttctaattacagggcagggatcagagttggaaataaaacacttatcaagtattagacaaattgtggtgggttctctacatttctcctggttcaggctggaagtggacaagtcttcagatggtagacgtggaagttaactatgactgatgacttacaggaaatccagacttgagaaaaataattagtgtttataaaagtgatgtcatttaagagggtctcttctcatacactgattcactaaatcagtatctgtatttcacaaatgaatgtaaatccaaagacatcatttagtcctcagcttttagattttgttcttaattatcgactgtatcctgatgtaatcccaggaggcgttggtagaggcaggggccatggaagtgtggatacatttgggaaattcatcagtaagacttggttcactgatttctagcaccttttggaaatggtgactatttttgcagcccagatttggaggcaaagattccaggatatgaacctgtggagagggaaacagcccagcccctacttgtgccttagctccagctggaggaggatgtaggacttcacatactcatgtcctgggtcatctgaggtgtgacagggaagtcactgtcccagcagcaagctggcttgtagcactattacacgtatcagccca

SEQ ID NO: 46988 - DNA, 2820 bp, Bovine  19866880816068
actggtgcccgggcccgagctggaagagaaggcgctggtgctgaagcagctcggggagacactgaccgaactcaagggtgagcctgggggcacccccagccccaccccaggcattgtacccccaccccactgcctgtcctcccagctgtccagagctgctctctcctcccgctcactccttcccttcgcctcagctcacttcccaggcctgcaaagcaagatgcgggtagtgctgcgtgtggaggtggaggcagtgaagttcctgaaggaggagccccagcgcctggatgggctactcaagcggtgccggggggtcacggacaccctggcccagatccgaaggtcattctatccctgacctcctatctctgacctgcgatttcccatggggtcacacaccgggcccagatcccttatcccaactccccgcagaggtcagcggtgtgctggctggctctgcactttgacctgtcaccccttgcatgttgcaggcttggcgctcccatttcccagatgcagtcacccctccccaggcccttccatctgttcggcaagatcccagagcccccctcacaccccgcctcctccatgccaggcttccctcccagggagccacgaccctgctgacctcacagctgctcccaactctcccaccccaggcaagtggacgagggtgtgtggccaccccccagcaacctcctgagtcagtcccccaagaagatgacggctgagacggacttcaacaagagcttagacttcgaaatgccaccccctagccctccgctgaacctccatgagctgagtgggccaaccgagggggcccctccagcccccaaggcgggcaaccccaccaaaggcctggacactcctggcaagagaagcatggacaaggctgtgtctgttgaggtgctgggcgcgggatgggggggctggggctaggctcacacattctcaccaccgacctacgttggccagtgccgacacgtgggacttgttcctggggaacaaggcaatctgagaagcatactgagggtgacatcagtcctgctagtcagggaagcatatcataaacctgtgataatcaaggcagtacaagaaaagattatgtgctcaatgaaacagaatagaatgtctaaaagcaggtctaaatttctcctgagagtacttggttatgaaggtggcattccaggctcgcagcaaaggcatgtaatactcaagagaagcccgaggctcggatcaaatgggaggcttcctttgcataccttgcatgtgtggctgaggccccagaagtccaggagcagggcagctgcttcagtgctgactgttggccctcctctcaaggctgctgagcgggactgggaggagaagcgggcagccctgacccagtacagcgccaaggacatcaaccggctgctggaggagacacaggcggagctgctgaaggccatccctgacctagactgtgcgagcaaggcccacccaggcccagcccccaccccggaccacaaaacccccccaagaccccccacggccagaaggcagccccccgaacggagcccagtgggaggagaggttcaggtatggggcaggtagggggttgcaaagagcccagaggaggggagccccagcctcaggaactctcaggttgatgagggaggtgcttgggagtgaaaatctttgtgggtgggctattagagaaacggggtgctggcctgacccttggccactcaggaaagatgggatagtgcaggactgcatccagggattttcccacagctgctgagaggaccacactgggaggatgagaaagttcaggcagagggttgtgcccctgcacgttttgtccaagcatgtgtggcaggagccaggctgtgctgagatggggtgcagccctgagggatgcagatggggttcctgtgctccccaagcctgtgagctcacaggggaagcagaaacccaaataggaaacagcagatgtcactcattcatttattcattcttgccacttgtatatttgttaagtgcccattgtgtgccagggctttccccgtggcgctagtggtaaagaacctgcctgccaatgcagaagacataagagatacaggttcgatccctgggtccagaagatcccctggagaagggcatggcaacctactccagtattcttacctggagaatcccatagatagaggatcttggtgggctacggtccacagggttgcaaagagtcagacacgattgaagtgacttagtgtgcacgcacacgtgtgctaggtgctggggataaggagatgactactttcaaggagctgaaaatgtagtaggagaataatactaacatctgtgtttatcaggcacttactttgtggcaagaaaaaccccaaatgctttctatgtattaatttttataattttgcaacaagtccagaaggtggatacagtaattattcccattttacagatgaggacactaaggctcagtgtggttaagtaatctgtcccaggccatacccagtgtgtaaaccagaaacaggaggcaggtgctaaatgctgttctgcaggagaccctgagagggcaggaagtccgtcccatgggagggggcttttcactggagtcttgcatttccctggccagtgagagagggcattccagggagaaacatcatgtaccaatgcctggaggtatgtgtttggtgttgctcagctgggtccaggcctgagagtagcaagcagagctgaagctgaaaggttggcaggcacagaggtttggggttgtggggaatcactgggggatcaaaggaagaacgggggcagggagag

SEQ ID NO: 46989 - DNA, 1931 bp, Bovine  19866880829104
cccatgagtgtgtggggggcagactgtatgcccaacaggctgcagagaggtgagcagactgcagagtgatgaagaggccaccagagcccaggcatgaggctcagagtgggcccgggccgaggaatgaatggaggagaggcgatggaagtgactggaggggcaggagagagggcagcaggcagaggagctgggtgccgggggagttggggaacctaattacagaggagggagatgcccgctgaagagactgaggcaaatgtgtgtcagggtagaggggcaggaggggcggagggtgagagacagaggtgtcaggcagtctggatttgaaaccccctccaccgtttgtcagccgtgtgactttgggtaaagcgtcagtttcctcatctgtcaaatgggaataataaggcccttccttagagtggggagtgtgcagtgggcgaatgtgtgtctggcagaatgtcagctgcggttctagaccccgaggagagaccagcctggacaggacacaggaacaaggcggtgacatgaagaagggctggggtgtgtctggggactcgcgaggaagacagcgggccgcggggagctagtgaggggcctggctggcccatctccactggactctgagagaacccgcaggcctgtgtgcccaaggtggctgcagagctgtgtggtggaagagctttgagatcctggggtcccagtcctggctctgatgccaccttgctgtgggcccttgggaaattcccttccttttctgagctgtcccctggtctgtcaaggaggtgactggatttacccatctctaacctcctacctctgagcctagaaccttcttcaagtcatagcatctggacatttcctttccccactcccacccagcacttagaatataggaactgcttggaaatactgaaccacatgaatgaactaaaggtctttcctgacatctaggcccggggaccaccctgcatcttctgatcagggcacaggtgggccaagggtgaggctgccacctctacataccatcctttaatctgaaagagggcacaccactcctatgcaccccactacaacccaagcacaaggctgaaaaggagatgcaagactggcttctccctcagttgggaggtggcctaaaaactaagagggaggctgagttgagagcagagggccaaggagcaggtgggatctgagagcagaggggaggaggcagaggagggggaggagtggcaggaagaccaggaataaaggccccctcccacaccccagggaaccggccttagaagggcccaggcatttggggtccgctcactccgccttgtccaggagcagctggggagatggtcctctctggccctgagtgaggggccttctgcaagaggagtgatcagtgatctggctatgttctcaaccagatcctgagcactggtactggagagaggaaggagaaaatggtttgagggaccagtggggtagtcctgaccggtaggacctccctggacagccgcaggatggtgggcacaggaatactggcaggagacagccaggcccagcaggagtgtacagaactgactgctggaggctggaggtgaggtgggggttgggggctgcgtggggccgcggccctgcccccgaggcgcccaggcttacctgctgctgggcctggatcctcatgtactcggccctctgcttgccatgcttgcctttgtcggggctgcctgcctggccctgggccgtcttcagccgagaggcccctggagtcaccaccttcatggggggcacgctgccaccgccgctctgcacgaagaggaacagggtcagagctggagatgggatcacacaggcgccctaggtacagtaggccctctgagacctggagagccctccccggcttcatacccccatccaggactcaggcccactctctgagg

SEQ ID NO: 46990 - DNA, 1186 bp, Bovine  19866880835103
caacgaggaccgtggtgaggttctggagcaggagaaaggggctctgagcgatgacgagatcgtcagcctctccatcgagttctacgaaggtgtcaggcaagtctggcccacacctggccctttcagggtcctaggcaggtccctcccctctgccgtcccccttccctgggaggaaagggcacttccgggagggccttccagatgtttgtgtgcagttaggtcctgcctgctccaggttttcccttgcttcattccttctccttctgcagagaccgggaagagaagaagggccccttggagaatggggatggtgacaaggagaaggtgagtgctcgggcctgcccagaatggagtatgggctgggagagagtgctgggggtggaccccagcccttgggtgcctcttccccagcagacaggtgtgcgcttcctgcgatgcccagcagccatgactgtcatgcatcttgccaagtttctccgcaacaagatggacgtgcccagcaagtacaaggtaagtccctggccccttttgaaacatgtgtcttgtttgtggatgtgtctgacaatctgtgcatcctagtcatggctcatggctggtttggtgtcaccaagggcttgcgtgttgtgtaacagcctgtgtagaacagtaactgaaaacgacattcaggtgcggcagtctacttctgctgaagccagtgtgcagaggtgcatgggaccaagacagtgtgtgcatgcctgcatgcttagaactacggcagagctgtgtatgtaaaaacttggggccatatctagggccagctggctagtctgaaatttccaaggagctttaggatatagcttctcaaatctgaacatacgtatggtcccctagaggtcttgttaaaatgtaattctgactgagtagacattgtgtttgtagaaagctcccaggtgcttctggtgctgctggttcatggactattgaggctctaagacagtagatcccaaactttgccacatgtcagaatcacatgaggagtaacttctcaagattaaaactcgattcacatcttagcagttaaaacaatctctggagcgggatccaggcatgttgtgattccaccgtgtgccttctccctggggccctttctgtgcctgttcgctcctctggagaacatgccagagatagaaagggacccagagcactg

SEQ ID NO: 46991 - DNA, 887 bp, Bovine  19866880837693
gatagaatctggaatcagtagtcttttaatatttgaatgaatgcatcgacaggaagaagcctgaagaatgggaaagcctgaggcagtgaaaagaatgatgaatatagcaagacatagaaaatacaagtggggttgggaccaagcacacacaatatggagttatctgtagccctataatggcacctctcagttgtatcacagcctaatgaaaccatttccagctctttagcccttgccctcaacgcccgtgcgttctctggggccatttaatcatttctgaatctctagtgtccatctaagtccctggcacatagtgttcagaaaaggggtccgatcaattaaaccaatgtttctgtgtcccaaacaactactcccaagctcctattgaaagtactctggggtatcattcattccgcagccttcaacccccaacaccgctcactttgtatcgcgagctctaggtgacgtcccgcatttattacgtaataagacagcgccctggggaaagaggcggattgagcaaactccgggtcacgtgccaagattgggcggggcgtcggagttcatatcccagtgtcctttgtatctacttcctttttgtccctttccggccttcaagatgtcgaagcgaggtgagcttttgactttggaagatccttcgccatctgttgcgctgtggcagctggccttgccggcagcggcggccgtgggcagctggggcgatttgctatgcgcgaggcccgagagggcttggagggttcatcgggagagcaccgggagagcccctgaaagtgacgggggccggctggagggttgagttggcaggatccagtcgtgactctaggtcgaactctgcgggttcactccgcgtcaccgctgcagtaacg

SEQ ID NO: 46992 - DNA, 1030 bp, Bovine  19866880867784
ctcccaggatttgttgtgaggataagtgaggggctgaatgtgcgcctggcacgctgtaggcacttagtacaagatccctctttaactggtggtgctgacgcacaggattttggccttggctccagtgtggtctgttttttcacccactagttggatgaagatatataaagcatgctgataagatttgttgatgacacagagctttgagggggagcaaatctgttggatggtagaactgagattcaaaagttgttcctcactggattgttgagctgatttccaacagatgggatttgacaggaatgtatgtgacgtcctgcatgtgggtcagggatatcagtaactcaggtgcgggactgggatgacctacctgggcagtaattccttctttcacttattcattccttccagaattacttaccagacctctgttctgctccaggcaccatgccaggtgctgggaatcagagatgaatcagaaagacagggtatcttattttctgcctagagctgcttagcctagcaaacaggagctccaggcaggaagcagacccctaacaccaagtgtaaggggagagtttcccactgggacctggggatgtgtgggagttagtcacacgtgtgcgcggggggtggggaggtggtggtaatggagtgttccgggcagaggaaatggcattatagaagtccagggagagggactttcctggtggtctcgtggataaggtccacactcccagtgcagggggcctgggcttgatccttggtcaacacaactaagcctgcatgccgcaatggagacctagcgtggcaaacaagaatgaccaacagggagagcagcacatacaaggacctcagggaaattctggatggttggaaatagaagcaaaccagatggggaggaagtggatgtggctagagaggaaataagagcagcccccagggactgaccccatgcattagctcatttaattgcttttagctcatttaatcctcatagggccccaggagggaggaactcttaccatcc

SEQ ID NO: 46993 - DNA, 1152 bp, Bovine  19866880870017
cgagcacgtggtgtcacgccgctgggcccaccttgaacttggacaccacggtcaacacaggggcccggttctggccggagggctcctcctgggacttgtcttcggggtcggcaggaaagagcaccttgagcagggggtcctgggactgctgcaggagcctggtcagctccggggggacggggtcctatggggaaaggacagagcagcgggtgagggcagggggcttggggggagctgtcggccctgtcactggggccccaggagggccggcccacgtctgaacctggaggccaggagacgcggtatgaggcgggttgtttttaggcaggtcgtgccagagtagcagagacctcagaaaggtgggcccgagaggtgaccctggaccccgagaggatgtgcgggcgggcagggaacacagtggatgtttctgcacacgtgcggcgacgcctccgcgtttggattcacaggtgacaccgggcacggcgtggccctcaccttgttcttctccaccaggcccgcggtgcggtaccgcacgggccccgcgtaatgcagcacaatgaagctgggctccgggctcagcctgtcgcgccccaggcgggggtggccggtcagggcgctctcgatgcgcgtctggagctgggctgcgctgcttggccgattaaggcggcactcctgtgtggggcgggcagtcagccacagggcagaggggcacgggaacccacccatgggagcatcatggcacccctgtgacagagggctcacagggcaggcgaacccactaagcagacagagagaaagaggcgcagggtgggcctcgaggtcccgggaaaagcccaaagccccgccctgggggctccgcaggccagcgaccctccaacctcgtttatgagggagcagatgctgacggggctcccctcgatgagatccaagcagggctggttgtcctggtagctgacaaacgaccacgccaggccctccattgcatactcctcctgggggtggagggcagtcggggtctgagctctgggggggtcaccccctgctggcctcggcactcacagagggaactgaaggcgcccagtggcacccgggacggggcttgggggccggggagagggcgaggacccgggcagtgcaccacgcacctgctgg

SEQ ID NO: 46994 - DNA, 1059 bp, Bovine  19866880880199
acttggggagggggtgctacagattaaggtcctacttcagtggcaggtctaccttatctccccttcaggtcatattctcaagcaggataagatggggataagatgactaaaagttttcttcctttgcttacccacagccctataataggcttctgctgggcttccttggttgctttcatcatcactttcaccaccagaggtcagggaaaccttccgatgaatcaggggttctggaaatgatgcagaaaaatactgacttattaaaaataataaagaacacttatttagggctcactgtgaactcattgcttaaaatgtcatatataatctttacaaccactctgaaattggttggggtttcccaggtggctcagtgataaagaatctggctgcaattcaggagatgagggttaactccctgggtgggaagatcccccagaggaggaaatggcaacccactccagtattcttgcctgggaaatcctatggacagaggaacctggaaggctacagtctatggggtcacaagagtcggacacaactcagcaactaaacaacacaagaacgtgaaactggtattgacaaacaggtatattcaaaataagtctatgtcagattgtgatatttttagggttcttatgtctttagattcgtcttggcacccaacataaggcagttcaacacaacgcccttgccctaaacagctccagatgccaagaattggcaaattactactttggtttcaatggatggtcaaaaaggatcatcaaggtaagctctagattttctttgaccaaccaggcccctttcaacattgaactccttgactttagaaagaaaactagaactgggctacagggaggagatggaaaagacttccatgtggaagtatctgagcatggacatgccacctagaattcgtgatcattctcagtgacttaaatggcagtgtccataattttctccagtatttgtgtgatgtataataaaaaatagttctctgtacctagtaattcatttgcaaatctcacttgattttgaagctatatgacacctcaa

SEQ ID NO: 46995 - DNA, 2488 bp, Bovine  19866880894731
gtaaaggagacaggtttggggaatggacagacctgtattcttatcccatgcatacattgtgggaccttagggaagggacttatacttctttatactttcctattgaaatttaaattcagtttccacattagtaaaaagggggaaagcctcttgggtttattgtgaggattaaatgaggccatcttgggagtgcccatgctgctgctgctgctaagtcacttcagtcgtgtccgactctgtgcgaccccatagacgacagcccaccaggctcccctgtccctgggattctccaggcaagaacactggagtgggttgccatttccttctccaatgcatgaaagtgaaaagcaaaagtgaagtcgctcagtcgtgtccaactcttagcgacctcatggactgcagccttccatgctcctccatccatgggattttccaggcaagagtactggagtggggtgctatcgccttctccggcaagtgcccatagtaggtgattaataaacacagtgtccaggtatcccctctaccaaccttccagaagaatctctccaatgcagcctctgtcctgaccttgtctcctttaacctggcaagtctctaacagctctataaagagttcatttctcactttggtctccccttccccaatcttgtttgctcccccagccagctaacaggaagaggacatgctctaggtggctggcagtttgaagagaatgctcgattgctcactcactccctgctccccagcccctccttgggtgactcctccctgtccgctgctatgggttctttctgaatcgtggcacttaaaagcctcatggtcacatgcagggcgcaccccaagcttcttatctgggcattcaccattaacagccccttctccaatgttaatctacccccatcccgtctctcttgctgccattcctgctcagccttctataccccccatctcccacctcaagcatgcccctcggctgagaacaccctcctccatcttctccacccagtaaagtcctgctctcctttcaaggcccacctccaatatcaattctctctaataaagcctttcagacccatttctctgcaggaaattgctcaacctccgggctggccatacatactgttcacaggggcagcgggatggagtccaggggtgacagctgttcagctctggcctctctgggaggagggcagatatgactggcctcctgtccatttcccttctcccctacccctgtccaggcagctgaacataggcgcagagccctccatggcctcctgtgcttgccccaccccccacgtgggctctgagccccagaggtagcaggtgtacctttcatccggcaggaaggctccgactccaccccacttggctgggtgcgaagctgtgtagtacagatggggatgttgaaaatatccgtgacatattccaaactggcctacttccctatcacgagagtctgagacagagacgggcgaggatgagtgagatgggagcttgggacctgttcccacctccttcttcctctcccggctcacttgttagacaggagaggggtttgcaacctctttcagccatctcatcccggttctggggccatgtagttggggtgtggtggggaggcaggcttggaggagtgaggctacagtgggcctggggaggtgggtagaggaaccaaagcctgggtcctctcttgggaagcttccagcctcggaggcaggacagtggaggccatctcattggacctgggggctgaaggcttggattctagccctggttcacctgtgaagactcaggcaagtttcttaacctctctgggctttgcttttctcatcagcaaaatgagctactcaatccttgctttccctccttgaacacttgagtatggggttgctttgaagactgttaagggccctgctttaattaatccacttctcccgcctttccaccttggctaggctgtgccccgacatagtggtttaaggggtcaccagttccagcctttggcctcccagcaggcctggcaaggcctccacccttaatcctggcttaatgatccctgagtagggagtcacccactgtccctgcctagtgccaggactgtgccttggacaggaagttcacagtgggagctaacgtcagtctctcttgctgacatggaaccctttggatgtcctctggcttgtctccttcatatatgaaatgatcattattttagattttctcttttggggctagaaagagaaagtgaagccgctcagtcatgtccgactctttgcgacccaatggactgtagcctgtcaggctcctccatccatgggattctccaaacaagaatactggagtgggttgccattttcttacatccccttttcccctgtttctcaagatgggcaggatccttggggcatttttctgattctgagaagctgaatgtcttcctgcttacagatcccttgcccaattttggattctcccaggaata

SEQ ID NO: 46996 - DNA, 1734 bp, Bovine  19866880912372
ttctttactgctgagccccagggaagcccatatacatagacacatgctgtgctgtgcttagtcgctcagttgtgtcccactctttgcgaccccatggactgcagcctaccaggctcctccgtccatggggttttccaggcaagagtactggagtggggtgccatcaccttctccgactcactcactgcaggctcctccataggtgagatgggccttgttctctcccactgatccgtaacacacctgctcacgcctccaggttgagaactgctgccctacatgatcaccatcctaacttgactcatgcagctaaacatagtgtgttgttaaaggttgacaaggagacatagtaaagctacattgtttttattcttttttcttttaaagctttttaagtgagagtactactcttaatactcacattgaacaagcactggatttccagatgcagggtttcttttggctgtgctggtcacctactgcacagccctggcatcccaagcagcgtttgtttattttagctgtgccatgcagcatgcgggatcttagttccccagctcaggactgaacctgtgccccctgcactgggagctcagggtcttagccgttagaccaccggggaaagtccgtaagcagagtttttcatacttgagattctaaaactgggctccggggagggcagtgtaagggttgtggaataaactcagtgcagcatgggtaaggctgacccatcttgcctttctgactcagttgcaggtagatggcaggccctgcccgggttgtacttactgcacaaggataaggaatcagaaggagtagtgaaagtcattttatgtcttccttatgaactcttctttatctttctttcccttttttctcagcgacatagtatgcttaagcaacaagatctaagtattgccatggtggtgacatcacgtgaagtcttgagcgcactttctcagcttgtgccatgtgtgggttgtcgtcgcagtgtggaacgcctcttttcccagcttgtggagtctggaaatcctgcccttgaacccctgacagtggggcccaagggagtcctgtctgtaactcgaagctgcatgactgatgcaaagaagctttatacattattttacgtacatgggtgagtataatcaattaggaaacaatgggtttgcttaagtttttaaactcagtgacagtgggtagcttttttctaactttggggcaaagcttaagttcagatttaccacaagtaacttctgtgtgccagtgactaaagtttcttttcttgagggagagacaggcagtaaacaaatatatactttgtgaagaaagttgttataaagacaaaccagtaagggagatagagaatgagtgggtagaactcacgtggagagtggtcagggaaggcctctctaataaaatgacattgcatataggctagaatagagtgagggagtgagccatgtagttatttgggtgaagcagagaaagggcagcagggtaaaggttcagagattggagtttccccggcgtgtttgaagaatagcaaggaagccattgtgactgggggcagatgaatgaaggaaacagtaataaaagatgaggtcagaggagcaccgagaggcctaattatgtggtgctatgctgaggtcttttatcttaactctgagacgggaagatttgggaaggttttgagcagaggagtacgtggtctacctggagttatgcttcctttta

SEQ ID NO: 46997 - DNA, 1762 bp, Bovine  19866881036478
caacagggcaccttcatatgtgcttgtgcagaacaatctctagtttatgttgctgagtgtgtattgtctgctgccatttggataaaacaacacaaaagaaatgcttgtgaacatataggcaggccctgaaagaccaaagaagctgggaatgatgtttgtttctgggcctggagctgggtgactgggaacagaggtagtgacagggaaattgacttttccttttgcaccttttgaattttgcatcacatacaaatagaattttctattaaacaaccaatcaaggacttccatggtggtatactggataagaatctgcctgtcaatgcaggggacacaggtttcatccctggtctgggaagattccatgtgctgcggggcaactaagcctgtgccttgctactgagcctgtgtgcctggaacctgtgctccttaacaagagaagccaccgcagtgagaagtccgtgcacagcaaagaagacccagggcaaccaaaacccatacaaaacaaacaaaaaagaaaaccagtcaaattaatttttccagcccttaaagtcttgtatgtattaatatttggccccagtcatataccagtggtttttactgagaaagtctgacctctaataaggcgagtgaagtcatggatggatggcgcagggagtggtatacaggcctgggtcctatcttgggaagatgcctgaagctcccccagcatggaaggagggcacatagaggcgcagccacaggaggaccccagagaatcagggcagcaggttgccctgaatccacaagcaccgatgctctggagggtggagaagacggggggaccaagaggacgaaagctctgtccctagagaagcaaaccagatggtcacaaataaagctaagtgagtgttaagaaacccagggggacagggactgtcagctagaatgtttgtgtccaagtgcctgtgtgtgaggagggcagggctggaattgggaaggctttattgaagacgtggaacttgagctgggcctgaaagtgggtatcaggtgtctacaggtgcagaggaaggaaaggacaaccccaaggtggggagcagtatggacaagggcatggagtgtaaagggaagacacaggacgtgtgtgtatgtgagtgttattgctggaggtagccagagatgaggctgccaagaacggggctagagcaaaacatttccagctgtgaactcaggttgttttttataaaacactgcaaaaatggtcatgcactaggaagtgtggcaatgtcaaatcatgataaagttttctcaaagatgagtcttcatttctgtactcatcttgtggacaacactttgagaagccctgccctaggggtcctaggatgggctgcagaggtcagggaggcccacagatttcttgcagctggtcatgtatattcatttgtttagggaagggggcaaagcttttgtcaggacctcaaaaggttcaagatctccaaaggacacaaccctctgctctagggaatggtcactgaaggtctttgagcagaacgatctagtgaggctttagagctgaggggagcagaaaatgtgcctgattcagcctgagaccccttccttccctgcccatatccagagaggctagcccagggccaagctcaagggaaaaggatttggtggggagtcaaagatgccagagaacaaggggcccatttagggggtaattaaaataatctgtgggaaagaaaaccagaggactttttcaagctatgtttggagcaag

SEQ ID NO: 46998 - DNA, 1901 bp, Bovine  19866881072452
tggagtttggagaggtcggggaagctgagttctaggcttcagtctccacctccccttgctccagcagggacacgggaatccggagggctgccaggacgttgaggctctgtctaaatgggcggggagaggggttgggggaggcctgtctctgccgcttccgtgtctgtgggagggggacaagaatcagggtattgttggggaccggtcggagggtcgggatccccgcgaggactgctatgcgccggtatcttcatctgccttgtaaacttcgctcatacgaaaagttaaaacaagacacagacgacaagtctcacttaggagtttctgacgaattgccttttctgacaagagtaaaacatcaaggaaattaaatgcaaaaatatcagcccaagccatgcgccagtttttggaatattttgagtaattgctttcggaaccgattttggccgaggtggccgaccgtagtttcgggtttcgctggacgagggtcactagaagaaccgtcggtctctgcgtctagggatggtcgacttggggactggggacaaggaacctttgttcgggtctttaccgcttgcgggtgcaccgcccgaagcttgcgggatggacgggttgtacgtttggtttagaatactagcaacatggtttcgtttaagtcacccacaaccctttggggtgttaataccctccattttattgatggagtaactaaggttcgtaaaaaatgaagtgacttgcccaaagtcacgttttctgacagcggcagagcggggatttgaacctagtctgttctccgctagagctggggctccaccaccatgtgttcaccgaatgccagtgtcgaactgggatgtccgcccatcataactgttcccgtctgaggtctggggaaacccggtgccctgcgggctgggcgggattcgcagggggtaatcccagggctgagctgtcaagctccttctccatcttccaacatcttccagacgacctactatgtgccgattcacgggaaaaaagcgagcaagaacagtactcggccaacaagtggttcaagttcattgcgctctccttggcttcacagagcactgatctgggatgtcaggctgatcctggctgtgcagtttttggcgtgtgacttcacctttcagaggctcaacttatccctcttaaaaggggcgttaaccccctctggcaagggctgcagtgaagatctaacgaaaatccttttgtaaagcgctagggcacacagtaggcgctcaatccctgctcttcccctctccacccctctaagggttccagggcagcgcgttcccgctctggcttcccgcctccggcacgctcgcccgcctagcgcgtcccgcggctgagggactggggcagagaggaccaaacagaaaattatttccgcccgctcggcccgccccgccccgccccgccccgcccgtccccggagccagaaggggattgtggggctgccgcggccgctgccggagcggagcggggcggaagcgcgcatcgcgctgctgctcgggcccgaccgcgccggcccccgcacctcccggcccgggactgcgggttgtggtcggggtggtcctgggatctgaggcggctgccgccgatctcatttccacgaagccttgttcgctcgttcccggaacctagagggggaggctgaagagtgttgaggtttctcttctcctagctggccgggcgcttggtttcgccggtcccgggggcgcgccctccgcactagaaagccccaggctccgggaaaggattgcgctggcgcccgcgggtttgcattttatttgcgtcccgtttgcttatcattttatcccccgaaagcaaagcttctgaccttggggacgttcagagaggttaggttacttttccgagataac

SEQ ID NO: 46999 - DNA, 1261 bp, Bovine  19866881274391
tcatgcactaaagaatattttaaccattttctggaaactgaagggagttctgaataggcagtttgagaatgatgatgatgatgataaagcatcctttatgttacaactgactaaagactttgtcaagctcacatatttaaaattcatataaaactataaagaactcttgtgaagatttaaattaaggggcagcatgaaatgacatggggtttaacatcagtaagtttgggtttgacctctagtttccatatttattgtcatgaaccttaagtaagtcagttaaccatcctgagttcgagtttctttaaaaaagaagagaaaagaaatgggggtgaggggaagaaatggggagctgtggggggcggtaagtggagcaatgcatctcaaagcattctgtaaatgctttgagtgctttacaaacgttggcctattcgttttaaattcagcacttcatcccagcggagcgaggaattccacatttggacccaccttcactggagatttctggaaaagctgcttctggttgcatgccttttgggctctgtaagcatccctcgctgaataaaacttgatgacggcataaaatccaggaccggccacggctgcgtttgggaagactcggaccgaatacagaaggccgaaatgggagaagactgtgaacagagaatgctgtagggtggtcccacgctaagtaagagcaggaaatttcaagcccaggaaacaaaattgcccattcccttatattccccccagcccttcgccacaggcgacggtggtgagcctccaactccaaacacttctcatttcacaaacaagtttccctctgaactgctaagcttcgagaagcattaggaggcagtgtgaggcctgctgggagctctctctcaaaaatctgtaaggacgagttgactgctccggtcggctctagagctaagattcctctcagcaaagaccacaggcgggctaggtgctgaagcagcgcccccggggctcccaattactaggacgcgaggcgactttctccatccctccctccaccccggcctggctcacttgcaaggcctcggccgtgggtccagagctcagttcccacacaagcaaggttttgtcactccctgtgggaaccgcaaaaggtaccaactccgccatcctacggtcaccgcgcgtgcgcggctcgagagcaagccgcactgcgcctgcgcacggcgcgcccgcgcttttttaaaaggagcgcgtgagggggcggggccagctatggggg

SEQ ID NO: 47000 - DNA, 1434 bp, Bovine  19866881380165
ggatcccttggtctagccccctttagaggcgcccaaggcccagagagggcaagggacttgcccacagtcacacagcacggcagctaccctacctttgtgttcattttcctcacctggggacaaaatgcctgctacctgatgagaaaattaagtgaaaacaattagctctcggtgctgccgtctctggggtcgcacagaatcggacacgactgaagcgacttagcagcagcagcagcagcagcagaggtgaaataaacattagagaccttgattgtttcttactctcaccaggttgtcccttgagaacctaccttctgtcccaggagaacagaagtttctactgtttctcctccttttcatctcagggggtcagaataggcaagaaggacagggcagtgcttggggttggagatgattcaggtacaattacagtacctggttgggggcggggagggtgcagcagggtctcctggctcccctccagcttgggagccagactgtttgtgggctgcccagtttctgcctcctgtcaaatttccaaactgcccccatcatcgctaaaggcactagctggtgtcccatccacgtgggccaccatttctgcagggccctgctccctgcacgacctccctgaccagccaagtctctgctctcctcaccagggacagtctttgttgttcagtgggaccacgtctacctccagggtcgggaggacagaggcagcttcaccttccaggcggctctgcaccaagacggccgtattgtcttcggctacaaagaggtgagtgggccattctttcattcaacaaatatgtcgaggccctgtagtgcgccagacttagggtgtggtgctggagataaggaagttcacaggatggctgctggcccatctttgtggagctgagaatctggcttgggggatagatagtaactgtgggggcaagtgctcttaaatagtgatgccaggaaagcctttcacggggctctttacctgaacaggagcctgggaggctctcctgaggaaaagagttgaaatcttcagaacgtgtaggagttaaggaagcaaagaggagggtgaagtgtgttctgggagggagcaaagcatatgcaaaggctcagtggcaggactgagcatggctggtataaagcactgaaagaaggcggcctagggatttccctggcagtccagtggttaagtgcccgtggtatgggttccatctctggttggggagctaagattctacatgcctcccagctgaaaaagcaaaacagaaacaatattgtaacaaactcaataaagaccttaaaaatggtccacatcaaaaaaaaaaaaaaatcttgaaaaacaccactctggcttcaaagtggagagcagagggctgggactcagagggaatgctgggagatgatgcaggagaacgggccagcttgggg

SEQ ID NO: 47001 - DNA, 1056 bp, Bovine  19866881385623
caacccttttggcttaaaaatgtacatcagtttccagcattgctgcccaagtgaggtttggtcatatcctatttgcctgagccccggattaaggcaaaatgagaagggaggtgctttcagtaggatccacagctggggggtgtgtggagtaagggagaggcagtcctgggtgggacagggagcagagaaagcacacttaatgaccaaacagcattttgatttctatgaaaatatttaaagctttcaaataagctatttcaccccactcccctaggtctgtctcaggggtctgtagataatcctaaatagcagctaagcaatagctgccaccagggagccagaggataagtgcagttttcatttccccttggggtcaaatccagctgagcggatggcccagatgtacaggattggctcgaagggctgggcagagaccatctgcagtgctagccatgtagctgaacactggctgagaattagccagaccgccccttagtctctaaggctgcagtgtggctaccagagcagccactgtcttttccttacctgtctactattaatgtttagaaatgttgaaaaaataaatttaccgtaacaaataagctagaaacaactacagtggtcaagaaagcattctttattttttccccatggcttatttcacagctgtgattacagggacgacttttctgttcccagctagtccattctcagtgggattgttttcaggtgcagaatttccattggttcagaagctatgagggcttcccatgtggctcaagggaagagaattattgccaatgcaggagacacaagagatgcgggtttgatctgtggctccggaagattctcgagtaggaaatggaaacccactccagtattcttgcctggaaaatactatggacagaggacctggtgttctacagttcacggggtcatgaagagtcggatacaacagtatacacacacacacacaagctgcgaggctgagaattcagcccagggaaagaatacactttaattactgatactggaaggcctggggaagggctccta

SEQ ID NO: 47002 - DNA, 953 bp, Bovine  19866881421317
atctctctttctctcaatcttgcactcactagccccattagaggccaggctgttagatacctccttgcctttgctcatgctggatccttctggctagaacgcccttctctcccttcttcactatcccacttgtcccagcaggcatctttcaagccttggcaagcctcacctccttggggaagctttcttcccttcagagctggagcatctttagcggggcagggactcagcccacgtttactgacggagccctggggtcctccataccgctcatgagcaatcccagacataggaggaaaccctgtgcatgcagggtcacagagaagcaagacataatcatgctgcctgcatccaccacctttcattcattatgccagcccctacctggacttcaaggctcagctgggggcaaggagaagtgcccacctttccaggatggggactgtgctcccaggctctttcttgtctgggcaagtagccatgacacacgatagccttagttagaattcagaaagacccagatttaaatttggatgctggatgacctttggtggagtaatttagcctctcagggtcttggttcttgttatttgtaaatgtacaaccacttcacgacagtccttgaaaattgatcagaagaggtttcaccaaagaattctcaacaatagatttggaaagaggagatgagagaaaggagattaatcatatcaccaactggtttttaaccaatccctatagaaattctacccagtggcactgtttccatctttaaactcccatcatcacttttgtgaccacatttacactgaaatgatgtccgcgggtgaagacaccatttgtgtcttctgtaggtctgtctctctgggtagatctggccaattttcagggcaatattttttggggggtggcaagggggtgtctgcactggtggatagtatacgtgcacatctcag

SEQ ID NO: 47003 - DNA, 918 bp, Bovine  19866881551325
gcactgtttaaagcactgaggttgcagaagtgatcaagacaaacttctcatcagctcatttccagactaatggaagaggcagataataaagagaaatacattcacagattttcatatattagtgagctctaacacgaaacaagggtaagaggatggaatgtgctgcgggtacatggtcctcccttaaccaggtttttaatggaattcactttctttgctttactctccctaggggagataagagtgagggtctatgtatctcctcctagggtcccctcaacctattttggcagttcaagcctcacagggcataatcttgggatttgagggggtacggcagagccagcccctcagaatttgctcaaggggccggttataagttaagtgagaaatggaaacaggtactgagaaagtctatttatcatctttcgtgggtgtaatgatactcctcctcttcaaatttaattcttccttttttcatcttgcacacacactcactgaattcctaactattcattcaacgttttttgagccctctgtgtaccaggcactgttctaggcgaccgaaacagagaggtagggaatgttctctgcccacaggagtccttgctgtgcaaagctgctgaacaacctcttttcatcttttcttttaacttcgctttgagattcacctctgtttgactcacgcagccccaaaggggtagatgtgaacattcccattttacggatgcgaaaaccatgactgctgaaggggaaaatgaagtgctttggcggctactaaacactgggacgccactgcgccacgtgcagcggcgcatttagcccatcgatatcccacccgcgcactcaccctccttccctccctcccagccgccgccgcgccgggtccacgtgtgtgtgtctgtgtgcagaatgggg

SEQ ID NO: 47004 - DNA, 1098 bp, Bovine  19866881901530
cccacgagggaggggaccaaaacagaccaagaaaagacgaccaccccatataaaaagatgaacggacggcttcacacacacacacacacgcacacacacacacagatgaaatgtttggacagaggcaaatttcacgtgatcatttctatttctttttaaatacaggtttgtggggtggtattttttttttccagctattaaaaaaaaaggcccaaaagtgcatatgtgagggggaaaaggcagaaattaagcaataaagtagttttccctggagggacatgaggaagaaaacaggaagcaatattgagagaattcacttttctcagcactgggcttcttgcattttattattggtccgctaaagttatattcacattctagctttgttgcatcttctttcctgggattagattggcaaaaaaaaaaaaaaaaccctctgtgaactgtaggaaaaaccagggactcggcccagccctcaggttctgtgctctgctagggatggatgattgtggaaaggaataaggactctcagcagcccctaggtccctcagcaccagtgtgatagtccctcctctctctgggggtgtgtaagaaaaggtcccctatttttaggatggaaggaaccaagggttggcagcaagattccagtggctggcttgccttgttttggaagaaaaattaggctgaatgaaaacaggctacttgttgctccccagccctcctcccagcctctcacttccctgccaaccacaggttctccaacaggatatgtctctctgacctttggttccagaatccacattgtgctttgagattaagaggaaatagaatggactagcatctgcccacggctcccaaaattgttccttctctgcttccgtcatcccccacactgcccaatataagactctccacccgccctcaccatggctgtggccaaggagggaaagggattggtcaggcagaggctcaagcctctgatctggggtaaatattcccaagtcaactcacaagcagtgaggactagatgttaaacgtgcctgcaggcccctccctctcctgcaaggcacaaggatgcaaagatatcaaccgtagggc

SEQ ID NO: 47005 - DNA, 3017 bp, Bovine  19866880094597
cagcttcttcaacattactggttggggcatagacttggattactgtgatattgaatggtttgccttggaaaccaacagagatcattctgtcgtttttgagattgcatccaagtactgcatttcagactcttctgttgaccatgatggccactccatttcttctgagggattcctgctcgcagtagtagatataatggtcatatgagttaaattcacccattccagtccctttcagttcgctgattcctagaatgtcgacattcactcttgccatctcttgtttgaccacttccaatttgccttgattcatggacctgacattccaggttcctatgcaatattgctctttatagcatcggaccttgcttctatcaccagtcacatccacagctggatattctttttgctttggctccatcccttcattctttctggagttatttctccactgatctccagtagcctattgggcacctactgacctggggagtttctctttcagtatcctatcattttacctcttcatactgttcatgaggttctcaaggcaagaatactgaagtggtttgccattcccttctccagtggaccacattctgtcaaatctctccaccatgacccgcccatcttgggttgcaagagggtgccctcatgagatgaccgcaaatcaagaagactgtcattttaaagggttatcttctcttattctacacaacaacaatgaatcatttcttgatcagattgtgaggtgtgatgaaaagtggattttatacaattagttcagtggttggacctaggagaagctccaaagcacttcccaaagccaaacttgcaccaagaaaaggtcatggtcactgtttggtggtctgctgccagtctgatccactacagctttctaaattccagtgaaaccattacatctaagaagtatgctcagcaaattgatgagctgaacagaaaactgcaactactgcagccagcattggtcaactggagggcccaatgtttctctgccataatgcccaacagcatgtcacatgaccaatgcttcaaaagttgaatgaactagtttgaatgaggttttgcttcatcaaccatattcatctgacctattgccaaccaactaccacttcttcaagcatctcaacaactttttgcagggaaaatgttcccacaaccagcaggatgcaggaaatgctttccaagagttcatcgaatccgaaggtacagatttttatgttacgggaataagcgtacttttttctcgttggcaaaaatgtgttgattgtaatggttcctactttgattaataaagatgtgtttgagcctagttatactgatttaaaattcacggtctgaaaccacaaatacttttgtaccaatccaatgtacccaaggttttttttctttgctgcgttttagatcaagtaatctgcaattaggaaaaatgagagagagaaagctggaaatgggaagtaggtgttgacaaaggtcagagtttaagtcctatgtacactatgattcacgtactcatttaacagtgcagaccaggcataaattactgaagatttctttggaatcagtaaataacaaatgtcttcggtatgtaatcaaaataactaattattttagtaatacccaaagttctgccattactaacacatgttacactaagaaaagagatttactttagtgaattctacagttcactgcagtagagagtctaaatggtacataagttgacttactggtataggtaaactataattctgggattccatttacaaaaggagagaatcacatttttcttctctgaataaagtgaaagaaacagccacagaactagggagaagtaaaactgtctgtttctatatcaaaaaggacattatgaaatgaaaaataaaataaaatgcaactcaaaatcaaccacatgttagaggatatgtagcaaagacacttcatcctctctaatttaaaagagaatcagaatgatttctcctgtggatgtgcctgccacagagagttttggctttcaaagaaaaggatattgaatatataaagctagaggaactttaaataactgttcctggtctttagatctgtatctttggcttactttcagctatcaacttatctaaacttgactgatctttcaagatctattttctccatggtcttctttcagcatgtcattcccttgaacacttaaggaacatctcccatctctgaactccttgtctatcccacagacatggtaaatgtcttcttaagcgctgtttgttgaaagaatttattagtacatgactgccttggaccaaaggaaacatctttctagaattgcagcactgataatctgtcataagattttaagccatcatttttcatctctaactctttccaggtttgttgtattttaacatgatatttatacaaaatttcaggaacaaattttctttgagaaacttatcttcaattctaagacataatcattttcctgttcttctaatgaattcctacatacactgtattaattcagtagaattagaatgaaagtggtttcaaaaaagatgtctacactgtacacaagaaatcttatttttaatatgatatcaagatacttttacagaagaaatggtgaacttttttttttaaataataaaagtaatacatacacctggtaagaaaactcaaattcaaacaagggtaaaacaaaccataaaagccatccattcccacctcagttctactacctaatggtatccattagcaagttccttgccaagattcccagaactgtgtcacacatagacaagcaatttttcaaaagtaatttctcaagtaaaattatccaaaaatttaagtcactttattttaaaaagaaagtcgtattcatactacagaaaatacctcctgtacgctatttaaaatctaaataagtcagaatgcctagctggttactggcaaattgagtatttttcagctaaaatacatccaatataccaggtatgttgtatgaa

SEQ ID NO: 47006 - DNA, 2176 bp, Bovine  19866880382654
ctgcagaaagttccactggacagggctgtcctaggctgttttctccttttcacagagggacccaaggtttttactttaggcgttaagtcaagaagaactcatgttactttaggcacacgccactgtggagggcaacgtgaaaggatgattgccttctacaccagacccagggccccacattatacacatccagggtaccattgcagcccatggtatgtgagttacatctcctggcatccttcagcatttgtcctgtatcatggctgcctatggcaaccctgatcatcccaaatttatgatttcttcttctagtgtttgatgtcatgccctcagtattcagggcttccctggtagctcaattggtaaagaatctgcctgcaatgaaggagacccagttttcatccctgggtggggaagatcccctagagaaggaaatggcaacccactccagtattcttgcctgaaaaaccccatggacagaggagcctggcaggctacagtccttggggtcgcaaagagtcagacatgacttaaagactaaaccacctcagaattcaggaaacaaataaggatcttagccagccaagctcaaaagaaacctgtagaaaaggacacaacatcatcatccagaggaatttttcaattaacttacttgagtgaaggtgctctcttgtaaaatactcttcttactcttgcactggcatgctttcccttccaaatctcattacaaattcttctctaacacctactatttactcaacagcagaaatcaactcccactcagaaaacagctatgcattgcctcttaaaaactcctaagtatcagatgtaggtattttataaaaattcaaattacacgtcagcattttagatttcctcctgtaactttctttccactggtgtttgattgatcaggagaaaaaagaacgacagttgtgttcctcacttctgacacagacaccctcccaccatgaccatccacctcgggttctctgaaatgtgctatgtatacttaaatgctctgtaataggttcttttctcattcgcttccgttggaatgaaatgcttccatatggctccagggcattaaaaaacttagcaaaactttgaaaataacaaaattaacataaaatgaccttataatttaaaaattgaggagcaccatccaataaagcctaatgccatgctaaaaatactctcagagtgccagaaggtggggtgacagctagagaggtgcaaaggaagatatacctcgatggaggcattcctgcgatttgggagacttgaaaatggtttttaagctaaaattttcaaggtaacttttctacacatggttctctctttcttaccccctttactttgctgaatatatccttttgctcggactcagtataagggggctatgtttttgaaaacaaaaaaattctttttctttctttctatagagatgtatttacacccagctggaggaaaaagaataacagtattaaaacaaggcaagaagcactggaaaacacttagaaaccatgattcttggtctaaaacccacagaagaaatcttttagcagaacaaaaagaaagataattccagaaatgtagcaaccaatttgggaactgtctcaagtgaagtgtgtgtattgagtcagcaaacacataaatcaagacacaagttataaaaaccatacaataaatgtgcagcaaatgagggtggtcctcaaacgttatccctgtggttagacagcaagtgagaaatctacatgaggactcaaacatgacaatttaacagaacaggtccagattaggcttttctgagcttcactgaccctgagtaccactatataccctctgtctccctgtccagaatgttgacattgcaaatgactggattggtgatgaaaagtaatgtgttcacttaccatatgcttatctgagactaatatttcattaatttttaattttaaatatgaaaatgcccatggcctttctccaaatgaatactcctaactcactctcgttttcagtctttactagtaagcataagtgaaattcattggtctaaatacaattaatgcaaccattggtccaaacaacaaaatgacttgtgacaacttctgaaaaaacttatgaattatcaatgatcaatggtcatctttaatgataattaccagttaccaat

SEQ ID NO: 47007 - DNA, 887 bp, Bovine  19866880437583
cccctaactgcttgtttgtttgtttgacttaagtaatcctgacttcctagcataacacccttggattctgaaaatatctccaatagcagtttacctgatacatatgcagatttcacattgttggtaggaagcaatccaagccaaggtttcagggaaagatccgttcagaggatggacaaacatgaccagctgcttcctggcacagaagactggaaacccagcctactgtacggagctcaaacacagcccactctctccttcagttctgccacgtgtgtgtgtgcgctaagtcacttccgtcatgtccaactctgagtgaccctatggactgcagcccaccaggctcctctgtccatgggattctccaggcaagaaatactggagggttgccatgccctcctcaaggagatcttcccgacccagggatcgaacccgccattctttagggctcctgcatcggcaggcagggaatttgccacttgcaccacctgggaatttgctatagccaagtgtaaaaccatttatttatggtgttatgaagaaagaattcctatctacaagtttataactctcactagaagagaactagagttgtttctaaatattgcattagttggaacagattaggtttagtaataaataagcccctaaatcaatgatagttcaaacacaagacaagttaatctctcatccacgtaagagaatttgagcattttgagcattactttactagcgtgtgagatgagtgcaactgtgcagtagtttgagcattctttggcattgcctttctttgggattgcaatgaaaatggaccttttccagtcctgtggccactgcgagttttccaaatttgcggcatatgagtgcagcactttcacagcatcatt

SEQ ID NO: 47008 - DNA, 2450 bp, Bovine  19866880483311
ctgtgtactgacagaagccagagacagaatgctatcagaaagcaaaagtgctccctttctaaagccgctgccctccctcctgctgggaacagcatcaccatggtgaaaccttggcggggcagggttgatctgggcagaagggctaccccctttggcaagaatgagctgaaatctcttctatgatggtccaggcctccagcgtcacgtcatctactctgcatcactcagtgcaaatggctgaaggagcctgaaggaggcccagtggcagaaaagctgaggccaccagagtgactcgttgctttcttagaactatttttatcattttattcctgcttaacttcacgtttttgtaaatccttatttcttgtcacaaagaaataaaaggggtcatcaggaaatggaaacaaatgttgcagaagccagagaacatcacagtcaccagctttaaccaaaatctaaaggtctttgggatgaaaggggctgaacagtgaagactcctcaacatcaatttaccgtgtgacttggacaattttcaagtacgttctgtggtagactatagctgaggacaagtcttcggaattcagacaattgaaacagagactgaaataaagaaggaaatggattaatagcctttctttcaaaataactgcagcaaaaaaatattttttatcttaaaaatatgtgtataacccattaacttggtaattctattctaaggaaataatggctatgtataaaaatttacaaggaagaatattaatcctttttagagaaaaactagaagcaacctaatggctaataggaaaagattacataaactacagtgcacctgcacagcagattattatacagtcattaatactgtagaaacaacgttttcataaaacggacacgtacacagtaaaaacgaaggctccaaagtgacatgtatcaacatggatgcgtctcagaaacatcccgtgtagaaaagtaagagtatatgctgtgtacatgaagtttaatcatataaaacaacacggtacactgtttagggttacatacccctgtgggtgtatctaggaaggtgcggaagggcacaacagggactcaatagtacagggatttgaaacatttctttctaaaactgggtggtgagtacagctgtgttcattattctccactctgtcgtaagtactgtattttaagaaattataataatagatatcttggactggcagaattagggaaaggaattcctttttattgcttgtaaattacacatttttccaactatgactaactctcttttaaaagttgatgttttaaaaaacctcttgtatgaccctaactcctcatcccaacatactcctccagtgaaaaagccttccagcccacagaccggaactcttgaaggggcagcctgggtggacaacaggcctccaacctcccacactccatcacaagctctgcaggtttcagccaacagtacacctggactgggaacatcacaagctccactgggattcagccaacaggaggagtggacacctggcctggcaacttcagtcaggtgaggctgggatagcaaagttctttctggagccaggccttgggaatgctcagctctgcttgccacctgctctcctctcttcccacctcccctgtctacctagcccatctccactcctctcagtttcatccctgttctgctaagaggaaagttccaggagttctcttccaccgtgagaaaaatggttttacattcccaagtctcctcactgcatgttttgatcccatgatctctaaccacccttcattaaattctcaaactgccctttcgttctttcatctaacccagcaaatcctccaacgtggatgaacttaattttccacttaagcagtgtggagcaccgccaagagaaaaagtctcgataaagcagggcacactgataccactatgcgtttaagtctataagctcaagcagagcttcgtatttttagaaattctactgctgtggtctggtgccaactggtttcccgctgttgacaactctttttaactttcaccctcttaaagagattctgtcatcttttccacgctgtctcagaaagtggtgcttatttcagaggaaaaaatgacaatttaggaaccatttcaacctggagttagcagtcatcacttcttccttgtcctctgctgttactctgctgccctcttgctactggagaccaagccctccccacacgctccttgtcccatcttcccatgctttctctgaaacttttctcagttgtctcctcatcatcatctctcacaggagggacgtcaacttcagggcgggggtttcagtcttggtcaatctctctccctctctttcaaaaggaaagaactgactggcatccctaattcccaatgaacgccctatagcctgttctcgacacagaagccagtgagccgcttaaagcggaag

SEQ ID NO: 47009 - DNA, 2416 bp, Bovine  19866880590534
cttctacttctcctgacatctgatctaattctttggggccgcctctgaggaagaacaaagacacagttaaaacagagtcccaccaagcaaaacgtctcaaggaaaccaaagctcctttccagaaaaaaagaaagtaagacactttgtcttttttcttacttttaatgaaaaatacgcacataacccatccattgtccgaagtgctgacagtatcaggccaatagtcatggtaccctagtaacagtggctggcatattggaagggagggacactgaatatttgttaaatgaatcaatcaatggtaacaagtgaggatttggaatagaggccaatcacagacaaagcagcaagaacaaacatttcttgggaattcagaaaatcattagattcaatggaaatttcaagataaacagttttatcagtgtaaacagtgcccctattactgttaagaatatccatctccaggacttccctggtggtgcagtggttgggactctgagcttccactgtaggggacatgggtttgatccgtggtgagggaaataagatctcacatgcaatacagtgtggtcaaaaaataataataataaactgaattaaataacaaagtatatccatctcaagatggttgaaaatgaaaaccaagacatttatactgccttaaagttcacataatcaagtgctaccacaaagcaaagggatacaaaggttagatcaataggtcaataatacctggggttcactaaaggctatgatgaaaaatgacaaggctatcaatgacatattcaatctcatttccaaccctacaaccgaaacaaatcataaaaacctacagaagagtagcacatccacatactggttgctgttaactagtctttcagtaaatgacagctcccactttttgtctatttctatagatgagccgtacccgttataacaaggcccctatataccacccacagccagcacaatcatttgtacagaaactcccacgagcagctgttcctgccctcacactgcaaacacgcaattaggacgatcagttactgtgaagtgagcgttctctccatcccctacccaccaagcccaagagaaaggatcacttgctgcccagacaaaatgccttgtatgcttccttacttatgcagcacagtgaagtttgaatattaaaagaagacgccttgtatgatctcagatgtgaaagaagaaagaaagagtaatatacatggaaaacagcacagaatctggaaccagaatatttactggctgtatgacaagtacagaacctcagctggaaaatgtgggggataagaatttctgctctgcctcctccgtgttaagagttaataagttattagagaaataaagcttgaaagcatgcagtaaggaggaaagtaccagcataaatgataattatgattactgttagtagcagtattaggagaagtctgaaagcgctgaggcaaatccacttgtaaaatctagctattctccaaaaggtgcaaaaaatacacacacaagaatgtcactaaaaaagggaaaaactagaggcagcttaaaagtctatcaacaggaagctggtttaataaattatatatatatatatcttccatgcaatggaaattattttatagctgttaataggaataacttggttctatttataaaaatagagattactaagaaaaacagtgaaaaagatgccaaacagaatggaaaaatatctcatttggtgggaaaaaatggggtgtacatgagatatcaataaataaaacctagcatctgcacagaacatttctacaagactaccttaggagcctaagaacggatatttgttgggctcaaggaagtaggaaagcaaacttatttttcctttttcttctcttttatacgatttgtatttcttaaacacatcattactttctaataaatccgagttttttttttttttttttaaactacaagactgttcccttccctgagaagtacaaaatctcccctagcctggcctctgcttatagtatttttacctgcattgaagtggggcagcttgtcgttaatatacatcaggcagtaagcactaacatttctctggcccccataggaatctctttcaagttcttcccaggaagactcagtaacagagatgtcgttgtacttgagccagacttgtcgcggctgattatagacgtaggcccagtagtgcccccgcgtttgcctgtccttcgtgaacgaggaccgcgtgcaagcgataaggcacctgcaagtcagaaagcgttccccgtgttaggttaaagcaaagtcatccgacaggggtttacatgacgaaaattccaaaagtgtacccaaccataagacctaagaaaactgcccatttacacgtgtgtttgatgtagggttcacatcaacaaaacat

SEQ ID NO: 47010 - DNA, 709 bp, Bovine  19866880611815
tgtaagttcttgtatttttctcccccatgcctttgaaagggagagcattagaaagacatcttctttgtgcataatatcacttaaatggtttactataataaacacatttacttgtgtagaatataatataaatggtaaatcattattctggccaccacccactgaatggaggaggttgacgccaaaatttagttatgatttgatggaagtctgaactgagtcagagcctgatagaaggaggaagaagggagacacagagagccacttaaggagtcataaatgtgagatttgctgcagtgaggactgaatacaaggagctataaataatgccatctcctaaaagcaccccaccccccattcatacatctatcttcagaggatgcagaaagtctagcactgacccagggaattgctctgtaggctgggtgtctgaaagaacatgactctgaaagcaggaacctctcagaagggacagacctgatctatattaatacactatccaccttgcgggcaacccacaagtagacatgcagtgtgtgtatcggagggatactggggcttctgagtacccttactagaactacctgggttcagtctacctgagtacccttgcagccaacccacaagtagacatgcagtgtgtgtatcagagggaggaacacctggggcttctgagtacccttactagaactaccgggttcagtccggc

SEQ ID NO: 47011 - DNA, 1314 bp, Bovine  19866880651219
ctcctgtgttggcaggtagggcgtgtgtgcatgctaagttgcttcagttgtatctgactttttgggacactataaaggtagcccgccaggctcctctgtccattggattctctaggcaagaatactggactgggttgccttgtcctcctccaggggatcttcctgacccagggatcaaacccacgtctcctgaggctcctgggttgcaggcggatcctttaccaatgagccaccagggaagccctcaaaacccaaagccctcaacatgctcattttactgcatcaccatatttcttatctgcaggatgagtctggaagcctcttcaggacaagggtagggtctccttgtcctcgtcatcctccaggtgctcagtcgcacctgtcccagcagatgttcagcaccagtcaggtgatctgagaagcatggagagtatctggcacagtgcctgccacagctggtgttccacacacgtgggagtgagagctggtgttccacacacgcgggagtgagagctgaggcaggtgctgctgaggctccgtgctgcctgggtctctgggctcctattctgcgtgctgatcccagacaagtcacagactccagttccctggtttctccttttaaagatcttctttcaaaagatcacagggattaagtgtgaacatcctttgaactgagaatattactgagttggattcttcctgaattcctttctcctatttcccaagatactacttgaagacccactgtcacaaaaccatgtgtctccatattttaagagacacaacttaaaatcaaaggaagtctcagcatttcatgctaaggaggtttggtttcagacaccctcatatgtcttgaaatttccatgtggttggttggaagctctttctaaaatctaattggtgactgtctatgctctgtatcacatgcccccaagggacaggagagaagaaatgacgtcagagttgatagaaaagccacacaaagactgtctggcagtgttcttattagcaagaaagacagagcaagatgcctaaatgatatacctcctctcttgctgctgcatcactgagtcccacacaatagacctttggaagcagtcagcttgtcagcatcacgccttgcacggtgggtgagctgaggcaaagataattttccaggctatttggctatcaacagacaccagattgcttagctgagcagacctgatttccttcaacttgctgcaaaattcttaaacaaacttggaaaacagaaatgtgttctcatttacttcacagctaaacgggggaaggttacagggaatcaagtggggg

SEQ ID NO: 47012 - DNA, 1024 bp, Bovine  19866880739719
gcacgctggctccagtagttgaagcacatggcttggctgccccatggtgtgtgggatcctttctggaccagggatcaacccccttgcattggcaggtgggttcttaactgctggaccaccggggaagtcctgagataaatattttcctaggtgcctttcataatgtgcaattctatctgtaggataaatggatagaaatagaatttctggaccaaacgtatggatgtggcctggtgatttgttagattttgcaaattgcccttcataggatgtccactctgacagcctgcaggggttgcccctacgcctttgccaataggaagtattatgacacagatgtgcttccatttcgccttcatgtctttagtttgtatttttatcaatttagatattatattattagtgtgtagatggtgactcagtggcaaagaatctgcctgcagtgcagcagacgcgggttccatctctgggtcgggatctgctggaggaggaaatggcaatccactccagtatccttgcctgggacactccatggacagaggagccttgtgggctacggtctagggtatcgcagagagttggacgtgaccgagcacgcatgcaccggcattcaggactggtggaactttatggtgaattgtgcccttttttgttttagcgtttgtccttcatcccaacttcaaacctgcttgtgtctgctgtgtctctgctcttgctcgcctgtacattcctgtgtatttttaagattttttaaagttaatttatcaattagttcacttgcatatgcatattaaaatgttatatattatgtataatcttcatttagaagcaccgtttcctccaccctcattatttcatgaaatcattttgttcagcttcacatgcatttttaagattatgcttctcctctccatcattagagataatgttctcagtcatttatcccaattttccagagcacatcattttctcctccttctgaaagttgacataccacaatttttgtatctatgtttgccagtgt

SEQ ID NO: 47013 - DNA, 1243 bp, Bovine  19866880765993
ttttcatacacgaaacgacatttgagatggaacttgaagaatgagtagaactactaacaggtaaaagatggagagatggcaacataaacaaaatctggcaactagggaaaaagtgggtctgcttggattatagaaagtaattctcatctgtctggatgggaaaataaaccggagaaaggcaagttagttccagaacggggaggagcctgtagcttaacagttggtcttctttccatcatataaaaaagcaatgaaaaatcctaaagccatattccaggagatgccagtgacgtgaatacttaacacttaggaaatcattttggtaaaataaaaccatttttgtgcctttatgggttcagtgccaaacttgctctcttaaatccacagggtacacgtctttttaagatgtttaagaaagcaacaaagatgtggcaaataacaaatgtaaggtaatgacagtagcacgaagtgaaactccgtgtggtcaggtgccttctgtttttgtatcaattccaagacagcaaggtccaaagaagtgctagtcacgtgttttataacactcggcatagtctcaaaggcctgggggtgaagagagttgagtttaataaagtactgatacgtttgtaatgacaaaaattcagggaggagaacggtacaatcctcccaaagctatcacattcatccacgaatcatacagaggaggaaactacacaccgaagaggggtggggtgaccctgccctcatttctatccagctgctatcccccgctccctagacgcctcgggcttccagtcccaaattccctgctccgccggtcttccaccgccctcccctcgtccccctatcccatacctccccagcctaaccccactcccaatactgccccagccaccgcctcttcccaccgtcccagcctcctcggctccgcagtcccagtcccagtctgggctcccctctaagcccccttctcatcccacatacttgcacccactctcgttcctccctccgtccctttacagtcagccgcccgctgctccggcttcaccttgatttcttccacccgctgggtcaggcgactgatccgagtgcccagatcctccttctccagcctcccggagtgtgccaggacttccgtcacgaacgaggccatcgccaccacaagaaccaaaactgacaggggtcactctcagccagcgcggcagctcccgtcccgccggcagccttggcgcgcggcctgccggga

SEQ ID NO: 47014 - DNA, 1930 bp, Bovine  19866880771806
gagcccatggttcaagccttttgtcttttcattagactgaatctcttagggggatccctgccacccaatgacagccttcccctctcagttctgcgcgatataggccctctcgttttccgaagaggactctctgtgtctaacagatgaagatactttcaataaaaaatctattcttagcttggtcacgtagggccaagttttgcttctgaaaattaaactgttgtcctggcagatgggttcctgtgtcatttttttcacgtacttgaaaccagctctgtacatctctgctggctgggtcttcactctaatgagattcttttttggttcgtttcctgggcacgctgcagacaaggatctgtatttcttatgccagctacggtgaccaagatggatgagcatcaatcatttgtcctccgaaatgcccgcttggtcacagctgtgagatgaacagacgaacaaggccaagtcctgatcctttcatctagtttaaatgtagcgtattctggaggaagtcccgagagccagtttttcccccacccatgccgtaagagcacagaatgtaaaataaatacctggcctggagattgctaggagagaagcaggaatttgagcttcaagcttccttgcgaggcggtacaatattgtgggtgtcctgaataaataagatgtgttcggtggtagcacagccttctgcctccgaggttcttttcagcctcttgctagctgagtaaataggccagtgatttagcatgtggctcttgtagcttcagcttctgtcgtcttactctgtgcattttatacagggcattcattctgcttattaaatattactgccatagttttaagggcattgacagctctaatggccctctggacacagagtgactgaggatcaccttcctgttataccattactaatttaaataagcagatagtcatgtgaaacacaagcttaacccacggcatcttctgagttcccagcatcttggggctcatttatttatttgactgtgccgggtcttggttgctgcatgcaggatttttagtttcggggtacaaattcttagttgcagtttgtgggatctagttccctgactaggaatcgaacccaggccctctgcattgggagcactgagtcttagccactgcactgccgaggaagtctcagcattttgggtttgacactgagacccttgttgatttggagccaggctctgtgttttcattggtgagcaggctgggagactctagttattgtgctcaagagagtctgaagaagctgagatgttttgtgtggggctaatggatattttaaagaacaaggtgattgtttgctattcatttctgtacttagaaacttggagtcgttttcattcatttgacaaatattatgcatccactctgtgcctagcattgagtgaggcaatggggtacgatagtgaacaaagagaaaatccctgcctttatcaagcttagtaaacacattagaatcaatgaaaagtaatttattcaattcaaagtgatatatgttatggggaaatcacacagacctgctggaattgggagttctagggaataatgatattggcaaatgaatatgtttgaaaagcatagtaataataggcataagcataataataggttgaattctgcccagtgatgaggctgtatatctttgtgacatcatttgtactattgccttgttatgctagataacctctcatgcttatgtcctgcttctgtgagtactttgatttgtagtacggagactataaatcatgagtcctggcttcctctacagccccaattccagcatcatacacattacagatgttccagacatgtgtattaagtgaatggatatgtctccagcagtaagaaacagacatggccatgggtgtgactgcttcaagctatacggagtgtatta

SEQ ID NO: 47015 - DNA, 1081 bp, Bovine  19866880780890
tttcttttatataaatcctccccaagtcttctaagtcagcttctcagaaaaagtaaatgtttctgtctcaaggctcggaatattccaagcttgccacaaagagcaaatccacacattcagtgtctaataaagagattcaaacgactaattttctagcaaatatggaatcattcggatctgcagggcacatagcactgggtggtataaagtaaatgctgaaagtattcttctgtcatatgtatcccccccattccacgaccacacacacacaaccccagctctttcttttcctttatttcctctctcctttctcccagcttggggcttccctcatagctcagttggtaaagaatccgcctgcaatgcaggagtcctgggttcgatccctgggttggggagatcccctggagaagggaaaggccacccacttcagtattctggcttggagaattccatgggctatatagtccatggggttgcaaagagtcggacacgactgagcaactttcactttcacccagctttgttcatttttctttttcacatcttcatctgtgcctcaagctagagagtggtacctcactcccacccctccctactttccagcatcctttagtgctgctacattcagcgatatgccttagaaacatgtctgactgtggaggctatctcagggctgtgtctgcctctccgcctgttgcagcagaaagaggaaacaggtttctgcctggccaggtcccactgcctcaggcgtattctgaacccacccactgggaatcttgatgtcctcaaacagcagcataaactcccctgctttttccagcacaaatcatccctgccattaaaaagtgaaaagactgacaattaccatctgctaagactttgttttcccttcttcttttggcacgttcttttgcatctttctccagagatgccaagaaggcttctgacaacagagtgatttcaaatattaaaaaagaaaaatccaaatactataatcagttctttagctcaaattcagaagaaagccactttagagttttagagccacacgtttcatgcatacacatgtaggcacacg

SEQ ID NO: 47016 - DNA, 810 bp, Bovine  19866880788310
ttgaaggatgaaaaacaatcctcgctatctggtagaaaattgttctgctttatgaaaaggcgtccctgttcgtaaaaacagagacagcggccagtccaaataaaagcccacatccgtcatatgctggagaccgcctggaagcccctctcccgactccccccatccttcagccccagcaggctggctcaggggacaccagggacatttcttttccacaaaggataaagccctttctgaatgggggtggggggttgggtgtggtggcaagcaagctataacttgaggactcccaggcaaatagctgtttggcgtctgtatctcaaagacgaatggagggtaaaacttcaccacaggaatgcaatcagcaaaatccagattgtggaaaatgaaccagaacaaatggtatggtttcttccaaaattaaattgcaaggacacaatagaaaaagctgggggtggggagagagccttcataataacagaaacttaaacgcctatcagccaattgcaacgtgtggaccttactggaaccttgattcaaaagaaaccaactttttgtgacattcatgagacaactgaatatttaaagagtacattttggatgatattaaggagttactgataacaagttttagctgtggcgatggcattccagttcatcgctttagagcccttatcttttaaagaaacacacttgagatacttacagttgaaattatatgatgcctgggatttatctgatgagatggaacagatgaaacaaaatccactgtaagcgattaggttaaagcggggaggatacattgaggtt

SEQ ID NO: 47017 - DNA, 1196 bp, Bovine  19866880804043
catatagtttttaatgaaaaccacaattttggtgaagaaagaaatgttttattttatgccagtgaagggaaatgatttaaacaagaactgtgcaagagggagcaggctaagtaggtacaacctgtgttggctggacgcgcggaggcaatgtgaacccagcccttcctggcccgtcctgctgggacagcagccaacagcggggcacttcctctgggaacccctcactgtgtgactgagaccacgagtcctccaaggccagccgcatatgccaagcatgagcaaagcttgcccaccccaccccagggtcctcacagctcatcttttcctggactgtgaagtggagacagagtgtctgagccaaaccctgatgacagatgctgatggggactaacgtgacctccaaatggattctcactaataactgaagcaggtcagtaggcaaatcatttttatgaacaccttcctcccacatgacacaccatctccaccaaatgaactcattcaagtaaacaggtaagctaataaagaatgactcaacccattttactgaaacagtcctagaaaaggacctacatcgttaaaatgcactgtgtttctaagttgattaactatcaaggcaagttttccaagggtctgaagtacgagtgaaatagttatccatgaacttcttcaccctcaagtaaaataatattagggaattcaagtgcataagactcaacttatttcaaaactggaggctcaaaatatcagtaattatgaggctaagtaggacaaagagatgtttttgcatcctcccaaattaccacaggtggcttgctaactactgcacaaggacaatgagcgatttatttccaattcagctttgttctcatttgaaaaggacttaaaccaaagtgaaaggcagcaagagcccaaaagatgcagtcaacacctgttgtcttttcacaactggatctgcattttcttaaagcagtacaaaagtcacaaatgtaatatgttcatacacacatatatctgtgacaggagggaaaggggcagggcacaacttctgaaagagtgacagagcccaaggacacaacacacagcaattagaatcgaatgggaccaagatggcagacaaggctggaccttcatcctcaatcagcaagtgaaatgacactgggaggtgccacgacagtcgcaagggcactgttaaa

SEQ ID NO: 47018 - DNA, 1885 bp, Bovine  19866880829729
atcctgtgtaatacctggtacataatcaactgtcaaggtatgtttgttagctcattcctgggactcaggatacatcgtggggagaatggtggtgggacatgggcatcaggataatggaggaggagcaggctccctgtagagccaagagatccatccctgcctgaagctgccagccagaagtggctggcaatcttaatggatccaggtgtcactttccctgagagacgagctggaataatagctggaagggagtatgtcagcatccacttagtttacagatgagaaaacaaaggctcagggcttcgtgggtccatgccagatagcaagggaatggtgatttcagagccaggttcccactcagtttattgcccatggtgtggctcattaaggtataggacaaccctcgaacccaaggtctgaacagctttagttgttcatctgacccaatctgctgactgccttagtcccaaagccctccaggatctccagcacctctttcccagcatattccagaacctctctgaagcagagccttccaagctgcaggctcctacaggggcagtgcaaggcagccctgggtctgggtgcattatcctgaaatgtgctctctcgcccttccccattctccccatttgggctgtcctggtatgtcttgctgagcacgtgaggtgctgctgaagctgtgatgtgagttctttaaagttcactttggaaacaaggacatgaagttcctaggaacgtcggctcccagcttgctgagctctgcagctctctgtgggactggctgctgccgtcaaaaagaatagagccgtcattctgcaggaaggtttctatgataatagggtttttgcctcccagtaattggaaaggtgctaatctagtgactcatgagctacttataagaaaaaaaacccacctggaaatgaaactgcatcatgtttcctgagtgcttcatctccttatttcactgcagagggcaagctggggcttagctgtagggagcagagcctggttgtcctggcaaccctgctggagcgaccttatacccctgcctcccatctaggtagtccagtgagacagaaatcaggagcgatgcatctagccccaggccactgggaaaggagctggcatgtgcatggacttgcaaaggagatagtcattgacgaactagtgttagaacctcccaagttctgatgtgtgtgcaagtgtgagggcatatgtgtgcatgtgtgggtctatgtgcacacatgggctggttgactgtgtgggcttgtagtgagtgtgtgagagcaagtacgtgtgtgtgcaaatgtgctggcctgaatgctgctgtttttgaggggcttgggttctaatggtttttgctttctccattcatgtctctgtccagctttagggacctgagatccagctctccgtgtcttggtacctgggtgtagatgacaactgtgctgtgtagttggagtttcagttgggctccacttggagaaatgtaactgctttaccctcagtagggcaggcagttggactctgaccctgcttagaaggcatctgggcctgcccagtacctggacccctctccagggcctccggggtagggcacctactccatacccagccttgcatccccctctgtcacccaactgaactccttttttcttggggacatcccactcctacttgggattcctgtccccttcccgtgggatcctgcctcggtggagaccctgactttggggcaacccccgtatgggagccctgaagggccaaaagtccttccagccacagcatctcctccctgcaccctcccaacctcctcccagccggcagctcccagccttagtcacagccccactaggctctcaactcctcccacctcccactc

SEQ ID NO: 47019 - DNA, 1785 bp, Bovine  19866880841991
agaaatatattttggagatagaatattctaggcttggtgaaagaattgatgaggggtaaggatgtagaaggatgggtggcaatgtatacaaactctgagatatgctgagtttctaacttgagcacctggagaatgggaacatcattcttaagttgggcagaccacgagaagaggagtttggaagggaaattggcacattctgatttggacttgctaggggtgaggtgttttcatttataggaaacagccttggtggagtagctggaaatcagactctgggagcccaagtaggtaaggctgaaatgtttctggtgtggggttgcactccctgagtagaccttagtggtctgtactctttgcaggactatgggggctgcttccttgtgtgtattaagagtttctccaaaagtttgtttgtatcatccagtgactccagagattctatggggaaggctggggagggtttggcagtagggagtgagctcaactccctccccccaggctgactataccccttcggaggttctgggcatcctggaaggactcagaggggagaagggagcttggatagacccatttcatctaaccgtaacaatgctaaaaacaaacgactcagcaccctagactctgcttagaagtgagatagatcccaccccacctcccaaatctcctgtttttcatatcagatacagtgtttttcagaaatcccaaccaaagcttgagtattactgctcaaacaccccgagccaaaatgcaaggaaagacaaataagtctaaagctttggcagaacagctgagaccattagagcaggagagacagagctggcaaaacatcagagtaaagccagttttcttctgcaactcaaagattgttccaaaggcagtaatcaagtatctggagaagcagagaatttgtcctgggctgaggttgtgatgggagtttcccactgatacatgtgctcttatttaacccttttccaatgttgctgatgctcggtgaggtggtgtctagcttaggccagcggtcaaactccccaagcccaaaccagccccaaagagagggcagtgatgtaggggtggagtcggggatgggagtgagcttggagtgtggcttctgaggtggctcagcagtaaagaatctgcctgccaatgcaggagactcaggagacgtgggtttgatccctgggttgggaagattccctggaaaaggaaatggcaatccctgccagtattcttgcctggaaattcccatggacagaggaacctagcgggctacagtcaatggggtctcaaagaattagtcatgacttagtgactaagcaacagtggagggatcgtagctgaagcagatatgctggtctatgggcacttagatgtccttaatggaaatctttggtgtgtaaatgggtcttgtttgtctccatatactcagcttaatgctggctggtgcaggcagctagtacttggtaaatatttgaggcattatgctgtgaactgctttatgggaataaagtggaggggatgaaacactccagcctgggaggaggaagagtctccacggagccagcagtggaggaggccggaatctccctagaggacttgttgtggaagatgaggctattagaggaattaaggggagagaggaggacgggcagaatgaggggataagggctgacaaaggaaagcaaaggaagagatgaaagattgctgatggagatcaaaatgcagggacagatggaggtacctggcaggatttctacaggccagaggaaggagacatagcag

SEQ ID NO: 47020 - DNA, 1364 bp, Bovine  19866880848675
cgattttagagcttccctggtggctcgatggtaaagaatctgcctgcaaaggaggagacctgggtttgattcctgggtcgggaagagcccctggaataggaaacaggaaaccaccccagtattcttgcctgaagaattccatggacagaggagcatggtgggctatagttcatgagatcacgaagagtcggacatgactgaatgactaaatgattattaattattaaatgattaaaaaaaaaaaactcacaggtacagcacttatcttcactcaaatgccaatcagactgttctggatccaagcagtatgcaaaactaagtgtaaatcaacatagcagaagcctctccactctgttcccttaatgacttttttaccttggcaactaaatgcaccatgactcggcaatctgggactctacaagcaccaggaagacaaagccagcgctaactgaacaccactctacttacgactctgtctatacaacccaatgttttggcaattgacagtcacagtcctgtctccttccctcttgtcactataaaaatactgttatatgatccagagctttagaaattatatcagttatagcctccattcaaacaattaacttaataatccatgattaccaattagatgctcaattggacaggtgcttgctcttatatacaaaagcggtactgcttgtgaataccagccgcatcaaacttgactgacaggtcttatttcttctaagttaaaaaaaagagaagtcttttcggagcatttaattttcagggttttatgtgtctgatttgacaacctgtatgcgatttagatggaatactttgtatttctactttgcaaagcgaaattttcatcaggaaactgtgtttctttaaggacatttcaggctttggggaaacatatatgcttaccgggagacctgtttcaaattaccaggtaaagcacatttctgtagtgggcacttgaaaatcataccatatattactaactcaatagggtgtatcatcttctgccaccctctctcttcattattacataaacggatggtagaaacaaaatgataactataattccacatggcttgttcaaccccaaatctgttccctttttcaaaaacacaatcagatacctgagcctattctctgtagaatttcagaatctgaatctctggtattattcctgaagactttgtatgtaaattataatatagtaaaatattattaggattttaaagccttaaagatatctttgtgcacaaagtcttccaaagaatgaagaccattcctttagaaaaaatagtaagctgaagcaagagctcattcctctgaaacgtcagccttgaaatggttttgttaaaata

SEQ ID NO: 47021 - DNA, 757 bp, Bovine  19866880858356
gaaggaggaaagtgaactggggctttctcctccagcttccgctctactaaaggcctcagctcctcttaagcagcgctcttcacaaagcagccctcttccgttttggccattactcctcctcctgcccctcaggtccagcagtggtgctggctggccactgctagtctccatctgccctgcactcaccctgtaaatagtccctttattaaactccccagtatgagtgccatctgtttcctgccggcaccctgattggtgcaggcagggaccagttattaatacttcgcaccgctctctcctgcccgactgcgctttctgcattgactgaagactgctcgctgcagaactgtgtgtgaatagcagctatttgtgtctctacaggcttatatcaaacttggggactaccggaaggcgctggtggattgtgactgggctctgaaggtaagaaggttgtttcctcttccacatgatggagggggggattgctcaaggccgggtgtctcagtcctgaagtgaatagaggggagctgtggttgtatcataatgggaagtggtgtggacgctgcagtcagagcctcggtttcctcatctgtaaaatgggagagaatagaattgttgtgagggttatgataacacctgtggtgcctcacccagaggaagtactctagaggaactgttgttaacattggcttttcagggtgttgtcacaacggctcaccctttactgtagtgttagcagacgctttgctccttgtga

SEQ ID NO: 47022 - DNA, 1174 bp, Bovine  19866880881662
tctttctcttattctaattttctacttgtaagtaagtttccctttgcttggtgtttacttagatgtgcagactccttcacagcagacgagtgaatgccatgttttagaaaatcagtggctgacttttcctctgggcaaggcctttcatggcagttagcttatagcaaactccgagccaggtgggcctggcagagaatgaacactgttccagacagttcaagacgtctctgtaataatcccaactatcccttgggtgagacgaatacatgagtgggaataattacgaacaactcactcaagtggcaaaacccttccctgaaagacaaagagctcgtggcccgtgagctctcacggggcgagtgtttgtcgggtggagacatggcacacagctcagagtaagccaaaatcaccaatatatactattttaaaacttgtttctgttacctttccttggatgtcaggtcagaagtcaggcagtgtgctgaagaaagtggttctgtcatgcacgcatcactttgagatgcagagctctctgaggcaggttttgtactagcaaattcaatcacgtatttcaacatgtccggaagcgggaaccgggctgggcccgagccatacttcacatacctacgaggcagagaaaatggtactctagtgccaaagcatcttcttctttcaggctcgctacattattatatggagagtcaacggaaaggcttatccctaaaggctatacaatagttaatatattaatctatagagcaaaagttttctaactacgaaagtgaaaactgacaacaatctgaatctttacacttgacagaaagcatttcaggtgggctcctattcaaagtcacaccaatggtgctttctcttaattcaaatcacatttaggctctactcatcaaagtaaactctattttttaaaggaagagagatatattatcattactcaaatctgaaaataatgctgttgaactatcaggttggtgcaaaagtaattgcagttttgagttgctgaaatttgccatttgatgttggaatatattcttaaataaacgtggttatgttatacattgtaatgtgcatttcttgctttatgtttttttgctaatggcttattacttggtggttattttatatgtgttttaaactatggaaatgatgttagtcagaa

SEQ ID NO: 47023 - DNA, 1462 bp, Bovine  19866880904706
accactgtgccatgctggtggggactcggctttggccctggatgacaccctgcccgtgggccctagggtggccaatgagggcaccttggcctccttagctcacttcccaagctatgctcatcagcgacccaaatgcaagggctcctccagggacaagagatgccactgctaggacgataaggatcaaacgtaattaacacggcctaattagtaagcaggcggctgcctgcctgtgccccgctctctgccttggcccagcccctggctgacggtcgcctccgagaagccctggatgaggctgcagacacatctaacagggagcacacagcacagcacagacgcacaccaccacgggacaccacccgacgacagcggacagagagaggccgtactcggtcttgactggtgcaggcggaagagagccgtcggccgtggaaggagcaagctcagaggcttgtccactggccccagcggcgggagcaggagagcccagggctgcaaaaacatccttggcaaggtcaatatctggggtcttgaagttcccttcgtccattttaaagtcctcgccctgggcagggtttgtggtgctgacggaggctgcctcgctcttcgggctggcgagggccctggcggcctcgggtgggctcttcgaggcgccgggctgggtgggctcggggtccggacctttggtgccgggagcctcctgcttggcctggggggcttccggggcaggggctgtcggggctgctgccaggggactggctgctgacggggagactgccttgctggctggaggggtcttgggggcctcgcccgcgctggccggggtgctggggctgagcacggccccctggttggccaggacgctagaggacaggttgttggcggccggggctgaggccggagggtcgctcaggtcaacgaggggggcgaccttgggggctggggccggggccggggaggcggcagtgacgccggtccccttggacggggtggcctggccggcgggcacagagtttgaatcaggggtggccgcgaccgggggggcgatactggaggtcagggtggtggtctcactggtggggctgttctgagcagtggcaaaggtttcggtgatagtgtcagagttagcggtgacggtggtgacagaaggcagcatgtcctccacagtggctgtggtgtcagcaggcagcctgcggggaggacaggaagtagaagagatagacgatgaagctgagacagacagagaagccaagagagggcggaggccaggagggggccgagggcgggcatgcggggacgcacaggcaggacacaggcccacagagaaaggaggacgcgggaggcagcacacgcccaggcgggcagaagaggaggacacaggagacgacagagaacgtggacctggcgggggcctctcgccttcctccctgccgcctgccctgctgcctgcctgggctcc

SEQ ID NO: 47024 - DNA, 1140 bp, Bovine  19866880913099
ccctcgtagaaggccaaagacctactgaaagatctttcagaatcatccacgctggtggtcagcaccgcacccatcgtgcgtgcatgctatgtcacttcagttgtgtctgactctttgcgaccccatggattgtagcctcctctgtccatgggattctctggacaagaatactggagtgggttgccatttcctactctagaggatcttcccaacccagggatcaaaccggcgtctcctatgtctcctgcgttggaaggcaggacctctccatcaagttctccctaatggccagtctgactccagcctggtgtgatacctgctgtcttcagagtctccgaagcagagcttcctcaggagatgtctaggaggatggagctgcgtggggcaatcagggcaagtggactgtggacctgggcttgtccagcccccagggcctctgccattacactaccagctttctgaccgttagcattttgtatgtgtgctctaatttgaaaatatgctagctctcaagctgagaagtgctctatgagcccagacagccacctggggatgaactggcccaccgagagggcccaggccagcagcccaccaggctcagacccgccctgcccaggggtgggaaatgggcagacagggcagctgggaggagggctgagctacaggtcactttccagcctgtaaacagaaacagcttctaagaggtctgtcggaagagggaaaactcctctgaagctccacagtccgaggctgatgcctcagcctgatattttcctctcaggaaggacggagaggcagtggtcgccctggtccctagcccagcagagtgagggcaacagggtcagtctgctagggtgcctgggaccctggaggagagctggaggcgtcagggaggagaggggcgaggatcctgatctctggtttggattccatctaccagcgaaactccagggcacgggctgggaggaaggggtgaggaacactcggcaacctgtttcccggctgcgtcctcccctgggaggttggcatttgaaggagtcaaattgtctaattaaaatttaacaattccttaccgggctcgatggcgggtgagacactgctgtcttaaacacatcatttttccctgttttctgagacttg

SEQ ID NO: 47025 - DNA, 1999 bp, Bovine  19866880920965
ctaaggtcatttcctgatggttcagatcccacattctgcttctagaatccgtgctcttaccttcattagcctgcctcctggagaagagttgggtttctcgttagaggagggaagacagagcccacgtgaccatcgtggtctgcatgaggctgacgtgccctgtgttctgcagaggagaaccagcgcctgcttgtgctgcgtccggacacgggcccgcttctgccctccctgctggcctccagggtcccggccatccggcagcagagcctggccctgctgctgcagctcgcccagacggagaatggacggagcctgatcatcggccaccttgacctgatccggtaaggctcggcgtgcgtgcgagcgggagcttccctgcggcatctcaggtttcacctgccacattaagacctgtcccctttcccacatctctgacgtgagaggagccagctgaccagattaagggttgaaaaccagaaggagcctgtgagaagaacactctctcttaaggacctccaggacaaactcctgtctgaacttactaccatggacagtgtcacttctgcgcttgtgtctttcttttcacaggtttatttatctggttgtgccaggtcttagttgtggcaggcagggtctttggttgaggcatgcaaactcttagctgcggcatgtcagaccaagtcccccagccggggatcgaacccgggtcccctgcgtgagtcttaacccctgggcaccagggaacagaccctgcagaccatgtaaatatggcggcacttgcaaaatccgatttggaacctacctgtaaaacgggccatttgcctctgctctttgagcctcagtcttggctccaccctgctcctgttcttacttttctttgtttattcctgtttcaggtaatgctacctgattttacttatccttaaatcctttctggagtgagtagggtacaaataaatacaacacatctcaaatgctgttgtgtgtaggtctttccaaggcttaaggtgataggaatggaatgtgcctctttcctaagtagactttttttttaattttaaatgagccatagtgatcctgcctggtgcttttccatctaaagatcattagtttgaatatgtgaaattgccactttttatgtcaagaaaaggttgcatgttggcaatttcatgtggttcaatttaaaagaaatagtagctgtgatcgtgtctgtgtgtgcatctgtgtgtgtgctcagtcgcgtccagctcttgaaaactcacagactgtagcccgccagactcctctgtccatgggattctccaggcaagaatactggagtggggtaccacttcctcctccagaggactcccgacccagggattgaacccaagtcccttgtgtctcctgcataggcaggtggtcctttaccactgcaccatctgggaaccccagccatggttataccattgctttataaatgcttcctatgtaatctaaaaacagaatttggcttccgattctgttcactattatctcactgggaaggaggcaagataagtgtccttcccccatttcacaggtggggtaggagagtgactcgggtcatctcagccagctgtctcccaggccatggagctcactcctagtctctgttccccgttagaaaggcagccaaatctgaagccgtgtcagacctgcttggaccatgctgagaattctggtgcctgtcccatgttggtgaggaggcccgtgggtgctgaggatggtatggggatgagcctgggctctgacttgccccttctcagcccagcccagccctgcggctcacaggacaagccctggcagcccctgaagctcggcgcacacgggcagatgggtcgttagcagagttaagtcatcaaaagcacattgcacatttcaaatgactctgcagtcatttcctccgtaccttcatcatatgtttttttttggttgggttttggtctttttaagtaaatacagccacagttatcataag

SEQ ID NO: 47026 - DNA, 953 bp, Bovine  19866880944977
cgtttttgatagggttgtttgtttttgttactgagctatctgtttattttccagatgtaatacatgtctgttccatggagatgtttatatactcatgtcttatactttatatactcatatatactcatgtatatactcatacatgtcttatactcaatgtctaatacttattaaaccttaaagggttagaatttaagaaatgcactggccagatgttagaggatcaaaataatgttaagaatcattttcaggaattagttgggggatgcagtggggaggggaaggcagtagggggaggaccaaggggtgatttttgttcttgtttgttttgctttgcttcattctaccttttcatctctaggttgcttctttgagttttcttttcatgtctccctggcctatttgctcataaaagagatggactaagaaaacgaagggcaaaaaggaggcactttttattcatattacattgactagacggtggaagtcatgaatcagggttctcatgggtgaaaaaaatcattacgcttgtcttctcacactgctaaaagctaattgcattaaaataattatgtatgctgtaaataagggccaggttatctgagctgatgtcggtgttacgttgcgtttaaaaatttttcagtagtgtaattaaaagtagaatagagggacttgattgtcagatgcagggtttcagagagaagcagggcagggatgggggaggtaaattaatgaatggtggttgccttcctgtgtcaggagatgggacgcttgccttatttgtgttatttccgcaacccctactacaaacctgttatgtagacgttatctccgttttatagaagaggaaagagagtgacagtttgtcccaaagcaccccgctcttaagtgacagccagaatttaatcctagtcactctagctgcaaaggccgtgctcagtcatcccttgcac

SEQ ID NO: 47027 - DNA, 1597 bp, Bovine  19866880987423
tgtttgagatgtgttattaacttctcgatccgtcctgctgctcctggtttagtctgtacacagtgggaagaaatcctgtttcttacccaaaattgcagagcaatttgatccagtttcttttgttgaaatgctgagctaattctgtttaaccacggatgatagtaaagttgcactaacagcgattttaatcaatgggaaatgtttagcttgtgtgaggtgagagctgggaatccagatgggtaggggtgtgtgggggggcggggaaccaggaaaccaactccatatgaaaatgttaactgtgtgattaagcataagctttttaatagagttattatgggctactaaagagacctttattgcatgaacttggaggcagaatataaatgttcttgtatgcctattaaagaggaaagcaaagattaccccctctctctctttttgtcttttgcccatttccagattgctttccagaaataacaaccagcttgggaaatttaggatgagactgacctagttgatattaatcatatgtcaaaaacagaaactgagggcagttgttcgcatgatttaatgggtggttagacagacctaggttaggacgctaggtttacccacgttaggacgctagccggagaaggcaacggcaccccactccagaactcttgcctggaaaatcccatggacggagcagcctggcgggctgcagtccatggggtcgcgaagagtcggatacgactgagcgacttcactttcatgcattggagaaggaaatggcaacccactccagtgttcttgcctggagaatcccagggacgggggagcctgctgggctgccgtccattgggttgatcgcacagagtcaaacacgactgaagcgacttagcagcagcagcagcaggacgctagcagatcatttcagcttgcctttattggcagaacaattagggttggacttctacttgtgtgaaatcagtagtacagattgactgcacattaggaaaacctagaatttgccttcttctgtccccatggcagctcctcacaaatgtattgagttttatatcacacaggagaacagatgatatgtattttcatttgtcataagttttctgatttttccataggctcttgggtgtaagtaaggtgaccatcattcccatgaagactttgttcccaatcatttcacgttgctgtgtcagagaaggatggcaaatattttcaccacctggcttgatttgattgttttgctgattggctcttttttctgagaagaatggactaacgtgtcttcaggtgtatgtgtattccttcacctctctttctccccactattaaaactctgctcagacgctcagttgtgtctgactcttttgcagccccatggattgtagcctgcctggctcctctgtctgtgggatttcccaggcaagaatactatttcctacttctagagatattcctgactcagggattgaaccctggatctcttaagttgcctgtgttggcaggcgaattctttaccactcgtaccacctgggaagcccgattaaaattctgtccgttcttaataagatcactgtcctttggccacactcat

SEQ ID NO: 47028 - DNA, 1437 bp, Bovine  19866881014559
cctaatactcattgctagacattgcttttaccattttcaaggataaagagtagaaataaaggtataggtagcacaccaggaactacttcctgactctgaggttctggaacatacggaaactcaaggaggctcctgtggcccccttaccaggaaagctataaggaaaagggccaccctgcccccgcccagcctacttggactggggacagttctgcctggaagggaggggagggaccccatgacctccagagggccctgccagtccaggaagcctgagtctccggtacagcctcctgcttggccacagatgttccctgtcatcaatcattgagggcatctgtttgctgtgccgcttgtttaaagagcgaggcgtttgctaattgaaaactaaaagatccatccgtctcactcagagccagcatgaaatccactcagccatgcaagaccagggtggaaaaggcagcacagagctaccgctaacgtatcttcaggttggcgcaccccacggaagtcatctcctgtttcctgagcaagcctggctcccctcctcacctcgaagcagccaggggctgcccatgctaccgtttatctaatacttcctcatctattatccccagtgtagtccagagagaaaggtatttttagccccaatttatagatgggggatctgaggcttagagagattaaactatttatccaaggtcacacaactggtaggtgacagaagcaggacatcagtccaggtcttctgactggtcaggagaggagtggcctgtccactgagtgactgtgtccctcagtcgatgtacaggtgctgagctgggaggcaccaattgcttccttaagtggattttaaaccttgggaagagtgatgtgaggctatgcaaggcagaaccctgagatttcaactatgtctgcaatgttttattgctttaaaagcaaatatggcaaaacgttaggattcctgattgttataatatctcgccatcaagcctgcagggagacaggaatggtccagatccacgtagagtgccaaaggcatagagtaggggaagagacatgtcacgcccactgacatctccttccgttcctccagtttgcctccagagatggtagatgtgctggtctgagcccccagagatgggggactgatccagagctggatctccatggcatctggaagggattccatttctctgtacctctgttctttcttgcagagtggtaagagtgggatttagatgaatgctaatttgtttttccagctctaacttttgataattgtctgtgtcattgaaggaaatgctgagtcaaatttaacctttagggcctagagcctcaaagtcctggagcggcttgattccagccacaatggactgactccctgatatataggtctaactctgtccttgttgttcccctctgcctggaacaccg

SEQ ID NO: 47029 - DNA, 1456 bp, Bovine  19866881036541
atgcttggaagtaacagcctgaaaccttctcgtgtttagaaacaaaatgtgaaagaattttttaaaaaccttgtttaatgttaaagatgcaaactatggtaatttcaaacttcaggtcatcaaagcagattttgatgttgtaataccttgttaaaatttaatctgccttttaatacaagtttgggccccaaatcaagtgtgtgagactgagatgctttaaatttctgaggcgactcctaagtcatcttactgtgtatgctgtgagcgggagagtccagcctttggaaccaggtacgactgcttgcagatccttctgggctcctccaagggcaagctactcagctgttagcctcagttttctcaactagaataacagggcggagaagattaaataagtgtatatataaagtgggtgcttaatagatgtgatcttttcatgggtggctcaaccgtcttccttgacaaccaatttaattgtctctccttttacctatttctgtacctaaactgcctcttcatacattatcttgtttcctctgcatccatatggcttactgctatctgacctgatctctttcatctatttgccttactgtctgctgtccgtattggctcgtgaggtctgggagagaagggatttcttctgttttctctatctttgcctctcctgtatttaaaaaaagcctgatgtgtaatatgggattcccaggaggctcagtggcaaagaatctgtctgcaaatgcaggagatgcaggagacgccggtttgatccttgggtcaagaagatcccctggaggaggaaatggcaactcactccggtattcttgcctgtaaaatcctatggacagaggaacctggctggctacagtccatggggattgaaaagagttggatatgactgagcacataccacggtgtgtaatacaagctcagtagacatttgttaagacttctcttttccctctttcataactggctgtgaccatcactttatctctccatatcttactttcttcatttgtcacagaagcacactggtctagggttcagttcggttcagttcagttcagtcgctcagtcgtgtccgactctttgcgaccccatgaattgcagcacgccaggcctccctgtccatcaccaactcctggagttcactcagactcatgtccatcgagtcgttgatgccatccagccatctcatcctgttgtccccttctcctcctgcccccaatccctcccagcatcagagtttttccagtgagtcagctcttcgcatgaggtggccaaagtactagagattcagctttagcatcattccttccaaagcagctagcaaactacagctcatgggccaatctggctctccacccattttgtaaataaagttttattggaacacagctatgctcacttgtttacatattgtctgtatctgtgttggggctacatcagtaga

SEQ ID NO: 47030 - DNA, 1620 bp, Bovine  19866881078357
tccctttcctgggaggtcttgaaggagggacaggtccttgcctggtgggtgtgttggaagggccactgatgccacctcctcctctccttcttcaggcaaagagatcattaaccacagagtcagtgttgcaattctgaatccagaaagttattacgattaatgggagtcttcattcagtccagggtcaccaacatcccatttcacctgggactaagggtttatccagggtaaaggatttgcagtgctagcacctgcaaagtcacaggctaaccaggatgcggtggtcaccccaattcagtgagagagtagaatctgtaatgttcttccgcatctcctacttcaatgttcagcattggtgaatctacacaggcttccttccctactctaaaatatatttcacttggagtttctttttagcactggatatgtctgatggggcataaggcataattaattattgtctaagatgtataatgatccaaaagaattagaaaagcacgcacacttagacattatctaaacaaaatttctaagtattttccactgaataattggtgctggtggctagacagtggtgtaaaaacaggacaagtctatctgaagcccatttatcattttgtttttctttttccttagtcactgattaaaggaagcaagtcacaagcacaacttttcgtaaatactttatcccacagacattaggattacacagcctccctgttgccgctttttgtagccccatggccagtacaggtgtaccttgcaaccctgttaatcgagcttccaggggggtgtgccaggggcccgcccagaccaagtagcagggctctcgtcagttttgtctctggttcctcctggtctcaaagggaaaggcagccccctcggccatcgcgaggttctcagcgtaactaagtgagttgggtggggtgggctggccttaccaagcaacatacttgtgggtgatgaggtccaaagcctggtgacaagcctcccccagctcttctgtcccatgtctgagattctgtcttccagagaacaagccaggaccacccacccagaaggtaactgttttataggctctgcaaatcttctgtctgaggtcatgaaatagatacaagagatggtttccaccagaaatgccagggtcccaagtgttttaaattttcattttaactttttataacagatgttctgtcatctcatggctttcaacatacactaatgaaatagtttctcttaaaataaattagcattttacaggagaaccatcccagccctcagaattggtcacatacaagctcatctttcttgtcaacctggattcacagtgttactgcaaaaaatagagaaacatcgactttttctctgttgagaaatgctgaagacattttttccctctctcttctcacaaaaagactttaatgaatgttccattaatacaaggcactaaggattatcaccaaggcagttgagccataaatgcagaatacttacaggaaacttgcctatggcaaatcatgctttacttaatcacaactggaaacctgttattttttttaatgactctaagtcataaaatttaattcatgcaaaagctggtcacaagaatgcaacatcatt

SEQ ID NO: 47031 - DNA, 1496 bp, Bovine  19866881111506
atgcagtcacagtccctcccttagtagacggcctttccgctccatgcttaggaccaggaatgataaacgggagctgtccacactccccggcagacagcaccgtgctgacagccacctctgtgtccatctcacgggtgcttctctgtttgcagagtgtggggccaggcccctggcttcccggatcgtgggcgggcaggcagcagctcctgggcgctggccctggcaggccagtgtgaccctgggctcccggcacacatgtggggcctctgttctggacccacgctgggtggtgaccgcggcgcactgcacgcacaggcaagtctggggccccccaaaacgggagaggggcgcctctagggccttttctgaaagtcagccgttggtaccttctgtataagatgtccacctgtctgcctgccacgtccggtgcaagtgggccccggagtgtttgtgaaattctccctgttcaagacctgccggaatggcaataataatacaaacattggttcttcggcttcatttggtttttaaggttttaaaatgctttcccactcatagccctctgtactaatgtttatcagcaccgtagttaaatccatttccatgtgattctttatgtccttcctccccttcagattggaagctccatgggggcaggcaagagtcttgtttatcactgaatccctttgtggatttcccttgccttgttcccatggcctagaacagtcctgaaatacagcaggtacttaatactggttagaaggaaggaagggttctctgcccatcttctttgacagaaggcagggcaggtcgtgtaaccctcatgttatagcgaggagccaaggccaggagaggggaagtggctcccttgtgatcacacctaggaagtggggagaccacacctaggaagtggggagacggtgctgagcgcagccttgctgagtcagcttagagctctcataccacatgaggctcttccttatctgttgcaaaacctggagggggttatactggagggaggcagtagtggccgatgaccatagcgtctcatttctcaatccatcagggcctgagcatttattaagcacctactgcatgcccagtgtcttaccaaatgctggggtagattcaaaaaggcctgggtcctgggaacttgcagcccggtgatagcttttctggtggcttcttccactaatagcttccccactaatagcctttctggtggcttcttccacctgccacctcacctatgtcagcgtctcctgcccctccttccctcgggctcagcgcggcctccgtgtgcagtttcaggctgtcccgcctgtccagctggcgggtccatgcggggctggtcagccacagcacggtcaggccacaccagggggctgtggtgcagcggatcatcacccaccctctgtacagcgcccagaaccatgactatgacgtggccctcctgcagctccgcaccccactgcacttctcaggtgaggctgcgg

SEQ ID NO: 47032 - DNA, 611 bp, Bovine  19866881119386
ggaggagggtggggcgacagaacccagtcttcccttggggaagcccagcacttcacagagtgaagaagtcagcagagataccttgcgggcacctcttctaggctcagtagcggcgtggctgtcatgctggtacatgaggcaaactacagacctcgggtttgccacatgccgggaagatggaatgttttgtctcagcctgtgatatgcaccccatttgccgtagagattaccgcttcctgggccgcaagtgtaattagatgatcaatcacagaaagtctaaagccaaggcagacttgggggagagacatttgttttacggtgtcagttcgaatatcagctgggcagaaagggccccaagagaggctgtgcttcagaaacaagggcctccagcaatagcacagaagccttcaggcagaacgaggagtggtaggaaaatctcagctttgtccaaatagcactggtgtttcctaaagcctccccagccctgagggttcccatcttcctgcagccaccaggcttaagggtgaggatcaggtggggagatcctagagtactgttcagaccagtctgtacagttcagcaatgtctctgcaactcagttaccccggata

SEQ ID NO: 47033 - DNA, 928 bp, Bovine  19866881188465
aatcctccctgatgagtctgggtgcttctcttaggcgggctgtgtgaaggctgaccaccagtttacttcctagcaggagtggtgagcccctgtctttagagtgagtactagtactaagtcaatgcactcgtgtccagctctttgcaggccttaaggactgtagcccaccaggctcctctgtccagcaaacagggcttcctgaagaacccaaggcatatgtcgcccattggatttagctttgaggtactattcaaaattctgggcaactataaatatggacaaggtagcaagaacacctggctttaaaaataaatccatcaattagtagagtggagtgtgattccagtttctttcagttctacatcagaggccagcgactaaacagttgtattaccctaaccctagctgctaagacacacctccagtccagaagcccatgaatctatttctgattttcctcccattccaaaatgtgtctcacccttgcgactttccccttagagctagtcccagaggctcagaagggtaacatgaatattttaacaggaacttcctggaatgccttctttgcaaatggtgaaatgttcaccattcaaaggaaggccagtggagaagataacacggaactcatcaaattctaactgcattaagtttggcaagtccctgagttattttcttaaaatgccttgcacataataaaagcttttggcttgaaaccttaattgattgatgtccctttctgtttttcatacatatgacaacacacttctccatgtgtaaccacaacaaagaaatgtttttaatgctaatttgccacaaatgtatgagaaaagactgagctgaagctaagatttaatgagttctatttttatttctcattattttccctacaaagtagcaggtagataaaagcaccgggcagttttag

SEQ ID NO: 47034 - DNA, 2239 bp, Bovine  19866881226249
tcgcagttccttaccttttggtgtggatgaggaagtgatgaaagaatttcatggcaacgggtgggacacacagccgatcaccaggttggaaagcagagggcaacaaagaaaagggaggagaaaactgttagtttatgtccttggaaagaaggacaaagtacgctcctgagtaacatctatcgcgtgaggaacgcagcaagagcacaacgtggagacactttgaaacacagtgacacgcttcatcacagcgacctctccttccgtcataattagaagcttctggcaccaagaacaaagaacagctctccggcgtcgactgcagaccttccttccagagcctgtcttttcttagcgactgactcttactaaaaacatcattttccttcaacagggcagaacaatgggctctctgggtacagatttctctccttgcacccccttttcctgaatcaaaggaaagaatcccactcctagcacctacatccgacacatgggcaccaattactgtgtccccaacacctatgagaagtgccctatgagagcatcagtatgcgtggccactgtgtaagaagctttgggtgccagaacagccactgttctgtagtcccggtaggtgcagggcagcccgctttgggcggggtcaggccaccctctctccatccttgtaacagctatgctgtcagagacacagggcagggcaagtggacagtggtgctcacaccctgcaagttcctagacacaaacacacacacacacacacaaacacacactctctctctctctctgtcttcctaatatgctggatcccaaacacatgtgcacccatgtcaaagccgtgcggccaaacttaggagaaggaagttgtgttgatacccgacgtcccgaagaaaccacactgcagaaaccatgaagcagagaaaggagggccctcccctcgggcccgaagggacatgcaatccctggagctgagatagactaaacagatgcgatgcggggggacctgtctttttcttgttataaaaggcaaattctcacagcccagctcaaaatttaggtcagagtctcctgggaacactgtcttttcttacacagcttacagacattatttcaaggcctattgttagctgcatgaggtgagccttgcacagaatatgcttacaactcagctgacttttttagccctggcagagggcggggtgggggtgggggtggggcgggaatcgtgggcctggcttgaataccagcccaattgctggtccagcaagttgaaacagcatccacgtggcagcgagttgaaatggtctctcacaaaaaagcacgacacatccctctttcatcctatccagcacagaaggacacacggctttcagtcaggtcaaaggacgtagttaacctggatatggagggatccagagctcctggatggggcagggatgactgactgtcctccaaacccacttctctttcctcctgggcacacagctgaaccgcatccccagcctcccttgaagtaagctggggccgtgcgctttcgtccaggccaacggacacagtgatatacgccacctccaagactgacccacaaaacagccagctcaaccctcccctctgccttccccggtctgcaggctggatggtgatgtcccgggtaaggacagtagagctccaccaccctggggccctgaacgactctgtggagcacagccttcccctttacgagcatgagaaacttctgttgcgtgagccgctgaggtctgggggtttacctgccacagaggcccaccttccccttaactaagtcacccattctcatccctggtgagggactaaacaccagatcttagcttctcttagatgctcctgcctgcttccagcaaagccctcctttccccttgagccaatctgaatgtgtgctcttcctcaatcaatgaacctctgggtaatgccccagatgcccagcgatgggcacagctgactgcccatgatggggagaagcaggtggctttgtggaccccacgtgcagctcagaagggttgaaagcatgggaagaaggactgactgacaggctcacccccaagacatcattaggctgtttggcttagcctacctaccatggaaaaggcagctaggcttacaattaatttagaaggcccataaaaaacaacttcctgctagtaactggaatgtcttggatcagaccacaaggtctgatgtcttcagagctaaatatgaacaggca

SEQ ID NO: 47035 - DNA, 1126 bp, Bovine  19866881243285
aacgacagtagttcttttgttcatagggtatattcttgcccctaagtatatcctaaagtatatttaaattaagttttaaaagagggaaaaggaaagtataggtttaaatggatttttcagtttaatttttttctgatcttcatgtatttttaaagggtaaactcagtttaatgtaggttgaaatttaatccctgttacctatgggatatatggtcttccctggtggctcaggcagtaaagaatttgcctgtaatataggagactgttgttcgatccctgggttgggaagatcccctggagaagggaatggctacccactccagtggcaaattccatagacagaggagcctagtggactacagtccataaggttgcagagtcagacacaactgagcagctaacacacacacgtgggatataatgcaaaaacatttgaaatatgaatttcttgtaatagtgtagtttgtgacataaattcgtgaggttgctcccaaattatttttgttatttgagtcaggaaatcatgaagataaaaaagtatgtagaattagtgtagtttgctagcagacctttaattttttctggtatggatatttagtatcatgacttcagggtaaggtacacgcggaagtctgtgtaaatacatgcaaatatgaccacatattttatttgcctagcctctgaagagtagccataccattggtatagttctctacaactgaagaataaaagtaatttaacttaaataaatgtgttgatttgcacatatgtctctcattgtgaagaaattcctataattgattttctttagcagttgaaatatttaggtatctaaaaaacctagtaaatttcatggttctagtttgaagaaagacataaatgaaggaaattttaagtctggaaattatttctttgtagattctcaagtcatttcgactaacccaaagaatatttccaccaacaacgtctgccatttcattttagttttgatccatgcagtataaatgaatacttgatttgtggattacaatgtttcattctataaatagtaatactggaatatctccaattttcaattcaacctacacctaacacagggaaatgacaattgcttactgattgcact

SEQ ID NO: 47036 - DNA, 784 bp, Bovine  19866881343292
ttaataaatatggatttgctatttcttaggacatgcttcttaaataatttgtatgtgttattttacaacatgaataagttgattttcaaacaattgagcatctctcttttgcgtatgcacattagcctatttatgtcatgttctgttagtctcttctataaattgattaagaacactggtatgtttgtttttattttcctctaaggatagagtaatgcctaataaaaatgaaaggaaacacgattttttcctaattctgaaaactcattatttatttggaagattgtggtaaactctacccttgtataatcattgcatttttttttttttagtcctgtgacaaatttctttaggaatattttttcctctgtatttaatttttagaggactttccccgtgaaatataaattgtaaatgtgatagggattgtcgtaaagaaaaacaggaggttctaatccacatgagggcacatctgggcatgcatttccacacagaccactacatggtcttagaagcatctttgacctataccagctacagaggaagttaggctgtttcagtttgtatgaaacttgaaatcaaatttgccgcagacagtgaggtgagaccttggatgtctttagtcagcatcttttctggcccaaacactagtcttgtgagcccctcacttggtgtggagactgtaggttatattaatcccatccactgtcaagttggaagctgccagtggggatgactggcttgtgggcatgtggatacacccatctgggctttccatagattc

SEQ ID NO: 47037 - DNA, 1478 bp, Bovine  19866881371136
acgattctgaaatgcatgggatgcaggagtccaggccccggaatagtatcaggtcacgtgcttaagaatgacctggatggcttgtgaaagtcagagttccttgctgattcagtccctctgcagtggagccctgtgattctaatgtgaaaatactccctcagatgattctgacatgtagccaagtgaagattctctggcctactcactaatctacctggcgtaactgatgaattgcaaacaacatcaaacccgtccaaacccttcaaggccctgcacaaagtttattattatttttttaattgtacaattttatttatttttgatggagctgggtcttcactgctgcgtggcttttctctagttgtggtatgcgtgtttctcactgtggtgcttctcttgttgtggagcacgggcttgtgggcttcagtaatggctgcaggtggctcaatacctggggctcccaggctctggagctcaggatcaatagttgtggtgcatgggcttagctgctccatggcatgtggaatctttctggaccagggatcgaacccatgtcttctgcattggcaggtggattctgtaccactgagccaccagagaagcccactgcccagagtttttgatgttcacaactgctatgttgccctaatacttggctacttatcacattaagcaatgcgacacagctctgtagaaactcctatttcatgctcttcttttcaaatttgtcacatgagctctttagaaagtataaccctgaactcaaaaccaatataataaacatcatgtttttctaaaggtagatatgccctccaatcaaaatggatataacagtaaaggacagcaagttacaactgggtatcactgcccttgacacagagtgtgacactcttgggttcacctagcccaggacgacaacctgctgttacaaatggaaggtcgcagtcaccatcagtggtcagttgagcggtcttgctcttgctttgctaagctggtcagcctgaattgttccctgcataagccacatgaatgtgctggtcactaagtggatgtgggtgagacacctattcaggaatctcagggcagacccctgttaactgtaagaggaaaagagaggtaaggggaagcatgagatatcagacaccatcttcctaaaatgagacttctgggctctgaaataaaaacagcctttagaaattccgaaattagctctaaatcataaaagaagatgaattcctcctacagtatcctcaaaaggtcagttaaaaaggagacccagccctactcagcagtctttcagcctagaaaacattccggtccatggtattaggaactacctgcctcttacctttattctgtgatattgatggatttcaaacctctacaggaacatttacacaggcctctcaatcccctgtggaacctgatagaagaaaacttccaattgtttcaaataattcctagctgaattcgtcttg

SEQ ID NO: 47038 - DNA, 1655 bp, Bovine  19866881380518
taaaacaaatacttttattgcacatttataaaatctgcatagttgtaacaagtctttgaccctcccacaattcccctggtaatctttaaaatttggttaaaacacaatacccaatctggagccttctaaaaatggtcaacggggtatttctctctctacatatacatatatatattttttttttacaaaccccacatcccctactttttaaaaggaaaaaagggggtggggtgtcaaaatgttcttctggaccagcagcagccttagccatgtgttttagccattttcagatgctagaaaaatttacctttaaatagttaacaactctgaaaatgtgatctttagtcaagtttcacaatgctgctcttccatctgatgtccttaatgctttctcctttctttcactcgggactgagtatgaggttttctggtttatttaaaaatataaaataaaatagaaggaagaaaggagaggcagccttcttttgacttttcagcctcttactgccacatgaccttatgttctacccacatgtgaaagggtggtggctcatcaacaacctatttttttcatctcctgtcaagagccgggcaacaacccattttttcatctcctcccttgcagctaattttttttaatgtcatctgtatctgataaaataacgagtagctgttcatacagttcaggtcctgatgaatcacccttttagtctgctgtcaaaaatactgatgcctgaaggatactctgaggctcagaaaaacccaggctgtcttgcagggacaagagacatttcagggcttctgccacaaatcaatgccttaatatactggttcctgccttttttcgtgaaattgcttctatgattctgtacctaaaaagtgcagttttattttcaacccttctttacacacacagcatagttaggatctcgatctgagtctcactttcccacctaatccctttcccagggtaaacactgtgacaacagacttctgtgcaacagacggtcaaccaaagaccaggctgggtcttgaacacgtgggggcttatttcactgtcacagctgacactccttgaattgactccatgacagctgcaaatcggctacaaaggtcatagggagaattgggccgaatagttggaggctcctttaagacaatgatttctgcagaaggatctagaagtctgggtagaaactcccctaagcacagctgcagattttctgtggagggaaaatagatggttagtatacagctaaataaatctcttgagttaaaactagtaagtctgcaacaacctccaagttcaaagcattattctggccagctaatgacaaatgacgattccttcaggccaaatcaagagcaaagacctatttgccgattatagcagagttttaggtcattgttttaaggcatctgacatgcggcaggataacactatatattcacttcattatggacatgtcttctaatcaatcatcctttaaaatttgacaaagtaccataaatacaatgtgctgtgaacatactactgccataaagataacgctggtcttatccttcaattaaaatataccagtgtgtacatggcattaagtaaagctataacgtcacacacagtttaaacaaaaactaaaacattaaaataaatt

SEQ ID NO: 47039 - DNA, 1543 bp, Bovine  19866881398389
ttcgtgaaataggccctgggggtacatcctcatgtcttaagtagcttgctattgcataaacctgagaagaaggggaaaaaagacaaatggaaacagcaatttctttctagctccttggttttcttagagcctttgtggtcatgatgttagttggcaaaatacagcatactgtcctcagagttatgcatatctcttcccttaagtccacagggatagcttatcacttaaagaaacatcaagcttttttactgtaccccatggggagtaaatgtcttgataaaagagtggtccgccttgttttctgtctctaacgcacgctcctaccagatggtgacgcgtccaaggatgactgggaatgcactggagaagggccaggctccacttgtcaagctccgtcttatcagcgtcgtcctgcaaggcggcgggaagtgggcctgctcacccaccaggctgccctgaggctgcttttctgggctctcatggtgtaattaatagctaccagacacttgttttctctgccttgcattggtggctcagatggtaaagattctgcctgcaatgcgggagaccggggttcaatccctggatcaggaagatcccctggagaagggaatggctccccactccagtattcttgcctggagaattccatggacagagaagcctggtgggctgtattccatggggtcacaaagtcagacacgactgagtgaccaacacacacatggttatcaggaaggatgacagccacccctggtcgggtatctactccacgtaccaggtgcttcatggatcgttttgcttgtgttcccctccacttcatggtgcagataagacctccatctctgcctcaccaaagagcggagccaggcatgactgggatgggaatagaggtagcaggagtgaagtgtagagaaggaagacgttccaggctcagtgggtggcagcgttcccggtggtctgactgactgggacccaagttcagggcagcacttcctcagtgctccaggaccccaggcttcaggaggcagcgctggccgccctggtgaggctggggcttctgatgagccaccaggatcagtgagggttggctcaggtgacaggtgggcctgtgcctacaggttcaagtcccccactccacctggcagaactgggacaagccaaccttggcagaaagacggggatgcccctgatgaactgccaccgtggcctcagtcatacaaccataggatagaatgaaacctaaaaatcgattagttcaaccccttctttttccaaatgaataaaccaagacctggcaagataaaatgactcgcctcaagttccggaggtgttttagggccagggttagacacaaaccctgcttttctgcttccttttcacctgcttccccacattgccaccctctgtggtttatcctacccttacagcaggggcccccgtgccatcgcacaaatgaggcaagtagacagagtccagatctccttactggggtgggcagtaaggggcaccgggattactcctgccagacctcacggcctca

SEQ ID NO: 47040 - DNA, 798 bp, Bovine  19866881408247
tgaaggcagttttacttccttttctatctatatgacttttatttcttttttttcaccttattgcactgactatgcctccagtaaaaacattgaatagaagaggcaagagtggtccttcttggattgttccttatcttagaggggaagacttttagtctgtcatcattaaatatgatattagctctgtattttcatcgagctaacatagaactaaccctgtgtctgattaaggtagtttccttgtatccaaagttcgctgaaactttgtgttattaatgtttttaaatataaattgtgtttgtgggattattatttgcttaggtatatgtacaggagcaaagagcttgttcgaagtaagcgaaattgtattcaaaaactcaaagaagaaataaaaattctgcagcaaaaactggaaaggtgagtcatagacacctttgtacttagaatggggtattaaaattggataatttgcttttatctaaaaattaattgtgagtttaagtattaactaatatattttataaaatggataaggaaaatgtgaaacagtctttaagatgggcagtggtggtcccaggacacctttgacccaagtcacatggtgagttattgacagtgtactgaagagaagccaagttctgatttcatagctctttactttttctgctctccttgccatcttgttcacaaacacaggagaggtaactatcacaaaactctaatccctttgtcttgagaaagcagtttttgaagtgcctggtgaaggtaaaacaagtcagcagtgctgactcaaagaga

SEQ ID NO: 47041 - DNA, 1544 bp, Bovine  19866881535008
ccgctctttaggcatgcaggaactaaggtgggtggctcacatcacgcatcatctttagtttttgtgaactgcgatggtcaaagatgtggtatgaatctctgttttgctgctgttcactggctaagttgtgtctggctctctgggacctcatggactgcagcacgccaggcttgtctgtccttcactatctcctggagtttgctcaaactcctgtccattgagttggtgatgccatccaaccatcttatcttctgcccccttctcctgcaatctctctgcttgggactgtttcttgctggccgaccccatgggagagaattctggaccccaaagaaaaattagtatggtgtttttcttgtgaatttcacttagggcaacttcagttttacctcgcttggaatctcccaagtcccagctgggaaaacacggaaatgtgcgtgtctcaatataggaaaccacccgagacagagttaataattctgagaaatgaatgttctctacaccctctgctcatagggcctcaaattcccctctgatatctttcctgtggatataggtccctaatggataaacatattttcaaaaatgaatcaaagtcgttgggtaaaaagagaaagttctggaagctggaaacaagaacaaaagagaaaccgggagtgataggagaaaagaagcaaagggaagcatggctaaataaactacagggggaaacagttctttgtttaaaatgggaagaaataataaattacatttctactatgaatacaaatttgcctgaggagaaagatcaattacaggagagagattaaggatttaagtgaccattaattaacagtaaattatgccccttgaaagctaatgtgacattcacacaagcactaaatgactcacagttcagtgatgtttcaacagacactgatggaggctatcaacagacccaggaaagacaccacactagcactgcctccttgaatgctaataaccagcatcaaacaatgcacttgtaagatttctgaaaagtagaatgtgttatgaactgagttgtgaagcacttctaggtaaagagaggttttaaaaagataagaatataatagaattattcctttgctttccttatttcaatgagttacatacacacctatcttaaagtgttctgggcactttgatgaaaagagctgtttctggtttatgagtataccacctttaggatataagagactagtactgcaacaggctgggacctgggacctagggtcctctgctgtagtgtttgtacctgggcaaacgtctcctggagaaacagaatacaaagaagctgtaagggactaaaaataaccatgtgcatgtgtagttggggcaaattatgaacaagatacaaaaagaccaaaatcccaaatgccacttctgaagagtggggagcaaaagcagggtaccgtgtttgccccctgcttacaacactaccagagtggtgggcaaaacacctaagccacgcctctggctcgatcacagacctgcccctagcttcatcccatgtaaagagccag

SEQ ID NO: 47042 - DNA, 2377 bp, Bovine  19866881574355
ctttcctgttgttaccttatgtttggatttctctgcttatataacagattgaatgagcttaatccaagtgaggtatatttttgatgatataaatagatgtgattccccattctgcaatgaatcagtgattaaaaaagcaaagaccacccccccaaacaaaaaaaaaaatcctcttcattaaatttttttcctattgaatctagtaaaaaaacaaaaacatgctatagttactatgttcttagggattaaaaggaatatttcataccacattcaaacattaactcaaaatggatcataaacctaaatgtaagagctaaaactacaaaactcttagaacaaaacataggagtaaatattcatgactttgaattaggcaataatttcttagataagacaccataagcacaagcaacagaagaagaagtaaatgggacttcatcaaaatttagaacttttgtgctttaaagtcaaatgacaggaagtcgatgacaacccacagtgtgggagaaaatacttgcaaatcacacagctagtaagaggtttgtatctagaatatataaagaactcttacaactcaacaataaagataagtaaccaaaatttaaaacaagcatcaaagaacataatatagtgagaaggaaactcatggaatgtgagaaaatatttgtgaatcatatagctgataaagggttattatcccaaatattaaagaacttctacaactcaaaaccaaaatccttatttaagaatggacaaaagacttgaacagacattttgtccaaagtagatattcaaatgccaataaacacaggaaaatatgctcagcatcacggctatggaccaaactgtgttcttccaaaattcatatgtggctgtatttggagacaggactctcaggagataactaaggtaaaatgaggtcacaagggtgggccctcatgcaagaggcttggtggccttagagaaagaggaagagagaatgatctctttttcctccatatgaagacacagtgagaaggcagccatctgcaagccggaaagacaacttttactaggaaccaaactggccagaactttgatcttgaacttcccagattcccaaactgtgagaaataaatttctgttgtctcagtcaccatgtctatgatatttgttatggcagtcagagtcagagctggcttatataatctctaatcactagggaaatacaaattgaaacccacaatgaaataccatttcactctcattaggatggctactttgttttttaagcagaaaataagtgttggtgaggataattggaattcttgtgcactgttgttgggaatgtaaaatggtgcagctgctgtggacaacagtgtgctgttcgtaaaaacttaaaaataggactactacgtggtccagcaattccactccttggcgtttacccaaaagaactgaaaacaagaactaggtcagatatttgcacatccgtgttcacggcagcattattcacagttgccaaggggtggaagcaacacaagtgtccatcaatggaggaataaatgaacaaaaagtagtgcatacatacaatgtaatatttactcagtctttaaaagaaaggaaattctgacacatgctacaatatggatgaaacttgaagactttatgctgagtcacaaagtaagccagtcacagaaggacaaggtgattccactatacactaggtacttaaaccagtcaaattcagagagacagaaagtagaataatggagtgtttcccaggggctgggaaacggggagttagtctttaatgggtataaagtttcagtttcagaagatgaagagttctggagatggacggtggtgatgattgcacaacaatgagcatgtacttagtgccattgaactgtacacttaaaaaatgattaagatggtaaattttatattatgtgtattttaccacaacaaaaataattatttagggacttctctagcagtctagtgattaagactctgaacttccaaagcaggaggtatgggtttgaatgaacagggaacgaagatcccacatgctgtgcggccaaaaaaaattttcaaatgactacccaatgttctgtaatgacctaaatgggaaaagcatctgaaaaagaataggtatgtgtatgtatagctgaaccattttgctgtatacctgaaacgaatataatattgtaaatcaagtatactccaatacaaatttgaaaaaaaaaaatgagcaaaggacttgaatagatatttctccaaaagagatatacaaatgtggccaattagcacttgaaaagatgctcaacatcattagttattagggaaatgcaattcaaaaccacaatgagataccactctaccccattaggag

SEQ ID NO: 47043 - DNA, 1331 bp, Bovine  19866881628305
taatgctgtggcttttcctaccaatgccaagctgacttgtaagtgaacgattcacagaatttgtcaggcgatggaatgtctcctgaccacatacaattgactagtcactttcagccttcccagctgagagtacatcttcacttacaaggaatgatttcaggatcatgaagatggtcagttcaacttggctgtaatttcgctctcttgagctcccaggagaattgcctgactggcccacaggttttgcaaattgacaaggggccctaagtttcagtctctcttttgcaagaatttttctggtaggcctctagttctcttaatctgatttcagctggcgttttcaggctcaggccattccccttgtattaatacatttagggcttgggtccttgattcaagagccaactggaggctttagaaaggtcattgttctcaagctcgtcatctcagagaacccgcgtggctcacgatgccccagggaggaggaccagcaccctgcctggctttgctcttacttctagaattctgtgctcaatatcctgttgtcttgttggtcatatcctgctcctactatgtatcagatcaagatgtgattcctcaaccaggcatccaaggccttcaaaacctgctcacatctcaactgtctagacttttctcccccaaaatgggcatgctccatctgccagcctcattcaacctcaggcctaagtcttccatcatcctttcctccccacacaggaggtcttttcctagattcctgaattcattctgccctgaatccattcaaatttatccctcatccttcttccttcacactatctccttaggctcctttagttcagagatctctctctttcttgatgagtaaaaaactgttaaaaaaaaaaagtaaaaactgcctgaaaatttgggagcagaacatactccatctttaagttctctgattgtcttttgtgtgttagttgtgccttctcaaatgaatgataaatcccttaatggcagagaaagagtggcatgatttttacctattcccaatgtggctcagaggttaaagcgtctgcctgcaattgtgggagacctgggttcgattcctgagtcgggaagattcccctggagaaggaaatggcaacccactccagtgttcttgcctggagaatcccatggacggaggaacctggtgggctacagtccacggggtcgcaaagagtccgacacgacttcactttcactttcaatgcctagattggtgctggcatatgaaagatgcttaataaagacctgttccatgactcgatatagcaacttcgatcataaggatcttctcaacagga

SEQ ID NO: 47044 - DNA, 1260 bp, Bovine  19866881712656
tggttaccccatggggtttggtaaaaatagtaatttctacttgagaagaataatcttctcctgtatcatcactctcagtgaactgctatgagtaggagaatgcacaaatccgccgcactcacttaacattaacagctagctggaaggcgtcctccagccaatccaggagcttgtgtgtgaactcactcacatcttgctgtaagagaggcacaaagtgcagaagagttagactcaacactgtatgtgggcaaatgaaactctgcccttaccccaccgatgagtaaggctctatgactgcacaagatttcttgttcaggtccaaatatcatgaagatacaaggagtactggagcccaaggctgcagacagcacacggggagctaggatctctgactagaaggaaacgcagccccttccaaccacggctatttgtaacaaactatcaaacacttccagctaggccttttagaaagtttcaaagaacagactgtatgggagatttgtggggagaaaggaaacatttttaaatattctgagaattctgtagaactgtaggacctttagacaaacagaggagaaaaaaaagtaattgtatgaacagtgctagttttgattttaacaggagacagggaaaggaatagacttgtgactagacaagaaagattgctcagaaaagctactgaacttgggtttagacagttttaaaattaggatttcgatctgggccattccaagacaaaggtgcagaaaaaggacggactttcttttcctctgtgaccctttgccatgactcactgaggtatcttccaaactcctcctttctaattcagcagcccctggaaaactctattctttctcctacttctttcctttagcaccgccagcctcctctacacaacacacacgtgcatgtccgtccttttcaccgcctgttccttaagcattataaagggcaaaagcgggcactgaagccccacaccgtcacgttcacagcttattctacagccgagacaaagcagcatcacagtgatggtcgcaaggcatcactgcaagctccaggacgagaggcttcctctacctgctgttcctcagggggatcggaacgctcccttttaagaggtccagggctgctgaagggtcgacaaacttgcgatttgatcccatcatcagagcaaacaaatattgaagctcctgcataaacacgatatttctcttttcctgcagggaaagatagccatacgtacttataacctcgtatttg

SEQ ID NO: 47045 - DNA, 570 bp, Bovine  19866881987255
gacatgaacttgagcagactgtgagagatgatggaggatgggaagcctggagtgctgtagtccatggggtcacagaatcggacacagtttagcaactaaacaaccaccaccaccaccctcatggggcctcagctaaattgctgcaggaatttgggtccccacaaaccttctcctttctgaaacattcgagggacccccttctttctcctctcaccccttaaacttttcccctagcctcccccttactaaccacctaggcagcaagtcagtggacccttttaatcctgaagtcccagtcttactaattgctttctttcttgtcctcatttgctttctaactcaggatttgaggtttcaatcagataagaaagcagctgttctaagaacaggtgtctggaagggaagtggtcctgttgggaggaagcaaaggatatctctagggaccaggaaggagggaggcagaaagctcctggtagtgggttgaacagtgttccccaaattcatgtccatccagaacttcagcgtctgaccttacttgcaaataagtctttgcaaagataattagttaag

SEQ ID NO: 47046 - DNA, 914 bp, Bovine  19866882285163
attgcccaggactgtcccagttttaatgcttcgtgtctccagaaacctgcagtttctgggcaaagcaggacagtcacaccaagtccatcacctcttctctgtataaaaggcaagatctagcgcccctcagcctcctcccatccctctttggtctgtttgagcttaaaagaagccatggaggagaaggctccttggagttcttgagatctggactcttttataaagccaatcacattagctgatgctgcgttggcccagaggctatcggcccgagagtccctccttccgtggggtctgtagctcaattgactgtccctcctttctcttggtggtctctcagctggcacccagggcagccacacctcatctggcttagtgttaggaataaatagcctggcccctccaggcccagaagccctgcagtctgggagaggcggggaaagtgaggcagaagcaggactgctcccagaagccagggacactgatggccgggtttcccttggtctcagtgatgtctggtctacagagcctgttccggcgctccgcctgtgacaggagctggctgtcaagggagggggctggcacccccatccgagacggtggctctctgctgctggcctgtggctcccggaggggattggggaggagcagagaagagactgccagactgcgggagcccgcggggatttggtggggtttgtttttcctccacgctgtctgcagagatgagggcatgaataaaagaatgaggaagatttactgttcccaccgcttggcagtagccctgtatttgtacaggggatctgaggcgggaacgggtgggggtgaggctggcactctgagacagccagagccttgtcaggctttctgccagcaccctggggtgaagatgaaggtgaggctgggaggggtct

SEQ ID NO: 47047 - DNA, 1330 bp, Bovine  19866880488204
cgctactttttgatgaatgacatctcgggctcggaaggatgtatgggtcattttgaccagtcattccctcgctctggcatcccacaatttttccgcctccctccaaaagagataataatatttagaggcgctcgctggggctgaatgagaattagccctcggcgcagcccatcattaggacgggacagccgggccactgtgacattttttagaaagctgaaatgatggaaagaataagaaaagagatgattctgatggagagagggctgcacagccctacgaccggcaagagattctccaatttgtccgactcggctggcaatgctgtgcttgaggccctggaaaattcgcagcacccggctcgcctcagcccgcgcctgccgtccgcccccctgcacagcgctttgggagacctccctgccaagggcaaattcgaaatagacactttgttcaacctgcagcacccgagcagcgaaagcaccgtctcctccgaaatcgcgtctgccgcggagggccgaaaaaagccgggtcattattcagaggcggccgccgaggcagacatgagcagcgacgtggaggtgggctgctcggcgctgcgctcccctggcggcctcggagcggttccgctcaaggaaaacaatggcaaaggtaatcgcgctgcccgcgccgcgctctccagtcccattctccctgttccttcgctgccctgcgggcccttcgtggtgcctttgcccctctccgaccctctgcagcaagctgcaccgagctggttcgggcgggggcgggacgcaggcgtgggaccgtgccctccggctctgctccttgagcctcccagagagacgcaggcctacggcctgccctcgctcctaagtcggagaaaaggttttccgcttgcgggtctaaacgcccgtgcgagccgatcgaccccgagccatccactgagtctgtccgggggaagggtgccctgggcagctgctctgaactccgcggcctctgaaccccgaggccgagcggaggaagcattctaaataagtcaagggagcctcgctgggcacctttgggagaccctcttgggtcagcgggagaaagttgaaaagtagagttcacccctcaatggttccagtttgagttgttgctgtctttcgaatcttgaaatattttaaacaaaattccagagccagtcaaaggaaggttagaggccgacagaaagctgccctgcggtctccagatcaaggaaaatccagagcttcccaaactgagtttagatgtaggctttttcccttggccagttttcctcctgagttaaattttccaattattaaaacaaaac

SEQ ID NO: 47048 - DNA, 1657 bp, Bovine  19866880957035
ctttattttttcccctaactactaacactcaggttcagaccctaatcatctcctctctggattactacaagagtctcctgactactgcctgccccttgtcttgtctcttgaaatcaattttctacaaagtcatgccagagttatctgaaaggcatatctgactatgtcattctcctgcttaagactcaacaacggctctcacctgccaacaaggtaaagcccagatgccctaatgaggtttttaagccttttgtgatctggcctctcatgtcttctccagccccatctctcactcacgcttgacttgatggctctgttcccaaagtagaatttcccctccatacacaacacaactcaatgccaaaatgctgatatctctctttacatgccaatagaagtcctacttttaagatccattttatttattttattttttggttgtgccttgtggctcacgggatctttgtttcttgaccagggattgaacctggggccttggctgtgagagcattgagtactaaccactggacccccagggaattcccttaagatccacttaggatctactttagtaatcacctcttccatctgatttccagactctgcaactgaacccacagtaagcacaacccaaagggtgccctttgtggtcccatgacaccttgaacacatctttttttaaaatcactttatttgccatattgttctaaagtagcctggagtggctatgtttcccctaggatatgaatttcctgggcgtagaaccatttctgtaatctttactgcaaccaaacatcaatcaatgacctcatttgggttctgatcctcccattcattccctggttctcactgatctcagtgagctaacatgatgatttataacttgtgactgaaagacagatataggaaatatccccatttcaaggatgatttcttttttttttttaattttttttaatattcaaggctgatttcaactcaagttaatcatcagagaattacagatacttagatttaggtgagcaattccaggtaatccaggtgctagttccactacccacctagcacttggaggcctttcatcatttctacaagttatagagttgtgcagtccttcaagtgtggtgtaatggtgctaagagtatggggaatcctcagttcactgaaggcttcctctttcaggatgttgtatgagaaaatcatgaaacaggaagttatttgtgttatgtttttccttatagatacatgcatatatacagtataattttaaatctgtaaattgcttaagatgatgaatggcagcctattacctaaaatgttaaacataagttacggactgatatagtacccagagagaaaattatttgtaaatcgaaattaaaaccatctgtcaaagcaagaggctcagagtcaaaagcacatgggtcggtgggctccctagatggatggcaagggacaagaacccacctgggcaagtgactgctagctggaactggcactctgggcaccagtctagctctacaagcagaagaggagactgagcttgaagcagaagcttcaagtatcactttgtctcagagttttgtgaagtatgccctactaacttttgcatatcccagttgaactcaacgtgcttgacttgttgaagcttatattt

SEQ ID NO: 47049 - DNA, 1719 bp, Bovine  19866881186396
tgggcctccctcagcagcttcttgcttatttttctttttttaaaaggagctgtttaaaatatatttcatcagatttgcttcagagaaggggagttggaaccattgaatgctcaaaattagagacttaacgtttttctaattcttccacttgctaaaagctactaattctctagtttccatctctgagctagcagggagctggggtctgcaagagctcagaatactgagcaggccccaggtttcctggcctggtttagaagctctgaagacctagagggtgccgggtccatatttgctaagggaggctgctgagctcctggcagaggaaccagtatggaggatttccacaggacgtagcctattcacaagaaacctgactggaaaaacatggcagggagagacgttttgtattgaagtcaaaggaacctcatatcttggcagccccctgataacagcaagcttcaaagtttgagaatttaggcagaatgcagaagtcccggccagcaacaagccggagggttcacttagtgtgtgggacacgctgaaagctgctcatggttcccctaccttggtattttatatgttttgttcataggcttttatacaccatttcctgactaacttggaagccattttctcatttaatgaacagtcaagtcgacagccatagtgaaacagcaaccaggaaagaaaaacgaattttgtgacctgaaatacattaggaaaagaatctgaaacattttgaaaaaccgacagcagtcctgtgacagcttgactgggacttggatatttatttccactgaaaacatttctgtatgtctgatacatacaagctattgtttttgacaaaataaacaaaacaggtacaaaaattattagatagcagagaaaatgcaattcatctaaacatcaactgaggtcagttgggctgaggctcagggtgccccatgaggtccattccagatcttgtactgaaaattcttggtctttcactgagaataaatcatcattgtacttttgagaaaaaatcttcaactctttggctgtggtgcatctcactagaagagagggagctatttctctgaaggaggtggagaaggggcagagatgatagaaggagcttggggggcccttagggtcactgaaatcaaggcaggacaccccaacacacccaggacatctctacctggcattcagcaaccccaccctccacagagcaagcctgccagggcccataatctctcaggctctgctggagcaggtcagacatggcctcagaaagagtacagcagtggggcccctggtgaatctggtgggcggtgaagagaatgaggagagagaacttctgcttctctctgcttggttgagagaagagagggggctgaggatctgaagggcctcctttctaaccctcctgatttctggctggtgggagagacttcacctctccctgcagtggttcattaccataattcaagaaagaaagacagagtggacaccttttcccacctctccaggaaagccttatggacaggcaacctcttaaagacccccccccctttcctggctcactcccacctccccctggatgtttcccttcctcctggtgcaactcagcctcaaagccaactaggagcttgcctcaccagagttcagctctgggggtccagttacaaagtggagggccctagcataggtatgtgtgaggttgtgggagaa

SEQ ID NO: 47050 - DNA, 1563 bp, Bovine  19866880166427
tgtgagagttggactgtgaagaaggctgagcaccgaagaattgatgcttttgaactgtattattggagaagactcttgagagtcccttggcctgcaaggagatccaaccagtccattttaaaggagatcagtcccgggtgttccttggaaggaatgatgctaaagctgaaactccagtactttggccacctcatgcgaagagttgactcattggaaaagactctgatgctgggagggattgggggcaggaggagaagagaacgacagaggatgagatggctggatggcatcactgactcaatggatgtgagtttgagtgaattctgggagttggtgatggacagggaggcctggcgtgctgcaattcatggggtcgcaaagagtcagacacgactgagcaactgaactgaactgaacggacttgtactttctgcccaatcctgcatcttccccttctctttcacagctgctcaatccaagaacctaattagtaccctgaacactaaactctgtctcagagtctgtttttcagaggatccaaactgacaggattgtttgttacctcagtctaacttaacctgtactgatggatacactataataagtgcaaatttccctctagagtatcttaaaatagttagtaaattgttttcgctcccaaaattgtttagaagaaaatttaacttgcaagcttataaaaagctagttgaggtaagtaatcttgcagctctagagacatttcatgcttgctggttatctgcacacctgtcaggatttgtcaacagaatgagaagagaaaaacataggtacggttgcagcaaatacactttccacttatcccttccaacttttcaataacaaataaagaggatgttgggctagataaattttgttgctaagttttcacattcttgatcaggattctctgtaaaatctagaaatttcaattgccttaaagctcaatattaaattaatataacttgtttacaaatgtctgactgcaagatccataatcatattttttgccaagaataaaatatatttccagagcactcaggtcattattgcttcataaacagttcaaggatagacagactaaagcaaattccacacagttattgacatcatgaaatctgacagaaataccatcccataccaacagaaaagtcacacagcaataaagaccaaagtaaaatatactctctggaatacagactttttaaaaatctatgctacaaggtactaaatattgatttataaaccatactttcaaaaagcacgatcaagaaattagagtaactattctctcaaacacaaatctcagcagtgagaatactgtgctgccaggactattcacatatgagggaccatacagttatattaaaaccaaaggctgaaatttacagacagatttattttacgacttatgcataaaacagtacaggtgaaaaaaaatgcacattcattggcgaatttttctactcacattcttccatgaaaatatgcatctctaatactctaaggacacattttacaaattcacttaatactccatctcaaatg

SEQ ID NO: 47051 - DNA, 689 bp, Bovine  19866880389023
acttgacttcatcatgtctttttaagtgtgggaaggagaaaattatttttggttcagacacagcatttctctcacacagtgaagaactattctttctcattcctttttccaaccttctaatttcatgaaacggaagatctttataacaaagagagaatagctgtcagccccagggccttggtcaggaaatgatattaaagctcaaactgaattgcgttatttaattatttacttctatagatactttatgtagaggggaagtggccctggaagttttgatttatggtttttgcctttgaaaataattatagttattaagagagcgctgaaggttttaaaagtcatgggcttatccggtggctcagtggtgaagaaccggatgccagtgcaggagatgcaggttctatgcctgggtcaggaagatcccctggaaaaggaaatggcaacccactccagtattcttgcctgggaaatctcatggacagaaagggcctggcaggctacaatctatggggttgagcgaccaaacaacaattgccatcatcacctaaatccttttggaacattgttttgtcacaagagttggacatgacttagtgactaaataacagcaaaggaaacagaatagatagttcaaaaactatgaccaaattaaaaaatagtgaaggtggtaacatgagtgaaattgg

SEQ ID NO: 47052 - DNA, 952 bp, Bovine  19866880528592
agcactttttattgattgtgtgaggtaatataccaattttaagctattaaggaacactttgataaataaaaataaaagagaccaaagaataacacatttaatggatataagaagtatacttccgctcttaaacatcgtaatggtacataatctactttagaaaattatttcaagtgtcagcatataaagaaaattatgaactattaataagcactttgacttctaaattattgtaagcatgtttggaaagaaattcctagtaataaagttaggcatagttttaaaactctatgagtatttgcatgtgagtcatcattgaaaagaattcactgtcttttagagcctaaatagttaaatatttgcctttttgaaataataatttgaagtcatgattcatgatgaaatgggattgtaatggcttttataaggcttaaaaatcagtgccccagatccagaaaatcagttaaatgaaatacagaatctaggctggtttattatgatgagacagtaagcttatttctcaggaggtggatgaacattttatgtgtttttcttctaggaattaaaatcctaggaaaagtgtagaattttgttgttattgttaaaaatccatgaagtgagatgttgaacttttgaaaagattcttcaagcagcttctactcaatttctatatttcaatgagcaaattaatgttgagctattttgtagctgacatattgggaatttatttttatttcttccatattgttcaagatgaccatattttaggttttatacatttaaaatataccaaagtgaaaaacattagaaatataagtttttcagagaaagaaagggctcagattattattattctaatagctactctttattaagtcagttccaagagctaggtactattgttgctgtttagttactaagtcatgtctgactcttttgtgaccccttccag

SEQ ID NO: 47053 - DNA, 2455 bp, Bovine  19866880593154
ccgggtctcctccattacaggcagattcttgtattttctgagtcaccagggaagccccatacagcaaatgccaaacctaatttatgcaccattaaaatttgtcttctatgattcctatgactggattatttttagagggagattacatatattaaaaatttctaattttcaccgcctaatattgtgttctgtaggtctatatttccaagtagccagtgcgctgaaagcaatgttcaatctacacttgaaattcaccacagaattttgaaaaaaaaaatgtgatgttaaaagtgaagagacgagaaagccatatagtatcacaattcctatagaaaaaaaaattaccatgctaagaacaccatatctaatggtttttaaatcaaaagaaaaaatgcaaagtaaaatgacattaataatggcttcccaactatatctccaaatcctcatggcatgtaatatagcacagcaaaacattaatattatactaacgttgagactcacattgagagtcttagaaagtgtataatgtactgctaacctaaaatgaaataaatttccctcaggactaacccagaagagctttatgacccaactgagtaaaaccacgcacataattcccctttgagatttatagattctctaaaattcctgtaattctaagtgcagcaaaaaggacaaactgacattcccctcactgccagagcaagttcacaagttcaagtatgtatcctatgtaacccaaatgaaaacagagtctatttcctctcatctatttcagcacttcatttagatacaatttcaaagatacaaacaagttgtaagaatagtcaaaggaatttcatatactcattactcagattcactaatggctaatattctgcccatttgttttatcgttagttccctctctccatctctcacacgaacatgtgagcacgcatgtgtgcaagggtgtagacatacttcacatacaacacacacacacacacacacacacaaaagcaggcatgatcattcctattacacttaaatatttggtgtatatcttaagaatgaaaactttttttttacaaaacaatattatagttatccacataaaggaggttaacatttatatactgtttaataaaacacatatatttcaatctatgaattcaagttctcccagtgtacaattcagtcttttatcacttaactgcattcaattgtcatgtttctttagcgttctttaatctggaacaatttccagccttatcttctctctcatgacattgacactcttgaggaatagctttcctcatttgaagattatacaatatggcctcatgatcggattcaggtattaattcttagaatactgtaagccaaaggtcagcaacctatgttccatgggccaaatctagccggccactcattttcataaacaaaatgtactggcacaccgatatatccattcatttacatactatccatggcttgctttcaaacttcaatggaagaattgagtaaatcagagactgtatgatcaacaaagcctaaaatatttactatgtaagtttttacagaaaaagtttacagaactcagctctaagtaatgtttcttttagcaggtaccatatccagaggcacataatgtccaatttcccatggtttgtaatgttaattttcatcgcctgacaaggttctaatggatttttacagtacatagttactatttttcccccgaacccaatgaacaatctgtgggaaagacatctaaatatcacgcacattaaaaatttgttcccacccccacagatttggaattccattgctgattcttttcctaaattttcaccgtgactgtcacaaaaaaaaaatgatttttcaactttagcaatgtcagtcagcattccgtgtaggaaagaggcatcccttctcctctatttgtatctgtcagtttgtgtaggttcatgaattcctgtgttttcagtggttcataaattattctagttactctaaattattctgatgggcttccctagtagctcagctggtaaagaatccgcctgcaatgcaggaaacccgtcgttcaattcctggatcgggaagatccaccagagaagggataggccacccactccagtattcttgggcttccctggtggctcagctggtaaagaatccacctgcaatgtaggagtcctgggttcgatccctggattggaagttccccgtggagaagggaatggctacccactccagtattctggcctggagaattccatggactctacagtccatggagttgcaaagaatcagacagaactgagtgactttcacttgcatttttctttctgatgctcaaattatcccagatataccaaaggaaccccttcaagctgacctctatgttcttttgacatacttaacataacaagacataccaggcttatctttatatttccctaccaca

SEQ ID NO: 47054 - DNA, 1181 bp, Bovine  19866880623975
ggcatggtagggctgaatcccagtcccaatctgcctgacccccaaaatcctgtgtcccttcacagggccacatgccttctcccctgtgcgtgcctttctgaaagacagcaaccctgtgctggaaatgacagaaggcagagatcaggcagagatgaacataaaaaagctacccatggatcacatttttttaaagtaccactttttcaggtctttaaaatatgatctagccatgcttcagaatattacacaattgctgaaaagaatgaggtagatctacatttttcatataaaagaatttaagatgtcctgttaagtatgtctattcaagatcctattttttatacatcatattaacatagtttatatacagactttattttcttggggctcttaaaatcactgcggtcggtgactacagtcatgaaattaaaagacggttgctccttagaagaaaagctatgacaaagagtattaacaagcagaaacatcaccttgcccgcagaggttcatagagtcaaagctatggtttttccagtagtcatgtacagatgtgagagttggaccacagagaaggctgagtgctgaagcactgaactgatgctttcaaactgtggttctggaaaagactcagaagactgcccaatggactcgtgagtctgttgggcagcaaaaagatcaaaccagtccatcttaaaggaaatcaaccctgaatattcattggaaggactgatgctgaagctgaagctccaatactttggccacctgattcaaggaactgactcattggaaaagaccctgatgctgggaaagactgagggcaggaggaaaaggggggcaacagaggatgagatgattggatggcatcgctgactcaatggacatgagtttgagcaaattccgggagctagtgaaggacagggaagcctggcatgctggagttcagggggccacaaagagtcggacaggactgagtgactgaactacaaccaactatcaaggtttggaaagagacatatttgtaactgagatcgtgaaatcatggacaaaaataccctcagaatttagttccatgactgtacttatgttacattctccattcctcccactctcaccccatcaattatatatccaggatagtgtttcttttgaagaatacatcatggaagaatggttctagacag

SEQ ID NO: 47055 - DNA, 2044 bp, Bovine  19866880626437
tagcaggggactctgcctatctctgtctctctctctctctccatacagtctcagcgcccttccatggggtctttccatgtgggctagttttaactaccttgcttcatgctgtttatatggtgtctgaggctttgtaggtgagtactccagcaagtgaggtgggggctgcattgtcttttatgatctagcctctagcctcggaattcacatagcatcactgccacatcttctattctattggttgaaaagacagaaacccccatccagtttcaaggagagaaaacaaagaagccatcattttattggagaaaagtccaagtagcattgtaataagagcctgtggaatgggagatattgttgacgccgcctatcaacaattcaactggccacctctcctttgctttttctttctcacttagcatgctacttaattgacttatttgtcctctacattgcctgtcttcctacactaaaatgccagcctgttttgtccagagctctaatcctggagccaagaacagtgcctggcacacagtattcagtaagtgcttattgaatgaatgaattgatgtctaccaatcctaacaataggtctccaaattagatgttaatgcaactattttacagttgagcaatatgaagttcaggaaggcttggtaaatttggcaggatcactcaactataaaaagctggcattcaaatgatgtctggctctttccactgtttcaggctgcccatcactcaatagcatctctttggattcctcttcaccctctacccccgacccctgccagagacacacatgtccacagtccaccaccaaaattcaatttgtccccagttggttgcactcaagctgagagcaaagcaattgcactttaaatcctcttatagcaggtatttcagagcgtattctgggcaatcagaacacattgcgtttgaatctgatgtctggtttgctgcaaaaaggcaattaaatgaaaggttaggttgctttttaaatggccaactcaaacttttggcttattttttgccttgctgtctttataggcattttaccaatatttatcatgatttcccttagggagccctcagatctgtgatatttgaaatactaaagcctctccgttggccctttaaaaggtttgtggtaaaactgcaccattaacattcacagttcctcatttatgaggccggattgcacttatttccatattcctcactgtttctccaatgagaatttcacataatagtgtttgaaggctaaggacttcaaagcaaattctttaccatttttatcttgaaaaatattcaatatttgtataattaaagttaagtcttcttagagaaaatgacaactcgaataatcttaaatgtacctccaagaaagaaactgtcaaaatgacatttacttgtacagtcacattctctaaggccttcgcttctcctcctgatttcttgtaatctttgaaggttatgtcatggctgacttagatccctttttaaattatagtgacctcctttcagtgtgagttctaagggtgaggggctctgtcttccctttgtttcagattttgtctattgcattgtcaccaagcagtaaaaacaaaagccgaaagcaaaccgaatcctccatgctaatttccccactacctaccacactatttctcttttcctcggcactaaagatttttagcaagtcagtgcacactctgtctccattttctcatgtctgaaattatatgataaagatttgccaatgacctccaatctcactggcaaatttaaaggaatttttcaagttttctttctaattgattgtctcctgtctatgttcccagtttttatgccatgcttttcactttgcactctcatcagtgctcaagaatcccttcatctaggatgtcttcagattagttgaacatttagtatcataattcatgtattcttgtatatgggctcgctaagacattgatggagaagaggaagctgaagttggtcaaaccaaagctaggggaaattgactcacctcccaggctgggga

SEQ ID NO: 47056 - DNA, 820 bp, Bovine  19866880645532
cgtgctccacaacacgagaaacccacacaccgcaaagaagagaccctgctctccgcaactagagaaagcctgagcctgagcaaggcaacaatgaccctgcacagtcaaaaataaataaacataaattaattaatttagtttaaaaatatatataaaaacacaaactaatgagaagaaatagccctccacttagcacatgtgagtacatggctagtaaattcaatctgtcaaactggaaattctcaatgttgttccaactgggaattacttaaaatcatttacatttaaaaaaaaaaaaaaaggaagagtaccctgaagattagtttcatcactatcactctagagggtttttttttactcttttgtatcgattgttgcctctaggctgttcactagctacatcagcatttcaaaaagatgacataatctttaaaaaagggaagatgagttcatgacatatctctataatgatcaaagagcagagctgttatacgttgtaaaaacaagtgaaagagatgtaagtcaaatacatacagcaactcacctatttacaattttgtggacttcagttttcccatcggttttggggtggtctggagtagcaggaggtgaggaactaagccactcttgatttgacaaagtgttatctggtgaaatgtcagtaaataagggatcttcttccagatctctaagtttaatttaatgatgcataaaaaaattttattatattttctaaaccaaaagattctctgctatgttctcagaaacctttacataattttgctaataaaggaattaaggaataatgaatgtatttata

SEQ ID NO: 47057 - DNA, 1107 bp, Bovine  19866880652726
cccagctttacttctttcattgtaaaggtgggaatgatgctttttccagctctctacatccttgagcaaaaactagaaatgctatgatcatgttcatgtttacttctttgctttactaatgttgtttccccttccctttactatattctatactcagaaaacttgaactctctccaattttcatcttaaatatgccctgttctaactatccttattcttccatgataaatcaatcattcctttcagtcctcattcagtattttcttcattctattccattaaataaatttgttgagcatttacactgtggtactgatgcaacagtccccaaagagtttcactcaataaaggatacaagcaagtacacacatcatacattggaaaaattcataaataggaagagacgcaatttcagtttggagaggttatgaaaaatctaccagaagatgtgatgtctagctgcatgtgcatgctgtgctaagttgcttcagtcatgtccgactctctgtaaccctatggactgtaactcgccaggctcctctgtccatggaattctacaggcaagaatattggagcgggctgtcatgccctcctctgggggatcttcctgacccagggattgaacctgtctttacatctccagcattaggcggattctttaccactagtgccacctgggaagcccccttctaactacatttgttgttgttctgttgctcagtggtatccatctctttgcaactctgcttaaagccaaacagaaattatcctgggaagaaggaaaggctcattcataagcatctcaaagcactaatgtaagaaagtagtgtagtatattttgcctagtgtctccactgaagtaaaagccatgtgttattcatcttcattaatagtaagaagcactcatttaatgattgtctactgacatgagtgactagctttgcttcctaacaagagcgttttttccagtataagcacatggcaggaaattacgttaagaatgaggaccctacatttccctggcagtccagtggttaagaatccacctgccaatgcaggggacatgggttcaatccctggcctgggacgattccatgtaccgcatgg

SEQ ID NO: 47058 - DNA, 750 bp, Bovine  19866880678681
actgagagatcctttagaattttctaatattctcccagtgtatataaagaaagaaacaaacaaaaagaatgctcttagaagtgaccaaattatagtgttcaacaaaatgtggtccatagactgcttacaccaaaatcattgggagcaacagtttaaagatggactttcctaaaaacaccccataccctcagaatcactatctctgaaagggtaaggattagaatctgtatctgtgcaagggactttaaataattcttatgtccactctgtgaaaaacagtgttaagacttggttaagtaatatctacatttccaacatatttttaagaaagcagctttggagtgtagagagccagtgattcatttgggtacagttcacttatgtgagccaaacaaaaggtttctgagggattagattacagaaaattggtctgcatgcccaagagcagaagtttatttgtgggtgtgtaggttttgttttttgtgttttttttttttttcccttgagaacgacaactgccaactagactacaggagttcacgttaggacaagtcctagccggagatgctccagatttctgtccagagtttacacaggtggtcgttctccctttcccttccttttatcacttgagccttgaaagggcaaaaagcctagcatgctccgtgcagcttccgctctcacggcgaccgcatggcctccgcctggtccccacccggctgcagtacctgccagcagcttctccttcag

SEQ ID NO: 47059 - DNA, 1199 bp, Bovine  19866880688441
tatcttttttttttttttccatttcagtcttgaatcctaaaataatgtccttttctctgaagagattagtaagtacatcaagaatatatttaagctaaggcctgagaaatagaagtatagcttatatgcaaggttttttttctaacttgtcttcatctgctattagtccccagctcatctcaacagtcttaaaagcaaatgagaaatatatttgtaaaatattctctatgaacatctctgtcctttctttgttcttttcttccatctttaaaatactttattttctgggtgttttgtaatatatatctggttgaaaacgttatctgttgtttttctggctctgtttattggcatttcacattttattattcttgtcaggacttgactcttaaatgtctaaaagaaagtggacatggggaacaaatactgggtatgtttacttttaaagcaaagtgataatatgaagtttatatatatatataaacacatacacgtgtatacatgtacacgttttttaaaatgagaataatgtgaaagtgctttataaattataaaatattacatagaaactagacatttgtataccattactgcttcttagtaattaatttatctctgatgaatattttatgggtagtgtttggtgaaatggatattgtgcttctttcaagacagatgatgtatagtctggtttctttgagcctcagatctgatccctaattttgtatttaaggaagcagagcttcaagtagctatgtgttttcccccacccctgcccccaatcagctccctaatcagagtggctcaaggtttctctcttacataactttagacaatcagaaccactggaagtctttggtttgattgtaagcaacagacacagttctggcttccctgagcagaaaaggcagttattgggaactatgtcagggatctctgcctcccaggatttgttcttgccttctttttggtgatagaattcactgagtttgtagctctcaagcacatggtcttcagctgcataccatattcctcagccttcttcgcatctagcatggttattatactgtattaggtcagtaggatatgagtagaaatgctgtgtgggaattttacatcactgagatcttttacaatggctggtaaatggcagcatctgtggtaacacttgcatatttgcctgtagaatgtgttttatg

SEQ ID NO: 47060 - DNA, 1466 bp, Bovine  19866880771299
tggagtgggttgccatttccttctttccaatagagtgagaaacttcctgactcagggattgaacctgtgtctcttgcgtctcctgcattgacaggaggattcttttccactagccaccagggaaaccaggggtacctcttctagattgtccttattgtttttgctccatgcctacttccttctgataaccgtgaggactagatgtgattacacaggagagcacttagcacagcagttggcacacagcgaacaccaggagatgtacccttccattataattctgggagggcagccatgccctcccaggccttcccttcaccattgtcggagcaagaatgctgagcaatacacaaagtacagtccatgcgactatgcaggaataaatatacctccgccttaagaagttcttctaatacttacaataggtccttgtggattttgccaagttacttcagagcagttaccaaagtgacaaagcagttactagaggggtagaccctttatttcatggtcagcaccattgcctgacctccacacgtatttcatcacccatcacatcttcaagtggccctgcccacgggtgaccctcacccaaactccctttctgcttcagaatctgtggggtgggggtggagtgtagggagagaagcctgcagcattgccaactcttggcaggaatcctatttcatttggaggactgcttctagagatctttcagctgtgcaaagataaaggcgtaaagcattgtcgtcaccattaagagcaaggttagtcggcatggttttcatcagaatgaggtttctttccgagggagagaagcaactctattactgttggcagtgaataagtaaatgtgtgcaagtgtgggacagagagacacagacaggcaggtgggagggggatggagggtgaaatgtgtttcctgcaatgcctatagaagatgggaacctcttttcacaatgcagttctacactgaaacaccgtgttaggagaagtcagactatctgtgcttttctcctctgtgagcacttcgtttcctcagtctgctggccagttacttgaagagcattttccaaagaggatgatacagcatagtgagtggccctggggactgctctgttcaaacctaaatcaaaagtcgctaacactgtctgatggctacttggcagtccttgtgaaaggcgctcacagcagcagctctgcaccccgtgggcttctgagagctccagccaactgaccaatcaggactgagctggctgctgtgcaaggaccgttaaaggcggccaggtgaatcctgatccacatggcaatcctggggagggtgggggtcacagcttcagaaaccacacactctgaacaggacccgtgacctgacgtggccaggctggagtgtgtgcgccagaaagctgggtgtgtaggaacagcagactgcccagtcatcacacacatcagacctcccatagtgt

SEQ ID NO: 47061 - DNA, 1586 bp, Bovine  19866880806588
acatcagcagtcatgttctttgagcacttcctaactgtttattgttatgtgcacacacagttcccactttaacacagcactgtactttcagcaggtcccaccaagaccccactgaagcaggtggcaggaatagctaagcaccaccatgctgatcttgagcactcagagggtgctcatgcttcctttcatcattttttgccaacttatttttgcccatggaggaggggctcttgcatctatgttatatccatgtaatgtcagactgtgagcattacttggctttttgcaagtggaactcatagctgatgacaagctggtgtggagaaaatgaaaatttttatgaatttggttctgcgtggaaacagttgaccaattttcattgctgtaatgtggctcttttgctcttggttgattgtgagtaatagcttcacttctgcagaaaggagattttatttgaagtccattcagagatttggttcaacaagctggactacagttctcacaaaatgtcttttgaaccatccaataatagcctttctcatctattattcctggaacactttatccttcacagccaagcatgtggctagctctgttgttcactgtgttctgtgtttgccattatgacctacattttcaacttgggatacaaaagaatacaatttctttttatttttctaagtaattacttgatttcccactttccctcctcagcagaaaggtcagtatcttcttgagaatgtccttttctcaatccaggaatgtacttgttctgtaaagtgtcagtcttatttctaaatatccaggggggaagaactgtagccattgtcatccacaaaggctcactttggaaaactgctcctatgtcgatctgtggacccatgtcctcttgatgatggcatgctgaccaggcaaggttcctgttcgagctgcagctgtgctcctgttgaacttacaagttataacagacattgaataatcaaccatcagccactggtagagcaatgtgtgtgtgttagtcgctcagtcatgtccatctctttgcaaccccatggactgtagcttgccagattcctctgtccatgggattctccaggcaagaatactggagtgggctgccatgccctcctccaagggatcttctcaatccagggattgagcccaggtctcccacattgcaggcggagtctttactgtctgagccaccagggaagtcctgtttagttgctaagtcatgtccaactctttcatggctccatgaactatagcccaccaagctcctctgttcatgggattttccaggcaacgctactgtaatgggttgccattttcttctccaagagatcttcccaacccagaaattgagcccacgtctcttgcattggcaggtggattctttaccactgagccgctaatgaagcccttggtagagactagaggctttttattagtcctgagtaacagccctttccagtccctatgcacatggtcagtccttttatccctgagaacccccaccacacagaagtggttgaatctggaagagcttcctgcctggaccacaatgctgtaccagaacctgccta

SEQ ID NO: 47062 - DNA, 1732 bp, Bovine  19866880809532
ttttgtatatgttactgaaagtactattgaaaaacactacaataatctgtttctctgttcagaaggaccttgtagtagataatatgttgaaagcactcgatgtaggaacattgagtgctttcagtttaacttttaaacaattttattgagttgtttatgagattgtaaagcattatggcaaaacaggcatttataggttgatctgaaccaaacgtaggatagtaaacagattgccttttaaacaaacttaaatctgtaaaaaagatggacacttactgaatgtttgatatacgctttgcaaatggctttgcaatattccatgtacttctcaaatgatgacattactattatccctatcttatagataaggaaaggaagacttagagaactgattaactcacccacaggttgtactagggccagaatccaaatccatgtgacttttaaccccactataaaactgaatctcaaccatctctttctatagaacctgggtcagaaaaccaggctggactcctgattccgccacatagtaattgcatagccttggggacttcactcaacttctgtgaatcttagttttctaagttttatagaactgaaagagtcataccttctttacttacctcataggattttgtggaacacatagagattatgtggaaaagttctctgcaaatgtaaaatattagcatggttgcttatagtagtgaacaccatggagaaatctctcagacctctgcaggagatcataaagagtactggggccttgggatacccactcctctttttctgccttgagttttgaagcagttgggatacctgcacaagtctaacagatgaaaatgagctatcatctggacttggagacggtataagtgtgaccacagcaggcttccttacacttcataactgaataaggacacagacctactgacctgtcattgacagatctggacactttgtgtctctctcacagggcagcatcttcctgctcagtaatggaggagaaaactggccaaggacgggctactccaaagagcagagcatggatggccctgagccacagctggtcaggtcctccttactgagtcaacaatcgcatcgctcagtctggacaaggccagtaggtgggtgtggagacagagggggcaagagttcctccccatctttacctcctgggtgtctttatgggaatatggaaatctgaggtttgggagaagaaagtttccctctttacagtgaagaatcacatccttattagtaataggaaaacgaggatcagagggtatctttcctcaactctttctgcctcccacatggctgagctgaagggagccatctgtggtggctgcatatgattttgtcaactttataattccacacccactccctaactccctaccatgtggccttcaaattgttcctttaaaaaataaaatgtgttccttctcctatgaaatacagaccactgtcaggatgcttgtgttgttcgctctctgatgtaactcccggacaccatgggggcctcctactttctctgtggggtccccttcaggtccaagcgtgtgctagccttctctgggcagcagaagtccgtggaaggggcactagggtggatcaatcacaagagctgattggggttttgtgattcagtgtcatggatccctggtcccgtcgatagtgctcaataaagccaccaggccaagcgttctcttccgcatgctaatgg

SEQ ID NO: 47063 - DNA, 2465 bp, Bovine  19866880827534
aaataagcattttccccaacagtggactgttacagccacaatgctctttttgctttgtgtatccccatgattatgacatggcggcaggggctccattggtgcttgttgaatcaatatgtggctcatttgatactaaaattatgggcatgtttatgcccaccccacaatgactccttttgtaggaatgctttctactcacatagatctttcctgtttttctttcagtggcccaccctcaggaccctcaccacccatcagagaagcctgtcattcactgccataaatgtggagagccgtgcaaaggggaagtgcttcgggtccagaccaagcatttccacatcaaatgtttcacctgcaaaggtaaggcacctctggcttcctggagacgtggcgtgtcacggtcactgcttgtcttggaggcagccccatctccctaactccataccagttgataattgaatgtgctcctaagtcctgaagttgttcaccttctctaattcaggaatagactgaagttaaggggaatactgagtttgccccagccccaagaccaggggtacacaggcctttgggtgttcactgagattcctcatcctgagagggaagactaactgtgaaagagcaatgaaatgaagttttgtgttttgtgctttatagttctttaaaaaaattgaaaaaacatttaaatattattgaagtacatttgattgcctggaaaattccatggacagtggagcctggcagactacagtccagggggttgcaaaagagtttgacatgacttcgtgactgagacacggacatgacacggcatgttgctgttcactcactacgttgtgtgtgactctttgcgactccatggactgcagcgggtcaggtccctgtccttcaccatatcccaaagtttgctcaaagtcatgtccattgaactggtgatgctatccagccatctcatcctctgtcgcccccttctcctcctgccttcactctttcccaacattggagtcttttccaatgagtcagttctttgcatcagggggccaaagtattggagtttcagcttcagcatcagtccttccaatgaatattcaggactgatttcttttagaattgactggtttggtctccttgctgtccaaggaactctcaagggtccctttcagacatgacatagttgatttacaatgtgacgttaatatctgctgtacagctaaatgattcagttatacattatttgtcatcttcttttccattccggtttatcacaggatgttgagtatagttccctgtgctatacggtaggacctctttatttatctgtcctttatgtttcttttcaactgtgatgaggactctgaccccaaagtaaccatgtcccaaggcccttgaatgggaccagaggtgactttccacaattagaaagaaagccctaagatacaaatgcctgtggaaataaaaagaagagatggactcttggattttgaaagaggaggaagaaagaggacactgaacatcttataggagagctagataagtatgaaggtgggaaagggttgcagtggaggaattagagttcacagcacaaacttaaaccagtaaactgtccaggatcaggattggtgagcaggagttttgttggtgaacctctgttacttcctaagatgtctggcatcttggaatctactggtccaagagttatatatccaatttgtcaatgttaatgaaatacatactccatgtgtcaaggaactcgtgggggtatttcaagagatactggctcagatggtaaagaatttgcctgcaatgcaggagacctgggttcagtccctgggtcaggaagatcctctggagtaggaaatggcaacccactcaggtattcttgcctggaaaattccagggacagaggagcctggtgggttacagtccatggggtctcaaagagtccaacacgactgagcgactgagcatgtgcacgcaggatagtgaataataaatgctgtgatggagagaaatacaggatgtagactggaggcaggcagatagatccagaaaggtggtgggtattatggtagtccaggtggaagtaatgtaaggaacatagaaccaagtgtggtagggactcggggacagattttagagatatttagccagcttaaccttaaccttaccttgacctaagacatttaaccttaacccagttaaggttgctaggatttgatgactgattggatgtgaggaatgaagaaagatccagagttccagctggactgcctgggtgaacataaggttgccaccagataagaaaatacaggagcactagagaggctattatgaggagaggggaggagttcagtttagataacacattgaggctgagcatacgtgatccatacaacgtctcgtaggcttagcactcaagagatactggtctgtgttgggaagaaggattggaaagtgttcggcat

SEQ ID NO: 47064 - DNA, 1435 bp, Bovine  19866880827691
cctctgtccatgagacttcccaggcaagaatattggagtggatacccattcccttcaccaagggatcttcccccacccagggatggaacctgggtctcctgcattgcaggtagattctttaccatctgagtcacctgggaagccttttgaagaagcaaattattaagacgttgactactactgaaattctaaaaatgaatctatgagatttgggtgtgcaaactacagcaaatgagtgtagatattatttgtattaatatattagctatgtgactccatgtttcaaaagccacttaccttgccaactatcattgcagacacacaacttttctcctgttaggtcacagtaaccgtgatctggactgccgcaattggctttacagtaggggatatcacaagcttcacccttccagtatttatcacattcacaatacacttgatttgaaacagagacactagttgtacacttcccatgaccagagcaattgttaggacaagaattgattctgtaaaatataattcatatatattcaaattcaagatgattagaaaaataatctgggctggtattttgttgaatttataaatgttatatgtgtccatgtgtttcatttaacacattttacaatgtgatttcaattctttactctgtacttttttacccctaaggcgattcaggtatacatatcttcaactggcctcagtccattcaatgaatttactctgctaccaagactacacactcaacgtctgcaggatctatacagttccaagcacaatgtttggtaaatattcaagtactcaaatgttttataggatatgagtacactttataggcaaaaaataaggtcatgaatacatgaaacagtaagagaaggcaaaacataaactggttgctgctaagctaagtcacttcagtcgtgtccgactctgtgcgaccccatagatggcagcccaccaggctcccccatccctgggattctccaggcaagaatactggagtgggttaccatttccttctccaatgcatgaaagtgaaagtgaaagtgaagtcgctcagtcgtgtccgactcttctcgaccccgtggactgcagcctacaaggctcctccgtccatgggagtttccgggtaggagcactggagcgggtgccatcgccacatgacacttaaatagcatgctatcacctaaacactgttgtggaaattaaaaggtgtttatcagattttattttaaggctccctaactgattatattttactatatatttattctcccttgtgtacatgcttgatataaataaactccataataaattgctgattcaaggatatttaggaatgtcttattcctcatgaaaaatcctcggttatcattttctacattactgaagaaaacaaacaaacaaaaaaatgtatcaaattcttctgggtcat

SEQ ID NO: 47065 - DNA, 999 bp, Bovine  19866880871553
gtttatgacaggatattgaatatagttcttgtgctatacagtaggatcttattgtttatctaccccatatataatagttttcatctaatcccaaactcccaatcattcccctgacccccattgctttaatatattcttgaaatttaagaagagcattacccacaattgcttgaaagattttaaccaggatgtgatctcacttgagtggctgaattgccaaaatgatgggaaaaaatcacaaaccatgtgaagtcctatgcttaagaaattctcattttaatggaaatcatgaacaaagtttggaaaattgggctgaccctatttttagctatcattaatctttactagttttcagttcttaagaagcatagtggtaaacaaacatgacgttagatactgtctctggttgcccagcttacaaaatgcaatctatccaaaacatatccagaaggaaaagtgaagttcaattctgaaattatatttctactgtcagatatgcagagacagacacaaaacaacaatgaaaacgttatctctgtgtgttttaatacagctccgggccttcagaaatcatatctgctgtgtgtacctgtctcttattctgttcaggggtgtgtgtccaataaattcatctcttccctccattttgtctgttttccaaaaaataaaataaaatatcctggtgcatatcataaaaaatcaggcaaggatggcagctgagatttttgacagcagtcacatctgcacataatctctgtcccagggggacctgcttctagctcgaattgcatgctatccttacgactgcctaataacttaatagacgtaccatcccaaaattcatgggtatatttgagaatataatgatttatcatcagacatcttgatttctaagcttggtcacaccctttatgaaggtgggtatctggctttacagcttttcctttctgaaaccacagaagggaagggtttgccttcctcccctggctattcttctgg

SEQ ID NO: 47066 - DNA, 1260 bp, Bovine  19866880925916
aacagggggcttggctgcttgttcccgttttgagcaggtcttggacgggtggcattacgggaagagaggcagctgcttgcagagtgatggatgaagcaggacttccagaggagccctacccagacaggagcctgtgccagtatgctcagaaaatcacagcctgctttggaggaatgggtaagaccccttaggcatggggctttgtggaggcgatgcatagggttgacgttgcaggccagcaggagaactaaacttaagacttgctggtggcagggaacaggtgtaactgctggagcaagagacacttcatgggtcaagacatcactgtctagaagtttgatggtgccccttcttctgagtactcctgcttaaaacactgctgtttgtctgcttactctgttctgctcagcagcgaagaccatcccgaagactatgagcttctgtaggtgttttaagtggacttgctgagctcttgtgtttgctcccttctgattaaaacaaaaccccaaactgaaaaagcaggtgacctccttgtcactgatgaaaccacaggctgtaaattcattgtaaaactaaatcccataaaaattagcatttaaaaaaattggcatttaaaaaattttttattggagtagagttgctttgcaatgttgtgttaatttctgctgtacagcaaagtgaatcagctacatgtttacatatatcctctctgctttggatttccttcccaatgtaattttctctcttaaaatttttttctcttatcaaaaagcagataaattttagcagatgatttaaaggtagagaagggacatttgtctggaaaaatataaagacttaaatcattacatggaataaagtcagaattcatttgcacagaattgcagggattgacctgtgactggtgaattaagagtagttaaggcatctgtcctctaagcactgtgtaacccccaaagtgcttggctctgaggttggggttcatctcactattgaggttccacagtgtgtaaaggcagaatgcccagggtctctcagggctgggttaaagctcctggttaactttgccactgacagtttcttttctttgcttatcatagacgagcttgtttagaagcgatggaactgttactagcagtgttaagaatgcctatctgataagatatgcaggccacccaagcaaattatgcatttgtagttagcattagcttcatagtgtagagttttggggtaccttcttttataaccacatgaactgtc

SEQ ID NO: 47067 - DNA, 1404 bp, Bovine  19866880951216
tttttttaaattatgcataataattttttcagtttatgaccagtaagcctctctaccaatgccaattttggttgttcaataagaatgctgctaagaaaaaatgtaatttttatttttgtgtttctttaatacagttgtaaacagaaagtgctacaatttacaaatgctttaatttccactcttctttaaaaaaacttaaatatttataataacccttaggaggtatttctgttttatagatgaaggcttgatggtggcggaggtaaacagacttacccaaggtcacactttcagtgactgaactggggtttgagtacattgttttccattttcctttctaatattcaaatacaatattagcatactaaaataaatctgaaatttatgttatttaaagggttctttcaaattgtgatatgtatttgaacatattcaagcctaatttgagtatatgatttttttttcctcctgtaagcattacatttgctgttagagtttttcctgtaagttatatttcagactatttattatgtacagtatatttattaatatgatgagcattgaattcttaaattcccttaacccatatattctatttctgtagtctaaggtctttgtttaatgcattgcattgtttgattttcttttacataggtcctgattgttctttgaacgttccttctaccgagtcttactggattctgcctaatgttaaacccttcagtccttctgtaggtcgggcttcccataaagctgttttacatgggaaatttatgtgggtgattggtggatatacttttaactacagttcttttcaaatggtcttgaagtaagtttttttcccatatttttacaatctattttttaagctgggtatttttggataatgaagactatcctaaatgtcttattgctatgctgattcatgaatggttgtctttgtaatagtatctgttttccacatgggactgatttgagaatgtataaactcagtatatccaaaagttatttgtcactatgcatatatgtttgttctttgtagatatttctttaactttctacagtgcttttgttaaattctgaataagaaagtattagctttaaataaggccaggccaggcctatattggcctttatgaatcctggtcaccttttactttttcagaatgaagtataattacttacataaaaataatttcagttttttcccccctcaaattttaatttacctaaactttttctctgcatttactttgcaaacttttattcgtagagcggtaccagtgttgtaaaataggttattgatttactgtggacttaatggagattgtcccttgcatgattggatgataaggagagttgcatgtaatgccagctttatctgatttttttcagctgttgatt

SEQ ID NO: 47068 - DNA, 634 bp, Bovine  19866880998428
aactctgggaccgggtccagaaatccccactctgatcaactcccggtggccctcatgtctgctaacacttgagaaccactgccctagacagtaatttctctgaaagcttaagaaagccagcatcttcacagttaagtctaagtattcaaaaaactcagcctgtttgattgcgatgggacacagaaactcacccctggtgccccccagggcacactggaccgtaatagcattaatcatgtcagtgtgaacacaaatacagtgtttcagagaaaagaggtcatgcctacaaatactcaccctcccccactgctaacaaaatttgcccttgactacacagctcctgccagtttgggataaacatacctctcggtatgagtcaccatcagaccaacacacaatgaaataggaagctgtgctggtttctactgtgctgtgcccagagcaggctcaaccacaatgggaagaaatcctgcaccactcacccatcactgaaccttctgaaaagtctgctgacgctctaatgctggctcaggaaaaccctcagtgttttggctttggcatatgagatgccagcagtatgagggaccctcctgcttgcctcccaagggcagtgaatatgatgatgacatcaaga

SEQ ID NO: 47069 - DNA, 1520 bp, Bovine  19866881037542
cctgcgtggagattatgaagacctgtgtcacactgccttcaaagcatctgccggctctcaaaaaagtcatgctctcatactagtgtagagcagaacaaaatgggtacctttccttctcggctgaaaattaaaaaccaggaaactgttcccccctgttttgatgtaacctgacaccactgcgcatgtgaagcatctctggtattgaaatgaaggataaagaaaacaccaaggtgctaattgaattcatatctcctcctctcccagatgctagaaaaacagaactcacaaagcactttcagttctcagaatcgaaatagcccaaatggaccccttcacaagttaaaatccttttaaagcatctgaaactgttgccaattagatttgatgcttaatattgctgtgtacaaactgtctcagtggagggcattccccaaaaggaaacaagaatgttatttcaccaaataatgtacttatcacataaacaatgatataaaatctatgggggcttaattaagaactgccagaagcactcctatcaagtcaaaataaattaacaaagatgaatttcttagatgaagaccgagatgcacatttaaatcaatgcaaagcttttgaatcattaacaatatttacgggttttagtgtttaaatatttaataatttgtagtacaaaacagtaactcttaaataaaccttcaatagcagctgttattgttaagtacctatttcatattagactctatcttgacacttcataagtttgctcctcaatacaaaccattctatcttacatgtggagaaacagatgctgagagaggcaaagtcaactgaggtcattcagcaagtggctttattaggatttgaatccaggtctaactattcctaccactgatgctttaaattataaaagcatttaagattatgagtttgacaataagcacagctttgaccacatccagtaagttaaacattcactgttcttgttattttctaaattgtttattatagtttttattttttccttttcagacacatctcttgaagtcataaaatgtttatacatgtatgggtggcagttgtcatactataaaattattagctttttgttgttgttcaccatatctgtcttgactatttccttctacctctgaatactatcaaaaatctactctccgtagttggacattctgctatttttgtttcattctggtcaagagaattaatggataggaatgaataattaagagatgatggaaggatgtgaggtttaaaaaaaactaagcagtgaagaaaacaacagtgtttgtgtcggtaaagaaatgtgcaaaataaaataaaaggttttaaaagaagcagtgaggcaggattctaagagtttctaggtttctagtagctcttgacagctatttacaaaaatgccaaacatttaatttatttattcatgtgtttgtgaaaagcaataacacttctccaataaaatatctagtaagtcccatatcaaaccctcgaaagaacatctg

SEQ ID NO: 47070 - DNA, 875 bp, Bovine  19866881050104
ttaatgggcatttagggttacttctaaaatcttggctactgtaaatgctgctgcaatgaaaagggtacatgtatcttttctttttttaattggagtatagttgatttatgacactgtgttaattattgctatacagcaaagtgattcagttatgggttcatgtatcttttctaattagtgtgtttgtttctttagataaatacccaggaataggattactggattgtatggtagatctattgttaattttttgaggaacctccatattattttccatagtagtcacacagtgtacattcccatcaacggcgtacaaaggttccctttctccacatcctaaaaggactctgtgctctagaagttctactttacaggcgaaaaccctgctccgtgtcccctgggccagcactgcctcctcctaggctgccctgtgcaggagcaggggggtgggatagacagagggtacggaattctcaaactcctcacaagtggatttgcaccatactcttcctccatcttctactcaagctaaatttttaaaaaagattatttcacctaagacattattctattcatctcctcaaaccctttcttcatagcaaatccaaaggtagactttgacatagcatcctctcaagccccctccaatgctgctttacggtgtggggtctcactgaatcagactttgccctgaaatccagagcagtgtgtttcaaagtaccatgcactgtagctccaaagtatgacatgctgtagcccagagctcaaaatagctgaacagagactcataaacaataataagagggggcagcttccaccaaaaataactattagctaatgcatcatcctggaagcaaatactaagccacaaaacg

SEQ ID NO: 47071 - DNA, 1729 bp, Bovine  19866881081371
gcatgttttaatagtgtctttgcaacaaggatggtgttctgcagctgtgatgtcagtgaactgatgtgctgtttggagtggtctttagaattagcacaggagacagagtggggagggtcaggagatgaggactctgtgctggaggaaggagctagactccaggaaactcctcattcttcctgagctgctgtgacacaccctcggggtggcacaccccctccctggagtccagctcagcccacagactcatggaaggagaaccagggcccaggcctcccctttgaggagtggatgtagcacttctgtgtgtcagccacctcgggaaggaaagctgaagccttagagctttgtgcacgtgacctgggaacccattgagctcatggaccctcatcacatcctcaaagaccaccgaaggtttggctgtctttttcataaacttgtcacgtgtgctgtctggggtgggctgtgcatttaaagatgaggagagctgcagggacttttccattggttaaaatagttgtgcacttattatattaacccttgaggttaatacaaacacatgcttgtataatatgcatatgttatatactaacatacttatgtgctgtgctaagttgcttcagtcatgtgcgactctttgcacccctatggactatagccctccaggctcctctgtccatgagattctccagataagattactggagtgggttggcatttccttgatcttcctgacctagggatcgaacctgagtcttttatgtctcctgcattggcaggcaggttccttaccactgcaagtgggttttttttaccactatttaagtatatttataaatattattatttactactctttaaacatttataaatatcattagaatggggttttaaaaaatggatatgactattatgtagcaggagtccagctccattaagttaaatttgggtaggttggtctgttggagcacactgggggtcctcagtgactgtgagtgagaatctgtgacctgcattttgcttatgtactctttcccatctccatgccagtatatctgtgttaacatagctttgaggtgaattctcccatctccttatgttatgttgtttttgtctgcgtagattgggtacaacgcgacactctgtttgagctaggggttggcttaaaaatatttacaacctaaaagctgagagttatgtttcattcagtggaaatttttaagacttcagtaccaggaggcagcatctcaagtaaccctgagagaacgtctctgaggaggcaagaggaggaaccaagttacatagaagttttgcaacaaaaaagcaggtcgtctgaacgtgaaaaattattgctaattaaagaaaactagatatcccagcttaaggaatttagcacgtttatttgtatgggaaggtacaagagtctgggctcaccgaacttattcctttcatatgcacctcagctatctggggccagtagcctgtgtttttcacatcctgagctcccttggggctcaccacagggagtggctgcagtcttgtggctgctcgatggcaggtattctccttcctgagtgccctgagggctcaccaactcaccttggagggctatgatcactgatgactgtgacatccttatttactgatgtggcaggaaatattccattttcatagggatgctgtccctaggatgcatcccttacagttgtgctttatgagacagttggta

SEQ ID NO: 47072 - DNA, 2258 bp, Bovine  19866881101729
tttcagagtttagccctaatgcttttgtgttagtgtctcaggattgttaccataaggatagaacataagtcttttatagttgcattttttttctcattagttttcatttcaattctaatgaaagctagattttcctatttctttgaaatctcatattataatccctaactgattttaaatgaaagggaggagaagaagccatgtgtagtgttgtagcacttttctgaggctaaaacaggattctagctacttgcctgggttccctgccttttataaggcaggacagccccaagagggggtgggacatgattcaacatggaaactttgactttttgaagagttagctaataaagtagttccttcctgttcatgggcctccaaatttgacttctgttagctgaaccagagatactctggcagtttatcagaatgcagacacctattgcttaaaaactgtttacacaactgtcttccaattaaaaggcaatggtacacttacattgtcattctaaaatcagagacactgctgtgtgttctttaccttacataactcagtcacctgaggaaactgcagcagaaatctttcccaaaagatgctcttcagaagtcttcccaggaaaccaaaattaaccaataaaaaaattacatattcacctatatttgagaaatgcttcattaagcattgttcagcatggagcttctcagagaccttgataagcatgtgtgccttgtaactctttgagagaaaaataaagtaagatgcattttctaaatttattcgatgagagaatgcccaaccccaacacaaagattaactgaccacaaaactgagtttggaaactgcactaacgaagtagagggctagcaaggaatgtagagatcagagagcaatcttagagccagaggaattcaggaacttgccaaggccacacagaatatacaaggaggagaattctgaccggcaacattcagtcctgttatctaggtggctaccacaggcctcagtgcctggttctgtttgcaagtcaagtctggtccccagtaatgctatgcttggaacatagatactgcgtgttcctaggcaaacaacacatcttaaggcaaattatgttaaaagaccgggcctaggagatgccgcctaccataatacaatttaacgacagagctgagagtaaaaaatagcagatatcaataacaaaacacccacagggccctggcctcatcttttaaactgagcagaagagacagaaacttgaagcaaatttaattccctaagaagaatgattctattgggaaagatggaaactaaatttctcaaaaggtcatattcaataaggaagaagacccccctagaccctaatgagaaaagcacaggaaggaaaaaagttaagactgatttgtcttttcccttgaacttgtattccaatgttatctgattatacgccgggataattgccccaacccaagctcagccactgactccatgagaaagaacaatgtcaagaactaaaagaggccccctggtccccaggcaggccctcgggtggcagtaaggcggcaccaatggccgcgaggagagggtgacgaggccaccgcgtgaaggcgagtgggctgggcctggctgggcaaccgccgccatgagcagctcctcaggcaccctgaacctgggcagcaagatcagcgtcatctccaaggcgcagatccgctacgagggcatcctctacaccatcaactgggacaacgccaccgtgaagcttgccaaagtgaggtcctttggtactgaagaccgtcccacagataggccttccacccccctagagaggagatttatgagtacatcatcttctggggaagtgatgtcaaagatattactgtgtgtgaacctccaaaagctcagcacacgctccctcaggatcctgctgtccttcaatcttccctgggcttggtttgggctcatccttccagccacaggtgccttacagccccttctgaggcatgccaccctacagccagctggtggctagctccctgcttagccagcagtatgccggcctccttgggtttccatctgtctcagtcagcaagagccccatggtggagcaggccatccagactggatctcttgataacttgaactccaagaaagctgttacctggctagggcaccatgggcatgcagctcaacaggtgcccagccccacccgcagcaaggccgccaccaatgtagctcagaggcagctgtgcaaactcaacggcag

SEQ ID NO: 47073 - DNA, 1319 bp, Bovine  19866881129468
gcttgcatggcagagcagcctaaaattttaatgcctgacttgagatggcagccagccccttcccaacccatttgcccaagtagccttacataagacactgctaatctctgctcctgcctgctgaaactccagccaagagtgaagcctcacaggaatttaatcaaagcaaaactgaatcatctgatctggaaattcatttctaatttcaagacttggtagcagaagagtcttctgaggtcatggagggaacaggtgggaacaggaaatggggctccaaggtcagggtctgttgtacggtgtgcccacgaccagacagctggagaaccagagctgcagtacaactccagtttcccagctcctcctccaactcttcccactagaatatactgtctcctgtggagtgcctgccaatttgattatctgtaagtgggaagatttggactcggtcttaaagagaattaattttcaggtttcattttttaactgagggttatgagtgatcatgaataaggataaataatccagcctctgtgaaatgtatcagcaccggactgttttgtgaatatcttatcctaaaatccatggatcattctggagaaaatgaatcctgccacaggcaacaaggttggctttagatgaagtaaggaaaatatatatattcttttttttcctctaggctagaagtggtctgtccctttatataaataaaggagatgtctgtaacattttctagtgctggagaaacaagctgttcctactgggcagagactgaacaagcacaaggcaagagatacacacacaggagagagcccagaggaagtcagcctcacaggagaccacgctccctcgccatttcctctgaaccatcagtaaagcctcattaaaagttatagctaacacctgtggctatctcgaaaagaatccccctgcaatgcaggacacccgggttcaatccctgggtcaggaagatctcctggagaaggaaatagcaacccactcctgtattcttgcctggaaaaatcccatggatagaggagactggcaggcgatagtccacagggttgcaagaatcagacacaacttagcgactaaaccataaacatgctctaaaaatctcaataagatatatgcacaaagatgctcaatgcagcagcaggtataaaagccaacaagctaagtatctatcaaaaaggactatcaaatcaggtgtggtacaaccttctgcatgaacactgtgcagtcattcaaaaaataaaaagtgagctatatctgtagaaaccaaggtagagcaacttcaatacattatgagaaaaaaggca

SEQ ID NO: 47074 - DNA, 1262 bp, Bovine  19866881280139
aacaatgattaacatttgattcttaatctgtgttaccttatactgccaccaggattttctccttatctcagttgcaaacttattgaaggcaaaacccacttcttatcatgatacttagagagatggaaacttattattgtccctttccacctattcataccgctttaaaccaggctggcatccggactgtgtgggtggagccaagttgctctggcacagcataaagagagccagtaatcctgcctttgcttctgaaagtacctaattggcatcaagatagtggtgccaaggtagcaactctaccctctctcaacttcttcaatctcctaagactcttctttcacaattgaaattgactacaactcaaaacaactctagagatcattttaattcgcaagtgtagggtcagactatgctctgctttgtgctcagtaataaccaaaaaggtcttgatcacagagaataagactgcagctggttaagtgctccatgatttgaggtgcatgagaagaaactagaatgagattacagggtagcaacaagagtaatcctgtctctaagagagaacatctgaggggggaaaaagtagatggaattgggattataccaaagaaaaagaaggcagagtaataatggtctttaagtgtatggcaggttattttaaggaaatcagtaatcagctcttttccgtctaaaggagaaacggggaacgtttgctttacatgtatgaggagatgtaggttagataagcttatagctatcactataggaggtgattacaaatgagaacaagctcctgaaagacactatcttacatctatgattaaaaatatttatggcaggtgaggtgagatgttagttgctctttgcgtgtctgactctttgcgaccccatggactgtagcctgccaggctcctctgtccacagagttccccaggcaagaatactggagtgggttgccatgctcttctctaggggatcttcccgacccaggcatcgaacctgggtctcccgcattgcaggcagatttttcttttttttttttttaccgtttgagccaccagggaagctatttatggtagaataaatggcttttccattcaggacagaaggggacttatctttttgaatatagacaaggtgataatgtgactttcctgacctgtacacctacatcaaatcacagggattacggtgcaatgaaaaaaaacatcaaatttattattttaccaacacctaaagttccatttggaaataagata

SEQ ID NO: 47075 - DNA, 1794 bp, Bovine  19866881332263
tggaaatcttgcttcattaacaacttcaaaagaagtagaatttgtactggatgaaatacagaagtatacacaacagggtaacaactgtatttgtttttattatgggaatatgcttataatcatatagctattggcagtgagtcattctgtttctattttcacttccaaggtttattaaaaataatgtatttaaattgtttttaaatacgttatttttaataaacccttggaagtgaaagtagaactcatttcaatagtcaatagtcagggggctcattccatacttgtatttggtaatatgcccctcaccccaggtggcagtggtaaagaatccacctgccaatgcaggagatgcaagagatgtgggttcgatccctgggtcaggaagatcccctggagacagaaatggcaacccactccggtattcttgcctcgagaatcccatggacagaggaacctgtcaggttacaatccacggggttgcaaagatttggacgtgactaagcacagcacagcatttggtagtttggtaattttctaaattgcttatctcatgttttgctcagcaaaccattgcattaccttagcaaaaagtcatctcatattaataaatatactttaaaacttgtgtgtataatttaataatttgtttgaagtgttattattcttgtaacttaggatgtctcttacaatcagaacactagaccagcatattggcaatatttgtataggtgtatttgtgtgtatgtgtgtttatgtatatgttctgagggttaaaattttgaattatcctcttagtatagatatgcttgaaataatatacaagtagttagctggacttaaacagatcattaaagtatatggaagatttggaacatacaacacttggaagcatttttaatttccttgaaaactgttttatggaaaatatttccatagaaatggactatttgcttggaaatggtatcaaatatcattttacaataaacttttaataggaatccatagtagttatttgctgttcttgggatgttaaaatatagtcaacccttaagaacagattaagttggagatttggaaataatttacaaaacatagttttgaaatatcttagttcatatacttacttgaagtgtcttgaagacatttgaaaaaattgagtagattatattatacattgtattgttttaagtgtacaacataatgatttgatatttgtatttattgtgatacatgttgttcttggatttcttttagattctgcatataaaaatatatggtatttttcttatcctgacttacttaaattagatctatccatgttcttgccaatggcaagattttagtactctgtgatctcacatatatggtgaatttaaaacaaacaaacaaacatgctaaaaactaaaaaaccaggctcacagatagaacagtttggtatttgccagaggtaaggatggagggtgggcaaaatggatgaaagcagtcaaaaggtacagacttacaattataaaataaataagctatgaggctataatacacaatgtgatgactatagtgaataatactgtatttcatgtttgaaatgtgctgagagagtagatcttaaaaatcttcacaaaaaactgtgtatggggacatatgttaacctagacgtataattctacaatgtatacaaatattgaatcattattttgagttctggaaattaagataatattatatgtcaatcatgcatcaattgatggagcttttctggaggctcagacagtaaagaatctgcctgcagtgcaa

SEQ ID NO: 47076 - DNA, 1486 bp, Bovine  19866881348348
accaggggatccgggttgctcacaagtgctcaacgtgcagcagacatcaggatgcagatacaacaagtgagtgatggtggcccgcctgcgagcgggggcggggctcccggggaaactcacatcctcgacaaccagtctccttttgcacgagcccctggtgctggttttcgcagatgaggtggctttgcctttgcccgagttgcacaatttccccagagactttaaaccaaggaagcaaggcatctcggcacagattgcaaagaaatgagaaatagataccaggcttccacgaagctgtgcttctccacaactctcctgactccttattgttttttttcctctcactgcccagcaaagaagattaaggaagatgtatttaagtgattaccttcaagggcttaggtacagctctgtatacacagatgatcaggttaaaaaaaaaataactaccaggaattcaagactattttagtctgagacatgaatgaagagttaaaaatcagattaatatccagagcaagagaaaggacatagcttcaatagcgaaaaagattcacccacagacattcctaggatattcaatatcatctggtaagagtgctgtgaataggcatatctattgatatgaatctaaaaatgcatatcagaaaaaattcaggatagtaattccaagttctctcgtgtttcaactctcatggaggacagagctcaagaaaagttcttcagctacaactaacaaccaagctagctccaggccacagtaaataatccttctcattttctaccctcccctccccctggtgtcatgaaaatccttcagcctccttccattaatccaatggcaataatattcttaacgttgtttcacatgttttctgctactgcagaatctctagcagaatcacatgatgagagagaattaccatgaaggtggctgcatgaattaataaagttataagcgagcagcagcatcacacagtcaggctgctgatgtacaaagcagcaaatgtacaaaggctggtaatgactttttacccttgacacccactcagtcaggttaataagcacatgtgactgaaataccacacaagagtcacaagtcagcgtgaataaaaccacactccttctcctgtcattgggatattatattctaatagcattttcttttcaataaaacccttacacactttaaacaggatagaattatagagctggaagggtcttcaaagataagctactccaatggttcacaaatatcactgcatgcaagaattttctctagaacttttgaaaaatacagagactggggcaccggctcagacctctaaatgagattctttgggggggtgaggcccagtattacttcaaagttccccagatcaggaccaacattcaggaaacagggatcttctccagacttttaatttttaaggggcacaaggtaagccttagggatactaactggctttcccaggacaacacagca

SEQ ID NO: 47077 - DNA, 703 bp, Bovine  19866881380592
attctccaagcaagaatactggagtgggttgtcattttctcctccaggggatcttcccaacccagggattgaactcgtgtctcctgtgtctcctgcactggcaggtggatttgttagcaccgagccacctgggaagtccctttctaaagcaagaacagaagtccaagaagaaaggggataaaatgtgcacttatttatgaatagaccaattgtattaatttatgattgttgttaatcattggcatgcagaaaatagtaatattcagggtactgagtaaagaagtttattttttaccctaaatctaagggatcttgttgaaagcttccattttaatattgtgaaagggtggcatttgttagagatttgtgtgagtggaagaaattgcattggaaataattttctatttggaggcttaatttatatttgatcacacgtgtccttcaatgatgatatagtgtgttcatatgtcaaaattattaacttttttcttaatacctgtgatttctattgagaatagtttttttaaaaagtagacatttagtcacagaataagggaagtttgttgtctaaattctacagactgttaagcaaagttgatttttggtgtatggtaaaatgaacactgggctgtaatcatcatgagttgtatactggctaccttatttactaagtacgtacaccctgagcaaatcctgtaacctc

SEQ ID NO: 47078 - DNA, 954 bp, Bovine  19866881408370
aaaaggatcgattttcccaagccttctgcctcttcttttcacttaatgaattatcatctcaccagatgggcttttagtacttttttttttgtactaggatttaacaaaaatactccaacttggggaggctcattttactatcagcctggttgttcatcatggctttggatgttgttcccagacaaaatgctggtctgaggccagtcatggactttgagtccttttgtattaggtaaaggctgtctgaaaacaatggccccatccggtaaggttcaggaaagaggcatttttttcctttagtaatcagtaatgccctgatgcagggctggattacccaccacccacagtccaatttttttcccagttatttttgaacaccaaggcttttgcaaattagaaatgttatgaagactgtttaaatgggaaaagatacttaggacaaatatccccagcatcagatgcatttataggctaagatgtagaaggaaactagcataactgttttaaacgtgagagcagatcatgtgattcctgcaagagacacaaactccagcacccattctgaaacagtaatttaacataaggcacataatttacccaatgaaatggaaagactacgtgatcacattgtttaaatataaagcttgattaattcaacattctcagcttactttcttctccgtctaggtgggttttttgatttgttttgaaatggctttgggccatactctggggtcaccccaccctcccttccttgagtccaggccactgcctggaactctgtacccctgataacatcctcctgacttggccaaagcaccaggcgccaggcaaaagatcacaactggaccactcgttgataaaatgcttggcttttgcagagctgtcatatgttagctgctgccaaaaggccagttgcatttattgaaatcttcgattacgcctaatgcccaa

SEQ ID NO: 47079 - DNA, 952 bp, Bovine  19866881452682
ttggaatcctgtggcacagaagtggctgaggagatcagggaggagtaagagatggggggctgccttaaggagctcacaacctaattgggaagatgagttattcaagaagccttcaactcagagtggactgcaaaaaattctgctgttttctaaagcagccactgtggcagccaccttccagaaaagctgccataatctcataaatttaaaaagataccataagaaaggaggctattaatatcatttacattctgtggtgagaaacagaagggagaccttctcctctagggtcattcattgcagaggagagctgacagacctcgagttatagcctgtgtgttagttgctcagacatgcctgactcttctcgaccccatggactgctgcccaccaggctcctctgtccctgggattttccaggcaagaatactggagtgcgttgccatttccttctccaggggatcttcatgacccagggatcgaatctgggtctcctgcactgcaggcagattctttactgactgagcttccagggaagcccatgagagttatttgtcctgatttatgaaaccacctccaaggtcagggtagttccagttgttttttttttgtagccaagctcccaggatatttctgcaaagacggtttgtttctactactgaggattaaaaagacaaaaaatagaaagcatcgttcagagagagctcaaaattaaaaataaaattcaaatcaaatcagcctctgaaacatcctgaaaacctcccaccaatgattccagactttgttatcaggagatcagtgactccagctgtacacaaaatgcaataagcaattaaatacaggatgcaaaaggaaaaaatgatatagtcacgaagctactggagccttcctttcttcaaaatatttaagctctagcttctttaaatttaatttcacttaaaaatttcaagag

SEQ ID NO: 47080 - DNA, 2013 bp, Bovine  19866881511264
atgatggtatccggtcctatcatttccggcaaatagatggggaaacaatggaaatagtgagagactttattttggggggctccaaaatcagtgcagatggtgactgcagccatgaaatcaaaagatacttgctccttggaagaaaagctataaccaacctaggcagcatattaaaaggcagaaacattactttgccaacaaatgtccatctagtcaaagctatgatttttccagcagtcatgtatggacatgagagttggactataaagaaagctgagtgcctaagaattgatgcttttgaactgtggtattgggagaagactcttgagagtcccttgaactgcatggaaatccaaccagtcaatcctaaaggaaatcaatcttgaatattccctggaaggactgatgctgaagctgaaactccaatactttggccacctgaggcaaagaactgactcatttgaaaagacactgatgctggaaaagattgaaggcggaaggagaaggggatgacagaggatgagaaggttggatgacatcactgacttgatggacatgagtctgagtaagctctgggagttggtgatagacaggcatgctgcagtccatggggtcacaaagagtcggacacaactgagctactgaagtgaactgaggttttctttattagaaaagatttctacataacagtgtttttccttcataaagaatatgcaaatagatcagattacatttgtgaataaactctggaaacacaatatgtgagaaccacagaaatgaatgacaaggtacagaaaatgcaaggaaaaggaaattatcgtgagcaaaaaaggaactcagaatgtactgatgacaggtaacatcataaatagtaaatgaataccacatgatatcttttaatattaacttgaagtttcatagtaatactatttgtattcaaaacgacactaaaaaacaaatgatatacattaatattttaaaagttgggtaaacattttatttatccttacggcagagctaaataatgtcatacttgcagtgtttctttaaagaattatcattgtatagtaactttaataatttctgagatggaaaaaaattgtgttaaaatacttttcaatgtaaactcattttgagagaattcccttgaggtactatactttgggctaaaatggcacaaatgtattttaaattcaattgtttaaaatgtatattttatgacatgacaatgttgaaattattctatttttgtcagcatttggggttatctttttatgctgaataagcacctataaaatcatcatactgtggccttttatttggtaaattttatatgatgatgattttacagcttagatatacactagaggaacattatgtggtcacatggtatttctgtttccctataatataaattttcaatatcaacttataaccgaaactaaaaaataaggataggaaaacaaatgctataaaagttatttaaataaattgtatataaagaacatacttagaaaactgaaatcgaacagtagtcactggcagttttgtttcaaagtcagtttacttgcttagagctttaatttctacatcattgctatttctcacaaacacatacgacttctgggagttgggaaatcatgtccatttaatttcctttctacatttctagcataattatacttgatatttagtagatatacattaggtttcacatatagtaagaattctggcaaagacaaatgttcaaacagccacatgacttaaaattatattttccttcttatatttttatttacagttctaagttcaaatattcactatctgtggcttatgcaaataggaaaaaaacatagttgaaataaaataaatatgaaatgttgatatcaatatcttagcaatctgatttttctcactaaaaactcaaaaagtacaaatattatcacgtattaacctgttacttagagtacgattttactttcttcggaaagataagtctcataatttaaaata

SEQ ID NO: 47081 - DNA, 636 bp, Bovine  19866881674871
gaatagtgctatagtgaaccctgactgttacgtgtcgtatccttttgtatattatgaattattgttttatatttatcagtgaatgacatgtttccaattagacttctacaaaaatatacgacaatattttgtttaaattacattatttatttttaattatccctcttagtcctgcatgcattgttagcacaaaaatttgattacaacctccattgaagagatagtaggtacacaatcaccatctgaagagtttcttcagagatgaccgacctagaattccaggccatcataacactgtcagtaacctatacaatgttcaatagaaaaatttaccaaatatcctttgtttaatgtaaacaaggcaggaggcaaaacagatattatagtaacactattttacagggcccagaaatatgattacctaccatgttttaacacatcaagtgtcacaatgacatgcatattttgattaactgtacaatccaaaatacaattaccatataaattgtggttttagcaattcactgtaacttctgtcaatacttataaacttcataattaaatggtaattgtatattaatgcaataacttatggaaatatgttaccatgaattatgaagtaattccataatttgt

SEQ ID NO: 47082 - DNA, 1286 bp, Bovine  19866881695057
ctggaaccagtctttgaactcaggcagtctgaccctaggacacagcctcttaactgctgaagtgaataccgccttcatctgatttattttaaaatactcattatgtaggacagtgccctagtccatgtaggtgctcaatttcattttttaaaatataaataagtgatttaaaaatataatagtgataaatggaggagcctggtaggctacagtccatgggatcgctaagagtcggacacgactgagcgacttcacttcacttctttaccactagcgccacctgggaagcccatctggcctttagtccccttatattcactgggaatttggactggatgatcattgttaccttcctcctgtagggtagtgtgattttgctatttctatagcaaaaatccattaatgtggactcatgaccataaataacatgctagatcatccattagcttaaaatttgtgattcataatgacatttttatgaggtcattttattcctaccttattctaattatgtgaaagttgtccagtatgatgctgaaaataaaactgtgtaaatggtatcagttggcttttgtgatggaaataagtgaaatccagagtgtaaacataaagactttaagcttctctgttgaaaattgcatttcgttgatttttattttactttttaaataataaagaatattcttgaagtattttctgatcttttccataaatgaaaattaggctgttttgaggccatttcagatttctttggtgctggtagtattacttcagtcatcatctgggctttgcttttcaaattgaaactttgaaaatctttttgatcattttactcttggtcattttattttataaaaggatagtaacagtatacaaagaactctatatccagtttctaaattctttgtattcaaaaaatgtaattctatatggcaattctaaagtatatcttgttatttccatatggctactatatatttctaaaactgtttcctccctagataaaaaatgtaaaatgcatatttaaattattttagaaactcattagatactttttttttaagattcttgttttgtttttaataggtccatgtatatatttgggaggattttctagtgtactccttaacgatatacttgtatacaagcctccaaattgcaaggctttcagagatgaagaactttgtaaaaatgctggtccaggaataaaatgtatttggaacaaaaatcactgtgaatcttgggactctgggaatactaataatattcttagagcaaagtgccct

SEQ ID NO: 47083 - DNA, 996 bp, Bovine  19866880435742
ccctctgcttgcccactgagcgactcccgggtccagacccacattctgcatccacagagagagggcttgtgagcacaggaagcggcccctgaggcactgggcagggggtgagctccccgtcagcagcggcagccaagcagcagctggtcagccaagtagcaacctgtggctgagcaggctttagcagtgaatgtttgatgagaacaatgacctttcatggccccagaggggagtccgtgaggccgaggcccagagagggactgagcttgctcagcagcacagctggagggtctcaggagaaagacccacatcaaatggagttttctccccagacccgccagctcagggccagtcagggcccggagtcttggggcgcagcggcagcgaggggaccaggcacctcacctgtcagagacttggctccacacagccgctcccaccgggttcccggccaggtagatggactgcgccatgggcctcagggcctgagcgtcacacaccaggtcccactggtgggagaggagtggaccggggatctgagctcaggaggcgggaaaggggccggcgagggtgctagatgggaaggcccagggagctagggctgggtgtccggcccggtgaccttgggggtcatcaccccttgcctaagcccctccttagctccctgttgccccaggtccggggtcaggccctctctgggctcatccgcctccttgccgggcccttctacagtagctacccacgctggcgccttctcccggctttcagaggccgcttccctctgtttcatagagtccccttcctgcttgctgggtgggccgcctctcctgtctcccacatccgctggaggttgcctctgggaacccagtgactctttgcggactgcccctgaggttcctgcaagctcattcctgccatcaaccctggtaggatgatgtggccaaggaggaactggaagctgcctgtgaatgtggaggccaacagtggtgggactcc

SEQ ID NO: 47084 - DNA, 752 bp, Bovine  19866880463175
aaggggacgacagaggatgagatggttggatggcatcactgactcaatggatatgagtttgagcaaattctgggagagagtaaaggacagggaagcctggcgtgctgcagtccatggggtcacaaagagtcagacacgacttagtgactgaacgataattagcctcttatcagatatatggtttgcaaatattttctcccattccatgagctgacttttcactttgttgctggtggcctttgatgcacaaaaggttttcactttatgtccagtttatctgattttcttttgttttgcctgtgctttcggtgtcacgtccatgaatcattgccaaatccagtgccctgaagctttccccctatgctttttcccaagcgttttatagttttagccattaagtttaggtctatgctccattttgagttcatttttgtctatgatctaaagtaagggtccaacttcattgttttgaatgtggctatccagttttcccagtgccatttgttgaacaaattctttttatacaaacaaaaaaagctatgtttaccattcttacagaactgtaagccacagtgaatatacaaatgaaacacaaacaaaaccaatgaccagtaaaattcaaacagcactaaattaacacaagagatgaggttattttgctgaaacaaaatccccgttgctcagcaagagcacagcaggttcaactgaacggctcaccatggttctccactggaaccgctgcctgaatacat

SEQ ID NO: 47085 - DNA, 1000 bp, Bovine  19866880468881
gggcagcaggaagcagggcttgtggtcaggatggtggtaggctggtgatgacagttgttaatctcatcctgaacggcttggttccttcacaggcaccttctgaagtcacgtccaggctcagcttttgcctgtagatgaactgagaccaggcgcgcctcatcgtcaggctgcccaggcagcgggtggcgctgggcctggcgctcgctccacacgcctcctttcctcttgtaggttgaacgtctccatcgagtgtaagcgagtgtccggcctggagccagccactgtggactgggccttcgacctgaccaagaccaacatgcggaccatgtgagcacgcctgggcgggaggggctggctgtgctctgcagagcccctgtcctgactgctgctgtctcccaggtacgagcagagcgagtggggctggaaggaccgagagaagcgcgaggagatgacggacgaccgagcctggtacctcatcgcgtgggaaaaccgatcagtgcccgtcgccttctctcacttccggtttgacgtggagtgtggtgatgaagtcctgtactggtaggggccgcggcgcggggggtgggcgccggggaggaggcagaggccacgcggggtgtctgggcctgggccgggcctcagggcccctccaggctcaccctgctttcctccccaagctacgaggtgcagctggagagcaaggtgcggcggaaaggcctggggaagttcctcatacagattctgcagctcatggccaacaggtagggagggggcggtgtgtgtgtgtgtgtgcaagcgtgcgtgtgtgtgtgagcgtgtgtgtgtgagctcctcatacagattctgcagctcatggccaacaggaaggccttgtgtgtgtgtgtgtgtgtgtgtgtgtgtgtgtgtgtgtcgctcttgggaggagctgcctctgctgtatgtctgggaagggaggtggggacaaggctcacaggaatttctgaagaagggtatctagaacctc

SEQ ID NO: 47086 - DNA, 699 bp, Bovine  19866880481023
gaagagcaccgcggatagaattcgcaccagccccggtggcacgtgccacttctgcagggaggggccgaggagtcaccaaaacctccaggctcacaccccacaccccctcttctcagaaccaccagtgttagaggttcgcgggattcaggcgccccgccccgctcacatgccccgggctgggacggacgtaggtaagggtatcccgaacccaacgccagggcgcacagggcttggagcagctcaccaggaagatggcttcgatgtgaccgatgccacggcgcaaggaagagcctagccggtccccgaccccggccagcagtatcccaaacagcgggatccccaccagcgcataaaagatgcagaagaggcgcccagcgtctgtgcgcagggctgcgttgccatagcctgggcagaggggccgtgcagcaggtctaggggctacctggcacccccctagctccccctgcaccttcccccatgagaaagcccagccaccccttgccccctctccatgcccaatcccttcccccaccgatggttgtgatgatggtgcctgagaaaaagaaggcactgcccaggtcccaggctgaatggttgctgttactggttgagttggtgtcagggttcgcgccccctcccagggcatcagccacatcctgcaggacaaggcgcagaaggaggaacctcagttccttgcct

SEQ ID NO: 47087 - DNA, 1873 bp, Bovine  19866880527755
atctgtgatgaggtgagtgaggggcaggcagaacagagtagtgggcaaggagggaggaggtagaacaagccagaattccataggtccagactggcacacggcttgtgggatcttagtttcctgaccagggattgaacccagggctttgacagtgagagtacgggactcctcctaactgctggactgtcagggaagtcctaggcatccatcattgagcaaagagcttggctttgcagctaggcacacttgaagtggaattctaacccttgcctctgtgtgcctcagggttttcctccctacagtggggataatgataaatgtcttgcctacttccccaccaggtttgttgaaaagaggggtaaataggagtcccagttactaaatcaacttcccttgggtgactcagggcaaactgttccatctctccagttctagttttcccacatgaaatgaacgtgcccaagatctgactttctgtgactctcggcacttgaactacaaactgtaaaacgctgtactagggtaacatgctattcttcattgagggggcggggacgtgggaattgggcactgacaggtggtatccctggccccaggtgaatgtgccgccactcaccctgagtcagccgctgctgttgggcatcgcctgcaatgagaccagtgccggccgtgccagtgctgagttctacgtccagtgagtgatctctgggggacagaatcctgggtcctggagtaggtgggtggttgaggggcatggctgagggagctggtgctctacagggcccctccaggggctaagcactcaccaggccactctcacatcctgtccaggtgcagcctgacttctgagcaagtgaggagacactacatgagtgggggacctgaggcccacgaatccacaggaatcatttttgtggagaaacaggttcgaggtggcaaagtgtgtcatttggataagcatctgggttggggcttgcagaggcctggttatgcacgtctgtctcccaggcctgggtcggacggggctcccagatctcagagcttctctccagagcccacaagtcctcacggggttgccttcagcccaagggagagtgccagggacctgctcagcccccttaacatgaggttctgaggctcagaactgtgggcacagctcccacaggaaacctgacgctgagatgtctgggtctcactgtctctccccacagagtatgcagaggttgcaggagactgagatgtggcctgagctctgcccctcagccaaaggcgccatcttcctctacaaccgggtccagggaagttccacctgagtctcctggagtccccagccctatcaccacagctcggaagacaataaaggactttattcttggattcctttggcatctgctgtttgcatgagacagagggggccactgggagagcccagggagggtgagagagacaggacaagtgacttgggttaaaaaaaggcccaggctcagtcttcccctctgcaagctgagggccgtgcccctttgccaggttccagtgaggctccaggctgactatggggtggaagggtttcccgaatctgcctgcaatacaggagacccgggtttgatccctgggtcgggaagatcccctggagaaggaaatggctactgactccattattcttgcctggaaaatcctatggacagaggagcctgcagcggggctatgcgcagggtcgcaaagagacacgatcgagcgactaattttcacacttcattttacggggtggaaactgctttgtgaaatgcgtctcggtgcagagtggagtaacagctgtgtccgaaggagtgaacaacagaggttgagctgaaagccgcactcagagcaggaccag

SEQ ID NO: 47088 - DNA, 471 bp, Bovine  19866880533972
tctccctgctgagccccggcagggattaggtcctctgtgttcactgctgtgttctcagcgcctggtatatagtaggcactcaatatttgctgaataaatgccagaagcccccaaatgcttcctcttcactgttcctctgtcctctgcgcgttaggcatctcacgccctccctcctcctcgaggtgaggcagaggggacaaaggtcgaagcgggatgctgggagagaaaaggagggtgaccttgaacaagccctcagcctcccctctccctcctcccaaaggcgggggcggctccagccaatcctgaacccgtagccctgccagacagactgggactgtcctgagctctggccaggccagcctggccgctgcggcgtggtgcctgggaccctggccaggccctcggtggccacagccaaggggctcagcttggggagggtggcaggcaggcgggcccttgggtgggggaggg

SEQ ID NO: 47089 - DNA, 1184 bp, Bovine  19866880585751
tggaagtccacgggtctccgggaggaagaggacgatgaggccagcagcaatggggatgacaccacaggagagcgggggcagcaggggcaggacctggtgggtcatcctgatcagcgggcccatcacagaccccagccgagctgctgggtacaggaagccttctgtgattatcctgtgagcggaggggagggccgggacccttgtcacagctgctgttatggtgggggccagggggaggctttcctagaggaggggcactttggctgggccagggaatgccaggggagggaaagctgggctgaaggagtcaccttccttgaggtctctgctaacatcacctcctccatggagcccacctggattttcccatcaagagggggtttctgctttctgggaccatctggagtccttcacaggaactctccaggcccaggccattcttcctggtcttgggtactttggaggcttgtctcaggggtcctgctaggccgctgagctcccagttcaggcttcccataaagtatcaacaataccaataaatgtggtttctataggcttttcataaagtatcaatgatatataaaaaaagagtgaacgagtgagcgagcgagcaccatgagtaaggctgggccaggcctgtgggggctgaggtccacccctgctcttcaactgagtaagtccttggccaccctaaacctcagtttacccaactgtacagtgtggggcttgtctaactcttgacaagggacagtgggaggcaaccctccgggctcttataagatttcacctgagcagcgggctctgcggctcaaagtggttcccagtccggaggcctccaggagccctccttggggctgcctccgagcctggactcagcggaggggctgtgtgtggaggccctggctgagctggggcctttgcggggaggactccggggcgtctgctcggttccacgtcggcgcctggtcctctagccctccactgtatgttcctgggtgccaagcccctgcccgccctccccacgggcccttgtgggggtgtgccttccacagctgcagcccagcctaccgcagtgaagttgggaagagttcaggcttgtaaatcatgatgcaggttaagctgaggccaaaacacccctttcccagcacagcgaagaccacacgcagggtctgcaggtctaaggc

SEQ ID NO: 47090 - DNA, 1847 bp, Bovine  19866880647188
atgaatggtagtctaaaaaagagatctatctgtctgtctgtctgtctgtctacataaaaagaaatccagaggtcatcagtctagggctgctgtggtgtcttcaaggagccaagcttgattttttctttttaaatgctccttcatttttagcacatagcctccattcccagggctttccaggcggtgctagtggtaaagagcccatctgccaatgcaggagacaagagatgtgggtttgatccctaggtcagaaagatcccctggaggagggcatggcaatccactccagtatttttgcctggagaatcccatggatagaggagccgagtgggctatagtccgtggggtcacaagaatttgacgtgccgagcagctaatagctacagcctgcattcccacggttgcctcctggtatcaaaatgactgccagacctcttgctgtctaggttgctctccaggtgggaagcatgaggaagaaggagggaagggcaaaaagggtacttaacaactgctcaccctcctcttcaggctctttctctggatttctccctcataatttttgcttacaagtaattggtcactgctaactgcaaggaagtttgtaaaatactattttttagtttgtacattggttcctgaaataaatgggggctatagtgctaagtatgacagagagaatgggtgttggacaggcaacaagaacaagctatgccacactagtttaaacataaaaaggaatgttttagctaccataaatgaaaagtcagggaaaacggtctgacttcaggcaaggctggatccaggtgctgagtctatgttattaggaatttcttactttgtctcctgcttctgcttttctgcctgggcatttcatcactagacactgagggggccccagcagttccagactcatatcctcccagatttaagtccagtaggagatttttttttttttttgcataccagttctattaaaagtcccagaattggctgagtgcggtggaggggtggttctctaagggaaacagggatcctgttatcagaggaagggaaacagaagctggggaggcaggaagaacagctttgcacacaactgcaaaggcgagacctttgcctcactgaggagctgcccagtgagggtggcccgagtggacagtgtttccacttcctgccctttgatcccttatctttcattccttttctccagggtctggactgggctgctctggctgctaggaagattccagccccgttccgaccccagatccgctcagagctggatgtgggcaactttgcagaagaatttacccgactggagcctgtctactcaccccctggcagccccccacctggggaccctcgcatcttccaggtgagtgagagctcatggaaccacagatgcaggggaagtggggtgctgttgcaagcctcagccccagctgacctctggacattacatagccctgtgtcctgagggggactcagcatctcccttcctctccattcatgatgaacttggaattgtcagtcattgaggctgccttggcaggacacgtctttgaatttctggtttatcttgaaatttcatttcgatttcccttctccatcatctctctttattgttaggtaaaactgttgttttaaggggacacctaggaagagatgctttgtttatactgtggcataccatatcacattcctggggacacaggccccctccacccagttttagaagcttaggcctgttggacaagtccaagctcctttgcctggtatgcaaggccttgcatgatgtggtctttttttttttttttacattttcttttcttttatatggaatatagcca

SEQ ID NO: 47091 - DNA, 5491 bp, Bovine  19866880650306
acatttaaaatgtagtggagcagaaactaacacaacactataagataatttccgtctggggaaatgggggaattgggtcagaaggtaatcaaagggtcctttagtttgaaagcaaatattaattaacaatagaaatgaattctaatatacagaaatacaagtgtatttctttttgtacttcacatcaacctataacaactccaaaggctatataacattcaactgcacaggtatgttacacactccaacaatctttaattgttaaggcactaagatacctgccactattgtaaacagccctacaaagaatatctctatagttgtttttgcacataaatttcttttccccttagaatacatacctagaaacaaaattgctaggtcatttccaggtctgttatatactgccatatataccacagaatagcaaaagaaaaataaaataccattaattttttcatagcttcctttgcctattttccccaacaactttaggcagaatataattacagaattggttttactttagaaatgaagactgctcagatacactgcttagagctagatggtggtatatattagtataatttacatcttaaaagatttattcacgatgtaagacaattttaaaaggttttcaattctgaaaccttcaaaggaagaacttttagcttcttggtctaattatactagttttctttaattatcatctaaaaatgtctattaatcatagaatttggtcagtgacaaaacaacttaaacttccatagtccttttcacctcttacactaaataactcagttgagatttactaataattagtatttacacagtactttatttactataggatcttccctggtggctcagacggtaaaaaagcatctgcctacaatgcgggtgacctgggttcaatccctgggtcgggaagatctcctggagaaggaaatggcaacccactccagtattcttgcctggaaaatccctctcttatagctcctgtagcttctattaccttgaaaagaagcctagtcaggctaccagattgatgagagacatatgaattggtaactccattgacctggctgacaatctgcaaaccattcacatgagtgaggccaaactggagtatccaataaccaaactatcacactatcatgcaacagaaaacccagcaaaaatgaattcagctagcccaatgccgaataattgccaaaagagcctacaaaattatgatctaactaaatggttgctgttttaggccaccttgttttgaagtggtctgttacacagcaaaagctactcacacaaagaagtacaaactaatatgttaggggttgttaactctgttaagcgacatgctgaaaatggaaggttgcatggcaattttaaggattataaatacagatctataaagagtagaatgggttataataataaaacttaagaaccattatttatctttttcacttagaatgcatttaatgttgtttcagttaccttacacatatgaacactttatattcgtatgtcaacctgataaattggtagtatttttatctctctcattttatataggaagaaacagagaataaatcagttaaacaagatggatgattgatttgaaatgaggcagtctgtctacagaaactgtactcccaaacattgtatggcttcttgtgacatactcacagtacactgtagggtgactaagacaggaaacaaaatattatgtaaatttcaacctacatttttgtttaaaaaattaatagtctgtgcagactagacaagaataagaagtgacatgaacattagtttcttgttgttattgttacaaattactgtaaatcaaatggcttgaacaacacaaagttactatcttacagttctctaggtcaggagtccagtgtgtttcagtagactacaatcaaagtactggtagtgtttctttgggagaatgtagcagagaatgttggggagaaggcaatggcaccccactcctgtactgttgcctggaaaaccccatggatggaggagcctggtaggctgcagtccatggggtcgctaagagtcggacacaactgagcgacttcactttcactttgcactttcatgcattggagaaggaaatggcaacccactccagtgttcttgcccagagaatcccatgggtggagaagcctggtaggctgcagtccatggggtcgcacagaatcggacacaactgaagcgacttagcaacagcaacagcagagaatgtgattcctgccaattcatcacattggcagtattcatttcattgaggttgctggactcatgtccttccttgttggctcctagagacagctacattctttggttcctactccctttcctccattttcaaatccagtgatgatgagttaacgatttttcaagctacatctctctgacatgcttttctttttttgttttcctcttaaaagaaatcatatgattagattgggtccacctagataagctaggataatttctttatatcaagatacttagccttaattacatctgcaaaatccctaatactgtataaggtaacacagtctcagtttacagggatcaggacacgagcatctttgtgagctattttctgtcaaatgtatctcataaagatatatatcccaaagctaacaactataatttctgaatgctttcagttgtaaggtgagttttgttcacttctttaagtttaatagaattctctggtattcccaaaggggaaatttattataatattcatataaataatatttgtactcatagtacatttcctgaacaatatttagggtatgattttcagatacccccaatttctgtatcttttaaatataaacaattttatttaattaaattaacattgcttgaatatcaaattctttattgctatcatcaaaatcattgtgccaaatggcacaaaattggacttattttcaagtctacatatttacaggttatactgcttttctagtagtccacaggtattaaagaattaggaatttaggttattctgatttttttattaacctattatagtattaccataagcttctcatgaataaagttagtaatccttcttgaatatctttttaattccttccagaaactgagttaacagagaaattttcagaaagctaatattttcaaaagttttattaaaattttggtgtccatttattaaagtggtattgtgacattgttgaccttttaagctcttattaactcatattctctctgtgtctccctgctttttccctctccttgttcttttccaccccatctcctgtccttaaaatgtctctttccttaatatctcagcacttttacattcatatttccaactccatttcctttgtatctgtttctattatatttgggggccttaaatgacatatagtgagtcttactgaactctcacagtattggcattctgtacacatgacacattacaagtaatatgtgtaatggaatggcaaggaatgttagacatgcacattgcaaatattcctctgatcacatgcatgcttcattgttccatcacacatcacttacgaaactcaaattaaaaaaattgttaagatgtcaccatgatggtgagagcaccacacagaattatgggcagtgtccttcttagcataggccccatgtgaaagcacagcttgtatatccatgaagccagccctgtcttcttgctcccatatcactttccccattttctcatttgtgtttcttgtgattacctcctggacaaattaattgcatcccaaacctttacttattttattttaaggaaatcatgccaaaatgccaatagtattggtgatcaaactgaaatgctggaattagtcagagagcaccaagagccccacactgctggtggcagatcaggtcagactggtagaccgacaatgcatgctaaactgaagcatcagttacttagaccctcattttcagagaatgaaatcatgtgcaagtagaaaggaaaatgtttcatgcagtagttcaaaaatttgaaacatactggtgcaacagctattctaatgatatcaaacttggctacatattaatattatctactgacctagggaaaaaagagaatgacaaactcatgtcaggggactagcaacataagtcatactgcaagtcagaaatccttcaaggcaaaatgtagcacgacccatatatttagtaaccaaaggtcagatttggctgaagcttaaacccatgttttgattttaagagctctagaatcaccaaacaatattaaattcagagccccagagcatattcacagaaaaacttacaccctttatagagaagggttggaactggagatccggaaaagacactggataggatttccctgaaccctctgaggggatggaaatgtgtcctcatctcttgctataggagggaaaagttgcctgaagatcaagaactatcttacctaagagagataatatgttaatgatactttccctcattgatctttatcatttgccttcattgcctgcaaattaatagccaagctaaactctcagcatgtatcaaatgggaagtatgactatattacgtgaacaaaagagttatccatttgtaagaacaccataaactggtcaacaactaacaggagaagaatcaattctgtaatatataacatcttataatgtaagattaagtatataacatggtgactatggttaataatgcagtattgtaaacttgaaaataagtgactgagtatagatcctgagtgctcatcacacacaaaaaagtgttatctatgtaagatgatggatgtgttgattaccttgatcttggtaatcctatcacaatatggatgtatatcacatcattacattatatactttaaatatacaccattatatttgtcaagtatttctttaaaagttgggaaaacaaaaaaaaacagtagaagccagtttactatgaaagtgaactttgagtatattgcacagaagaaagaagaaaagacataaagctacttagcaagagagtatatagttatgggagtgatatctgactcatcaggactaacagactggcaggtttgatgaaacgcctgcagccagtcctaatatactgctgaagtagatctgtatcagttttctactgttaataacaatactgtaaaacagataaccacaaaacccaatgacttaaaagaggaatcatttattcagtgttttgctgttctagatctcaataaatggccagtggattatctctcaggcatacaacactagcagacaggtggtgtgaatgtagcttttctagtaccaccttagttcatatagccttttatccccttggagcttaatttacacttccttggatggtaagacagaggctgaagagaaagaactgaagtatgtactactctaggctagatacacatacattgttccttccatttcattctagtggtcaatgcagg

SEQ ID NO: 47092 - DNA, 2261 bp, Bovine  19866880826088
tcaccaataatttcatagatagaaggcagtgatgaggcagagacaaagtgggaaagagccagggcctcaaatgcagctccagtaggacttttgttctcacatttgagcccaagttaatccaagatatctgtatgcaaagtgtgcagtcaccgcacagtgggaccaaccccccacccactgctggccgctcagagcctccccgccagcccaaccggcccctcccctgaggaaagccctttgctgccccatgcagggcaaggaagccaatagccaccaggcccctgtcagcagagaactccaggccccgtgtccctggcagcgagtggctcctggctgtggccgctagacagagcggagtcactggttgcaccccagctttattctcctgtgcctcacatctgagccaaggttcagaaatggacccaggtcaccgtccccagggaatggtccttggctcccctcctgggccgggctgggggctctcttgcccactcccgcctgcctccctcagctgggagtttccctggggactgcctcctcagggagggctgcagggccgagccccagcagggagctgtttgtaggggccagccgtcccccctgtccacaaactcgtcccagctccagcttgggcccccagtgcaggccatggaggatccaggggcccaggtctccttgtccaaggactcgccatgagtgccctgcctccccgcgttcttgggctgcctggggtccccactgagattccagtgctgagaacactccgctcccaagctctccatccatgcggtgtcactggctgagagaaggggcgagagttcgcttctccggttcctgcacctcgaggcctggagagaaaagctcagctcaggcttaccctctccaaggggttcccagccgcctggccgggcctcgaacataccaggccttcgcttcagctcttccctctgccaggaacaccattccccagatacatgaacagaacacaccctgacctccaagcctttgcttcagcttcacctcctctcggaggcctgccctgagcaagctacctgaccttgccacctgcccacccgaggctcctgatctcacccaccctgctctctttttttttccaaggacactgtcaccttctaatactgtagggctgagctccccaggacaggactgggcacctgagatgtggccagtctgaactgcaatgtgcttgggtgtaaaataccactggatttcagacttagtgtgaaaaaaatgaaatatctcattaaggattttttacactgactacatgtctaaaatggtaatagtttaggcatactgagttaaaatatattaatattctaatattaatatatgtgggtgatgttgaaatatattaatatatcgatattaatatgtacttatagagtatatttggtgtatttgatgtataatttattaaatgcattaaatatatacaatatatagtatattaaatatataccatatgtttatataatatattaatatgctaatattaattaactttacatgtctcattacttcctctgattacttccaggggtttccctggtggctcaggtggtaaagagtctgcctgcaatgtgggagaccccgggccctgggcctgggccaggaagatcccctggaaaaggaaatggcaacctacgccagtatccttgcctgggaaatcccatggatggaggaggctggcagactacagtccacaggggtcgcaaagatcctctgatgaggctacctaaacattttaaattacacgtggagctcacgtcatagttctattggacaagctatggtagataattattatttttatgcatatcatgagctgtctcccagctccccataccagaatgttctctgttatattcccaagtatcacatcacctgacattccagaaaggctcatggtcaaatgagggaatgggtgaacgaggcctgccaggggcccaggaagggcaaatacccgctttcctcccaggcccccactcactctctccgttggcatctgcttcgtgttccgccagggtctcgatggagccgccccatcccacgccaggtcctgagggcacaaggtggccactgggccatgaaggccagaacagaggcagcagggtgggcgggcagacacaggagccaggagggaagccccctcccccaaggagccagtgggcccccagggacccttctccctcacctttgccatgggagctgggtgcccccaggggccctgggcgccg

SEQ ID NO: 47093 - DNA, 642 bp, Bovine  19866880854880
taggactgtgaggagtgcatccagctggaagccaaccttcagtaagtgtcttcctgtgctactccgctgccccctgtctggccagagggttgagaagagagagcatactctgcctgtgtgtctttggaggttataacgttttgaagctagtgtcaggctgaggagtgatggtgttcagagcaggtgaaagcaggcggaagtgtgttctgggtgatgcctcacctctctccttttctgtctccagtcaagggttatacccggaaagcagctgccctggaggcgatgaaggactacacgaaagccatggatgtctaccagaaagcactcgacctggactctaactgcaaggtggggctgccctggccttcagggatctctgccctgcttccctttctctgattcttccctctcgccctccccctcaatgactcctgttaccttggacctgctgcagcagtgagccaggtagtgctaacgctctccccttctggccctgccggaatgcaggaggccgcagatggttaccagcgctgcgtgatggcccagtataaccgacacgacagccccgaggatgtgaagcggcgggccatggccgaccccggaggtgcagcaaataatgagcgacccggccatgcggctcat

SEQ ID NO: 47094 - DNA, 1546 bp, Bovine  19866880905956
ttcacccgccctcctcacgtacccaggagccttctctgcacccgctcgtcctgagcaactgtcctctcaactgccggcagtcaagaagccagtggagcgtgctgggtaggagagctctgggaaggctggtgagcattgacaggtggagggcctggacgcacccccatcatgaactgtgaccctccgcctgaggaacccctgcaatcccctaacacttcactgcagaggggcggtgggcttgtatgaagaggtagatggatgcctccccaacaaaggaggccagcagagcctgtgaccgaggcgaagccgaaaacaaggtggctgactgtcgttcggctgtctgagctgcaagtctcaccccgaggatgagagaccgggactgcagcccaggtcgcacagggagtccacgcgcctcccagcagccacggcagagccagcgcctgcctggaagtctggtgggtgagaactgaccacagtgaaagctgagccaccctccagctcacaccccttcatgcacagaagccaccgtgccaggagcacccctcagatctcctgtcttctgagtcacttgaaatgctgggctcctcttcaaacacagtggattctatggagcaaccagagctttagaagtttccacactacttcatccctgggcatccactcgcccagggcctggtctctgtctcaatctccaattactgttgcctgttcagcacactttcactgagcgcccaccgctgaagcccgtttacaaagtcaagagagatttggcttctgcctccaagggactgagaggagcgggaccgtacacgagactcatgatgtgcctgtggacggcacggcagagctcaggaggcgccaggcctgctgggagccctgctttgctccttaccagctcagaccaccaccagtgagaacacttggagccgccagatctctagacatgaggactctagctgctcccacttcacaggattagtgtgaagaggaaatgagaaaatccaagccagtgttgaccatggagcctggtgcgcagcaaggtctccgccatgttttctgtgatctctcttcactttcaggtaggaacttttgttttccaactacaggggttctctaagctctgagaagagctataatctctaagaacttgattacaagtgcggcaaagctgatattccttctagaatgaggaaaagttaaattcctaccatggcaaggctgtcagacaaaaaggaccctccttcctaacataaaaccactcctgccaggagaagtgggtgaataagaaggcagccacgcctctgccctcagagcagcccagaagaggaggaaggtgtgcccgctcttcccatccttgtcagctccttaaccccttcctttccaaagaggcccaagagacagccgacataccagtgccacacggtgccacgggctatgggaagctcacactgccagcctcacgctccattcggctcctcccgtaccagtgggttactgtaaccatggagaccagcaagttcctccatatcacaggagagccagcctg

SEQ ID NO: 47095 - DNA, 1638 bp, Bovine  19866880965177
cctcgagtgtctccagctgcacctgcacacttggtgggaaatctgattacaggtgagcacagttatttgtcaggtaggagaaggctgtctttctaactggcttcagccatcattttcctctggtagagtttgtcatgataagcatcataatgcttcctctggatggactgaacttaatactcacttagcatcccacttttattcttttccctcatgtctttgtatgtttgacctattgaatcctgcctcttgcatggacagctaccacccaccgagactcctttgccctctgcccacctacagagccacaaacactgcaatttttattttgttcacatatagcacacattcacttgtcacatagtaatggttaaaatgtagccatatcttattttctagatcaggaatcaaaggcatagggaatttattgaaagtcacataagtacttggtgttacacctggtactcacatgatctcaccttttccaaatacatcacatgttgtgtacctattgtatgtacttacatgtacatatgttactgtctatattcacgcatgctaagtcgcttcagtcatgtctaactctttgcaaccctttgggttgtagcctgccaggtttccctgtccatgggattctccaggaaagaatactggagtgggttgctgtgtcctccttcagggatcttcccgacccagggattgaacccacatctcttatctctcctacattggcagctgggttctttaccactagcaccacctgtttactgatggcagtgggggaatctccagaacaggagcaggagccattgggcagcgacaaggaaggtgttaactgtcttgctcatgaagccatcatggctcagcagacctaattcagcaagagatcactgtgcagaacccgctggtctgggtcctacacagatagtgcactgaggataacaacgtctgtcaacagaaggtcaaggaccgccacagaaagtactcctacatccgcaagaccagggctggtggaaactgcctctatcgcgcttttggattctcccacttggaggcgttgctggatgacagcaaggaatcgcagcggttcaaggctgtgtctgccaagagtgaagaggacctggtgtcccagggcttccctgagctcacaactgaggatttccaccacacgttcatgggcctgaacgagcgggtggagacgcagacctcagtggccaacctgctggtctccttcagtgaccagagtaccttggaccacctggtgatctacctgcggctgcttccctcgggcgacctgcagcggaacagcaagttcttggagcactgcatccagggtgggcggaccatcagggaactctgccagcaggaggtggagcccgcgccgaaggggggcggccacatcctcatcctggctctggcttctccagctgggtagagggcatgggccgcggcgagggcggtaccacgaccccccccgagggctccagcccaaggtctgccttctctgcctacctggacaccaggacaccctctatgaataggcctgccctcccctctgccaggcgctaaacgcgtacagaggggtttttgggtcataaagatcatatttcactgccccacccccttcccgtcacacga

SEQ ID NO: 47096 - DNA, 1609 bp, Bovine  19866881037958
cccccggaaggggctctttcctttgagctgtaaggggtaaatcagtacccctttacagctaatctttcttctgtctcttcattttgttttctcttgaacttcatgtcagcagaggcatacacgcagcgtgtaaggtccttttactcgacgtctgcgggatccacccacattactgtgtgccagcggtttgcttttcctcgttgctgggtggcatcccgtggtgtggcacagttttacgtgcagtcttcttgtagccacttggtttccagtttgggacatttgggagtaaagttgctctgaatatccttgcacgtgtctttgatggacacatgctcgcctttctgtgggggatatacctacaagggcggctaaactcttgtctgtgcctgagatgatcctctctcaaagactggcacatagtaaccaaactcacaggagactaatgcatagttcagagggttgaggtgctgttcatggtgggaaatagaatagtagcggatctggaaactcatgtgcgcctgggcagggcctccactccctgtggaaaagccattgttgttcggtcgctaagtcgtgtccaactctttgcgaccccgtggactgcatcgcgccaggcttccctgtccgtcactgtcacctggagtttgttcaaattcatgtccattgagttggtgatcgctagctagcgatctcatcctctgccaccctcttctcctgccctcaatctttcccagcataactgtcttttccagtgagttggctctggaactcactggaattaaccatcaggtggccaaagctgagcttcagcttcagcatccatccttccaatgcatatccaggtttgatttcctttaggattgactggttggatctcctcgcaattcaaaggattctcaagagtcttctccagcaccacaatgttagaagccaagttgtagtctgaagtttgttcagcagcatgtgctctcaactagggagatggtggagtgacttggaagcggatcccgttgtcctgagcacacccacccaccttcctcgggcagttgctcagtgtttcagcccaaacgcagagctgagtgcctgctctgggccccaagggcagcagcctcagttcatggtccagtgggtcctctggacagatggccacatttggcctgggctctgtgcattcctttgttctggctttagactgacagcccacgtgtatggacctgttttctctctaaataagtaaataccatcaggctggatcttccacccaggagacattcagtctttttgagagatctctgcagtatctaatttcactggccatgggttaattcttttagcctaatttcctcagttctaggatgcctcattatccccaccccaggttatgccttttcattagaaagagtgtggaaacagtcctgctataaggtgtgtcagtgtgagggggacttaaggtcaggcagtgggggctttgtcatcacaggaggggcctggcctccagaagaagggcaggtcccttctggcctgcagtaggggtggagccgtgtgctaaaaagagaacggacttttggggtcatcagacacggcaagccccagcaccactgcgtccatg

SEQ ID NO: 47097 - DNA, 1238 bp, Bovine  19866881046940
cggccatggccgaacccccacctctgcacacctccactgtggggtgaggtccaggggccggcttctgctgggacccaggcttggcaagaggcagagccagcttgggagacccatccaggccagaggacacctttccttgctgggcttccccacggtgaggagctgctgtttctgcacctgcatctccacttcccttctcatgggctcttgcctttctccttgcttccttccctctttcccttcactctttgctccatttcacttcccacccccaacccctcttcttacataataccccttaccgacctgccagacatgcctgcacctggagtcagtctgggctggggaggaccagaacacctgggtcctaaaaatggcccggggcgggggagacacttctgatccttgaccctgattctgctttcagagcccttaacgtgcctcaccacccctgaccttcatttcctataccctctgaggccaggaagagaggggtcaatcccagttcgtttctgagtcaggagcctccaggggttctgtattcatcactccagcttataaagggatctggcatttattttgattcttgttatgggtgtgttcacttggatgtctgactgaatgttttatggcaaggaatgggcttaagaattgaggagatattgttctgggatcaagagagagctgagcccagggctctggatctggggaggaaccccccctggggggtagtgagggtctgtctacaaagagctagtgtgtgggggctgtgggcactcaggcctgcaaccttgctggattgtggaggatgttttatcctctcgtgattctagatctaccagaaggtttctgccatggcttctgatgctgcagagggtctgcacatgtagttttaaccacaggggtagaactgcatgggtggcttttcacatgggatgattattttgtttgggtctggattagctaaccattattaatggttggttggttttttttcccctctagaatgcaggtttgtgggaattgtacagaagattcttggtcatttagtgttttactgggccagtgaatgtctgggtccaggaggcatagagaggaccatgctgggtgtgggcagatggttccaggcctgggcctttgggtggtggccacttaggcctgtgcattttgtgtctggtcagaggcagtcttgccttgggcttcaggggtgttccccaccctgccaccccacagtgtta

SEQ ID NO: 47098 - DNA, 783 bp, Bovine  19866881096851
gtggactggccctttaagagccgaaaaaaggggaggagctgggagtctttaaaaacaaaaggggatggggaatttctgggaggggagctcggggattaggggtgaagctccagagcctggacgcaagcttcagggctcttaagccgttgaccccgcatagagaaacagcctcctttgagagcaaacggggaggactggctggtcccgctatagctgacaaactgtggcaaaatttctgaaaagatgggaggggtaacgcgcggatagaaggggagtgaatgacattgtgggcgagcccatctctttaaaaactgcccgcccgtggggaaggtactgataggtccccaagaggcgcaagctatgctctcttccagggagaacataggggaaaaagaaaaagggtgcccttctctagagaggccccagagaagacagcccaacttaaagcagcggagtccccagctcagttcctctggagggaagccccggaaaggaacccacggtctgggcagactttttaagagacagctggttaagggagaccacctgggagtctgaaagagaaagggacgggggacgcaagtcccaacagcctagagcgcgcaccccgcggcgccaggccaggtccttcggggcccctccagctctgcctccgaggcgggggccgcggggccctttaagggggaggggatccgcccgagccccgcgggccaaccccgggagctgggcggggggctccgccgctggcgctgcagccacaatccgcgcccaccaggtggcgcc

SEQ ID NO: 47099 - DNA, 607 bp, Bovine  19866881124839
ctcctccccccaggaagcatctctcctgtctggagccaactgcattccagggctgggccagggtaggcagcacagggcaagcccactcctccaccctggcccccggggcctgagtcaccacttgagcaaggaaggagtcacagggtggagaaccagaacccagagagtgggctagcttgccccccatgccaagatggactccagattagcccattagaaacaggcaagacacataaaccccaacaactgggttggctagtgccttaaactggtataggctcgcaagccataggtagctctccttccccagccagcctagactagccccaggtctcttgtccaaggcagcgaataagaaagaagtgacttaggtcagacaagaaagagcatacattgggggcggggagtacagagagcaagggagcgcgcttaagctggatgcccactgacgccgggtgacaggcgggctcaaggtggggtttccaggaggcccgaatcggaacaggtttagggtgtcggcgcagggtgggggacacacctggcagtcgtagaggcgagtgagctgctccaggatccactcttccaggttgaggcgcttccgtagctc

SEQ ID NO: 47100 - DNA, 2116 bp, Bovine  19866881137571
tttctcgaaccccaccttcctgtgatccgtgatccaggaggaggctgggattattccctgccatctcccttctcttttcaaacccagataacaaacagctggccgcgcgaagcacccttccaggcagttctctagctttctctttttctgggtgggggccgggggtgggaggactaggaagagaaaaaatgaggttccgtgagctcctggccatgtgggggccgcccgcctggcccagcactggctccgcttcccccagcacctgctcctcttgctaaatgtcattcagaggatccaactgggcctccagggcctcggcttccagaataagcgctgcctttccccgccagtgggaagcaggagcgtcagggaaccagaagagccggcctccgggcctccctctgaggccaggccccgtgctgcactcccagctgccctccgcggctgccttccccttccacggagacctgggggcagggccggctgctcccccagatcccaaacgaccccgagccggccggatcgcctctcattagtgtggcgtgctgaaggcccacgctgccctggcgtccgtattccccctgcaggagcccctctttggaagagggcttttattacacatctgagagcgctagccctggtttgaaatcggatccagatgggctcggctgcctctgggtccttgcctttgtagggccgaaggtggctgctttgagaaacacgtgttgtctggggttgtcgcaaataaaaaccaggatatttgggtctagagccaagtctagagcccagactgggggagggggtctgggcactcaccgggcaccccacctggcaccccaccttccatgtggaagaggggcaggtgctggccaggtggagggcgggcagagactgatggctggatgggaggagtggagaggccgcgtgggacaagcttccccaggagcaaggagggttaagaaacagcgaggtttaagaacccacaggacgtcaaccctggatggccaggatctggtaaatactcatggtgtgagcaggcaggtggggggcagcccccctggcaaggggtcgggtgggggctggacaggagggaagatgaagacaaagtccccacgtaaggggtgactgctgggctccagctcggctcttattgctattacacccgcgtgatttcatccaattataaattgtaatttctctatgaaagcgagagatggaaagagtccaatgaggtcatccgcctccctggccggggtgaggaaattgttttctaccttgggggggggtggtgggagcagaggcggctgggcctccgtatttagaaagggtggtgacagcgtcctctggacccagagccatggctggctgatccccccacaacagagctctgctctcgaaattatgaacccgggaaggcagctgcgtttggctggctcagacccttcccagagccctcaggataaaggcgacattgccgtggcagcctccaaggccccacaaagcctggccccctggcctccacccccaccatctcccctaactcctcaagctggcctccgcccctccccatgctgctctcctttctgcaagagtccgtccaccgtcacccctcacctcctctccgcctgcggggttgaacaaaccatgatggcaatgacgtcatgtctcgcaaggaattatcttcctggttcaaggaagagaccacatctgctcatcggaggctaatctcctagcgcctgagtcagtgccttgcacacagtaggtccttaataaatacactttctcactgagagaatcaagagtccgagcaaggctctcagcaggccgtccagccttgtgcattcggggtcccttctccctgcctcccctgtccctgtgtgtggtcctcctgggagccgggcagcaatgccgggcccaggccccctggggatatgggctccttgagtgcttccgggtgatgggcgcctctcgagggtcggggagggtgtgtgcaccgagggcagcctggacgtggtgcttgcaaggtgagagcgctttgttaccgtgcggtgcgtggtaacgattactgcggccgcctgcatgtgctgggcccaggaacacaccctgaacgagctct

SEQ ID NO: 47101 - DNA, 677 bp, Bovine  19866881316603
agagggaggtgggtaagtggggaggaagcccataggtgagccaactaggcccctggggccccacccaccatgaactcctcaaagggttaaagttcaccccgctggagagagcagcccagtgtggctgggggctgtaggttttagcgatgtctgttacagtccctttaactttttgtcctgctacggatttatcacatctggttatcagcatgtttagtccccgctggccttgtgggggctggaagggacattgggggttttagttggggccggccccagtggacatttaaaagcacagttatcagctggttaggtggaggtttaacagcgctacttcccccctagagtttagccttagaggtacagagctcgccccctctccaaagggaatgggatggctttgcccttggccccaacttcccttggtgacaagtggccttctccctcctccctcacacccagcagcgcctcttagccagctgttctgtcttcctcatcagctcagcgggcacagaaatcctcctgggatgccacctctcccccacctcctagtctccccccaacctccactgcgtctgagaccttctagacccaggtgggccccttccagagacagtggccgcacagacactcttcatctttccagtgggatctgaagcaccccaatcctccctttt

SEQ ID NO: 47102 - DNA, 693 bp, Bovine  19866881402724
ttggccccgcgaggccttgtggtgggctgcaactcctgtggctttcctgtcctctggcccagtgcctgccccgagcgccccccaccgagccctgcttctgggctgggggcagggtgcctttgcctgttccccctgggccaggggctgcccccacactgcacgtatcatctcgtttctgaggctggtactcgtgttcccccagcttacagacgaggagactgaggcacgcaaggggtgcagtgcttggtaaaaaggccgagccaggaagaaccctcatctttcgatcttggggtttgagagggacgtcattgaacttgcattttcagaagctccctttgggtccagtctgggggtgaggggccgagtggcccacagagaggcgtgggctgcaggtagccccctctcccacattagaaagcccaggacaccggagacagtgccaaggcctgatttccaccactgcaggaggagacggctcgtttccacaaggtcgagaagcggttacgtaaattcataaatgatggatctctgctgaattattgagattccctcgagggctcgtggggcctggtccagtgagtcgagctctggccaacgggcgggacttgaggatcccggcaggtcctttccccccaagctcttctgccaagtttccctttgacggtcagattgttcctgtccttccagagggaa

SEQ ID NO: 47103 - DNA, 960 bp, Bovine  19866881420287
cccttacccgggctgctgatggaggagctgatggaggagctggtcggggaggtggcggggcctgggggccggcgcggggaggcgtccagcgggctgggcgtcgggtgtgggttcagctggcaccccagctgctgagtctgggtctcctggctcgtctccgggccagactgagcctgcaagggtgaggtggaggaagtagaatgctctatgctccttccagaaatgctactctctccagacccttcttttattttttttaaatattttggggggagggagccacaccgtgaggcttgtggaggaccttagttctccaaccagggatcgaacccaggcccttggcagtgcaagtgcagagtcctaaccactggaccaccagggaactccccctctctagacccttccatccttcacaacctccttcagcctgtggccctggactcctctcgtctgtcacgtgggggctgtgagaataactctatgagaacaagacatgcatttctaaccccctttggcacgtggggtctggggaagagaacgtgaggtcatgtctctaggatgtgaggcctcactgcatatggttaggaacttctagattgttctggaaagccctggcccagccccaagttccctcctgtctctgagtcccccctccacccttgcccacagctgctcatcttcctcgatgcttagctcctgattaaatcaacgaaggaagtgaccgcagagggggcactagtctctcccgctaataactccagacagccagctttcttccctgctgccgcaggcccccaggggaccgggcctagatgtgtggccagcctctgctcctgacccctccccgcagaagccacggcccgtctcatggctcccaggaccatgcttgaaaagcttttagggcttccaactgccctggtgaagcggctgaactcctcaccctggctttgagcctgccgg

SEQ ID NO: 47104 - DNA, 1199 bp, Bovine  19866881476244
cgagtccgactctttgtgaccccatggactgcagctcgccaggcctccctgtccttcaccatctctcacagtttgctcaaacccacatccgttaagtcaatgatgccatccaaccagctcatcctctgtcgcctccttctcctcctgccctcaatctttcccagcatcagggtcttttccacctgggaccaggcaaagactccttaagacaaagtcagtttaagcaacttcctgaagagcggatcaaaaagcgagggtcaggtttgattgggactcgatctggaaataaaactcaaaattaggaaaacattaattttatgctatattttagcacatgtgggttataatggcaaatatgtgctgcatcttagagcaaagaatgcatcaaatgcctctctctgtattttttgcttttctttttctgatgataaattagaaggagtgcccgggggccagtgagtgtccagggctgttctttcaaaagccatcaaggcttcctcagttctcccaggggctgctctgcaccctttgtcattcaaatcacagactgtgaggcggccaccctcctgggttttcttggctttgactgttaacccagttattactggctaagactctaggtgcttgtgcccgcaagtcagcccagcttttctcccagtcttgttcacaagcttcaggaagcacctgtttctgcaggaattgcagcttttctctgcagctggcacctgaatgaagcctcttgggggcagcaatcaggcgctgctgaaggggagggctggggactgtccaggtgaagagcggggtggggtggattggaaaagtggtcaagaattatttacctgcatggccacttgtggagccagagtcaatctccaaggggcagaaattcagctactgaaggtggctcagcagtaaagaatccacctgccaatctaggagatatgggttccattcctgggctgggaagatcctctggagaaggcaacccattgcaggattcttgcctggagaatcccatggacagaggatcctggcggagaggtggacacaacttagcagctaaacaataacgacattcagctactcagaagccaccctcctgagtaggggcaggggacaccctctgggtggcagactctgagatgggaggtctgggagcatgaagttcatggagagagctccaggggtcgcctcctgtg

SEQ ID NO: 47105 - DNA, 1447 bp, Bovine  19866881735113
acacccggcacacgaactacacccaaccgagtgtgtacacatgctcacacacatacgtgtttggtcacaggcaatgaatgaacagccagcatacacacggacacccccacctccaggtcaccctccaagaacagggtcacccatatgcaaacaatgcacccggagcctcagaggtgctcagagttaagacaccacacacacagtccctccacacctcctcagacgggtgcttcccccacccgcggcaaccctcctggacacctccaatccttccagtccacttcctctgcccctccccccatatgccaacctccccgtcttgggtggggagggggcgattccaggataactatccactgagtgttccacttgggacaaaaccctttctgagccatttatgtcctgctgaggaagccattctccttctagggggcctctccactgagacctgcccctcagacttggcggcacttctgggaagtaagagcaaggaggctttcatcccttcatctggatgccacctctgcactgacatcaacctgagttctgcttggacggggtcttgctgggggtggcggtaggggtgtggggaggccgaatgtagatgaggaagagagggagggagggaatgatgaacctggaaggagacagacaaggagaggcgaagaaagggcaaaaggggagaggggcagggcaggggctggcttctgcttattatccagcattccgttttggagcaaaacctgtcaccaggagccctgaaagagcttcacccagctcctggatgcattcaggacccgagacagctcctctgccccagctgccaccttccccaacttattagatgccaatgccccatttggtccccagcctttcagagggaagaaaggagtcctcagaggcacccagaaagaagtgtccaggtggtgtgtggccccatgagggaggagagtttgcaagctagggagcacggcttcctgccctctcttcctgtgcccgctcttggccctggctctgggatagagactgacagagctctgagcaggcagaaaatgtatggtcccggagggagggagggaggagccggtggcgagaggagaggaagggaaaccgcctagaggccaatcaatactagtgagtgggaagtggagagagccggagggggtgacactggcgagcgaggtggggatagagagggtaaaaaagaagggagagacagaggtgtgcgggagatcaatagaggctgcggagaccagcagagcggctagggagatgagaaacagacaagggcagagatggggaagaacccattgcctgggagagcccgcggacaggcttcgggaggtggagctggagctgcccagggaagcgctgtccagacctcagccctggggcttcaggccctgccaggaagcaggcctccgtccagcttccttcctctctcatt

SEQ ID NO: 47106 - DNA, 2118 bp, Bovine  19866880169248
agcagagacattactttgccaacaaaggtccgtctagtcaaggctatggtttttccagtggtcatgtatggatgtgagagttggactgtgaagaaagctgagcgctgaagaattgatgcttttgaactgtggtgttggagaagactcttgagagtcccctggactgcaaggagatccaaccagtccattctaaaggagatcagccctgggtgttctttggaaggactgatgctgaggctgaaactccaatactttggccacctcatacgaagagttgactcattggaaaagactctgatgctgggagggattgggggcaggaggagaaggggacgacagatgatgagatggctggatggcatcaccgcgatggacgtgagtttgagtgaactccaggagttggtgatggacagggaggcctggcgtgctgcaattcatggggtcgcaaagagtcggacaggactgagcgactgaactgaagttgggacagcagcctggactttgagtcaggatacttagggatttagacactggcagggtcgcagtgtcccacctgtagaattgagcttctgtcgtggacccatgccaaatgctggggtccagctgtcctcagtccttttatcattaagaatcctcacgggtcaccaggttttgaatattttggccgctggacaaaagttcctcggttttaagtcactaactcgtttccccctttcatactgatccaaagcctgatagccagttagcttccagtcagcaaatgtcaataactaacgtggtgggtcggaattgctgtaattctggccaaaggtaaaacaaaaccttggagttgattagtctgtgttacctagtcagagttaaaaggtactatattttccttacttagttaggtcttttggaaaactggcaatagccctggagggtaaattagcagtgtcattttgtcagtatgtatgagatatcttaaaatgtgcttactcttatgacccagcaattccacttctttagtaatgcatcctaaaaaaaccactatgcggacaaaaatatatatactaggatgggtgggaaaatgttgtttgtaacaacagaaaactggaagtcacttaaatgcccagtggtagagaattagctaggaaaattatggtacaaccatttgaaggaataatatgaaagcatgtaatatgatgtaaaaaagccattaattttgggaaacacgtagtatattgccgagaggaaaaaagcaggccataaaactgtataatacggtctatttaggtataatcagggaagcctggcgtgctgcaatccatggggtcacaactgaacccatgactaagcgactgaacaacaacaaaatataagactggaaggataaacaatcgaaaggtagttgtggtttttatctctgggtgatgggaccaaaggtaattcattcaacaaatatttattaagcacctaagctgtaagaggtactggatcactaaggttaaaggggtgaatgggatcaaaagggtgattttaaaaattcccttatacttttctgcttttcccaagttttctgctcgagcatgcatgtgttactatgtaaattagaaaaaaaaaaaaagtgctattaaaaaccacaatgttagttagaaaccttaggccccattactaccactgaggactcaggaatccaggcccaaagccaaaaaccagggtattgtcagggttctgaggtcacctctagctctctgacattctaagaattctgaggaaagagaaatgctggacttagatcagggaaaaacaacttgaagggcttggtggaggcaagagagtttgggtcagactgtaccttggacaggtcacagaggaactggtgataccatataggtggagcactggttacactgcctcaggtgaacgtcggacagtccacacacagagctgcagggtgaaaggggacaggtcatctcatgataactggcatcaccatgagcccaggtgatgagaacagagcataacccctgggggcacagtcggtatgaagggtgtctggggtgtcctgccagtgtgagtgtaccttaggtggatggaagaggagatgggaatagagtcaactgtgagctcaggtgg

SEQ ID NO: 47107 - DNA, 2160 bp, Bovine  19866880345620
aacttcagctgaagatgttaagatagcaaaagatggtgactggagttaaacccaggcaaagtgagatgttccatcaaagacttgtacagacattaccagaaccagagagagatctgggggagatgtcagcagtctggtagttgaaatcatgaggttgaaagaactctccaaggagaaagatgaatggagggaggaacatggaagtcaggggcaggagaaggtttagatactcaattgcccctttttaacagatcaacccatcctctaacaccccctgccccccaacaacagcctcaagtaactactggagcatgactccatgagacttgttagaataaagtgtggccagtatttcatccggagaaggcagtggcaacccactccagtactctcgcctggaaaatcccatgggtggaggagcctggtaggctgcagtctgtggggttgcacagagtcggacacaactgaagcgacttagcagcagcagcagcagcagtgtttcatcattcatcctgttaggttttgtaccatagaagttaattagaaattagggattgaggccggactacagattatggattgacagagaaagtgagaattctctgcaaacgcagtagcttgaaggtccctagaagaagagaatcagggagctctgaagggatggagcagcactgccccttctcccagtgggttgttgaccagaaaggagagagggccctcctggtggttccttcttatgtttctaggttcttggcctggtttaaggacagcagggtggtggaagacaagggggaggccctgggagggtgtctttggtgtccgtgactttttccctttctgtactgctcattggcgtctctgctctgtcacaagcctccactgtcattcgtatacgaaaagtcctctttctgagtggtaagcactttcggttgttgtccctttacctctagtcttactcctttttcctcttctctggctcactgcttcatagaagagtctgcaaatgcaaccttgggttgaggcggtgctgcctgcaataccgggagatgacattcctgggacaaaggagccttttgaggctgaatcccagcctcccgtttcctccttgggtgtctgctgtactgattgacaagggcagactggctgttctatcttgacatggaggagcatcacctgtggcaactcggagttgagcagtagtgttcccaaggacaacggaccttcccttccctgtcactcagtactctccccattttgcttgctttcaccattatgttacatgtaagcacacagttggcttttattatgcaaacaaaattaatgcttcatctctaaagggggtagatgaaggaaacctgtgggtgtggccagtgctctagactctctgggcaagctgttggtgatctttatcctagattttccagaagcctctgctgacttggctgtataacctttcacataagcatcccatttcctgtagccggatggctctttcatctggttgtgtttccatggtttccacactgacttatttcatacttctccgagagttcattttccagtgtttcagctctgctctggcgctgttcagtttacctcaggattctgttacactatggctgctcaactgctctttctgttagcttgggcccactttgattttccctgtctctgtgtggctgtcagtaacccatgtatgtcatgtatgactgctcatctctgcatttaagtccatctgaggaaatggctcagctactaggattagtaaagccctggaagataaagcgtaaagtaaagcatcatccctctcgtgtcctgggccgtttccccactagtcagccttagcgcccatatccttttctcctcttcttcaccagtagcccgtatctcacttgcacttccaaaagtcagcacaggaagactgtgggccttatctgggtgtctgacttagcctctaaaggaagatttgggtcaggcttttagcagaatactcactgctagggagagatgactgtggggaggtgctgggaaatcactcctcttctaagacacctgatagcaccatccaactggatccgcctgagctcaggaagctcagaccccgcctctctccccgcaaccagagcatgagaaagacagactgtgtaagagtgctgacta

SEQ ID NO: 47108 - DNA, 1914 bp, Bovine  19866880354604
gtattgccccgttcttaaagaactccgctctagtgaatttagggggcaggggcaggggcgggaagacaagtacgtgtgaaaagtatattgattccacaagaggaatagtgtaaggctgggcagaggtttttaaaacagaggaaacaggtaaaaaggggaaacagcaagaggagggtggaggtgggggcaggagaggggcgtgcagggctgggccccaggacttctacctgccacctgccaagtcagctctgcttttatcaattttatatgaggctttaaatgaaatttctttcaaaaggggaattctgctgatgtttaaaacataaaagagttgaaaactgatttaaagaaagaactcatgttgacctggtttcaaatctcagttttaccacttactcctcagtgtgttcttagactgagctacttagactgagctacttaattcttgtgagctcccatttttattaatctataaaatgggagtgatgatagcatctatttcgttgagctaacgaagtggctgagatgtatgtgacatacttagaatactgcctgacatttattaaaggctcatgagcagagatgcagtgttaacacaatagtatttttataagattttacctcagtggaaaatgggggcaggcagaacagggagagactggaagctgggtacagatggtctgatagtttatggcagggggatgggctggaattatagcagagaacttagaggaagaatgggcttggctagatattggaaggaagctgtgacaggacttggtgattgtcaggatggcgaagggcaagagaaggggaggggtttggagacctggctgataaaaggatagtgttgaccgctgctgttataatgctaccattcactcagcctttctaaagtcaactttgttgaggtataatatgcataaaataagataacactctaagagtacaatttgatgagttttgaccaataagtacacctgtgtaactactgtcccagttatgatacagaacagaaagtttcttcagtaaatccccaccctgttcaccaagcatattgagtacattctttgtgccacatactatgctagttgttggaaccccagtgagataaatgaggcatagtcctagctggtgagaagctcagatcagtctagatagcaaacctataatttggcagttacaattcaaacttaagtgctaccaagggaataagcattgggtgctgagaatcgcataacccagacctggaaagagcacctgggagggctttctgtaggaggtgatatactgactgacacctgaaggatgatagaacttatctgtggggagggaaggcattcgtgacagggaagggagcgacagacattttaggcagaggttacagtatgttcagagacttgggttctagagagagctggcatgcttcaggaactggatacggtaattcagtgtgattaacactttaagagtgtaggggaagagatgagtgagaggtgaagacagagaagcaggatagagctagatcatacaggaggttttaagccatatttaggattttggactctatcctgaggccgttgagaaccattgaacagcaacccaggttaaacaagggattaacatgaccacatttttaatatagaaaaaccacttactctggctaccatatagagaataggttggaggaagaccagattggagactattatagtaatccaagttggagatggtggtaatgagacctagacaggtacaagtgtgactataaagaaatggataaattccagagaagttttagagatgaaattaacagggattagtgggttaaatggatatgaatagataggaagaaggaagacttgaagatgatgctcagtattgaacaagagggtaagattactgtgtatacta

SEQ ID NO: 47109 - DNA, 3007 bp, Bovine  19866880480037
catcagagaaaaggaagaacattcggggccgaggctcccctcggggaggcaccaccaatagccatccctggcgtaggaaccagcgacctgagaggtgggagacccattattctggtacagcttcaggactacaacccacaaaatgaaagggaggctgagaaaataggaggcaggtggtatgtgcatggcagtagggaggatgggggtgagaaaagggcagtttgcaggttgaggggaagcacacccatggactacctgagataagcccctttgcttgccgtccactgagcagagcctggatgcgctggagatgctgttcattcttctgtttctgaccaatggtgtggactctctgggcagtctcacttatcagctgggcagcccctagaatgatattccacaccccactcccagcacaactttgactttgggtgaatggtggtgaaagacaggctaatccagacatgactagggtcagagtctaatttcttcaagagtagaggcagggcaataggaacattgtatacacatcattggaagattggggcatatcatacatggttggaggtcagaaccagaaagggaacaggagcaatctccaagaaatgctgtggaagagcaagaacatacttgtgagctgtttgtgttcagggctgttgggacctgtgttttcagccaaagcaacagcgagattctcatacctgaaattagaagtctatgaggggaaagtagagctgggtacaatttcctctgcctgacacagatcaccccctgtacaaacttcagctggggaaccaggaaagacctgcctgtggctgttttatccccctcttccatctgggactcagatccgggttcactccatatggccctcttccatcccacactgaagagtcagggaggcagaccagatccaaggtgaaagttaatcaacccaaggaggatgctacaaacaactgactataagttcttaactcattcccagggacagaaattctaagcctttcatcttcagaaaccttatttactagccttatcacagacccctcacttcagcttaagttaaacaatcccagctaagggcctgaggctgcacagcccaaatactccagtgagttcacatttactcttgcagaaaattttgaggagcaatttgtcccaggagagagacagtgggacagatcccatgaaagcccacaaagattgagagcagccatcgtacagatgcagaattctaagagaagttggctgagtcggggtgagttcacgcactgctggagcctctgcagaggcagagggagcaggtcctggagctgaaggcccccgaactcagggcgaccttcctgaagtcgtacaaatctccggaaatgtttgttcttctttagttgctcctagaatgaggaggaaagggttggcagcagggagagaagccacctccttatactgcattcttctgtgtacacatcccaggccctcaggaagctgtatgctcctgagagaaccccgtctccctactggaaacttaacatagggctgggtacccacagggctctataaatgcaggaacaatatgaatgaagtttgggtctccagataaagaggaaatgtacaaaggacaaggggaaggacttgaagttatcaggttacctgcaagatggtccgggacctctcaacattggcagcaaattgggtgtagagctccaggtggttgcagaagccctccaacccctgtccccagcgccctccttcgaggtagggaagcagctctctgtgtgggtcaggacaataaaagagcagcccaagaactactcaagcaccacctctcttaattctcataaccctgctctggaggtagtacggccccattttgtgggaggagactcagtggatatgaatctgagcaaactcggaaatggtgaaggaaggggagcctggcgtgctgtagtccatggggtcgcaaagattcccacacgatttagcgactggacagcaagtggctggagaacttgggcagattaaggcactgggtcaagaccacagggggaggtaactggcagattctggatgcgaatctggatctcccctactctgagctctctgcactgccagaaaccaggtctccctcctcctctctccccacttcccttctactcactggctggcgccgtaaatgagttcccagggcccaaagagggcctggcgctctggtggtcgcagggtacctttggctctcaaaattgccacgaagtactgcggaaggagagaataccggtatgtggtccgcagaaagaggaggctggtgccaaggcgccgctaggtcaccgacctagtaggcaccctcccactccctggggtccccgcccccctacgggagactgtggggttcgcaccgtggccaccaagccccagctgttcctggtagcgccgctcggtctccagcagctcccgggcagtgcaggcgcgtttccgctcccaacgggcacgctgctcttgcaccgggcaccgggcaccgggggccgggctctccatgccagacttaggggttgccacttccggacgcagcccgccggagattcaaatccaaccggacccgggggcggggctgctggagtgggcccttgaggggagtacgccccctggcgcctggaggctgtgagcaggcgagggcgtgcgcagcggctcgctaaaccgcattaggtcggcgccagcgaggcgttgtaggtatgcggcccccgccagggccgggcagggtgcggcaagtgggtggccctcctttgagtggcactaagttggagcagagacattactttgccaacaaaggtccgtctagtcaaggctatggtttttccagtggtcatgtatggatgtgagagttggactgtgaagaaagctgagcgctgaagaattgatgcttttgaactgtggtgttggagaagactcttgagagtcccctggactgcaaggagatccaaccagtccattctaaaggagatcagccctgggtgtt

SEQ ID NO: 47110 - DNA, 2371 bp, Bovine  19866880493645
atcttgcggttaatgaccctgagggtggggactcacacttcaggagatagcccccatccttactagacggtccagaaggaggaaacaccttgttccatgtcttgcttgctgttggcctaacaaaggatcagtggacatgacctctctggttaagatgtgcttcttcctgaaactatattgtgtgcatgtctaacacctcccttattgtggacgcgagtgttcaatcagtggagaccagggaaggtgcacgaaccttcaccctgacacagaaccacagagagggcaccagaagtcaggtctcaagagctgccaagacaaaagtcaagcgagagcatccaaactcagtcaacagcagcagtcatggagggagcagggccaaagtgaggcaggttgagaaaccaggagggcccaaaatgagaagtggagtgagaagtgatctgaacgaagctagcgtggaagaccctcagctgattcctagattgtactagtacaggtgggctaagtttctacagaagcacctgagcttctgggtgaggcttgcaggctgaagatgcccaaagatcttggtctctgtggccatctctgtgggaatactccagcattcaagacagctccagcccacagttagctggcaccaatcaacatggaagcaaatgagcgctggacagatggcagggggcaggagtggaagcaaagaggccacttcggaggttactgtgacggcccagcagatggctgagggaaggtgctaagagtgaacagagaagtagatgtatccagggcatgctttaggaagagagtctcaagactttttctttatggattagttgtgtggaaataagggaaaaagaagaatcaagtatgacccctaaatgtggggctttgagcaactggtgactagctgtgccacttactgagaagattagagaatgaagaggcttagacttgggagaagtgaattaggaattaaagagattcctgacttcaggctttgtttggatatgtacttgataagtttgagataggtcttagacatcggagatgtcaagtaagccgctgagtataaaatctgagatacaaataaattagggctcacttaaaactcttggaagacatgaacttataggtggtatttaaaactactgtgctggagacacttagtaagagaatggagaaataaaaaggagttatcccaggaccaagctttgggtaccacaacacaaacagatcaagcagaggagaagccaggaaaggagacagaggagggggtggtgggcaggaagaaaaccaggatggttctataaagtcacaaaggacaagagaagaaaatatttcaagaggaaagaggtactaggtaatagctagttactagttaactctggagagggaacgtggagaccgaaaggggatgaagggaagaggaagacttacttttcactgtatgccttttgtaccttttgaatgttgtaccaggtgcatatattacctatttgaaatacaaataaaataacttaggaggaggaggaagaacagaaggaagacggttagcagatctgaaccccttcggttgagatgctgagtgagccacacttaagttcgagctggtggagtcaactgaatttgctccttttctttccttatggttgttttcattattttatctgctttcatttgctttcaaatcttggagctgggaagaggaagcattcaaggagaaccgtgccccaggcatttggagaacttctcctaataaggcatttgggtgccagatgttacccaaaacccaaaggccagcctttcaggacagactggctggacaccagaggatgaacacatgctccaacacaagacaggcaaggagatggaaggcagaggttaagacaaaagaggttgacggaaagaaggagaaatgatactggtttcagaaacacgagtttgagatggcagaagggcaacaaaaatttgccaagcccctactatgtgccaggctctgtgttgggtgctaggaacacagtaacaaagtaaaaataacacacacaaaggcccgcagaagtgtgggaccagagtccaggagagtagcctggaccaggtaagtcaccttccttttacaacatgttaaggctccctattgctctcaggataaagctctagcttctagacccttcctgatctgacccctgttcaccactccagccccctcactcaccctcacactgaaccacttcagccctcccttctcaccttcagcccatgctactcccagcacctggaatgaccccttccctgctttctcaaaatcagatctcacttcctaacagtttcttaaaacctaaaaccacctcttcaccacaccacccagctgagttataaa

SEQ ID NO: 47111 - DNA, 997 bp, Bovine  19866880502296
acgtggctagctccacttctggatcaaatcaacattttctaagcatctacctaaaaggagagatctgcacttcttcaaggctttaaagagttaatcaaatcagatagtcttccttgaaataaatgactagctttataataaagtgtaaatagaacctacattcattatctggaaaccattattttcttactaaatttggaaggaaagttatgatcaacccagatagcatattaaaaagcagagaaattactttgtcaacaaaggtccatctagttaaggctatagtttttccagtagtcatgtatggatgcgagaggtggactataaagaaagctgaacaccgaagaattgatgcttttgaactgtggtgttggagaagactcctgagagtcccttggattgcaaggagatccaatcagtccatcctaaaggaaatcagtcctgggtgttcactgaaaggaccgatgttgaagctgaaactccaatattttggccccctgatgtgaagagctgactcatttgaaaagaccccgatgttgggaaagattgaaggcaggagaaggggacgacagaggatgagatggttaaatggcatcactgactcaatggacatgagtttgggtaaactccaggtgttggtgatggacagggaggcctggcgtgctgcggttcatggggtcacaaagagtcggacacgactgagagactgaactgaactgcactgaactgaaacattagctggtcccagtgtatcagaagtagattgctaaatcttttaacccaaagcaaattgtgaaaaacatctagctagggattcaaaaagatctaagactcaagctccaaagaaacaaatataaataacataaataaatggaagcagcctgactccaaacttgtaatctcatcagttctcaggggaatgtaattctcacaggtaacaaaatttaattatcaccaaggtgacctggaatatcaatgttagtaagaaagcttcatt

SEQ ID NO: 47112 - DNA, 1708 bp, Bovine  19866880572383
ctgggctacttggcattccagccttgtgccagtgtggaaaacagcctaagggtggctggggtggggcacagctagaggtcagcaggtcacctggtgggccagaggccatgatctgcaggaggcactttgggagccttaggagacaccgtgggtccaggtaagctagagggaaagtccagagcctgccatcagaagcctggtactggggagtggtgtcccttcctattggaagatgcagggttaatcacggtggtcagaagccagccagggactggtcagatgctgcggcacaaacccaaggctagtcttgttctacgtcttggttggtgatagccctgcagagtcttgtaggctgcagcccagtcattagtccctctgggagtacgtgttccttttctatcataatttcagcccctacaaccttatgaagagggtaagagaacactcagtgataggcaagcccttttcctgttaagaggaggctttgggcaactggtgtccaacctgactgttgccctcctttctcccaaatatcagtgattgcatagatcagagcttcttaaagtctccagtattgtggggtcaaggtcaggttgcttctctgttgtggtttgaagggaaggaaatgctgctgagttttcctgccactctcagatactgggcaggctggccctcttcatcacagggagaggatttcttattcctgtctgttagcaggaagggagattgggacacggtggccatgtcagagtgggatggccaggtgtgtggtgccagcggtaacggcagaagcacaagcgtgagctgagcaggatttaaagaacaggacacagagaacaagaaagtgagtggggtttggcctctgagaactgggaggagcagaaatccccagtcaggtgaggatttgaccagctgtctctctccagggtgagttccttgaggacaggcgctctggactgtcagactccccttcccctcctgctgaggcccagcgttcagaggtgttacagtgcttttgaatgagctgagaattacacagggacaagtgtgctggccatactgttgccagagatgggaatgcaggctgatgggaactcaggctgagccctcagtgataggttttcctgtgagtgaaggatgggagaacttcctctccaggcctggaagccctctgggtgagaacatgctgggaacttgcccagaagtggctctgggctctaggttcttgattcccttcagatccaaggtctcttatattaggaggaatatcttcttaggtctttggccaaatcccagagagcttgtttgtgatcccagctgtgatccttgactctgtctgtgagatgagaaaatcttttgggagccatgctatagttacccaacaacctttctgattaaaccagaggaacctggcgcctaggcctgggctgcaattgtgggagctgaagcctggttaggcgagatcagaaccaggcctgatgtgcccacgtgcatctagagacagctagtggggcctgaggaacttggtactgcaagcccggagtcctagccaggagagatctctgggtgtggtgagagagagaacgggcacagttacgccttaccccgggagtggcagctgcgagtggaccccatgacagctggagctctccagtcagccctgttttagaggctgggggaaggggggccaaggatcttctttatgttt

SEQ ID NO: 47113 - DNA, 1027 bp, Bovine  19866880682146
ggtctggggcgtcggggtcaatgaggtaggcctgagctgaatacccgaagggaattaagggctgattgtgcgtacgcgcagttcaaatgtcttttaactgccctgggagtcctttctcctctccctccctcaggtcactggcagttgacaactcggctcagggagccgcaagattcctgggctcaaaggacacgcagggctgaaaaatggatccttctggcctagccacaatcagaggcagcccagcaacctacctaccttcccagcctccgccctggcccagcctgcccatttcccaggtctcgacctttacaccttaaatctccggactccctgacactttctaccttcttggggggtggtgatgccccgagactgcagcgagccctcggccagcccattccaagtgtggccccgactcctcctcatccatcccgcctccctcgaataaagttcagattccagagcctggtcaagtgaccacccagcctgcaccttccttttactgtttcgtccgaatgcccctctctctcaaaagagaagactccacctgtagggacgcccctctaagctcaagatcccaccccttagcaaaaccccgcccctcaaggaactcttcggagacttctctctcagtgacacctctcagtatgacactgccaaccaacattagtgtgtaccagaaccccttagtgtgacaaccctcctttgtgtgttccttctgcccagagagaccccacctctcagagtgactccaccagccattgtgaccccgcctctcaacgtgactcctcccctcagtgtggcccttatcagtgtgaccccctctagacaggtaccgcccccattacgtaggaatccggtccgccggctcaggcgggaggaagttctgccaccggcctctagagcggcgcgaggtcccgagtgcgcacgcaccgttccaggacccggtgcgctcgccgtacccaacgctttctcttctccgctggctcctccttcctgtcgtcggcagtatagccaatcatcg

SEQ ID NO: 47114 - DNA, 1888 bp, Bovine  19866880745621
tcttcgtggggattccagatgtgtgggtctttcttttgcctcattgattgggagtgggcaatcccagcagcttcttctagaggctcccccttctgtcactctaccctgcgtatgacctgttctgcttggctgttgctttgccttcactcccaccctaccctcttgcctctcttcacctaaagccatccctgccttttctctttggctcgccatcagctctctgtgccaggcccttttggatacccagagcctggggctgcagtgtggttggtaatgtggagtctgcttgtcattctcagtatccagccatgccctgatgtgaagtacggcaaacgcatccatgtactacccatcgatgacacagtggaaggcatcactggcaatctctttgaggtttaccttaagccatacttcctggaagcttatcgacccatccggaaaggtgagaaataattctaaggactgaactcaagggctattgttgtagggatacccaaaagtaaaccttggtccatctttgtctattctcatacatgtatgcatacatacacattccgcacatgtgtactctctccttccctgcttccttgcacttcccctttttcccattcccactgcttgttctagtacagtaagctatcttctcttgtatctctgaaggaagaggtgggcaatttggggtgtatcacagtccacagtgtatttaatacttagcacagttctgctggtggtggtggtggttgtgcaagcttgggttatctatacctcagaagtcaaaaatcttatgggcttcttcctggcacatcaggttttattcactgtcttttgaggggcagagagacttttcacaatttcgttttctctttttgcctgatgcttaatgatgctggatgggaaggagaaaggacagtatctagtgaacttggcattctagatcccaggttctgatggggaattcttagcttggtctggtgatagataacctctgactgctcttgtgctgattgctctcacaggagacattttccttgtccggggtgggatgcgtgctgtagagttcaaagtagtggagacagatcccagtccttattgcattgttgcgccagacacagtgatccactgtgaaggggagccaatcaaacgagaggtgagttctcttcctgatcccggtatcccactttgtgagtgctcagcagggcagtagtgtggtagttccaaagaatcctcaggcttgatggttaagctacttcccagaggtggaaagcatggctattcatttctggacctaggtattttttagaagtatctgatatcaataatctttaaaatctagattgagcctaatgagtcaagtggttgaaatgatttttgaagaagtgatgctaatgatgacatccagacccctgcccatttcccacactttctagcttcaggtcttaggggaacccactgcaataagactaaggacaatgtaatgaggaaaggctatgctagaaatctttgccatggaataaataaacaaatataaagtaaaagcaaagattggaaattccctggcagtccagtcattaggactctgcactcttactgcttagggtgcaggtttgatcccttttggggaactaagatcccacaagctgcgcagcatggccatataaataaagaaattcttgccctggggttttttgaattgttctttgaggcatgatccccttagaggagaatcttctcatacagcagattctctataccacctttagagaaactcaccttctgctgatcgcagcattcttaccttcttttctttttctcttccatcttcaggatgaggaagagtccttgaatgaagtgggctacgatgacattggtggctgcaggaaacaattag

SEQ ID NO: 47115 - DNA, 750 bp, Bovine  19866880774568
ctttccctgtacccctgaatcttggaccacagcatgtcctccaacactggcccatctcacaccacagtgcccatccctctgctctgtcagaggcgtgtgcatcccccagccacaaggttttccaccctgccccctacctcatgcttgtgatcagcttcttgatggagtccgagacagtacgggagtggccagccagcacggaccagcgtggtgggtcccgcggattgaccgccagggctcgggctgtctgaataaggcccccagcactctccaacattgtcttagcagagatcacaatgggctccatggcagcccggccctggggagaggggaggtcgaggggtgagtctcaagactccttgaaagatgaggtggccggcagttcatgcgttcaccctgcctcacctcagggctgatctgggcaggaacactggagaactcagggttggacgcaaaggcgctcagattgtccacagcctccagcaaaggggccgttgctgctcggcactgggcacggttctcctctgtgaaggccccatccagcgcctgaagtgggagtgacaaggaggagctcaggatggactgtagacaaaggcagggaagcccaggtctccctcctgagctcaaagggcatggggcggggctggtggtgaccagcgcggacaggcaagaccttgggcttaggcaggtgtgactgcgtgaaggcctcagggaatgacggggtgcaggggttgggggagagaaaactgg

SEQ ID NO: 47116 - DNA, 1273 bp, Bovine  19866880796697
caggtcctctggcagccttccttttcctcagcctagtggcagtttaccctcctgaggtcatcactgcatcacagaacaaagaactcccatcccccacatacctaacaacagtctgtctgaatttagggccaaaacattgcccccagtagacaactcaaacttcattcagtgaaacctgagtgatccccttttgtcttgattcctaagatcagaattaccttcaggcattgtggatgaggacatggattctagcatcaagctgccttatttaaatcctagctctgccacttcttacctgtgaagtctcaaaagactcagtgcctaaattctctcacctgtaaaatggggataatattattacttagcacatagagttgttttgaagattaaatgaagaaaacatttatatgcttagagtagtacatagtatatgctgtgttaaaattttcttttgttgccataaatgatcaataaccaatctaaagtaagattagaatagagaacagttttatttgagtcaagctaaagactgtaacccgggagacagcctctcatagctttgaggaactgctcccaagaagcctggtttccagcacagctttatatcttgtcagaataaaagacatcaaacataacaggggtacatttcttccatgtttcaaaaaagattacttggtacacagcaagtcagtatggccttggtacctgggaagggagccttatcgtcaaaggagtactggcattggcctcccacgaagggaggcgtttatctctaacttcaaaacagatattctttacttctggacaatgcacccttttcttcaatgattaaatcagatgtacaatgtatgtttgatagactacaagacaggcttgtagctagtataaagttcaagtcaaatcatttataagccagaatgacttccccatacctcaatatgtgaaaatgtcttccatcacttttatttttaaaaatttgtatttatttttggctgtctgcaggctttctctagttgcggtgagtgggcttctcattgctgtggcttttcttgttgaggagcacaggctctagggtgcacaggtgtcagtagttgtggcacacgggcttagttgccctgcagcatgtggaattttcccagaccagggatcaaagctgtgtcccctacattggcaagtagattcttaaccactgggaacaagagaagtcatctttcatcacttttaaagttcctaattattaatataagcctcattccatctttaataggtagag

SEQ ID NO: 47117 - DNA, 1116 bp, Bovine  19866880806895
gtgagacaagaattctgaatgattaagttgaggttgaaaaggacaaatagatcaggaatagccagctgctcattggtgtgagagaaacataggccctaagagggagctgaattgggggtacactgctcaggagccccagtaagacagagttctcttggcctcagaatggtaagaactcaattttggttgctctcgctttcagcccgaatccattcattcagtaaatatgtactgagtgcttgttctgcgctagacactcctttgttctgctatcttcacatcttgcatttctccctcactgccctaatcggagctgtgccctccctccatttggcaatcctttctggccaccagtttcaaagtccagtttcctctaagctgcaaagaagagctgccttcccaccatcccactgttcatcttccctccgtctcccctcactcccagaatgtaccctccctgttctttaatcatatttctcctccacttgctcctgtccctgttcatttctcttatgttccactgtttgtacatacgttctttacaaacccagcaaatatttgttgactgcagaccaggtgccctgccctgtacttgaagctgtgggtaataagcaacaagtctttgtcgctgtccctttccccatggaactgaaaagtatgtcagactcacatgaggaacactaaagtaacaggacagtgtctgatcgggagctgagatagtgtacgtacaagtaatgatgatatgtgacatgtatattccactttgtagctttcctatctattgtgtcatttgtgaccttagaagggcacaggtgtgccaatagaagggtatctattgtgcccttccaaccatctgttgaggtagggacttgaggtaggactctacttcagcaggattacttaccccattacatggctctcagcagtgtgcttgaacaatggggataaacgaactggtgagggaggagagtggaattgggagagagtccggcaggaaggggttgcttagtgaggacccactctgaatggaaattgtaggaagtaagataggctggggctttcctggggctcagatggtaaaggatctgcctgcaatgcaggagatctgtgttcaat

SEQ ID NO: 47118 - DNA, 2815 bp, Bovine  19866880883611
gccctggggacctctccaaaataagacatttgtttccgccgaccgtccccaaaacctcaatgccgtatctcttgtgtttggagtccctttctcttaaatctcttggtgggctaggacacatggaaatgaaaccaccaccaccacagaaaaactaagtctagctcaccttgttctttatccttaggtgtggcccggaagagcagctcaagacacctgaagtgggatagagagcaggggtaaagaagagttaacctcagaaactctggggtgagtagattaagaatagagcttaccaactcaggtcccagttacaaaattatccctccacatttaccctagggtcctggttggcttcctgaactcaccggctatattcactaattgcctccttttgggcccccagttgcacccaagcttggccctgaagcagatgggtagcagagacccagtgtgagcagtgtggtgactctttggttcttcttctggcatcttcccacagccgaggcctcttgggaagcagaaatgatgtacggctaagcagctcctcacatacggtcaaagcatcctgggctcggcctgcctggatcaacgctgctgctgcctccaaaaacaactcaggtacacagggccctggagggcaaggtggtggggagaactgcggtgggaagagaatgcaatgcagtgtcttgaggagacatgaaccactacctccaaggctctagtatcatcaccaggctctagtaccatgcagggaccatccactgcttgctgccctggatctcccttgctctgggaaccttcccaatctggtctcccagaatggacaaaaaaaagagcagaggaaaggtcagaaaaaagcactcctgctctactccaaaggaaactccaactctcccaccccactacatagaaacgtggcatacccacctttggctctgagccatccagcaacagggcgagcaggtccaggtaatgttctgcagcgtctgctgccctgaagagtcataacccaagagcctcactttaggccatagcagggccctccaaaagctcttagctaagggccctggggtgagggaagggtgaggtgtgggactccaacattggctcagtatggatctacactatttacagactggatctgggagaagactttatagagttttcaagatacaggaggttagtgaaggggaaaagagtcctcagctcacgtccagcagcaaggcaggaagctgatagtggggacccgtgtcccactcttgatttatttatcctctcaacttgcaagaacagaagcagagtcacaccacaggggtgccatcagaagtgggaaggggagttcaggtgagcaagatggaacctcaccttcctgtctgtaggcatcggcttgctagcaggtacttggcctggctctgtgtgccacagtgaaggggtgaggctgggtcaggttgtgggagtaataactctacctcaatgagaagctgacgagcttcagggatacgagtgatactcaaagcctaacaaaaagaagaaagtttctataatctccgggaactatatatccttctacttaaaccttgactagtcacacaagcacaagcatctcagcattacctgcatcttcgcctggcatagttccttacctcaaccagcagctccagactctcaatctccgctgctatgttccccagttgctgatatagcctggaggcctccagaagcgggggaccccaggtcgatccctctttcagggctgcaaccaagtagagcagagctctctgtggactgccctagggggcagaaaggacacaaaggacacaagcctcagctaccctcacaaagtagaaaactgtggtttctccaactcatgctaggacggtctttaccatcttacgaagacaggtccccagggctgtgtatacctggaccaacagagaccgtgggcacagacctgaggccgcttcatgcaggctgctcagtgccttgggcaagctccctgtgatcagctcctggaggcctgtggacaagcaggctgtgagcttagagaggccaacagggcaagtgggcctgatagggaagaagagcacagagaagttccaccaagctgaatggtacaggacagaaaagacatgagcccagaggacttcttaagacaggaagtggagaggaagggacaagtcagattgttaactggccttgacgataggcaaatgctgtcagaaggacatccctcaagcctcgggcatcctgcagggtcagcggagcatctgactcctcagctgggggtctccaagttttcagaagcagcagcatatcttcagaggctctgctctggggaagaaggatgatgagaggttccaggcttttaactaccccctctctatctcagtctgccccgaatggactttaaactcaaggatcctcttgattcttgttccctcatttctaagagattaatagctgaggggaaaggatacaggtaggaataaaaacctggggcagtgataatcttaatgagccttctcactcaggataagtccacaagaacacagagcagggaccatgtttgggttactgacacaaagactgaagcagggaagtgacttcagcaaggtcacaagagccctaattctacccaagataatcaagctcccaagaaaatgcctccaatgaggaacaaatcagagcaaggtcacttaagagtcctgagagaaccggggtcttgtgaacaccaacccagcagcctttccagcacataataatgatactgcagctaggaagggtgggaggaggaaagagacccttagatccagat

SEQ ID NO: 47119 - DNA, 1494 bp, Bovine  19866880887020
gagggcactagagacagatgatgaaaggtagcccacatgcctctggcaatcaaaggcctagcagtgacgaagtggctgacggctggcaaatcagggcaagcagtaggtgctctgtgcatgcatctctgttcctgtgcatttgcagacttttggtttgttttcccttctgatctttcaagcaggttaagtgatcctggaattgtctgactctctgtggctggggacaggctcaaccagtggagctggggcagcaaggcaggtgggaggcatttattagagaaataaagggcaccaggggtaccttttctctttcaaagaacatgaactctgagtgtctcattcctatagtacactccagcacagggcttggcacacagaaagcatcctgaaaatactacatggaatcatgtacatctctaatcgccacatcctacactagccaagagaccattcctgcctgggaggtattgtccgggacctctgctctacctcctggctcttacttggttagcgatgactgtctggtgctggtacattccaggattaagctgccaacgacagaactggcctctccagcctctggtgatagtgcctcccccaatgccacccaagggacaacctagagaaagaatccagatgtcagaggggcacgggagaagaaaaagagcgcatttctcactttctagactatagagatgggttcccctaaacctggggtggggggtgaggggagaatatcaaattcacacactgtgcactttaaacttatacagtgttctatgttagttatatctcaataaagctggggtgggggaaccctagggaatgggtcagtgcaatttaaagaagctgaaggcttctttgcctagctccaagtgggcctggatgctgctctctctgactgggcaggactggagtgaggctcaccgtagatctgtctcaggggcacagagttgatgaggtcgatgaaaggtttcttcttttccacctgggtcttacggtaccaccactgcaagtacctgaggagcaaggggtgctgtgggtcagggcaagaggctgcagtcacctctctctctttggacactgtgacttcccatgtttaactgttccaaggacccactgccttcacttcaaacttctcctctcaacttctctgtagttcaaggtcctctcatcttcccagtcacccccagtcatggcacgggactatctttgtttctcctttctactccttagaaggagctctctgatctttcctcacctctaactccaccactgatttaatttattccaggagcttctgtctgaggtgctgaaagggccagttagtttcctgacttataatcacccccaccccataaacaggcatgtgaagtcgcttcagtcgtgtccaacccttagcgaccccatggactgcagcctaccaggctcctgcgtccacgggattttccaggcaacagtactgggagtgggttgccatttccttctccaatg

SEQ ID NO: 47120 - DNA, 2144 bp, Bovine  19866880908321
taaaatgaagggcccctgacttgggatggaactatccaaatggggctaggataggtcatgtagatcatccccaagtccctctattttgaataggactgagtctttaaaatttagtatatggctcaagggagtaacttatgaatgctattcttcctgtatagtcacgattcactgccattttctctatgcctcttataccaggagaaaaatttcctttccaggtatgggaattcaggtggttgagagaggggattgtgctggtctctcttcaggaacaaaaatgcattaatgtggccctgactcagatcttggagttggactgtgtccattttgtccaaaactgagccatgacctgagaggaactcagttatagatggctctgggatacttcctatgctgccagggataccacggtaacattcatgtcaatgagaccattctccctgaggaatttctttgtcctagcctctatttggcttccattaccttgtgcaggtggttgagggacaattgaaggaacatattcactttcctttgcacattctgaggaacagacctttatatttccaattggagaggaagaaaagagttctcaatttaataggtaacagaaaaaagggagtagagttcatctatccgttttactttgtgaaaattagaaaactttgattacagccactggacaggttgtttttaagaagttcgagcagagaattttaggcataaacagactatttgaataattcttaatgcttacaaaatagcagattaagataaaaaattcttcaaagtcagttgcagggttggggctaagtgctattggagaacccagcatgctgtgttgtttttccttgttgtgattttgctgaatagagcctagttcttctagaatgtgaactttgctcctctcttcccaggaacctcctgtttgtgatccttgccactaatagaatcattatttcctggattcattcattattttgttccagtgtttactttgtatttatttactaatctgtcctcctctcattctcacagccccaccagcagtagtaggtatggctcctcctgtaacgtgagtcaaggaagctctcagttaagtgaactggaccagtgtcatgaacaagatgatgaccgtcgggagagggactccattcattcctgccacagctccagcagcctctccagggatggccaagtgggttttggagaacaagagaaagccttggaggtgacaggtgaagaggagaagaggggagtgtgtgaacccaaggagatgaaagaagatgccatagcccatccacccccagatatggtgctacacaaagaccttgtccgaagcccccaggagaggtaggtcatggctaccttgaggagctcatatggtttcctcagtacctgccctatggtactggtgacagaatgcaattgctctgtttgtttccctgcagctgggtatggttgtgatcaggatactgaggcttatctctgcactgcttccattgttttctggtgtaattaccaaagtatttcaaggaactctgaagaacattgtagctgcagtgtaccaggccttctagagtctgtagttcttggcttactagttgaccccatgtatgacaacctctgagtctggaactgacctgagccctgaagattatttcattcagaggagctgcttcaaataaaacaggcttcctagcctattaatgtttaaatttttttggtgaacattgtttttctttttttttttttctcttgactaatctgggaggcagttaaagaactgatctagaagccagatctaaatcacctttctgtctccctggggcctagcagtacatctggcagttggtacccagaagaaggaaaattttaaacttgtccttttaacagtcacataatgaagcttagtactgagtttgagtattgttattgttgagctaaattggtcagtaagttgctgataggttgggacaaagcagggtttctcagtcttggcactattaacatttttagccagataattctttcttcgtttttttgttttgttttgtttttgatattttagctacattgtgcagcatgtggtgtggttcccgaccaggggtgaattcaggcctccacagtaaagcaccgagtct

SEQ ID NO: 47121 - DNA, 1315 bp, Bovine  19866880947234
agggatcacagtctaagttccttctgtagagttgaacggtttatgagggggacagcagctgacctaaatgaaagggagtgaggacaaaggctagattctgtctgcaaggggaaggaccaccaaaaggcagtggccataggtgaacaggactccttctagactgatttccacaatttttggctttgttcagggcttatctatgaagaagccctctctcctggattcttcaactagctctcagatatgtatacttaagagcctttcatgtcctaaagcatcactccccttcctaaaggagtgaggtagggagactcctgggcaggtggcccctggtgcttgggttccaaagaaattctgctcaggcctctgaagcaccatgtgaacctggttctactcatgagagctaatctgggggaagggattagcatagctcattgctgaaagatatcttgttcagtctcaatgccctgtactcacttgagctactctacactgctgggttctgctcaacagatggtctgcattctattctgtgtgttcctgccctggccatactccagttcagactacagggctcagcaatacctgtagactcaacggattacttacctcattaggcacaagctccaggccctctaaacatgttcctctaatgattggtatatatggatctaactggattaggtgtggtatggagggggggaaaaaaggggtgtgggagtggaaggatctctaccaagaatggctgacactctcagaaatgtctgcccctccatgaaaaatctccctgtgtggtaagccccacagcccagctcctagcaccacagacctgctggtcagggattcagaccctttctgtgaaaagccacactcacaccaccctagattttcccttaaactttcctaactgaatgaatcagcctcttgactgtgaggatctaagatgactatgtagtaactcctattatccctgactggtggaactggtgccctctggttggcacaggagtctgggtgctcagctcccctcctccatagaacgagactctgatttgagcttcacaaactcccgggccacttcgtcattgctcctctgagacagaatccggagaatggtcacgcctgtctcatccatgtggatcttacggcccaaggggcaccagcaagcacagctgcccttggctgccacatccctcagaggcattacagccagccccagcacatggtcctcccgggcaaagcagtaatccttcacgcatatctgcaactcataggcttctggcccctcttcatttcccaggaggctggagcacag

SEQ ID NO: 47122 - DNA, 4006 bp, Bovine  19866880963402
tgaatattcattggagggactgatgctgaagctgaaattgcaatactttggccacctgatgtgaagaactaactcatttgaaaagaccctgatgctgggaaagattgaaggcaggaggagaaggggacgacagaggatgagatggttggatggcattaccgactcagtggatatgaatttgagtaaactccaggatttggcgatggacagggaggcctggcgtgctgcagtccatggggtcgcaaaagagtcagacacgactgagagactgcacagaactgaaagaaagtagatcccatttctggattctctatttgcacggaaattatttatctgctgtaagtaccggagagggcaatggcaactcactccagtactcttgcctggggaatcccatggaaggaggagcctggtgggctgcagtccgtggggtcgcgaagagtcggacaccattgatgcgacttagcagcagcggttgtagctgctgtaaatacacaagagtgccatctagtggccactaggatgaactacagctccttgaaaggtcaagtcggagaaagtttgagagtcatttcatccatcttgcgggttaccagatttccagatttcacagaaattttatttatttttaatggcgacttacatggagttgttgaggttttctattttttgttgagttatgatgttaaacaacaacaataacaactattatctactatttaacaacaagaagatagatcaaacatagtctcagaataaatgaaatgtacttcaaattgcaaatttaaaatgtaccacattgtcttttctttcttaataggaaaatgagacctggaaaactttatggacaggtaccaatgtacagcttggtaattgggaactgctgctcagttgataaattctttcttcaacatcctctgcttcagtattcccagcactggagacgtgccccctccactacctccttccagccctagtaggtaggagatttctctttaggtaagagttaaattggcagccttaacacataggtcctgattttggtcccgggcagtctccatgaaaaagcctaaaccgttttttattttgatgtgtgaaagtggctctctgatccccagtgttcacctcccatgatctcgttcctaggctgaatccccttgttccctcagccagtatttacaccctaagctggcagagcaataaagtacattctaagccttctaggagtatggttcctacaaagtgaagattacagacattccagaaaagatcccgggaaattagaaatcagaaggctaaccaattcagagctgtagagaagtctacttattcaccaaccttcttggcagacaggcagtaggcacctggggctacagtatcttatattacaaagtgtatcatttgtaggtgggaggtcaactctcctcccccacaccttctgaatcacctgaataatgctgagttctttcatggatcacacgccattactgaccttcctaagcttcttgccagtggtctgtgctttcactaggaacagatgggttagtctgccgtttaatttgttctagctatgagtgatcaaagagaagactagtacaccctgcctatttaaggacattttccagacattgcacccccacttctgttggccatttctagctctgagggaggctgtgttgttgttgctgttgttctaataataagaatgaaggggaaaacggaggttggagacaaccagctatgttgacagctagcttgtgccacatgtgcaagaccagacagaggtcaaatgatcacaaatcaatcctagtggtcagccattctgtaaaatcactatacttaacatcacattgtataggactccacacctaaaatcccctaaaataagatggctgacagtgaccagtgggcaaaattgggaccaatgaaaatacatccaggagaatcatgatcattcaagcaaatggactgttttaactcagacctactggtttagtgcttctctgcaggaattccttcccagcatttctcagacatgtaatgtgtttccagagcctgaaaaccctaataaaaataagttaagaaatctagaagcctgggaaactattcccctgtgagaattaaaacttaatgatcaacatagagctgtcactagttcaaaggaatccactgataacatatcataagcaagagtagaaaacactgaaacatggattggaaaagtcaggttgacagctcctgaacagaaggggagcaggaaggagggaagtggtcacagtctaatcggcctggcctgtagctgctgccaccttagaagcagtgatgttgaggagcaggcgcataaaggagagagagagtgtggcagccagttaagagcatctttttctgacttttagcggcgtcacatcaatagctcaaaattgaccctggtgggaatatttatacctcccctcctcagaaactggcaaaagctacatatcaggacgtccctccctgccctgcagagggtcgacttaccagcacacactggttacaagtgtatgtttgtagcctggtctgtttctaacagtaagtcatttctataaataaaataaatactggtaagttcatacacataggatacttaaacaaatcctatgagtggtgtcaggaaaaacaacaaactttggaagcagtttgttggcatttgcctcatattggcagtttcaacaagtgattctgtgtggttctattaaagttgctagcagttctgaacactcatgccatttgaaaactttccagtaacgactgctgtcttttccaaatattgcagtattcaccataggctacagttccttgtaaatacttaacagatgagctgcaaaaagaaaaagatgtgattgttgctataggacacacaaacacgaaatcagaaactgctcccaaaatctgaattggcaagagcgatattttttttggaaaactaaggactggatttatttgctcagtatgcgttttactttcagtaaagtaaggacaaccagacaggggatctccaatcaggcccagatagcagccaccagcaagagaaatattgaattcaatggcaaaatcaagactagggcaagcaaaccaatatatatatatagtccatttatatataaaggaaatgagcttctgtgaagcaacatgtaccctctgggacacccaccttgaagatgtttgcatgctcagtgagtgttagtcgctcagtcgtgtctgactctttgcaacttcatggactatagcccatcaggctcctctgtccatgaaattctccaggccagaatgctggagtgggttgccatttccttctccagggaatcttcctgacccaggtcttctgcattgcacgcagatgctttactgtctgagctatggtcactagtgtagaagggaagatgtttgggacatcttcttaattcagccaacatcaatgcaaaatgaaagtttcctacatctggaatatttgtcacaaagcaatggtcaagactatctttaactcttttttttttaagttgaaacaattgattcatttttttctacattctattttcttcctttttaaaatatttatttatttggctgtgccaggtcttagttatggcatgcaggatcttttaattgtgtcatgggaatccttacttccccaactcgagatggaacccagtaaccaaccctgcattggaaatttggagtcttatccactggaccaccaggaaagaccctatagttcatttttcaaatgataacttttaaatatcaaatatttacagtattctatttcaatttcaagtgactttatttggcctttattgggggttaacactcctttcctcttcagttcagttcagtctctcagtcgtgtctgactctttgcgaccccacgaactgcagcacgccaggcctccctgtccatcaccaactcccggagttcactcagactcacgtccatcgagtcagtgatgccatccagccatctcatcct

SEQ ID NO: 47123 - DNA, 2127 bp, Bovine  19866880992062
ttccacaaattcccttcttgttgaaatacagggttgtgctggcctggctcatacagctctgggaagcgtaggctccatgtttcattcacatcctggaagcatcagagggtaaggaggaaggctcagggtctctccaaaggtcccatctccagcagagtagaggcttctcccctcactgagtttgctgttaggctgcctaggagattcctcatggattacttgagatgtggaaccagagaacagagcagtgaccagaacctttctaaagccctactctctaggcagggatatacgtggtggaagaaagctaaaagttcatgatggggagttaagaaagggggaagttaggattgggagtagagggaaggaaggactggagcttgggtggggaggcaactgggacatgagtccctagttctaagtgttcctttggctgagtattctgtcaaaagccagtgggaggcaagaggcggccggtggcatccagttagtccgttagaggtatttctgttctgtgatgctcctcccattcccgtagccactgggaaactcagctgaggtaattctctgtgaggatgacatgggaccatcttcatctcctaaatctaaaactctgggtaacaaggattgaggcttgttttgagaggttgtggatccctagatttagatcactgaagctgtatagctgctgaatgacagaactcatcctcttgctgctctgaggctggcagctacttcacggagagtttccttcctaccctgatggagaccaggaaccacgatcccgtgatgtcctctttcagctactttatttctctttggaggctccctttttattctacgtacccaggactggaggttgggtagaagagggagaggtagggcaccaggaccctcgttgcccagggaaatttccaagaggattaggcagtaccccccaggctgactccctacaatttgaggaatcagacccatacttccaagcttggccttcaggattctcgcctaggcctcgcttatcccattatctctttatgggtctctcctttctggagccccttgatttatctagtcctgccccaacaactatttccttccacttttgtacacactccatttattgcacagcacaatgtctgtgtttctctctatgaagaaaaacttgacacaggaaagtttgggtttctgcagccaatgattattctgtggcagagtatactttactttatccaatgatacctctccaggtggtgagctccctcccttcctctagaaatgattctatttacatttgactttggagcctatctcttggctgctgctgtccttttcattcctgggaatactcttcaaggggccaggggcttcagccttgactaagaggtttgttgctggtcttacctgatcaaacagactcaagcccaggacagggagggaggtgtagaccaggttgtagaaagtgataaaccaggtatcataaactgtctggaagaacaccaaggagatttcttaggagatttctcttttccaaagtctcagctctacctcccagctttaagaggaccccttctgccctccacctacccatcaccgtgataacctagaacatggtttggatttctgaaatttgaccaagaaagctgactgcagactctgtttggtccctgggtcctaggctggggcaaggccacattacacttgtttgtggccaatctgatgaggatgatttagaccaactctaccatgacctgtactgctcctctctgcatggaaaggacccagagtggctgctagggaatgctgagtgtacccctgcactcccaggcatgtaagcctctgtgttctttatctgctttacggcattcagtagttctataaccctggacaccttctaacactggcaagcagaacagacccatgagcctatagtaggctactttctttcctagccacaagaggtcagcagtaacatgtacatatacatacgcctcccacaagctaggctggtgttactagacactaggggcagacaaacccactactgtctgctgactggtctgttttcctggagccttaaggtcatagcatagcaaggtcacaaaggtagtagggatctcccaagatgat

SEQ ID NO: 47124 - DNA, 2130 bp, Bovine  19866881023747
aaatccatctgtgatgcaggagactgcctgcaatgtaggagacatgggtttgatccctgggtcagaaagattccctgcaaaacgaaatggcaacccactccagtattcttgcctgggaaattccagagacatcgcaagagtcagacatgactgagtgactaaaccaccaccaccactgctccttttcctcttttcagccccctaactactgattctcattatatccttggccttctgttttctattttccactttagcagtcagtcgggagctgtgcttagtcactcagtcatgtccgactctttgtgaccccatggactgtagcccaccaggctcctttttctgtggggattctccaggcaagaatactggagtatgttgccatacccccctccaggggatcttctcaacctagggatcaaactctggtctccagcattgcatgcggattctttactgtctgaaccaccagggaatatccctgcccaaataaataaataccccaaatccaaatctaccatcactgtcatgtcaaatgaattaaacacaagaattctatagttaagcaaatgttctatatccttaagatcttgcttctggtttgacatttaagagtaggacaaaacactagttgccaagttagtaaagaactactgatttgtctatcttgggacagaatcagcatagcttttgtctttgttttctaaaaaaaatgctacccaaatgagtagaaaccaaaatacattaactgtaaagtcaaatggaaaatttactaaagccagactttagtaaggtaaaagatcaaaagatctttgggtccaagtgttgtcatctggatttagacactcagaaattcagagtatcttaaaatcaaagaaaaccatttctatgttagaataacctaccctcagggttgggaggggccttagaggtcatttagttagaactccattcaagacatagctgtgaactttccaggacagattttgtttaactctttttcagtccctactactagagtagcccagcatagagctgtgaacagaacaaaccttgagaaatgtatagtgtttgactgatcattaattgaaaagtcatggagaaacaccaaggaaatcttaggtttaacttggatctctaaactcctaagtgctaagctatttgaccagcttctcttccctagggaaatagaccttaagcaagacgtgactgggttgcctgtctagtcttccaaggccagttttagccttaagacaaaaaaagtgttggttctccaagagtattcagatgtcttcccaagttaggacccagaaagagattcttcatgcttaagcagtgtctgttttccaggactgcaggtaggtttgttcttttgtttgaccctataggtggaggaggtgggagagaagccctgtccttggattatttggtctcattctcctacttttcttaagctcttagattcaaacccttacatcttaggtcaaacaactgaagatccaaaagtagaaagtaagatggtcttgtcaacatcttgagattagcattgaagaggtagcaagttcccactgttcagacctctcccaggacaattaaggggcaagtgattctccagtgctgaaagcaaccattgtaagaaccttcagtgggctaaggttgaaagacagtcatttgcttttggcatctgacacctttcagcactgaaagcaacatgtaaagacacagcaaaatggctttgccagacttaagaaaagcttcagtagagagctctgagtagagtgaacacaaatggcaaacttgcctactgtttggcactgagaaggaacttgagtcagaagataagatgaaacagaaagatttctgattctaaggaatgaaagcatttggatggctgcacaagtgaactggggctcagggaacagtacaatctcaactccacaagtaaatagatggtcttcggcaaataaattaacctcagggcctcagttgccgcatcctgaaaaggtgatattactcccttcttgcagttgttttgagaattaaataagttgctttttctaaaatatttaaaatagtactaaagtacttagaatagtactttacatataataaatatttaataagttttga

SEQ ID NO: 47125 - DNA, 869 bp, Bovine  19866881025874
aattgtgtccaccccatggtttctcagcagaacaatgtgggtcccatccagcccaaagcagctccttcccacctatgggctgccctgcacacagtgacttcttcgtactcaaacctggacctctccacacacagctccccaatgccccctggccagtctgcaggctcccctcagtagaggcctcactctattttgggaaaaccccagtaccctgcactccagataaaattttttttgtcctcagatggagtggtgggggaattctgaagacaactattgttaaccccatcttggactatacaaatacactgcccaactctgagacttgggatagaacctctgacctttgacatctggttccctcagccccaccttaagcagctcattctagttcacaggggacagtattagcccgtattagattcacatctgcatggtgtataacgtacccttttccggctgaatgtcctcattagcagtaaacctaatacctttcccatcatgcactgagtgaggacaggcaagtcaagaggtagcagcagtaggacagagaaagaagaatcagttagagtctaagaagttcacaggcattcagagcagctctaacacatagtctgagggagcacagagatggagcagggtgcagagagaagtctaagaactggggccagtgaatgctccaaattatacttaacagtttgcacatcaaccaaatcacagacagaggcagtagaacatacagcaagtttctgagaccagcaggacacaataaagaaagctgtaggctctaatttcctaggctccaagtgacaaagcagtgggtagaacacatacacacaactgcagactccccatggtcaccacccctg

SEQ ID NO: 47126 - DNA, 715 bp, Bovine  19866881030425
cccaggcacccccaatcattcaccatggatttcctcctcactcccccatccccacaggtggccaggaaactggtgatcctggaaggagagctggagcgctcagaagagagagctgaggtggctgagaggtaaggacaccccagggtagcaagtgaacctcggcctgagcccatggctgtggggcactatgtgcagtgggaggtgcttccccagtcagggtacctcagggacaggtcctgcctctgacccctacctgctggcccccagccgagccaggcagctggaggaggagcttcgaaccatggatcaggccctcaagtccctgatggcctcagaggaggaggtagtcacctctctggacctttctggccaatggcaccttctctcggctcaccttcccctccacctcaggctgctctctctcaacctgctgggggtcgggaagggcctggggcttccagtctctgcctgctgtcactctcacaactttgctcttcttctcttccctcctccaccccttccccactgtgccacctccactgtctcccccactgtgccttcacatcccaccctgccacacacccccctgcagtaaatgtggggacctagaggaggagctgaaaattgttaccaacaacttgaaatccctggaagcccaagcggacaaggtagagggggcagaggggcagtgaggatgggttccttcagggaaggg

SEQ ID NO: 47127 - DNA, 1251 bp, Bovine  19866881038096
ggtcatgaattctatttggatagattcctgttgcactcacctggtccacgctgacgggccagaacagtggtttgagaaactggtacccaatcacaggcaacatgcagaggattatgctgaggataacactcagccacatctgtggcaggttcagagtgttcctggccacacctgtaaacaaagagccagaaagggaaggcgggaccaacgcctggaaggagggggctgtcagcctgaacttaggtacttcttcagcccaaagaaagaagttactgatttggaaacagtttagtctcctgagaaaaatataaacgctaaaggactgtactggggtccttggtgtagccaaagtcactgtgaattcacatgcctttgtctccccctaaaggccaggcaaggcagcagcggtgagggtaggttctaggagtcctagagcactgaccgagacacaaaaatgggatggggggttttggaggggaaaaatgagtggcttgacaaaaaataggaaccagttatatacagtaacatctgtctgttattttgtcctcatcagagtggagatgagagaggggaaaattaatacaggagctaagaaggcattatgtcatagtaggaaggacatctgactgggagtcaggaggcctagatttgagtcattaaaaaaaacttccagtctctaaagtggtgcaataattcttgccctgtctatctctcggtctgcttgtaacgctcaaattaggtaagaaacttaaaaatatcttagagactctaataaggtaaagtattttcgctagctagattttgagtccttttagggctaagatcatgtctcaatcatatctatatccatggagtctaatacatagcaatagctgctcagtaaacatttaataaacaaatagacttggttcacactcccacccccagccccagccccagccccttgccacactgggcagaatattacctaggaactggaagatgtcggggaacaataagcataagccatcactgtacaggaagaataagacgcaaaagtagaaacccaggctaccccaggtgaagacatggcttatcatcgtccagtaggttgtctccagtgtaatctgaaaagcaccctcttatgtacattagcctacaacccaggatcttcagttacctcccttctcccatttcataaaaggggacactcccctttctgcctcccctccctccttcccttcctctcttccagacaggctccccatgcaa

SEQ ID NO: 47128 - DNA, 1295 bp, Bovine  19866881042197
tcttttgctttttctacaggtattaccttttagggtcttttccacagaatattttatcaacttccctggggtcaggttatgtaatcagtccttctcctccttaaactgagagatgtcttctctctttagacaatgggcgaatggatggctggagtctcgggccagtctcctagaatagctgtggtcaggattagccagggtgaaacaaccctctataagaggaaggagacacggtcgccgagtcccatgctaaggggtgctccctcaccatgactgcatcaccacagttcagcttaaccgtgaaaggccacagacttgattctacacccccgcctcagctgcagccccattcctccttcttgtcccagcctccccgacagaaagttaacacatgggagcaccaagggaggagaatggtttagaacatcagcacagggcacggaagcctagcagggtaggcacaagttgggggagagagacgggtcatctcatttccccttgtgctgaaggggtataggcggttatgtggttctcccatgcccacacttaatgccctaccccccagcaccttcattatcagaagagaggaatggctctttgccatcaagacaaagatattagagttcaggacattacctggcaatttatcatctcctcttctttcatctttaggaggtgtttgcttatactggggtggctagttggaggttataacagtggaaagcaactaggattgttgaacttattatgaatctagggagacggaaatggtggtgcagtgggggttgggaggaaatacattgtcctttaagctttctgacctatgtttctctccccttccctctcccagttgattcctcagatctcctccttggcatggtacacgactgtgataccgctgatggtggtgctgtccataacagcagtgaaagatgccatcgatgatgtggtgaagtggcttccagggcctctcttccctcactgtacctagtcaggcaggggaggaagggagcaggaaggactccccagaactgcctaatactagaaggaagaaggaaagaggtgtttcctttccctatgtccttacttgtgccagaggaatatgagattcccttaagcccaagattggtgagccatccatggccagaaaggggtcactcacgcaaggcctttctctgtcttcttactgccgccatttccaggtttccttccatctccttcataacccacctctgcctttacttagctctctctgggttgctctcacctttctttctccattcacccttctccca

SEQ ID NO: 47129 - DNA, 1883 bp, Bovine  19866881047963
ctggaaggccgttctgtcgtgataatgacatccggaagtatgaaatgtttgctcagacccttcagcagagtcgaggctttggcagcttcaggtaactaggtttcagtgggctatttttaagtcgtcttggggaactatacaaccaaggtagtgggagccctaaggatgctagaaggggtaattgtgaaaatcatacacaagccctatcctaaccctcttttttgcctctgctcttaatacagattcccttcaggaaaccagggtggagctggccccagtcagggcagtggcggtggcacaggtggcagtgtgtacacagaagataatgatgatgacctgtatggctaagtggtggtggccagcaagcagtgagctggcctggctggaccttgttccctgagggtgggggcgctcgcccaggagggaccaggcgtgcgcccacagcctgctccattcctcagtctgaacagttcagctacagtcagactctggacagggggttactgttgcaaaaaaaaaaaatttaatacaaaagcgataaaataaaagcgattttcatttgggaggcagagagtgaattaccaacaaggaattgggcctgaggcctataccatttctgctgtagtttagagcagtgcaggaggaacctctgtgggtgtgaacaaaggcattatcaccagtccccacagcaaagcatctgcacttcactcaatgctgcccaagccctccctttcccctacccaacctgggcaggagggtgaagggctgcagttgctgggtgtttatatagagagtaggttgatttttattttacatgcttttgagttaatgttggaaaactaatcacaagcagtttctaaaccaaaaacgacatattgtaaaaggacaataaacgttgggtcaaaatggagcctgagtcctggcccctgtgcctgcttctttcctgggaagggccttgggctgctcctcactgccaaggcactcttccaaatgtgaaatactagaagtgaggttgcaccctcttcccctcctgattaacattggtgtactgctaccttgcccagtgtctgtggtttcactggataggactgcagtggagggcagggtgcagcctgatggaacttcagaagtggtgaatgtggcatcctctacctatatttgatggggatggtgagactaggcctgtagagtccccttttcctgaccaaggctgggttggggtatagtctctggagatggatgttctcttgatgcatctagaaattttcatatattcatgttctggttgaggatcacttacaattatgtccacctttatgtaatttgtattataaaaacatagctttttttctaatataaaattctagttttggatgtgtttctttctaaactaaacatcctcccctgctcctagtttttcagatgattgcttgcatagttttgtctaggtatagtgtgtcttctttgttcaacatgtaccagcgtaatcacttagtatttctgggatcggtatcatgatgccttattgaagaggagtatgatgcagagaaaataacctgctgaatcaagctagtcattctagtatttacaccagcctccagtttgacgtttataggtaggtaatctgcaaggactcaagatagttacgtagactgattaaattggggcatcttgaactcatgtgctatgaaatagatattcttacacttttgtgatttgcattgactctccctgttaaccgtaacacttttctctaccagatgttgtcttcgctcctcctttggttttcacaccatttaggtatcctgatggctcagctttcagtcttcttactcttacattgttgcaccatctcatccctgtggcagcctaacctcagtgag

SEQ ID NO: 47130 - DNA, 1469 bp, Bovine  19866881087535
gtttggaaagaagctggatctttcatttcctggctgaaagagaacaaaggggactctgaacaaatgcctgcagaatcctcctctccagctttggttataagcagtgatcaggaccttaaatctggtgagactgacaaaactttggagtcttctcaaaggtctggggcctttgctgagccagctaaggtcttgactcagccctctgggacctctgagcagctggaggccgggccaagtatatgtactcaggagctttcaaggcctggagaagtgaaaaaccagcaagaaatcccagcatctggagaagacaaggataccaaagatatctgtccttcagagagtcatgaggaagaacactgcactgtctctgagctacttcaaccagaaacacatgaagaggaggcagagcctgctagcactagctgtgtttcaaatgtacagcagccagttactctgctggacatcaaggaaccaaagaccagcaaaaggcctgttctcaactaaagcatcataaatgattttaaggaattgaccatttatgatgcaatgacttagtggtagcttaaccatagcctgctttttatcctccttgtgtctttcccagcacctgagcttcatgttaggcattaagtaacaagaaataatatgtggatattgtcatctcttctctctaccaaatataattcacttattggaacaatgcgcttcctggttaaaggaaaggctaaattctaggatttacttactctggcttgctctgccttgaataatggtagaaggggagaagggagggcaagaagaggcagcaagtcattgagtggcatatattattaataattacagccatgtgataggcttgaatgcttccttgggctttgaacacctatatctataatagctgggagagatctactttgctttgcttttccaagtcttctaagatgctttctccagtggcagtgaaattactaagtagaatataaaatgcaaaggatggcttggattaatctatactgtatatcctattccatatggatttgcatagcttcttccagtttctgagttttatcatccgtgagactggtgtttctttaggtgtttttggtagagtctcccaggagctcagggctatcatttgctgtggagcattgtgctctatggtggagcattgtacagggtccacctgcaaagcgtactattatttcccctaagaagatgtaccatacaggacagtttaagagtgctgccttgagcactggcccaaaacagtccaaagaagttggtcaaacactttggagattgtgtgttaggaactactcagcacagtggcctggtacctctcctactgctatgggatgaaaaatcagaaatcagcctggaaacaccagataattgggaggaaccggagggaaaataacactggagaacaataaacattaacccttagttaaagcttgactctttggcaa

SEQ ID NO: 47131 - DNA, 1939 bp, Bovine  19866881198111
cactgagcccttcaaggaatctgactgggggcagatgggttacttatatatattgtgggaggcacccaacactgcctccaaccaaggagctatccacttggaggtgacacttcagtcatctgtctgcaggaggagcaagaagagctgaagaggaacgtgcatgggccacaacacatacctttccctcccacaataacacagacactaaggacacacaggctcacaccacacaacaaacgtatgcctatgcttaccaacacacaagcgtgtacacactacatatgcccagcattcccacagatcccacaggtacacacacagacacataagcacccagatacctgtgagaatccacacagagctcgcacctctgcaggagcagtgacctttggcatgcattggtctcctcgagattatactctgaatgcagcccgctacctccagctgctctgctagctgttattgccaaagacttcttcaggcacctcctcatcccctctagagtgctacccaccagagatggctgggggctggggccatgaagactctttattacggagccatccttatggcacatgtcctacagccgggaccccctcctctacccaccttccacccattaggaagctggttatctccttctgtcccagtcacttcccctgggctgacaactggcagatgaggaaagtttgtggatgaagcccccttgtgggcagacaggggagaagacaggttgtgcttacagcctttctgcacttggatctgttttcctattgggcatatattacagtaaaaaacaacaacactaggacagggtaggaatcaggaagccgttttctagccccacactgtcactgtcaacacatatgacctcaggtcaattgatcccttgctgtgcctcagtttccctatctgtaaaacagtctccaaatttcaaccctgctctgaaagtgtcagaaataattcctaagcaaatcaaacttatttggaacgagtttcactacaagaagaaaactcattataatggcaactaacccgtggccatctgtttgctacacattattttcaaaactgctttcttaaccctgcttcaatgtatgcccagtacgtcaaaggtttaggccagatcttcccacacttgactagaagttctctgttgggggacactcacccccatcaaacttcacgagccggtacaaagcactcaagacttccttggaagagtcaaagtggagtccagatagacccccagaaagaaaaccatgcagtctctgtcagccacctgctgagctcaagcccacagctgccactattctgaccctgccaattcctctcagttatgtaagacttctctcctcctccctatttctctctgcttcttccccagccatctggttgccaacgtcccacctctcctgaatccctccagtccacccctccctgccagaaccccatccctgcctcgttctttcctgctctgcactcaccagcccctgggccaaggacagacaacagcaacagcagcagtaaggctgacggcagctggagcccagacctgagtcgaggctggtagaggggcggggtatgagagtgagaggtgggcagtgggagagacttgggtaaacacagagatgagggcacagacggggataaagagttgggctgggctggacacagggacttatgcaagggtagggggtgtgatagaaggaggggctgtgatgggggctcgaacaagggcaggcgttgggacccgggcttaagcaaattttgagaatggggttggcacaggggccgggctgggatatggggaaagaggtgcaacagggccagggactgggatggggcccaggtcagggactggagggggcgcctgagctggaacctggatctgggcattcgctgggacccaggcgggaactggaagcgatttgggaag

SEQ ID NO: 47132 - DNA, 1568 bp, Bovine  19866881219302
ttcgaacctcaatgatggtttggccgaggaaatcatcagactctcgctttagccgctgctttactcgtgacttgatgtcatcatcctcatcccacacacgtaccttaatgcggtcagaagagttgtggcactcactgtaagagagtcaggcaggttctgttatggacgggcccagcaaccctctctcttatgacttccacttccttcccaaagctctaccagctgcacttgaggctgacagaggaagagaaggagtcacaggacactggtactcaagtccccagtgagtcgggctatctgagcaaatggctctccactccttagcctgggtagctctcccaacagaaaacagcctgatagatgccacagaaccctaggaagcagttggtagttccctcccctgagtcctgtatgaagtccataaagatgttaaatgttcatggtaagcccatctggtcatatttgctttagttttctacctaacatccccatatatctgggaatgcgcttggtgaacttctctcattctccttcttcgtcttcttttttttaatcattctttaatagccacttgacttgtcattttctctatggtgcttgctttggagggggtagtttgccaggtacctccctcacactctccatcccccagcagttgcttttttggatccctgctgccttatctaaaagttgtacttggcagagtttgctgctccttatcctatgttctcataatgtctttgcacattctgttaaagtattataggataactactggtctactgaaaaataacagacaaatcatcaataagcctcttgaagccaggcattgtcttatacatttttagatgacaatatcatgtagagtgtcttatacagaatacaagtgtgtattagttgctcagtcatgtctggctctttgcaaccccatggactgaagcccaccaggctcctctgtccatggaattctccaggcaagaatactggagtgggtagccattccctttccaggggatcttcccaacccagggattgaaccctgggtctcccaaactgcaggcagattctttaccatctgagaagaatacaaattgcttactaaatgaaaagtggggaaaaactgactatagagccaattcatttagcattaactgtaagtatcacttctcggccttttgccaagattgagtgtagaattaaccataagtaatagtcaagcaggaaccagtcagcttcttgacaaaaaggtgctcccctcagtaactatcgcctctggactggagatggcttttataggccccaattccttttcccaatttccttccaagtagccaagagcagaaggtctctacataagctgcctgtttggctgattcagactcaaagtcctggtcctaggcattaacgggggtggataaagcatctggattcaccagacaccagtccaggttctaggctacagcttgccatttttcagcagtcatcccttgctgtcatatgaaatagtctgtacaaaagtgagatacgaataaaggagaagggagggaagctaggcagaaagaaaagca

SEQ ID NO: 47133 - DNA, 772 bp, Bovine  19866881261154
aacaccacagaggcagaagtctttacaggctcagtaactgggtgggcacagaggtggcaggaactcaggtgctctagaaaacagagggcatcactgccatgtcaacccaaggatctcagacaaaaccctctttcgtctgttttttttcaataccaaaattcttagaaggatggactatgttaattctttctccttaattatttcttaaacaatcagaagtctgtcttctttttattaatacttgagctttctaaaagcagttctaacttttaagctcataatatttaaattgcctgacacttatccaccctctcctattgaaaccgtctttttcctttggcttcctagtttttcttcttagatcattctttcttcattgtttaatatcacaatacctgacctatatttaaatatagattcacagcagggctcagacctgaaatcttttcaacctgagaagtgtttagcccttcccagtattctattgatttccaaatcttcattcttcctgaacttccagaatcaaatctccaataccccattaggtacttcttactcccccaaatggagggacttcccctagtgatctaatggttaagactgtgagcttccacagcaaggggtgtgggttagatttttggttggggaacttagatcttccacttagcgtggtgtgcccctccccaaacaaaaaccaatcaaccaatcaaaaaaatttttttttaatttttctatttcaaattagctttatttaaattaccattatacaaaa

SEQ ID NO: 47134 - DNA, 1561 bp, Bovine  19866881274183
taggcccagccgggcctggctgtgggcgcgtcttggaggtggagacagggaacgagggagagggaagaagaggaagggggcgaatgaggagccgcggaccccaccgggcccagctgcgcacccgcgcgccccctaggcggggcttgcgttgggcctgggtcggggcctgggccagatcgtgctgtgtcatgcaggcccgggccggcctgattggctcctttggaagggccgtcccgacctagtgagttctgcgggctcacactgacggcgcagagccccgggggcttgcggcgcccacctgcgatctgatctgccacccgcctttgggcctttggtcccaggagagcgcaggccccgcggcgggcccaacgccctaactgggcccggtgggcgtggactttgagccacgtgaaggccttagcccggagaccgaggcggaggccggagctgggaaaggcctgggagctcagggaagctcacgaaagcccttttagagctgggttggcgtggccagtagttaaagacctgagtggtgagaggctgttgaggagagggcgggcccagccgttcggttctggccgccttcatattaataatacttgaggcctgttattcatacgagtaaggctttcgtcagttttccttgatgttgtgaaatgggattctttaggttcttgataaaattcaaatctcaggtcgttttttgtcggcctttctagatttcagtctttgtggtgtgaaggttagagttcccttaaactcacacattcctttccctaagcagcagtgttgagaaatcctgggccctctgctcaggaaagcatcagataaaacctgaccacctctgcccgttttagaatcaagggctttagatactaggagtataaggggagacactgccatcctgtggaaacccttctatgcaaatcactttactgacttgagagtttaggtggggttttttttttttttttttttgagacgtgttcccttttttcaagtttctgaattgagatgaagtattactcaggtgcctatttaaaagaactacttaataattaaagtagtctcttagtctttagttgccaagactgaaagtaaaaatccagaattcttgaaacctggcatcataagagtttctgatctctatgtcattttgatgactcttaacctgaactctgtccaagtctcctgtggcccgttggggttctgaaaagggcctgaatcatgccgaagaccagggggatgtcccccaaaacagttcttcaggactgttggccggggatcaaactgaattccatcatgtagagattacttcctttgatctcagtagatagatgtggaattaaaggtcttttaagagcatcccactcttctccagtgccagggtcaggaatgtaggccgaatgggagattttcctagaatgcagctttggggttaaaatacaaagtgatggctagaggctcctgatactttatttttgtctagccctagtcctatacatcagacaggaagatgggcagcccttgaaggatactttgatgcataggagagagggag

SEQ ID NO: 47135 - DNA, 802 bp, Bovine  19866881354809
aaaaaggaggcattattaatgtggatgaactcaaggagtggggaagactcaccttaacaaggtcattaatgagtgaataacgaaacatccagtccaggttgatgctgtcattttccagaatatcctggtaggtgacatggaatagatgatgtgactatcctcgccccactgtcacccacacagttgatgtaattttgggtctatctcccttggccccataatccccacctagatcccacacctgtaaactcccacgaggacaatactcggtgacaatgcaaatgttgggagggtctatgcaggcaccaatgaagcgagtgagatggttaaactgaacatctctcatctagccaaaaggaaaaaaaaaggaagaaaagagaattcaaagagctaaaaattagatacagaaatctaccactacaggagaggacctttctcttaattgtactcacaactcaaagtcatttacaaatgacccacttgccctcccagccagtattactattccctagtcctctccttccccttccacatccgtgtctatcctgggccctcaacccatacaccaggacttacatgtttcagttcaaacagaacctgccgggtcagctcaatgcgcttcttattcacatgcttgatggccacaacgtttccctgagggtaggggtgaaaggggaagaggaacatgaatctctgaaggagcctctgggtgctgggaaagactagagaactgtgggagcacccaggagctcagctggacagagagaggaggctgacaaggggcagagggtcacgggaagag

SEQ ID NO: 47136 - DNA, 1514 bp, Bovine  19866881404126
gaaatcttttgtgtttgagtttacacacatctcctccaggctctcatttcttcagtaagagtttcgtctgtttcctctagcaggtctctctgccctctggtttgtttgcattctcccagcctcaaggactgagaaagatgatccatcatgagttttttggagagtcagggaaattcagcaaagccattcattgttcttgggaacctgactgttctgagacttcttgctgtcctgaggctgctctccagaaacttgtctgcagggaattctctcagccagttcaggagagcccatgtaaactttatcacctgtagctgggagttgcctgagaagtgtggaagctcctgtaggattgccacatgcccagaatctcctcattctgggtagtctaagtataattgacagatacattgatattctgggtttcctgggtggtggctcagtggtaaagaatccatctgcaatgtaggagccacaggagacttgggctcaatccctgggttggggaatcacctgaagaagggcatgcaacccattccagtattctcacctggagaatctcatggacagaggaggctggcgggctacattccataggatcatcaagagtaggatatgactgaagcaacttagcacacatgcacaatgatatttaccaaagacttaaaaatagaagtcatgaacagtaggtacctctgggaagtacagctgggtgtaggaatgaggtgggccggggatggccttttacttcgttttttcccccctctagtaggagttctcaactttagcacttttaactttgggggccagaaattgtctgctgtgagtgactgatctgagtgtttagcagcatccctggcttccacccaccacagactgatagcactccctctccagctgtgacaatcaaaaatgtctctggatattgccaaatgtcccctggggttgtcacggttacttctggttgagtaccactgttgtataccctttagatctattttattttcttaaccatgtgttcacattattcctataattaaacatgtgactgagatcatgagacagaggaggaaacataaaactgttgtgaggaagcagaagcatgaagtagagaaaacacattaagggataggaagcaggttagcaaagtggtaagaaatttggggaaaaaataaaagaagtagacacagagtgattcacagggctggaggagaaggagtgtgaagacccacatcctcctgtcaccaaggtccccagtgatgccagaatcagagataataacagtctgcatatgcccagtcagatcgcagacactgttatgggattcccattccatccagcctcataaatacccaggtgtccttacaataaacaccgctttacttaagctaggctaaaggagtgtatttctttccaaaaaaggtcctgtggattaagtgcccaataaagagagaggcccccacgtcttaggatgagtaggctgcaaatatggtctaaaagaactgtaaaaggaa

SEQ ID NO: 47137 - DNA, 677 bp, Bovine  19866881408570
tggcaggtgatctgctgaagatgatgggatcttcacttctttcacctctttccctttggagtcatgactcagtaggcaaaactcagtagtcaccgtgactggcttaaagtgtgctttacagagcccttccattgacaatgaaagggaagtgaatggggtagagagggaaggaaggagagatgaacaggttagactctacttctcccaaccccttgccttcaaccaaaacagctcagcctttacctttttgtgtccacttatctgtggaatatacttgaacaaagatctcccctctaaaaaacattttgaaaatttctattctctactacatgttctcaacaacccaataaaaagccatagcttaaggagctgttagtgctccttgttaactgtctatcaccaccacctggctgtcaaaaggactcacgatgcataatgggcaggtggtcctgcttccaggactcccttctccaaccactatcattagggatgaataaactaataatgttgcaagttgctgtgttggatgtgaggctaagcatatcacataaaccagcctataaactgaacctgacattacactatctaaggagtaaaagattggggactgctgttccaaaaaacagtaatttaaacattgctgtctcatgtatatattactgtataacaaacattcc

SEQ ID NO: 47138 - DNA, 1067 bp, Bovine  19866881619274
atgattaatatatattcgttactgataactagctgtgccctaaagggcgttatcaaaacagaaattgtgctgcagagaaaagctatacacaatgagaaaataaactgcaagattaaagcatgcatgtttaatactggggaaaatcacagccctccaaaatttctccacatttcttataaaagccctctgcactcaactaaaattaaaatgatcttaaaaggataatattcgcagagtttacttaagtcgtttcagccacagaaactgcattggaaacaaatgttcagagtaattttcaaaacaaaaacaaaaatctatgatgacattcatgattaaaggtctgtgcaagacacattgttctacgttcccaagaactaggggaaaaaaacctcgtcagtttttagtttgcagataatcaaaggattttgtatcccagcagttcaaatcttctggatcttttcaccaacaagtactggattttcttttctgattttctcagcagccatcagtctttaattgtaagagcagttgtgtacatctgagtaatggtgtacactacagtaaacatttccacctggcattcaaaccaagtcccactttcttcctgcacatgaaacagattctttttctgttttggtttttcaagagacttggttttctcttcagacggctgctatgctgtttctgatactgcagtttgcaggtcatctgtttccagtattgctttgtccatagatgtactgtccacttggggaagacactacagattctgataaaagtgactgatgtgatacagggcttggctacatggacgaagacgtagcgtctagcgctgactgagcttctgggacactgccgtctgtgctctgggctggtaaagactcagacagactagagacagaaagtacaggggggcttattctaccatcactattctgaactactatttgaagatgttctttattgcgcactgaacacatgccattcgtactagggtttccataaaatctgcagccagcagaacaaagcacaggcactggctggattagtttcttagccacattccc

SEQ ID NO: 47139 - DNA, 766 bp, Bovine  19866881649191
tgacgctggcggtggtgctgcccgaacacaacctgagctatgcctgggcctggccacgggtgggtcccgctgtggcgcttgccatggaggcgctgggccgggcgctgcccgtggacctccgctttgtcagctctgagctggacggtgcctgctctgagtacctggcccctctgcgcgctgtggatctcaagttgtaccatgaccccgaccttctattgggcccgggttgcgtgtaccccgctgcctctgtggctcgctttgcctcacactggcgccttcccctgctgaccgcgggtgctgtggcctctggtttttcggctaagagtgagcattaccgaaccctggtgcgcactggcccctctgctcctaagctgggtgagtttgtagtgatgctccacgggcacttcaattggactgcccgtgctgccttgctgtatctggatgctcgcacagatgaccggcctcactacttcaccatcgagggagtctttgaggccctgcagggcagcaacctcagtgtacagcaccaggtgtatgcccgtgagccggggggccctgagcaggctacccacttcatccgggccaacgggcgcagtgagtgtggcccgggctgtgttagggctaggggaggagggttgcggtgtccctggggctcagcactgggaggctgtagatgtagataggtgttgaggagctgatggtggtggttgggatcaataagcagacatggatggagctcctgggagaggcccgaggcattgtattg

SEQ ID NO: 47140 - DNA, 932 bp, Bovine  19866881651546
gaagaagagcctaagctgtatccctgagagcaggcactggccagaggctgctgcccttgagatgagaaacggtctggcttcacaattagtctcaccacaaggcaagggtggtgctgagtaaatgtgggaggagatccagagcctttcccactcaggttttctcatcctctgtgagagctgagagtatcccaacttgaagtcaacaatcctgggtctccccctcaaccccccaggagtggggccttcagctctaggactcttaatcctatttaaaagctccagtgaactgccatctccatcaaaaagttgtccctgatttccccttctgtctaggagtccctctcctcctgccttccatgactcttgtgctacccttgtcacagcacagtgccttctagtggactgttcacttgtattctccttccactgtgagttcctctaaggcagggtcagtcttttcatcactgttttgagtcctcacacaggacctggtacaaaacaggtgctctgagaacatagaagcttgactgaataagcgattgagcaaattcctttaggagggaagagagacccagtatttcaggtaaaaccctgaagttccataaggagaatgagaaagagtcaagtgtcctctgctctttgactctggccaggaccacaatccacaattctgtgcctgtcaaactaggttttcttgtcttacccatggtctcttagcatctgaagcctgtccagatgtggcttttggctttgatgcttctgacttacaccgccagcccgttgtattagtgccccatcacaccagggaagcttggttgaaagggggcagagtttagaccgagtcacaatgaggttgggtggaggctggcattccactggaggaattctgaactctgtttagaatagcaggatccagtgcatgaacaggtgag

SEQ ID NO: 47141 - DNA, 3073 bp, Bovine  19866880297518
attgacccccgcagccgcctgtggttcttttctcctgctggtctgtcaagaatctgtcctgctgggggagggccttggttcctcgtctggaatgagagaccctggagtgcaactcaggcttgctctcggacgtgcgtgccatcctcctgactatgccccttgtccagaaaaaaaaaaaaaaagaagaaatatataatattgaagtaatttatatcatcagggagatgatacagtgtatctcttttttactacagttttatgtttacttgaaaatgactgctggtgattgttactcataatgaagtgctaaaattttttgcaagtggtttttgaaggtcaattcaaatagatctaatattattcctgtagtatctatcacacttgtgtactagtatgttttcttgagtgaaagaaaatgaagtagtttgagctggttatttggaagttgcccgaaaccttgatcattcattcattcaaaaaatctttcttgagtgctggctagctttgagaaggcaatggcaccccactccagtactcttgcctggaaaatccatggacagaggagcctggtaggctgcagtctatggggtcgctaagagtcggacacgactaagcgacttcactttcactttttactttcatgcattggagaaagaaatggcaacccactccagtattcttgcctggagaatcccagggacgacggagcctggtgggctgccgtctatggggtcgcacagagtcggacatgactgaagcgacttagcagcagcagcagcagctttccttatcttaggcactggggatccagtggtgagtgtggggatgcactggggattgtgttccttgtgaacattttgtgctcctcgtgatgttactatcatgtgtgttctcttgtggatggactatatgctcatgtgtgctacagagaacactgatttaggaatggaggtctggattcagagtctaccatctatcctgttaaaattgttagactggagcctattaaccacctgaagttgacagttttttaaaaaaatattaattttttatttgtggctgtgctgggtcttcgttgctgcgcatgggctttctctagttgcagcgagcagggtctggctactgtagcgcggggtgtgggcttttcattgtggtggcttttcttgtggagcgtgggctctagagctctagtgcagcatgtggatttagttgccctgctgcatgtgggatcttcccggaccagggattgaaaccgtgtcccctgcattggcagggagattcttaaccactggaccagcagagaagtcctgaagttgacagttaagtctggggatctgtcttttgcgggggagagagttcagagccttatattagatcctcagagcatttactagccttccaaaatatgaaaaagaactgtgtttagagtctcatgtcttctctgagacctcatctcgtatttgtaataatgctacattcatttcctccttcgttggattcttgtgggcttcacatctggtaatgatataagttaaacaccataaaaggtaaagataaataaaaataagaattctttgttatagtaaagtgttcttttttttttgttgttcctcttagtgaccccaactggtggaaaggggaaacccatcaaggcatggggctcttcccttcaaattttgtgactgcagatctcactgttgagcctgaaatgagtaagtattttctggtctgtcactggacagtaatccttaattctctaaaattcagctttctggagcaagaattctcaaatgttagagcctccaaggtgtttattaaaaatgcaattccccagtcagtttatcaggctgtagacttttatttaggaaaaaaaaaaatgtgtgtgtgtatttatttgtcattgcagaaatgcaaattaaatgttgtagaatttaatcttgtatttttggtatcatcagttgacaatagtgcaacaaatgcagtgtaaccttgtggagattcttcctgttctaaggttagttcatttccctagtgtccagcctcaaacctggcagcagtagcctctaagcaacttaatggctttcctacacttaatgtcagatattcagaaggaaccatacctaaccatgtcagtactttctgacttccaaagctttgctgacaaggagaaacggactaaaaagtggggccaaggaggaaaagtggtattactggcaggcataatcattgcaggagatgtcaactgccagtagcctatcgaaatgttggtaggtgggccactgtatttccacaaaatactgtgatgaatcttcctaatgataagtttgagtcatcaggagtaagtcatattcttcctctgtttaaggaagcagaaatatgttctcatctagaaaggtttctattagtgactgaaatgttttgagtttaaagggcttttgtatgttagttatcttggcaaaatgtctcagctcatcttatctttctgtaacgccagatagaagagatcaaagagagttataaatcaccgtttgctttggtctttttcagtttacgagaattttaagaaaagatctttgtctcagttgttttatttacagcagtacttggtattgagtcttatccagaatactgctgctaagtcacttcagtcatgtctgactctgtgagaccccatagacggcagcccacgaggctcccccatccctgggattctctatgcaagaacactggagtgggttgccatttccttctccagtgcatgaaagtgaaaagtgaaagtgaagtcgctcagtcgtgtccgactcttagcgaccccatggactacagcccaccagtccctccatccatgggattttccaggcaagagtactggagtggggtgccattgccttctcccgatccagaatacagactgtataaatgtttatacaataaatgataaataagtgtctatgtattagtaaagatacacttttctttgaaaatacagaaatgcttttctttcaagagaaggctttaatagcatacattacagatcctggataaaacagtgccgtttcatagttattttcag

SEQ ID NO: 47142 - DNA, 837 bp, Bovine  19866880401978
agttgtgcttaaattcttaagaaattaggaaagtgtttttttaaccttcaattttacttataaaatcaaccccaattgctgaaatttaaaacaggtttcataataaaatagcacaggactcgaacaaaggcatcatcggttaaatgataattctgttttcttttctcttaaatttcaggagactttgctgtgcttctaagctctggacttccgggtaagattgccatcctgatgaattttataagtgctttaactgccttcataggactatatattggcctctcagtatcaacggatccatgtattcaaaactggatcttaacagttactgccgggatgttcttatatttatccttggtggaaatggtaaggtttgtggtttttctgttttgtttttccaaacactaaaaatgtaaaacagagaaaaagacaaaatggaaggatcaagggtgaaacttgatccttatagaagaagactatagataacaacataaaggactaaaaaagtattctgtgtaaaccaaaaaaagtaagcaggcagaagaaatataatttgagattcagaaaatactgacattctttaagtcaatttaagtggaatgaatgaaacctttctaattctccaaaaggcaacatcagttcattctgctccagctttgcatctgtagaagatgcctaaacttccaactaaagaacaaaaagtttttttaaatacccagccattttgtttatacattagcaaatattgggttggctaaaaaagtttgtttgggttttcccgtaccgacatcttggccaacccaatatttcagctgactttgtcattaagttaaagaa

SEQ ID NO: 47143 - DNA, 1193 bp, Bovine  19866880423426
ttcagcccatctctcaccccagctactgctgcagagaccagttccaagagggcattaactatcctgcaccgagccttgcttcaggtccatgctacattcttccttctgttgccatccatgtgatggcatggaactgccagtaaacgcccttggcactcaggcatccataacctgaagtgtgtgtggaggggttacttacgggacagataaaccacagggacagaagcaccctcagaaggtcttgtgcagagggtgccatgtggcagcgttgaacttaataaaaacctattgtcttaccgactttttatccttctctgtttcactccacctgtccttccctcctgcttcctgagatcacctccctagtgaattgaggccttcacagaggcctttgtcttagactctgcttggggaaacccacatggatctttctaacagagaatgaatttcctctggccacccagagctgcattcattcttaatttcctttagaaaccattcagtgtcactggaagttggtgtgcttggataaagcaataccactttggagaattttaggctggctgactgccctggtgaagactttctgctttgttggcatcactgccaacaaatggcccaattttttgagttcttttctttttaggagtttgaaataacacagctgattactttgaaacaaataagcaaggcaaaaatatagctaatcttttcacattaaccctgctcagaaggtgcctggtacatttccaaggtttggtaaatagccagggtatgaaagtattcctccttaccctttagttactgtcatttattttctttgctgttgtacagtcttgaaaccttgttttcttcccttgaaatgacaagattattttctttggcacagccccagagtacgacaacggttaaacttgccgctatgtgaaagggctgtatttgtttagaagttactcaaaaggccgtgagagcaggcgacctggattatagcaagtagccccaggaaactcagagtattttctttcctgtctttttgccaggatgctagtttttctttggccaatagtaatttgcaataaggtcaggatttcttctagttggaatttcataggatgacaaccacactgttttcttacaagcaattctttatccttacaagactgggaggaaaaactttgaggggaaaaggatgt

SEQ ID NO: 47144 - DNA, 3940 bp, Bovine  19866880576809
tcttttttttttcttttagtgactctctggagtgttccaagcttcatttattaatttccctacaaaaccctaaaggtaagaatgtcagaatatttaaaacttgaattttaaagtatacctatattattttacccagttgacttcaattttcacttaatttgtagattatctacacatttcacatagtaagtctccttaacctacggtccttagatcgcaaggagcctatgagtagaatttaggaagttcaacaccttgaatggaaaaattaacatcttattttcaataataaacttcagacaaaaatttggcatttctttcaattacgaatgtcagcaaaaaaccatagtagtggtggcagtacctctgacgccagcaatagaaatcacagatattttcatatcagattataattactccagatatctggaagtatgtctgtcttctagtttataatatacatgctgagttatttaggggaaacctgcaatttgctttgtaatttacaccgacatgtgtaaaaacattaggatgttttgatgatgcaaggctggctggctggttagatagacatgtgataaaacaagtatattaaatgttaatgggagaatctagagagagtacataagtattctcagtagaatcatcactattattatttaatatgtaaaaataagtcatattaccatattaaagatttggtttttaatatattttgaaaagtatatcattatatgattagtttcccttgtaattctacaaatttcatattacacacttgaaagtactgttacaagaaataattcttagggatttaccagactacaaaagggtccaaggcacactcaaggatttcatctatttagccaacaggctatgagaaggtgttgtcatcacttagaccaccctaattatcagaaaaatgcaagtcaaaattacaagtagaactaccatatgatccagaaatcctactccggggcatatatccagataaaactataattcaaaatagatagatgcatcccagtactcattggagcactatacacaatggccaagacatggaagcaacctaaatgtccgctgacagatgaatggataaagacgacgtgctacacacacaatggagtattattcagccatttaaaagaatgaaataatgccactgcagcaacatggatggacctgaagattatcatcctaagtgaaagtcagacaaagacaaatatcatatgatatcacttctatgtgaaatctttaaaaaatgatacaactgaactttttcacaaaacagattcacagacttaaatgaactcatggttatcaaaggggaaagatggggggagggataaactgggaattgggattaacacatacatactctcatatttaaaatagataaccagtgaggccctactgtatagcacaggcaactctgctcagtatactgtaatcaccaaaacaggaaaagaatttgaaaaaaggatacatgtatatgcataattgaatctctttgctgtacacttgaatcttacccaacattactaatcaactatactccaatataaaataaaaattaaaagaaaatgagaatgaggtatcacctcacaccagtcagaatgaccatcattaaaaaatctataaataataaatactgaaaaggatgtggagaaaagaaaacactcttacattgttgatgggaatgtaattggtgcttccactacggaaaacaatatggaagttcctcaaaaaactagtagtaaagttgccacatgatccagcaatcccactcctgggtatatatccagacaaagctacagttcaaaagacacatgccctgctatgttcactatttacaatagccaagaaagggaaacaacttaacatccattgacagatgaatggaaaaagaagatgtggttcatgtatacagtggaatactgctgctgctaagtcgcttcagtcgtgtccgactctgtgtgaccccagagatgacagcccaccaggctcccccgtccctgggattctccaggcaagaacactggagtgggttgccatttccttctccaatgcgtgaaagtgaaaatcgaaagtgaagttgctcagtcgtgtccgattcttactgaccccatggactgcagcctaccaggctcctccgtccatgggattttccaggcaagagtattggagtggggtgccattgccttctccacagtggaatgctacccagccataaaaaaagaatgaaacaatgccatttgcagtgccattaatgaacccagagatttttatatcaagtaagtcagaaagagaaggacaaacaccacatgacattgctcacccgcagaatctaaaatatgacacaaacgcacatatctacgaaacagaaacacactcacagacacagagaacagacttggggagtgccaaggggaaggtgaagtgagggaggggtgaactgggagtttggggttagcagatgcaaactgttatatatagaatggataaacacagggagttatattcaatatgctgtggagtggagctccactcttttccattcataatggaaaagaatatgaaaaaattatatgtataactgagtcactttgctatatagcagaaattaacacaacgctgcaaatcaactacatttcaatgaaaaaagaatttcatctgtaaaagtatcaggaggaaactgataaacaacattactccacaaagctatttcaacaacattactccacaaaggaaaaaagaaaagcatgtctttaaactgtcttataacaaccatgtgctcaagtaaaattctgatatctgataaataattgatttataatctgtgctaggtaactactgatgttacatacaatattccaaaacttaatggcttaagtaacaattaattaatattctctctcaaggttctgtggggtcattgggctcagcggaggggtttccatttggggactccaatgcggttatggttggatggttgctgaggctgagtcatctgaaggcttgactggggtggacatcccagatggcttactcatatgcctagcagatgacactggccatctgttgggacctcagctggggccggtgaccacagcaaaacgtgtgacctctgcatgtggctacagtgtctcctggcatgccatgtaggttccaagagacagtgtcccatgacaaagcattccaagataccccagggggagatgcaaaggttctttcttgaccttaaaaatcacacagcattacttaaatcatagtttacttgtcaggactgagtcacaggaccagtccagattcagagggaaaggacagtacaagggtgtgagtactggccacgtggctcttgtggagggcagaggggcacctgtagacaccagctacaacacatcccaaaccaccacacacagctgggtgaggacctgggcatgtaaacctggatttgatgggatttctgctagtcatgcttatccgtgtctccaacatagctaattatctagctaattatttctcaaagagtcccaaatgaattcctttcctggtgaatttcttattttggccctgggtggtaaaaatggggccaaatatgtgatttagtactccctagttctccattatctctaaaattcaatcattctcatttaattccttcagtaagagagatctttcttgaaaacaagagattagtggggctttttttttaagtctttgtaccctttccatttcaaagatcaagcatactgccaagaacacagaagtgccctcaaaatgatcaagcaattttcatcatcagtaaattaagatgttcaaaggtctcgtggcctttggaagctttggaggaatacaatagaagtaattatcaatatgaactcacaacccatctcaattcccatgccaactctcctggattaatttctagggagag

SEQ ID NO: 47145 - DNA, 2663 bp, Bovine  19866880581010
aatagtgtcagaggtgatggtaataaatctatgcaagttcaatctgttatgactaagtcccagctaaaatattagcttcaattttctcaggagcacaggaaaatttgtaaactctgtatacgtttcataagtactggtgaagacattatagtttgcccccaaacaaaccaaaacaccaaaacacccaccacaagcttttattcagtagttaatactttgggacaataagtgctataacggtaagttaaatgctaggaatatgaccttgttcccaccatggagcctgacattctagtgaagaaggtccattaaaataattaccagaaaaataattacagggagaaaacagtgaacaggctgagatgagagaatgatggtgggaagataccactttaattgggaagataagataatcctaagagatgatatttaagttgaaatatcccaaaagataaacaaaaaacaagtcagccttgggaggtgctgggaaaagcaatataggagagggaatggcatatgctaaggccctgaggacaaggaatgaagcacgatcagggacgctaatgtgctattctgctggtgtgtttatttaagcttcctcctctttctctttctgtaggtaatacatgtggaatatgtcttctgggaatctcttcatttatgtggcacaacctcacagaaaaacttcttacacaagtttgattttctaaattagaactggcatttaagttgtcagcaaattccacattatggggaaaatcaagtcttctaaggtttaaagggaattctctcattttcttccttctaaattaagggctatctcataaaggctaatgtcaggatgtttttgagacttttctatattatgtgaattcaagcagtcaatttattaaggttagacaatgtacacaagtgataataacaattgctatttaaaaaaaaaaatcttttagcctcaccatggggcatgtgagatcttagttccccaatcagggattgaacccatgccccctgcatggcagtgcagaatcttaaccaatgggccatcaggggattcacataactgctaatcttgaatgaatgcctatactgtactaggcactgtgtggattcgccaatattacataatttaatcattaatttttctccatttttcactgatgaaaaaactttagcatagagaagttacctgagcgaggttacaaagctaaaaattgatggagataggggtcaaccctttagcaatctaaatttaagttccatacatgcaatcagttcagaaaattaaaagccagaacagatccttacatgcaactcatcttttctgttaatcaaaaatacatttttaaaaattctttaaaaagttgaagtatagttgatttacaatgttgtgttagtttcaagtgtgtagtaaagtgattcacttatatatattatgtatatatgtatgtgtatatatatatgggttctcaggtggtgctatggtaaagaatccacctgccaatgcaggagacaagagatgcgggttccatccctgggtcaggaagatcccctggagaagggaatggcaatccacttcagtattcctgcctgtaaaatcctatggacagaggagcctggtgggctacagtccatggggtcacaaagagtcagacatgactgagcacaaatatgtgggtatatatttgtgtgtgtgtgtgtgtgtgtgtgtgcatatatattctttttcagattcttctccgatacaggttattacaagatattgaatatagtttcctgtgttatagaaaacatgtttctgtctgccaggcacacacataaccatttctaaaggtcctaatttgtcatgacgactttcaagttattagctctatctttgctgaacctggaactctccccactccctttctccccttcccttctcccctcccttctgacacactctccccctccaaccactccacacacacaccttcacagattctccaattttatcttcccaaaggcacaatgaaggtgcaatgaaacagataatttctcattcatcagtgtaacacaattttgtgacaatgtgcctactaccctgaaattttcttcacttcagagtatctcaactggaaagcattctttttgttacttatctacaatggaaagtaggtaactagaataggaaaacaatggaagtcaagaaaccggctattgaaaacttccccttttccctgaaaatgaacataagtttggcaagctggtcttcagtagcctctttggcagctactcttgtctgaagctggctggaattcaagtgtctcctgagtaatctttcagttcaataggaaccattgtagtggcactgaaactaaaattactaaaaagtagaaatggtaggtccaaggctcagtgatgtgacttacatatttttcagagtacattacattacattaaaacacttacactcaattattcttcgaaccaagggtatgatggttatttatgttttgtagaagagcttctgtccaatatttgtaaaatttgacactttcacaaagaaccattttgagaaagctaatgtggctcagaccatgaactccttattgccaaattcagacttaaattgaagaaagtgggaaaaccactagaccattcaagtatgacctaaatcaaat

SEQ ID NO: 47146 - DNA, 1517 bp, Bovine  19866880582687
tggttctcgatttctgggtccagagcccaggggagccttgaggttattccaagaagcctgtgacttttttcttctttaaaaagattatatttattttggaaaaggttgagaggcactgatttcatgtgtatgttatataatcatggctgtacacgtgctatttcatagcaatgagaagaagtgatatttcaaggtaaaaaaaaaatcatgcagctagaaattgcagttactctccttacttccttaacatgcagaaaatcttttgcttcaaatgagatggccatgcctggcacgggaacatcgtcttcgtgggctgcactgtagctgacatttgtccgaactgcaaatgcaacgggctttgtctaaaatggaaaaaggggggaaaaataaaaaaagaaacaagtgttccttctctttccccctcaaaatacaaacatacacggaataacggctgtcacagttgttgtttttcctcgatttggttctttatcacaaaacaccatcttagtatttccaacaggggaaacctttgggcgctcagccacatacacccatttctgaactagaaaaaggccattgtgctttatgaaagcactccaagcaatgaaagtaaagatgaactactgaaatatgtttacacaacataaaaacttgtaacaaatggaaatcaggaaacatacacggggttgaaatgccaagttcttgtgtttcagtgaaaaagacttggccactgccatatccacccccaaatctactttaattaataatagaagatggaacttccctagtgccccagtggttaagaatccatcttccaatgtaggggactctggtttgatccctggttggggaactaagatcctacatgccatagggcaactaagccctcatgccacaactaagacccaatgcagccaaaaattaaaaaaaaaatttttttttaatgacataattccaaaacatactatgttttgcatgaagaaagaaccaaggaatatatcttataactattaaaaactacattcatggctgctgggtatcatgaaagcaatgactttctattctaatatttgtcctccttgagttttcttagtcactaaagatgataacatttaataagttatttttcattatttgatgctttgcaaatttacagatacattttgtcctctatcaagcaatacttgcttaatcacaaggttaaaaaaaaaaaaggtaaactcagaaatagtaaaaggaggtattgctctaactagcactgggtttctttcacaatgtgggcaagtggatttcttctgagctgtttcttcttattcaaagagctcttcatcagaactgctcatgaaggatgatggggaactggaatagaaagaacccatcttcacttctgaattttccatagttaatctgttctagctgactactgtctgggtgaggactgagttcagaagagccatggttacgtagattcatccacaatatgcagaaaggaggtccaggtcctagacaaaggcaca

SEQ ID NO: 47147 - DNA, 907 bp, Bovine  19866880662993
ccaatgcaggaaagtgaaaagtgaaagtgaagtcgttcagttgtgtccgactcttagcgaccccatggactgcagcctgccaggctcccccgtccatgggattttccaggcaagaatactggagtggggtgccattgcctacactttcaaaatatttttaattatataagttacatgtatccattgtagaatgaagagagagacaaataatctctgcctgaaatttgcccacccaaaaagcctcactattaaatggtagcatagtttagcctccagagttcttgcattttcaaaagtcaccctcccaacgtgtgccttacaattaatctccttcctttaggaagtgttgatttatgcagttagaagtggtgtatctaattaagcttttgcctttgggaccataaggactttctgggtcattctgccttctgtcaggaagagctggcggtcattttcgtaaatccaaatgaggttcatcacaagctgtacccctgatctcttgggttccttcagtacgattagttgaacttttgtaatatttgccctggcaggtacatctcagatttccttttctttatcttaatattctcactcctcatcatacagttccaaaatgcaacctgctcctaatatctaacaatagctcatctgggatcacttacttatctcctcaggacctttactccaaatgtgcattctttacttacaggaaatgttagttaattggattaattgatgcttctatttattcttcaatttctgttgttttccaatttatgtcaaatagttgcacacaaagcattgcctttttcctttaacacattttcctggatttataaagttggcttttttcatgctgcactctactgtttcaatcatatgtctatttccatgtctatcttcacat

SEQ ID NO: 47148 - DNA, 1361 bp, Bovine  19866880709522
attctgaaaggaatttccatctcagatttctttgaaatggaacttatcactccataaccaaatggcatgttagagatgggaaaagaaatttaaaaaaaaaaaaaggacactgcttttctctgaataaaatgaatggcatctcaagttcccctttgcttctttttaagaaaaagcttatcacacagtctgaacccgatgtgctcactggtttccataatgtgttttgcaatgtggttagagagcacataagaggaacactgagtccgcagccatgccaagaaggggagggaggcatttccttttatactctccctttgctgtttagaagaaggaagtttcagaaaagtatgtcagctctaggattttttccccccttctcaagaaacaagtagccatttaccagactgggggtgagagaagggtagagtttctgatttataacttctaatgaagcaccagctgtcaggattaggtcagtgcagacccggccagaaattagactgccgtggtccctgtgccaaacaacatggggcatcaggtgctgtcaggtctgagctgactccctttgagtaggacagctttacgtgagcatagcaatttggtatttaattgttattttttttctctaggaaggaaataaaatgtatgaacattttaaatatataaagtgcagtttttgagaattgcaaggtattttcaaaataaacattttcagggtctggtaagagaaagagaacataaagaattcagcgggcaatactttattttttttaacctgactttattttattatctttttggccacagggcatgcggaatcttagttccagaccagggatggaacctatgccccctgtgtggaagcaaatccagcatgcattactttataataacaacaaaaatttaaggccccagctagaaattaaagggatagatcatggatttttggtatctaaatttccttgcataggattgaagagagtgacaggttgtggagctgatggccagagagccttttaagtcgtgtatactttagtagtgggacaccagtttgctcagactctgttgttgagagtggagtgggtgttgtaaaggctgcttcctatgaactcacaaactcttcttggaatcactcattggcatgtctgcccgtgctcagtcactcctgtcgctgctggtgcttgggaggctttagaaaaccttgagtccccgccaccttcgcggggtcctagaggctgggtgagctcacaccgctcatgcgcatgctctgtggtggccacggtcgctggaaggtacccaggctgcactgccaggaattccaaatgccttccaaagcttctcattcttgcttcaagggctgt

SEQ ID NO: 47149 - DNA, 1520 bp, Bovine  19866880713006
ttttttccttcttgagtaaatttattgtaaattagtctttccatttcctcagttcttaagattaatttcctttgtaaagtttttaataaagttcagttaaagtatactcaataaaactagtcgtagcatattcatttaaccacaaacctattttagtcaagtgatgattaaattataaatcactcaggcaaattataattactttctattgtgcatatttctcaaaaacagtaacacatatgtttttcaaaatcttgaatatattcctttctaagaggcgtgtgtgtctttaattaccaaaagagactagaagttgttcaatgaacaatactactaaactaaaatctaactgtcatgatgtccacttatttcataagattaaattcagtacaataaataacctgattatcactctagattttaatactgttctctatgctctacactacttaagtgaacagacagatcaattgcatggctataaaatagtacatactttaaaaacacatacaaaatgtcttactatctcacactatgcaaatatcaagtttttcatctatataaacttaaacctatggtgttcattttggtgagagacaatagaacaatgtagcaatgctgatttttttcagttaacgtaagtacatgaaatgcggcacttgtaagaagtcacctttctcggccccctggtatttctctaaggcagtgtttctcaaacggatagtggaacctctaaactgcctatatcaagctgcccaggtccttgcaaaaaatgcagatttctcagttaccaagccactgatgcagagtctctaaggcagggggtctgggatcctaggatcactcttatagaagctgtggtcaaaatccttttttctacagtcttaatcctaaaagtaaaatccacaaaatgttaagtggatttaaagaacaattttaattttcaagttgtacaaatgacattttaaaatataggggaaaggcaataccctaaatcaagaaataaaatgtattaaaaaaaatttttttaatgttttagtctcactgcatggcatgtgggatcttagttccccaatgagggactgaacccgtgcccctggcagtggaagcttggagtcttaaccactgtacttccaagaagaccctaaaatgtactttcagagcacgctcaaccttgcattatgtatcatcttggtaaagcagaatatcatggtgagagtatacagtaaagtagaacagaaaccgtagttaagaacttgaagcaaaatcaaagtatattaattaatcacagagttttgcagtctaggagcttaaacatcaacataaaggttgaattcataaaacgcctggaaattccaggtgtaaaaatcatttagcactttttaatcccttaaaaagacatcaatcttcatgtatcagagcaaggcatattaatcaggttaaaaatcccaatgccacatttcaaagccaaactccagtgaattagaccaaaaagacctatgtgttactctgcaaccaaa

SEQ ID NO: 47150 - DNA, 1520 bp, Bovine  19866880716202
caggccagtgagcccccagctgtccctgcccgctcccgcccttctcagaactgcccaagctgaaaaggagcgtggaggaagcgcccacttttaaagggcttctgaaattagggaaaccctcccaataaggagatatcctgtcacatgagggtggttggaaaaacaggaattcaaagttacaactttgctttgtaagctaacttctgagaagagcagacacagaggaaggggagagagggacacgtgtgggagagagatgaggaagagggtggaggcgactgggcgcctgtgagaacccaggagccagggccggcctgctgggaaaggggggaagtgaaacagcgctggacctcccggctctgcttggatgcgggggagggcaagctggaggccactacctgggctggaaaagtgagattctctctgggcagcagctgaatccagggaccttcagcagacaagccctggaatgtagtggagatggcaggcaataaagaggacagttttctggacttcttagcagtccagtggttaagactctggcctttcaacacagagcgggcataggttcaatcctttgtcagaaaattaagattcccacatgccacatgcggcccctcctccaaaaatgaaaattttaaaaatcctgaattataccaatatggcattacatctaaaataataaactattttttaaaggatagttttctggtggaaatgtcttcttaagcgctgaaatggatcccatcctactctccatattcaacgtttagagtttccttttttctttgaaagcttcgaaagtggcttcatatggatctttgttcctttcagctagaagaaatgtaaaatagagactaagcttaagaaagaagctcagttgtaaaaggaagaagaaagttcctagaagtctttttctagaaagttctcaagagatccagagaaaacagtgacaggacttgcagtaaagccccactgcccatccttaacaatagtgatcctcttcaggtttacaggggtcgtcttgccaggaggaagtctgctcatttggtcatttcatgataggtgggataatttctttttaaagaaatgaaaacatctttcatgaaccatcatattaaccctacagatctattgtgttatttttcagaagtaaagcatgaattaagaacattttgaagcagatatcgataattagatagccagctcacaactggagtgtgggaaatgttagccaaacaaaaggaagctgctggagtatttcttgaaattttattttagttttttaatttaaatttactgattttaattggaggataattgctttacattattctgttggtttctgccatacatcaatataaatcaaccataggtatccatatgtccccaccatcttgaacctcccttacacctgccaccccatcccacccctctaggttgtcacaaagcactgtattttgagctccctgcctcatacagtaaatttcactaattttacatatgggaatgtatatgtt

SEQ ID NO: 47151 - DNA, 792 bp, Bovine  19866880735234
agaagggaatggcaacccactccagcgttcttgcctagagaatcccagagacaggggagcctggtgtgctgccatctatggggttgcacagagtcggacacgactgaagcgacttagcagcagcagcagacattagaaatgagtgacagtaaatatcagcaatgccatctattgaaacaggcaaggatgaaggactgagcaggtttggggaagaaaccaaacactgttattatctctatttcccatactaacaataaggaaaccacagcacagtatatttcagcaactaagcaaagttacatggctggtcagcagctaacctgggaattgagtttagacagtgcagcttcagagtctgaattcttaacactaagctaagtcgcctcgtaagactccaaaggggaaaaaaaatatatcaaaaaataagttctaagaccgaacatttggaagtcacaaaaaaaagagagagagagaaagagagggaagccaaaaagacttaaaaagaactaagcagaaagttagaaaaagtttggtgtcctagaaaccaagagaatgaagtacatcaaaaacaggaatgctaagagatcaacaaagaaatggactaggaattgaccaatggatttggcaaaatgggattcaccagggactttgaaataaaagcttgatggaatgagttatctttataattcaagagttcaactgagcaagaaataaaacatctgaaatgagattcatgtgttcaataaatgtttactgaatgtttattagtgccagacagtggtctacatgttg

SEQ ID NO: 47152 - DNA, 1234 bp, Bovine  19866880739283
ttttttgggctccaaaatcactgcagatgctgactgtagccatgaaattaaaagacgcttactccttggaaggagggttacaaccaaacctagatagcatattcaaaagcagagacatctctttgccaacaaaggtccatctagtcaaggctatggtttttcctgtggtcatgtatggatgtgagagttggactgtgaagaaagctgagtgctgaagaattgatgcttctgaactgaactgagtgtgtatatgttaatcccaaattcctaatttatccctcttcctccttcccttttgaagaaataatgagaatgattgaaatgtcaagtcaacatttaggcccagatgttttaggaggagtggtcattttgttaaagttaaggttcctgtttgctaagtctttgggaatctctccacacacacagacacacacatcagtacataaacagagtcattgccaggagactaggagctacagtcttcttgattttaaattcagaaccatctgcccttgctctgccctcaacgctgtgttttccagtagaaaacaaacacattttgtgcttttccaggagaaacctagagtgaggagcaagttcttgctgttctacttgcaacagacactttccgagcattgagactgggttgagttctgaattcagcacattagagatgaggacaccttttatgtcttcatcagtcattccttgtatgccaaggaaaactgcaagatgattcatgaccacatcgtgtctactcaccttattatttaagagtaattattgggagtgtcctcatatttggtttcatacgcatagggtgaggaaagagaaagcctcactgattgtgaggggaattgacaatgacctgccacccgatacccaccagaggacactgctcgttttcgtctctgatccctgggaagtttacagttttccagaggagctaaaatatgcacactgtgttcagtagaagagagtgggagtgtcttaaagagggaaataaagaaagtgctttaggagttgagtattggaagactgtgttcttttcggggaggaagattatgttcttactagggaatcacaaaaggattgcagaagaaattagatgtgatccaccgacagtgggaaaggaagggcattctaggaatagtgaccagggagatgcagacatggcagagggagaagcttgatttctgtagagtactgaggaatcttttacctggcattcagg

SEQ ID NO: 47153 - DNA, 1023 bp, Bovine  19866880804595
cttctgtgcactgatctgaacattttgattttctgtttagaaatttaacaatgactggtggatagggcgattggttaaagaaggctgtgaaatcggattcattccaagtccagtcaagctagaaaacatgaggctacagcatgaacagagagccaagcaagggaaattctactccaggtaggagacaaatatcaagtgtttgtgtcagagttcagactgtattatcattcatgaaccattggttgctgtaatctccaatctttattttgtgttagaaaacttacattgtattcgtttctataatgatgcaaaatccattgtcaatgaccatattttagtatcaccaagaatctcttttgagcgcccacaaataagtcaaatagaagatgctttgtggtttggaacatccatctccgttcactagtattttataactctcgggctcttttagttcagactggtgatacggtttactgacagcattacaaatcctgtattttaaaaacatcacccagcctttcattttcatcctcttcaagagagaatcaaattaagtgttaccatgaaggaaagaaaagagctaaggtcatagagtattaaattcaggctttagtgcagaggaaattctgaagccctaatcttgctgaaaatactctggcatcaagcaatcgtggtgactaatcccagtatccggagctgcctggcatggtaggaagatgttttagaaatgacagtctcagagaccagcaaagagcagctcttgtggtctctgagtttcactttcacttaagaaactcaattttcagttctacccactgcttaacacttaaagagaaactcggtaagaaagcagttaaaattgtccttgcagatagcaattagaagagttatgtaataagctggggccaaacgatcttttttcctaggagtcttaaggctgtttgcccctcaccagaatctttagaagggctcctcgaataggagtaaatgtgaaaatgacccccttgcagacaagtacaggaa

SEQ ID NO: 47154 - DNA, 2533 bp, Bovine  19866880823639
atattaagtaaatcaaaatcctaaaaactgatgtttttcagatgtcatgaaaaacaataaatcacaaattgatggttctgtaacattctttcccaaataacctgtccgaaatcctaatcgtcaagaaatgtctactatagatttttctagattcaatctcagcagcaccacctactgataatttgaattcagtactttatataaactcagcaataggaaaattaaccaactaattggaaatcacctagaacatgcttggcttttcataaaatatgtatgataatttaactgacagaggaaagtgttttaatatttttgcaagtggtgaatcaaactgcattcaatgacaagggttgcttcaatcatgcaacagattgaatacttatgttccctgaaaaatttgttggaattctaagccccagggtgatggtgtttggaggtagggcctttgagaagtgattgggagagagacccattgtgaatgggattagtatcttctaagagagacgccaaggagctgtctccctcctttcttttgccatgagaggttatcatgagaagacagctatgaaccaaaaagcaggccctcacaaactgaatctcctagcatcttgaccttggactttacagcttccagagccgagaaataaatttgttacttatgtaatttccatctcccctctgctacagtatttttttttttttggctttgccatgcagcatgtggaatcttagttccctgaacagggattgaatccatgaacccttcagtggaagcatggagtcctaaccactggatcaccaggaaagtcccctggctatggtattattacagcagcctgaagggacaaacacacacccagatatgtttctactatgttggctattctccatccatctcctcacctgtgctcccaccattctgtattccagttgggtttggccagtgagatgactagcaagaaatcagagggcagtgggagacactagggtgtttattcctctcgtccttctctcctgaccactgtgccattcatagctctgtccatctgtccctcctcctctagtccagctctcaccttgtgttgctgtgtaacacttacccctcttgactcagaggtcctgacagtaaaggatgcctccatacccttgctggctccttcagtcttcagttaaggagttcttttgcaaaagcctgtttagttgacctcttgtgtgtaatctgactttctggcaggcccctgacagggacacggagctctctggagactcatcgtgcttactgtaaaactgaagtgatcacttactcaacacttaggtacctgagtacagtggaaaagatattgctctaggtacaatacacataaaaatatgaaaaagattccactattaggaatctcccattaatgagaagttcatattaatagacatacaaggggtttgggttgactgaaaacttcaatgattccacataactattctaatttctatacatagtatcactaatcttaggtatcaaataagtcagccttttagctatcacgtttagctatcacgtttccacagtgccctaaaagagtttcacccagtttatcaccatcagactggaaccttgtggtttatttaaataatcttaaataagccagctggaaacctggaaccaactacttaacctgaaaatgtgtatttttacattctaatgaggtagtctcaccaacaaatgtttactgtagagttcttctgtgggacataaacacacacacacacacacacacacacacacacacacacacacacacactacaaaattctgcctttatgtgaagattctggagagaaggggctgcctcattctcccctgtagcttctggagttcctatacgttagaaaacgaatcatcattttaatgacaagctgatgaataagagcacaaactttacttagctttgagccccagccttgcccccatctggctggacaaccttgagtaaattaccaaactctgtgccttggtttcctttcttcatcagcccactttaaatgagagatttgaaaagcacttaagagtggtacccattctacagtaagaacaatgcaagtgcttgtttaataaataaaattaaagtgatgccattttttcacatcactgcaggaacagcagcttgaacagaacttaagacataattctctcattttatagatgataaagctgaggaccaggaaaagttaatgcaataagccagggtggaaaatgtgactgacggagatatcacccctaggaggctcactcaccaacacagcatgctttagaaagaaatgcagcaattttgtccaagaaacaaaactctgatgtcaaaatgaacctataaatgacctgcatttacatctcctgatttataaaagtatttaaataagtatctactaagtgctatgaaatataaaaatttagaatgcagtaaacctgaaaaacctggtacagactcaaaagtcagccaactgaaggtcaaatcgatagttatttttaaaaaatcag

SEQ ID NO: 47155 - DNA, 1698 bp, Bovine  19866880995722
ctttaccttgtttaatacgttgcttacttcactagcaaaatctctcgaacatacttctaagtgaaaaattttgccacagtttgatacacatgctcctagaagctaaaaggataaaatcggaagttaaaagggcttgattttggcagacaattttgctgtagatcttaaaacgaaatcactcacagtgagagcctgcatagccacatgaggatctttatggtttaccctcctcataatagaccgaagacaatctttaggtctaaaaaacgaaaaagtgtaacaattagttgtatattccgcttccccctcccaccttaactataagaggcaataagttgtgatataaaatgggagaacctggtagagaattttaatttttattaatgacacaattgaaaaactgtacactaaaaagttccttcaaatttttcaacaaaattaacaggctctatccttagcaatcatagactaggcatttggggctaattctggttggaaggttttgaaaataaaatgacagatcaagagttttacttctagtcatgatagaataagtggaactcctgttgtaaataatcagaaaactggaaaaatatatttaaaatacacttgagacgtcaggccacaggtagcacggaatgatgatctgtaagaaagaatacaaaatagataaaccagacatttgcttcaactttctacacagcggcactgcagatactgcaacaggctttctgtctataggcagtttctggatctcagtgcagagaaggtgatcccaggaagacagcggtgatctcactgagttgaggggacattaggattttagcaggctaatttttgcacttttgaaaagcatgttgacaaacacaaaattatcacttcaaagcatggcaggggccaaatataaaaaggattatctgaatactaaaattgaaatcattaaaaaataatgatccaaaagtgatttagcactatgagtaaaactttttagaaaataattcccaatacttgctttgccaccaaggtttaaatgaaatttctcatgtattgttcataaatcacattaaaaaaaaaaaagaatctaaactgcagggacttgtggaaggaagatggagaaaggcactttgaaatggatcttgtactttgtatttcactcatttctatactgctgaaacattttgccacagccaattttaaaaaccaaagcaaagacatgtctgacaccaaagtaaagtttgctacggcaaccataaaaaggataatgcaaaacaggaaagtggactagaatgcttgaatcctgataaacacttcatatatgctaacaaagcaatatctttttagatacattaagctaaaaaaaaatccattcagagttgtacataaaattggtgctattaaacaacggaagtgacccacaaaactctagtattaactacctcattctgttccgtgtttttttaagtcatcttttcagtatttccacaagattataagtaaaatacagaagtgaaactgaagtatttgtatacacataccattattaaatcttactatgcaacaaaaaattatggctaaaatattgttttcaaaaaggcataagagttataagcgattttatatgtatacttatagctgattcacgcttttgaatacagcagaaacacaacactgtaaaacaattatcctcgcattaaaaaa

SEQ ID NO: 47156 - DNA, 3539 bp, Bovine  19866881038579
taatgttttccccacatttcatatgcaaatttggaagtttttgctgatattcttcaaaaggaggtttctctgaaagtctctctgctatagagaattctccagaatccaaaaagagtcacttctggctccaagaaatatgaaggagcttaattgaattctatcttgaggtacaggaattttcttccttcttctctgcttttgatggtttaaataaattatgaatggaaagtattcatctttcaattatgtgttggaaaaagaaggctagtaaatcatggcaggaaatatattaggattttctcaacaaggaggcagtgattctactctgacttacccatttcatggggaatttcatgacacaagatagcaatggtcgtggtcactcccgcctcggatgaagatgagaaggctgctcctattactaggccatctgcaaaattatgcaggctgtccccaaccagaatcattattgctagcaagctaatggttttgcctaaagaacaaaataaaggtgtgagaagtattaacagagcacaacacagttcatgaaatccttcgattacaaccaattttcccttccatccttgacattcttaaatcgcatcagattaagtaactctactttgtttcagctttcaaaataagtcaggactagagatgcaatatggcactcttgcaggtatggtcgctgcttttctaatgcattcaagtaattaggaaataaactatatttgctcttctatctccctactcaggtgtgccaaaagaagaaaataaaagtaatactgcgataacttttcaaaatacgttcaatgacctttccacataaatcttttgtaaagcatttttaaataatttaagaccttctgggcagaatgtcgttaaaatggagtctattttccaaaactggcccctgaatcagactgttcctcgtgtcaatctgctggagtcaactgttaacctcatgcccctctgtgatcatccccctttctggttggtgctaagaaccccccactgccccttcactccctaaatgtgactgtgatagaaccgctgccaacacttgtgattccaaagttagctttggaatgttttgtctttcagaaaaataattcagcactagatcactccagtactcttgcctggaaaatctcatggacagaggagcctggtaggctgcagtccatagggtcgctaagagtcagacctgactgagcaacttcactttcacttttcactttcatgcattggagaaggaaatggcaacccactccagtgttcttgcctggagaatctcagggacgggggagcctggtgggctgccgtctatggggtcgcacagagtcggacacgactgaagcgacttagcagcagtagaccaactagatgcccaataaagtagagagaagctgtcttcttgggattctattatatcgtatacattatctgattaaggagacagccaaagaaataaaccggaccatatggatttaattaatgaaataattagatcattaattcggctcaagtttttaacagacagaatttctgctttcagaaacctgaaattgtatattactatttggggtggaagcattaacaagtacaaaaagtacttcagggataaacacatatcatgacagtgaactacctaggtatactacttgataagaagagtcattaaaatcaattgctgtagtctaaaaattaattagtcagttgatataaattgtgtgacaggtttgaggggttgctattgttactattagaaccgcacacaatattctaacaattggacacccataaaaatagggagaaatcatctcatttctgttattggatctgaggtggtggagggactatattataatatgatttgttattttattgggggaatatgatgtaacatttcatagcccacactgtgaaaaaaagaacttcagtaaacagcatactagcccagacaactggccaggaggtaagtgcactgactgtgttgtaaagacatcccaagtatttcacttttcaaaatcattctttatttagaatcatctctgtgagactcagttctatcgttcttgtggtttcataatccattttcttccttagtaaaaacgagaagattttaggcaaaggtcagaaaaatacagaataaatatcaaattactgaattagagagagttgttattggcattgcctggaagctctctgaacctaataatgcaaacaggtcacttgagctgttcctgccaatattcagaagtaaagcttttctttgtggaaaaaaaaagaaaagcaatcgaaagtagtgcatttgacaatgttgtagcatacaaataaattgtgattcccaatttctgtgcatatgcctacatacagttttgatattaatagcatatattcagatggaaaaatctttacccaatttatactctgccaagaaacagtccaacctatttttgtagcctattattttattatcactgatgtggggttataaatgtcagatcatgaccatgtaacaagctacaggcaaatatacatatttgcatataagctataaggaacacaatgtacatactggttaagacaattgcaacattattcaatggaagataagacaagcatgcattgacaagtcaatgtactcactatagaactattgataatattcaatattttccctttcctaggaatctggcagtcatactgagttccacatttctgacttatcagaggttttccatggtgatacatggattggatatggtatcatgttgctttttgtttatttaaatcagactgtggatagaccttcacatcctgagctctaccaatgaggtaataaaaaacaaggaatcaaatatttgaagttaattcaatatgtccctggcaaaaatggcggttgggtaatcaaatttggatttgttcactgttcattctgtatgccaagcttcatatctgaagtggaaagatatgaggcctacaaaacatttgaataagaccgtcattattccctgagctagcaaccagtctctgctcctaatctgactaggtgtggcctttcctcttccttttttccaaaaacaaatacaaagaaatgtctctaatataacttctaaagtgccaggcattctaaaatttctcctggagctaaagattcgggagttaaaaatatcactagaagtgtcctgaaaatagaattggaaggactatgtagttatatattttgaatcacagaaagaacctacaggatttaaaacatcaaacacattccaaatagtgattgttaccatcatgttcattgctcttagcatttaaatcctcaaacacattgcaaactagggataaagaccatttctaattttatttcctggtgcatagacagtgcctaaaacatccatttcttggatggatggatgaacgaatgaatgaatttgaaaaaaatataggaatgcatgccgaaagaagatcacaaggaaattgttggtgcattagcattccttagttcctcaatgctgagtccggtcagtacttac

SEQ ID NO: 47157 - DNA, 1332 bp, Bovine  19866881052456
agacacagctttgatctctgggtcaggaagatcccttggagaaggaaatggcaaccaactccagtattctggcgtgggaaatcccatggacagaggagcgcggtaggctacagtccatatagtcacaaaagagtcagacacgactgagggactaaacaattcctgctataggaacccctctgagaaaattaggattaccctagcatgtgtgttggtgtagaaaaactcctatcacccctgtgaattttacaagaaccaaaaaattgcaatgcattttctgtgtcccatgcattttatattcacttgataaaaatataagtaatctattaatttatgttatgataccacagtgagggtgcatttgatctacagtgtttattctagagcctctcctgtattttctatttaagtcatgaagattggtcttaacctagaaatgaaaggaatagggatggggagaagtgagagggtggtggggtggaaggagggaggggaaaagtaaggaagattttcttaagaatgctttatttcatttgcacgagactttacaaaataattgcccccccagacaaaacatagtttagaatgcagtgatagaattttatgtttactttaggaagcctggaagtgtgtatttcttcataaactttcaaaaaagtattcccattaatactggaaatgaataagtatgattctttcccaagcctcagtcactttatttataagaagagtttggactaaatggttctataaatattaactccagctaataaatcaaccaagattttacatttgttcctaattgctgtgatagcaatttcacatggttatttatcccagtgactttatttggaagggtagttgctcagttggagaagcggttcaaagccactttgagctccgttattgcttagcgctgtggttactttcaagtcctatttcagtgagcaaatctctctcttgcattttgtttaggaaatggagctatcaagagcggctttatattgaatggatgagcatgatttgatttcgattgcccaacaatatcatatatcatatgtattatctatgaattgtcctatggcataggatatactttccgcagcagattaatggaaggatattgttaagaggaaaagaaaaagggagagagcacaggtttcatctttgagacgtttcatctgaaataggagcatgtcaaacatcccaggtgcctggtactatagagtcaaaaagccctttccagctgtttacacttcagatgcaaaatggcaatttgacagactaaccgggtgatgtgagcgtctgcgtaaaaaggctacagacggagca

SEQ ID NO: 47158 - DNA, 1028 bp, Bovine  19866881188032
atcctattaaaagcaattaatcttgctgttgggaaaaatcattcctgcagatgtcatctttaaaaatcttgctggcacttactactacatttattccttacatgtcaactgttgagtccaaatgacaaatgaccctgaatagataaccggcacaaaaaacctttaagagacttcgtaagcttttactattgaataaaattgaatattctctttaagatctgataggaatacaactatccctttcacagccctggtctctaataactttattaggttgatcatatcagattttgaccttgtttgtcctggccgtgtcacatatctctctcatagtggccaattttccaaggtcacagatttctttacactctgcccttaagtattgatgagctctttgtcgatttcctatttgttttgcagccaggaatctcagatcagtgttagcaccgcagtttgtccagcctgcataaacctcttgttgcctttcacatcactccccgaaaatcaagtagccacatgcaatgcaaaaggaggctggaaataaagccagcacttcctctgagcttgtcggctagcatactgcactgcatctttcaattagcatccaattattttaagtagtgatacttcagtgtttgtgtaagcctgccttgtagaatttaatactcagacagccattttgcaaaacacagcaggtccatgaaataagggctatttcagtgaaagagtcacagaatgataaagctgctgtaaatgctggcgtaactgcaacagctgtgtcatgcatcaaataattatcatctactctttttctaaagctgttcaaaacaggatttaaaaggagcttctgtggctatctttaatttgacaaactccgtggtatctctccctaaaaagattttttttcatgccatcattcaaagatgaaaacagcactactctacgtaaaagagaatatcaactggtttgaactgatacagacctctgagaaaatacacttcccaagcaatcccagtgcaagctatttc

SEQ ID NO: 47159 - DNA, 872 bp, Bovine  19866881425815
tatgcttgactcttgtcttcccgacttacaatctgtctctggaaaatttaatcataaatgttaaattttataatctagataaattcaaattaacaattcaataaacttagtgacaaatattaattatgcctaaaatataaaaattgcatagtaacttaaagaatttctatcactgagagaacatttgattttttcctttaacaaggaatcagcttatgcatagcttttaaaatattgtttttctatataaaacctggatttagagcagtcttctttaaacttgtgaacaatatttcacttattggaatttgtgtgtatggaggtatttctattttaaggccgatattttctctcacaggaaaggtctctaaatgaactatctcatcctttggagtttattttctctgttaatctagctgattctgctagaatgatgagcagaaaaatcaagaagatgtttgattggagtggttagatagtggcctaaaccttttgaagtaattcatatatccactttaggactataatctaagagatacagagtaaatgtagaaaatatagaaaactaacatattgtaaagttttcaaaaattggctctatcagaaacaattgaaaagtgggtaaaggacttgggaatgcttatcctgaagaggaggagggtgaggaaggatataataatgatggacaccccatggtacttgctgattaaatgatgatcattttcttcttccactgatgagattgctgaatagctggacctgttcatttccagagagcaaaacaagaggaaatggatgatggtgatgctgggaatgcttcctgacacttactgtatgaaaattgataggagtgggggtaggggagaagaaaa

SEQ ID NO: 47160 - DNA, 966 bp, Bovine  19866881913091
tcctctatatcaagtttctttcattcttttccatttgaatggcatagttgacacaacccaaattaatcctgtcttctttaagaagctgtatgcctaacccatatacctaaacctttcaatccgactttttcagtgctataaaataattatattttctagggttttctcaacaaaatcatctgctaaactctgttacccaaatattctctcacaaattgattttcagccaagagaattatgttgcttggggccattgtaatgtcttgcttttcgctaaatgaaatctcgtcaaaagtagataattatttctcttggtttgataagctgtgaagtgtaaaataaattctgaatctgtattacttttagctgtttgcaaaaggaaaacatgagaagaaaacctggtttgaatctcgagatttttgtagagctctgggtggagatctagctagtatcaatagtaaggaggaacagcaagcaatatggagattagtaacgtaagtatcttttctagttaatactccttcctttgaccctttgagtacacatttgttgtatgttattcagttgtcaagttgtgtccgactctgcaaaccatagactgcagcatgccagagctccctgcccctcatcatctcctagactgtgcccaggtcacgtccattgaactggtgatactatatcccaaatctgtgggtacttttggacctagtttcacttccaaattctggcctggagaattccatggacagagtagcctgacaagctacagtccgtggggttgcaaaaagtcagacacgactgagtgactttcacttcatttccaaatgctttaattttatagctataaatcctgagatgaattgctctataaaagcataagacacttattattcgtttattaaatgaatgaatatctcaatgctttacaattatttcaaacagcagcttgttttcaggatatttaca

SEQ ID NO: 47161 - DNA, 746 bp, Bovine  19866880554239
cttctgatgtaattgctccttcttcctaaatttcacattgaaagtgaaagtgttagttgctcagtcattaaggataatgaaattagcctttacccaacttttcacagccataaaactggatttgcagctaccactgaagagttggtgaatgctataagagccatggataaaaacaggcattaaaaaaaaatctatgtaataataagaaatccagggttcaatgttctcagaccttagagttgcataagactcacctgggtaacttgtgaaaaatgctgattcctgattccactccagctctcctgatttggatctggggtagggccagctctatctccaggattctatgaagtgtagggcttaggggaggccatctggttggaagaggaagctgggagctttgccacgaggctatgtttgcaaagcaagcactctctttttaacttagtgtgtatgttacagagcactatcgatattaaagtttcctaaataaacttctagtcacactttacataagaacgattaaattggacatattaaaaatatattttatttatgaatggaggaagctgatggaaatcaaagcagctacagccctaggtactaacaatgaatggagcccaggcatttgagtggagcccagatgtctgcccttctagtcatcaccatgggaagagtcttgtttactaattcactcattcaacaaaatatttactgaatgtgccaggtattgttctaggtaaatt

SEQ ID NO: 47162 - DNA, 1460 bp, Bovine  19866880661518
actttttcccccctgttgagtaatactcttctaatatccttttcaacagaaaaattaaactcaacaggtttatttaattttattctattgctgtgaaccattttaggattattaaattatatatatttctcttttcctctcctgaattgtaaatcttttcccccccccaccccgctaaagaaatcctcacagaatccctatgtataaaatgtgtaacacaatttcctgctttagtagaatcaaggaaaagagtgtatgtttccattttctcagtatccccttctcacatttgggatgatctacctgacttgtggaacacaacttaaagaccatccttcttgatcaagggctcaaagtcacacccgtattactatatacacccaactccataggaaagcaggtgatatggatactctgcactatggctgccgccactgatttctcagctattaatcaatggttatataaatacccagcattatctgaacttccctaagttgctgtagtatggccttttggtggcctgctgtagtggctctttttattcttctgtctgtgcgctccaagatggcctattactaaataatttcattacttctaatacattagaaaaatatatgagttatttgcatcaaatattcatcctacagccttttcactaaatggcagacaattatttccctcacattcagatgcagaaactgtgttgtgaaatatgagggaatggtaataaatttcatgagggttattgattcttccaaattcaatctgggatatgaagacattaatccagaggccctaatatttctgtgaagtttcctcccagaggcagtcatatatctgattgtattagtaaaatgaaaccatttaaaagtactagactcttaattgtaaagataatttgagaaacactcagcgataccttgaaagagagctccatattttctccaccccaaacatcgagcccaggatcatatgttccaagttcaaaaaagtaatttttatcaatagaaaataatccacctgccatgacgggacatctacaaaaagaaaagttggcttttaaatcttgcatgtcaggggagctcaacttttagggagtgttccctaacaagaggcattttagaataattaccacatgcagggaggtcttggataaagtcacaaagaacacctaagtgacaagttccctggttcttgtggcagaacttgattagaggcagcaaagacagggtctagaactaggattcttccttggctttgacacttcaacacaaattctccaaagatgttatttttaatcagttatttagtgctatttaggaaagatgagtcaggcactgttttaagtgttatagatgtattaactcaggcctcacaaaaatcctttgagtatctacccttaagaaactacagcccccaaaggcaagaaaatttcccaagtttacagacccaccggt

SEQ ID NO: 47163 - DNA, 1077 bp, Bovine  19866880703584
atcttgattaataatgaatatattttgtatttcagatacattattattttatatatttattaatttattcaagaaatgtttattgagcacttaccatgtgtttatcactgagctatgctttagagatagaaataaaaacaaacatgagataaggtccccacttttctgtccactctaggcatcaggcagaacaaaggcagaggagtacatgcaaccccagatgaggacatctgagtcatactaggtggatgtaatcggcctcccagagctgctgactttgattctgtccttgaagaagaactaggatgaactaggcagttccaggcaggtgttctgtgtgtaagggcacaacgcttctagaaagtaggtatagtttgatatggatggaaccaagggtgagtgaggaaaagaagcaagagatgaggttagagaaatagtcagtggttgcagtggtagagggaaggatggtttggaagtaaaatgttttagatcagaattctagaaagcattgcataataactgttcttcttgtaatgacagaatagtagcctttaaagaattttttagcacatctataagtttcaagtcatgtaccagaaaaaaaaattaactatacatcaataacattatttatgagaaatttgcgaagtagatattattattctcactaaaatttggaaaaactgagcttggcaaggttaaataccttatccaagttcataaagataatacctaacaaaaccattcctaggattaaaatactagtggtcagattttaaaatctacatttcttccatcagcatcttcatagtctgtaggtatcctgcaagctgccttttcacagcatttaactagggcctgaattggtgaacccaagttacaaccaactcagttaatgcaatagaggagaattggtctcacatatattttccaatttgaattatcctggagcttgggttactagcttccctgatagctcagttggtgaagaatccgcccgcaatgcaggagaccctggttcgattcctgggttgggaagatctgctggagaagggataggctacccagtccagtatt

SEQ ID NO: 47164 - DNA, 2538 bp, Bovine  19866880714034
aaatcgctctttatttaaaatgtgattttactagactctggcaataaactttgcaaaatactttgcctttcttattaccttcagattttaagttgttttgcttggcatctatggcgtgaaattctgtataggtcgccttcctaggtgttaccattcactaaattttctcactagaggggctgagcaattgtcagtcaggaaaattctgtttactaaatgttggctttatgctctcaagatgaattaaacccattgtgagattgctagaaggaggggttggaagatttgtgggcaattgactaaagagttatatcagatagtttatttctgaaactgaaaacaaaatcttgtctagcacagttaaagtcattaaacatgaaaatgacagctttagcacaattttaagaaaatacccctctctattactacactttctcttattaacagaatctcagaataattttctttccttagaaacctgagacaactctagtcataactgtactagttactatgaaaatggaaataattatcttagaatattttcaaagtagagtgtgagtgtgtatttttagtgagaaagctttgatggttgttgggaatatataatttactggacctcagcccaaatcaagatgcttaaaactgtgctcgtgaagcttcactcaaaccaatgtgtcaaataatgtactgaatatttatgaaaaggggagaatctatatttatattcttagatccataatttttcatttcatgcttctatatatattaccctcaactttctgtcaccacagataaagacatttttttggccctgggaataaaaagacaattccttattgtctgactgtaatacagtcttcattgtactattcaaccctttgtttacttattttcattttgtgaaaagccctgggttagcccttctcagatttttgcttctttatgtgtaacaaatcccacacattctaaaggcactttctttaattctctgttgccatataatatgtttccatagtatcatacactattattaagtgtttatgagactcaattttgaatttttccttttgtttttttcaagcagatactttatagcctgaccatatcaaagtctgtcatgcttagtctatagaatctatacattttattcttgacaatgtaagttttcagaataaagtcaggaagatcaggtctttattgataaatttaagtagaagattgatgcactaggacagtcatctgttaatttagtgcctttaaatctttttacctggacaacctattttcttttttggattactggtgacccctataattttctgcttaacttcaaagcacagtattgtattatccatcataggacaggacccattgttaacctacaatcaacagagcctgtattttgaattatttcagcagaggtggcaacttccagtggaacttgagtgaggtgtgtggtctgtgatcatttgatgtggccaatcaactatctctgattgggctccaaaatatagtaaccctggcccttttagctttgtgatatcttatcagatgattaaccaactatgaaagatttcgtcaacaagactattgcagggtatgttcaatgagtaaatgcttaatgctcacagaggaggcagcatagttgcagagcattgaaactatcatttggcatcagtgctcattgccctgtgctgccatgttctgtatcgcccagaatgaaggaaccagaagtgcaaaacagtgataggtggctctgtgattctttctaacttaggaaaagacacaggtctggttccaactgtagtgggtgggtcttcaacatttgaaaagcatatgggacacattaagaatacaaactgggagctccatgtgaaggctgactgcctttgggattcaaggttcagggatggaagaaggactctggtagctgttagcagggagaaccgatttattatgaaaatgctgatatttcttgcctgactttttatcttccttagatgctgggtgaacaggaagtaataacagcttctatttctcagtcaatataaaacttaccccttcatataatgctacctttaaaaacacagcatgtacatcagactctatcgatctacctattaacagtttaaacaaagaattttgtgtttgcttgttctcaataaaagtttgtatccttgttttttttggtgtctagattttactttctctagttgccttttaaaatttagaagaaccctcgcacatcagcagctactaagaccatcaacaaatgctttttcaaaaatcaagagaacaccttattttaactcacttgcattatttatttcaaaaaggtcttaaaatacttgtatatgaaattgcagaaagaatttctgatgggtaaacatgtaatgctcatgaaacatttctatcatttttacaggaactgaactattgtttgagatgcatcttaattccaacaactcggaacatatatatatatctatatatatctatatatatatatatctttgtagtctctaaggtaaaaca

SEQ ID NO: 47165 - DNA, 1326 bp, Bovine  19866880894968
ctacctgatgcgaagaattgcctcactggaacagaccctgatgctgggaaagtttgaaggcaggaggaaaaggggatgacagaggatgagatggttgcatggcatcaccaactcgatgaacatgaatttgagcaagctctgggagttggtgatccacagggaagcttggcatgctgcagtccatggggttccaaagagtcagacatgactgtttgacttaaatgaaagtctcagtgaagaattgactttggggtaggactgactactcaactatatatttaccctcttaatatttaactgaatgaagtctattttctctactcttttctaaaattattttttctttttcttctcaactgaattcacatctttcagtcttcctcttttttccccaagatttttcctgttcactctaaatttctagctcttcctatctttattttgctcctcatctttcttctcttttcgggttcttcttacctttttttgttccctttgttttatccctgcccctccaattatctcaatagtaattgctaatcataaaagttgtcaaaaaagcaaagatctaggttttgaaatctgtcaaccataaaagcaagtcatatccatttctaaagcctcgtggagcacaagacattctctttaggatctccaagagcacttttttctaagttgacttgctggtaattaaatgccagcattaaagacaaattaagctcatttagtttcattattttaccattacaattacttaaacaacaatactatttccaattgtttttatagcacatgtataatatttgagttacatttggggataaagacttgagctaagattgcttcagagatgaactattccatttataacatcatttctaagggaaaatgtgcgttgagttcctaacaactgattagcaaattaaattctgggatacacctgtttgttaagaaggaactgcctataattagggaggtaaatctgttaggaaaaaatcaaataggtgagccaaaatgcagaagctggtgttgtgataagagaactagtatgtatttgggtatttcatgactatttcaaagcacgttgatacacatgcactgctctgagtgtcaaaacaagcttgaacactaagcagggtggagttttctattatttaaaatttgcagatgagaaaagtgctttaaagggccaagtaactttctcaaggtcaggtaacctggctagatggaactgctgctgctgctgctaagtcgcttcagtcatgtccgactctgtgcgaccccagagacggcagcccactaggctcctctgttcctgtgcctggg

SEQ ID NO: 47166 - DNA, 1483 bp, Bovine  19866880935676
ctgctgcgtcgtcatgatgttagttcattgtttaatttaatgctttgcttttcctacagtattctggcaagcccctctataaagcaattaaaatgggtctattctcttagcctagagctgggactgtcaaccaataatttgattccttcctacacagctaaagagagttttcttttggcacatatgaaaagcaaaagatagcaccatgcatttgccacaaaccagtctaattcactgagggaaaagaagaacctttctagatccttagtttctatctgccctgttcttccaatcctagtaaggtccaaaaccacaactaatgaactgctggaggaggagctcgaagagagaaaatagactgattccagagctctccatacttcaggcttctagatgtgtgtatcaggctgaaagaaaaagaaactgaacagtgagatgaagctcaatctcttagttttacattggattaatatttcagttggtgaaatgagatagcttttgtgatttcagtgactggaaaagctatgacatctccctaagaaaccaaacaagggcagagggggagaaaatctcagaagatggattttaataggttgtttcctgctttttcttctataactgtacacaaagcaatgttgcgtgttgcttctgaattgtgtgtgtgtgtacacattcatgcacatttgtgtgtttgtgtgtgttagagggcagtgtgccatttcactaaaaagctgtatctgaaagctggaaatacacagcagaatttgtttaaaaggtgcaagatagaccataacaaaacaaagggtaaatgtggccaaaagatgactatagagtttttgatgtttttagttatcacactctcctcacaattggggtgataaggagagaaatgatcagaaggtataaaacacacttccgctactgacttgaagagaaaaaaacaggtaagaaatgactaatgaatgtaaaactgagaaatggtaaaacaaatcaatgactttgtctcctaaatacagccaaagacctagaaatatttatgggagaaaggaattggtaaatgtagaaatttgaacctgcgtacacttcttggtacagacctcatccaaggcccagtttaaccatcgtaaaataattcatcaaattcttacagtgatattgcagtgagtactcttgtcccataaaatagctttcttttgggctgttctgggtgaaccattcagagcagagtttcctaagaagagaacagttttaggtcaaggctcagaaaattggggaaaagtagcaatatttagaagctctgttttgttgtttgctttcagaaggaagggagcattttagaatctcctctatgtttaaaaaaaaaaaacaatctatatttttctacactaaaataccttctaaatcggccccacttctaaaacatttgtgtatggatatgtgtgagaaggagctatagagacacaagcagagtattcacaaaggg

SEQ ID NO: 47167 - DNA, 766 bp, Bovine  19866880946832
gtggcattattatatgaataaatgagttagtcaatcaatcactgacaaagcatactctgtaatcaaaagatttttcatgttaagattaatttcatgtaatacaagtctaaatattacataaacctctgtgacattgagttatacttcataggataaaaagagcacttggagcagccaaagaatggcagacagtcaggagcaattcttttggatttcaggatatctgggtggcccctaaccaaaatctggggatacaaattcaaagtatagacttacactgtctaatgccataaccaatagccacgtgcagttacttaacagtgctggcagagacagaattgaacaacaggagcaaattccttggaactaaaaatgttagcctgtcacaagcatgaactatatgctaggtaatctagttcaacggtagaagcattgactattgaatagatatttctcctcttgtatctaaaaacagtaatagcatatattgaatgtatatgtatcattgcaaggctttcacattctactgggaaatcattcatcctgagcatcacattgacacaaagatccaccagagaagactacacatttcaagtcagttaattatactcacctcttttgcaggtatgctcaaacctgactctctcagtacacagcaaaatcttctagcaaagtgaggatgataattgatacaagaaccactttaaactcaaaatggttctatatgataaattaagccagaatggaggaatccagaaaaatagct

SEQ ID NO: 47168 - DNA, 1448 bp, Bovine  19866880959013
tggaatccttaatagaaaatgttcactcactctaacagtttagccactcactacaaaacaaactaagggccaggggtcagtgccaacagctcttttctgtttgtcttgttgtttttaaaatatgatatatgacaactgtcccctgaatttcagtttcctgaagacaatatgataaatttatttcaactattctgatgcagaaagctaattaagtaaactagtttagcaactgatcacgtttcactaatttcaaccatctgcttcaacatttgttcctatgtgcactagctttcatagcttctttcctctaatagcaattaatgaaattgttaataagctacatatatgatatgatgttgcaacaatttaccaaaggattacattatgaggcaaatttaacaaatgtagaaaaatgactctgataatcaaatgttgtacaacagcaactagttttcttcttaactcatacttctcaattaatcgtctaattaacacacattttatacataattcataattttaaactcatggtcatatttaccacccctttttacatgctaactgcttatataagacacatattaatgaaacacaacctctgtgcaaattctgagccttgattttgttttaattcactgagcattttcataacatttactttcaattattgtggaatgcatcaggaggcaagctatgccactatccagtttctatgctatattcagagaatggtctatgcacaaacatacacttacatcatgattttagtatttttaaatgagattaacttataaagaccttgaaacatgagtccgattgaactactttagcttactgcaatagcttgatacattcagtaacattcatacaaatgaaaaatataaaatatcattagactttactaagtattggggctttattttcatggcaatttaaacaaataaatattaacacctctttaatatgcttgcatgaaatacatggtcagtgctaaaagttcacctcatcaatattgtctccctctggttttagctactactcttgcccaaatatacatgcctatacagttgatccttgaacaacaggaatttgagctacttgggtccacttacaccaggatttttttcaatagttgatactacaatactacacaatccattgttggttgactctacagatgcagaggaacaatgaatatggaggaaccaccaatatgaaggaggaaccatcaatatgaagctatgaattatatgcagatccaactgcagtaggttgcacccctaacctcctgggttgtttttgtgcatgccctcacccatactgaaaactactcccttctctctgatgaccaccaccttttatttccatatacacaatcaaaatattgttatagaggggaataaaactggatattgtaaatatccaaaacatctttacaaaggtgcaaa

SEQ ID NO: 47169 - DNA, 687 bp, Bovine  19866881050990
cacttgactcactctgttctactttttgtcctagtgttctgcccattgttacaaagcctgtttcttcgctgctgccgctgccgctaagtcgcttcagtcgtgtctgactctgtgcgaccccatagatggcagcccaccaggctcccccgtccctgggattctccagacagttttaaaactattttaaaactgtaaatgttctcttttgaggccaacactagtggcctcaaagtgttaatgaatatttcaaaactgtctaagttgaacctagaggggcttctgccttgagtaaagctgactgtataggtagcaccccaaatcctttcaaattattgtatttactgctctatggagcatcatggtttgatgtgttcatggcattcaacaaacatttatgaaaagcctatttcaattattttcccagtttgggggataaaggaaattcagagatgaataaaaagtgaataaaaattccatgaagagcttggaacaaggcagaatgaaaaagtgctagctctgactttaatggttaacagtgtttgaattaaaaacaaaaactctcatcgttatttccctgacttatcctaagggtgaactaaatatttaagtgtattataaaagatcacattctctttactatttttttcttttacctgagaattctcatcagggctgaaactggaaaca

SEQ ID NO: 47170 - DNA, 1281 bp, Bovine  19866881347651
cagccaatgttcatatcagagatgcacttcaggggagcttatacttccccccaaaatttttaaaactgagtctgatcccagtaaattcaacgtattctactcattcattcactcattcatgtattcatccagcaagtttgcaggccatttactcattcattctagtctcagagttctactttatatttctacttagataccactataaaatgacttaatatattatatatttattatattgcaagttgaattgtatttcctatatacacagtgaagtgaagtacaataagttgattacatagatgttgaacttgccccagtaccaacacaaaatgttaggttcaatagtcataatgacataaatctgacaaacctaagaacagatctaaattgtctaactaaaaatgtaaatcattatagttaaccagaggaacataaacacttgtttgaaataagacaatgatttcactctcagtacacagggagaattttattgttcttatattgtttctcaataatgatatatttaaattttatgataaaagatcattgttcacacaaattctatcagtgattagatacatgtattgggttgattcaagcattatggagtctttttctgtctagttcaccgtttgacccctcatcagagcaaacttgcttttaggttagactataaaattagtttttgactactagtttcaattgtcagctttctagaactcaagttatatcttcaaaagaaaatttacaaatgactgtgttttttaaaaagcaatttttacctcttaattgccatcattagggacatactttctacagctgtcaatattgtatatgtttgtcttctatcctgctgataggtaacaattttccaagcaagctcagagagtagtgactctttattaaaactgacaagagagggaatcagatttttaaaaattattctggaaattattactgacaagtctgtctttaattcctaagcagaaagacacagtgagaagttaacatgccccgtcaccacagcaagctagtagcatttctgccttgtttgtataaaaaagtacttcttagcaggtaccattctactattgtctaaagttccatttcggtccgccatgttagattcactccgcaggggatagcaggagagctggcagcgtacggttcttgcattggccttcggcaggcgccccccgggggcggaaagctgccccacaacatggttttaaaaaaataaataaataaataaagttccatttctcttataaagcaaag

SEQ ID NO: 47171 - DNA, 774 bp, Bovine  19866881390947
gagggaactgatgagtatagcagatggtaattgcttcctacatttgaatgaaatgatatgcattgctacaatttacagctctcgcctcatattttattcaggaaccctttatctcttttcctgcagaattattctgcaataaatttagacatcttatcaatagcttggtgatagtagcagaaacagaggaaacctgaactttgtgcatcttaatgtttaaaataattttctgcaataattgaattatctggcagtgaacattcacatagagaacctgaatgttttctcttttgtggggtatcagccctgtgatgaaaagaaaccccttagattgacaaattattgactgaaaaagtttgaaaccaaacaagaagattttgactttgcctttttttggagaaaggaagggatctttgtcccttttcataccctaccaagtacccaatgaatacagagtaaagatgaaactgtcttaaatattaccctgcgtttcctaggtaataaacacctagcattgcaaaaatcatgggaaaatttagggagtttgagtcttgctctatttctttccctgaaattgtgtcccatgggatccatgttatttactaaatgttgaacatgtgggaactgtttctgaaagtcagcgtgctgtctcccaggacttgagggtaatctgccacactgcagggtcagctagtaaagacaattaaagccctcatagacacgcttacattatctgagaccattggtaaagaatgtgattttgaatgacttcag

SEQ ID NO: 47172 - DNA, 1367 bp, Bovine  19866880342256
gtcgctaagagtcggacatgactgagcgacttcactttcacttttcactttcatacattggggaaggaaatggcaacccactccagtgttcttgcctggagaatcccagggacgggggagcctggtgggctgccgtctatggggtcgcacagagtcggtcacgactgaagtgacttagcagcagcagcagcagcccagagtgctcatctctccccatctgtgttcattgatggtgtattggtggcttgaaattgaatttggagggaatatttacttcagatcaaggctcttcatattgttaaaacatttaccagggcaccattgtgcgacacgcctaggtagccagggaccaatgcccctggggaaggaatgaattcaggaattcctcctgctgagttgtcagaactactactgtgtgcttagaggccgactaatttctgtgagccatgtggaaagagaactgctggctacctgggcattatcttccttacttcaaagccctgatttcccatttacaggagcccaaatgtctccatttttacagcctgaaattgctgaacagttttcatggtgccaagtaaccgatttagctgatattcacacctgcgttggttgtttgggcataattttcacctgggactccaaccttttgtaaacttagtatggacgtatttgtatcctgatcgagttaggaaattcacacttttcttcctcaagtatgaaagccagcagggctttgtttttgaacgattagtgttagccaaggtccttgttgtttttatttataacctatgaaatagccttcagcatgttgacatgttctctgagtttgcttctgacaatcattaaagtagaaaaggacaaccaaacctgtgttgatagtgttgaggatctcattttttgttaagaaagccgtgcccactggtctctgtgggtcataggttttctctgcaagggttcttccttctctctactcttcttgttcctcactttgttaatatgcctggactcaaaaggtctcttgttccaggatgccttctctgattaagtgcaataacttcttcatgcctttctctgtctctttaattcacctctattcatgcttctcaatagatgcatacttaagtgattcttagggatttttcatatctacatgttattattgatccagttaaatgacagatttctgggtatcagagaaattgcttttcttctacttctttttaataataggttttcttttttttggccaaaccttgcagcatgtggaatattagttccctgaacagggatcaaatctgtgcctcctgcattggaagcatggaatcttaaccactggatcacaagggaagtccctcttctatttc

SEQ ID NO: 47173 - DNA, 699 bp, Bovine  19866880396958
tttttctttttggttgctttctatttgtatcttacttcctcccaaatacgattggtatggagatactcaaaacctgctttggggccatctgctttgagactttctgatgtggtaattttgaaacatgatactaagccctgaaaataatgaagctgaaagactgtagagctcatcttgggtctttgttaagatgtttttgttttcttaacagaaataagccacctttaccctataaaaagaatctttgtaatttgtacaaaattctataatgaacttaggatccacattattttacttgacagaaatgtgctgaaatgtgtaatatcaccttaggaccttgatagaatgcacagagactgaaaaatttatttttagtttaagtattaaaattaaagtcttgagttttctttactgcctttctggagacagtgtggcatgaataagtgcattggttctggagtaggactgccttgatttgcatctggtctctaccacttatcattgttgatcttaggtgaattacttcacctctctgtgccttggtttctttacctgtaggataatgataataataggacctttctcataaagttgttgtgagtacaaattgagttaatacatgtaaagtgcttagaacagcctctatatctcatcccagatgttttttcctcatctaaaatataatgaagaaattcaggg

SEQ ID NO: 47174 - DNA, 863 bp, Bovine  19866880565414
tgatatttttatgggccagtgaagcttatataccgttgagtgacatttaggaactatggttatttccatgtgaagagaattaatctcttcaaggagaggagtcagccctctccacttctggttctgtccaaatatctccagttatacttgctgcctgaaagagcacagtcttcagtactgttttaaatcttaaatatagaaaaattttcagaaagcttcaatataataatgtatcttttgagctacctttgttcctgctttgtgactgataattaacaaatgtatttttctatgttttgactgtcacttatattagaaattaatcttacttgcttcctaggattatgaaaggcttgaatgtgatagtgagtgagaaagtgatttaaaatttttacagctgtaagcaaacaaaaaaatatgtatatatattataacatgttcatggaaatggaattgtagattttatagcgaatgaagtgtttttagaagaattaagtatctcaggtcgattctttttaaatattgatttaatttttatggtttaattttattttcaatcttgtttcaggggatcttttctgttttttctttaatttttctttctttttaataaagaactgtctgactttcttcaggcagtgctcatgtgtttgttaaatgtgcaatttttctttctttatctgccattctcccttctttcctcctccctgtcttgaagtcttattccttggttcctctgtaacaacacagagtaaccctcttttacttatggctaacctgaatataaagcccactggggatgttttcagttttgtgtttagtcttgtttagtcggccttggcaaaggtccagacagacagcaa

SEQ ID NO: 47175 - DNA, 1732 bp, Bovine  19866880618534
caatataaatggtgttcatttgcaaatgatgaaactgatgtttagtgtagcaagtatagaagcaagacataatctcagttctcagactgaatagtttacagatacataccccctctcctcaacatccactttgcacagtctcatacctgttcttgaaataaagcagatagcagactacacaacaaagccttctaaacacctaggaagctccgagacacttcataaagatttctagcaggcaatttgacataggtctgtagttcaggaacactacaggagctccaaaagtggacttgggagtcatgagcatgatggtgggggctgaagttaggcatagatgagatcaccagggatagctatagagtaagaagagagggcaggagagcagaagagagcagagtgagaagtaggatgtgcacatgacatttaagttgctgctgcgaagtcgtttcagtcgtgtccaactctgtgcgaccccatagatggcagcccaccaggctccgccatccctgggattctccaggcaagaacactggagtgggttgtcatttccttctccaatgcatgaaagtgaaaagtgaaagtgaagtcgctcagtcgtgtccgactcctagcgaccccatggactgcagcccaccaggctcctccatccatgggattttccaggcaagagtactggagtggggtactattgccttctccggacatttaagtagagggaactcaaaatcttacctgggagctgctgggaaaagatgttctctttcattgagctattaccaggtggagtctggcatgaccccaatcccctgtaaagcacacccaaaatgtgaagagatcagtgctgcagtcaggcctacccctggattttgcaagtatatgagataacttgttttgtttgtttgttctaagtcaaaggatattggggtttcaggtttctaatacaacccaaagatgctgaccttttcttaccaagatgttgaaagtatcagaagacaaaacttatgaaatagaagctatacaaatttttgtcatatagattttccatcatcattaaataactcttcttcactgaccattcagttgtgatttctagactttccacccactggaacactatcttaaaccatctatgcaagtgctgcttggggatgatttgccttccttgtacagatcatgtcccatctagttggaagatgcttaagattaccctgttatcagcccttgaacagtctgaagaaagagcccaccgtttaagcattttattcacattattattgagtctgttactacagtatccagtacatcattgaagcaccatatatgtttgtagagtgaatataacattagaagttgttccttatgtgcttcacacattatccgtttaagatgagatttctaggctgcaaagaaaagtcctctgcttttgcagacagacttcctatgcttcacgtggatgtgactgatgccatttcatacattatacttaggttgtttgacataactgcataaataagtcattacagaagctataactgaggatttgaaataccccaaggatctcagtggctaagataaaacagtgatgtatcttgccagacctggcgatttccttttgctcttttatattgctgccagtatgtgtgctaaagtcttttacaatatacagcttgccaggtgtagctgaattaattttgttcaaatctcacaactcacaattgtgcttttctct

SEQ ID NO: 47176 - DNA, 1184 bp, Bovine  19866880651134
cagagttttacattgagtggaagtgtttccctattgatgggaagaagttagattccatctaatcttttgtattacaaatgttactgtgccaaatatccttgtataaacttcttggggcttgaaagtgaaagtttactcactcagtcgtgtctgactctttgtgactccatggacagaagagcctcctctgtccatggaattctccaggcaagcatattggagtgtgtagccattcccttctcaaggggatcttcccaacacagggatcaaaccaaggtcacctgcattgcaggcaaattcttaaccagtaaatatttttaaaggagatatttctgggttacaggatatgtgtatttgaagcatgggttaaacatttttgttaaattagttaatttcttatatggattataggtgttcattggagaaaagtccaaaggtacaaaaaaatatagtaaaaattaaatcttttccaacccttccttgtcttcctctgatacccttctcaatctcaaccaagacttttatcacatataggggtttgttagtgtgtttgtgtgtattgacacttctgtcacatatggatatgtgcgtctgtgtgtgtttcttctcatgtaaattcctagaagtaagatagctgagtcaaagatatgggaagcatttctttttaaaagtgagtaaatatttttttctgtgaaaaatattcgtatttaatatttttaaatggatccatttgagccctcctgtatgtgccatgagtcaggccctgagagttacatcttatgctccttcactcacttctgcttttcccaaatccacattccatatagatgccaagggtttttccagggatggatgtttatcttcacctgtatcagaacagagtagattcttgcagtttcatatactctccattccttccttctaacattagaatccatggcagatgacaaataaagaaatagcgtttggttcatttggtctctcgtcagcactgttgaaggtaaatggtgcaattagatgtttgcctaacaacataaagaggccaatatttgatgctgggcaactttctgtgcagaacagtgtaattgctgaaatgctgtttgtcttcctaccttttcattactatcattttcgttcatttctagtgccttttacaagctttcatttctccatctgtggacagt

SEQ ID NO: 47177 - DNA, 799 bp, Bovine  19866880654315
ttcattttaaaaaataacttgacaaattgcagacaaaagacttgcaccccaccataatgtaagattccattaaatgttccttacagttttgatatcactgtagtaatatggacattttctgggttattcccattaaccatactaatatcttgcctttaccttataatagcccactaagagccttcctataaagaaagtcaactcctccattaccttgagtttgcctggttccttcttgaaaaattcatatactagctgatatttctgtgaattatgttttcctgcctctctttttcccccatctgaatcattggtcttaaaatgccatggctctttgtcattctcatgagagctttcctagctaaatttgtatctcactcttttacttctttcctagatctttccctcatgctgccttgtcctgtagaagctccattattcatcagctttccttcttttaaaattgtcttgaaagtgccttgaaacaaagaagtctcatgttgaatttttcaacttaagaaattagaaataggagttttaagaacaaatgttgaaatttacaagtctgtgtttttgttttcattcattacaccttaaaatcttgtgaatgtgcaaataaaagatttgctttagatagtggtatttagaatcaaagattataaattaccttctggtgataaatatcaaatccttaaccagtaataaagctatattccttaattactttgcttttaccatctgccaaagaatacattaaagaatatagtaaacaaaagagtgagctgtaaaccctgaaatt

SEQ ID NO: 47178 - DNA, 1769 bp, Bovine  19866880787685
agaggttttggaacttggatgtgctaaaggagggtgtatgtgtggaagaggagctcaacatagagtgtgtgaattggagcagtatatggaggatgtccagtgtgcaagctggtgatagttgctcagagtagtttgacagaacttgagtggagtaacagagcttgagtggggtatagggtgtctatgcaatgaatggtccacatcagtgacagaagattgattatgtatgaggtagggcagttgactgaattagtaaagataatggaagcctagcgtcttactgttggagaaaggagttaaaagatggaggaagacaatgaatcatgtactgttgaattagaattggagataccagtgtgaacttaagagtttccagtgtcggtagatagatatagcaaatctgggacccacttcttggcctctgaataccattctcagtagactagggcctgttggagaaatggctaatttagggaacgtgtgagatgaacctgcatcatcttatcgtgcaagaaagttgttcaaagaatgatgagattgtgtcaaaatgattcagaagcagcttgaataggctctcgtggccaaatttggaataatttgaacatcaaaataaatattgatggcaaaatactgcaaataaaattgaagctcataagtctatagtgaaagaattaatgaataaatggaaactatgatgaagggtggtatatttttataatctcaaagcatctccttttagaatactaattataaagattaaaaaggaactttacagtggaaaagttgggcaatggtcccagcagacataccagtgtgccaggactgagaatatggcatcacttcttagatactgttgacaaagatacacaccctgaatttaatcatgggaaatcattggttgttgttattctgtcactaaattgtgtcccattctctgtgacaccataataatcagactaactctaattgagagacattctacaatataatttacaatataagcaatctttaaatgtaggtcctgaaaattaagaaagcacagaacaactgtgccaaatgaaagagacagatattaataaatacagttcatgagtcattacgctatacaggatattatttggaacctggcaaaacttgaaatgggggtctgaagattagatatatcagtgttaatttcctgattttgatgattgtgaactgcttatgtagatgaattctcttgtttgtaggatatatacactaaagtattttctaggactgtgtggacatcatattagcagcttactcacattagggggaagaagacaccattgtactatactaagaaactggaggctataacagaaaaaagtaaaaacaactacctctgctaagattgacttcttcttctgttggtggttttcaggtggcctggtagttaaagggagagacattttgtattgctgtacaaatactgttaagaggagcctctgttatcagtcctgttttgtgaattattttatggaaatacaggtactcagaaagtttacatacagaaatgtgtcctttggttttgtaggcatatgtacatatatgtgttggggagatattttgatcttaacaggtaacttactagctttttgtaccttttaatgttacatttgaattactttttaaaaaaagttgccatgtgtgtttattttaaaactggttctcattttctagataaaggatagagtttaatatttaatctcttataatggcaaataggtttattgtcatttaaaata

SEQ ID NO: 47179 - DNA, 1599 bp, Bovine  19866880818333
atcataaatgggtattgaattttgtcaaaagctttttctgcacctattgagatgatcatatgtttttatgcttcaatttgctacaatggggcatcacatgaactcaatttgtatatattaaagaatccttgcatccctgggataatcccacttcatcatgcaaggtttcagttcagttcagtcgctcagtcatgtccgactttttgcaaccccaataaccgcaagcacgccaggcctctctgtccatcaactcccagagtccacccaaacccacgtccattgagtcggtgatggcatccaaccatctcatcctctctcgtccccttttcctcctgccctcaatctttcccaacatcagggtcttttcaaatgagtcagctctttgcaacaggtggccaaagtattggagtttcagcttcaacatcagtccgtccaatgaacgtccagcaaggcttataatccttttaatgtgttgttggattcggtgtgctagtatattgctgaggatttttctaggacatggaagtaacctaaatgtccaccaacagaggaatggataaagaagatgtcgtgcatatatatagtggaatattaaccagccataaaaaggaatgaaaatacatcatttgtagagacatgtatggacctagagagtttcatacagaatgaagtaagtcagaaagagaaaaacaaacattgtttattaacacatatatgtggaatctagaaagatggtatagatgatcttatttacaaagcagaaatagagacacagaagtagagaacaaatatggataccaaggagggaagagggattgagacgaagtgggaggctgagattgactcatacacactattgatactgcagagagggatggtacagggagggaggagggaggagggttcaggatggggaacacatgtatacctgtggcggattcattttgatatttggcaaaacttaatacaattatgtaaagtttaaaaataaaatcaaattaaaaaaaaaaaaaaacaatagcttgagatgacacaaaacagaagagagcaaagtcctgagctggaaattccaaagtgcaataagaagaaattggaggattttacacctagcctaaatgtgaaaagcatcacagagcagggtgcttatgtggagaagtgtttgtaggtagcaggatagaagcaggaagaacaaaaagaaagtgattacaagcatgaaggccagttcaaagaagacattggtttccacaaaagtgttggagatggaggcagagaagagcaaatctgggagagatgtttaagaggtagacacagcagagtttgctgacatgaggagtgataaagaatttgaggtaagcccttgacattgcacagagttcagacagaatgagagatgagaaaacattcttagggggagaaactcatatctgaagcattcccaaattatacagaaaaagaaataatcatgggaaagacatatgtggctgtatttcaaagacaacataataacagtcttcaaaaagccattatatgactgccacatttgtagttcaaatgacgtactggagccgatcagggaattcagagaaaatgggcaggcaa

SEQ ID NO: 47180 - DNA, 1056 bp, Bovine  19866880833124
ttatatggctatttctttcaaaggaatgtaattttgctttacttaaaagtcagtaatgtggatataagtaaatttgtaaaacagtctctcctttcattctgtaatctttgaattcagtgattttctcacaagcttttccttgtaaacataaagaattttgcacattatggagaatactgccagttttgatgaaagctggaataatttttattttcaaggagtgtataaaaagcacccaatgatctgatgaataaaaagataaatactacaaaggtatgtaggcaaatagtataggcaaatctactctcctatttttcatgttatttgatagcttagcaaatattaagctaaatacgtagaagatagaattttagcttagcaactttaatacatttgagaagaccattgtgtctttgcttcactttgcccttctgttcttcttgtgcttggtaaaggcatgataccttggatctctgacttttcaaacagtttcttttcataaatacctgggcactaggctcagtggagagcttccctggtggctcggatggacaagaatccacctgcagtgcaggagacctgggtttgatccctgggtcaggaagatcccctggagaagggaacggctacccattccagtattcttgcctggagaattccatgaatggaggagcatggggtagcaaagagtcagacacgactgattaactaacactttcttatttacaggcttagtagaacacaaagcaactatgtgcagcattcaaacaaaaaaagaaaaatgaattctaacttaaaaaaaaacttatgactcaatatactagagagttggagaagggctggggcttctgataaaatctgaggttttgctcttatctttttttcaacaaagcaaataatatctatcagagctgatattaaaatgaaatataagtgtgtgtgtgtatgtgcttcccaaactttaacccaagagatacgttgtgattatcaataaaaaatggatttaaaatataagtgtggaaagaattctcagcagttgagagtgagggttatcag

SEQ ID NO: 47181 - DNA, 3111 bp, Bovine  19866880844976
tttagaataagaattaacaagcctctgttacagataaatggagtaaaggaagagaagaataaaaaattttgaaccctcgacaatgacaaacttgaagtatagcttcacaggtggaattggtaaagaatgcacctgccaatgcaggagcctcaagagatgcacattcagttcctgggttgggaagatctcctggaggtgggcatggcaaccactcccagtattctcacctataaaatcccatcaacagaggagtctggtgggtatagtccatggactcgcaaagagttagacatgactgagcaactgagcacactatatatacatagtttctttgttaaataatagagtatcaacaaagtaagtaatacccaccaatgctatttctgttaatataacttgaaaatttcaagctatgcctgattatcaaaatgtgtttttagttaaaagatttgatatttggtgacaatgagaagattatgatggtggtagaatttgctagtgctaagttcatacttaaactgaactcagaatttgtaatctgtgtgtggctgggttcacatcccataaaaattagtctcagagcattagtgaaggctgacatttaacgggtttcgatgcctaacatccccattagtgttggtattcatcggaaggaacactagcctttcatccttaatttattccctggtgcctatttgataaagtggtttctttagatgcctttgaaaaactgtcttatttaaacacactaataaactgaggacagaaagtttccattattgaagtctgattgtccaaagaattattttaaatgtttttatactgtaaaacatgagcaattttttatccacctgatttgttttaattatatttagaatagttttagatatagtactgttatacaaatcaaaccatagtataacagaatattgaagttcatatgtgtaattcctggatcataattttaagaagtgtttcatgttgtaaaaattaataagtaaagaagttggaaatggttgaagttcactgcagtacaatttattgtataattcaagtcctgagactacattcataaagttcagaaaaagaaggatataaaattaacattttgtcattttatttagattattcgatgttaagctttagcgggaaacaaacttaacaacgaacataccttagaatagtttagggttagatgatttactttatctaattttatttttagtataatagtttaatttatgtttaaaatatagatagcaataatgaccaagtaattatttgtgacttaaaacttttttgactgtcaccacttatatttaactgccttttgctgtccaaatgtgccagctgtgtcatgttacagctgcatgtataaaaaattaatttcttcttgctcattcatttcctcttagaatccaatattattaatcattcactgacatggacacttaaagtcagtttttaatttagatgacctatggtttataaatgtagtgagagctatttaatgagtgaaatcttttattccaaatatattttaattccatatactacagtgtagttacacattggagtcgtatacatttaagtaaagtgtataaatcaatctcgaatagataaaccagattatttttatattgtgcatgaccatgaatctttttcatattaactctattttaatttttacttagatttaaaaagcttatagaaacttgttaggaaattaaaaggaaagttgccaaagaagaaaactttgcaatgcagaggcagaagtttactgtctttgcagtataaagaagtcttctgacttagtaaaaaaatacaagtatccttgtaaaaatgggcaaaggacaggatcatagaaattcataaaagtatatataaaaattaagtttaaagaagcatttaatgcatttaagtttggcaaatttttattattttaatgatcatacctgatgttagtaaagttgcagagaaaatgatcagtctcatttacctctggcagagatacatactgatacaattttctagggcataatttaataatacatgtcaaaaatttgtaaagatggatgtacacaaatgtttttatcataggatctttttaaattttatttatttattccacctggcatgtggaatcttagttcccccaccagggatgcttatcctctagtggaagtatcttttgggtctttttatttttggctatgcagtgcttctcacaggggattttagttccttgaccagggattgaacccctgtcccttgctttggaagtgcatagtcttaaccactgggctgctggggaagaccctctaacattttttataacaaaacattagaagcaattaaatgttcattatgtaattaaattatgaacacccacataatgtaatactgtgtagccagttttataaaatgatgttttcaaacttagattgttcaactgtgttcagaatgcccttgatttctttggaggaagtttgaggaccctcgaagcggaggaggcagaacacgacttccttctgcttcaaccatatcagctttgtcttacttgtttttggttttgtttttattaaagtataatttacttatgatactatatttatttcagatatacaacataatgattcagtattatatactacaaaataatcaccacaatacatctagtcaccacctgtccttaaagtcattacagtattgttgactgtattccctttgctatacttttttccctctggcttatttatgttataactggaagtttatacctcttaatctctcatctgttttgctcatccttctctcctctgtggcaaccatcactttgttctctgtatctgtgagactgttcctgttgtgttatctttgtttgttttgttttttcaattccacatataagggagatggtaccaagttcatctttcagtgtctgacttacttcactttgcataataccatctaggtccatgtgtattgtctcaaatggcaagatactatactttattagggccgagtagtatttcattatgtgtgtatgtatgtgtgtgtgtgtgttgtgtgtgtgtgtgtgtacacaccacattttctttatccatttat

SEQ ID NO: 47182 - DNA, 791 bp, Bovine  19866880873543
gtcacacagggcaagatgaagataagaaaggaccaggagaagaggccgtgtgtcctcatcctcaccactgtgcagtttttcctgaactactacagtatctgcaggaggcaaatgaactattctgtgacatgccaaatccattcttttttgcccatatacacaatcgataccaattgccagagccaaattgatctggctgcaactcacatcaattcttagaagactgaaaggaatggattggctgtgccataggccagccatttcacatgctctgtgtgaaatttcacattcctgagacatgctgtatgctgtctcaagagttattaagccagtggaagaggaattcaaggtccccgccctgttcatttttttcaggctctaatatcacattaatttttttttaagatacatagctgcctaagtacttgtgaaaattaggaaaatttgtttcaattttctaaccaaactgataatatttgagcatcttctatatgcaaggctcagtcttggctaaagtatttattggagaatactccaagaggaagagaagtgtatcaacacaaatcctttgcaactccattcaacacccagtgagtcctattagagagaagaaagcaatgtaatgagtatgtcctctatgctacatacagctcaagcgcatttatgtcacttgcatctcagattagcccagcataagcattctaactccattttaaaggagcttaataatgtatccaaagtgatagatacccagtaagtgacagcgatggcaattaaagcttttggtgtta

SEQ ID NO: 47183 - DNA, 867 bp, Bovine  19866881023164
ttacctgcaggatagcaaacattcaattatttgcaaacttctcaatgattagttgaattgtatacagcttatctgcagtgttcagtggctctagaatagagagatagctgtaattaaaaacagccaacttttcttggcagtcacctcaatgagataaacaggaaagtctcttaatcagtgctttcttctcatctatctctcccagtaactcttcaacaagcaactataatcagtgttagtcaattcccccaatatgactgatctacaaggcatgacaacaaacagtagactgtactttgaacaattctacttgccactctaccctctttgtgccatctgggaagtagatacacaaaagcaaacttgtttggtggctgtcccaagtcaaacatatttacttagggctgaaagggaacttggaaacttaccgcagtacagccaccttttgaagatgactgaataaatgtattttctgaaactaaaaatatacccagaatgtaaaaggtttatcaaacaatctaagtatcagataaaataatctattaaaaacaaaattcagagaacgagaaaaggaaagcagactaaaggctctgttttccttctcgagaagactgctttacatgaacctctcacctactgcggagaacaaacagcaacacagtggggaacagaatcagccaccaaggacagctggttccttagccaagtatattctctcaccttgatgactagaggaataaatggttatgactttcctggaacattttaggaagtatattctgcaacataaaaaagttatttttgttaaagttcttcaaatgctctgtagaaaaaaaaaaaaatgctctatagaattttctgtttatt

SEQ ID NO: 47184 - DNA, 1614 bp, Bovine  19866881039335
agtctgagcaaatttttgcatgtatgtgcagatcacatactttctggccagaatgtccatactttgcaacgaattctgaaaggagactttgactctctgatgttagaaaccctcctttggtaatcaactgtttggagcttttaatgcataaatcagaaatggattctgcctcaagaagcttacagcctagcaaggttgataagatgtgcatataaatagctgtaaaggtttgacaaagtgtttctggacattctgagaaaaagagatgactctgggcatcaaaacagcttaatgttttttcacagtgaatcagggttgtacagaagagtaaacaaaccagtgactttaagggagggagttaagagacccacgtcagtgtgagatgtttgcaacttaggtgtttgtaagcctttttcttactgatatgaagatagccaaattatatttatgactacaaataccatttcttcatcaaatttgaaaaactgtatgaaaaaacagaacaaaatttcactgctctctccattagaccgtatctgcctcatttgaaaagaatacattaaaaagcagactttgtacttcatttcttagcactgtgactggaaatcctctcataaagtcatatttagattgagaagtgctgagtttttgtcacatcgtgcctggaacttggaacgaaaagcagaatgttcccccttcctgcacacccccatctcctttattcctgtaaacctagcctgaagtgacattctctgaccactagatggcactcctgcacaggagagtcacatcccgatttaccaagggcggggcggggctcagctaatctcccccgctacatcttctggaagtgacggccgcgcttggtaaacgcgctgttgcaggaggcaggaagtcaaatgctgctgctgctgataagtcgctttagtcgtgcccgactctgtgcgaccccatagacggcagcccaccaggctcctctctccctgggattctccaggcaagaatactggagtgggttgctatttccttctctgagaaagtcaaatagagttgtaaaagattttcaggaaatcaaatcgatgatgtttgaggtgacaaaaagcaggaactgcctgtctgcttttcacatttacatttttaaaaatgtgagttgcccgaggcatgactgtctttgagccacaggcaagggaggcaaattaatatgcacagaactgaattcttaactatccccaacactggctcttctacgtttctgtttctcttattgggccttcctgtttccaggctcccaagagaagcggtttctgaaatccatttttgattcttcagctctcctttccccaattccgtcctcaagtcctgctgtgtttccttgaactatcctctatgtcttctatgtgcccctttaattttcacagccatcacctccatataatttgaagggtaaaattcaatagcctcttctccaaatctattcagtgaagccttatgttactgttaaacttgtaaaatgtagttgaatcagtcatcatttattcattgattaattttatttacttcaacaagtatttcttgaacttttccttggttgctgttctagactaacagggcttc

SEQ ID NO: 47185 - DNA, 3422 bp, Bovine  19866881073042
aaaaaggaaatcatagctcctcttaaccttatagaaacattgtcaggatcaagtgagattttatcacacagtttttaatatagagatggacatgtaagcatacttaatatattttccctatttttattagactggtagtatttggagactggatgtggagtataaaaatacaaaggaataaaaaagagccttgagtttcttatttgatcctcttggttgctgtttcattacatctttataccagaaaaaatacttaaatcagacaaaagaaaaaaataagttaaaagaagtggtcttggttttcaatgcatttatcttgggattcaccacttgttggtgtatgcgtctatagttcattcatttttactgttgcaattccattttatggataaatcagtatgtagagtggatgggcatttgggtacttcctcagtggctcagcaggtaaagaattggcctgcaatgtggcagacacaggagactcaggtttgatccctgagtcaggaagatcccctggagaagaatgggcaacccacttgttttctttcctgaaaagccccatgaacaggggagcctgcagggctacagttcatgcagtagcaaagagttggacatgcctgtgcaccagatacacatatacatttccatttatatatggacatatgggtcatctttattctgatattaggtacagtgctgctataaacattcatgtttctggtgcacatatgcatggaatctggttgggtgtaggcctagaagtgtttgtaagaactacccaggcaggtcttgtacataccatctcatctcactcttctggtcctctggctttgctttctcatccacatttcaactctaattcaagtgccttttattctcaaatgctaaactagatgcatgggaaaaggagattctagaaaatgtagttgttggtctctcatttgtgatgcagagaaattaaatgtgggtagggatgatgcttaattgataacagacaatacagtatgagcatattttcatttctagtggtcatatggatattgtattttgtgttgtgtttgttgaattatcttgccaattatttgtctgctaatcttttttatttgtagataaaatgttttgatattcgagatacaaacctttcatgaatgataggttttacaaatagcttttcctattctgttgtttgccttttctctcttaatggtgtcttttaatgaatagaagttcttaattttaatgtactgcattttagcaattctttccattattgctagtggccattatgagccatttaacaaatctttctctatcatttgtccaaactttttaaaaattgaaaataaaagattctatttttaggtatgtgtcttgtaaacagtcttttgttattttatttccctctccttccctgagtagcttggtatttttatgctgcattttgactcttattgtcattgccctactatacaatacccccttgactagtcaaagtctaatataaagagtgcttttaccttaaaagtgcaaaagttctaaaattctttaacatcatttactgcctgttcaactcatgtgttgcgtcaagtgtcgtaattatctatacctggtaaaataccacaacacatgatcattattgtttcatttcataaataacattgagatttaaccacatattccttttgccttttccttcattcttcattccatttgcatagctgtatttgctgggttgggaaaacccttcacagaaggaaatggcaatgtactccagtattttgcctggggaatctcatgaacagagaagcctgaagggctacagtccagagctatcagagttagacacaacttagcaactaaaaacagtttcaatcaatactatgtttctttttttctgaagtattatctttggggtagactactgattaaaaaaaattataggaatttctttgcttgaaatatcttttttttttccttttcatttttgaaagccttattttggtataaaatgaaagttgtatttacttcctcgggagttggtgatggacagggaggcctggtgtgctgcgattcatggggttgcagagagtcggacaggacagcgactgaacttaactgaactgagggcggggaagttaccatttttacatattcatcatgctctcgcttctactttatctgcttggaagtcagctataagtctgattgactgactctcctttggagttaatgagtctttcttctctggctttaaagacatcttttggtttttgctttttggttattttgccatggtgtacctaggaatgagtcattttatttttgtttcttggtgttcatggtacattttgaaatctgcagcttgaatttcgacattttgtttatctagccctctgagtctgtggaaatttgctcagagtcagtcacaggttccactgagcttctgagcctctcacctgcctcttctggatacctgctcaggtgttctgatcaggcccctttaggacataagcagtgcccacctttccttcactgatctgcctttttcttctatatttctccctgtagttcttcactgccttgttatctctctgaaaggaataagaaatataatcaatatagttcattaaaatgcagtatggtaatttgaaatgaattttatttgctcttctagagaggcgagcatataaatcataagctatttatttcctttacaattttcataaatgcatgaatatataaaacataaattctgtgtttcaaactgtagctttaaatgtgtaaatagaatacgaatgagaaagattatccttgaacactaataattttctttttctgattttgtttgtgcattgtttctaagtaaccttaaatgtattatagagtttttagtgggttagggacaatctttcagtataagttaatgttttccctaagtaggttagagaaatgacacccactctaactttggaatttaactcagatcttaatttaagtcaccttagcatgctgaagtaagtaatggagagaattcttgagaaagcatcttttgctaaatttatattttggtgtatcttcggaggcctgctcttcacacagagtttatattcagtggccttgagtaatcttggtttacataactttttttgtagcaaaatgaataaagtagtagttctaaataaatcagtagaagactttatagtgattatgtctcagttggggtacagagatgtatctgccatgtattacttctcttgtttgatattcatgtttgagactaatttcagttctgttgtgttttaccaacaaattagaataaggtcattcatgctaaaatataatctaactaataataacaaacatccctgtattcaagtagcctaaaatactgtattgactgagcttgacattgtgaggaaaga

SEQ ID NO: 47186 - DNA, 887 bp, Bovine  19866881111655
ataaggtttcagttatttaaaaatcccccccatactaacaaaaaataaagccccaattcccctttcttggccaggataattgatctttctataaggtaattcctaaagggcatcttccttcagtatttctcttgatttataacttcttttctattaaatatttttcaagcagggccaatctgactgttgaatgattgacagggtttaaacctttgctaagacatcaggctcaaagttctaagattgtgatagatcacagaaaaaagttgttatgaaggaatttaaaaatataaaccaataagctagacctaagtaagatgtaggtctgcccagttataattttcttggttcagagtaatgttccatcattctaactttggaagcttggattttactcttcttataggaagttttattcctaatttgtattaaaatagacattgaatatctaatgatatttttttcatggagtcatgtagatttgtttcatggagcagtatagattttagttttactatttatttttcattgaataaatttgaagtgtaatactgtataaatttaatgtataccgaatgttgcttatatacatttatatattgtaatacaatggctgataaagcaacatttataaattacaaattatagcacaatgttgtctatattcattttactgtgcattaggtctctatggcttattttctgctcttacagatgtgtactgttaaacaccatcactcttaatttccctgccctgtaccctggagatgaccattttacttctgggtttttcatgtttaactcctaaaaattctgcatgttagtgatattatacagtacttgtctttttctttctggtttatattgcttagcataatgcactcaag

SEQ ID NO: 47187 - DNA, 1450 bp, Bovine  19866881119510
atctcaaaatgatggtttgtgttttttttttttttttgcctgtctgagaataaagcagctcagttccaatcattatcatgttgctggtttttaaaagtgctttctgctgttttatggaacacaccaagctgagtgcagcagcctgcataatgctgtgccatggggtgcgaagttgaagccatcgaacactctgaatttccccagtgtatctcagtggaagaaccccttgtggtaaatgcatgtgaaccgttccactgagaaaatgcaatgttcaatagctctctgagtttctcattttatacctatggagaaaagactcagtggctgcctgtagtgtttcattgtgacgtacacacagatggtctagttcaaggttctttaaaaggcacacaggggaagaagttatgtttctgcttatttttcctatatatatgtatttcttcctctttatatatatttgcgtaattagtcaaatatgatattctaattttaatgtaggtagaatacatgaaaactgtcaattattctgaagaaacagatatgaggactgacctatgccagttactcaagcaatgtatatacagtaacttgtatttttgtagtctcttttaggtaaatgctgagattggttcatatctaagcctataataagaacattagacagaaagttgcaacttgcagtataagcattttctaaatgctttttctggggactgactaaattcaccctcttttaaaaaaattaaattgaagtatagttgatttacaaggttgtgccaatctctgctgtatagcacagtaacttggttttacatatacatgcattctttttaaaatattattttccattatggtttatcccaggagattggatataattccttgtgctacccagaagggccttggtgtttatacatcctatatataatagtctaccaagccacatgcccagtccatccctctccctcctcatcctccttggcaaccacaagtctgatctcttatgtctgtgagtctgtttctgttttctagatagattcatttatgccatattttagattccatatttttaggctggtgaaaaagtaactgctgtttcagactgtgaattttaattctttataaatagactcaaacacatctttaataatcaaaataggaaccattgcaatcaacacattttgtcaacaagaaataagtttgtttcttcctgtagtgtagaaatccatgcctccagatttgatgaactcttggaaagcatttctgcctcctgctggttgtggaagtattttccctgcaaaaaaaggtcaagatgcttaaagaagtgttagtagttgatgagaggtaaggtgaatatggatgaggcaaaatttcatagtacaattcattcagcttttgaagcattggctgggcaatgtagtgatcagatgttgtcgtggaaaagaatcag

SEQ ID NO: 47188 - DNA, 1174 bp, Bovine  19866881138923
cgtgttgtggccagaaaaccaagaacataaaacagaagcagtattgtaacagattcaataaaaactttaaaagtggtccacattaaaaaaaaaatctctaaaaaaatcccaaatatttcttaacttgtcctattttgttcacttagaatcgagatttttcaaggacagagacttaatattttaagtttatatatacaagatgggattattaggtttttattcctcatgctaactgctaagtcatttcagtcgtgtccaactctgtgcgaccccatagacagcagcccaccaggctcccctgtccctgggattctccaggcaagaacactggagtgggttgctatttccttctccagtgcgtgaaagtgaaaagtgtaagtgaagtcgctcagtcgtgtctcctcataatcaatagtaaaaatcaacttcttccaccaccaatatcattaggttaaacaaatttcataattaattcttaaatttcagtcaagaggagaaaacattgaaaaatatcttataacaagaaaatatttattttagaaataaaataaaaaaataatcctttggaaaaatgttctttttttttcttttccatatgttttgagcatacggatgcctggaataaatttaacctggaggacatactaaaagtcccagaaaaaagcaaagaattcttatatatgattgacaaatctcaagagtgctaatttagaagaatgctgataaataaggatgcttctgtgtgtttggattgcttatctaaatccttatttcgttgccagctgaaactgtggacactttgggcaagttttattggtgtgttatttgtctcttcctttgtccagaagtatcattgctaagaacatttggggtgattaagtatttgatgtatttggatcatgtaaagatagtcaattaggagaaatcagggcacctcataacctaatcatttgtagatctcagataattctatcaacattaactttcttaaaagagaatttgtgtgcaatagctgctgggagtccaaaactacatctcagaaaaaggacttccaagttttgggctgtaataatattatgggaataagggctgacatttttatatcactgctttgatagatactgagtcattcaatccttatgatactcagattacatatgaaatttatttctaa

SEQ ID NO: 47189 - DNA, 880 bp, Bovine  19866881157600
aataaaagcatttgccttgtggtgaccttaatattaatctcttttctttatgcatagatactgccagcttaaattgaaatctccttacaaaaagagtatatttaaaatcttccaaggaatgcggtgatttggagaattggggtctatgaggttcttattcccttaattctttgctcagagagctctggggttcattcattttcagtgttagagaacatttctcagtctgtgtgttccagcctaggaatttgcacactctctttgtaaaaaaaaaataccccagttaaccagtgaattctaaccttgacttggtcttgcctgaaggactctggtttcacttagttcttctaacttttttgataagtggaaacaaatgagaaaagcttgcaatacaacttgctttgaatggccatatattttgaaacttgctaaggctggtataaagaagacagaaagctaaatcagcccagctcagtgtgacacttatgaagaaagactacttgtaccagaaataaagctaaatttacttatgccagaaaagcctaccttgggagcagagtcataagggcaaaactatttctgaacaggaatggactatttctagtatcaaaagaactctctgatattttctttaggacttatttcctctcataatcttattcaaaataagctttcagtttatgacaaatgtttgaaatgtatgatatttttagctaaactcttctgttaatttagctgttatgtgtgtgctttaataaagtgagaatattttcttaaaccatggactaggttggattttgttttcatttataatgattagcttcatatataatggatttatctgaccaacaatgttcatttaatttcaatttttgttaat

SEQ ID NO: 47190 - DNA, 1460 bp, Bovine  19866881266068
ctatggaaatattcagtggtagagtatagtttgaaatgtttgtgatgcatgttagcaagtcattgctttttctgggcaatgaagcacaagcttagattgtgtccaggatgaatacattccttgaattttaaaatcaaaggttcttgctattgcttgctatcccatcttcttggcagcttcacctctgcattgtgatgtttgcctatgctgttctgaagtctaatacccagttagaggcaaccatgttactatgactttagtgttctaagtagctgttagtggcagtttggttacaatgagaaccagaatgaggatgatcaaagattctgttatcaggagttgagagtgcctgacacattttgaacaaagtcttggttttcactttcattcctggcaagtaatttgtcattggagtctatgtggatgatcttttgaacacatccacctgcaggtcatggggaaaaatgatgagtggaggagattttacctcttcatgaagtcagggaatagggattagtaatagttccacctagtttaatttactattttgtaagtcttggaattgttgcaagctttattctctgttactaccaacattgagagtttgatgtgacagactggaaaactcaggaagaatcatttaagcaatgtggatgtgaatttagtaagatatttttcatcccacagatacctgtcattaaactttgtagataatactatctgttgcatgcagaaaagagtgttgaataagaaaaaaagtagcttttgcttcagaaaactcattgtcagcaataatcaattaccttcacaacaaacatggaattaatgcaggatgatatactccagtcactacatggtactctgatagaattttaaacatgcttctgatttaaattatgtattaattggttcaggcaccaagttgaaaggcctggctctaatgataaagccaagtaagcagcctgattaatgaaaggagctgggaagaatttgctacagaagctgaagctcttcgtctggtagctgtaatcattgtaatttattatgggaagcttcttccatggccctgagtcatagctgttattccttctgtaagaatatgttgactcacatgtttaaaagattatccagggaaaaatgtttattttaaaatggaaaaaaggaaaatattatactcagtttattatgaaaatgagtgggaaacaaaagatgggttgcacaatggtatctatatctgtatttgaaagtttgattccaaatagaacaatagacaatgcattggattaccactgtgtatgatattaaaatgttgaaaacattccattattcttataactatactaagcccttattattcttatattgtgactgagaccataaaaagaataaaaaacacaagaatacttaaaaggagctcacaaaatacaaaactggaaggaaagtatggacatcacagttgt

SEQ ID NO: 47191 - DNA, 668 bp, Bovine  19866881287952
tcgttggatgtcagtatgctagctagatttgatagcttttcaatacctggctctatctgaaaattttaatccaggaaagtaaatatttatatatgtagtgtcctctgatccaaaatttatctcaaaagggagaattctaaaaaacaatccaaatttatatttattccttggttctagtaaaaaattagaatcaagaatttaaggtttctcttaaatagttcctagactttctattatgttggtgtccttagtcttaatgatcattcttgaagtgatttatgtcttcagaattgcaaaccaagtttgctagaattcatcttttcttgctggataaaatatattaggctcccataacacattgatatgttcatcaaaaggcctaaatttattagccacctccctagtagtaacttccagtgacagagtagttctgttggaagtctcttctgggaggtttaccaaagagagcacacaaatcttacttgatttaattggactcctataaacagctgtcattatatttccaagagacttgctttatcagggagtctaagaagtcataattttcattaggagaaagaacttggtcagtgctttattttctcccagttgatgagctactttcctggtttaccccttcagcctctttcctgccagtatccttaaca

SEQ ID NO: 47192 - DNA, 1040 bp, Bovine  19866881375375
ctgatcttgctgggacatgaccatcaagtgtgctgaccccttgggagccagttggggttctgcctgggattcacagcaaccccagatatatacaaacattttattttccatagtattgatgattttgcttctcttttgtttttccttttacatcgcttcttctctgtgtttagagtgatatttgggaacaggagagcaggtatgaaggttattgactatgacaactgtgtggcccttgagtctgagttggcaaataagattctggagacagagacaggctttaatctaacactgctcttactgagctttctggaagggaagacgacaagagacccaacaaggaaatacagcatcatcaactcatggggaggcctggcaggtaccctagtagcagcctttttttttgcccccctcacccatacaaggccaaagtgtgagagccaaggtgtgtggggtcaccttgttacaaagagtccacagtctccttcccccatcagtcctgtatatggttttcatcaagcctgagatctgcatgccagctcgcagatccccaacccaggtttttgtttcacacagtacagagggagagacaactgttctctatttatcttaactctactgtttccaaggaaacagggccttgggagaccgaggtcattctcaggcaggcctgcctcagccaggcctggtgttaaccctttgctcgcactatacatgctgctatagaaatgatagcatcactagaagcaatgctaatgccaagcttcagtgtgccattagagtgtcttttgtatgaacatttaccattgtatagtttccagggcactaaattagatacgccacactcactgagtgtacactgcatgtctcacctgattttaggtactggggatgcaaaaatggacaggacagagacctggcctctaaacacttcagaatctggaggggcagttctctctgcattttgagttactgcaaacctccaagttccacgtggaactgagtgctctttatggggagtgtgaagaaagcaatgtact

SEQ ID NO: 47193 - DNA, 1478 bp, Bovine  19866881402935
gctaccccaaatgtgcaagatgctgaaggctcatctctcatttttgtgttccaaaggaggaggagaaagaaagggaaaatgagggcatcctcctagatgactcagcttccttcaaatgagtgctctcacaagtcttcccagttactcctgtttatgtctcattattcacccctacccgtaggagagatgagaaaatgtaatacttagctagctacccttctaaccccaataaagccactgttcccttaataagaaaaagggaaatgggtacctgataggtgcttaaagttgctgctacaggaaataaaactctttatttggataatatgagtggctgggtttttctccatgcctaatatatttctatttctaggcatccattaccttaaataattatgtatttgaaatgaataataggatatatttagttccattaactcattttaaatccatatatgtattaactatattttataataatatgtgttagctcaactttaaaatctaaaggtattaattcagccaaagagggaaagttaaaaaaaacttagagatttgaacaactgatttagccagagaaatcaaatcattgtaaatttttctgttatgcatgcctttgaatactctttgatattaaataactatattttaaatctaattgctccaataatagttttgatatatatctttctacttgaatcattcaatattttaccactgactaaaaatttctggttaacagtacaactgtcattcagctgctggtttcagagttagaaatttatttacttgattaaaactgaacttttactactctgaagagcttaaggcagtgaatggctaattcataccttaaaatatttagcattacaaaggaaaaaaagaagtgaggcaataaatagaatgtagaaatgggacttgagggcggatagtgacaacctcaagtcctggttacactctaggcagtgttctttctctgagtaatgcgttaggggaagacagagctttcctcatttttccccttaatggctgcattagtaatttaccaggggtaaaattacctcttcctagagtttatttttcaggctcccaaattatttcatatatctttcaagatttctctcattctaactcacaaaaatacctatctgtgcatttatacaaaaggagcatataattttagatggcactcacatttcctgaagcttattccaaagtcccaaagttgagaaccagtgacttaaagctgagtttgtcaaccagatagaagcgggcgggagaatattattcaggcagataagtagtagtttcaagtcgccatagcttcaagttgcagtatttggacactgctgataactctatatttatttcaaaataacaggccttgtaggaaagttgtgaggataaaggaatggataaaagactgctgacagatgatgaaaccatgctggattttgaactttatatacttattttag

SEQ ID NO: 47194 - DNA, 1142 bp, Bovine  19866881425252
ttcgatgcctgggtcctgaagatcccgtggaggagggcatggcaacacactccagtattcttgcctggagaaccccaaagacagaggagcctggtggactatagtccactgggtcacaaagaatctgacatgactgaagtaactaaataggcatgcacgcaaccctctaactagttatttatcacaatctaggccaagcagtatgtttgttttgtgttgacatagacagtcaaaatctaaatgcctttttcacctttcttattttatttttccattttaataattacataaggaatagaagcttatttttctaaaaggaatggacttagtgaaattacttgctataccacaattagggctccccatttaagactgtacccacttttacaatgtttgtacattcatttatcctcttctatcctcagtcttagttgttatgattttatgttttaaagcaaatgaaagtaatgcaagtaatattcatagtttacattcagaagattccacttacatatcctataatgtatatccattcacacttttcttgtgagaaaactagttatctacatacaattcctctgcttccagctgagaacatttttccacctaattaaaatagaaattcatcttactgcatttcattttgaaattcatttcaaaaatccactgaaagcaatgtataaggctggacacagatataattatgggaaaacaaatcatttgccaaaaaaaaaaaacagcttacaaacaatcagggatatttttccactcaagagttgttcatttaacagatacgctatgaaatgtaagttatctgattattccaaagacttttcctaacgttttgaaggattttaaaatattgtacatattatttaaatatagttatctttccgctgtgctgtgctgtgcttagtcactcagttgtgtctgactctttgcaaccccagggactgtagcctgccatgttcttctgtccatggggattctacaggcaagaatactggagtgggttgccatgccctccttcagggggattttcccaatccagggatcaaacccaggtctcccacattgcaggcagattcttttacagtctaagccaccagagaagctcctaattcctctatttttagatttca

SEQ ID NO: 47195 - DNA, 1282 bp, Bovine  19866881886315
tctatagatacatagtaatttattttaccttttcccaaatattgggcacttaggatatttccagttttgtagtataaatactatgatgattaccatttggaaaataaatattcatatatatttgattttttcctcaggataattttagaagtttagtttaatcaaaagatacaaatatttcagcagttttgtttaattgtcaagctccttccagaagaaattgtactgataaagtctcccagcagctgtggttaggattgcctttttcccatttctgcacacatttaatgacaagttatcattttaaatgccttattttgtaaaaagaatattgtattgtttaaatctgtattgttttgattattagagttctctggaatttggccagcaaaattaaaaagcataataaacaatgctactgatttcaacctgttacttaatgctgtgtctcataatattatatcataccatttcacctgtatagctgttaaaaccacatcgtagttagtaagtgcatctatggtcatactctggctatgcaactataataatgaaataatattttcaaaagcatcttaatttaagatgcttaaatttaactgaaattacatatttctggtacatagaaatacaaaaaagtttatatttctggaaatataattttcctaagcatggaagatttattttgaaaggacatactgtacctaaaactataaatgtatgtactagaaatagtaaaatgtacattaaaacatattaataccatatatatataactatagaataggtcctgatataacatagttcgtaaaacaccttatgtctgcctgcttacattaatcattacaaaagaaaagtgtgaaagtgttagtcactcagttgtgtctgactctttgtgaccccatggactgtagcccaccaggctcctctgtccatggaattctccaggtaagaatactgggagtggtttgccttttccttctccaggggatcttaccaccccaggactgaacctgagagttcagtctccattcatgcagatacttaaccaactgaaccaccaggagagcccaattacaaaataatttcactgcttttgtcagtgacttgatatattactaataatacactctgatacaacccaaaccagagatattagacatagtttcatagaaagcatctaaataggctgtacaatgacactggaaagaaaaacaaaagcatgattctgcccaaccactgtactgcactgcacagagcaatttctgtctggattgcatac

SEQ ID NO: 47196 - DNA, 1501 bp, Bovine  19866880122593
ttcttttctttttttaattaattttattttatttttaaactttacataattgtattagttttgccaaatatcaaaatgaatccgccacaggtatacatgtgttccccatcctgaaccctcctccctcctccctccccataccatccctctgggtcgtcccagtgcaccagccccaagcatccagtatcgtgcatcgaacctggactggcgtctcgtttcatacatgatattttacatgtttcaatgccattctcccaaatcttcccaccctctccctctcccacagagtccataagactgttctatacatcagtgtctcttttgctgtctcgtacacagggttattgttaccatctttctaaattccatatatatgcgttagtatactgtattggtgtttttccttctggcttactttttcatcaaagaaaacagcctgaatctctcacataaaataacaagccagcacaaagcagtgagagatcagtgaagtggagaaggaactgatgcaggtttgggtcctgactcctctcttagctcatttcgttcagatctttactcaaaagctgcttctgagtgaggctttcttggtcactcactcaaatatttgatacctcctagccctgaaaatttattctctagtttttttaaaaaattccttatcatttagtactttctggaatatttttcttatcttctttccctctgtctccttcacaagaattaaagacccatacaaagcacagttttgaccgtcctgttctttacagtattcccagagcctagacagagcttgacgcacagcagatctgatgaataagtgaattaagttataaagtaagagagatggattggatgatccacatgatactctctagctctaacacaatgatactcacatgtatacatatcaccataaagctatggattacctgagaatacctcaagcgaatcatgccctcatgaccattgtagatgtacacagctccagagttctgattttccaaaggcgaaccaacaatcacgtcattaaagccatccatgttgatgtctgaaagagctgcaattgctgaaccaaatcgagcattttcaagacccttggggccttccagaaattggtgccaattcaaaatgcccttgcaaagagggaaaaaggggacaattaaagccaaccttacattaacaaatatatactactatatatttatagtggtataaatatagatataaatagataaccaaggacctactgtatggcacaaggaattatattcaatagtttttagttatctaaaaaggaaaagaatctgaaaaaaaaatctatgtatccatctatctacctacctatgtacaaatgaatcactgtgccatactgaaactaaggtcataggctatctgctcataaaccaacgtgaaaagaagcaattcttttctgtaggctgcctgtacaacctacataagagtgtccatttctttgtcttttttgcccttaatattagga

SEQ ID NO: 47197 - DNA, 1743 bp, Bovine  19866880234735
cccagggctgatctccttcagaatggactggttggatctccttgcagtccaagggactctcaagagtcttctccaacaccacagttcaaaagcatcaattctttggcgctcagctttcttcacagtccagctttcttcacagtccaactctcacatccatacatgactaatggagttcaaattaagagggtgttcccttttacttatgtattaaagtttataatattttgctgttctttatgagttcataatctgaatgtattcactggttgaaaacaattttattgaatatttggaatgttttactgaaaaaaaaccttcagatgaggtaatatgatatggatgcaagatcctggatcatggcctcactccatcaacatttagcttaattctctcatattttagaggcatgaacacagctgtgaggtgtaatgggcagaggctctggaacactcgagtcaccaccacgttctctttctgacatctctgccccacctatatgcctcagtttactcaaaagacaaaaaatgggagaaacaagccagcactgaagtttcattataaatattcttttatcttcatgtcacctccatgaatgaccttaaaaattaccctaggtaatgccagccattctccttgccatttgacaagtgaagacacttgtcatagaacaggtctgcggtgcacaccgtcttccatggaaattttcccttgagtttttcctttccttctcttttttcgtctttgcccaaatcctgatgggacgagtcctcattgctaggctctgcagaggccaaactgtactctttcttctagcacaacacatgcaacaactatattgtagctttgagccagaatctgaaccttcttgatttattaaaaaaaaagaagaaaattgttgacttaaagatgaactagaactttattttcagaccaaagaataaaacgaaattaatccccttggtttttcttttctttacttctttttttggggggtgatttcattattaaataaaaccactttataaatgaaacaaaatccatgtacaaatgactgaaatgaatggaccaagatttatcttctttcttattttacccaagggaattgtttctaagagatcttaagacttaaacatgattccctaaaataaccagctagcagttctgcaaaaaggaaagcaaaataaatacatcttcttagaagtcagttataatttcccttctgacttttttttctcttttgcttacatgctccttaacccctatcctcctctgtccccatttcacttcctttggagccaaagatctgggaaaaaagttgcctggtaaagcatctggtcccctttccttggcagctgacatgccacttgaaatatttctcatgcagataacttaaggaaactgctgaattaatgccttaaaatgacattgatccatagtgagtgagtgagtgaagtgagtgaaagtcactcagtcatgtccaactctttgtgaccctatggactatacagtccatggaattgtccaggccagagaactggagtgggtagcttttcctttctccaggggatcttcccaatccagggatggaacccaggtctcccacattataggtggattctttaccagctgagccataagggaagccccaaataactgctgctaataggtctggttttgtggtggatttaatacattataaataaattgtacctaaatttgaagagaatgattcaagcttga

SEQ ID NO: 47198 - DNA, 1604 bp, Bovine  19866880473603
agaaggaaatggcaacccactccagtgttcttgcctggagaatcccagggacgggagagcctggttggctgccgtctatggggtcgcacagagtcggacacgactgaattgacttagcagtatctataacaagtttccagagaaggcaatggcaccccactctagtactcttgcctggaaaatcccatgggcagaggagcctggtaggctgcagtccatggggtcgctaagagtcggacacgactgagcgacttcactttcactttgacttttcacataattggaatcatacagtttttgttcttctgtgagtggctaattctactttacataatgttttccaggttcatccatgaggttgcatattgcaggatttccttcttttataaggccgaataacatttcactatagtgttggagaagactcttgagagtcccttggactgcaaggagatccaaccagtccattctgaaggagatctgccctgggatttctttgcaaggaatgatgctaaagctgaaactccagtactttggccacctcatgcaaagagttgactcattggaaaagactctgatgctgggaaagattgagggcaggaagagaaggggatgacagaggatgagatggctggatggcatcactgactcgatggacatgagtctgggtgaactccaggagttggtgatggatagggaggcctggtgagttgcgactcatagggtctcgaagagtcggacacgactgagcgactgaactgaactgaactgaactgaaactaggaggcatctgtaggttcagcaattataatcggattggcagtacttttctttcttaatagtacctaaaatactggtgcatcagtcacttaatggtgatttccattcaactagatataaatatggatagatagaaatagatagactattcctgatataactaaaagagacaacttgactcctttattattttatgagtttgtttgtagtctgttcttttgtgactcattcaatagcaaattttcaagtacctattattcatagatggtagggataataaacaaagaccctattctcaacagaacatacactaatctgggaaaacagacaacttgatgtttaattttaacatgctgtgtattatagaagcaaaggtgctagagtcattcagatatctgggggaggggggttcagtctactccagtggcttcatggaagtgacattcacatggggacttgaggatatgtagcactgtaacggagaaggcaatggcacccaactccagtgctcttgcctggagaatcccagggacggcagagcctggtgggttgccttctgtggggtcgcacagagttggactcgactgaagtgacttagcagcagcagcactgtaacagcttatgcaaagacctggagatttcagaggaactggcacaatggaggagctgaaagaagctcaataatcataaagacaggaatatattcagctcatttacatctgttgatacattactgtacttgctttgagagcgaatacagttctccagtcaggggccactcggaattggcagtgtattctgactttagcattgtgacaacgatt

SEQ ID NO: 47199 - DNA, 1252 bp, Bovine  19866880506950
tgaagatatttttctacttctaaatatatctgtttgtttggaaaaaatatagaaaaagaaaaagatggaaccaaaatttaccttaggtcttatcaccttgagactaattgttcatttaacaaaatatttattcaatgctcactgtatggcagagacaactttctaccctctctcacacacacacacacaatatttcacataaataaggacacatcatatatgctattctattatttgcttctttataataaaaaaatacattgtagatgacaaatgtctatatcaccattgttgatagttgtctagcacttctctatgcagggctagattgttacttgatcactgttggtatggcctttctcagtttcttatacctgcaccaatctcttgagactgaaactttctcaagtttacttcaaaaatgaatgtttctgtcatttagtgactttttcaactgaagaatgcaaaaggcagtcctcgtacacatttatgaatatataatatccatatatgtatgtctgtttgaaatatgcttgtatgctctatctatatatgggttttttttttgccttatttatttttaagtctgtgcatttaaaattatttcctccacaggttatgataagaaaacagacatatctttaccagttccattaaataatagattatttgcaaattgagcctacataagttccctgctgataacagagtcatttcctttgaaagatgtcttttagaattgtaaccactgtcctgagaatgaatacacctaactggatcttaattttcggtatatttgcacaacttcagcaagtctttcttggttattcttgtccttttctttgtgctgcatcttctcttggagttagtcacccaaactgaatttcctctggggaaactgtaagcacatgttctgcataatctcttgaggttaaaagctttgaggatctttgtacataatggaagaggagagtcctttgactacaattgtcttaatccttaagatgttttgtgtgtcctgaatggggaagccatcatttcttctaaggcttcctgagacaggatctgcaagattttgcttcttggtgattttactgaataactcgttgaatagacaaagttaattattactaaataagcgtgtgttaaataaattctctgtaaccatattttaagattatttggtgccctcaggttatatctaatgatatgtgataacatgtcataatgaaaaagatatttgtcttattga

SEQ ID NO: 47200 - DNA, 726 bp, Bovine  19866880531772
aattgcctaataccttaaaatataatcactcacatttcaaattcgggatccagcaacatagctaaaatgttactgctcatgagtggtggttatactgagtcagagagtgccacaaattaaatattcttgccagggcaccaccctggtcctcactccctccactgtagtcttactgtctctctcatgttgaagtctgccaagttttagagaagtttactcagtgttaagaactgtccctcactaggattctaaagtcagatcttttttcataagtacccatcgcccaaatgtctttggaccaggtttctggcacagacttatccaggaaatagagcgggaggagcacctttttttattttaagtgaaaaaacattcacacaagaacattacacaataacaagaccaaaaaaggttggctggtcacatcattgtcatcataaacatgactttgttttggtcatggaagaagtatcatgggttcttaagtcaaggtagcaacaatgaatatgataatttcacaaaactgcttaatttaacaagcttaaaatgcaacataccaatgttagaattgaggacaaaactgcttattttctgttcctagttacaaagtgaaagaagttaatggacagcagattttcagtagaaaaacaactgttctacccatttttgcctcagcagaacataacccctgggagtctgatacatagcaggaactcaaaatttatt

SEQ ID NO: 47201 - DNA, 920 bp, Bovine  19866880532164
tttaaagtggaagtctgaggatatgggaaaaaaaaaaatgaaagagacaaagaatctgaagaattgaaaactgttaggatgaagccaagatgtgacttcagcaggctagtgtgggaaattgctgctaaaggaaatgtctggatgggggaggatagccccttggcttcatcacatagcgtggaagctctgaaaaaatctagcaaagaaggcatccgaaagggacagagtttattttaattaggaagataattgtagcagaggagaagttgctgttcattgagcacacactttatagcgggcactttacattagttatttggtttagttttcacaagcagatgttactgtcactattttacaagggaaaccaagacttaagagttaagcgactcactgaaggtcataacacagaatagaagaactgagatgtaagccaggatctttagagttcaggcctttttcatgacattgcattgcctcccatctaactgcccacagaatcttccatagtccaaaatggaaaagcaagaagcagtggccactgctacagcataccactccacctgatgccactgttgaatttgaagcaaataagtgctccagataaaggcactaaataggttaaagaaaatgcaattaggaaactatagccttttatctctcttttaaggaaatgcagtgacaagagagatcctttggctaagggcaggtaggctaagaggataccctaaagcagtggttcctcagtattgtccaccttggcttcacactggaataactgaggagctttaaaaaaacttcatgcttttatcccaccctagagattctgaatttactggtctggagtcttgggaatttttcctattggatttttaatggaacttcccaaggattttaatatgggacaagttcaagaacca

SEQ ID NO: 47202 - DNA, 1671 bp, Bovine  19866880553673
tttgacctctgcatgtcctctttggaaaaatgtctattcgagtcttcagcccatttttaaatcgggggcttgtttttttgatattgagtcatatgagctatttatatgttttagatgttaaccccaaacatcatttgcaagtcatattgtttgcaaatattttctctcattcagtgggttgtcttttcattttgtaatggtttcctttactgtgcataattttttaagtttaattaagtcctagttaaacctagtttaattaggtttaatttgtttatttttgcttttatttctcttcctttagggaacagatccaaaaatatttttctatgattatatcaaaaagtgttctgcctatgttttcctctaggagttttgtggtttgtggccttacaggtttaacagtttttttattcacttgcttatgcaaatgggaacttccttctctgtaagaattttgtgctaatcgattgaaaacatacacacacacacactcacacaacacgcatatatgttcctttgtcactaagagaacagtttaccaacctgtctctttgatggtcctcttgtctagcctaaggaaacaggagagggggacactgaggatgctgtgtgtgggcataataaaaaattcctacgggggcacaagaacttcactatagacgtcattaaagctgttatccttagaggaactggcaagcggcagatgagttgtcacaacttgattctttgatttctgtaacaggaatgatcttggcacagtttacaggcagcaaactgtgcttagaaaatggtggtgttttctcctatgtatcagaatagataaccatatgaaagatggtgtgatgaagagaaatgttatacctgttaccaagtgtatgttactttaaactctttccttaatcatattcccccaaactaaccaatagtacttttattaccttacatagatgagtattatttggcaaattatgaaacagtttgctacactttttaaaaagttaataacacagcatctgattctttttaataaaaattttcttcccttgaatgctttcattatttttgtctttagattataaccagttgttctttccactgaataacccagcttttctagtttctggttccatgtaactggagcccagtaggcttaattacatttgaagatgacttaagtagatgaactttgccttagcttgaagatgtaagcttaactgtgccttgctatgcattagctgcctaatcaatcaatcagtgggctacatgtgctgcagaagaattcggctgtgtgttcacgtgaaaaataatggaactgggtccaaaagaatacccagtggattctcaaatcattagttttggattaggtctttactttggcaacaagtgtacaaataaacaagcatgactgaaattaatttattgcattcaaaagacatctgtaattctgcagttactctgtgagaaagaattaaacaatttcatctttgaccacttcccttcatatttcagctaaacaaacctctccttcagatcctcttttcagctgataggaaaacaaagggcctcataaataagcctttgtgtttataaatattaatacatatcaaaacacaaggatgacattaaagtgtcagaaaagccagtttagagacaaattatagactaatg

SEQ ID NO: 47203 - DNA, 1541 bp, Bovine  19866880572634
tttcctgcccctggctacaatattttcaaaatatgaaatattcatcaggaataatgaaataggtcagaagtgggggcaaataggctatttcatgtaaaattccaagatcatgttcaagtctctaagtttcaatctccattactaaaatcagtgttttctcagtacatctgttctgcttttctttttctttagtgtcacatacattttaagagactcttgctctacgtacacagcgatccaataaaatgcatttcaaatggttcaaactggcttagcagccatctctagaggttaaaattttgctttccaaggctccctcacccactaaaatagaaacaggtagcataaagcttacagatgatggaaaatgccagatattttcccttcagcctaaagtcaaagagtgaaacacgtagttccatggacaaaaacagaccccagaaagcataaggcccaacagttccccctcagggcatgtaaccactgagccgcaattgacagacaaggcctgcaaaagttcagtgatgctttcaagttgaaagaatgaatgaatgaaattaataaatgaatgaaatacaagatctctatcagctggtgcaccgtgccttttactgttccataatatatggatgtctgataacatacagaaggaatatgaaagatagctttatgatacatatttggaaattagaaaatcagatctgtgattttctaagaaaagtgaacaaagtttagttcatgatttgtactttgaagtaaacgtaagattgactgacttgaaataaggcatctctattttattttgatctggaataagtcagctattatatatgatttacttgccaacatgtagaaggaatgcttagtgcattctgactctcgaactgtgatgtttctttgaatcttcctctcttgagttccagagaaaaaactccgtgatatctgccttagagaatctaatgtgacacggtactgcatatctataaaaataaaaaaagaataattggcagacatgcttatttggggttattatcatatgatccagctcattaatattatagaaaaatctctagaacaaccagttaacacgttattcagcatcttcacactactgtagtacaatggtatgtgaagtcatgaagataatcttgaggaactctaaagaactctccaagtttgcaaggcttttaatgtttaattatacttattttaaaatgtagatgtatgtttacacacacctacctacatactacctaatttcttgaccatgtgggtatgtttactgggttttcacttagttttttttttttaatttagaaatgttagaccctgtttagaatattgactgtgttgtatttcaacagaggcaaaaatatacattaatgatattttaaacttacattataaaagatgtcatttttgactatttaaaggatataataaaataagctaaataaatgaaagttaaaaaaaaataagcataccacgataaggaaaacaagttaggccttatactttatatgaaggcagcaatcttattt

SEQ ID NO: 47204 - DNA, 1486 bp, Bovine  19866880599831
gaagcaaaaaacaggtttctgaaaaatcaacaacaatctcagtgttgtaggcactttccttcttgtttttcagttgtactgaaaatgttaaccttttgttttggttgctgacaatgaagggctgttgtctgttaacagtaaaaaggagaaaaaaaagtcattacagttttgttttctttaagtcagcattcaaatacttcactcatttaaaaaacaaattttggatttactatttagagactgagaaaactgcttataacaaattatcttcatagtaaaataatattggcaatgaatgaataaatcctattgggttttcttctttgttgcttttaattacattgcagaaaaagacaccattcaaatataaatggttttatatttcttagtgcttacttctatatggatgagagaaattgaaatttatactctctatattgaagtataattgatttataatattagtttcatgtgtacaatacagtgattgaatctttttatagactatactccattgaaagttattacaaaataatgactatattttgctgtgttgtacaatatagctttgttacttatctattttacatttacataatattgatagtttgcatcacctaattacatacctctatcttgcccctccttccttccctctgcccactactagtttattatttttctattttgtaatatacatttgttttggtttttagattctctatatgagtgaaacagaatatttgactttctctggcttatttcatgaagcacaataccctctaggtccatctacattattgcaaatggcagaattttatcctttttatggctgagtaacattctattatatatataaatgtgtatacataaatatatatatatacatgtgtgtgttaatcctttttatggctgagtaacattctattatatatacaaatgtgtatacataaatatatatacacatgtgtgtgttgcatcttcctttatccattcatctattgatggacacttaggttgcttctgtgccttgactattgacaataatgctgctataaacgtctatcttttcgaatttgtgtttttgttttctttggatgcatgtccaggactagaactgctagatcatatgatagttctatttttagttttttgagaaacctccatactgtttcccatagttggctgcaccagtttacattccgaccaacagtgtcaaagggttccattttctccacatccttactaacatttgttatttatgttctttttgacgacagccatcctgccaggtatgaaatggcatgatacctcatcacggttttgatttgcatttctctgatgattagcactgaagagcatttttttatgtgcctgttggccacttgtatgtcttctttggaaaaatgtctattcgggtcttctgcctattttttaaatcaggtttttggttttttgacattgagttgtacaaggtgtttgtata

SEQ ID NO: 47205 - DNA, 1613 bp, Bovine  19866880622107
actgactgagtctggtaaaatactaaaagatcatttcacctttagcaattaataatattcagaatatctgactagcaagaaacatttaagaagctggggagttgttaaattttcaaactagtagatatgctcttcccttattaaatacttaattacactttataagctttaaaattgttttaattgcttctgtttaagggctgttatattaatttaaataaggtaggacaaaatatcacaacagttaaatataacatttactacattaatatcagcttctctttttccatcctttccttatctagccatctaattttctatgtcaatctgtgcctttaattttggttttcttttcaggtttcactaagttcactataattatgtgcatggatttagtccagtctataagttggtaaaactaggcttttccatgttagagtatgctcagttctatgtgtaagaactggaatttccaagacttggatatatacctaaatgttacaccaagcagtggaattttttgacaatctaatgtagaaagcacacaggaatatatggctatttctaaagtgccctgtacaatttgtccttaccattgtcaaatgtcaataaagtagctttgccctgttattgttatatctttatagcaaagaagaataattgaatgagatatttgggaaacacacagatgtatatgcatgtgtgtgtatgtatttcaaaaaacaacatgcatttataataactttatttgtaaataaaatatatattcaaagacctcttgtggaagatggcaggacactataccttaagttccaggttatgcttttcaatgtgatttttaaaactataacaatggtgacatcctcaaaatgaaatataaaccatacttttatttaataataaggtctttaatctgcaaaaatgcagattcactttcatttatcaatactaaagcaaatgaagtgaaatcagtttaataattttttttacctttgtaatagtaaacaggtagactcttccttcctctttctttaggtcattcatgtacattggtgcacctaccaagagcacatctgtaatggtgtccttattcacatcgactgcacacagcacactaccaaaataggagccaatctgcaggaataaagcatatcaacattagggttcttctactcttagtattacactaaatttttatttacttagtcaacaaacaaaaattgagcatctgttgcctgtaaggtgctaggaacataaagacataacatcaccccttctctccgtttgtgtcacaatctaacacttgcttcttagagctcagggtacacaaaagtcaccaaaaaagcacctgtaaaatacagattcccaagagccatttccagagactctgatgcaatgtctataggcaatcaagaaaacagtattttaagcaagcactccaggtatttctgatgctggtgggtaaaagaccacacttaaggaacacttagaagctttatgaggtgttgtagacaaaggcaggcagggaagagggaggttgaacaaataacagggcttctgtgataaaacataaaagaaagtgaacgtgtagtcactcagtcatgtccaacccc

SEQ ID NO: 47206 - DNA, 1746 bp, Bovine  19866880630103
gatgtgacccataaagtgggcagattagtgttcattcttttgtcctcttaacatgcaagactgttcctttcctgaaaaataaagtctgagtccatagtttgtagtccttgccaaggttctctcagcacaaacagctcccaaactaaattacacaaaattctgaacatccctgtttacctccaataaatattctcccaagagtgcattgttaacatgcataaagcaatgttctgcttccttttctctcttccaaatagtttcatatacatgagtcttcgtatgttgctgctgtgatgttaaccctggaaactgtgaatagatgttgatgaccttgtaaaataaacaaacttcctatggactgcatcaaaactcagtgggctactgctcattcctaagggtaacctcccaatatatttaaattggacagactattggtctctagggttctgtcaaagcattctacttggactccagcaaaaaaaaagtggagatagcaaagactcttctgcactgatttcctggccccactggcgtcaaactgaagaggtctaaatgaacaggcctgaatcctcaaaggatctacatcactgccatgtttccaatctctttttgtacattttcatatcatgacttggtctcatacattaaagaatttaaccacttcaaaccacttctccttcagttcctactagctctttcaatttttttcaccagcaaacatcctcaaaaggcaactactaacttctccaagcattctgactatatcgaaagatatttccaaagattacaggcttatttatcaaatctactctgctgtaattttcatattgtcttcacaaaaacaaactgactatgtatattacaaaatcatgctgataacgcaaaaatccaaacactttgaacagtaataaccacatacatacatccttgattaatatcaggatttaggcagcagcaccaaaataattacacaagacttcattcattcattaaattccatcaaaaatacttcttagaagattatgtctcatgcattatgcaatgctcagaaacaaaaataaattactgattttgtcttctaaaaatatatagaataaaaagtgatgtgtaaataaataaatgtagtgaaatgtgacaggtgttatgattgattttcaggatacaatgagatctcaaaggagaaaataatcagtctcatctttaagagaagaggaatgatattatataagtacaattgaaaatgaaaaacacacacacagtcatatctactctgattagtaacacattaaaaacttgatgtggcccaatttaagaaaaaaacataatttcaaaattgccaattatttgtataagcaacagaggatgtcaaaagataaccctgctagtccattcatactattaacctaatatcttatgccaggcaagacacacagaatatggaatccaaacattagaaaggggggactgaatgtcctctgcatgattacataaagtcctacaggcagtaacattgacttgaggaaaatttttctctgcttcaataatgaattagactataccatctctgagaattatgatttgatcaaggaaatgtgtgtgtgtgtattctatcccaagttaccagtaggaaacaagaagaacaagaattgggggaggaggacatatctttatcacaaactagcagagagaccctgaagtaagcctggattgggacatgggattgccacatatggtgatgcaggctgt

SEQ ID NO: 47207 - DNA, 817 bp, Bovine  19866880688697
ctgttcccgagactttcatcagatgattgtccttggactgctagagctgctttgccccaaaggttccaagagtcagcagtgtctggacttttctccctcctcatcccttgccctgctccacaggcaaggcctgagtgcaggcaatgcaggatcgggcccttgacttaacctggagccccttccagacccagcttcacctgacgccacatgcttgcttgcactccatggctgctctgttttgctcccccaaatcacctcctattttcttttggaagcactccctttgtaaactgctatcacttggctcctgctctcagagtttgcgtctgggcgattggatctaaggcagttattatctacacttctgcattctttcttcagcccaggccagacatcactgactgccttgaacctggaccatggcaatcatggtctctgcactgctgatctccttccctccattcccactgtcttcaaatccttctacatagtggtggtagataaactgtgttaagagtctgcttctatcacatgccttccttattcaaaaactccaataactcttcattgcctacatcaatgactttgaaatatactttaaaagagaactgtaattctaattaaaatagaaaatagatacaacttcaagctgcttcttgaaatactaggcctataggttaaaattcagttttccaccccctgagtttcagccacccaaccatctggccttaccttctctcatcatcctcatcttcaggatttacccagaccaaatgccctttcttatccctgcaactaagctaagtcctacccattt

SEQ ID NO: 47208 - DNA, 1101 bp, Bovine  19866880718716
aatgggatataaaaggcaaaaaagagtttagctatttctatctttattaactaagtgtatcctaaacagaatccaaacgatgactccatagcaatgaattagtttttctttgcaaagttttgatgaaatatttgatcatatgataacacttaccattacatcattgaaacttgagataaatatgaaagaacagtatagtctttaccatttttaaactctggtataagatggctttgatattgagttcaacttatatgacttatatagttaaatttctctgtaccttattctgcgtggtttctgacttaaaactctgctggcaaaatcctcaaaaacatttcccccttgcccttttgatacccatcttattcagcagacctttaatcaattcaaatgtttgtatcacttggctgccagaagaagggatgcaattgcacaagatagtgctacttaaaatttgagataattttcatttttgtgcaacaagttatttcacatcgtttgtcaattcttgtgctacctcaccaaaggagctattccaaattatctttcttctcaagtactaggaccctgctgccttcctttattttagcaagtgactatatcaggcaagataacagagaccacagtaggtattttgacagaggaagttgaatgtaggagatggttacagaggaattaaaaagttggaaaagcagaaaggaaatgtggatataatactacagagctagtaactgcgagaaacagctgccatctcttggacttgggaaacgaaaggaaaaatcagggtattgaatttagaagcttataggagggactctgtagagtttagacctccaaggagggagtatgatctagatgctgccagtacccctgaagacatgcaacgaggctaagtgccaaaagaaactggagaagaaatttggaaaatacagttgtagagtctcaatgctagcaccatagaacataggatagaaggtagtatttgaagagacagtagccaaacaagtagtatagtccatccttttcttcatgtctttgcctggttcttaaaaaagcagaccttgagacaaaggcttatatgctattatctgagtagta

SEQ ID NO: 47209 - DNA, 2199 bp, Bovine  19866880730324
ctgttggcatcctgagagctgaacttattactttttgtggctacacagcacgggagagctgcatatggaaaggcatattgcagttgcaaacagagtgggattggaccctatttaagtgttcacccagatatacgacatatgaagtctttggacatgtgagaatcagagggaatgttgtgtttttgttaatgaaatcctttcagtgaattttattaacttataaataatttcttctcagtgaaacagtaagtcattgccaattttcaagttatttttgttagtatgtacagcaagtactttccagggccagaaaaataaagaggtagtacacactataaaataaatggttttcagtttacctagtagctttaactggcaattttcaattccaggctctaagagattccatattgattcttttgtatcatttaatgggacaatttttctggatggctttgttgttggcttttgaaagccatacacatgtccaagtgtgtgaagcatggttactatttcagatacttccattgtttctctggggacagtgagtttatcccactttttttatgcttatttggttggttgatgtgtttaataatgggcttctcaagtggcactagtggtaaagaactggcctgccaattcaggagacataagagacttgggtttgacccctgggttggaaagatcccctggaggagggcaagaatacctgctccagtattcttgcctggagaatcccatggacagagaagcctagcgggttatggtatgctgctgctaagtcacttcagtcgtgtccaactcttcgaccccatagatggcagcccaccaggctcccccgtccctgggactctccaggcaaaaacactggagtgggttgccatttccttctccaatgcatggacatgaaaagtgaaagtgaaaatataggatcacaaagaggtgaacatgactgaagcgatagcactcacacacgcatgcttaattactccaatgaaaattaggcacttgaaaatcattcctatactacttcatgcatatactacttctttgctttcctgactcattaaactatctgttctgtatactagcaaaaataacttaggactagcattgctttactggctcatatatttcactaagaagaaattatacgtgagttaacaaaattcattgaaaaggatccgttaagaaaagtacaacctattattcaggttccttcttctaaggcatcgaatggacagaatgcctatggtagctgggtaagactgaaactgaatcagataatataaaaagagtgaaaaggcatcctctttttttttaattgtacaatttggagtttagaactaaaattattaaaacacacctctgtgtaacaaaaaataacaggaataaatgtaaaagaataatcataaaaatttcaaatatatcttgaaatcatttatttagattattaaaatgtaaagatcaaaagtttaatgctttttaaaaatatgattgtttataatctaacagacatccttcacttagtgaaattccaacgtgaaaaaagtcaattaaattaggctgtcattatttagattggaaagtaatcactggcattatgagtcagctataatattttttcaaagaggaagaatgcctaggcttttaaaaatgttgtggttctttatgcaagttcttaagaacacaatcaacacatgaaatgaagtctaactacattttagtttgctgtggatcatgaatggctattaaatgtagcttgtcttaacctctcattaaaaaaaaaaaccttgtcatattgctcagaagcagcaggcaaagtgtgtgtatgtgtgtgtgtgtatgtgtgtgtgtgtgtgtatacatatatacttgtttataaaaaattaagaaaaaatacagtaaaaaattaagaatttaagaatatttataatattctttttggaatacaattatctaaatgctttctgggtttgacacacaagtggtcaattattaacattaataaattaagggcttcaagaagctaacccactaagtatggtatataatatatataataaaacactatgcaaacttcaacagtatattgcaaccaaaccccaaatcattaagaaaacaattatactacacttgaaaatcattcatatattacttttatgtatatactacttctatgctttcctgacccat

SEQ ID NO: 47210 - DNA, 1230 bp, Bovine  19866880788878
tgtgttaccttctattaactcatcccagttttagtgctaagtgattagtgaagtgaagtgaagtgaagtgaagtcgctcagttatgtccgactctttgctgtcccgtggactgtagcccaccaggctcctccatccatgggattatccaggcaagaatactggagtgggttgccatttccttctccaggggatcttcccaacccagggatcgaacccaggtctcccacattgcaataaatgattaatgtaaatgatttgggagtcctgaagaaatgtaggcaaatttctctatcatcctaagcctccttctcctcttctgtccaatggtaataatagtggtatttgattgtaggcttgttagcaaattaaatgagatggagtttgtgaggtgtaacacacaataagtatactatgtagctgttaataatattaaaggaaaaattctctgttgttggtacatgagaaaccagaatttacttttgacctctgattattgtctgtgtatttttcccatcattttctccccatgttgctcctgaagccaccccagtctgtttgctgttttcttttaaactttggttaaaaataagtgtgattttgctttacttctagtacatgaagttccaagataactgaagatagtaatgtgaacattgtactaaaatttatgagaagctacttttattgtttatgcgctcctttaaatcgaaagaacaagatgtaaactatttttttttaatgtcatctcctgtgcttcaggctccttggtgtcttagaaaacatgaaagaaactgatttacaatcgttttgggcaaattgcctgtggaattctgaggacaggaaatgaaaaaaaaaagttcagcacacacccccggacattccacacaacatgtagaataaacaaacaggtccccagaaggaaaccaaaacttttgttcttatatcgagaagcactatgaatagcctttgggaagcatactgaagatggggcttcccaggtgaccctagtggtaaagaacccgcctaccagtgcaggagacatgagacacaaattcgattcctgggtcaggaagatcccctggaggacagtgtgggcaacccactctggtattcttgcctggagatcacgtggacagaggagcctacagtccatggggtcgcaaagaaccagaccccactgaagtgacctagcactcatgcacacatatactgaagatgatgaacttcag

SEQ ID NO: 47211 - DNA, 1019 bp, Bovine  19866880807753
attgaagaaataaataacaataaagggaacaccttgtgttccaacccattaaaaaaaaaataaaatggtaccggtacctctgaaattctctgtatcactccatactctatcctatccacttttatcttgtgccccccagatagcaccaccatcctgaattttgcatttatcaatgtttttctttctgatgttgctaaacatgtatatattcctaaaatatggtttagtttcacagggttttgaactttatataaatggaataatactattatgtgttctacaatttgcttaactcaatagcaaatttctgggattgtttttctctctttttttatttgtagatccctttccataaagactgtggtgatgatggagtttgcatttctgatctagttctaaatgttcagcagctgccagccactcagtaagttttactttaaagtgcagtgaaaattgttgaaataaaagacatgttagattactttattcaaatgattgtgtatggaaatttttttctacaaaagaaacatcataactcctaaagatccttaaaatctaaagtatctagaaataaacttaaccaaggaggtgaaagacttatactctgaaaactataaaatattaataatggaatttgaaaataatcccaagaaatggaaagatatcctgtattcttggattagaagaattaatattgttaaaatgtccacaccaaactacagatttaatgcaatcccactcaaaatatccatgacattttttacagaactagagcaaataattctaaaatttatatggagccacaaaagactccacattttcaaagcaattttaataaaagagaacaaagtttgaagtatcttcaggttatgccttaaagctacagtaatcaatagagcatggtttgggcacaagagcagacgtatagcaatggaacagaatagagaaccctgaaataaacccatctacttacggtcagttaacctagaacaaaggcaagaatatacaagaagggaaga

SEQ ID NO: 47212 - DNA, 996 bp, Bovine  19866880810187
ctttgcctaaacttgggctgatgtttgaattgctcctcttttgtctgtgattatttcaggaaagaggctttcactgaagcccggggtgcccgaagaggggttaaaaaagtcatggtaattgtgacggatggagagtcccatgacaaccaccggctgaataaggtcatccaggactgtgaggatgaaagcattcagcggttttccatagctgtaagtatggggctggagatggctttcgggctccagtgtgtgcatatcatgattattttatgagctatgtaagcaaggttggaaaacagaagtgtctccgtttggaagtaaactctgtggaggcaggattaggtcttgccccttttgtgtcttcaacatagtgtcaggcgactggagactcagccaacaatcactacaagaaaggaagggagaaaatgaggaaaggctgaggagggagaagggagaaaatgcataagaagaagcaagcgagggagggagagagaaagaaagggacagaaatagggaggggaaaagtggaagagaaagggaaaagatggagggatggagggagaagaacatatgccttcagccttgggggaagggggtttcttaaattgattttttatttaatagagaatgaaagatttcagaactctaaaagttcaaccaaaattgcttttcaacaaaatcctttttatttatagttcagttcattcagttcagtgtctcagtcgtgtccaactctttgtgaccgcatggacagcagcattccaggctttcctgcccatcaccaagccccagtaacaacagctattacccacaatttgtttttcagcatttagtcagtgatatttccctttttcctttcaaaagtgtgaacagttgaaagacaccccatccaattgtaggtagggaagaaaaagagattcatccttgatgaagtcccagaacacacaattgagtcactgcttccctgaggcaaggtgcctatttcttttttataac

SEQ ID NO: 47213 - DNA, 3682 bp, Bovine  19866880825762
taaaaataaaagcaccttgagtagactatcctgagaatctttagtagatcaaagctctacaacctaaaagtaactaattaggtgctcctctaaagtaaatacaatttgttctaaactagcaagaaaaacccagcttattacttttaacaaggttggtttaacaagtttcttaagaaaaatagattttaactttagcctcagggaagtcttctaattactaagcaatcatttaaaatagcaaataaacttaaaaattaagaaaaattggaatgtgggggaaacggcaagaaaaaggatcatataacaaagtgtaagaatacatcgtgccaaattaaacaatttaaactgaagataatgagatattaaaaagcttttcctaaggaaaactacttcaaagcatgctgtatgggatttttatgttccatcccaaagaatatataggcattctttttaaatatacaaaatgtttctaagagctgcgaataactcataattccaaaataaaattatcccaattaataatatatggagattatttccttttattgttcagtttgaaaacatgtcctgccaaccacaaatcacctagagtgaccaaaatacatgaaaaacccctgtgagaaccacaaagtgccatttttgcagctttcttcacaggatgctgagaaaatgtaacagtgaaggagtgagaaacaggttgtctcaattgttagttgcaatcattcatcttcttcagaactggaatcattctcttggtcagagagttcagggacaggaaagcggaggatggcagctattccagtcaactggctgagctgttccccagacacgtgaagactagagaatatcctaacggtgcctgcgttctctttcacgctgtcgaccagccgcacatatcggctgcgtgtggctacatcctggtgccggaagagctcatcgctgatgagcaatgtgtcaattgccatggcctcattggccttttccacctgcttgagtccataaaatgctcggtccggttcgtgttgcaacattttatagaaatcatccaaggcctttacttccccagcggctttcgtgtctgaaaggcggctagctactgtagggtcacaaagagcctctttcagggagtacttgtgtccagaggaggcatgtacctagaatcacaattataaaagttagataaaagaatctcttagggtatccgttaaactgcccacaatgacctcaagccaaaaacactactaaggttttatacgtttaagaatttaaaccaagtttattacataaaatctctagctgcttaacaggtttcttttcaccgcattatccaattcacaatcccagccaagttaaaccttttttcctctggtactattctgagttctaaaactaggagtagtttaagcaaacccctctgcccatgtttaattatccctgggtaagactgttttacctgaaggaatttggaccggttttccaggagcactttgttgtcggtcttcactgcctgttgaaacatgtagtcgcagaactgctccctcacaaatcctgggctggccactaggacgcactttacaacatcgaagtgtatgtggcgctggatggcctggaccacctgttcatagaaccgctccaaggcccggtcgtgctgcgagcagttgcctttccgtttccgaggggatgttcacttccaccttggcccgagtgagggtcatgctgggagtgactaagcagatgtgggcgaggccttcctgcataaccacagccgccacatcggcgctccaggctgggtcacaggcttgctcgatgcgctccagaaccacacctgtcccactgttttttggccagggtgaactggcggttgggctccagctcgatggtgtggtaagcccccatcttgacatattcattctcctggatgttggtccccttgacccgcagctggcaggcttgggagtcgaagtcgatggcctccacgcagagagtgagggtcgtgcggacccggttgcttcccacgctgccggtggaggactcggtctgcaccttgcggatggtggaagcgcgcaggctgtcgcccacctgcactagattgtaggtgtgccacatgtcctcgggttcctcgggaaccagggtcacctggcccgcattgtctttctcaatgtccttcctcacgagcttcatgaccctggcgggggctcactgccaaaacaagaggaaccgagggggtccccgcggaaaaaggagtcgggaagggaaagaaatcctaggccgggaagggggcggggcccggttcctcccggcacctgcctcgcgagaaggaaacacgttatatccgactctagcggccgtggggtggggcacttactctagcccttccttttcgtagtctcgaggcgcgccgcgcaaaatcggctcgagaggcaccgctgcgaacacctttctctccgcggttcctgctgctgtacagaccaaggctgatgcaacgagggcgcatgcgcagccctcctcctgcctcccagcgcacggcttacgtccccaaggaggaggcggggccgcagcttgcgcgtgcgcaggcgcgctaagcccggaggtgtttcccgaagaataaaccacctaaggaaagcacacggagtctttggtggcgagtctttggtattagtgctgaaactggacttcctaagttttttcttccacccctgtttgtgaagaatctggggagttgtgagtgcaaatatatatatatatattttaagctgtgtgcacaccttctccctatggataattctagttacggaaaagtaataacttatggaaaagtaaaagggctctgaaaagtgcagacttggcaccaagggccaaactacgccccgccttgctcctgcctcatccccagtcagacggtgcacgctttttggagctgctcagtccagaagctgtttcttaagaacgtctggtcacggggcatctgcactgagtaacgtgcccagctgctttgtgctctcagttgaccaagtgtgcacgatctgattaacccagatgttaaaacactgatcccagagagagaagaaaccatctgtggaatttacccctggatggacctctcagttgctttgatctgatgtcctgagaaccccagaagccaaggttggcagtctcagctttccgctgctcagcagcctgtgaaatgtttacgtaggggttgggtctcaacagtttaggaccggatcttcattgtcagagctgagctgagaccccaggactggggaagtggaggaaggactgatttaccctgactgaacagctgcagaattcatttgaaaaaaaaaatccataagtcacttaacattttgggatgaaggagaggcgggggtaatttgaaaggtgggaactgcctcttaaaaggaccagtgaatcgaagaaaacccaccaaagttttgagagttaagatggcttggagggcagagggcacaaatcttccccattggccttcctatgttattgggtaaggcattggaagggaaacttaaccaccctaaaatgtaagactgggatgaaggggtgtaatatgactttggcacagatcttgatacccaaatctcaattaacttcctcaaaggttgtctggggggaacacaaaggtcccctccaaaactctaggcaaattagaacagctttttctttt

SEQ ID NO: 47214 - DNA, 1000 bp, Bovine  19866880839498
gaaactgatagatgcctgattctgaaggttttgaagattgaagtcgaagttaatagtgaaagtcacctatacacaaaatgaaaactcatcaatctatgatgctttgtactcagggaccaacataaaaaaaaaaaaagtgtcccataaaagttaactcactcccatttgattctgaattttatgaaacttaagctttctaatttgtagaatatctatgtatttttccaccttgcctcaccttcagaacagaactgaatttacttaacaaatacatacagcaggtctccctaatgactcagtcagtaaagaatctgcctgcaaaggagacctggccttgatccctgggttgggaagatccctgggagaaggaaatggcaacctactccagtattcttgcttgagaaatcccatggacagaggatcctggcgggctggagtccatggggtcacaaaagagttggacacgacttagcgactacaccaccaccaccaccaccatacttatcacaggcactaatacttgtctgaatttgaaggctttgtgctgatgtaaaatttgcttaccaccaggggttaacaaatgatatccgtgactatgtgtaaaccactttgactggtgttggtcaatgtgttcagaaaaaactttctatgttgtatgtgtctttggaaatgaattgcacagggggaaatcccacttttattaataatttaaagcatgcagatatttttaaacttcctttaaatatgcagccaattattttatggtgcctctcaaatgatgatacttaataaagaaagatggttcactggtgaattaacaccaatgatgagaaggggtcagcaagagatttgggcatgaaatggaagctgtaccctgttgtttgctctttaaagcagggtagcccacattgcaggtaacagacttctgagatgaagcaatctggcaggtcaccttctgtcccatcaaccctgaatgagaccaaagaaacaatgatcaatt

SEQ ID NO: 47215 - DNA, 1199 bp, Bovine  19866880859637
atgctgaaggtgaaactccgtactttggcccttgatggaaagagccgactcattagaaaagaccctgatgctgggaaagactgagggcaggagaagagggtggcagaggatgaaatggttggataacatcactgactcaatgggcatgagtttgagcaaacactacgagaaaatgaaagatggggaagcctggtgtgtagcagtacatgggggcacaaagattcaactgaacagctatgaaaaggttggtgtgcttgggacactgccactaggaagcaaagtggttcaagatgggaaggacttaattggtaaaaatcaaatgcttccctttaccatagctagggctggagtcttgactgtattaaattggtgtttatcaggtgctactgcttataatcatgactataaattgaatcaaaaatatatagcccctagttctttcctgttttcttatctgtcactaactcgacttactaatccttacaaacacttgaaggcatttttttcctaccctgtggatgctactcacctgcttactaagactgcagtggcacctgagaatacgtagggggccgctcactaaccctgacacccaatcatgatgctcctcacagacttattgcaggaagtcagccaggtttcagggagatgaatatctgtctgtttccttctgactcactgaaatgtgagtaagtgtttggaacagacccttgtttgggagggagtgagttctcttcgtgtgagacaggagtctgtgctttgtctaagagtggctggagagaaaaatgtacctttctttgcttttgtgctcagaactagacaaattaacatgctggcatgaggtacaggataaatcaggagctatatttttccagagcaggcaacaatttcacatttcaagaaacaaagaaccaacttctgccccacattaagttttttaagagtgtaaaggtttcctgacactaaacagtttgagaactcccaccttaatcatcctaggaactatcctgtctaggggtaattttgctggttaccacattctgagtaggaaataagactaagggaggttttctgaaactctttgatctcaggatgccttggataaataaatacaaaaatgtgattaggtacactgtgaaacgttattcagccataaaaagcaggaaattctgccatttgcagtgacatggatgatgaac

SEQ ID NO: 47216 - DNA, 2665 bp, Bovine  19866880861721
gtctcttgtagacagcatatataggggtcttgtttttgtatccattcagccagtctttgtcttttggttggggcattcaacccatttacgtttaaggtaattactgataagtatgatcccgttgccatttactttattgttttgggttcgaatttatacaccatttttgtgtttcctgtctagagaatatcctttagtatttgttggagagctggtttggtggtgctgaattctctcagcttttgcttgtctgtaaagcttttgatttgttttaatgaatttgtgggggagaaaagtgttctccccgtcctactcctccgccatcttagctcctcccctatatatgctttttttaagtttctcttattctttcctttgcactttccttaacaccttagaattcagttaagaaagaattggggaaggcgaaggtgggatgatttgagagaatagcattgaaacgtgtatattaccatatgtgaaatagatcaccagtctaagtttgatgcgtgaaacagggcactcaaagccagtgcactggggcagccctgaaggatgggatggggagggaggaggggaggggggttcaggatgggagacacatgtatacccatggctgattcatgtcaatgtatggcaaaaaccactacaatattgtaaagtaattagcctccaaataaaataaataattttttttaaaaaagaaacaaagagtcatagagagacaatccttgacagcattaacaaagattagagctaatgtatattataaatttactgcattatgctatctatctattttggaagacattttgacacttaataaagtcaaatccatgtgacaattggccactgtaaaacttaatccattgtattttacattatttgtttctctgttaaaagtattttgttaattatatgaaatttctattttttagatttgattatactaagttgctatttttaataaatcattattgaatattggtaatttcaatttaattctaaacacatttctacataaacctcattaccagagagtagctatgccatacctaactacatgaaaagagggcagggtttggagttcattttgcaaaggaaaaattttaatagaaactgtgttattcagaaaaattcttcattctgtaataaggatctaagtgagaatctgagtgcagagaggaagggtggatacacagccatcacttcctaccacaaatgccatctggatgttatatgcttcaatctcagaaaaattgtagtttgaaaaactgctctaaaacacggctagctctcattgtgactagctccttatattgaaaacaaattgtttgctttgcaggcacatttttccagcttaaatcttactgtaagggcagaacttcagagtgaaaatgcaacactagttctaagtgctggcaatcaaaaaagagaggtaagtgcgactccacgttttgaaaacattatacatttcactccatttgtgactatatttgctgatagtccctaaagcactgactagaagcgactcagcagcagcagcagcactgttgtcaatgagtggcagacactttctgcttcagattacacttgattagcttcaagtgtgatttcagtctccttttttgtgagaaactgggaaaaaccatgatatttactattaacatgccatgtttgactttattatttataaccatcacaggaaattgatgtttttattcttacgttgataacatatgatgcatctgtcattttcatccttaaaaactaacattacaaaatgcagttgacatctgaagagcagacttgaaaaacaatttctttccagaaaatgcctttacactgaataggaatacttgtaaatttatttttaaattttcttcatttagccattgggaaataacaaacaaaaaatgaagtaatattccctgacacaaattcatgctggagttcttcttaaaaataaaatggtttgtttttttctcttttgtcctattgtaaaataaggtcaaaacacctgttaaacatgtgggcagttgagcataatttccctatttatcatgagagtttaaatttttcatatggacatcatgagtcataaaattatatttaaaactaccaaaaattgagaagttttcattttttatttcaaattagtgtgtgttagtcactcagtcatgtttgactctttctgacatcttggaatgtagcccaccaggctcctctgtccatggaattctccaggcaagaatactggagtgggttgccatttccttcttcatcaaattagtatctatttaaaataattacaatgtcagtgacttctgataaggatttacctttaaagaatatatgcatcatttatctacatataatgtttactttataaacagcactttgcttgatatatgaaaagttgttccacatgtagaaaaactaaaattttaccagtaagcaccaaagaaaaagtatatattatattggaaaggatttggaaagagtatgtttggttactaaatacattttgtttaaattttataattagctttattttccctaaatgttacttaaattttcccacagagccatttttgctatattttattctaaagaaaaattacacttaaactgttaaaattactaaaaattatcatttcatagt

SEQ ID NO: 47217 - DNA, 1375 bp, Bovine  19866880877080
cagacacacacacaccataaagaaagctgagtgtcgaagaattgatgcttttgaactgtggtgttggagaagactcttgagagtcccttggactgccaggagatcaaatcagtcaattctaaaggaaatcagttccgaatattcattggaaggactgatgctaaagctgaaactccaatactttggctacctgatgcaaagaactgactcactggaaaagacctgatgcaagattggcaggaggagaaggggatgagatggttggatggcatctccaactccatggacatgagtttgaggaggctccagaagttggtgatgcacagggaagcctggcatgctgcagtccatggggtcgcaaagagtcagacaggagtgactgactgaactgaactgaaccttaaatgtagcaacaaaagctgttctcacgacattcatgatctgataggaaacaaaggaccagaaatttcgtgggaaatcatccttttgtaagattaccagtcaagatctgctggatttcaagagcattttgggttcagagaactggccatcctcttaggtgctttaacagacctgggcatcaggtctcttgatgtcagtttatcacttgcctagatcacttcctgtacagattccaaacctccacccatgctgcatgactcaggacagcatcagtgttatctgagctgttctgcaatagaaagggaaagcttgccacaagtgaacttcctgagtgatatttttttggtcaagtttgtgagaaacagtcaagcaggaaagaataacagggcaaccacatacaatggaacttggaggacatgttattaagaaacaggatttcaaagataagagagaaattccatcaggcccttagcgagtagaatctataaagatcacaacccacacttccttttttgtgctacaaattttcaaccgtctagagaaaatttccagacactgctctcccagcccccttctggtaacttccagagccttctgcttcatgctccacaccagcccttctttgacattcttttcatctaatctcctcattctaagtcacttggttggtaaatctcccaagggatttgaactatccctgctttcatagaaaaggacctcagcaactttaatttattattagataaaatcaattgtctaagtttttctttggtattcttggcatatgagagcttgctgacaaggccaacttcaaaaattaaatagttaatgaaactaaaccaaatgtactaaatgttgagccagattatgctgacattgatcaaatatttcaataaccatgcatgtggcttcagtaaagcttctagcatgcaaataattttttttaaattttagatagctttcagattcagat

SEQ ID NO: 47218 - DNA, 714 bp, Bovine  19866880892582
aatatgcagttcagtttatactggttagtaaatgtaatttacatgtacaagagtaggcaggcatagactggataaaatatttgactacaaataccttgaactaataactttaacaaaattaggagtaggctttcttttctaatttatattaatggaaatgtttaaaatgccttgaaaaaaaccactgagttatacacagaataaaaggctttaatattttaagaacagaaccttttgaagatgacactaattctctgtgctatatgggactcagatttctcaaaagatatttttgaggatctttattatgctagatagaaataaagcattaaaagcttaactggagacacataaatctatagctacaaaagaatttctttgtttttttttttttagaaaatgtgactgaagcactgaacttaattctactaatagaactggaatatttttatatattacgcaccctaaaaacagctgtaagcttgttaattacaactgctttaatgcagtaaatacgttctgaagcaaacaaaagtgtatatacatcagcttcctctaacccaagcagccactttggagggtgggaggtgccgattcccgtagctctgctgtcttctctctgcaggccttggtcagcttcacctttctctcatcaattgacatcctctccatttcacagcccagaatctgctttgccttccttcacgtaatcat

SEQ ID NO: 47219 - DNA, 1951 bp, Bovine  19866880974991
ctggtgggctgccgtctatggggtcgcacagagtcggacatgactgaagcaacttagcagcagcagcagcagcatagacagttgaacatatctgctattcatagcagtatcttaaaccatgaagttagtgtttatttctattaatataaaagaatcattcctaagtcatggcgtgaagttttcgtctccagcccaccccataaacacactggaaactgccattcctttggagggatagagaaactgggggctgttgaaggcactgttttgtgaattagataggaagggctcacttgtaggctgaaataagagttgacctttccctggtggctcagatggtaaagaatccacctgcaatgcaggagttgttgttcagtcactcagtcatgtccaactctttgcgaccccatggactacaacatttccaggctttcctgtccttcaccatctcctggagcttgctcaaattcttgtccattatgcaatgcaagagaccttggttctatccctgtgtcaggaagatcccctggagaagggaatggcaactcactccagtattcttgcctgggaaatcctatggacagaggagcctggcaggctatagtctatgggattgcaaagagttggacacgactgagtgactaagcacattgcacaccatcacctgcccggccatctctctgagaccaggatcctgcttgcagaggaaggactctgaagccagtcccagagaactggcaaagctttttccagtctcctcatttctggaaagtggtgtgtttattccctcccaggccttttcacttttattctgaattacaggaaaaataataatagtaaaaatctgtctgtattatgactggctaaacagatggggattttcttcgaagtaatattttcaaggagtgtcacctagcagctggattcctttgcctggacagaacttgctccctaaaagcaaaaagaaatggaagcacttggggtggtaaacttgtgtcagtttggaatcagtttggaacagtttcagttcagttcagtttaaaacctctcaaatccagcacattctaaagctttaaatgctatccactaagaaattatatctgaggaatttttccattaaacatttagtctggttcaaacctaataagatgctaatcttttcaaaacttgttttcccttatttggctttcttactttttgtaaaaagtcagtaagagtttaatataccagaactgttgaatacacagggtggagtagaacgtactctaggcttggtttccggagaactagatccaaacctggattccataactaagtaattttacaaacttgggcatcactaagccattgtgaacctctctataaagtgaagataatgccacctggaaatgtgctgtgtgcttagttgctcagtcatgtccaactctttgtggccccatggacagaggagcctgacaggctacagtccatggggattgtacactaaattatggagcctttatgtaagtactcagctcatgtagtaggtgttcaataaatgttaacatctgtggcctcagaggggatctggtcacaagcttcattagagcttcttctttcattaaatgtgaaatgaattttactcatagaaactaaaatagcttgagaagacagacatcattctagggtaagcagcagaaatgcagaactgtagaattgtgctttaattcactgaagattaaaaacaatgcaaaatcagaatagcatttatttcatctgccagaatcttaccctatttctttccttttatttgtttaagcataggagattagaatggtacggacatttgaagatctaaagtatttgtaaatatgtgtctttgcatatgcacattataacatacatatttttaaaagttgttccaactgtatttgggcagaggtcagcaactttttttttctgtaaggagaca

SEQ ID NO: 47220 - DNA, 958 bp, Bovine  19866881022307
catttgtgaggttcagtggtgctgccaaggggatgagggtacatgtggtgttgtactgactcacaatctacattgctgcctttcctaccactccacataagcaaaaataagatatctgttatacaaacacagcttcaaggtaagtttttttccagtcacattgctgtttataaaccccttctataactgaacatcaaagcccatggttggggtttacatttcattagaaaataatatcactgtgactaataacacacaatttacaagctattgcatgcactatcatatttcatggtttatcatatttctgacaccctcccccaaacacacacagttagagagcccagaaggatgcactgtgcatttctctgtactgatctgatcaataattctgcccactctcctatctcccttctggtcaatttaactgtgaatgtacttaaaaagaaataaaactaactactcttctgccttcctaaatccacagagaaaataccaaaagctcagcctctctgcactggagccaaatcgaatctcggagacaaaatttggggtaaagtaggaaagaatagcttttttgctttgccaggcaaaacaggacccagtgggctcctgctcttgaaaattgtgtcctaacctgggaggatctgatgaagagttttatagcaatagttcaggggtgggattgctgacaaaatgagaatgtgagcagggcttgcactctcttaatctcaagtaatggtctcctaatattgatgagattctctggtccccctaacttgcttcaggtggtttcttggccgcttctcccttaattagcaactgtgcgaatctgccctttggaactaaaagaaggtgatggaagttaggagtcttgcctatcagaaacaggtgacaaaaaaggcttccacacccaagagccccgccaggtccttctgggtttcaagctcactctcag

SEQ ID NO: 47221 - DNA, 1436 bp, Bovine  19866881030386
tgtccagtatcgtttgaattaaggggcagagctgacccaggagtacagtataatgacttccaaactgtggaatacactgtgcagggagattaggggtttgttgaaatggctaaaaatgtagattttggaaactctatttaaatttagagaatagttatagaaaccattctgagatagacaatacagcctttggggaaatacactgtttaatattgggtatttcagaaagaagcttgatatgtgcttaatcacaaacaagattgatggtagtatctgtcagtataagaacatacataggacttcctggtatgcagtgtggttttgttaatggagagaagagatgttttgtggcagatgcctgctagcaagaaaaaccattacttccagaagttaaggtcaggaaatgagaaagaagttcaaagaggtgaactactccagcgccatgagcaaaggtgctcatggaaacacctaaccttttcttgtgtgcggatgaggctctagagggaggtgctgcagagtgcagggtgcccacttaacaatacccagggtggtctctcactctgagggtgaagaggacatggcaccaggtttatgttgggagtttcatcctgttcttggggcttcctgaagcctagtgctgttgactgtgttgttgtagtgctgcatccacagacttctgtccaggttcctcagtgacctctactgtcagagaagaccttgtctggttgaactgaatggcggagacccctcaaacgaataaagaggcaaagctggaagaggattccaataagacctgcagatgctggatgtctccaaggaaagcgatgggggaagttagggctgtgtagtgaagtaggtgtggagggaaagggagtgctaagtagtcatcatgcttttactttgggagagaacttgataaaaactgagactgctaatgttcctccttttcccttcacttagggcaagttttaattagattcagaaaaattgcattcgttagaattcacttagacaacattctgtttagaaaagtgtgtggggtttagaacaggattccaaggatattcatggaacccttttgagcgagacaagcaaagagctttcttagttcttggaggagaagaaaggagagactagtactggtggatccacccgaatgacagaaagtcacacactttataatgcagctctcttcatgactgtgtaccaaggtaataaattcaagaagtacttgaacaggagtggatttttagtggcagccaatgaagagactctgtgtggaattattggagaacttggatgggagagcatgaagccagagagaaggatgagaaagttggacattacctgtaatattttgcactctcacagtctatataattggcaggcaagtttaaccagatttgtgatgtatgtatgtgtgtgtatatgtgtat

SEQ ID NO: 47222 - DNA, 1378 bp, Bovine  19866881038549
cttgtgaagttcccgccacgtgaaaagaaacatcaggaatgagaagtaagcatttccctctaaaacacagctaaagccgcatttttaaatctttttttggatccttttctcctccttacctttcctccagtccagaagtaacctctacttaaattctaagatccttgtgtgtaacaagtacttagtacaagtactagagttttgattctaagtaatagaatgcttccatgtaaggaaaatattggctgacagttcttcagaatattgactataacatctgtatatactttcatttcaagataccctaatagtcaaatggaaaggatatacaagataatgatactagataggaatagagtttgaatccaaggatattagtgctcaactattatgttctaagtgctgaaagttagaacaacatagctaagaaaacaaagtttagtgctatctcagtacaaaaaagaaagcatgaaaaaattatctcttttcactgaaaagaaaatgcacattctgctgaaacttgccttctgaaatatttcaacattccaggctactgagatttttttcaactcttataaacaaaccccaatgtccattaaaatattttctgattaattttccaaattttttcaggtgaatagcaagttgtatttgtttagcttccattatttcctcttgataaactagacacattttaaattgaacagaggtaccaagaggctactgaatgaagagaatgtttggtagtgaatgatataatggaaaattgctataataagtagctaggaagggacatagttatacagaaacattttagtttaagtggtagcatattattaggggcagagctgagctgtccagaaaaattggcctgttaaatggaataggagaatcagtaacgtcttctcttagtatctggaatttaaaattgccagttaaagctactaggtaatggagaacagtgtggagattccttaaaaaattggaaatagaactgccttatgatccagcaatcccactgctgggcatacacactgaggaaaccagaatggaaagagacacgtgtaccccaatggtcattgcagaactgtttataatagccaggacatagaagcaacctatatgtccatcagcagatgaatggctaagaaagcagtggtacatatacacaatgaagtattactcagccgttaaaaagaatacatttgaatcagttctaatgaggtggatgaaactggagcctattatacagagtgaagtaagccagaaagaaaaacaccaatacagtatacctaatgtattgtattagtaaattctaattgaatttaaaaattctaaattctaatggaatttagaaagatggtaacaataaccctgt

SEQ ID NO: 47223 - DNA, 2539 bp, Bovine  19866881049390
ggtgcctctcagacgggcccaagcccccctttgaaagtgggcatgaatcacaaagcccgcggccgccgcacctgcactgcgcgcattcggtgcagcaggctggtaaaaacgggtgacctcgccgctgcttttcgctttataattaccgtcccgaggactagagaggaggggcgcgggcggtccgggcggggtggggtgggggcgctggcttttgctcacttcagacggctctgggggctccacatccttcttaatctttccagatttattcttcctctctctcttccctcttctctctttccctcctgtccgcccaccccttctcttttctctttccctccctctcccccgactctgctcctagtctccccgcttttccctcccctctttcttttcccgtcttcctttctctcttccctccaatgcagcattaatgtagagttgtttagtgccctctaatggcagacgacattaacaattaatagcaaactgtcccctttgcaggagccgacactccatggcagagttccaaagttgaatttatttcttctttattcaggcagatggatatagtgcttatatagtaatgtgctgtagggaaagtttgttttctccctttagagtcccctttcccagggaaaacttggttgaaagaaaggggaaacctaacaattatttttgctcaactatttttttttaatcagggaggggtatgggtatagatttgtcttttaatagcagcaagagatacaacttctgttttatcaaagtttatcaaatgtgtatctagggttggaaaataaattcgatattttaaatatataaatgatcttagatagttggatctcatggtagtgctaccaatagccattaaacattttaagacccaaatgtaattacatgattttatattgtctcctgtttaagtatatttattggtcctgaatcttctgtagcctctggaagctgaaatttttcacttttgggccatgcaaaccatttaaattccctcctgcttgtgaagtcatcttgcctagaggtctgtgggatcatattttaatgcattgtttattttctcaatacttttgggaagatcgttttaaagaccacaatttcctcttattttataaccatatagcagtgaaaatagtgatgtaacttgaatgttctcattataatttaacttattcattcactatacatgtgcccccagaatatattgacataaaaagagcatacccagtatgacttttgggggtagtctatgtggctaaattaaaattagaataaaagtaattttgagggtttaaagatatttggatttttggtttattcagatggtttgtgtatttagaaacaactcatatcacaagacctttctgaattaacttaatccaaggtatgaccacacaattccagtatgatgggtaaaaagaaaaaattctgtccctattttattcttttttttaaaacaattatttattcatttctggctgtgctggatcttcgttgctgtgttcgggctttctcgagtgtctagtttgctcattgcagccgcttctgttgtttcagagcataggctctaggtgagtggacttccgtagctgtgtgtggcacttaggctcagtagttgtggcacatgggcttagctgcccccatggcatgtgggatcttccccagccaggggtcaaatctgtgtcccttgcactggcaggcaggtccttaaccactgggccaccagggaagtcccctattttattctttgtctatgtagtgccaagtgctcagactggtcatttgactaaactcaccacattgactagttgctttggcatcatgtgattgtctaggccaaagcagacacagttgcttttattgtaaaaaatgccaccactcacaggggtgaccaagcgtaccagaggagtaccagaggcagacccaatacaggattacttcttgccgaaaagaaggtagctctgccggtcagggttgaggtcataggcaaacacactgtggaaaacataagtgctgtgttgctttgcctttgtgaataagcagtttggtgtttgtttagcgatacaagctcatcctgtttttcagctgcaccttggatagtattgatctgtttgggagaatgtctgccccgaatcggcacagatcagtcatcaagattcttgttggcctggcgtaattttctagccaattgtagaaaatgagacacaggtcaatatggtctcatctgggcctcctgtgagcatcagcaaaagagtcatccaatttctggggtatgaaacggtatcacacctgtttggtgacatcacagaaaaacagctatttcttttactgttttatctcctataaatgttacattttgggtttgtagatgtctaaatgtcaaggggacattttaaaataaaagtgccttctttcatttgtgttgtatgcttccaagtttgacttcttatttttttccctttctgctctgccaaaaaagtaaatgtaaattatgagaaatacaataggaccactttgtaactga

SEQ ID NO: 47224 - DNA, 940 bp, Bovine  19866881078624
tgggaggttcagccacacagggcctgtttcacagcagccagtgggcaggagccacagtggtctgccctgcacagcaggtgtgggctcttcactcaccgtggtgtctacacctggcccaagctctctgcctggcccatggagacacagggtttattatttgtcctgaatagtgaaaatggaagggacaggaggagacatatgttcaaggtataatactgctaatgaggctggctaacaatgacatatcatttgctatttacccagtactgttctaagtgtttcatagacatagactcattttgtcttcacaacagccttaagttaggaggtctgatcatcctcattttatagatgaggcaggtgagacccgggtacctgagagacaaaaaatgaacttggccccttttttctcctggttgttctctggaaggacagcaccccttttctctggtttggtgggtcacctgatgggctcctccctacactgacagtcccagtgtccctgtcctcgagacgcctgccaccgggcacagcacgtctgccaccctctccttccccctgtgggctccagtgcactttctctcaaaggcgttgttaacttgttagtttcaagagttgatgattcctagtgtcttagaagggaaatgattcctgagcttcacaaatggcaaggtggaaggttaacattttctatgtattttgtcattgttctcattttttttaagacctgtggtcccctgtgggcacagcagtgtggaagtcagtattacacaactggcgtttgctctgatgtcagtcctgattttcagttgcggaccagctttgcgcctgcagttcagagtaagttatgaatgtgccaagggtctgagcaatgccttactttaaaagaggggaaaaattgtatcagcaagtgccattctctttactctgtcgcatttca

SEQ ID NO: 47225 - DNA, 1502 bp, Bovine  19866881082431
cgcctgggtgcccagaccccgggagaagcgaggggtgcgaaggcggagccactgggctaacgacaccccctcaaggtccagccctcgtccgcgttcctaccaccttagggagttggcgccgggagcgggatcaccctctcaatgaaaggcagatgtccctttaaggtttgcttcgcagctcgtggactttagcctaaacaaggacccgcgaagctggctttatttgtccatgtctcagacagagcctgggaggctgccagtgggatttcagagcacgaagagggggggcgatgtggcaattctgcgaggcgagtagcgtgaaccgaacttagaggcaccggtggaaaacacaggaaatcgccccgcggctccccgggcgccggggccgaccggccagcgactgagacccccggcggcgagcaacgcggctcctgcgcgcggttccgccgagtcctcgcctccgatcccgcgcgtcccccgggcgctgcgcccactccagtcatggacccccggcgccgcgccagcccaggggtcgctgtcgcctactgctggctcctctccggtgagtgaccctgcttttctccgagcatctcctgagcgcgggactccgggagggaggcgcgcagagcttcggcccggagtggagaagggagcgcggatccactttcgggcgctccagatagtccgggcaggttggagctctgaaagcagttttctgcgttgggttttcggtgtgaattacttctgaagttgtttcaaaaccctccgcctcaatgatggggggagaggtgctgaaaactttacaaggtggaagtgacttttcaaattaaagttgtttttgacagtatgcatggtattttaggactttgctgatggcttctactttcctttttcgtgtctgtgtgtagagtttctactttcaggttgctcaagagtggacattattcattttcttgctttatgtactcaagatagtttctgctacagaggaggaaagagaagaatgcaaggcaaagttgtctcttgtgctgaaatgatgtttctgtgttagcacccaggaaaaggaacatattgaaattgaggaagtagtgaacatttactttgagaattagcagaataatttttaaaatacaaagtaaagtattgttacttgtgcataaataggtatcttttgggagagacttaagcacagtggagatgcaagcttatgctcaatttagggggtaaaaaaaggtggaatcaaagcattttctaagattttccaaatcgttaaccaatagttagatcttttctaccagttactgactgagcaggaaaagttgcaagggtgaaagaaagagaaggcagatggctgaagctttgtgtgaaaagggccaataatgcaaatagtgtcaacttgggaacagctttacagtcagtgaatagctgactgtgtaagccactgtcactatcctttacacatgtttgagctatgcgtgcatgcatgttaagtcatgtccaat

SEQ ID NO: 47226 - DNA, 1093 bp, Bovine  19866881103661
ttttttctgttagttccaaggtcagaaattctctcagaaaacttccattttcttctagtttttaagattaactctttagttcacttggaagtatacctggatatgcaaaatattcaccaattaattgtccccagactacttgttaaatacagcattctcttttactctgatttgtggtggtctttacacagtgttctagaaactaaatgagagtaaatgctaacatgaaatgagtccagatcattgctttaaataatatcagagtagtcaatgattagcagaaattattaaaaacaaaagtacttcgtagctttgaaacctgctttctgaactagctgtacctatccagaatgtttctacaggaaggggaaatgagagctagaattctgttgttatcaacaaatacaaaacacatttttcaagggcaaagaatcgctgttccttctgccctctttccccaaaacattctgtggcaatatttttgctaaatatcttaagatgcttacatatcaacacattgttcttttcatgttggctctcctctagcataatttatccaaaattcaagtttgaacatttaaacctcaagatttggtttgctaggagggatggtcggaagacactgacttcatacttgagaggaatgaggatttgaaaagtaaacactcacaagaaatcctcctgttcccacgttccttgtcagtgtcaagccaaggctcatgttggttttcatctcagtaacattggacatgctcgtggaagctttcaaaggggagaagatttttaaaagtggttaaattatcatttaaagactttttttttcaatgtacattcaggtttatatgtagcattgagtttagtactcatggtgggtaatcaagtgtatggaaatgagatgtttcattgatctggctgctcacttaaatgagtgaggctgcagaatatgatcctcaggggtggggtctacaaaggtcatgatgattccatctaatgctttattctggatcagaaaaaaacattcttaaagtgttatcaaagaatgccatatggtagaatcggcccaaagcaacagtaagtaactttagaaaaccat

SEQ ID NO: 47227 - DNA, 1872 bp, Bovine  19866881128170
ttttcccttagactttatatatgtaagactccacacatctctctattttttttactccctttaaaaagggagtacaaaaataaagctgctgtgctggtagttttctcctcagctcactttgactttctttacaatctgtcttgtttaaccccgacttcatctctcagccctttcctgccttctgaaaactcacttaaagctctagcctgagttttcttaagtcacactctgctattttcaaagtacagacttcatctgttccgtgtgccccatgtttctaagaatgtattggcatattttgcacggggattttacaaagattttaacaaaatgatcatgagtcctttgctggttttatttactatacttttattacactgtggacttttactataaaaacagcagtgatatgctttgcaagttcttgaaactttttcatggtctcttatgagctggatgattttaaaagcaagattacctcccaagtagagctccacagtgctcctcttcctgtaagtaaagctgtggtctgttctccctccagtgtaggcaaagggtcaccctactttggagccgtcattttatatacaggatgttcagatgtaggtgatgcaatccttatcacagttgtacaaaggaccgtgatacatttaaagtcatttcctggaagcttgtggtgatatgtactgtttctgtttgtctaatctgagggcctgtctcaagaatcatctgaactcattgtatgactcaaaaatcttagaacactgcaatctcttatgtgacgaggactgtctgggaattgagggtatttccagttgtaaaaatgtattttcctgttgtagtgaggaccagtgcatgcttgtctttaaaaagagaaatataatgaatatgtgtcatgggcactcagttgctcagtcgtatccaactctgtgaccctttggactatagcccgccaggctcctttctctgtggaatttttttggcaagagtactagtgtgggttgccatttcctccttcaggggatcttcccaacccagggaagagttttcttaagtcacactctgctgttttcaaagtacaaactttatctgttccacgtgacccttgtttctaagaatatataggcatattttgcacaggggatctataagattttaacaaaatgatcttgagtcatttgctgggttttatttattatacttttgcatctcctgtgtctcctgcattgcaggtagattctttaccactgagccatcagggaagccctgaacatgtttcatagccaaaaataaaaacccttccatctatatatattatagattctactttttaattaagaaaaattgtagtaaagcattatgtgtattataaatataacagggtgtatgagatacctcttgtaagggaattttagataaaccatagagaagtaacattcaattccacacaaacagcaatgactaggtaatatagtatattggcaatatcaatactggtaaattcttagccaacacataatactcatgatgactaagagttttgtcaaattattacccattttataagtgataaaggggtgagacttagaaagctttgttagtcatctaagtttacagagctaagaagtaataagcatagggtagattactacaagcagcttctccagtggctcagaggtaaagaatccacatgcagtgcaggagccacaagagacaggtgttcaatccctgagtcggggaagatcccctggaggaggacatagcaacccactccagtacttttgcctggagaatcccacagactgaggagtctggtgggctacagtccatgaagtctcaaagagttggacacgactgatgtgacttagcatg

SEQ ID NO: 47228 - DNA, 1987 bp, Bovine  19866881171498
tatctctgttaaaatcatcttagaaagcttgattatgacatgttgcattgacatgctaacttaaaagcttgtgtatataaacagatttctctaaaaatgtaatcaatattgaacaatatgattctgtttttcctgagagatattagactttggtaccacctagtaaattaggtgttgcttataatatatgttagatcaatgcatacatgagtatttcaatgaatcttcctggtttataatcttctgaagtctttatcatagggttgttttgtctttcttgtttctttttttaaagttaaataaattaaaaaagaaaatatattgaggtatagggattacagaatatgcttcaaagtttttaagctgtaacttcagatttttaatctgtaactttatcaatttttatgtaactgtaaaaccttttataaaccttatatataaaatgaagttgaagagaatttgaggttaatttaatagtcagtatagcaagtagaaggaaagagggaaagagaaaaaaaagaaaggaaaaagaaaaaaagctaaggtttcctttccatacctaaaaggtcaaaatctcaagatacttttaagaatactgtggaaaagactgacaatcatcacattttttgaaacttcttaagttctgggcttaaagtcggaatgttgttctggcattaacaattggcatattctaatttcaactccttaatgttgttttccattgcttttacaaccaaaaaatatttttgaatacttcatgagttagtgtttttcagggtgattaagctacaccaatttgggggtgtggatgtaggaaatcagtaattggtatctcattcggtaaacatacccaaggcatcaattgtgattctcccctaattggcaaaatgaaccagttttataagggaaaaactgtgccttgctcattgagcatgaaatatgaccacagctgcttctcctttgagctaccaacaattaaactgggtcaaataagttccctttcattcttccaatcactttgtgcaagtccacacttttcagttaagttttaatagttgttccacagctttacataaggttaaactttgcagatttttttaagatcatgactagacttgtcttccccattttttctcgttccacatctaatgatttgtatttaacctaatattttctgcctgcaatgcaggagacctgtggtcaatcccttggtgggaagatcccctggagaagggcatggcaacccactcccgtgttcttgcctggagaattccatggacagaggagcctgatgggttacagtccaaagagtcagacatgactgagcaactaacacacagacacttgatatttcccacatgatttaatcaggagttcttgccgttcaagggctactgaaagggagagctttgggactgggttgatggtgatattaataactggagtatgatgtgcacacgaagacaagcgccagcttggatgactgaaggttctagggagtggacgtaggcagctctgaagtcctcaaagaaatgctttgataactgcagagttaaaaactggcagttcatgagcctgctagttcctgtgtgtttgtttagcatgtagagtgtttcaagggtgtttttttgttttaattataaattttcacagaaagtttttgctttgattctccttgagaatttgagaggttcagccacacagggcctgtttcacagcagccagtgggcaggagccacagtggtatgccctgcacagcaggtgtgggctcttcactcaccgtgatgtctacacctggcccaagctctctgccaagctgcctgcctggcccatggggacacagggtttattatttgtcctgaatagtgaaaatggaagggacaggaggagacatatgttcaaggcataatactgctaatgaggctggctaacaatgacatatcatttgctatttacccagtactgttctaagtgtttcatagacata

SEQ ID NO: 47229 - DNA, 1467 bp, Bovine  19866881248432
tgagttgcaaacggcaaaagcagaaactgtatctcaagtcatcatccctgaaaaattattcagtaactacagatttcaaagggccctcagctgctaaaataagtaactgaaaacagctgcagccgaagagattgctagcaccacattacctaaatgttttccttcctacctataatgctactttctcatcctaaatgctttttgttaatagagccttttcatcattccattctcccaccatggccaatgttttcagttattttgagatgaaataaatttaatattgaagtgggacttcacatttactaaatcttagctatgtattttttgtgatggtaaattggattcttagacattctgatgtttaaattatatcatgaagttaaaaaatacggagaattagcaagaataaagctaaagcggttcctaaacctatcatccagataatttgtcttaatatctttttaaaaagaaagatgttaaatgtgcatggatagaaaactcaaacatcatggaaaaatgcacgatgaagagaaatcatccctccgatctcctctggtcattttgtaatgactaattcggctgtttcagaatattttccagatacaaggtctatctatctactaggatatatgccacacacacacacacatacacacacagtttacttactttttggaaaaaaaaaaagttctacccaatcccaattattgagtatatcccttaggaaccattttgatagtatataagtgtgcaattatattttgcaaatatgatgggtggaaatagatgacagtggagtttatttctaaaacaggatctggcccactatagctaactgctaatgtaaatatattgatcaatatttaagtaactgatggaacccttaaggaacaaatgaaaaaaatgttggatctctttaaaatgcagaaacagagcatattaatcaatttgaaaactggccatacataggggctcacacaaagatctgaaaggcacatacagccaacctttctattttattttttaaattaatttttattggagtcaggctttctgttttaaatcccagtaagttttcccattttccatgtaaggctgacaaatcattatttcctctcatagacataaccttgacaaatactacatttatttaagtccctttgacatattttccttttaagaatttgggggaaaattctaaggcataaaagagaaaaaggcaagattttcagtaaagaaacgaaaggattctatcttgaaaatatccagtcctattttcttttaggaaatagaatcaatgtattataattaggataaactgtctgatggcaataaatattgcttctcagactcctgcccctgctatctgccctctaccccacaaggaagctgccctggttggaattcagcctcagattcccagaaatgagtgaagagagggaatggtattcagttacatttcag

SEQ ID NO: 47230 - DNA, 1663 bp, Bovine  19866881269273
ttttcactcttccctcatgtagttgggtcagtaatgttccacccttaattcgtgtccactcagaacctcagaatgtgacctgatttggaaatagcgcctctgcagatgtcattagttaagggtctcaagatgaaatcattctggatttagggtgttcaatgactagtgccttgacaagagaaaggagaaggcaatttggacagggaaaaaaggctacataaagatggatagaggttagagataagctgccatgagccaagacacgctggaagccaccagaagcttgaaaaggagaggaagggttctccccttgaggtttcagagagatcacagccctgctgataccatgattttggatttctagcctccagaactgtgagagaatatatcttcactgtttgaagccactgagtgtgtgccactggttataacagctttaggaaactgatacatttctagaaggacctgcacggggcaaagacatagcactgagctgttcattgctagagaagctcgatgcttagaacagtgtctgacacacactaggtgctccagaaagatctgttaagtgggacttcccaggaagtccaggggttgagagtctgcagaatctacccgccaatgcaggggacgtgggtttgattcctggtccgggaagatcccacatgctgtggagcaactaagcccaggagcccaaactagctgagcctgcgctctagagcctgcaagccgcaactactgagtccctgggcctagagcccgcgctcagcaagagaaatcactgcaatgagaagtccacgcagcacagctagagagtagcccctgctcaccacaactagagaaaagcccatgaagcaatgaagactcagcacaaccaaaaataaataaatttttgaaaagagatgtttgctgttcaattttaagctactgtcttaagataactgcctcctgtcttacttattcctactatctgaagatgttgggagagatgtcacctaaatagaatagaataaaaaaagtcaatagtctctactctagagatgctgccagaaattatggtttcaggctggattttgaacatggacaatccaggattagagactgaacctgattagagactgaacctcactatgaaagagaagaaagagatacaggaaaaataaaatcaatatttttgctgcccaatattttacacatctcagttcatttaagactccatttttactggtaaggcaatggaatttcagaaattaagcatagttttttggaagtcattgagctgtggtacaaattagagactagcaatagaagtcagaggctgaaaagtgttctgttttcagtatggcagattacaatccttatgtacaaaactacctgaaaataaatataaatgacgaatgaaaacaggagaacaacaacctcaaaattctacagttaagatcaggcagatattggaaggacgttagaatatgaaagagacggacagtacagcctgagtcttctatttgtgtgattttactctgacaacaggctgctgtcattgcaagttacagaatggctaaaacttacttagaaaaccctctttcttgtctgaagaaccagaggacagagccaaagcaacctaagatatggaaaaaaagaaagtgttggggggggggggagg

SEQ ID NO: 47231 - DNA, 837 bp, Bovine  19866881300568
ctgggtcaatgctttatctagttcctccaccaaggtaacctcatttacgaaactccttaatcctaagtgcaagttgattcccgctggtcctccagcctgagcagacaacatccgaaggagtggccttggttgcacaagggcatcctcctccacaagtggactgtgggggaagggcagggtgtattgaacttctgttttaccctctctctgctttctgttggtcagagaagttggccacaacaaacttgtgttgaactgaatatgacagaacctatttaacatgaagagagaggacctttcctcactacacagaattcagaaattggctgacagcaaaaatgagaataaaaatcagagatgttgattgaattgcatttgatgacattattagggatgggaccatcaattgatggaaataatagaggaagaaggactgctcagacatcccaggagctacctagctctccaataaggcatttgctttatgtttaagtatcatttccacagactataaaagggaacatcattctctttaatcaatttctagtcaagacagccatgtgggcttagcttgaccatacctttcaaagatgtgattaaatatgaataattagtctctcttctttcctttcctagacatcatggcattaatattggcatttagtttccttaaattgcattctaaagtccacacccgccacagctccctctccagatatcatttctggagcctagaatttacaagccccgccccatctccttttctatacacatattttctttttaactttagatttttaacaagtttaaagtcatgattattttcttagtggtttt

SEQ ID NO: 47232 - DNA, 1127 bp, Bovine  19866881328953
cctagcttattcttcatatattatatgaaagccaaaaaaaaaaaaaaagcctcaacagctttgacctattgtacatataagaaaaataaagctcatagaatttaattgtcttgttatcataccttgaatattcagtgtcagggatgagtcatacaaacaatatacagactattttttttttcatgttctccttcttttggtgtgtagagtcatttttttcagttctgatgcatcctggaggcagcctctaggaactaatgatgtctatttttaatactgtggtacaagattatcaatccagttaagcaacacgggcctctggcagtcactggcctcttaagttcccactttacctgtggtgctgaggtatttgggaactggacgatctctatgatgaacataaacatcaaaaaataaagagaagtaaaagaagtcattttaaccaaggccggaaaggttgtcacaaacccaactaccttcttcctgagtttccttttactttaatagagaggcatgcaatcaacaagaggctgaattttggagtatgagtcctggtttatataatttatttcctaacctattttataatattagaggagtcgggaaatatacaaaaaaatgtgaccaatttagacaatacagcaaaacatgccatttggtctcatttatcataataggaattttaaaggatactcatgagccacttagaacctatgagttcatagagaagaacaagtggttttgcataagattcacccttaaataattcagtgcctgtggcatcatgaaaaacaaacacagggggaaaaaaactctaagagtcataacaattaacgtctcagaaaaacaatttcacccctagttaaagggctgagtcaagaggaccacctttattctaagttccaatccctctgcaatccctatgcacatttctcccatggctctgtggtggggaatggaacccctttggctacctccatcctcctgtgtaacagtctccagctacagtgcattaaccaactcttggcactctgttctgcagaagagagaagctgcccacagctgattctgaacactgaacaagaacactgaacctagaaaaagagtaaaaggagaggagtggattt

SEQ ID NO: 47233 - DNA, 1385 bp, Bovine  19866881354431
tcagggatatgaagaaaggaacatagatacttcttttaaggaattatggcagtggaaggaaggcacaaccaagatggaaaagggcaacaagtaggtttaaaggaagatgagcatactgttctcatttataatttttaaacaatatgagaatgtttagcacttttttggtaaaggtatctgatcaaatcagagtgaagatgaaggtcagcagtgctaagaaaatagagacactgagctaagaattaggagagtgttatatagttatgaaattgccccagatagtagtaagcagaatgagtccttcaattcagactcctatgtcattaacacttaagattctatggctattcttaatttggctgaagtatcccactagctcaagttgtttgtggtcttaataaatagtaacaaataattgcattaataaatagtaacaaataattgcagattgctccgtgtccaacttaacccaaggtcttttaatttcattttatttacttcatataatatattaaaaaatcttataaaagtcacagaaatcaaagatttaaaaattttattcccttatgccttctcaaagtgttcaagtaaaagaatgttcagacttgtctactctactagttctgaggagaagggcaggaagagaaggggacgacagagaatgagatggctggatggcatcactgactcgatggacatgagtttgagtgaactccaggagttggtgatggacagggaggcctggagcgctgtgattcatggggtcgcaaagagtcagatgcgactgagcgactgaactgaactgaccacatatttaggtttcccacatggtgcagtagtaaagaatccacctgccaatgcaggaaatgcaagagatgtgggttcaatccctgtgctgggaagacacactggaggaggaaatggcaacccactccagtattcttgcctggagaatcccatggacagaggagcctggtaggctacagtccacagggttgcaaagagttggacacgactgagcaactgagcatgcatgcaccatatatttttctttgtcttttcttacttatgagcactttttattttatattttatcaacatattgacctattagcatcataacttaccttgcatactgaattgctttgaaggtatttgtaaggtctccaccatattggaatgtctgcgatgttgctttaatcatttcatctttggatttaaaagtattcaggttaaacacaactcttggattattggcatattgaattaaccccatctttaagagaaaagaagtttattacaggcttgtcattgttataaatcattcctatgtaaccaatataataaaaatcagaagtgcatttatatatgggctgatagcttaa

SEQ ID NO: 47234 - DNA, 1483 bp, Bovine  19866881536472
attggtccttgatgagctttgattcttaattggtctccactaagatgaggaatgggcttccctggtggctcagatggtaaagaatctgtctgcagtacagtgagacctgggtccagtccctgggttgggaaggtcctctggaggaggaaatggtaaccccactccagtattctctccttgagaattccatggacagaggagcctggcagactacggtacatggggttgcaaagagtcagacaccactgaacgactaacactttcacttttcaagatgggaaatagtccgttttactgctgttttaacattagattgtagtccacagagtctagtaaaacccaactgagcttctcttaaaaccggttttctcactggaggtttcaagtgatttctgtagacttaaacctgggtcccctatgttctttgaggagataaacctttttgagttgatggctcttgttaaactgtgtatttcaagcaggtgcctctcattctaaccaatagtggctaaagaatgattttgaaatatccatttttaactcttccttcctggctgccttacttaccagatggcttaaaggtattgctgtgtcattgttgtgccttcactcagcgagactctgaccttagattcacctcaaagcactcaagcgagaggaagtagttaagcagcagtgagagcaaacaaataggcccacatgccttatatgtttactataatcacctgcttaaatggaggcactgttaatgcaactaggaattctttctgcattaatgaaaaaggtatttctgatgatatctaatagcaaaagtaattctggcaagaactacggcggctgccttaggcagacaaactgagtgtctagggtaaaggagggaggaagacggaaacatacttcactgaacacacttttggactttgtgcactgtttgtgtattatctattcaaaactagaaaatacaaaagaggtagctataaataaagtcaaagagaagggaaaggacaaagtaattctgcctaattacttttgactaaaaaggaagcatgagcatactggcttttaggagaactttatttgttgttgttattgtggtttggcttctgacgtgtttgcagcttttcagaacttaaggtaaacctctgggtggatacttggatgaacttatttgcagataacaatttaaggcaagagcttggcttttgctcacatgcaacatcaagacatatgccattttgaatctcaggtttcagtggacatttatcatagaatcaaagagtatatctttcctcccctttttaccaataagaaagctagtgctgaggggccacaccaagaaacattcaaggttacagaggccctggaagagctgtgtgtgtgccatgttgggactctttcccctatatagctgtgtgtggtgatttactccagtaggagctatttggtgaatgcaggcatacttaaaggcagaatttgtcagtgt

SEQ ID NO: 47235 - DNA, 1162 bp, Bovine  19866881685710
cgctcagtcgtgtccgactctgcgaccccatgaatcgcagcagccaggcctccctgtcctcaccaactcccggagttcgctcagactcacatccatcgagttggtgatgccatccagccatctcaccctctgtcgtccccttctgataggttattataaatatcgaatatagttccttgtgccatactgtatatttctttttaacaaacaacaggatcttatgcactgttcagacagctaattttttaaaaatacagttcttcattagaggattgctaaaaagtaacaccacaaagttacatgaagagtctgagtgaattaagctaagacttcaagtctttaaaggcctctcttcaaaggaacgctttccccggcctgaactcggcaagatggatgcttgttcatccgggatgctgctgctgataattatgccatcagagagaggaaacagtgaatcaagcataaaccatgctcattgttgcctttagtagttctctctgttcacctccctgtgtggagataataaaaatgggggtgtggttgaatagatgtggaaggatttctgtgtttcacattccccgttcctgcctggagcacgtctcaaccataatctgccgggcactgctgcttggtaaacagcggaaaactacagccgcagacttcaaccagcgcccataagaagtctttgctgacatgtgatgtcaaatatttttcagttgacttagaaaagactgagattaagaatctctgtaaacattagccaatgagacctttagaactttctgaggcatcttccttcccactagaattgggcaatgctttaaaatcaccatcaatggagcagacatctagtcactgaagacttaatgagacatcccaagaagtcatccttcacgaggtggcttttaagtgaaccgatttcagtgagtagcgttggttggagttggaaatcaagctgcaattcccatctgcccataattagcctgtctctttgtatgctttctgaccttgttcccctgccagtttcaaatgctgggcgcagtgacttttgaatagaaatctgaagatgagaggtttgattgtaaagcctcacttctgactggactggaaatagctggatttattttttttctcttgataaccccaaactctaatacttgga

SEQ ID NO: 47236 - DNA, 1251 bp, Bovine  19866881704368
gtcttaagtagagtgtttgcatgatgactgttaggtgcctcgatggggttacttgtcccacatttgttaatgtcaggagtttgccattactggagttcactgttatctagcatttcaaaggcaagtttaaaaaaaaaaaaaaaaaaacacagcagggccctgctgaaatattttccttcaatacagccaagctgcaggcataaaacacaatagtaaacatacaatggaagaaagtaaaaggcctttgtaacagacctttgtcatgccactgtgcacatttcataacatcagctattgtttttctcaactgacatcatataggtcccagttaatgaaaagagacatggacaatattgcatcaaatagatgctagacaggaaacagaaaatggatcatgtgtccaggctccctagctgaagcagtcatacatctgaatagcgaaaggactaatgtgttttagccatcctcccttccagccataaactcaagagcaacgttgaaagtattttcttttctaggttgctaacccaatcccctacccaccccaccccactgtgaaagccagtcagcaaggatcaaaaacatttccttttaaatgaatcatggcaatccaataaagatgcaacacacagattatgttcaaatcaatgacagaaccacagccagtatcagcaggcctcaaggaacaaaaattgctcacagtcagggggtgtctgtccgataacgagctgcagggctaaacacagagcacatgctatgccctgggcaaaatcccttgagcttctactgctctggcttctttaagcaatgctgggctgttggagtattgtcctcttttgtacctccccagacaggtcatgatggcttggcttagctttgcaaatggggccttcagtgatagttacatccgggaaacaggcaaacaactgtaatgctaatatctagaaataaaagtccacgtaaatagggaatgggatggatttaagagagtcaatgactatgcatgattattcaaaaacccaaaaaatgaatacagagaagattcttaagacttcagtgaacttgccaacaactgcctgccaacatcttttaaattgctgctcattgtaaatatttgagagggaaggagatatttttctgtttaaaaagcaaagggaataaacacataaagctatgtgtctatcacgctctttccttttttcaaaatacttaataccattagtcgacttgcagacctctcagtttccttat

SEQ ID NO: 47237 - DNA, 729 bp, Bovine  19866881943273
taagataaactacatagaagggagatatagaggaaggatcggagaaggcaatggcaccccactccagtactcttgcctggaaaatcccatggatggaggagccaggtgggctgcagtccatgggatcgctaagagttggacacaactgagcgacttccctttcacttttcactttcatgcattggagaaggaaatggcaacccactccagtgttcttgcctggagaatcccagggacggggaagcctggtgggctgccatctatggggtcacacagagtcggacacgactgaagtgacttagcagtagcatagaggaaggataaaatgctttgttagtacatttttttaatgcatttcacatgtgctagggacaagctgcaaaatttgactcagtgcttcctagaaataaaagcaaagactgaaagaaaaccagtgaaaagattcttggtatctataaggactttttttttttttttttaaaaagcccttagatgattttttttattattattaagacctgagaagaacttcttccatgagttttcattaaaagtataatgaactcctttctcagcagtgtctcttaagaagttcaaatacgtatccttagcatgcatgcttcttctggtgagttaacagcttatgcccaatgtaattgattagaaacatttttagaagctaaaattttaccacatggtaaaaatttttcaccattctgatggcttaaa

SEQ ID NO: 47238 - DNA, 1137 bp, Bovine  19866880123112
gtgtacacgtgttccccatcctgaacctccatccccataccatccctctgggtcatcccagtgcaccagccccaagcatcctgtatcctgcatcgaacctggactggcgattcgtttcttatatgatattatacatgtttcaatgccattctccctaatcatcccaccctcgccctctcccacagagtccaaaagactgttctatacatctgtgtctcttttgctgtctcgcaacaccaaggaaaccagaattgaaagagacacgtgtaccccaatgatcatctcattcttaagcttactaagaaataaatgaatgacctattgtggaagtgttggagatatggttagttgctgaatgtgtaaaaggtgatcaatacatcaaagaacaaatacacaaaaaaggaagaagcatacaccatgtgtacagaattatgttgacagggaagaatttgaattattatagaataaagtctgcgggaatgacattaaaataaaccatttcacaaagactttcaataagactgatgagaagctaatttccagagacagagaagaggaatgcagatattttataagagaaaacattgagatgaagtcaacatacacactttaggagcctgtcatgacagttctccaggtagagcaagtaaagacactgtaactgcaacttagatcaaacctctaagagaaacaccaaaattacagacaaaccagaatcaggcaatctgaagagtggaggaaaaaaatctatcacaataggaaaaaatcatggggaaataaaatcaagcagtagataagaaaacatttcatagtatcagatacaatggacatttattacatattctaggagtcaaatatcagctattcctttgagaaattacccctagtatcgctgactatgagtcccactccactgactaaaatgtacatagattctattgagctgagttaaccagagcctactgaggagactgatcaatattatactaggagaagagaatgtgtttctttttttattatcaggctgtagtgatttgaacaaggtcttcctgcagaaggttccctcactggaggagaacatagcctcagtgagagaagccatcaccacacagagaaagaagggaaaggagagaatcc

SEQ ID NO: 47239 - DNA, 2011 bp, Bovine  19866880450300
tggatgtttctaaacatcctccaatgtacagaacagtccctcttctgccccacaagaaagaatgtgcatgttcaacacttttgcaacccctggactatagccccccaggctcctctatccatggagttctccaggcaagaataatagagtgggttgccgtttccttctccaggggatcttcccagcccaggaattaaaccggcatctcctacagtggcaggcagattctttaccactgaacaacctgggaagcctaagacaaagaataatcctgtccaaaataggattagtgctgaggttgacagatcctgtcctggaacactcctgagcgtcttgtctactcacaaagccaaatgtagagaaatgactgtaccccaacttctcacatccaggaaccaggaaaactaagttcttatgtttgattttttacttaacttcaactcaggacaaatctttgcttcagtgtcttctgtcaaatgtgatgaaagtatccgttgtactgtctttgtaaggtggtgataagaatgaaataatagaaatgaatgttctttgaaaaaaattacaaaaagccacaaaactcattatttctgctatgttgagagagttctagacacaaaagtatcctggctgactatggagtggaattactccctgctttatccctttgcttaactgtaacatcaagcacctcagtttagaaatatgtcacttgtttaaatataggataggttatctagatgagagaatttgcttgacgttattgtctttggtgttaatcttttcttatgctcgattagttcccttgtcatcactttttttttttatggcccaggttgcatagaatattatctacatctgtgaagatattaaagttggactggtttgtaattagtagtatcaccaaaacacctaaattagtggcatcacctaaaatttatgatcagagtctgaactaaatctatatcattttgaacatgacataaatgaaataaacacagtgaccttgggcatgcacaatcattaacagatacaaatgcattaaatgggatgaaatgttacagaaaacctgtgtacctgtgaaaatgcttccatagttagatccttaccaaagcaatgctaaaggtaacatgaaagggacctaatgtaatcttattatcaatagttggccatttaccaaaacagtttggtaccttcttagagtgaatctcttgtcagcaatccagttgcaaagcttcattttaagagttaagagggataaactggaaaatgctgttaggattctgcattaaaatataaaatattacaggctgagaagagcagaatggataaaaggcttttagtttgctccctttgaagcactgtttaaaaggggcatgcctgtttagatcgagtcagagtgatataaggtatgttgtagaaggaacatgttagtcctgaggaaagagggagcacaagcgaaagaatacatcccaaatcctttttgatgattccatcatcacacagaagtgacacagctggcttctctgtgtttatctggaattctggaaaggaatctcaagtatgtatcataactcttccttcttcaagattgtgatactagctaccgttatgcttaaatccatgatttcctttaaggtcttagtactctatcatttgatcatttttgtactaagttctctaaatcatgtgttgctactctcaggaggtgcttgtggtaaagaacccgcctgccaatgcaggttagatgttgggcgtgccagtttgatctgtgggtctggaagatccccagagaagggaatggcagtccactccagtattcttgcctggagaatcccatggacagaggagcctggtgggctacacagttcataggtttgcaccaagtctaacatgactgaatcgactttgcattagcactctcacatttgctgagttctgaggtggccctcgtggtaaagaatccaggagactcaagttcgatccctgggttgggaagatcccctagagaaga

SEQ ID NO: 47240 - DNA, 1261 bp, Bovine  19866880609807
cccctccgcctcccaaaggtgcatataaaacacggactgtctgccaaggtcaggagtacaagctagatctctgtgtataaacatgctaacataaaaatggaggattaaaagctcattaagatgttgtgatgaggataaagagaaaagactggagcagaaggaaaagcaatgacccacacgtgtttcttttgctaatgccctttatttaatcaaagctcagaattcagaggttatccaagctgctcaggagcacactgcatagtgtaaaatgcctgcacaaaatcaccatttccctgcagcatgaatgctctgctctgccccaggaagggtcccttctccctgtgtgcctgagcctcctttctttgagtctccaggaggcagaagctctgtttgcttctttccagctctgccctttttcggggtgctggtacctgtgttatttaaggacccagggcataggaaatacaggaatcatttccttaacaggctattatacttcaaaacaactacttcatctgactgaattaaagagcagtacgtttagggagggcttccccggtggctcagcggtaaagagtctatctgcctgcaacgcagatgagggtccaatccctggatggggaagatcccctggagaaaggcttgcaacccgcttcaggattcctgcctagagacctccatggacagaggagcctggcaggctacagtccatagggccacaaaaagtcggatgtgactgaagcagtttagcacacatgcatgcacgcatgcacatttagggaatgagataatactgctctgtttgctttggtaagactttcacaggtgaacgaggggaacttggctccttccagaattcactgttcattcccataatactgcccctcactctcctccactccacacctatgacacactgtcctttccaacagtggacccagaggagccgaaaggccaccaggtaacagcaggaaaaccaaacactaaggcttcttggctcgttgtccagtgctctttttccatatccctgaaattctgaccactcacccatcactctttaactctgcccctagccccccaacaccaagtcccgattgacgagcagatgtaaacatgaatctgggggagctggcttaacactcattgctgaattctaatgaaaaaactcagtgatgtccgtttacagaatcttgcaagatgatctctcagagtgcctggaatatgaaaggcagcagcagagaaaaatgtcagagctaatttg

SEQ ID NO: 47241 - DNA, 1722 bp, Bovine  19866880799168
aataataggaaaagaaaattggcctttggggttaaactgaaagcagttcaaaccccagctctattagcagttggtaaatgaataaaacctctctgatgctcagtttttatcatctgcaaaagagacatagtaattcttacctcacaggttacttttattggttaaatgagacactgtatgaaaagtaccaatagttatatttaattgttaggagtactccctttagacacagactattatgtccaaattcttattctagactacaaaataataacctgttattaggctgagaaactatagataaaaaggcaaacaaaccaataagcaacaagaatttaccatatagtacagggaactattttcggtatcttgtaataatctgtaatggaaaagaatgtgaagctgtacatttgaaaataaccacaatattgtactttgactagttaaaaaatttttaaagggcaaacaaacaaatcatcaacaaaataactttctaacttggattcacatggtaacttttgtcttgggtggtggatcacttacaatagtcggtaagttattccaccatttctcgtgtatgggttgttctctgctggcctctatttatagtgtgggtactgaataatttccccatttttgctcatttcctccttttaaatacgttgtaaaccgtaaagcagtgttcatggtgggttccagcatactctaggtcaagcttgtacgcatactgtgcgtgcatgaatgtgtgctaggctgcttctgttgtgtccaagtctttgtgaccctgtggactgtagcctgccaggctgtgttgtccatggggtttttcaggcaagaaaactggactgtgtcaccatgccctcctccaggggatctgcccgacccagggattggacccatgtctcataaatctcctgcattggcagacgggttctttaccactagcaccgcctgggaggccccatattgaagagtaataaatgataatgttcagtgaatggagtcatgcaagtctctaatcttctattacgttattcaagaaagatttttcagcaactctcatagctagctctcgcttactttcttcacatcttctgaaaagggtcagatttttccattatctagaatattgaatttgctaactttgaggtgtttatgaactctactgaagagaaactcagtgaccttgatttagtcttggtttcaactatgaaactttcttcttcagtaaataactggctttatatcccttttctttctctgtcttgatgtatatgtataaagagatgtgtatctatccatgaattttattctcttgccctgacaccccacctaccacacaaaagatcaggatatataccatatatctattacctctttggtgacttttgtacattatatttgaaaaaaatattattttctcccttttctttttttggaaccttgcctctagtttaacaatatacccatcgatctgccaatctgtattcagagtttagtcagatttaggttggtaattatatatgaattagactacatgcccccaaacagcaactggtttactgacttcaaatgctactgcagacacccgagggtattcattaaacgttaattaataatggtatgctgagttgaattgacttgtggattctggctgactgctctttaatttaaaattatgagatgcatagcatcaatctatcagcaggcaggatcaatttt

SEQ ID NO: 47242 - DNA, 2312 bp, Bovine  19866880819968
ctgaagaagggaatggcaacccactccaggattcttgcctgggaaatcacatggacagaggagtctggaggctacggcccatggggtcacaaaagaagtcggacatgatttagaaactaaaaaaacaacaaaaaatcaagagtactataaagaaggaaactcaagatattgtgccaactagcatctaaataagccttcagatgcctacaatttttacatttaaaagatctttagaatatttcactcaaccacttaaggaagcctttgtatttgtttacttaatacaaatgcttcctacaaatgcttctagatgctaccaaactctttaacttcaatttaagtgttttcctattctttgtttctagaaatagacggggggtgggggtggggggtggggaaacaggccagataaacaactgtaaaccccaagagaatcagacaacaaaccaataagagatttaagaaattctcttctgcctttctggtcaatttctattcacctttcgtggtaacatttgattctttaggacacagaaaaacaccaatattaacttactggtatagaattcaggaatataatttatgggtcttaggagaagagcataaaatgaatgacaacgttaaacagaacctacatatttgataaattaaattgagctttttgtgtaacttgtagtttctgaaagcttacaagattagacaaagtaaagaaagaccttgtgatgatctgattagcaagctgtaatcgatcaagcctgtaggttatttccttttgaccaccaaagaaaaagttaaaccagaagagtttagaaatggagttgccctgctccttccctggtactttagaaagattcactccccaattactcaattatagttaactgtactactttccttccttgctgattatgaaccagtcacaatctgtattttatacttctgacattacctattcattacatttaatttcaggaagatgcccctacacatcaattttgctacaaaacgtatttacagcaaaatccatgcagtgttcctaatgacttttctagctttgtaacatgtatcagtcatccttgtaatattcctgatcaaatgtctggatttaagtatgttagtaagaaaatggaagccacatgcatcaaggtattgacttttctatttctgaagtcttaataaaggtggtgtaagattaattgaaactctcaaaataccaaatggactagaaattgaaactctaaaaataacagagaaaactttgcctaacaatagctttttaaagaatccccaggtacagattctcttttaaattaattcagccaagtcccctccccttgctgtgtttctcaccatttcattccttgccatcctggacatctgagttataaaaccagtagttgtgaatgaatgatctggctgttctgttatatttacatggaagatgcattttaaagctactttaacacattatttgaaaagaaaagttgacattttagaaacaaaaaaaatgagaaatattgagcaacactaaagtgtgagagttaattcaatcactagcatctacattttccctgctttgtggctggggggtaggtctaaggtatttactgattggcttctttctctagagaaaataatgcacataaggagagaatgagagggggagtcacaactaagttaattataaaattagattttaggtactctactacaaagttaaaagcctttaaaatcttaggctaagcagatttcattttttccacacaacccaccaaggttgactgagaagtaataaggccaatttcccctagcaacaagtcaggctgccctcgtagctgcttgtgtagctgccaagcattctgaactttaaggaaaaaggaagctattttgaagaaataacaagtgaaaagaaaccaattatttttcaggatggcctcaaaagaatatcttctaagctatcagacatggtgcttagagaactgagtggtactagggatccaaaacaagggaaaaatgtaaataggaaagatccctaatataatctctctttttataaagtccttctatcatgaggatttccttttcataaaaatcagaatgagtaaggggataaaagaactatagcatataacgtattaggaaacatattaataaccttgctgtactttagctataaaaatgtttatcaaaatgagacagaattctctaacatgtctaatatgtaatatattatatctgacatatcatttcaagtaatagaattggcagggagacaattaacatggccactctatacatctgaaatactcgaa

SEQ ID NO: 47243 - DNA, 678 bp, Bovine  19866880917607
aatgacttccctttacttttactttcatgcattggagaaggaaatggcaacccactccagtgttcttgcctggagaatcccagggacgggggagcctggtgggctgccatctatggggttgcacagagtcggacacgactgaagtgacttagcagcagcagcagcagcagcaggataccatgtttatgcctccagattttaaagtaagtacagtaggagccaatcaaaattttccatgtggagaatcattgtctgatttaatttttcagagctcactttggctactttgtggagaaggaaatgtgtgagcatgtgcctatgtgttcatgtttgtggttaaaaatggaagcaatgagactagattctgggctattagaatcatctaatcaaagacagtggtgacttgggtcatagagtggagatggagatggaatcaactagatagatttgaaatatcttttggacatataactttctgaatttacagatacatttgatgttcagggtgaagaggaatcaggaatctaaaatgatcacctttttttcccctctaactgggcataacatggtatcctttactaagatcaggtttggggcaagatcaggtttcagaaggagatcatgttcactcttagatatctagcaccaagcctattgcaaaatttattattcatcaaa

SEQ ID NO: 47244 - DNA, 1149 bp, Bovine  19866881176307
gggcaaaaggtactgggataaaggaaccttatctctatggccctcaaacaagcaaagaaatacactgcttgctctgggagtgaaactttaagaagaggaatctggtacccacttctaaacacattctagatatgagccacttctacacagaaattctataacaacattattggggaaacttcaggaggtgagaattcccggcatgaggttgcagaaggtgcttgtgcttagtcactcagctgtgtccaactctttgtgaccccttggacagtagcctgccaggcttctctgtccatgggatttcccagcaagaatactggagtgggttgccatttccttctccaggggactcttcccaacccagggatcgaacctacatctcctgcttggcaggtggctcccctgagtcacctgggaagcccaatgttaacaaaataaattacagaaaatattcttgttatatttctaccacttcattaatacagataaatttggtttaaatatcatatcaaatattttatttatttagctacacctgatatcaagaggcacatgcttccttaggagtgggagctcttttgttccagcatttttgtttcaataaggtaattattcttatgaatttagtcatagaagccattaatgttacattgaagtatagtctactatggaattaaggtaatcgatcactatagactgtgagatctatatacaaccattggaagagagaaatggcctataaatctttcagacaggttgtgggaaccagtattaaatttccatattatcaggcaggcaggctagaaacatcaaaatacaaagaaataagataagaacgatctagcactcagcttttgaaagttattttgttgatcatttacctcccataagtctgtcaagcaaaatttccatataatactcttcattcatacacagcaccatttgtgtttagaatcaatgctgacttcaaagattgcatagacagaagtcagactggatacattttaaggaattaggatttagaaatatgaattatgtcatcaagcattgatgcagaacataccacatcaatagttgcaaaaaataaaaaacaaaaaagaaaaaaatctcccctgcaaagttttctcaggaaaacaaatacacaaaatg

SEQ ID NO: 47245 - DNA, 1326 bp, Bovine  19866881225576
ttagcctccacttgagattgctataagtataaaatacacagtgaaaaataaaaataaaaaaataaaaaaaataaaataaaatacacagtggactttctaagacttagtaaaaagaaatactaaaatatattttaaaaaatattgtttgtgtgttgaaatgatacatttttggatatattgggttaaaatacattattagaattaattttacctgttcccctttacttttttaatgtagatagtagaaaattttatatgtggcttccattatatttctgtgagaccaacctgatgcagatatttatgacaatccccatagtccatagtattgggtactgagaactccagtgttccatggcatttatattaagcccatactgtaacagggactaaatctatattattgggttatgacaataaatgcttttatgactttaggaagtaatctgaccactttgtgactcagaaaacagatttgttgaccaaatggagttgctgctaagctgctaagtcacttcagtcgtgtccgactctgttcgaccccatagacggcagcccaccaggctcccccatccctgggattctccaggcaagaacactggagtgggttgccatttccttctccaatgcatgaaagtgaaaaaataaagtgaagttgctcagtcgtgtccgactcctagcgaccccatgcactgcagcccaccaggcccctccatcagtgggattttccaggcaagagtactggagtggggtgccattgccttctccgaaatggagttaatgctaagctaatattaatatataggaatcaagtcattaaaacaactagaaatatttagagtgaggcccgaataaatgcttaccaaaattttttcttattccagatttccttgccacaactttcaaagagatttatcttagtcaaaattagctaagcaaaatatattgttccaaatatattgcatattgcataaatcaaacaataaatatttatgaatcatcatatcagatttacaatgctcctggtctcagagtaaaatacaaaagcccaaaagactttgtcttcacctgtgtggatcttagaaacctgagaagctaagaagcatatttttaaaatttggtaatataaaaaatcatatatcattgttcagtctcttagtcatgtctgactctttactaccccatggactgcagcatgccaggcctccctgtctatcaccaactcctggagtttactcaaactcatatccattcagtggtgatgccatccaaccatctcatcctctgtcgtccccttcttctcctgctgtcaatctttcctagcat

SEQ ID NO: 47246 - DNA, 851 bp, Bovine  19866881233888
aatgcacctgtacaaattaggtagttagcttactgatggaagatggactagacactctgaatcattaagcatccatataagttctactttcaaagtcagagctttcatttggacaacaacatctctcattattactcaagttgctgcctggcaatactctgaccaaaaaggagcctcattagcccctctcagtatttttagaattgtttaaaaggtggtacacatctttgcaaatccttgtaagacaactcagtaaatatcatgtctgcagtcagaatgcagcctgcagaacaagctattgccttagactgttgcccagatgatgtcaaaactggactggaacttgagacttcctgttttccagtaacaggcttagatgactcattaggcttgaataaagatgctttgaactgtggtgactacagagatgttcttctctgcatgttgaaatgagaagcacttccttggctggttgcttatcttgcctgctgtaaaaaatccccagctgtccaatgatgggaaaaaaaactaagcctatatattttgaaaagaaaaaaaaaaaagatatgtgagacgaatcgaaagaattacccatggtttataaatatatgtctcattattcaataggcttgaagtactatgattggaattaacctttataaccaaaaataagggacttgagaaaaattttattcatacattggagcactaagcagccattaagatatttgtatagatgaataactaataaaaaggagaaaatgttcatatttttagttaaaaatatatgtttcatcctacttttaaaattttaaattatttttagatatattactcggtcattcataata

SEQ ID NO: 47247 - DNA, 742 bp, Bovine  19866881272308
gagcaaaaagtgtatttctcctctaaaacctagagaagttagaatctttgggaaaaggctctgaaatctacattccaacaaatcccttaagtgagttttctgtacaccgaagttgaagtatatttactaaaatgtccatcccctactctggcccttctgtgaaaaacaaaaatgcagccatgtataactaataagcacttattcacatttctaagaacatgaaagctatctctgagagagcaaataacaaatcactaagaactcattcttttcaaatattgcattacattttcttttatttgcttcaggcaacttagaatttcactagattaactagtgccattcaggagatcagagaagaaaccttgctgttaagtgcctcacacttattccacagcttatttttattcataaccagcctattatcatttgttcaactcttcttagttcagtgttattatttacttattagatcttgctcagaatgacttctatcttagttctgttgctttagagttagaatacataccaacactgatatttgaaagaatatatcaacatatatttttggtaaataaagcatcattaagatctcaccttctaaattgaccagatttaagaaaatgtaaagataggttggagatgtaagttaagttttggtgtatctattagacttttaagcctatagttttataatctagcttatatttgaatttaaaattaataaaatgctctattttag

SEQ ID NO: 47248 - DNA, 1379 bp, Bovine  19866881351170
agaataaaacacatggataatacaatgccgctctttgatggtgaaaggaagggtcagtttgctcttactactttgtccctcaagcagaggagaattaattttggaacaaatgaagcttaagcttcaaggctcctcaactgcacagccctcatccaaggtcctgcaagggttatgtcaagctgctcacatggtcatgtgctttgtaaaattctcaaaattaagatgcgttagccacagtcttggagaaggcaatggcaccccactccggtactcttgcctggaaaaccccatagacagaggagcctggtaggctgcagtccatggggttgctaagagtcagacacggctgagcgacttcactttcacttttcactttcatgcattggagaaggaaatggcaaagcactccagtgttttttgcctggagaatcccagggacaagggagcctggtgggctgccatctatggggtcacacagagtcggacacgattgaagtgacttagcagcagcagcagccacagtctagtaaaccccctgtttccaaccatcgtacctcccttgggtctgttaacaccagaatgggcaccagcatttttggtatccagataagaagacgtactgaggatatatctagctcaggttccctggtggctcagctggtaaagaatcttcctgcaatgcaggagaccggggtttgattcctgggttgggaagatcccctggagaagggaatagctaatcactccagtattcttgagtcagacacaactgagcaactttcgtgttttttcactttagtggaatatatgcatgtggttcaaggaaaggctgaattatcttttcactctttctgtagaaagtgatattacaacatagttgtcaaaaggtaatcagagagtactctgtcaattaaggtagggcagaaggcgttttaggcattctgtaagtaacaatcctgttatttttctggatggggtgattcttgtgggtactgggctgctgtcataaatttggaatttgttgtgaattctttttcattctgagatcacagttgatttcttattcataattttgtactctttctcttaaatacaactcccacatggtctaagttttagatccctcaaacattactttatagagtaatctgaaatattcatggagacatttatatactttctttatatactttatacacatccatacactttatatactttctttggaatagacaagaaagtcaacagctttattccaactaggaattatttaagtggtatttatttaaaaaagagaatacataagaataaaagtctagtctgtctacttaataattcctccccttgtttcaacattaccatggtaagcaagtagaaat

SEQ ID NO: 47249 - DNA, 719 bp, Bovine  19866881560250
atatacatggcaaggtgaacagttcagtgctaactaggggtgggagatttctgtccattaggatatactggccattggtcccacataatcaaaagttagatgtacaggagttcatatacaaacagagatcttccgtttcagcttgctgaccaaggaaatgagtcaaagtgagccatttcagacagcgaaagaactgtccaagtgctaaaagagataaaatcttgtattttaatcacatggaaaataattagtgtaactatgtacattataagttgattgttgttcttagagaaaggagtttccattctgggttcaaaaatctctgtggacaatatgcatgttgggcattgtgagcagggtagagagtggagatttctcttcagacccaaagtggttggaatcaaagatttctcaggctatttaatctcttgctctgagctatacaagataaattctcttcagctaacctggttgatagcattcatcacagagcatgatgcttttaagatttagattatcatatgttgagaattacatagaaatagatttggaataatttagattttgcaatgactatttaaaattttgaagtccattttgcttattctgccccccacccttccctggcaagtcataaaaggatttatctaatcttacctagtctacttattctatttgtcaaggcctatttcctgatttatcagtcagctgctatcagt

SEQ ID NO: 47250 - DNA, 979 bp, Bovine  19866881684939
ttcttggggctattttccttgtattaaaatttgagaacttaattaggaagttggatcaaggctctgctttagtattttaaattcctcagacataatttaacaaacttctcattagtctaactgaattattaatacataaaagtagcaatgaaattacattctccactcattttttgaaatttctattttttagcatacctttaccaaggccaagcatttgactaagaattggtatatatatgttatgaaatgcttagaataatccttcgaggtaggattagcctcatgtatgaagaaatcaatgcttaggtataaagcatattacccagagttagattgtggtgccatgtttgcctctagttaagtccaagttcatatgctttcattcaaagatctcataaataagttaataagattatcccgtatttatgtcatgacagctataaggcatttccataaggacagggaagtctggcatgctgcagtccatgcggtcacaaagagttggacatgattgagcaactgagcaacaacaatgacattcatttcattatagcaaaacagtggggaatgtgggagttattattacaaatgaagaaactgtggctgagataagcaccttcatatagagatcagaggcaaaggagtcttgtttgttatcttatcattgtaccttgttttatactatgtaatacagtaaggtattatcttgaacataaaattatttttaccaaactcaggttaatgtgaaaaaaagtagaacatggggcattcattatagaaactttgatatggaggaccatgttgaatacagaaggagatggatgagtaacattcaatattttattctatggacttttgttctggcatactttggatgggctgggttgttaaccagaatgagtacaaattaaatcattaattaggtctcatctagaatctaaacaaaggattaggggaacaaacggaggttttagga

SEQ ID NO: 47251 - DNA, 1571 bp, Bovine  19866880166631
tgtcttaggttggggctggcttttcgcgtggtagatatcccacagtctggtgtgctagcccaaattatttcgctcagagagtgctcagggtattcaggccagattcttaatctcagtgatgcagcccgcgctgcgcctccctgcccagcccccgcttgctaatggcgcgtgcaggcgtctgcgctgcttctctgctgggggagttaccgtaggactcgcaatcttcgagttttaattgtttatttattttttcttcctgttatgttgccctctgtgcttccaaagctcggcacagattcggcagtgagaaggtttcctggtgtttggaaacttctctctttttaagactcccttcccgggacggaactccgtccctccctcttttgtctcttttattgtcttttatattttttcctacctcctttcgaagagttggattgcttttctgggtgcctgatgtcctctgctggcattcagaagttgttttgtggaatttactcgacgtttaaatgctcttttgatgaatttgtgggggagaaagtgttctccccgtcctactcctccgccatcttggctcctctcagtatattggtttttaaattgcacctcctgtccccctccttgtgtttattcaaaataactctatccatttgttagttttctacttaaaatatttttgttgttgcagtgttaggcaacccattctaaattatttgtggaaatggtggatagtgataatacaaacataatattaaataattcaagtgaagacttagaagaatcctcaaatctcatttgtttaagttgaaacccatcaaaccttttccatgtctacttgacaaaaagtaaaatagattagccttaatttcttcttttctgttgttgttaatcctttagcaaagctgggggtaaaaagtactagtaatgcaaaagaaaaaagggggtgccaggcaatgttcatatacttaacatattttaactctcttaatccttgtgaactctgtgaggtttgtgccattatccccgtattgtagggaggataggaaactaaggcttaataacttgctctgtggctagtaagtagtgaaaacagtgcacaaacccattccccctctttaaacatcctgcatccttacaatcagtcttcaaatatagtgtgatttaaattgctcgccctctatcctttgccttcttctctggatctcaccctctaactcttaagtgcttgtttactgtttttcttatgtcctcagatagatctgtacccattttatgttgcctcatttgggtttctgggaccccagaaggtgaagttctccagttggaggcacgttttgtcaaggcatctatggacttttcccgtagtctctacttgcttttctccccagtgactggctggtcagtgggagacactcatttgtcaagtccactccatccttcagagcctggacccagagctaaacctcctctttctcagaggtcctggctcccccgcgctttgaggtccatagcacaaagcacacttggtaccatatcttgtgacaccccgagagagaactgttacaatccct

SEQ ID NO: 47252 - DNA, 1449 bp, Bovine  19866880181273
atgcctccgcctctcatcctctgtcgtccccttctcctcctgcccccaatccctcccagcatcagagtcttttccaatgagtcaactcttcgcatgaggtggccaaagtactggactttcagctttagcatcattccttccaaggaaatcccagggctgatctccttcagaatggactggttggatctccttgcagtccaagggactctcaagagtcttctccaacaccacagttcaaaagcatcaattcttcggcactcagccttcttcacagtccaactctcacatccatacctgaccacaggaaaaaccatagccttgactagacgaacctttgttggcaaagtaatgtctctgcttttgaatatgctgtctaggttggtcataactttccttccaaggagtaagcgtcttttaatttcatggctgcagtcaacatctgtagtgattttggagcccagaaaaataaagtctgacactgtttcccaataaaaatcatacatatttcatgaaactgcatgatcaactgtatttcaacatacagaaacagagcccagtgtactttagtaatataggtaatatggcacttaaggcttttcttaattaaaagccaagaatcttatttgcatttctttgaaggaaaagactgtaataaggacaaagtattggcaaagtgatgagccaaacagagaggaaattctaattatagacttcagaattcagtttaagatgtatatgtatgtcgctttatttttttttttttacagttttcacataactcattatttattttggatatatttcattttaaagtatagttaatttacagtgttatgttaatttctgctatacagcaaaggagttcagatatatagagagacattctttttgaatattcttttccattatggttatcacagaatactgaatatggttccctgtgctatacagtaggactttattgtttatctattctatatataatagtttgcatctgctaaccccacattcccactgcattcctcctccacctcctctcccttttggcaaccacagatctgttctcaatgtctgtgatcctatttcatagataaattcatttgtgtcatttttttggattccacatagaagtgatatttgcctgtattttctcccagtccattggttgtcttttcattttgtttatggtttcctttgctgtgcaaaagcttatatgtttgattggtttagtcgctaagtcgtgtccaactcttgcaaccccatggactatagcctgcgaggcttctctgtccatggcattctccaggcaagaatattggagtgggtcgccatttccttctccaatatgtttgattaggtatcctgtttctacttttgcttttatttctattgccttggttaactgacataagaaaatattggtatagcttatgtcagagaatgttttgc

SEQ ID NO: 47253 - DNA, 1518 bp, Bovine  19866880464581
ctttacctcttacaaagccagtactaaaggccaagataatatgaaaagcagtcagtgacttctaattctatcaaattcattgcatagaaatgttgtacaacataagcattttcttttccctagcattcccttttttattctctctacttttcccaatggttagaaatttttatcctgcttttagcgagcagtgtgtcgatcactcagccactttggattaaattcaaattcatttgtgcctgctacacagacaaacacgagagtttattagaagcatgaagaataatatcttcagaagccaggaagtctttccctcagaaatcatctcaaatgtgccactgctcatgcctccacttttaaacctccactcccctacgcacacacatgactttaaaacataattaaacaaggaatatatttaacactaggaaagtgttcttttattgaacaaggaagatattaattctcctctatatagcaaaacaaaaaacatctgttaatccagctcctctctggcttttacattaagaaagctcagaggttttgtaggtaccaacaaaaaacacacaccccaaggcacaaaagaatgagaaaaacaaccatcaaataggcagcagcaacagcaggcaagaaaggtaccctgggtaccatgctagaggcagctaggagccttgagtgctttgcaagacatcaggcttagctagagcagatgtttctcattcaccagagaggcctgggtaccatgcatgcctgcctgcccagcaaaggaaacattatcagattgaagagttagtacaccctattcaagtttcttgctctctttttttctcagagctctgtaaagttaaaaataaagaaaaagaagtaaaacaagtaaaggagaagatgacctgttttgaactgaccatcattcaagaacacggcttctgctctgggccctgaaagggaaaccaggagaacacgatgagccaatattatgctgggaacagggagaagagtcgtacctggcactgctgcctgggacactgcaaggaaaagatttctagccaacgtcaaagcagagagagtccacgccatttggattggctacaaacaatatgtcagttttcattctctcagccaacatctctgtgctgctgctgttctagatgctaaggatacagccttgaaaaagggtaaagaaggttctggattcatgaagtttactctgatagaagagacagtaacaaagctgggaacaaataaataaaggtagtgtgagtgcagggaaagggaataaggcaggatacaagaatgaagaaagaccgagggtagatgagtggaaggagggagggaagctgggggttattttagattgggggtcaggatagatctatataagccaacaaggatttcagcaaggtctaacttcactgcctgctaaatgtgatttaaggggtcctgcctggaaaggaccgattcattcattcaaacaaatacgcaactgtgccactactgtgcactggccactgtgctggg

SEQ ID NO: 47254 - DNA, 1056 bp, Bovine  19866880486446
ttccctttccccttctcctgcttataagtctgttaaaaactttcaagggctttaagaataaaacttggtgaaaaaattgttgtttgcttgggaaaaattaaatttagccctttcagttggagccaatatagataactgagcaaacaaaaatttacaaatttgtttccaggtcccatggtggtttcaggtcaaagtcataatagggtttatctcatgtctaaatttaattgaagggtaaatgaaatgatgctgagagattttgctgactcctcactttacaaaaatatacagagtaggtaatagacttttagtggaagaggaaagtaaggagcctggattcatggactggggcagaagacagaaaacaggtgaaaaagcattttgaaaaggcgaacattagacctgtagtttgattgaggaccacgatcaaaagaaatcaatacaaatgttttggtttatttttttcccctccattttcacttaagtagcagtctctaatacaatggaaagctggcacaaagcgtattagaaaggaggtaagacgaatgggctcagcagtaataggaagtaccgcatgtgttgcatgctgcttagtttaaatttactggagccttgctacagagccctgaggggaggcttggggatttgcataggaggactttattaaaaggagatacttagtggatgtcttgagaacatcatccctaaagcactgttgcttgctgttggcttgcaaggagagtacaatagcaaggcttgactttggtgtgaaaatgtgctagaattcaaatcacagaagcttgtgtccatagtagcatcatgaatggcagtcgtcatggaataatgctaaaattctatacatagaggtaactgtcaggatagcagctttagagtttatagatagaattgtttacctgatatggtatgatattggtaattttgatactactgacatctctagagtgatgcttaatggtcgactttgccatcaaaagccatttgatataataatggaaagcagggggtcttgcaggtgagaaacgagctcaggttgaa

SEQ ID NO: 47255 - DNA, 1542 bp, Bovine  19866880533767
tttgttgacaaactttaactgtatctgcaagtttggatactttaatggattccagtggaataaattcagactgaaaacaagtaactttagaagcccttcctatatattcaggagttcctattatgtaaaggttaattctgtgtatatctcaactctgttgattggttttataccgaaataaaaaatatggttattatcaaaatatatttatttgagagaggagacttatttctgttctacttataagcttagaacatatataaacgtgcagatttttcagcataagaattttcagtatacagaaaagctgaaaacacagtagaaagaacagccatataccatccgtctagactgaacagtgaggttttgttaagagtgtttatcagataataatttgtcatatttgctgtttggtgtccatctgtgtcacatccattctttaaaaaaatattgttttgctgaatacttgaaagtgaattgcatatatcatgatacttcttagagtgtcactttttttgtttaagagtggggttcttttgtgacaacctggatggccctacatggtattatgccaagtgaaataagttaaagacagatactatatgattttacttatatgtggatctaaaaatcaaaacaaatgaacaaacatgacaaaactaagtctcatagacgcagagagcagagaagtaggtggtggttaaaaggggcggggggcgcagtgaaatcgctgactgaggttaaaaggcacagacttccagttctaaaataaatgagtcatggggataaattttttttttttttttaaacaaaaaaggattccatatgatcttaatggagaatgtttttcagattcttcattggggtattaaaatgctagctaaatttctagctgttttatatagagctgatggtataagtttgtggcttatacacatttgtaactgcttgttttcaggggtataaatgttgcttttttacagacctgtgaggcaaaaaacagacccttgcatatgcttgtctgagttcattttaatgtttctacagtttggaaataataaaatactacttacagggttgttgggtagtctgtttcatccacgcagtaaatgttagttgaatttgagtctgttggaatgtatcacatactgtgttgagattatgaaagacaaatgctaagcttttgtttctagggtatattggactttgccaggaagttctgccatattgttcagaattggctcatccaaaaaacaagaataagatctcataggaacccatccaagaccagaaccaacatcttttgttgactcagtttggttatagttggtaaagaccacattaccagccaaagtagtctgcagaaggaaaaaattaatgacagcatttataaataagggtttcttttatcctgctcttaggataattgttggctaatttaaagaaagacagtgttatttgctttggagaatggtagcagcgctagacagtagaatcaccctgattcccaaccctggcagcagggctgggaattaaaaattc

SEQ ID NO: 47256 - DNA, 1623 bp, Bovine  19866880564363
gaaatggttcattatccaagtatgcagttcttgtgcatttcacttcaaaaaaaaaattgaaagcctgtgaaccagatgatttttaagacctcttccagctctgaaatttcttaattctaagtgattttttggttctggtcgaatccgttattttaggaacactattgccctctagtggtaaaatgcagtaacagctatggtagtgaaactgttagtcaccagtctgtcccactctttgcctccacatggctgtccgtggaattctccaggtaagaataatggagtgggttgccattcccttctccaggggatcttcctgacccagggatcaaacctgggtctcctgcattgcaggcagattctttactgtctggccacccgcgatggtagtaaatgcaaagaagtattgagattctcaagtcagaactagctggtgaaaccacttgtgagtattctgttttgtttactgattataaggagagattgtaaggagagagtcatagtgagggacacaggcatccctcactgcccctgtctgatgacctctctttcccaaccgtacactacccttccatgaccagaaggctcctgtttctctgatgccgcaggccccagagcatggaaggttgtggtgttgagagctcctgtgctacccagggtaccctggataagcctacttctgaccacctggggctgtcccctacagtgaggcaagcacactcaggacacttgtaagacctacgaccactagtccctgccccaggcagctgttgagaagccagcctttccctggcatttagaaagactggtgagatctttgtgtgcacagacttaagaacaaaggcaacccatttgaaatcagcccttatttgaggattgctcagaggaccaggccacgacctgattggaaacattaatcaaaacatttgaccagaggtaaggcggggggaattatgcccaaatcttaactgcttcaatttaaatgaaaatcagcaaatataaaactatcatctgtcttttggtgtagcgtgaaggacattaatgggcactccttgcagtctttcaagcaagaagatccacccataatggacatctgtgactttcacttttgtttacgtacgatggcagaagcacttgcaaagaatacagttcacaatcctctccttttacttctgacttttcttgcctaaccctgattcactcatacccagttcaccagcaagagtttttagagactttatcaattctttttatagtatttaacttggattttgtggacttacattttttcctgcctactcttcaccagtttacttaacaattttgcagctagggaatgggtacacctgacacaggcaagtttcagagcaaaccagctgacttctggtgatcatccctccccctccccacaggtggactggctgctgtgtgcccccaccaaccccagtgtctatgggcagaacaaagcctgtccattgagccgacaagacagctgggagagcgcctagtatactaagaaaaagcttcttcctttatcccttttcaatctataaagcactttaatacagcataattcatctaattactgctctccttgaagtcttctctccattaatgtcaata

SEQ ID NO: 47257 - DNA, 895 bp, Bovine  19866880603635
aactgagcagctttttttttttcaactgttgaagaaacacgtatttctgaagattcaagctctactcacaatctgcttgtctgattactttgcatcaggatcaaacactactttagtccccatttagtaaagcgtatccacaagagatgcagcctattcattaagtactttagcttttttcagtgacagcttttctcaccagggcaggaatgagcctttcaacatgtcaagttagcagctattttccagcataataggcgctctctggtcaggtcagttttcttcagcatggacaactaaaacaccatactatagaaacaagaaatttcctccctcattttatgagtcttctcaaagtttctgccacatctccttgcatcatcttttttaatggatattaatttattcaaaatcattaacctcaaggctgtcttaagactttattgtgtttggtcagtcttctacagtttaactatcccttaaaaattttttcccctactttcacaatacaaagtattatttatagcatgttcatggagggaaaggggtggacagggtgctccatttttaaaaacatacccaggttttccaatgaccttccctatcggtttccttgggatttcaagggaataaacagatttattttaataagcttaaacataaaaacctgaatttaaaaattagataggccttctattcatactaaatattttaacaataaagctgctccagagcatctaaaatattcatccagtagatttaaaaatatttagcacttgttttgtactaatatggtaggtaagatatgcatagaataacaattataatgtagccattatactaataatattagaaaagttttataaattggtacagtagttcagtgccagaaaga

SEQ ID NO: 47258 - DNA, 1822 bp, Bovine  19866880632210
ggccttgctaccacgctttgtctccccgtgtattcttccctttaacttccgctgagtctccatctggagcgtggaacccaccacgcttactaattatgcctgggcttctaagacccactcgagaaggtgtctagggtgaggcaccttccgctattcgagagggcgcctgcggcctacgtaagtggtgcaaacttcttgtcttgaagttttattggtctcccgcgtaaaccaagctactcagcctcttttctccactgaattttcctactgagctatcctcattctattattctttatatctctaattagcatataaatagtcgcctaggccgtctctccttcgaataccctggatcagctggggctggtccccagcagggactgatggtgtgctagggacaatgcataggaaaatgaccatgttctccattggatagaaataacttgttgtatgtatgattaaagattagttactcttatttgtggaaattgaagacagagctgtcacagtctttgtagaccgggacctggggacttggagttgacgagaagaaggaagcaggggacccaagtcttgagtgaaacagggtgctttatttgcaaaaacacatgtttctatatcttcatacaaggcagctttaggcagtaaaaaaattgaggaaaaacaaagccaagcaaataacaatcttgaaagggccagaaagcattccatatcctgagtaagaggggcataactgaatagattacctgtaagtaaaaggtcactgaagggagtcactgaaaggaatccaagcaggtaccctttctcatgatctcagtcctaagaacttcgtgcagctctgcttgttcctgttttccaggaactgataaggaatagagtccttgagaagctgcacagaaaagaagagaataacatattggatcccttaaagttgaacgtcccctgacagattatgataaagttcactaaattttctgatattcatataataatacattaatttaaagctctgttaaaactgacttgtatatgctttttatggttgacttttagccaccagctgaacaggccaaagcaagactgcaattggttctagaagctgctggtaagtgtaaataattaattttatttaaatgaaaaaatgtgaaataaatcctagcattcttacaggtttatcaaagaggaaactacatattttcatatagcctcacaaatttatgacatctatgtatggccatgtgtgcgtgcacgcttagtcgcttcagtcgtgtctgactctttgcagccctgagaactgtagtccaccaggcttctctgtccttgggattttccaggcatgaatactggagtgagttgccatgtcctcttccagaggatcttcctgacccagggatcaaacctgtgtatcctctgtcttctcaattgcaagcagattcttttaccactgtgccaccagggaagtcccatgtgtggtcatattttaacctcaaatatatattgctacagtgtaatggtcctttatgttctcatttataatattgctacaattttagtttgaattttgatgagatctagtttattgatttttgttttttatggactattattttagaggcatgtttaagaaaaactttatacttttacatttcagatttgagaatgtgatctattttgatttaattgttgtataaagtgtgagatttagatcaaggtttcattctgaaggaaatgagataaaagtcatttaataatcctccagttcagttcagttcagttgctcagttgtgtccgactctttgcaatcccatggactgcagcaca

SEQ ID NO: 47259 - DNA, 1672 bp, Bovine  19866880697736
gtgtggtgattatgatggggtttggggagggtggacatccccaatctagagtttaatatccgtaacattaatgctttaagagtgatggtgaaatactttcttagacacagaaaaatggtgggaatatagtagaggaaatcctttagacagatgaaaaatgacatcaactaaaaatctgggtttcagacttccctggtagtccaatggctaagactccatgttcccaatgcagggggcctggggtcaatccctgcttggtcagggaactagatcccacatatttcaacaaagaccctgtgcagccaaaataaataaaaataaatactttgttttaaaaatctgggtttcatggagaaagtaagagcctcagagaattaaaaaatttcactgacatataactgcaatggaacactgtgtatcttcaaactgtataacatgatttgatcttggcttccctgatggctcagatggtaaagaatctgcctgcaatgcaagagacctgggttcaacccctatgtcaggaagatttactgggagaaggggaatggctacctactccagtattcttgcctggagaattccatggacagaggagcctgatgggctacagtccatggggttgcagagttggacatgactgagcagctaacactaccacagacttctctgtcaccttggaaaagtcagcttcacctccttgtgcttcagtttccttatttttctccccagcttaattttgatgtgattgacaaattaaaattgtatttatttaaggtatacaatgtgatgtttaaaacatctcttaaattagccttagggatatcaggtttttttgggttttgttttttaaatatgctgccagacacctcttaaattaactaaatgcatttttgtccaaacttgctctaacactgtctagaaattaacatttttccttcattaaaatggactaaattatttccctgttatgaaattactttgaacttagacactcttactttggtttgtattttagtagttttcaaattaactgaattatgccacccttgttgtatccatgctgccaaaataagcaccagacaacccacagaaaactaaacagacctcaagggagttatattgaatggggaaaaaagtcagtctcaaaagtttacaaactgcctgatttcatttacacagcattcttgaaataaaaaacctatagagatgaagaaaagattagtggctgctggacttgggggctgggggaaagaggtgagtgtaaaaaataaacagaatgtgattattaatcaggaatatagaaagatgaaatcctatatatcatttatttgaaaaatatttatcattacacatttgatctttttcatttccaaccatatatagttttcaccttggcaatgaccttgctgagtgggaaacataatatctttaatacacgagttaaatctaagatgatgttcaaatggactgcaggtaaccgtttatgtcaataataaatacagtagattacttttaaaacccatactttgggttttttattacagatgcaattgctgacttaccataaatcaatgtgcttaaagtgccatatgatatcaaatgtttagcttaacagcataaaattgagcagaaactgtaaaacatgttttatagatgccataaaaccctgggg

SEQ ID NO: 47260 - DNA, 1142 bp, Bovine  19866880698860
actcttaggaactgcctggctgtccaatggttaggaatccccacttccactgaagggggtgtgggttcgacccctagttggggaactaagatcctacatgccatgcggtgtggccaaaaaaaagaagaaagaaaaagaaaactctacgtttcagggaaagactgtctcatgtttttcccctctgccattggtttccaggcacagtcccttcatgcggccttagagccggcagtgatagccttaaacttcatgtcccacaccgagggggtgggcggcggggacaggccagttgttgagagctcaaagctgatgctgatctcccctcgggagcacagtgagcttcagtgacctaacagactcagcttctaaatgtcccctccagccttcacgtttggtaagaaaacataaatgtcatgccattccaggaaaagcaaacttcttcattttataaggttagttttatgagtcaggcttagttggagacaagtaaacaactcatttgtggataaaaattgctgcgctgcacttatgttctggacagggagaacattagtgtattacattataccctggagttatttcattgcattttccttctctcgggcaatgcctgataaggtgaatgcaacatatggagcaaaagtcagtgaccttcagattaggccctatcctcctgtggagatgaaggagatctctgccttggatactatcaagctaaggggtagtggagagagacaggaagactactgttgtgttaatctgtttggtcagctctggggatgagttcttgaccctccccaaagagctggggagtggtcagaggcagtgttcccctctggcctaggatggggctcctcaggaaaggctgaaagagggattcgagttgttgtaggcaggttgggaatgggttgggtcctggcctggcctcctgttccaggtgcccagtggtcccaacacccttccagctgcctttgctttcatctaattttaatatcttaatcactatgctttacatatttaaatatttttcttttggggtttgtagtcagaaaacttcaaggatatagaatcattaaatattagacttggagactttcaacttcttgccaacacagaattgactgacactgattattcagcat

SEQ ID NO: 47261 - DNA, 1770 bp, Bovine  19866880720667
gtggcaatcccattttacagatggcgggtatggaatatctttagctgtaccacaaaatttgataccaaagaacacaactggtaagtggtaagagctattcttataactaatgatcagtccttttggattttacagcagagcatttaccaaaagtccttatatttttcactagtcttgcacataactttcaatgccttggctcttccaaactccgcaggctattggtgccctcctgtttttccttccttccctgcccaacctgaactccaagattatcatttcaattccacatttataaacaccctcttttccctgattactttgttgctgtgctaagctgctatcaacatatctgaccatttttacttttgccatataagctccctacaaaatggtatataaatgttattgactataatgatttagaaattatctgaatccttccatgttgctccttcttaatcagcatccacagccaatttctattcttgtttcctacaatttactaaactttctccactggaagtgccaataatctcacaccagctcacctgactcccttatattgtctcagcttcactcccgttcacctctaaacttttatgtgcatcattccttatctcttttttttttgccttgtttcaaaaagtaaatccatccacttatgctttagaacctattcctttctgtatcctttagggttctttctgcttctcaaggttcaaaatcactcttctctatcctcagatgataaatacattcaagtttcacaaatcctgtacaatatttattcttctgtcaaccacgttactgacttttcttgttcctattagatttttgccccaaagcttttgtaatggtccccccaaactctatcacagccaaaatctaatggttatttcagctttatcctttcatcatctctccatctttttttaaacagctaaccaaccacatctttattcaaatgctttcctaattctaacaatcctttgtcagccttttctggctgctgtctcttttgcccacctttcatttcttggagttctgttgtttcgcagccttgtaggtcatctaacatgtaatctatgtatttgtcataactccagttctggcctcttttcagacaatcagaacattttccccaactacttcctgaatacctccacatagatatttcaaaattgtgtccacaactgaactcataatctttccctcaaacttgatcctcttttctagcaaatagctgttttctctctcagattagaaacctttgtgccactatcctccaaatcatatcctcatgcagtacagactgactaggagttccatcagattccactccacggattatctccagaattcatccagtcctttgcattttcattaccagtattcacatttaggcctcatctctttttacactgaataaaaaaggagctcctatttcatctctgtacttttaatactgtccctctaatgaacccttttatattacgaccagagcaaggaacatgttccttttacgcatctccagcagcaagcacagtaatatctagaacataaaatgctcaataattacaaaataaataaatctagcattctaaatacaattatatcacactacctctgaaggtaccctgttgtgcatatatatgtaaatccaatcttcttagcatactatctaaggcctttcacagtctgatctcaatgagctttctagccttatcattcaccttttttttttttctttttctcttggccacacca

SEQ ID NO: 47262 - DNA, 793 bp, Bovine  19866880745023
ttaatactccgtttatatatcccaaacccatgattttttatatgttgtctaagtaaccattataaaagaataaacttagctctaaatagcagtagttgatgaaagaatatttattgtcacaaagcccactagtcattaaatcaacagatattaatgaatacttattaagtatataacaccttattaggtacaaatagacatttctaagctctttcccctcaaagagtgtccatctttgaaactgaattttgtgggcacctttaaacatatatgcataatcttaatttctctcacattatatgtattttcttcatataaagccatatctccagtgtgaattattcatgcagtgtttggttcctgattatgcacacactgcccttagtcactcaggaagctcaggtaatggaaatgtgttttaatgacagtttaaatcagaggtgagcacattacagccaacctgccaaatccagcccaccacctggttttgtaaatagagtacaggaagaacaaaagccatactcacagtttacatattatctatgactgcttttgtcctcagttcagttcagtggctcagttgtgtcctactcttggtgaccccatggactgcagcacgccaggcttcctcgtccatcaccaactcccagagtttactcaaactcaagtccattgagttggtgatgccatccaaccatctcatcctctgtcttccccttctcctcccgccttcaatccctcccagcatcagggtcttttccaatgagtcagctcttcacatcaggggccaaag

SEQ ID NO: 47263 - DNA, 1995 bp, Bovine  19866880792959
tcaaagaaagagtccaagggctagaagggcttgtaagggctataagtgctgttcatttggtaagtggagagataacaaatctgaggagcccagagttgctagattgacaggtttcaatgaattcttacatttacttccttttagacagttataaagaatatcattaactttacttaatattattagtgtacaaagcaatacatagatgtatatatgtgatattatgctatgtattcataatgctgttaatagttcagtcagtgggtcaattttacaatgttaagctatagagtttgaataactgaggtaaaatgcattaaaatcatctacttccactacctgttatattaatcctggctctctaatccctaaaatgcattatctttgaaatacatttgatgtatatgactcagataaaaactaaatataacttagagtcaagaatgggaaataataatttaacaaaccattactcctgactataattaacacacgtggctatacttcatcaaaggttttaaaatacctatagtcgcagaactctgtttagatgaaatcttattttaaaagtttaaaagtatataaaatcactaaaaatgggcactgttctggctaaagtgggcagtggaagcctggagtgctatttgctatggggagaaaacctggcagcccagggcagtcagaaaaccactgttgcacaagattacaagtcaagtataaatgcaagaaattgtcactgaaaataaattcatactagtatgaaaaaatataaaatttaaacaaaggttagaatctaatttgtttactgatgaatatgaatcacataaatataaagtctttttattacataataatttacaagagattggcactacgttagctattcttccttgttataagctgccaactgatactggcattagatgttttagattaatatttttattgtaatgtccatatgtatctcctaaatatatcttgtactattaagtgagaaatgaagattcaagaaataatttttaataatgagaataacaatgttatttatttacttctaatctggaaatatatacatagttcaatttttctaacttggttattgtgttctgcttttaataattaacctgtaatttttagcatgacttaatcactttgaaaagtctagatttcctcagtttcctttagttattgaaagaaaaaccaaaaatcctttcaactctaaaactgctataaataaaaatggagctgctcctatttgctcttgtgtgagcacaacaaaagcacattaatagataacaaagctacaatatgatacatgaatgaagtcttgcatgaaaaaactacttagatagtatttacaaaagaatctctatcattaattattcaacatttggatctgaccagaaaccagagcatgactttataatgctctgtttaaatgaactacttaatgttgtaatgaacactcaatgtggtgagctcaatgaattttggacctggtataacacagcagttttccaactttttgatcaatggacagattttaatgttaagtcagttggaatttcacttgtgctttaaaaatgtttactgaaaccgaaaattttgcatctcaattattttatattctaaaactgaatgtagtttaaaccaatgcattattcataaagcaaagacattaggaaaaacaaagctgtgcacttctttcaaagctgttaaattgctaaaacataccacatttatgcatgcaatatttgattgtttttttcttaacacacaagcttgtttttgtcagatcaagatatgccaaaaattctacaccaaacatttttgtttataattaaagcaatcatcaatccaaggattgtcatctattttatttcatctctacatcaaaaaaaaaaaagtaatttaaaaaaattttaattcccttgaaatgataagataaatgaaaatgtaagtgccttcacataataacagtaagctgaccctttg

SEQ ID NO: 47264 - DNA, 1375 bp, Bovine  19866880820089
gaagttcacggttcacatattgctgaagcctggcttggagaattttgagcattactttactagcgtgtgagatgagtgcaattgtgcagtagtttgagcattctttggcattgcctttctttgggaactgaccttttccagtcctgtggccactgctgagttttccaaatttgctggcatattgagtgcagcactttcacagcatcatagactagattagcgtttcccaaaatatgttctttgtttatttatattacaggaaaagaatcatcctttagtaaaatcaagttggggaaacataggataaactaagttaaacagatatttcaacctgcagaatatctctgagctttgattttgttgatgagcactgtagctttccaggaggagaggttcagtactgcatctagtctaaggtccaatgttgtgaaaccttatttaaatgaagaatcatgagaaattagtatgccatggaacatactatgtgtcttattgaagattccttctagcttcagacattgatgattttctgagaatatgcattacatgtgatttgtacttttacttcattcttgacttacgatcattttaaattgatagggtcttcctggcagtagacagcaccctttatgaacatagtcatgtgtccattcatgactttctgacttaataatttaagttaaaaagaacaagctatcctttattaagcagtactagtacgattagatttgttttgggtaactaattcctggtcaaaagtccctccttggatcctatgacagcatacctccgggatttctactactgttttttccaaggcccatctcaactggattgtaaccataaaacgaaacataaaatatacttgagctggtgcatttagatttcatgaaccaaatgattgtcctgtcctcctaactaagttatcctacaataggcagcccaagtatcacctcttcctggaagtcttcctcgaccatatcctcattcttcgttacttccagagtacctgtacacaggtgtgtgtgtttggttttatgtttcccagtgttaatttaaacttttcatttctcagtcttcagcacttagctcagtgattagggtgcagtattctgctggagaattttctctgtcatctgttttatcttttttgtaaatctggacacttgaaggaactaatgaaaaaaacctgcttgtaaggtgatctagcaaaaattaatattttagagcatttactcatgttgaaagatggctttttttttttttgcaatagctatgtaataattgaaatttcatgtttgtacaatagttttccagttgtagtcactattgaccctgatgctatttgaggcagattcagaataatcatttcaaa

SEQ ID NO: 47265 - DNA, 1795 bp, Bovine  19866880845923
ctgtgttttatagcccagaatgtggtctatctcagtgaacattcccacgtgagcttgagaagaatgtatattttgcaaacactggatgaagtagtctattgatgtcaattacatgcacttgcttgatgatgttgttgagttcacctatgtccttactgattgtattaatctgtccatttctactagaagggttttgaagtctccagctatgataatgtattcatctatttctctgtgtagttctatcagtttttgcctcatgcagtttgatttggttaggtacatatacattaaagactgttatgtctccttggagaattgacacctttatcattttataattcccttctttatccttgataactttttgtgctccaaactctgcctgaaattaacacagctactcctgctttcttttgattagtgtttccacagtatctttttctccattcattcacttttaacctatatgcatcttatatttgcagtggaattttatggcagtgaagagttgagtcttgttttttctattcggacaatctcttttaattggtgcatttagactgttgatgttcaaactgtttattgagcagctggatttatatgtagtacatgtgttcatattcttccctgttgattgtccttgttctttgttcctatttgtgtcttttcattttttgtgattttaaatgagcattttatatgattcaatttcctctttcctcttagcatatcagttataatgttttcttgctaggtcaaacttaaaatgcaaattttataaaactctaacaaatattagccaataaagttcatcactatatggaaaagactactgtgtgaaaaaaatatatgccaaaccttaaatgtgatacagaattcaaaaccttgggttcagcttataaaaattagcatgtccttctgaggctaaacataactattaaaaatggctagaagtaattcataatctctagatgtaaagacttaagctccaaataagaatgtcatagtatgaataaggtatgctactttcatttcattttaaaaagtatacttggtgtagtgctaaacagtatgccttgaaattagccagatgtggttaacagacaggtgttcagaagcatgaatcactcctcaaactcttccacatttgaaaatctgtgactagaaccaggcatttggcccctttcacagtcttcagagtcatggactgtctttctataattaatttctagtgtctaaaaatgcttgaattcaacgctgcatcactgtaacacccttttagaagacattttaatccacagaagagataggaatttaagtcaagattcaggagagtgtggtaccttcagatccgagaactcaactgaggtgctaactggataaacatgttctgcccaagctctgtccacatatacctgaggccttgacaaatctgtcccagcccactcctccacccagtttctggcaggcatccttgagagccattgtaagtcaccccctgaaatatatgggttagagagaaaaaggaaacagtgggtctcagaatggaaaaaaaaaaatgagtgtagatgaccacacaaactgtctctgttatttgctttctttcatccttaacacactccaatcagtcatctgctcagtgtacctctgaactctactcagcaaaatgaccaatgacctccatgtagctaatgaagtaaagtcatttctaaactcataacgcttgactgctcagcagtactgaccctggggtgaccccactcaatattcccatctcctgggtttcttttgg

SEQ ID NO: 47266 - DNA, 876 bp, Bovine  19866880882626
aaaaatctgatttcaaagtcattgacggggtggtattacccttttgtatttttacttcttccagtggtgattatttttccagacagtaacatcagtttcagagcagccaccttctctgttgtgacaatacaatgtcagaacaatgcttcccaatcactccctgtgtttacactaatttgaagctgccaattttgtcagatccttgtcaatagaaaacaaaaatgtgcaagctgctatataattattgaaattaagtactcaccgtctctagatattcttctaaattatttaaaggatccaatttgcttttccttgtgaaaaaataaaagcccttgccttcttatgtttgtggacaattcacacatggaaaagagatctaggtacacagcaggcacaagcccacactgcaaaaatataatacaaaattattaaaaggctaatcagcaccttttatcttaagactcaaggtatagtttaaaactgggttgctatctaggtctcatacttgaggttttcttcaagatttttttcttttttgatgaccattttttaaagtctttattgaatttgtcacaatattatttccgtttaatgttttgattttttggccatgaggcatgtagtatcataactccctgaccagggatggaacctgcaccccctgaattgaaaggtgaagtcttaaccactggactactaggggaagtcccttgaaagttttttaaaactcagatctgtcctctctctctttaccattatctccagatcatgttttttgagctagggttctgcaatgcaggagacctgggttcaatctctgggtcagaaagatcccctagagaaggaaatgacaacccattccagtattcttgcctg

SEQ ID NO: 47267 - DNA, 2637 bp, Bovine  19866880913518
cccttctcctcctgcccccaatccctcacagcatcaaggtcttttccaatgagtcaactcttctcatgaggtggccaaagtattggagtttcagcttcagcatcagtctttccaatgaacacccaggactgatctcctttaggatggagtggttggatctccttgcagtccaagggactctcaagagtcttctccacttcttcagcactcagctttcttcacagaccaactctcacatccatacatgaccactggaaaaaccatagccttgactagatggacctttgttggcaaagtaatacctctgctttgcaatatgctgtctaggttggtcataactttccttccaagagagtaagcgtcttttaatttcatgtttgaatcaccatctgcagtgattttggagcccccaaaaataaagtctgacactgtttccactgtttccccatctattgccatgaagtgatggaaccagatgccataatcttagttgagctttaagccaactttttcactctcctctttcactttcatcaagaggcttttcagttcctcttcactttctgccataatgtaggagacctgagttcaatctctgggtcaggaagattccctggagaaggtattccctggagaatccagtattcttgcctggagaattccatggataaaggagcttggcagggtacagtccatgcggtcgcaaagagttggacatgactcagcgaataacacataggtatatacatactttcacttcagttcagtcgctcagtcatgtccgactctttaagaagactctattgtttgtctggggaattccccagttagaccaatggtgggaagcagcccagcttcccattactgaaactgaaagtgacaacttccccctacccccacctcctggccagaaggtacaaccatgtggcctcagaggctgggatttgtatttgagaaaatcagtgtgggagagatcaaggtagtctcccctttgaaactatttctaggttgaggttttgatacctttgcaaagcagagggcaggtaaatgtacctgtttaaactataaatattcctgggactttgctggcagtccaggtgttaggaatccacacttcaactgcagggggcacaggtttgatctctggtccaggagctaagatcccatatgccatgagatacagccaaagagagggggaaaaaagaaagtaaataaaatgtaaatattcctagataagtgagatgttactgacctggaagggagacagattgcttttcatcataaaggaaaatcaagggaaacaagacaagagagaatcatgtttgaaagaagaatgctggaaatactcaagaggcagcccagcctgggagtccaagggggacaaaggacccagacttctgggaagcctgggaatctgggaaggacagacaaaggtcttcaggtaggagtagacctcttcagcgtgtggtccagggcagcacaggcgagacattagcgtagtagatgccacaattgtcacctatttaaagtaggaggtctccccttatggctcagctggtaaagaatccgcctgcaatgcgggagacctgggttcagtccctgggttgggaagatccctgtgttgggaagtctaaataaaggacaaaataaatatttagtgtttgtgggccataagatctctaccacagctatacagctctgctgcttgcagccataaacaatgtatgaacaaataaacctggctgtatatttgcacagtatatgtgcaggatcatttcacatatactgttactgggtagtgaatatgcgtttcttaaacagaccttaagaggaatattgtaaccttaggatcagagtcacctcttttaacttactcatctataaaatgatatctgtcttagtttttaaaagaaaatagctataaataagttttttgcaaactgcttaagctgtttagaaaaaatatttgattaaaattcttatgaggaatttgctattggaaacagaatatgtgctattggtttaattctgttcttttctggtctttgtttaaactaacttggtgctaagttgtagaggcaagataaatctacttttgagctatgtgtaatatttctagcttagaccttgatcctaagagatagaattatagtaactgttaaaatgaaatgtagccagaaatatgataagctgttgatatgtgtctctgtcatagtgagattgcatttactttaaaggaaagagcagagtacctatactgtgaatatgtttaatatttttaaagttactcatttgaaaaagcttgattaaaatgagcttttttgatgacactcacagtctttaagatggttaatggtagcattcaaaagactaaagaaaatttagttctaactttatatggtcttttctggcaactaaaaattatttgatttattctcccccaccccccgccatgaaagttaataaacaaatgaatctctaattatgtagaagtatagtgttgctaagaacatggattttgtgatctgggttaaaatacaagttctgccaccttatcacctttgtgacttatggtaatttattcttcatctaagagatggcattaagaatgcctgtcttgtcaggatcgttatgtga

SEQ ID NO: 47268 - DNA, 2314 bp, Bovine  19866880951010
aaatgtttaaagcccttctaaaatcattatttctaaaacatttcaattatattgtatccaaaggctttaagaagttagaacactcatgtttatgactgcaaagactacacacttaaattttaaaattcagatgacttcatgaattcaggcaacatgaggataatccttttataccaagggagaaatattctaactaggcacctttctgtagcagcacaagttcatcaattcttccaaactctgctctgaccagttgttttgcctcagtaaaggagaaaaccatccctacccttgaaataagtaagaaaaagtagaataaaatatttataggaaagtaattttgaaagtctgacattctcaaatatacctgttcattaatatttaaactttaaaatagtatgtaaattaaaatttgtcattatgaaaaaaattatcatgaatctataaaaaatttaagctacataagaaaaatagggtatttaaaccataaatcgcttgtgttaaacccactatgcaaagaaaaacttatatgatattctaaaatgattatttagctgagcaaattttattattccaaattttacaaacttagtaacaggtatattacatacagtaagtcaatagtgagtatttctcaataaatttttatgactgaaatttttattcattattttatggaaaagtttatgcattattacaatgtggaattcaaaaacccaattagtgacaacactagaagttcctaaagaattctacaaacacaagactatctgcagagctcaactcttcttacagcctaccattgtgaggcctcatatagagtgaggacactagggtctccctattactggagtgccttatccttttttttgagttccaggacctttattaactcaggaggtagaatgatctttcagcttcaagcagccctgctgcagctctttccctcattagttccctgaggttagctctaagcaaacacagcagcaaagacagcagggagtatgaggcatctcctatacatcaaccactggaacaaatgtgaagagtgtttgaggaacaccacaagcctagcacaaaagcctcctggaaaattacacacaggtaccaacaagcaacctggtatcctgaattatgtatgtggcgatcctttacttacactaacacctgacaataacacctgacaacaaggacaggagctgactgtagctcagatcatgaattccttattgcagaattcagacttaaattgaaaatagtagggaaaaccactagatcattcagatatgacctaaatcaaatcccttatgatcatacaatgaaagtgacaaatagattcacggaattagatctactgacagacagagtgcctgaagaactatggatggaggttcatgacattgtacaggaagcagtgatcaagactatccccaagaaaaagaaatgtaaaaagggaaaatggttgttcgagggtgccttacaaatagctgagaaaaaaagagaagctaaaggcaaaggagaaaaggaaagaaacacctatttgaatgcggagctccaaagaacagcaaggagagataagaaagccttcctcagtaatcaatgcaaagaaatagaggaaaacaatacaaaggcaaagactagagatctcttcaagaaaattagagctatcaagggaacatttcatgcaaacatgggcatccaaatggtatggacttaacagaggcagaagatattaagaagaggtggttagaatacacaggagaactatacaaaaaagatcttcgtgactcagataagcataatggtgtgatcactcacctagagccagacatcctgcaacgtgaagtcaagtgggccttaggaagcatcaatacaaacaaaactagtggaggtgatgaaattccagttgagctatttcaaatcctgaaagatgatgctgtgaaagtgctgccctcaagatgccagcaaatttggaaaagtcagcagtggccacaggactggaaaaggtcagttttcattccaatcccaaagaaaggcaatgccaaagaatgttcaaactaccgcacaattgcattcatctcacactctagcaaaataatgctcaaaattctccaagccaggcttcaacagtacatgaacttccagatgttcaagctggatttagaaaaggcagaggaaccagagatcaaattgccaacagccgctgaatcatggaaaaagcaagagagatctagaaaaacatctacttctgctttattgactatgccaaagcctttgactatgtggatcaccacaaactgtggaaaattctgaa

SEQ ID NO: 47269 - DNA, 1366 bp, Bovine  19866880997690
tatttattatacatattgattaacatgtaatcaataatttaatgcccttaaaatatttatctctgaatatattatagccatacatcttatggtcaaaggcagattataaggtatgctgtaggagataaacatttacaccctctaattggattttgtccatatttcttttattagagcaaatactttgctatagcaaacatatactgatatcattaaaggtattagtaagacttgagggaattcccttgtggtccagtggtaggactctgagctttcactgcaagaggacatgggtttgatccctgatcagggaaccaagattccatgtgctgctgagtgtggtatcctcttccccaagaaaaaaacttgagccttactaacattaacagttgtaagttgtaaaaattatttgcatttcatctgttttctgttaacaggtaattactgttttcaaatattaatactataatcaaggcagagttcttaacttaggctaagccatcatcattcttatattaaatacaaccctgattcatgctaatctgctaacttgctaattgctcttcctatgtgaacactggcttatgtttgatcttcggcaaatagataagtctcattattactgctaaaaattaaatgttaggtaacttgacatgtagataatgttgccagcttattcaagtaaacatcagttttctcctcaataaagtcaagatctttcaaacccagtgtaaaagcagatttatatttataattatttatagattgtttccatactgtttcatttccctgagaagatgttgtagtataatactcaacacagcacagtattaattgatccattttcagctggacaaacatcttttgtgttgataacatactactatcatagccaaaaactgtaaaaaagctctatcttttggattataactataggaaggaacaggtggataaaatcacttatttctgtaatatcactacgcttcatacaacgaaactgatacacaaaaggtgatttgcagaaacttttaaaataaaaaggaaagttgtcatttacaagtaataactgtgacctacatattttggggtatttttctcattatttagagaaaaactcacaaaaataactcactgaaaatgttatccactatttcactatttagccttgggctaaataaacatttacggttgggctgaggaatgatatcagcagcataagatgtccttccattttgtctaacaactaatcaggcatctatccatgaatgaaagcaccttaatgggaggtgtagaatccagcaccatatgccaaagggcctgggaagactcttacccacttgtgtatcggtaatagacagatctcatt

SEQ ID NO: 47270 - DNA, 1206 bp, Bovine  19866881037478
tttctcttttctccttatctctgcctttacgtcgttctctattcccgagaaccgactacgtgttcttctgtgacttgacctttcactgcttcgactatgggaacgtggccgaggtcttgatcgggacctatggtaagtagatttcattaaatacattgagaatataatttgtattatgaaataaaatttttttaactgtctgaaagaaaaggatttagttttaattaaggattcagttaactgtgtgaagtgagcatctaaagatgattctttatgaataagcatatgtgagggaaacatagggtgccaactttacaaaaatataaggtttagtcaaagagtgtttgttcaggtgttcacaggaccctgttggcataatggatacaaatccgcctgccaacataagggtatgtgtttgacccctggtccaggaagaccccacaagccttagaacaactgagactgtgcactacaactactgagcccacactttagagtccatgagccgcagctactgagcctgcccacctaaagcccatgctctgcaacaaaagaagccactgcaatgacaagtctgtgtaccacagctagacagcaacctcagctctctgcaactaaagaagagcccacacacaacaatgaagacccagtgcagccagtaaataaataaataaatagaaaaaaacaaaagtgcgccagccttgtagtactacaaccagctttttaaaaagtgtttgtttagtcaaaaaagtcttaaagttcaaatcaagtcttcaatgctgaaatctcttcaacataaaataacaaatctaaatggatctattctaatccccaagaattaggatcttccccatccctacgaactctgcttctattaatatattgattcaacataatttcctgtattagttacactaaaactattcttctatataatccagcttttctttcattaaatggaggacaatattaggtcggatatattatatgcctttaaaaagtaaatatttttaaatctgccctatagtactgacaaaaaagtctctaacagattgatgatcctacagacattataaaaaactgtctgaagtcactgaacagtgactgaaagaaggcaatgacctataaaagggaaaaaatcttactatttaaacatgttgctgatttatttaacatatttcaaacaattaggttaggaccaaaaat

SEQ ID NO: 47271 - DNA, 1068 bp, Bovine  19866881042981
aacttaattgtagaacatagcattttctaaaatttaaacaatgttgaagtatgtataaaaacaaagcttcctttacccttcacgtccccctctccttttcccatcccacatagcctctgctaataatttggatttgcttatcaaacctctttatgcaaaatttgtctttctatggtgaaagcaccacagagttaggagaaggaaaaattctcttctggtagtatgaagtctaaatagtgacagccatagaatttcttcacccagtttgatcagaaaatgtaagtgcttcttccacttgtatctcccttgcaggaaaccatctgcatgagtaggtctgaaattcagagggtgtgaacgcagaacatcctgtaaggaaatctcttaaatctttgttgcctctcctgaccacatagaaattgcctttccttctgtcattcatttggataagctacagctgctcttatggctgttttttcttcctttttttgttttacagtgtcctttcagtcagaacatcttagcaaatgctttccttcgctaagcttcccaaggccatgtcaaataaagcaccaggaacatctgaaataaaaacagcatccatcacagtgttgaggctggctgtaaatcaacacgttcgtgaagtttacaaaccatggttgacactcatcaggggctgcccacatactggggtgcagacttccttactgagtgacactctttgtagatgcctagcactgtccctgaggcctttatggaagcgctcgtctgtgctcctgtcttgtttcagctcactgcctacatcctggtggggtcttactctgtgtccttgttgcggtccattgagcctcctgtgtcttcctggaacgctcttaccctgctctccctgtcccctactctcatgccctttttgcagggcctggcttaatgtaattccctcagatcccccacatcaggtttatctgcctttcctatctctatgaagtgttttgtacttcatccaacacttaacacttaaaacttcttggttgatgtctcttttccttcctaggtggcagccttcttgagagt

SEQ ID NO: 47272 - DNA, 1161 bp, Bovine  19866881103525
aaaataaaaataatattttgtgatacgtgaaaattattgaagttcaattttagtgtcaactgtaaagttttgttgggacacaactacactcattcttgtacctatttttatagctgctctagtgctacaacaactgctcagttgtcacaacagagatcatatgcggcactttcactgcttcgcactgcagctcagagcacaaaaatcacagtgattcagtatacctcaacagagtttcaagagcttcataaattgctgtaatgtgacatttaaattttgttttaatacaagtatataccaatcatgtcaaaaccagaaaagaagagagagggggacttcaaatgacatgcttgtaaggcacaatgcactatagattattttatccaattaaatggcaatgcattgcatttattctacaatgactatatagctgtgctgaatgaataccatacaggttgacactaccaaactaagcagccttcaggatatttccaacgtaaaggaaagcaagagtaagaaaaaaaaaagaaaacttaaaatggaaggactcattatggtagagtttcttcacaaaaataaaaaatacaaatgggtttcttagtggtgtatttgttcaccaataaatgaaagccatttaacacagagttgattaaatcatatttgactgcagcaggcaaaggaatgtgaatggagaaaataaacttgttaaaactattagcctttcagcaagaaaagttgcttgaaagttgaggacatagggagtatcatcaatagtcaaagacaaggcaaataattttgagtacttttccttggtacttgatgaatccacagatgttagtgataatgctcagcgttgtttatttgaggagtcagacctgaatctgaagtgactgaagaattacagcctctgtgagaagtctatgtagaacgtgaaaatattttcaagaaaattgagaaaacactaattcagtacaacctgatatggaatctactaagatatgttacacaggatgggtggttaacatatgcacagaaccaaaagaggcttagttggacaaatttacaaagcttgtaaaaatgtaagcatatgtgaaaatttattacttttttttttttttttttttttttaaattttattttatttttaaactttacataatt

SEQ ID NO: 47273 - DNA, 1416 bp, Bovine  19866881123510
gaaggaagaagtaagattgatgagaagtggtttttctttcagttagtaggagtttatttcattttggtaattacactatgttgattttttttttcttctcatattactttcaggtttgactttacacataaaaaacaatcaggtggtgcaggccagtttggaaaagtgataggtgtactggagcctctggacccagagaactacactaagttggagttttccgatgaaacgtttgggtcgaatgtaccaaagcagtttgtgcctgctgtggaaaaggtaaaaacaaacaaagcctttattgcattgaaaaaaataaaaaagtgtattagatatcaaatcatattgctgtcatgtattctgtggttcatttttgttccagtcctgcttctttatctgattaagctctccatctggtttagaatcattaagttcaagagctataaatataggctatgacaatgagaggaaatcattctgtctctgaatcatagttattacatttctcttgataagttgaaactacttgattgattataattagcaattgaaattttcagtagtcattaggggtttgtgaaagttttacatgtagtacccttgtagtagaatggtcatgcgttaagattcccaggacctgcgtgtgttgttatctctgctaatgattaatatgtccttgcataaatcacagtgttcagagccaatttcttttgtaaattgagcatacagtacttaatcccgaacccctcacaaaatcgaagattggataagactctgacatttctttgggaattgtgaggtgtttgcatatataaggggttatttgtgttttgctagctttctacatcactggctttaagactgttgtaaacctttagcaactgtctattcataaagattaaggttattttttaaaaacttttaacttagaggtctttagtaacagatcatgattttggttttagtattaattgtggtagcagtttttgtgatcatccattatacttaatttcaaaacagtattttgtcattcccacaaatgaatgtgtcattcacacaaatttaaattatcttttactctccaagattaacataggtgaaggaaagcttagatattttacagcattcagagtttacagttttgaagtgtcagaaatatattgtactacatgtgcaactgtgtaactagaattgtagcagctctgcaagtatttaatgaatgaaaaagaactgcacacatagcaaactgcactcttgaaatatgtctagtttattgtatatcagttatatctcagtaaagctgtgtcttaaaagaattgctttggaaaaatgaaattagtttttaattttagttctaacattgtgtagcacaaaaattattatgtagtggtctgccagtgagtcagagcagtaataggt

SEQ ID NO: 47274 - DNA, 1528 bp, Bovine  19866881127827
attaactttattttaattttattcttgtctgccatagtgtgattgatgtgtggcatcatcttcttcctggaaggagatctaacatcaacactgacaagtgtcacaaggtttatttaggacaacctcagccttgtcccagttagtttcaagatgtctgcctcatacatgttgagccactgcatttcctgctttaaagccttgtgttatgccaacataactatctgtgctgcctcaactacaaattggatgaacagcccgtgacactttttcaatattattacattaaaccaagtggattttgattgataacctaatattcaactaatgcaaaacatcaatcatggcaagtatattaattatttaatattgcagtctaattcagaaatcgatgtgctgcatgaggggaagggaaactcatggttcccagaagatttaagacagggaatgattaaaaaaagacctgctgtactcctgtgtgttagttcgatacaaatctttattcatttgccaataatctcttcccattttccacttcaggaccattttatcagttttgaaacctataattgaattaagtctgctttcagcacagggcaaaaggagttgcacaaatattgatgaagtcatgacagggacaacccaagagacagaccactaaagaggacaggctttgtaccatttgttacaagatccttctgtcaatgtcttgaatcttacctctctatttaaaaaaaaattgttttagccttttggaaccactcttaaagacttttgtgttaaaatatctatcacaataacagatttatatagcatattacaatatatagtgtacgttcatatactttatcttgcttattttttcacagccaccctatgtgttaggtaaaacaagagttaaaaaatctgcacatcataggtgaaccatttgagcttcagagaagttggattattacccaagctcattcaactgttttgttgtagaacttagatttaagatattttacttctagaaccggtattatacatcatgctctctcatgtagtatttatgtactcatgatggtttattcagaaaacaaagatcgtggcatctggtcccatcacttcatgggaagtagatggggaaacagtggaaacagtgtcagactttatttttttgggctccaaaatcactgcagatggtgactgcagccatgaaattaaaaatgcttactccttggaagaaaagttatgaccaacctagatagcatattcaaaagcagagacattactttgccaacaaaggtccgtctagtcaaggctacggtttttccagtggtcatgtatggatgtgagagttgggctgtgaagaaagctgagcgccgaagaattgatgcttttaaactgtgatgttggagaagactcttgagagtcccttggactgcaaggagatccaaccagtccattgtaaaggagatcagccctgggatttctttggaaggaatgatgctaaagctaaactccagtacttggccacctcatgcaaaga

SEQ ID NO: 47275 - DNA, 754 bp, Bovine  19866881130948
aaacagtcgtataaaagccaaaatgcctattagttccatttacttttcattaagaaaagtcattccatcatttagccccagcatctatgattttacattttttggtctctgactctaagtaggtcaaagagtaatgatgaattcatcaagtttttgttattcatcaaaaatgtcattttttaaggccacagggctgaagtgctatatttcttaactgttaataaaagaatattgtgaatatatctatttgtgcccttggtgagaagtctgtgggatggattcctagaagtagaaatgctagagcagaggttttgcacgctgaacatcttggtggatgctgtgaagcctctgctgtaataactttctacccatttaggactttaccaataatatatgaatgtgtttgttttttttattaatagtgtcctcgctatgttggacactggcattgttttaattgttgccaatttgatagggataaatgatgagtgatcttattttaacttaaatcataaagtctcttctttaattggagaaaaagttagcagtaggtgctgtttaatgagcagtggttgttactggttctatgcttggctctctagatgggtggtgatgacccagaggtaagataatagactactggcataatgttaccatgattgcttaatttgtaattcctaatgaatactggaaaattagctttcctgagacattggtaatgactttttgcaaattatctttattttcttacttg

SEQ ID NO: 47276 - DNA, 1107 bp, Bovine  19866881192283
ttgctcatctgaattagcaacacattcaatcagctcctgccggtggtctgctgccgccgccctgaattctgctggaatttccccgtatcgaacaatctgactaagagaagaaatgttttattttggtactttaagaatattcaattaagttgtaactaactttactccaataaaaattaatttgaaaaaagaatattcaattaaacatataagttatcagtgaaaaagataaactaatggccaaaatgttttttgagataagagctctgatatttttgcattaaaatcacaaataagaaaaaaatgtatctgtaaaattcagacggaatagtggacaaaatatttaaaacaggcaaagcaaattgctcaaggttctactaccagtaaatgtatgagccacacacaattcaaagccaaactgactccaaagcccatgagtatagctgacccgtgaacaaaacaagtttgaactgtgcaggtccacttatacaaagatgttttcaataaacatgcaaaaatatgtgtattacattgtctgcaagacttgtactgaagtgtatcattatgtaggaataagtgatatttaatatgaaattaaaaatgtattagtttaattactgttttaaaactttgctttcaaagaattacatccatacagtatgcctctcacagaattagagaaactgcataccattacaggtaatttttttaagtcacaatatttccaatactgtattaggaatatgattataatatcatatgccataaacaattttataataactaggctaggctactactttacaccaattatactaggctaccataaagcaatacattgctgcttctttcttatcaatgcatgaactgttatacctgtaaataaatatgaatttcttttcacgttatcttttcatttttgatagtgtccagtcaacagtaggttactagtaggtaagttttgcggggagtcaacagttatactcgaacttttgactggatgagggatcgacacctctcatctctacaccgttcgagggtcaactgtactggaaaattctattagattaatcagaatatcacagtctttgacaagcaagatagaga

SEQ ID NO: 47277 - DNA, 1086 bp, Bovine  19866881205355
cattagcattgagagtactatacagccaaatgaaatcaaaaagactttatgtattgatgactattatttatatactttaaaaatagttatcctgtggaaacggacatcaagtctgtctgccccactatcacgagcactgcgatcagaagaccgagcagggcttctgctacgtgctgtacagtcctccctgagccccacggtgtcagcagccacattaccatagcaatccaggggttccacagtgtgaaggccagcatgatgtgggaagcaagtgtggtcaccactgcacacaaaacccagatgatgttctttcctgttttatccaccagaagcccaaatattggggacatgggagctgatattacatatacgacactgcccagaaaatacaaaagatacttaataaaagatatcacagcaaaaaaaaaaaaaaaaatccaaaagtccttaattctaaaattcctagctcatttaacattcttctaaaatggtcatcagtaaatagaaatataaagatataaaagtgatccaagacttcgctggttttccatgaatgtaaagatggccattttcaggatcaagacccaagacagacttggtttcacactatagacgttagctcacataaatcttctctggctctaacacggggttataactaaagacccacactaagcacacagtaagcattcacagaattaatggaatacctgttaatagcactggctgcctgggaggaaaatccaaatttctctgtaaagaaaactctaaaatagagaggggggaaaaaaataaaccctttagagagaattattctgtttttgtaaaaataaaagcaaaataatactgaataaaatagtcaacttccccttctttctgaactgttttcccatcttatttgatattcatctttgagcaacgggctaaagctttagtatttatgtaagtacttgaccaactaaataaaatacactgatgcctaatttttcctcttttacatatacagaaaataatacacacaaattttcagaaacccaaatatattactatatgaaaccaagatggcttctttttcttaaaaataat

SEQ ID NO: 47278 - DNA, 1037 bp, Bovine  19866881238401
aaaatgagagtgctacataaaaccaatactgggttatttgttctagctaaatactagcacctttagctagaaatagcatgacctacaagctgactgccataacactgaataagtgataatcatcaaaatgactgagaattaaggaagaaaattaattcccaaaggtaatcactatagatctcattagctcaagaataacctaccttaggactttaattaaaaataatatttatcccagataaatgagtgctggcaggtttctgcaggatccataatcttggttatgctaaatcttcttatattaaggcagacatcattaatctcatttgcaatgccctccagtctgacagctcttatagcactggggctatttcttacaatatcctttttatcttcacaaaagagttataactcatgcagatacctagtgtaaaaaggtctaggcaattagagacatcactccgagatctacactggcattttatcatgtcagaaggcttctcataatgagtttgttcttaaatggaggccaatatctcaacactaccatcaaattaatggtggttatgttattattttatttatttatccctatcattctttgttccagagaagcatcaagtattttataattcaaaggatatgaccagataaagagaaattgtaacaagtcagtgaagaaactagggccaagaagaaaatgaaagtagagacagcaggaagttagaaggaatgaggttaatattgtaaacgcatgctgtaaagttctgcagaattacacacctgcaaacttgtcagctgatgttggcatatattcccaatctttggctcctcctgtggctcagcggtaaaaaatccacctacaatgtaagagctgctgaagacaggtttaatccctgggttgggaagatcccctggaggaggaagtggcaaccactccagaattcttgtctagagaatcccatggacaagagcctggtgggctacagtccatggggtcacaaacagttggacacaactaaagtgacttggcattc

SEQ ID NO: 47279 - DNA, 941 bp, Bovine  19866881306792
acatacttgactatttttcttcaaaaatttgacttttcttcactgtcaacactgacactttcttaaaatataaaacttatataatggtgttgtgaagtgctatatccaattacacagacatctgtttccatttacaagctttaatacatacttagactgcatttaaagtcatgaaatattaaaacttttatgccactcggtatcattgcaagaatctattaaattagataataaaaacaaaccaccagtaactctaaagacttttacttcatttacactttattctccctggtagaaggacaaggataatagaaattccatttaaattcaattttggttatatgtgtaattgtagatataccccttgagtcatgtaaaatgctcagcttatgtttctttcaaattatcccgctcagattcacattctactccttacaaccatcttcaatatgtattagcagagctcattagactgaaatttaataatgcaaacatcaggtggatttcaagaacctccattaacaacgtaagatggattgcttatatatagctcttgggccaactgggcacaatttaaattcaataaactaccctgcctaaatctgatttatctatttcactaggctggtctgtcctttcttactgatttgttgggcaattcattggaatattgttttatatggttttctttaaactgcaaatggctgttgtgctgtggttaaatattttatgtaattgagcttcacattgtcaatcaagattcccaagtatgtgcttgtgtatataatttaaaaaaaaccaactttgaattatggaaaaatattaaaaacacatttgaaaaattttatcaataatcaatacaggtatgttctctacaaaggatatcaatgaattcacttgaataaaatttatttattcaaactgagtcattaagatcaaac

SEQ ID NO: 47280 - DNA, 1670 bp, Bovine  19866881338906
aataccagttttattttactttttttttttgagataattgtagacgcacatgcaattgtaagaaatgatacagacagatccttcagacccttcagccattatcccccagtagtaggaaagtgtattgtatttctgcagaataatatcataatcaggaaattgacactgatacaacccctcaatgcctagtttaagttttttagtttgccttggccagacagatgttgtagacactattggaggctctagctttgcattttcaagcaagtttctttcttcttcagtcagccaccctcttctgctttccccctccctctcctaggtagcctgtcattatggcactattctagctgtctttgtgcaggtgtgtgagctctagattcttggaattccaagcactgatgttccttagagcccctgtgaaataaggtcagagactatttcttcttctatcaatttgtagccatctcttggtttctactcctaataccagtgtaggtaacagcagggtatcagagctggcaggaataatagatacagtctgctgtccatcaaattcactaattaaggttacattcctttgttcttatttcagattctgtgtagtcacattttatatacatatgaaagtgtgtctgttatattacgaaaatctcaccttacacacaagtgaaatagcacaaatttcaaataaaaaatatcaagaattgtgtaatttcaaaactaacatgcagcttgagtgaaatagtcactgtgtttaccttttgcttcaccttttgctttagccctgcaaatggacgcacccatcacgctttgtcagaacaggaacttctgcaagtgatattggtggctgttgtgcctttatctgaaaaggcactgttataattgagtctctttttgtaattgtaaaataatgtcatacatgtatttattagtgtcttggacagatgctggtgctagctctgaaaatgtgcctgaaaaccagtaactagaaaggaagggagatgtgataaaactattgagacaagcgtgtactatgatactctgcttttaatttcagagagagcatttcctgaaatattatagataatgccaaggaaataaaaggctgcattaaagggaaatatgctactatggttgtagatttatgtgccagcatcttcatacattatatttattccaatgggaaaattagttgtgaattatgcaagttttgatttatgcgagatcttgactaatttatcccttacataaaatacatccccctatagtactgaatttactttgttcatgattcacatggtgtgtacatttaagatgggagtttgaaacttcttagtcctagtggaattgaatttcttatttttacaacttatgaaatttttaagtcagttgtttgaaattcaaggatacatttctcaaagaaacagtcattgcataggaactcacatttgttgattacctactatatttgtgttggtgctttacatattctttctattggtacttcaatagagccctttcaataactctgacattcaccaccctgaatttgtagaagaagcttccaagaatcagaggtgaagaaatgggtcctacaaagatgagaaggctaggattcaagtatacatatgtctgatgaatatttgatgtatatacaaaacctgtgt

SEQ ID NO: 47281 - DNA, 770 bp, Bovine  19866881370999
ttttttggtcatctcaaatcatttaaaatttttttcctaacaagacaagttattctctttaacttttaaatttcttctgtaaaacgactatgctgtgctgtgctcagttatgtctaactctttgtgaccccatggactgtagcctgccaggttcctctgtccatgggatttctcaggcaagaatactggagtgggttgccattcccttctccaggggattgtcccaacccagggatcgaacctgcaactcctgcactggcaagcagattctttaccattgcacacgtgggaagcccaaaattggggtaatgatagttgaaaagctgtaaatattagaagcattgtgtgtaagagactatctatgtattaaggttttactaaatcgtagttattttattttttattaatactatgaatttaactattgattcctgtgattaccagtttttcaactatcattcttttttcttacctttgtgtctttttaaagaaatattccctcagccttaaaaactctttctttaatgttgtccattccaatgatctttttgtctcattttagggatcacatcctttataaagtatttcttgcctctcatgaggtgctaaatagatatgcagttagcacccacagtatctatacctaatctgaacagagacctttgtaactataaaattttgtaattgccagattatatatatcttatttattgcatttatatttacttggattataacaagtactgaaatatttgtagaatgtataaata

SEQ ID NO: 47282 - DNA, 1309 bp, Bovine  19866881579430
gggttttaaatatatttaatttaccaggaggactcagtagtcttcataattaagtttattgagtatatgcaccatattttgtgatcattaagcttggaataaatgaagcttaattgctgctgccaaggaaataggaagagcttttttacataaacagtaacacagatggattttcatatgtcaaataatttaagagattttaaatgtgtatggccttctcccagggacgggagagcctggtgggctgccatctatggggtcacacagagttggacacgactgaagcgacttagcagcagcagcagcatggcactctccacatccccattctggttactaaggtaatgtaatatttcacacaatgacttaactcttgcactgcatgaagaatagatcttaaacttgatatttttgaactgtctgttttgacatacaatctataaatgggaaacttggaatatactcaataaatgatccaaaaatatatttatattggaatttctggtgattggtacccaattttgatatttcagtgtatgattagcaatgtgtctcaatgccatttaattcagattatcaacttgagcaaataaatgaagtcacctgattctctttaagatagcttttgaatctcccactttgacctcaactatagttagattgcttttattcaagtaaaatctttttaaattttctaccaagaaaataagcaccaattttagaaatttatcaattatttaattccataggcctaggaattaaaataaaccattcttcatcaaagtaaacattttagtggaactgaaaggggctgtaagctcctttcaaaagccaaggaataagtaccatattccttacatgaatggagcccactggcaaatgctatcaagtatggaaagagtctgttgaaggattctggcaggttggaagacttaatctgccttcaaccattcctcccactgtgaaaaatcttctaatatgactggctcttagtgaagggataaacagaaattttcaccttagttgctctttatctctaataacctgagaaatctaaccagcatctctgccaaataatgccaagtagacttgctttcatcataaagtatgactgatttccccacatttctcctgatgcagctcaacaaaatgaatgtgtggtagttaacgtaggcctatctgtaacatctgcatcaaaagtactaagaaacataacacagccaataacaagtgtgctttcaaaaataaaaacataagaattacagatgtaaatttcactttccttgtcaatgaatatatcctgcagctg

SEQ ID NO: 47283 - DNA, 714 bp, Bovine  19866881822619
actgttttaaagtagatctatttatttttagttgtgatttggagccagaaatccacacaaagtcaaagtattttaaggaagtgcattaaaccaagggaagtgccaatcggaggacacagcacaggttttcctgagtgaagctggacacggttttggcttctgacctgcacatctctccacaaggttgagcaaaacatggagcaaacatcatttcaatttgagaaaagaaaacatcctgaatattttatgacttcagatctgaactcggagcagccacaactggaacactgctcctggatgtagagggagaagcccagcaggtcacaggcttacagccacactgggctctgctcagccccacagcacaggccacacagccctatgtatacaggagccactgcccaggcctagagagctagaggggacaacgtattctcatctaagtagaccctcaacttcagatttctttactgaaaggtaaaggttatacaatattatataaacttctggtgtggaaaaagccactctgaatgtgcaataaaatctcactgagaataaaagtaaaataactttaccttgggacttatccacaatccataactgctttctgttggattctaaaactctgtttgaattttacatataactgaatccattgctttaagcaaacccaatacataaacatcctgattagggagtgagaatttgctttat

SEQ ID NO: 47284 - DNA, 745 bp, Bovine  19866881837676
ctctgttgtctgtctgaggacttaatcaactgttacttaagcacctactatgtgcccagaaaatgccaggcactttccaatagcatcaacagaagtctgtctgctgtacaggtcaactcactcagtctttcagagggaaaagcggttcctgctgctctcaccagttacccctcctggccattttaatgacccgcagtctggatgcctgatcccagacacagccatcagggcacaaatctgccatagcaccaggtaaccacagaaccacgtcctggatctccaaaagcatcaaccagaggtgcagtgtctccagttcaagagaactgtctggggccagaatcgggaacatatttgctcgacacaaaaagaagagcccatggtgtacatgtgtgctcatctgccatgttagggcttttttcatatattgaaacttcctgggatagatgaaagactcaggcagataacagctttgattgatgaaacaaactgcaagtggatgacttctacttccatatgggataaggtcaagagataattttttttaggttgcaaatagtaacaaaccaggttcagctccttctgatctatatatttttgaaaaatgaaaagtattattcacatttccagtgattaccacaagtaaaagttcctgatctatctgattacagctattattcttttcctttgagcacaaacatatctgtctttgtcagaagcagtttgctggttcaacctgagctcgttt

SEQ ID NO: 47285 - DNA, 880 bp, Bovine  19866881867935
ttggtgggagggataaaatgggagattgggatggacagatatacactgtggtggtttagtcgctcagttgtgtctaactcttgcaactccatggactataaaccacgtcactcctctgtccatgggattttccaagcaagaataatggagtgggttgctatttccttctccaatatacacactactatatatataacatagataattaataagggctactgtacagcacagggaactctactaaatactctgtgaagtgaagtgaagtcgctcagttgtgtccgactttttacaaccccaaggactatagcctaccaggctccttagtccacggaattttccaggcaagagtactaatactctgtaatggcctatataagaaaagaatctaaaaaataatggaaatatgtataacaatcactttgccatacagcataaactaacataatgttgtaaattgactctactccaataaaaaaggttttaagaaaacacatagtctctgagagctcacctaaattcaactagagggaacaggtggactccagaagtcccaacatcaaatccttcactacttaagagggaggtggcttgggcggaccacctaagctcctgtgaaatggggataaaaagatctaccttacagggcagtcatgaaaactgaatgatatatctgtatgtgaaacgcatggagcttggtaggcatttatttaataaatagaaagtgcccttaagatgtagactcttgtctttgcgactgtgcatcatcagaaaatgagaggaatggagttgtcttttgcagccttgaatttggctgccctgagatttacaacatctgtggaagcaataaatcatcagctcgaaggtgggccaggttaca

SEQ ID NO: 47286 - DNA, 1554 bp, Bovine  19866881023888
atgctgggaaagattgaaggcaggaggagaaggggacgacagaggatgagatggttggatggcatcaccaactcgatgaacatgagtttaagcaagctctggcagttgctgatggacagggaaccctcgtatgctgcagtccatgaggttgcaaagagtaaggcacgactgagtgactgagctgaactgtactgaaagataaaaggattccaactccaaaaatgatccttttaattactaacagtatgttgtgctgctcactcctgcttctgtgcagcttccatattctctgtcctctatcacagtgatgacttcagctgcctggaagttccagctgtctataagccctcatcaagctggatggattccctgaagactctgcagccccacagctgagttccaagcctcatccatttcatagatccaggaccctgctattcaaagtgtggcacttggacaagcagtgtcacctgggagcttgttagaaatgcagactctcaccccatacctactgagtaagaactgacattttaaaaagtttcccaggtgatttctatgaatattaaaaacagtgatctgagaattgaatcacagtggatacagattatcttaattgcttggatatttttcagtgtgataatctcctttctgcattagccatagtgtttttgatacctgtgagcaaactccaccatgaagcttatcacactctcctttcccagctttatttaatagcagtgtcttcactgacacagagttagagaatttgggaaccagtaaatgatttcactttggggtagtcctctgttccatgccaaatagaaggtcctgctcaacttctactctggaagtcaggaccactgattgaccaagcctttacagctcatgggataagggatgtttttctttgttttctggaaatgagccttcctgtttattttttcctttccacattagacttaaacatagcacaactgcatgtgtgacaattgtccacctctgcaaccagacattctgaagatgtcagcttctgtgcacttgaagaaaacccttcttatttgtttctaagaagccatttctgtcttatttctcaaagcagacagaattagagaaaggaattcattcatttaaggtagtaatagaggggcagtgggtctttaaattctggcaaaagagagatttcaaatacctgtttgctataatgcaaaagagggtaaaaataggggggcaaactgttcctactgctgccaatcaatttcaatatatcacttttaatcttttgagaaattctatgatttagaggttctgtcaatggtcagcagaacaggtgagaacaggtgagcttcccagatcccactctccatcactctccatcactcctcatcagaccctatcagaggacttggagctgggatgctggcccatgatgactcaggagcatgaacgtcagctcccagggctgctgagactagtgctcacatggcacatctggagaaggctagaaaccctgggagagggaattctgcataaaaatgacttggctctcagtgctcc

SEQ ID NO: 47287 - DNA, 969 bp, Bovine  19866881805891
taatgtttccaactgaagctccctatatcattctatgttgataaattcttgagatcagcttggattttggatttcttttagtctcaagtatttttaagatctaatttaattattcaggaatgtactttattctccaaatattttttatcttatttccatgttgaaactggaatgcttggtcatctccctttaaaaaacagtttcatactataatttgtgtgtattttggaatgtgactttcttccatgagaatttgaaaataaatgccctgagccatttacatgaatatgagacactggaagataaaattaatgcatttgtatctcaggactcttgctataaccccaaatatactactagccaaaagttgtattttcaagtttcagtgcaactctttttggcaagagatttcatttaagtctttcttttttccctctgaaagcttttctgatgtaagatttaagattaaggtgaatcaatggccttcactgctttttattttcttcccaaccatgagcatccacacaggagaataagaggtgaacttgaagaagccagcctgcagcctttccattcttctcacttcccctgcttttctcttcctttgccctcgttcagctttcgagatgaaagtaggctatgagaaaggatggtggattgttcctggatgaagtggagccaagtgacaacacagcccataaaacaatgatgcagtcctctatttttgctacagtcaaattgcttttcaagatttttgtgttataaaaatgcatggatttttagaaactatactgattatataacctaatcctcattccaaccctgaaagccagatgtagggcaaacaactatctagcttttcttgtttttctgcttcatcccataaaataagaacttttgacctctcagaattctcagaaggggtgagaaaatagcttattttttttcctatctctcactgctttctct

SEQ ID NO: 47288 - DNA, 900 bp, Bovine  19866880067302
gctgctgtagtctgaagggaagacagaatttgctgctctgttggtttgtgacacgtactttttctttaggagaacttattttcattttgctggatctcacattttagagagctctttttggttaagctgattccgagcaatgtttctgagctggactaaccacagagtaggatcttatctcacttatggctatgaatcttcagttcagtcagttcagtcgctcagtcgtgtccgactccctgcgaccccatgaatcgcagcacgccaggcctccctgtccgtcaccaactcccggagttcactcagactcacgtccattgagtcagtgatgccatccagccatctcatcctctgtcatccccttctcctctggccccaatccctcccagcatcagagtcttttccaatgagtcaactcttcgcatgaggtggccaaagtgctggagtttcagctttagcatcattccttctaaagaaatcccagggctgatctcctttaggatggactggttggatctccttgcagtccaagggactctcaagagtcttctccagcaccacagttcaaaagcataaattctttggtgctcaaccttcttcacagtccaactctcacatccatacatgaccactggaaaaaccatagccttgactagatggacctttgttggcaaagaaacgtctctgcttttgaatacgctatctaggttggtcataactccttccaaggagtaagcatctttaaatttcatggctgcagccaccatttgcagtgattttggctgtgaatcatattaatccatttatcttagctgtcatgcaatttgctaattaagtcattgtaggggttaggggaagtgaaagactttgaagtaccagcagttaatgctcttgcccagt

SEQ ID NO: 47289 - DNA, 2515 bp, Bovine  19866880125207
gaaagttatgaccaaccttagatagcatattcaaaagcagagacattcctttgccaacaaaggtccgtctagtcaaggctatggtttttccagtggtcgtgtatggatgtgagagttagactgtgaagaaagctgagcaccaaagaattgatgcttttgaagtgtcgtgttggagcagactcttgagagtcccttggactgcaaggagatccaaccagtccatcctaaaggagatcagtcctgggtgttcattgtaaggactaatgctaaagctgaaactccaatactttggccacctgatgtgaagagttgactcactggaaaagaccctgatgctgggagggactgggggcaggagaagaaggggatgacagaggatgagatggctggatggcatcactgactcaatggacatgagtttgagtgaactccagtagttggtgatggacagggaggcctggtgtgcgtgattcatggggttgcaaagcattggacacaaccgagcgactgaattgaactgatgtaatgtttattccatgtgaaaaattacgagtgggaaaaggacctacttttctgatcctggtcctttctacttgaggtcatcactgttctctgattattctttcagtgataagttttgtgtaaggcaaccatatacgtatatctcctcccccaccccactgctttagcatttaacaaatggtagcatgctgttatatactttggagactggcctcagcgtagttattcacttaataatgtgttgtttcatgttagaaaatacagatgtatcttatttttaaatacgtatatagaaaatgtgcttgtaagtaattggctatggtgtattgacattataacatgatgatatcttgagtcttagagctgggttcaaatcctggctttgccatttataaactgtgtcactttgggcaaggtacataatttgtctgtttcagttgttcatttatgaaatcaaaagttagtatctcttcacaaggtttttgcaaggattagaagagaaaatgtatgtaaagcatttagcacaatgtcttgcttaatattaataaatcatagctgttattatgctcctgaatttatcagatcaagtgaaccgctaatgtgcttctccttcctcaactaaagtagaatacacaggaagcattacatgtttcttgacctcttaacttacgttggttgtcctttttcttccagtctattactgtttatgttctctcccgctcccttccccaccctctccccagtcaataatgcgtatttcttttacttgtgaggtttcttactgatcagtggtgtcctcctttcaaattgttgcttttcagttgctgagttgtgctgactctttgtgaccccatggactgcagcatgccaggcttccccatccttcactctctcctggaatttgctcaactcatgtccattgagtcggggattgccatatgactgtctcatcctctgttgccccttctcctgccttcagtctttcacagcgtcaggtcttttcctgagttgactctcggccttggtggccagaggcaggtgctgtcgtttgtgctttagtataaacctcagcagagaaggcgtgtttctgttgatgatactctggagtgaatttaatattggcaattgcatttagtcatgtcactagacaggatgattcttcttgtgactgggatttcaaccgggatagaactgagatttggatacagatggcagttgacagggttaagtgtgggcctgagaatctacagaggcacttcaactgtgggcctgtctggaggtggccctaggaggccaaaccatgatgggggaagtgtgtgtgtgcattgctgggggtatgcagtgatacattgttcactaaaaactatcaggagaagtcagaggcagtgggttctcatggggaatagtatgcagggtatggtgtgtttttataaaaaagaaaaaaattggtgcatataaaccagatgagcttccttactgagctcttctaatgttctgctccagagtacgagctgtctagctgtgggaagcccccagccttttccacaggggaagcatgagtctcacttgacagagcatgccaagctgtcacacttggaggactgaggattggtgcacccaggaatgcttgtggacctttttaagggggttgagtgcctggaagagtgtctgggggcttagctgcccagtttaaagtattaattcacatcagtgtgatttcatctgttcccactgactcgggtggcctaaacaagccggcttatatttgagaggtttcttttatcctctcttcaaggttgtgctttctggcttcttggctttgataggttttcattacctgaatgatacatatgtgcactgtttgataatcttaatgtttttgtccccattgagtttctatcatatgttgtggtcatgagtcaggatctgttatctactcccagggtatctggtgatggtctgcatgtccttggtctgtgtattgccaactcaa

SEQ ID NO: 47290 - DNA, 1909 bp, Bovine  19866880142724
aactaaaaagtctcttgatgaaaatgaaagtggagagtgaaaaagttggcttaagctcaacattcagaaaacgaagattatgacatctggtcccatcacttcatgggaaatagatggggaaacagtgggaacagtgtcagactttatttttctgggctccaaaaccactgcagatggtgactgcagccatgaaattaaaagatgcttcctacttggaaggaaagttatgaccaacctagatagcatattgaaaagcagagacattactttgccaacaaaggtccgtctagtcaaggctatggtttttcctgtggtcatgtatggatgtgagagttggactgtgaagaaagctgagtgccgaagaattgatgcttgtgaactgtggtgttggagaagactcttgagagtcccttggactgcaaggagatccaaccagtccattctaaaggagatcagtccttgggtgttctttggaaggactgatgctaaagctgaaactccagtactttggccacctcatgtgaagagttgactcattggataagactctgatgctgggagggattgggggcaagaggagaaggggacaacagaggatgagatggctggatggtatcactgacttgatggacatgagcctgagtgaactccgggagttggtgatggacaaggaggcctggtgtactgcgattcacgggggtcgcaaagaatcgggcatgactgagcgactgaactgagctgaaatagcatcagtttatgtatacttcttcagtattttaaaatatttgtgaagagcttgtctacttaattgtgatttagttttccaggtagggcatgtttctaggttggtttttcaaagaaagtttttgccaagtgtcaatgccatgcttttcccttatccattgacatttctgaagtctttgtattctccatttaattcctaattatttgaggattctctgagcagtttgcttgaagtctgtttttccctcttagccactgacagcaaaacgcatctgcctgagcgaggcccctttgatcttcagagagcttcatctaaagggagattaaaaagaagtctgccaggcattatcccaaggaaatggaaagtgcttcccaagatttcagatcaggtgaagcttctctgaattaggacataggaaagtaatgtgctgatcaatggcttagtcattggttagagatttcagagaattgcttgacttggtatgagagaatatttttaatgttatcctaggctcagaatttatgccataatattgatggccagaagcaacgtctttccattaattttcctgtatttaacactcctcatgtccatgaggacagagaccagcaagattcaatggttttcagccttgttggggcctggtgtcattggaagaatttgcaactgggcttttctgagttgagttgaaaaatttcagaaacttatatgccaaccccctttcctcattttaaacaaatatacagagagtgcttattttttgtcagattctaggtttgtactgtttaccaggagcaaatctaacaggtataggatctgacaggcaatgggcttcagagtcaaagtactgtcctcaaaacactgtatataactaagatgtcttgtagggcctcagttttagtaaagaaatataaagcctgtaatcaaacaaagtttcattttaagactattaatttagccttttaaaaagttagagctgggggtggctaatgagctgctgatttgtaacataaaatatgtctgtgaaaaaagtcttctttgaggctctctttctgtcagtaagaaaaccttggggagaaagctgtaactgtgtacagtggaaactttttattgagtttggggttggaaaggagaggaaactataaagtctaggaaggattacag

SEQ ID NO: 47291 - DNA, 1206 bp, Bovine  19866880513198
aacgtgaacattctcatatcactatctcatctcttttaaactttctcactgcattaatgacctcctaggtttcaattagtcttgccctttttttcttccagccgtttaaataaataagcatctcacattttaaagaaatttattcctccaaacttcaggtcttcattgataaattgcagcactaattcattttagagaacctaaaattttgagtatgaaccactttcaggctagagtaaatatatcatgtgtaagatggcagcacctaaggagaaatattatattgcatcttagttatcttcgacattgtaaacaccacagcaaaagcaaaatgaagagaattaggttctaagagctaagacataaggagttatagaatccccagatagaagacacagaagcttggtaaagggcagaaaagatgtgacaaaatacaaatcaaaaactcacggcagaacaattctgaagatgtagtttaacctccaacttttacaggagagaaaaaaatcaactcagatgctaacaaacctgctaatataacaagttagttagaggatgaaataaaaaccaggtctactaacccttatcccaatgccttttgcattcaccatatccttttttctaggaaagctttataaaatgttctcattcccacagtacccacaggagaccctggggacagggagcctgcagccagatcaaggcaaggagtgtgtcttcagagcggcctgtcagggggtcagagcacctcaaggccagaagagcaaaggagcaaacgagcgcttcctgaagcactgctcctgacatctctaaccctgtctgtacttggatatgggttagtaacaatgtgtttctccagagcaggtctcaggtatgggatcaataactggtgggtggtatttatcaaactatgagacacttttctatttcagggaatcattaaaaaaacacaagactaatttctatgcactgctacaaaagaatgacatgagaggccatcgctgcagttccatgtggcaaaataaggcacaaatgtttatattagagattattattttattttttaaataaattttttattttaaacattttatttaattaatttaaaatacatttaaatttaattaaaataattaattttaaaaattaatattttaaaataaaaaaataaaagttctgttttattaaaagatttatgaactgagg

SEQ ID NO: 47292 - DNA, 3685 bp, Bovine  19866880520887
ataaaagaaaaggggctttgttagaagtcagaaggcagcctgagggcacccgaggtccctgtccctgtcttccctatcacccatggcagttccaaatacatctctttgcaacaagatggtctatgaagcacagtccgtaaactttcattttatatcatcttacaactatgaaatagctgggttttaagaaagttctattgagatatgtcatttatcataattttagctgtttaaagggcataatttaatggattttagtaaattctatgagttgtatcactatgacaatccaattttagaatatttcatcatcccaagagaaacttcaattctattagcaattcccattccccatctcactcctatccctaggcaattattatctttctctgtatatagatttgcctgttctgcaccttttatatagatagaatcaaacaaaatgtgttctttgtgtctgtcttcttcacttagtataatgttttcaagattctttcatgttacagaatgcagcagtatttccttcctttttattgctaagtaatattcaagggtatggatatagcacattttatttactaaccagctgatggacatttggattgattccactttggggctattatgaataacactgctaggaacacctgtgcacacattgttgaatggatgtatattttcatttttcttgcatacatatctaggagtacaactgctggcttgcatgataagtgtatctttgacattttgaagaactgccaaactattttccaaagtgacattcccatgagtgatccacaagagtgtttttcttttgtttcttacgctttcagtataatatctaagaaactaatgcataaatggctgaagatttactcctgttttcgtctaagagttttatagtgttagccatagaagagaaaaacagagttattttggtacaggtgtgaggtagggatccaaaacattctttacatgtggatatacagctgtctcagcacaattttctgaaactatttttttctccattcagttgccttagaattttggttaaaaatcaattgactttaagtgtaaaggtttatttctgcagtttcaattctactctattgatcaacatgtctttctttatgccaataccacactgtcttgatcgctgtagctttggagtgtctgaaattgggaagtgcaaatcctcccattttactttctttttcaatattatttggttattttggatcctttgtatttctatatgactttaggatcagcctatgaattctgcaacagacagaaagattcagctggatttttatatgaattgtgtttaatctgtagatttggggaataatgtcactttaataatattaagttttctgatctataaacatgtcatgcctttccatttacttagatgttctttactttcttttaacaatattaaaaaaaaaacacacaatgttttatagtttttggtatactagtcttgcacatctctttattcttaagtatttcacccttttaatgctatcataaaatgtagttgttttctttaatccatttgtggattattcactgctgtatactgtgtttgacaagattcaatcattgcaggcaaaaaatgaatatactaaaatattatgaataccataagccaaataatccaactgttccaaatacaattgctggaatttcttgaattttaattaatattttcttactccctatttttccctagagctgataaattcttcagacaccttgtaattatgtataatttaaatatttcgtgttaatattcacttgccatttgcagaggaggacaagattgcagcaagcatgccactatctccctgtaattttaattaaaagaaatccaaaacattggctgatacaatggcatcattatctagtccactgtactgaacataatacataatattaatgataatatcatctatttaggtaactccaattctaaaaagaagaaaatatttcacaaacattcattcattaatcctcacaatattgcaatgatttggtagaatcaggattaacatcttcatctcagttttatagccaagaaaagtgtgttacagaacaaataaacaatttgtctagtctctcagaaaagcagaagctggacatgatttctaccaaaaagtcctttcatttgtcaaaaaatataggtatatataagctcatgcaaaatatgtagtcctgaaaatgcatgtgaatccaaattttgcatatataatcagactttaaatacattagatactattaaaataaatcatcttgtgacacattttgttaacaatttttatgaaaacaatgaatgttaaaattctgaaccagcaacctccaattaacaatccttgtatatacatgagttttcatttcatagctttgttttaatggcagtgacttaataaaaccatgattttaacattaataggttaattcattgtaagcaaatgacaatgagcttacatataaatggaatttttattcaaggtttttctatcactagaaatctaactgtataaaaacatatgaaatcataaaaaaaaaatacctctctggtctaggagggcaaaacaacaaccaagaattagttaaaatggctactgaatgcttgaaatttccaaacgtttgtgaatcaaaaggaaatcaaaatatgaaccttggagaacatcaaaagtaagaaatacttctcaaacataatgtattacttttgagaacctgtacatagtttataattacaaaaagttcaaaggactgttctagttcaacaaaaataaagattatgataattatggaccagtattatttaattcagtaggaagattagagaacaaagtaataaatcattttatcatcaataagagaagtacacatactggatcaattgaaatggtcaagaaaaaacaaattattccagaacaatttgcaataacacttcgtctatttagaattctgttacatgaacacatgtttccagagtacatctaagaacacaaaataaacaaaaatatgtttctaggtcaccaaaatagatgccaaaaagtccacacattaaaagcattttatgcacaggccagtcccttaggctgtcactcaggatttaattgttataatttcaaacaatcctaatcaggttttctccccatctgctagatatagaaaattggaaatagcaaaatagagaaaggaagaaaaagtggccaaagctaacatccaagttaagtgattgaagtaatctcctctagggaatctagtccaacaggaattctctaaagatattaatgtcaaagtgaccaaagaagagctcgagcagatcatcctgcaatgaaactccaagttaaaatgccccacccacatgcttagcactttccatccactttccagcctgctattcggcattataatcacatatataggattaatagtcatcgaaggaaagacttccaagaagtcagaaatcaaaacaattacaaagaaaagcaaccattagaatgtaaagactatgcagaaagaagaaaactcaaaaaaatatatcattaaaattctcagagatatggaacaaatattgcatctaaccaataagaacaggacactattaaaagaaccaacacacacacacagacacttaaaacttaatagcataagaggaataaaggga

SEQ ID NO: 47293 - DNA, 1394 bp, Bovine  19866880589899
ttccatagtgtatgtgtgtaactagctagatactaagccacattcaaatgcataaattattccctgggaattaataaggcacttaagaaacttgtattaactctttcaggccacaggggtatcattcagtgaactgaattcttcatttactaaaatggtacccgagtggttcagaagcacattaactacctctgagggcatggggagaaaaaacctataaagctatttaggaatataaaccaaattcagaatacaattaaaaacaagctacagggagatactgctctagtgatgggccctgggccctcaagaatttggcagaaatgaaactaaagggaagttgtaaatatctaggtcttttggacagaaaaccaccttggacagagtatcttggctacacttgactgtagtcattagagaacaggagaaagtaaaagttgacttgctcctgtttcagcaggtcctttcggcagcgagagcaggagagcagcggctctagggagagtcgccagccatccaaccagcaccactatctctccattctctcccacagcctcctcacttgggggctctaacctgtcacagtctgtctgccagcaacagtcctccttgtcactgtcttcacagtaacagcagatcagtattcacaagtctccagcagacttaaagttcactgtatatcttacatgtttgttgctgttcagttgctcagtcgtgtccgcgtctgactctttgtgaccctatggactgtagccagccaggcttctctgtctatgggattcttcaggcaaaaatactgaagtgagttgccgtttcctactccagggggtcttcctgacccagggatgcaatctgcatctcttacatctcctgcattggcaggcagattttttgccactaacaccgccttggaagaagtggtacaaaaaactttgtagaattaagggaatatcaaatgagatatttttaggaactttgtcttttaaaatagtgattctaagaaatgtcacttttatctgtttcagctgatgacctactttctatttacatgtcaaatgttgacatcagaatatctttgtgattctgtttgtgtaagaataaatgaattcagttaaataacacagtggtttttacatatttagaccccatgtccaggtggtgctagtggtaaagaacctgcctgccaacacaggagatgtaagagatgtggactcaatccctgggtcgggaagagtctctggaggagggcgtgggaacccactgcagtgttcttgcttggagaatccccatggacagaggagcctggcaggctacagtctatggggtcacacagaatcggacacaactgaagcgacttagcacgcaggcactcattcccctcagagaaatgcagt

SEQ ID NO: 47294 - DNA, 672 bp, Bovine  19866880596928
tggagaaggaaaaaagagggcacacagttgtcaagctccgttttactggtttccagagaaagggtggttgagttcacagaagtccatgatttttagagccagaggttatgacttctatttcttagctctctcatgatgtctatgtgtgcatttgatcatgaatcatcaccttcccagaaacacattttatgacatctaaagttagatttattgtccttgctgatattattccgagtataatcagtcaacctcacagattttactacctgagtcaaggaagaacgcagatgggtacacaccactcttgcaactttaccctgtaactgtatcacacggggagagcacggactacttgccagagtgatgcttcagaaaagacacgtgtgtggttagattgagagctgaaatctggtgggttataacatattagcatcactttccaatttaatgtaatttaacttttcatggcattcaaaacagtcaatcctaaagaaaatcaactctgaatattcattggaaggactgatgctaaagttgaagctccaaaactttggccacccgatgcaaagaactgactcattggaaaagaccttgatgcagggaaagattgaaggtgggaggagaaggggacggcagaggatgagatggctggatggcatcaccgactcgatg

SEQ ID NO: 47295 - DNA, 1361 bp, Bovine  19866880691727
ttgcttttaaaactaaaagtaacttgctcctctatctgcctgtaaacaatcgccagggacactctttccaatgcctacttaggatgcaggtgagattttaaaaatcaattccctttaatggagggaaacattgctgtctctctaatgtcaagcctgctttcttgtcacaaacacatcatgtctgtaaagactgaaaggtgcattctccagaatgccactcagagacctattcttgatctatttatcatggagacaggcaattacagtttgattagcatgtataaatggcatttctttccaatatatctagcaaagtggggaagcaaaaaccgtttggtatcatttacacccctacaggggcttcccaggtgtcgtgagtggtaaagaacccacctgccaatgcaggagaggtgggttcgatccctgggtcaggaagatcccctggaggagggcatggcaacccactccaatattgttgcctggagaatcccatggacagaggagcctggtgggctacagtccatggggttgcaaagagctgttgactgacgtgacttagcacgcatgtgcacccctccagactccacagtagattgagcaaggggaagagctgggttggtcatagaacatttactagaaaagtggaacccagaagatctggtggccctgtggtcactgccgaatctgccgtcatgagctgtgaccttcccagctcccaacaacaccggagaacccagtttaatgttcaccacttcccaccttttaaagtttttgaaggattaaaggtttatatatatatatatatatttttttttaatttgatttgcaattgtggagcagattcaatgacaaagaataaactaagaaataattgcgctgcaatggataaaaccaagcctcagatcaagtattttagaaaactcttaccaagacaaagacttactgcctcaaaggaaaacacgtagagggaacagttgggcctcaaaacttgccagtaaggctacaggaaattgatttcctagaagtaagaagtatctacagttgagctgctgcttccgatttcactgtttgcatgtactgtccatcttaatatccaaaagcattaactctgttcttcatgctgatcggaggtaatggagttggggaagcatgcctctaaatccactttttaaaaagaaagtctctgtcaactcagtggctgtcatattttgcctgcggtagcacaaagattctcacaaactgggttctggcactggactggaatcgtctctggaaatgctgtctccgaccccaggactctttgctgtgaagtgggagctccctgttctgtctccctcggatgctgggagggccaagcacaa

SEQ ID NO: 47296 - DNA, 1959 bp, Bovine  19866880763431
cagaagaagaccagttagaatggccagccctctagggctttggcttccacttggttctcccggcagtgggcagaataagaattctccatttcaggaaagatgaaaccccgaggagctactggcggtctttggttgtcagcagcgatcagaaacactgagggggacaggctcctgggaggcggctcccagacccgggctgatgcatgtggtgcgtgggttttgggggctgggcagtggcaatatggtcaagtgtgcttcccccgacaccagcctgtgccacacggagcatctgctgtcagagaagtgacatcgttgtatcaattccagaagcaccaggtttgtcactgaggcaaacagcccagggtgtgcctgctcaagaccaggaatggaaagcgagggcctgtgttcccttggggtgccatggagacaggtccaaacaactgtatcactaaggagtgggcagccatttgagttcccaggcctgactggagtggagggaatccaacctgaaccaggcacacattgcccatgtcccatggcgcttagagctggtacatttatacaccacatgaagtaacaggaaacactagtaatttgccctcaagactgctaagagtgttttgggggcttctcaggtggttcggtggcaaagaatccacctgccaacgtaggagacaaaagacactcaggttcgatccctgggtaggaagatcccctggagaaggagatggcaacccaccccaggattcttgcccaggaaatcccatggacagaggagcctcgcaggctacatacagcccatggggtcatgaaagagtcagacgcgacttagcgactgaacagcagcagcagcaagagtggttatggacgcaaagagaggcgctccaagtttcccaaaatttccataacgttcatcacagcgttcaacgtgggcttccccaacggtctagtagttaagaagctgcctgccaatgcaggggacacgggtcgatccctggtcggggaggagcccgcgtgctacagagcagccacgcctgagcctgagcgccgcaacgcggaggccctcggccctacagcctgcgctctgcagcaggggacgccgccgaaacgagaagcccgcacaccgcgacgaagggtggcccctctccctgcaactagagaaaagcccacggcaacggagccccagcacagccaaagcgaagtaaataaaccttaaaaacactttcactgtaactcatcctttttgttttcataaaaaaatttaaatatatacttagttctcaataagtattttgacctttgacactttttaacacacagccagatggtaatataaacaccgatctgtattgacactttatcaaacagtccagacacgaccaagcgactaccattatgatgaaaactcggtcaaggcttcaggaaaataagaactttgcccatgagaggagagtataaatctgggtctgtggttttactattgcagatgttaaagcaacatttgactggtttcgattgttattcgattacactttttttttaaattgggagtgcagaaaaatgcagaacattagtttttaaacccttaaaaataaaaatgaaacatttaaaatattccctattttaattaaacagctttttaatgggtaggttctgaggtttagtgctctgaggataatctggatatcaagccttcctgtgtaacagcaagttcaaggcagacaacttgtaaattgatgaacttcccttacttgtacaattacaagaactaaaattgcttttaagttgtcggccgtaaaggagttcctgggtactcagtaaatgttaaggcagcggaatgacgtgtttacttagtcaagatgtaaacacttgctgctcactggttgccccgggtgcgagaagaacattttaaaggcaactgaacaagaatttgggaaacctatttctcaaaatttcaaa

SEQ ID NO: 47297 - DNA, 1158 bp, Bovine  19866880836983
gaaggggtggcaaggtgaggaggcccctccttcccttgacggcggtccatccctcccgtgtgttagggcgctgaccccaggaatcggtaaaagccgatggagaggtctgagctgcctcaataggcgtgaaacaccttgagccaaacgctccgttttaagtgacgcctctcacggtcaagaacagacctaatgccatctgagttttgtctgcccgccatctgggcagaggcgatgcgtaagtgctcttccacctgaggtctgagctggacttcattggaagtgtaaagtaatacatctgtgaatgatgcataaacttgtggagataactacgcaagtactgatttatgatacctcgcacagcaggtacttaataaatatgggggtgatgatgaggtggaaaatacgaaactaaaaggccttgagaaagtgtaaatatccataatcagcctcatctcatctcttaaaaaaaagaagccatcaggcatattactctactgagactggagatttatcagtcacttcacggtggtaagcagactgtctgctatgacactaagttaaagccctatgagtatcttttgtgttattggctcaccaggaattaagcagtcttcagcaagaaatcacaagttaaaaaaaaaaaaaaaaaaacaagcttacaaaattaagagttgttatttctttctgcatccttttgtacttgaataaatgttgtctcaggaacatagctagacaatggattaacaaatgaattactttgtagttatttgctactgaatgaaaataatcctccaccacagacactaattagaagctccagtgtttgaggggaagcctaagtcaacctacccgcccttccgaggactgactctttccacccgtgcccagccacactgtgctcaacacaaggaccttccagaacactgcacaggaatctacctcagctgccttattctcagccccaccaccctctaagaaaacgagaaattgatcccttatctctgtttcacaccaattccagaggcatttgttataattggaatcaatataaacgtggatacctaagcaagtttcaataaaatacagaaaaagggcataagttatcccatttcccaaggtaatttatatttttactagaattttaaaatatggctttta

SEQ ID NO: 47298 - DNA, 2111 bp, Bovine  19866880866399
ataataataaagtaacaaattggctttggagcttggcaaacccgaaaaccatatgctctgagagttgcttcattcattggtaattaagttttcttttctcctcccaaatgaggctttttctggacccagcacatagcttgaggcctgtgagcatcttaatggggactcctctcttcttttgaagatcaaatcctggctagttttctttgaagttcagagccctgtatgggatgtgaaactcgttaataaaatagtagtacatatttggagtatttctacaaccccaaagacttcatcctgggagggaaacgtattaaggactcactgactttaaccacaaaaaaaaaaaaaaaaagatggcctctaacttaatctgacatcatggaatcatgcatataccttcatgcccctgtcgtcatgctccgggccaccaaaaagactcaggcgtgaggatgccagggcattatctgcacctcttccaatcaaagcccagcccagacggtcatcatccctctccacagcaaaagtcactgagcatttgggtatctccacagtttgtttgtctttgaattagagcagccttgaaaaacagatgttttcctcttaatcctgtttgtactttgcagtggtcacactcgaagtcactgggctgcaggaaacccctccaggacttgatcccacaagagaaacggcgtgtgcgtggagccatctgattgggggctgctccttgcctctctgcattgctgagcacacttaatttatctgaacagaatggattacgagggtgaagatgcacgtacaaatacctttttttttaaacgctaactctataggctctcattaaggtcaatttaggactgtggtttacacacttttggatattcactcctctgccagagagccttcctggctttcctgagaaagatgactcaagagctcaggccgatgataaacagtctggactcgagtcctggacctgctgcttccctgcctgtgtgaccttgggcaaactatttaacctctgtgggctgcttatttaacagtaaagaggagctcatacaagtattacatcacagagccgtggcaaagattaagggggatgctgcacagaggcacagggagtagacatgcaacgcatgtttgttattcatttaatctctgtttcctgggccttttgctactcatttcaagcccttgatctcataaagagcccgctcgagagtcagaaccttggaatgaaacagactgtgtgtatgtttctcctctgcccgcgaaaatgtccactttgctcccttttggctcaaggagcaaaggcggctatgaagcacgatattatcatgttactcacatcccggacattctgtgatccagaatatggatcagctctggagagagacttggtcttagatgaacaggacatggggcagataaagtccagattcaataagcattcactgagaggctactctgtgccaagaaatttgctaggtctattctttgtatggttttctttaatagtcacgacaaaactctaggacaggtgtccttatgacctctctgctaaagcagcagcagctgagctttattgaggtaatttgtccaagatccgaaagtccccctttgccatcaggataaagtcccagatgccagagatgacccgagggcaactcggtgggaccctctagccatccacctcacccccatccctatcttacctcactgtgcgtcctgggctgagtcactcagtcgtgtcccatcccctatctttcctcactgtgcgtcctgggctcagtcactcagtcatgtcccatcccctatcttacctcactgtgcgtcctgggctcagtcactcagtcgtgtcccatcccctatcttacctcactgtgtgtcctgggctcagtcactcagtcgtgtcccatccctatcttacctcaccatgcgtcctgggctcagtcactcactcttgtgacctcatgggctgtagcctgccaagctcccctgtccatgggattctccaggcaagaatactgaagtgggttgctatttccttccccagggggacctgcctgacccatggatcaaacccacgtctcctgcattgcaggcagatt

SEQ ID NO: 47299 - DNA, 1490 bp, Bovine  19866880912081
tgtggtcagaacactgtgaggaatgcagggatcagaggaaggggagccagtgatggagtggtcaatattttcagctggctcttaaaaaaaaacaaaactaaccctcctcccctaaccccctacagtctcaatttgcagtgtttgccaatttccacgatgtaaacactcacatcctggctgatgtcatccaccaaggtgaaccctaaacgcagaactggaaagagatgcaagtctggctctagagagggggtaccagccagctctctcactcataataaggagcaacggtaaggagtttggaaaggaagatggaaaactgttagaagggttttgggcagaggacagaaaagatgatctaatttatgtctgtcaatgagccctgagggtaggaaaaaaaatgggatgagctgtatgtagcatttagaagtagacctaagacctaaccaccttagaaccttggcaggggcaccccacacacaccctggttctgagaagcacagtttcagagaaaagagagaaaatctgttctcagacgctcccatgctggtctgagacccctcttctacttgctgttgttccgtcgccaagttgtgtcagactcgcgatcccgtggacggcagcacgccaggccctgccgtcctccactgtctcctggagtttgctcagattcgtgcactttgagtctgtgatgccatctaactgtctcattctctgctgccctcttctccttttgccttcgatctttcccagcaccagggcttttcccaatgagtcagctcttcacattaggtggttaaagtattggcgcttcagcatcagtccttccaatgaatattctcttccatttagaaagccttaaatatttttcataagttaacaaaacatggggggctgcaaataaagacagacgcactcccatcatcagaggtgatgtgttcctttccccgaagttccccttcacccaagtaagttaaagcctcaacacaagctttggtgacttctgtcagtttaacttagacctttaatactccttaaacatattttcctgtaagtaatagaatcatggcagagaaatgaagctatttgtcatgtaaacgccagcgtggaaggaccagaagggtaataatggtggggggagggcagtgccaggcaaccagaatacctgtgcaaatgaaaattgattttctggagaattccttgcctggtgaaataaattaaatctacatttacttctatttgtttaaaaacctctttgttaaaataagtacagcagtatatagacataatctaataaattagtggaggataaattatagctaataacattctgcatggagaatatacacagagggaacccataggaggtaggctcctggaagccacttaaatgtttggactaattctatttgtaatggtaaaactgacaaacagatatgtttagatctcttcaagcttgtttaattttatctttttccaaatcagttttatta

SEQ ID NO: 47300 - DNA, 1164 bp, Bovine  19866881035300
gccttttctaaaaggcgcttgaacatctggaacttcacggttccgtactgtgaagcctggcttgaagaattttgagcattactttactagcgtgtgagaatatgaacctaacacccagtttttttcacatagtgatttcagctcatggctaatcttgttgcatcaacatcccacttgcttccttccgcctgtccatttgaagcatgttccagacattaccatttaatctgtgtcaaattattatttaatacctcatttttatttacatctctctgttaccgagaatgagtatctttttatatacatgttgggtgccaagtggttatacattttaatttagtagtgaattagttgatcttctctctctcaatttataccagttgcattagtgtgatttagcacttaggtttaataatcttaagatgttagaggtaaaaataatacttggttccaggaaagactagactagactctgtgctggtcagataacgtcagcatttcgtcctgtgtatgacatcttcaggatgttgacaaatgagagtgccttcaagagagtgatcagtgtggaaaaaattacggaataatgtcacacagaggatggttcaaggagcctggtgggcatctttagtttggagaagacaaaattgaggaaagaaggtgatgaatgggggtaactctgatgatgtgtcatgtggaagggttttggggagataaagaggaagaagctgctaattaagtagcaataaatgatatttcttctctggctctcctccttggattttactgattttgtttatacacagctgataaaagaaagcaagtgattagttatgtgatgcctttgagtttccaggagaacctgagatgatctttgtcggatatacacccaacacacccctctctccaaaagaggacttaattctgaggcttaaagtgattttgccacacaagaaaatactcttcagtagaaaaaaatttccagctaggaaactgcccagtataggcccagaattccatatccatcacttcagcataaagttttgaaatattttttataactcattggaggcgaaacttgacctgaacggatatgtctttatttgtcccccttggtgtgagtattcatacatttctttgcagaaacagtaatgtgttagattatat

SEQ ID NO: 47301 - DNA, 678 bp, Bovine  19866881040198
ataaaatggaaaacagttcatatagaattcactcattagtgtacaactgaaataatgctttaactgaaatctactaaacatctgcagactaaagataaatactgctggaattatgatattattaatctaatgcaataaaccccatggctggacttctgagccactctttacctaaaaaatagatacacttgactttaaggaacactgtatttggccagcatatcagattgcaacaagacactttatctctctacggatcagcttccttatccatgaggactcttggattcccaaagattgacctaagtttcctttaaatgctgaagatcccttgtacctttgaaataagattcaatttacaaagaattgatttacccacagcttttcaggagcaattctatattggcatagacataagtttattggatcaatgaaccatccaacacattcttattgaacattcagtacatggaaagcgttgtgtcggctgcagagaacactgaggagaagaccgggactctgctccaggggagctcatacctaaccaggatgtgggaggtcttgatgtgcacccctgcgaaactaggactccatccaaggaaggccagggaggaatgcaacggtcactttcatgtgtcagcctgactgggtcaaaggctgcccagacggctagttaaa

SEQ ID NO: 47302 - DNA, 2047 bp, Bovine  19866881085793
ttgatgattgatgattgggatccccctgggctcacctttggaaaagctgcttgcttcttttcttccaaagttcaagaagcttgaaggtcagtggataacctggcaagagtctcacccagagtgcttgatttgtgaggttccagctgtgaggctcacagcaccctctgaaaaacacaatcttattttaaaataatttccatgttaatccttttggtggagagggaattcacaagtattcacatcagagtgtgagtagccttttctaaggagatctgattagtttgttaaattcagactagcatttggacatgacttcagtaaaggttacaggcactgtttggctctaaaatttcatttcaaagtaagaggtccctaagggctagtttgacttatttaattataccgtataggacttgggtaatagttttataaaaaccctcttcaaggcaaattcataatttaatacaaagtggtaaattggtatacctttaacatttgtatcatgagacagatgatgtagatgaggattaaataaaggggaaaagtaggtatcacatttgaattagaaatgacaatattggtatattgtctgagaaaatatttctgagaaaacttggagtgaaatcacctgaaaaacactaagtgcaattgacctgaatgatgtaattgctaaagagccaccagattttgcaaaagcatttgtaagtcatatatgaaacagctttgttccttctccatctacaaacggatcctgctgggcgctgggtccgggacgagacctgtgctgccttgtctcatggggaatgagccgcagactcaggcatatgtgtccaagggggtttactgtgggtgcagagcgagcgtgcagggagcactccgcacacagggaggcatcaccaagcactggagtactgaatgacccttcttccaagcgtgtctgcctggtgaatggctaccaagctcttgaagtttagcagagtcccccacgtgtctcttatctttgaccctttacctcctctctggagtgtgtgcttctgtcacagcgtttacgacgctccagtgggtacagccatcacaatgaatgcagcgtggggagcctggggggcccagtgtcccagagcagcaggaaaatctgtaactgtcagaagtcagaatgatcaagtattaagtaagctgtgacagttgttaacaaccagttaccttttgattggcagcaatgcaaaactctttttcttttcatcaaggtagaaaacagaaacaaaggaaaattcgaacccttccaacaacacaggaagactctacacatggacatcaccagatggtcaatactaaaaccagattgattataacctttgtagccaaagatggagaagctctatacagtcagcaaaaacaagactgggagctgcctgtggctcagatcatgaactcctcattgcccagaatcagacttaagttgaagaaagtagggaagaccactagaccattcaggtatgacctaaatcaaatcccttgcaattaaacagtgaaagtgagaaatagattcaagggattagatctgatagagtgtctgatgaactatggacggaggtttgtgacattgtacaggacacagggatcaagaccatccccaaaaaaaagaaatgcaaaaaagcaaaatggctgtctgaggaggccttacaaatagctgtgaaaagaagagaagcaaaaagcaaaggagaaaaggaaaaatatactcatttgaatgcagagttccaaagaataatagcaaagatagataagaaagccttcctcagtaatcagtgcaaagaaataaaggaaaacagtagaataggaaagactagagatctcttcaagaaaactggagataccaagggaacatttcattcaaagatgggctcaataaaggacagaaatggtatggacctaatagaagcagaagatattaagaagagggggcaagaatacacagaagaactgtgtgaaaaagatcttcatgacccagacaatcacgaagggggggatcactcacactcacctagagccg

SEQ ID NO: 47303 - DNA, 2124 bp, Bovine  19866881216143
ctggcgtagggtctggcatacagtgagcactcaacagtgctggttggcaagagatgaaagacaggagtgagggctcatgatcacgagtagtgcatgatcagaaagtcaaacacctaatacaatctcttgtctatgcttagacattcactcaccatctgaagagtgtttctcttctatattaaagtaaatgtcacattatatgaaaataatgaacaatgctcttttgtgactgaactatttatgttaatagtatcctacattcagatcttcaagtcatactagcagattatgttctgcttggctttaactgaacttgacattgtccgtttgcactttttaaactttcactggtgatatcactagcctgacaacattaaattttaataaaaaaaatgtaaaaataaaagccattatgcttgctgactaaaaaataaaaatagatttactatcttcaaggtcacttaaagctgaagttagcaaattcagtttccccctggcaatcacagatgaagaaagtaagcacaaatcaaactaatatcaaggttgtatgactcctactggtgccagctgatggggaatgtttaaacttggtattcagctggtactatggattttgtaactagtcattatctccttcattaataagcagttagtgacaaaatcagatcacatcatctgtgcagttaattacaagctggaaaatattcagggtatacaaattttattagcatggctgacatctgtcaactattttggttaattacttctgaatttggattctagcatttcaatatttcaaatttaatacatgtgacataaagggttttcaagctactattacctctgtttagtagttttgtcttattcccattctaaaattgtcagaaataagctaaataaaataaattgttaattggcagaaaatggttaatttttttttatcaatgcttattaaatactctcagcactaataggacacaaaatattttgaaatctaagtttcaggatagaatgctaaaacttttctctttgctctgggatagaaaaatcatttggctttttatttttgcaggttggatatggagagattgtttctgaggttgtggaagtaaaggtatttcccatccctcctctaatctataagttatttgtggtgtgtgagggcaggcttcttggaagaaattagttttgaagtaaaagagaaggctgactaaggtgaaaagaaaagatcaaaaaagtaagagggaatgcaagaggtgagatggggtgagtagaacaaataatttacacaaagtaaagcaaaagtcgttcactgaacacacagttcacactctcacaggtagtcaggggcaacaagaatatacaaaacgaaagattaaaaatgcgttatgctaaaaacacaaaatgtaccaagcacaccaaacccaagtgttcatttttaatatctctgtgctatgattacaattttctgtaccctttaaagaaaagaggcatacagaaatggactcaccacacgtgcaaaggcagaatggtaatctgaatccatgtaggctaatttcacatcctcaaccacaacacgatcctagctcataaggttgtattttccacataagagaacagcacaggcacattgtcagtgacagagagttctgacttgtctttaaaggactggtggtttgtctgcaatgaccctcaccattctatttgttgtgttcacataactgactacacagggctggtgggtccaagctctggcagcgataagcaatcctgctgtctgtgtcacagcctggtctcatactatgtcaacactccttcagaaaaatatgaagctgcaacatgaaaggctataattctataaaaggcgtggttatctggatacctgtgatatctgacttcttcccttcataaccagaattatgctgctcttattgataatggtctcatgttggttgcatgtattcctttgcctttccggcaggaaattccaaccaagagttagctgatcaagggaggatctgaatattcttggatctctagcttgaacacctcttattttcatccaaaatgttcaccacccagtgtgggatcagcagacaaggtgagtacacctgtttatgactg

SEQ ID NO: 47304 - DNA, 1374 bp, Bovine  19866881248220
tagtatatttgtgattagggtagttaacatctctcattaattatatgtacaattattttggtatacagtgaacaataaggacaattacaatcttagcatttaataaattttaaagtcatcatttgagaagttgaaccacactgagaaatgagtggtctctctacttgagtcttcatttactttttattggagttttaatgctatataatattgattcaccattttaaaagattagaattattatcaatctaagcccacactgcattctctcaaagcccattttaaaatctcagaattggtgccatgtattaacttcattgtaatttgcacgcaattagaacctctccgcatctgagacacacacaaaacagctcactctggcataactgggaaatgagacatcctgcaaaagcaaacatcccagacatctgatgcgcaatgcttcaagcagggtcaattgttttagaaacacattttggagaaaattttctgaaattaattatacaacagttcttttccttcttaaataaagcatacggcatgacatctaaccctttctggaggcctcagggacattttcacaatctgtctgttgctctgtaatgtatcgcaggaatgacagcatcactcattcataagagtgcaaagctcacagaatgcaaggagtttaagggcattgttttactggaatgaaatgggcaagtaaagtacaattattttctcaatttaggaggaaactgagtctcaggatgagtgactagtcagtaattaaacacctaatcaaaggcaaaaaaaggactttttagctaatcttcacattgtacttttatagagccaaagtccttttcacacgtattatttcttttaattctaagaacaataattcttatccttcatattcaccattaagaaactgcaactggactgcaaggagataaaaccaatcaatcctaaaggaaatcgaccttgaatattcattggaaggactgaagctgaagctctaatactttggccacctgatgcaaagagccagctcactggaaaagaccccgatgctgggaaagactgaagacaaaagaagggggtggcagaggatgaaatggctagacagcttcactgactcggagcaaactccaggaaatagtggaggacagaggagcctggtgtgttgctgtccacgaggttgcagagtgggatgtgacttagtgactgaacaacaaagtctgctcacagacggcactttgaggcctctccagaccctgtgctgcccgtcgtgggggatgggtagggtgggaaagcccgtctgaacctgagcccagagctgttcctgcccccccacccccgtcctgcagggtcatctacaccctcagggtg

SEQ ID NO: 47305 - DNA, 2683 bp, Bovine  19866881278215
cctggtgacctcacgtcaccactgaatattttatgaacaagtgtaagagttgtattaaaggatcacgtcggtcactttctcatcattacattcaggctgtgggctagcttgcactgattctcacagtcccagccttcctcctgacttgttcacatgctccctccccttggggttggaagggcggccaccggcacgcccccctggcacagtccttcggctgggctcatggggagctcgggtcccctggcagctcctcactgccttgaacgaagccggggtggcaggcctgctgctgggagcggggctggcttgactcctcatcatgtggctgcctggggaggcttgggcaccaccccaaattcaggatctcccaggaaagaggacccagagcatggacgcctggtacccgctccagtctttaaagatggtcttcttcttaagcattacaaccgtcaccagagttgtgaatgagttgaatgttgttagatattttagttttcatttaaaaatcagttccttttgtataagtgctctgttcagaaagagttgaataggcagggacaaagtcttctggggaactgacccttattaatgtaatgttctgtaaagtttgggaatttttgtggtgttctttttggcaatagatacatttctcttcacaagttttgactttgctacagaaatttaaagctagaagaaaaaatgagcttatagatataaattataatagacgtaaactttaatatttctattctttatgtacttttttattttcagtacccttgaaacaatgtcataaataatacagagaattaatggatatattttggagaataattctgaggaataataggcatatttgaaattactattgcaaaaatcagatgttaaagaaaaaaagttatgatgtattcagttttaaaattgtactattaaatgtgaaacttcatgtgtaataaataattcttatttaattttaggtgccagtgtaacatatactaaaataaaatggaacaatttccatggttctataaaggaatctataaaggagttataaataattatagtaaagcttttgtgaaatatttttatgggactaaaaattgaaaacgtcttaatagggaaattttcttaaatgagaaatggggtaagttagtcatagagacctcaaatctaatatatcctatgggaaccatgaataagcagtaacttcttaagataatcttaaaaagtgtctgaaaatcaagagatttcgaaaaaggtttttggaggtagcaggaagaaaaagatgattgttatgttaaaatttctcatgggaagttatttattttgcatgttttttgatgttactggaatagagatctcagtttacctgaatctggaagggctgtgactatgtaggattaaaagcgaacaaataaaactgttcaccatagagtcacacagttttgggaggtgatataatccactccagcatcccaggatttttctagtgttttgaacatgagggcgtaggctggaggacattcggtgctcagactgtgaagaaagcgctcttcagcagacaaggaaaccatcacttacctttgtgtttttttgttttttaacacagggtcttaccgcctcccaacctccttaactagtaaaaagaatacagaactataacatgggcaaagcatacccatttaatgaaaggttgctcggatttatgaaatttttgtctttattgcttttcttcttcttcttttaaataagggtaagagtctgtatggggtatggttggcagagcaccagtctatatgtgagaagacttagtcctccctctggcatcgtcaccttgctgggttaccttgattgttgttcagtctctcagttgtatccgactctttttgaccccatggactgcagtactccaagcttccctgtccttcaccatctccgagagcttccaaactcatctcccaaactcatgtccattgaatcagcgatgccatctaaccatcttgtcctctgttgtccccttctcctgccttcagtctttcccagcatcagggtcttttccacgagtcggctctttgcatcaggtgtcctggggctggattttcctctcctctctctggtgtcatccaccttgggtctcagcccctcatcacaatcaagaactgatgaccgggtgattggtgacatttttcttttcctcttgacactagttcatttatatctgaatcacccttatcattcaggaatgacaggacaaagctgcttctgaacaaagtgaacaaactgaacaaacccatgctaattcttgccttcctaacagactgtcagccacccacagctgccacggtggggcctgtggtggacagaagagactgagtcagctcattcataaacagcgaaagttaagagttgccttggcctctgggaagggattcttgagaagccttttgttttcacccagcttttcctgaaaaatcaggaaaacaatgtgattgtttctcagaaatacagaaatataccatcttttcttaattggcccagagcaaatatttttagtaagggctgattttttttttgcagaaaaataagacttggggattttttttttcctgcagacatatactggacaaaagatgtctcttctatcagcagagtgatgatggtgaaaatggtgatggaggtg

SEQ ID NO: 47306 - DNA, 1327 bp, Bovine  19866881335328
ccacctgccctctccaccctgggcagattccatacaaccagggacgggccctgtgccctggagcctgcgggaacgatgcagaccagccagtccttcagctgcccaccccgcctcgtccacaccttctgcagaaacctcagcgaggcctccagtccgcgctgctccgccctctgtctcctggctgaccctggtgctgccaggtgtgacgctgcatggcctaagcctcctgggtgtaaatatcttcccttcttctgtctgcgtgtcttaccacacctggaatccttcagactttgtggaacccagccctgaacatctgtcctggggtttgcctgagagcttcgagcatccagatcctctttcctctctccttccctgatctgtatggatgacatcaatggaccaacctgtctgtggcttcccatcggggtcgatggatgggccagtggagacatttcttttccttgggcgcaaggaagccaaactgtgtggctctggggttcaactgacagacgcgtgtgcctgagacccgacactcgaaacagccttggcaatgttggggtcacttcagagggcatcgatctgttgggtctgcttcaccttcccacacgaccccatcgctttctttcagagaggaagacccaggaatgagctatttctgccaaaagcctcttcctgtcattaatatgttaacaaatgctgtcaaataacagttgcagcaggcggaatttgctgttggcggaggctgcctgctgccagatgaggctgcgtccgttgcatgggagccaggctgcttctgccaggagagcttggcaccggaggtcaccaagcccgcggtggggcctgcctgccccgtcaacggtgacagtgtctcatgtatgagtaatgcctccacagggcgtttctaaatgccttcctgcaaagaaggagcagagattccctggggaagggcgaacacctgcccactttctatgacgccgggagaggcggtgggggcagggggagggcgggaatggaagcccaggtgcagggagaggaggggaccaggcgggatgagccagctccctgtgtaaagggtgctgcgggaccgagaaaatttcaaaggagatggaagcatcgatacaagggacacacggggactggaaaatcgatggtggtgctgaagggtcttagggagtcaatattagcataaagaatgcagagggcagctggtgtggtggtggtgcagctgcagattagctaaaatgcatgcgggacttccctggcggcccagtggctaagactctgtgctcccgatgtagagggcctgggtttgatcactggccgaaga

SEQ ID NO: 47307 - DNA, 680 bp, Bovine  19866881349110
agcaccagcacggcagaggaggagaaaaggaaacgtggggccgaagaggaagacccggggagagagagaaagtaccgtgctccccacctctcgggcaaaacgtgcacccgctggactccgctctgcgggcgggccgggcagaggcccagtctcctcgctgccatggccataagttggaaggccctctggacacagtgtgctgtggacagattggaaagcctgggctcaaacagccctaccaggcacactcacacttcacccaggatgatgattcttggtgtttcagtgctccgtctctatcaccgctgacggaattttactgttttaccttggaagattataaatggggaggagtccttagaacttatttatctttgagagcatgaatctttccttcttcagtcgagacatgcccattcattataagacgaggaaaattgttatatccaagattgataaattatgtcctgaggttacatgtacaatgtgaatactttatttttgtagtccgagcctatagtttaatgcatgagacacctttgtgcattacctatgctgagtaaccttgggtatttagaaattgtctgtgtgaagtctacccattttaacacatgtctttcattccacaaaaatcactgggaagtcatttctgcctacaatgagatcactatttacctaag

SEQ ID NO: 47308 - DNA, 871 bp, Bovine  19866881359412
cccctgtgatctgcagcctgggctcagactgggcgctccaaaagttctgaccgagtaccagcctgcagcttgtcacgcccttttacagtgtgcacttatgtattattttgctctaattgtcttaatcttagggacttttacagaaagttgtcctaaaagtattgctaaaaatatgtggcgattatgaaaggagatgtggtctgccccctacctttctaagccttaacagcaccagttccctgtagagaaagggtcagcaggagatggcagacgttgttatctggtagctggcatttcctaacatgattttactttacacaagtagcctgaactctttcttcatcatcctctcatctaccttcaggcaaaagacgggttttgtttttgttttgtttttaatgtatgcacacggaagtcaaatggggcctgcattttccctgccattataactaccgtcttggtaacagccagtggtgtataataggaaagtctttctatctttaagcaaattttgttttccttattaagaaagaaggtataagctagaattttctgtacattggtccatatctttgtaaaattttcttaaaggaaatcatgaaaaagcaaggtgataatatattttggaacaagccctcatgactcagattttttaaacaatgcctttgttaagtgttttgggccttggacagaatgtctccataaggagctccatttcccactgcatgattcttcacatggctgggctgaagttcacgttatctttttgtatctgaaaaatataggcagagaatgtttttgtttcatccaacagttatttctacacacgagcagacggctcgcctgcgtctgtatttatgctctgacagca

SEQ ID NO: 47309 - DNA, 1140 bp, Bovine  19866881532097
tccagaccaaggttacatatagttatatattacaattgtttttttaagtagataaattcagatttctagttggagctgcaatatcaagctctcaaaaataaatagaatgaatatacagagaagttgaaggatatagtaaaactgaaaagcattatgaatgaattcaacataattaagatttatgcaatttccacacaacagtaggatacaaattctatttaagttcccatagactataaactaggagacactgaacatatccaaggacatacagcaaggtgcaaagcttcatggtctaaaggtattgagatcatccagtgtgttcttcaagcgggtgattgttagcagacttgttgcttgagccagtgtcactagtgacagcttgtggagccattggtttaccgtattaatcttagtcggcggctttagacaactgtgatttgccattcctaatttctggctgctttctggcaggaagcgtgttccttcctggtgcttccgttgctcttcgtacctccgtgagagcagtgagcgccattcttctttgtacgtaacgtgcatgtttttccccttgctagattttggatgcttctggtcagggactgtggctgctcattgtgaaatacctcaagtggttaccattcaaggagtttttgttgaattggattggaccttcccccttggtatcctttggacttctttctggtaaatattcagaatgtcccccaaggctattcagtactgcattccgaaggacctcagaaatgatttacaccagcagcttgtgataaacagcagacccttggcagacagagcctttataatttatgactccacctctggtgacatatggatgtggcctttggcagactccctgatatgaaatgatttttttcccctaaattggcctcatcttagagtatctttgagtaatactgatcaccagatcctttcaaacaccgctcagataccaacaagttttgctcctacataggagcatatatccattttatgttgttaataaaacagaaaatattttcctaaaggcattatagaaaaattgatttagtatctttttttgctatacaaataagcatttagtttagcttctcttatttattactgaatattttagcatgg

SEQ ID NO: 47310 - DNA, 2095 bp, Bovine  19866880128359
tgtcatctgcatatctgaggttattgatatttctcctggcaatcttgattccagcttgtgtttcttccagtccagcatttctcatgatgtactctgcatataagttaaatgagcaaggtgacaatatacagccttgacgaactccttttcctatttggaaccagtctgttgttctatttccagttctaactgttgcttcctgacctgcatacagatttctcaagaggcaggtcaggtggtctggtattcccatctctttcagaattttccacagtttattgtgatccacatagtcaaaggctttggcatagtcaaaaaagcagaaacagatgcttttctggaactctcttgctttttccatgatccagcgaatgttggcaatttgatctctgattcctctgccttttctaaaaccagcttgaacattgggaagttcatggttcacatattgctgaagcctggcatggagaattttaagcattactttactagcatgtgagatgaatgcaattgtgcagtagtttgagcattctttggcattacctttctttgggattggaatgaaaactaaccttttccagtcctgtggccactgttgagttttccaaatttgctggcatattgagtgcagcactttcacagcatcatctttcaggatttgaaatagctgctcagtcgtgttcaactctttgcaaccccatggactgtagcccaccaagttcctctgtccatggggattctccaggcaagaatactggagtgggtttccatgccctcctccagggaatctttccaaccaagggtcaaacccaggtctcctgaattgcaggtggattctttaccgtctggagtgcatattagatgagtttaatatttaggtagaggacagatagtacagtcttaacgtatcatgcttatggcttatcctaaagagatttgggaaagggagtaaaatgatgggattcacaagtaggagtacagtactatgaatgtaggcatgaattcatccagaagcaaggaaacatttaggtccttcctcaatttctataattccagccccctctctggcacactttcatgggatgtaatttctctacagaataataatagatgatgacaaaaataagaatgaattaaaaatgagatgtgaaagccaaagggactccttggtagaagcaaagaagccctcatgtcttgcagcaggaatgcagagaaagcctagcatgaggcctgagatttatcattctgcatgactaacttcaaaggaggttaaactcagcagattggttgggccgggagcagtgctccattaggaaaatctggatccctaacacacaggatctagacatatggatgacttcttctgaagactttgattcctctgactcttctgaaccatctaagcctgcagaaatattccatttgtctctattaagcacaatcatctcaaataatcctgagaggcactcaagatctgccctctatcttcttcctggccatatacctaggttttaagacacaatgccaaccaacagaagatgcgttgggcttcttaagtaatgaaagtattaaagttttaagatgctgccaatctacctgatatgtattagtagacatctggaaagtatgcatgacattgggttacaagattatttattaaaggaactggaacatagaattgaaaggaaagagtttatttacttgagaatattcttgggagataaaggatttagccttctggaaagaaactcagaatattttacaaattaataaagtggctcccagtggcatggtgcacacactggccaacctgagcaaaattgaaatgtgtgaactgccatgtcagatgatggataaagagattaaaaagttcggagaagcagacatgctcaaatggatgtaatatgtacagtcagaaaatgagcatgattgttatgttccttggaaaggcccagttcagtcagtcagttcagtcgctcagtcgtgtctgactcttcacgacccagtggactgcagcagccaggcctccctttccattgccaactcctagagtttactcaaactcatgtccatgggagaaggcaattgcaaccca

SEQ ID NO: 47311 - DNA, 6333 bp, Bovine  19866880169030
tgaagatgaaagaggagagtgaaaaagttggcttaaagctcaacactccagaaaacaaagatcatggcatccagtcccatcacttcatgggaaatagatggggaaacagtgtcagactttattttttggggctccaaaatcactgcagatggtgactgcaaccatgaaattaaaagacgcttactccttggaaggaaagttatgaccaacctagacagcatattgaaaagcagacacatcactttgccaacaaaggtctgtctagtcaaggctatggtttttccagtggtcatgtatggatgtgagaattggactgtgaagaaggctgagcgctgaagaattgatgcttttgaactgtggtgttgaagaagactcttgagagtgccttggactgcaaggagatccaaccagtccattctgaaggagatcagccctgggatttctttggaaggaatgatgctaaagctgaaactccagtactttggccacttcatgtgaagagttgactcattggaaaagaccctgatgctgggaggaattgggggcaggaggagaaggggacgacagaggatgcgatggctggatggcatcaccgactcgatggacgtgagtctgagtgaactccgggagttggtgatggacagagaggcctggcgtgctgcgattcatggggtcgcaaagagtcggacatgactgagggactgaactgaactgaactgaactatactttttgttgttgtttagtgattatactttttgttgttgtttagtcactgagtcatatctgacacttttgggcctagaaaacattgaattactgtgtataaaagatgaactttattgtatatgaattatatttcaataaaatttatttttaagttaattttatgtgcatcattttcaaatttccttaaaattatgttatttctttcctattccaccaattagtacataatacttttgcacataataaattatgtgtttaaaaatatgtgaataaagtatctctagcagaggaaatttgttatcaaagacctttttctagggcctttgtgtatactttttagtgaagagtatgatttttatacttctgtaaacccttgatatttcttcttccccttccagtcttcatgatcatcactggtcactgatcttcatcatcatcatcagctatgatgtcagctacagtgttgagccattgcaactttttttaaattgaggtgtagttgcttaacaatgttgtgttaattttggtttgatagcaaagtgactcagttatacacatacatatccttttttatattcttttccattatagtttatcctaggagattggatatagttccctgtgctatagcgtcgaactttgttgctatccattctaaatataattgtttgcatctactaaccccaaactcctagtccatatctccccatcatcttcccccttggcaaccacaagtctggtctattctctatgcttatgagtctgtttctctttggaagataggttaatttttgccatgttttagatttcaaatgtaagtgatatagtatttgtctttctctttctgacttatttcacttggtattgtactctctatttgaattcatgttgctgcaaatgacattatttcattctttttatgtctgaagaatattccattgcaccatatctcctttatccactcatctgttgatggacatttggggtgttttcatgtctttgctattgtgaatgcactgttatgaacataggggtgcatgtatctttttaaattatagttttgtcttgatatacacccagtagtgggattgctggatcatatgagccattgcaaatttttaaggaattttattacactctgcataggaatttttgaatttgttccagagaaactttacttgatttggttgtcctattatttgaacattttaaattagaaaatgaagctttgactgtttaagtaagtcacccacaatcagctagatagtagagaagccaacacttaaatctaggtaaatgtgataccaagaaaataattctggcaatatttaatttaaaagtttattttttatttaaatgcatttttattctttataagcataatattagctatcttgctaggttatcttttgctccttgattattcaatatattttcagaaaccattatcagtaaaaaattctattctttttacaaatattggattgcttaaacagcatgtcttcaacaattaaatcaatttaaaaccaccaatacaatataagttaaaatcataggcaagtgtctctgagatacagaaacaagtgatgactattcttttctggttttaatcagcagtgtcagtgacagtgttaaaaatgcaactgctaattcagtaaaacgttatcacagataccttgcatgcagcaaacaagagagaaagcaattaaagattactaaaaatagttttcaggagatttctctaattcacttcaggagaaaaataaatgtacttaatactgattttgtcttattttagaagcaatttattatagagggaagaattttttaaaaaatcaaggaagtatgtaatttcctcacaaataacaagtcaatttttcctaagttcttttggaatgtaggataatttttttgttcaatgtaatatccaataatgacatatttctaaaatatgaaatacagacatatgcgtgcccaaattactgaatttggtgattttcttggcaggaaaaaaagaaagcagtattatcttcgcaactcagaagaattttgctcgaatgtacagcaagctgggcaacgtggagagctgctgtagctcagattttaaaaataattagatgtttatatgtgctcagttaccatatcacctgtacatgactaagcatttatgcttcctatttaaaaatcatatatacagttcagttcacttcagttcagtcgctcagtcgtgtccacatctttgtgactccatgagctgcagcacaccaggcctccctgtccaacaacaactcctggagcccacaaaaactcatgtccactgaggcggtgatgccatccaaccatctcatgctcggtcgtccctgtctcctcctgccctcaatcgttctgattgagtgactgaactgaacttatatctcattaaaatgacttcatgtatattagcttatataaaattaatgaatgtattttaaaccagtgaatcaatgaataaatattttttgcattttaagctttatctgattacatggtctgagtatctgaagtcatctattttcctttgtgttataaatgtaaatgggactttgtttcataaatgcacatatacatcattttaaccattagtcctgacacaagtactttgctacaacagtggtgggaatgttttatttcagtataaaaatatatttcaatgtaaatgaattgaatgaataacattgcaacacattttcttctcctttgataacacagataacaagattaaacttagtttactttattgttacatgttcatcatgatgcttaccagaaatacataaaaatgaagcagtcattatccaaaccatcagaggtcaccttgaacgagggaattggagagagttgtaatccatcttaaagtttatggcagaacatgtcacagactattaacacttaaaagtcattgccagagtaagtaatgtggccatatctgacctcaggtggttggggaagtgtcatcctctcatgtgcccaaagggacaagaatcagactacttgatcagtgcttatgctacctacaaagtatattttcaaaattgagtggactaacctatttatattaaaaaaatgaaatcagagccatgtcattatttttacattattttttttctgattagtaacatttattgtgaaatgagatttttatcacatttcactacatcaattaaatgtattggttgtttctaaataagagtatttaagaaacaaaccactgcatcaacagtaaatatattttaaagattgtatcttactgtttttaaggtaattagaaataagtacaagggctggaatcacttgtttaagaaaggatcttctatgttagctgggtaaatgttagatatgaacatcatatagaataaatcaaaatgtacacagggaatagtccaattgtgtcatttttattgaattttggtatcaagttttacaataatagttcatagagtttatgaagtaaccactattaaatacttttgcttaaatattttaaaatattatacttgttttaagttttaaatgatatgaaaaataataataattgttttcaggagcattacttttctgaattataagaaaggcaacagaagttattatgtttctatagaaaacttcctcttatgtgtatttgaagtaatattacagaagttcagtttgacatattttgatgtactatggtagaatatatatatttttttttctgctgtgatatttctttatatattacaaataccatcatgttgattaataagtaattttaaggagaaaaatatatggcatctgatgaaagcccacttaaacaaatcattggtctataccttaaaatcatatacagagatgttttattagtcatttttaaaaagaatgaaaaaactgtgtgagaatagatggaaaaatctcttaggaaatgttttcaaatcaatctaggaataatataggaatgataatttaatctggtaagtcacaacatatttgcatatttactgtaattattttagcttctttttaaacaaatccattttattttcttttgtttgagtaagtagtgtgtgctaagtgtttgtgaatttttaacccaacaaatttaattttgtgtaaaaatataactcaatgtatttatttatctgtttaatatttactctgtgggctttttttccaaaaatagaaaaatgaaagaaataggccttgttttggagaatgctatggcaccccactccagtactcttgcctggaaaatcccatggatggaggagcctggtgggctgtagtccatggggtccctaagagtcagacacgactgagcgacttcactttcactttcatgcattggagaaggaaatggcaacccactccagtgttgttgcctggagaatcccagggacggaggagcctggtgggctgccatctatgggggtcgcatagagtcggacacgactgaagcgacttagcagcagcatggtgacttagaaatatttttcttctttcttacaagatatttttaaaaatatctttctgtagtgtctaacagaatgctttttatacttaaatgtatttgtttaacatcccattactattttcacatctttagactgtcacttttaaaaaataagttatgaatgcaaacgaaagacacgttccatacgaaccatgactacctgcaagaatataatcttgaaagaaaattgaaaacttgtaagtaataactggctgaaaaatatacacaccagataaaaagtccttgtcttgaggagctgacagggaccttgaggttccaggagaaccactagttttatggagctgagaggatccacatgactcctaaaataaatagaagataaattgtttatgttaatgcaaaattatttaaaaagttatacagctttaatttctaaacaggtcttgcttttggcttattataaacaaagaatcaagactaacacaaattatactttacaaaattaaacacatatatgaaataacaaaaagcaaggtgaacttgatttatcaggtcaattgggtgagtggggcaatagttaaatacactagaaatcattattttttcaatattttgtacataatctcacagactgtccagctgatgaaaaacttaacatctgtagctctgactacctaatattgattcagatcaaatgcctattctcaagcctcaggttccttcaacatggaggagcagaaattcatggaagaagtaatactgaacttagctccaatcccagctgtgtcatggaattactgcctaacctttgacaaggcatttaaataatctggttctcaggttctttctgtacacctatctaaaaacgtgcatgtatgggctcaaagatccaagagacagcatatgtaaagactacacactgtgttttatggttcattttgaaggtattattacatttctgaatctgtaaagagaacatattttatatgttgctaaaagaaatgattaatatgaaataattctgaataaatgctaccaaagaaatctatttgaatagccacataaatagcattttcctttatccagtcattgtaagaagttaagaacaaggcaggtagtg

SEQ ID NO: 47312 - DNA, 2135 bp, Bovine  19866880796192
tttacacctgactgggtggaccctcaggtgtaatttataagtgcttcccttacattattcttactttttggtatgtcttttgttttaaagctttttaagctctaaaaggcagaaatgctatttctactgttgccaaccctcagagctaactactttgtatgagccaagcaggtgcttaatattttcagtgtgattgtttttcatatggaaaaaaaaaacatattagaaaattaagttttttcagagtttgggttacttataaaatttggaaattgaaactcatttcattactgcagttgtgttttaatttgtgagttactttaatagttcaaacatcagtcagttcatgacattgcatttgctactctgtcttataggatatagcctctattatgcagtcaaaacattttcacaccttgattctattttaatcacattcatcaaaattatccaatttcccggtcgttgccagatataacacggtctttgtaggcagataacattattctatgaaagactctatctttaatagattctgtactgacaagaggagctagggtgaacagatgtgttcaaactccagtgaccatctgctgagccctgagcagtcctcctgacagaggagcagtctgcagagtgcttactcataaaacacccattttgtgaatgaaatggttttagtggtctctgaggccattgctttgtcactctctgtcagtactaaaattaatgtggaaataaaagtaaacaaagcatctttccttcctgtgtttccaaaaatttatcaacttgtttaaacatctaactctactgcaagcaaacatggttttattataattgcatttaaatcttgatggaaaacagcaacttctcatcaaatagcttttcctttttcagattatatatacaggcttacaactgaactctagtctactcttcaagtagaagaccagtctttttttttttaattttatagaggtaattttctcctctagacatactaaccagtgaaggcaatggcaccccactccagtaatcttgcctggaaaatcccatggatggaggagcctggtaggctgcagtccatgggatcgcaaagagttggacacgactgagcgacttcgctttcacttttcactttgatgcattggagaaggaaatggcaacccactccagtattcttgcctggagaatcccagggataggggagcctagtgggctgccatctatgggatcgcacaaagtcagacacgactgaagcgacttagcagcagcaccatattgtttagcctcccatgtttgtggggtttttaaagtttgtttgtttttgtagttgatttctaatctcatagcatttcagtcagaaaagatgcttgatgtaaactttgatctccagtcacagattcagaagggactccagaatgtgctatgtgatctgaccaggttacacaattagacctattgaattttagagctcttataatatcatgcttagtaaaggaacatactctcacctcaaaatacattatctttcatctgtgacccacgattattatactggagcccatctctgcagagggtgtgctgtctgtttgcttgtacctcattctctaatgagtccaaggagtcactgaattgtagtttgttcaacttttttctcactttaaggaaaggagtgatgaattccaagctctttatgtgttggagctgaaactggaaatcagattattttttaaaaatcttttaagcccaatattttcaataggctatgtctgtgttgatcattttctatcgaactgtcctagaatagtacactatacttgcagatgccaaattcagttttttcattttactttgaaatatatttctgttctgttagttgtgtctaccacctcaagggaaccaatttatatattattgatccctttttgtctgttaatcatagcttctctttatttttttcatcatctctatttttgtctattttagctgcattctgtaatgttttctagagctcttcattaacttgatctttcactgtgaacattatttaattgctgtttatagataatcggttctaaaataattttgatgttctctctgactcgttctctagtgtcatttttaccttattt

SEQ ID NO: 47313 - DNA, 1403 bp, Bovine  19866880798080
aaaacaaagtgctcactgaaaaggataaaacttttaaacagatccttaacgcagtcagaaaacccacccaaatgggggcagaccagagtctgagaggagaatcaccaaaccaaaactagacaatggcacagatgcagtaagctccagggctttcatgggggtactgcacacaatttcaagggtcatatctcttgggggtcatctcctttgaatcccacttccaatgcaaaaaatatctacctaaataaaaagataaaatgaagcaaactcaatattgtcaaaaattgtctcttttgggagtagcagaagaattgcaattcaagatacacaaactgtagcaagtttcagagaagtctgttgacaatttgggataggctgtatttttggacagggaaggtaaagaagtgagagcttagagtcgattaaaaaaacaaaggaagattaactctgaaaatttcccaggagacaaaaccagaccagtcccataaacaaagctcaattcagtttttttacaagaccaacttatccagagtgacttattcatgcctctggaaaacataagcaaaatttcccaagattccttgatcaatttcccatcatttaagagcatcccaatactatcagttttctgtaaattaggtatttatgggaaatccatctctcagtcctcaagttttgtttccctgagggcatatgtataagattttctattttctattatctgcttccattttagactgaaattctttcacagagcatatgtaggatttgggggatttaaaaaatggagaataattttggaagattattaaaacttctttttaagaacaattggataaatgagtcaaattagaacacaccataaaaaatatttttaagttcatattttttcctgtggtattgttttgacattgtttcaaaagggtggaaaatattctctgaaattttttaaatggagatttttagtcagtaaagatattttaattgcaatcacataaaaaaaagaatatagacaaaatgaccttaccatgcattccagctttatgcttctttatggctatagaataaatatgttttgactattattcctttacaaatagcaagtgggagtatgagtattgacattccatgcatagtaatcaaaataatatctatttttatgagagtacagttcttaattaaggttagtccgagtgggtcaccttagtaaaataatgaaaagtcaaagtgccaatattcaaggttgcactgccttataaatagtttattattgcttcctactctctatgttactaggatggctatctttatatgataacattttaattttattctcattttcaagtgagtttttggttggttgttgctcaaccctaacccttctaaaaatatctaattattta

SEQ ID NO: 47314 - DNA, 1756 bp, Bovine  19866880925848
tgctccttggtgatttatatttaacactgaggcatgaagaatcagcttagaacatccttcactacacactggccccactgccacattactgactaattgggtcagcactaacaataaagagaattttctggtcgtatttgctttctagaaaataataacatcatcatttgtttctctcataagtttgattgttatctttctaaatattgaactagagaatgggtgatggggatcaaagtactcagatcaaatcatcttagcttcttgcttttctttttaatggataggcaataaaggtaataaaaaggtgaacttacctattacatctagtctattacctattatgtctagtcaaagctatggttttcccagtagttacatatggatgtgagagttggaccacaaagaaagctgggcactgaagaaatgatgcttttgaactctggtgttggagaagactcttgagtcccttggactataagtagatccaaccaatccatcctaaaggaaatcagtcctgaacatgtattggaaggactgatgttgaagctgaaactccaatactttgaccacctggtgtaaagaactgactcactggaaaagaccctggtgctgggaaagattgaaggcaggaaaagaaggggatggcagaggatgagatggttggatcacctcacgaactcaatggacacgagtttgagcaagctccagaagttggtgacggacagggaatcatggcgtgctatagtccatggggttgcaaagagttggacaagactgagcgactgaactgaactgaacctattacatatttttttttttattactggtcaaaaaatgtttttcaggttttctctactttataaacctttaggtagtaagtcagttagttcagcataaattgtcacatggaataaaatatatactgcaaattcagggctaaaaagttcgaaataaaatgaatgaataaacatgtaaataaagggagatgagatatcttagtataacaataagaggtctaattattttttcctctttgtaaatttgtattttgggtagtagagttaagctacctcatttgtttcttttgataagcattcatttatattaagctgaaggactttgagactcaaaaatggatttctccaaaaagactcctccaatttacatcatgcactcatggttcagttcaggatcaatgccttcattagtggagaggctctatcattttctggaagtaacagttcctggaatggtaaaatatttcacattcgatattggtggtaaactagaatttatgacctatcctagttggcactgagagccccattttccctctccagcctgcccattgttctaatcagaaagaatacgttttcactgtttagccaagttacgtctgagatggttgccagggtttgggaagcacttatgtagccttcttcattttcacacacaaagaatgagcgggtaacatttactatgaataaatcaataagactgatgtactagaaatgcagtttgaaaagggcagcagccttctaaaagctttggaagctaacttttaactttagaaagagaggtgaaagttgaaactcacatagaagacttataaccattatctttttttgtgtgtataagagaactataactcactggggcttacagctacagtaagaacttttccaggagatgaagaaacatgataattgttcattcgtgctgcaaggcacttgttcagtctgtttttaaaaaa

SEQ ID NO: 47315 - DNA, 1508 bp, Bovine  19866880968476
tgtggttaagccaatttagatttctattactttaccttaaagttatttaaattctaagtttaaattctaaagggcagaagaaaagaagtacatttatttcccttttcccccatctcttcttttatctataatcagaaactttaaataatacctaatagtttaataaaacttgcttcaaatgtcctattttttgaattctaaagaagagggttttttgatgattattgtaaaataggaaagtttggattgtatgattctacaagaagtctagaggaagaaatgtcatgtccttaaggttttatgtttgtgcttttattattttaatttgcttttaatttttaagattttaactttaaaccctttgcccaagggagaaattccagaactgctgtcgtggctctcatgtttttatacacattttagatgcatgaaggaagagcaggggataggatgaagaaacaagcaacttgttcacatgatccatagaaggcagatggaagcaggttatgaaaaatgtaaatgcattggatatagagatattaatcatcagcccagccagagatggctagcattttatgtatttttttcctggatagggtgaaatgtagttgccatagcattttatatacatatcacttatatgcatttaatacttatgcagataaaattaatttcgatctcctcacacactgattgataggtcagtatttctattttcttgctgtgaaaacaaaagttcagagaaattcagctatttacctgagaaaccatagctgggaaaatgtagagcttacctcattctagttatcttttttcctaattttgaaggctttcaaacatatcattgtctgttcaactgttcatgcatgtgtacctaaaaagctactgttttgtagaagaattttgttggaagagggaaaatgctgttgtataactttaagatctgtgaatagaagatattacgcgttacaaatattaacttcccaagggaaaaaaagtacaatattcctcaagtataagagtaaacacaagaaacagtctatttccaaaagaactctattttgtgccaaatgtgcttttacacttattagaaatagttcctcattcataatgtaaaaatgatgttattattttagtttatatataacatatgacataaggagtgattttgtgactaatttaggcctcaggttgtttttcccacccaaacaaagtcatacatttggccatttaatttttacaaatctaatgtttcaaatttcacagttcattttcaagttagaaaacatactgatgtgttccctttctatttcttcctgaatatatttgtgttatctttctgtgagataatgaatcattttttgacacattccaatatttttttctcacatgcctgtctttttttcagctccaaataatgaaatcatcactgaccccattggccttcatttctattctgatttgtgtgaagaactcttagatgaagttttacacggtcaacaactaga

SEQ ID NO: 47316 - DNA, 1217 bp, Bovine  19866881060445
atttcctatattgaatctaaagtttatgcagataagtaattatatgaatgaatcttcttaaaatacagctttttaaattttattaattcaagtagcagccttcagatagactttgctgtaataaaaattataatcatgtttcaccgaagattttgttatttttcatataaaaagttatatctaaattgaaccataatcatattgttccatatttctttaacatctacactaatttttctatttaatttcattcaacatgaaaataatacttagtaatgcatttcgcaggctttattaatgccttccagacattcatgtttgttaactgaacgcacttgattatccacgctgatggaagaccacagaagcatggataattgaaaatagtaggtaattcagaaaattgcggtgcagtcagatgcacgttcatagacacatattcacacgtttattcaaatatatcccctttgtcagttctgtaagtaaatgatccaaagtagttgatatggtttctgccaaagcacatgcagataataaattgcatgtgccaccgtctcactcaacacagaaagggaagaatgtctatatttctgcctctagaaccttatgtttccatgtaggcaacccagactctcctctaggttcgttctatctgagatggtccagttaatacgatggcactaccagtctagagggaaaagtataggttaaggttataaaccagtttgaccagtagatctgaccagtagatcagagtcagctcaatggactatagagcagaatcagaaataccccacattctgacattttaaaagtaaagttcattaataagtttatgtaactacctcaaaaaaatggcagtgttgtaaataagatagaagtttacttctcttttgtgttaggcatgatatgctaggaatggcaaggtgatgtttctttgctcagtcaggtgagctttgaggcttcctgtactttcttgctctggtgcctactgccagtcgcctcctgacatgaccagagatagtttaccacaaccatatccacttctcagcccacaaacaggagaaaaggaaatggaggacaagcaatttccattcagtgagggtgacctgggaggagccagtatcatattttccagaacttaagcaagtgctccaggcggctcaatggaggctgtgaatataatctccaacaaggggctcatttactcaactaaa

SEQ ID NO: 47317 - DNA, 2519 bp, Bovine  19866881063100
ttttttaaatatttgcacttatatcctcagggcatattttcttgtgtttttatctggctttggtatcagggtaatgctggcctaataaaatgagtataggagtattcctcctgcttcaagtttttggaagagtctaaggaggatcggcattaattctttaagtgtttagtagagttcaccatagaaaccattttgtcctgggtatttctttgtttagagatttttaattgctgattcagtttgcttacttgttaaaggactgttcatattttctctttattcatgatttttaatgtcttaaaatattagttagataataattctgatattttctttttttgatctgtgctggactgtgtagatattggccttttcactcatttatctgtagaaagttgaacgcttaattggtgtctggcctgtccatatggtaactttcacatgctggacaatggcaagtattctactgaagtgatggaggcaattggtcccactagggaccagttcacctatcagtagaagtataaggtgtgaaagcaaaaatctgcaagttctttggaattgtatgctctgaaatagaacattgtcatttatgctgtatctattgatcaaaacaagtaccaaagccagtcttgattcaaagggtgggaaaatattgcttctcgatgggaaagctgtaaaaactgccatctgttttgcaagctattacattttatctctatatttttctaatttctaattctcttcatcaactttaatattttctattgtcccctttattgtcacaaaacattagacacctctgacctatttgaacattatcatcactaagcctaactcagacattgttatagtcccctcctctgttgctagtaagaatctcctgctgccatcaccatggtctaaaagagcttcataagtttgattagatcagacatggaagagggatcattgaatttaagtgtgatttttcagacctttttacttgcagtatcatgaagaaggtgtgcaatgttcaaatctttctaaataatatgagaacaaacacatttcatggatttatttatttttatctccacttatgtagttgcaaaaattaaatagaaaacccttctcctgcttctagacattaaaacatgggaaccgaacttcatattcttactgaactcactagacaaaataactctaccagaagttggtcatttttcaaaatatactaggtataaaattggcacctgctttctgtcaaataaatttcttgttattttgttgttgttcttgggttttctgctattgttctgattttttagtatcattgcatttctgtattccgaagttaaggtaaaactgtgtttatctaagtcaactagtaactcctaggtcatttcccaaagagctttcttccccattattatatttccttaataaatgcaaattaagtaattatctagttatattttgactaggcattattcatttgagaaactgtggctttatagtgcaaaggaagcattttttccacctttggcactttacaataaactcattctgatctaaattgattgctgtgggattatcttggagtcattaaaatattgctgtattgacattcactaatgattttaattagcagtttcaaattccagtgtttggcattaaatatgagcagatatactttattatatccctatagatgtttatttggttttgtttatctgttgtgtatattaaatacttatttgacatgctttatgttatatgtaagcagtcaatgttttagtatattgagattagcctgtctttttaaaagaatgatatagttgagattcaaaacctctctgagcaaaattaaggtaaaatatatatttttgttttgttttattattttaaataattcaaaaaagtattcagtttgtcataaatttaaaagatctacactcccacataaataaaaaaaaagtcttactcttaaaaaattggtatatttcaaaagccagagaattctgctaaaagagttgaaacatttgaattttgaatccatatacacattgcaaagttattctcacctggcttgaccacttctctttttggtaactgttataatctttgtgttgcttctaaatttctgcaaaggaacagcttgaacaagaaaggaccagtcataaaagtataaaagcaatcagttcatcattatgaatgacaagagaagattattaagttgatgtaataacggtgacatttatcccaccaaatccttcatcttttataatgtaaattagagactttatactttggattagtgttgaatgtctatctcctctaatagttgttaactacatattccctatgcaatccaaattccttgatataaaattggtaaatcaatagggagaatggcattgaaacttgtataatatcatatattaaacgaatcaccagtccaggttcaatgaatgatactggatgcttggggctggtgcactgagacgacccagagggatggtacggggagggaggtg

SEQ ID NO: 47318 - DNA, 1357 bp, Bovine  19866881484258
aaatatatttaataaccaacagctcatccatctcactcaggaatcttgaaataacatattgacaattctattataaattatcctctgttaaaaggtattgctgcttgataatatatttccttttccctgtgaaacaagctatttaatagccattaggtttgtttttgtgttttagtgaaattccaagtgcctaacttcaggtgttataacttctctagtgtgttcaacctcctagattcaatcccagttaacttccccaaaatgttaaggttgatactgattttcatgacaccttgagagtttaaatgtttctccttcatttcatcaaaaggacatttgtggatacatgagctgtccctaaatgaaactgttagataaacacttaatataatacagcttcaaagatccatattcactgtataagttttcattgtctttaacttatcatttactccatggctttatagtctataaaaaatagtctaccaaggttggcagacaaagaagtgtatctgcaccactgttcatcttgaacttttcaaaaaatatgtttaatcccacaacatataagaatttatttaggtttaggtgaataaagttggcactgtgtcatcaaagtgaaagcaaatggtgcattagttgggaaggatcattagatttgttttcttgagttattttgatttcttaggagagttcatattctaaagcatgcaaaatatgtgttataggttttagagagaagtcacttgattaacccatagcccttgtatttgttaatgaattaggaaattctttcccagtgatttattttgaactaaagaaatcctccaaagatacctaacttagctagatttcttcatgtgtgaactttatgtaatcatgaaaatttatcctgaaatttatatataactatggattcttcaacaaaatgttgattatatgtcaggttttgttctaaacattgggggtacaattgtgagcaatgaaaagaagagctcttttctctccctttggcccttatcagttcagttcagttgttcagtcatgtctgactctttgtgaccccatggacttcagcatgccaggcttccctgtccattactaactcccagagctcactcaaactcatgtccaagtcagtgatgccatccaacccatctcataatttcaaaaataacaaatgatgaataaaagttaacaggtaataggacagacactggaggtgggttatcctttagagtgattgagtaagtcatttcagaggaaacattatttgagatcttaatggtgaaaaagaatgatccaatgagttctgtgggcaagtgttcagtagagggaaagagtaaacacccttagg

SEQ ID NO: 47319 - DNA, 2268 bp, Bovine  19866881534958
cttttcttccaggagcagcatcttttaatttatggctgcagtcaccatctgcagtgattttggagcccaggaaaagaaaatctgtcactgtttccccatctatttgccatggagtgatgggacgggatgccatgggatgcccataattagcttttacatttaaagattacagaatgttttgtacaggatttaagcaatgtgggtctcacacacacacacaaatttgtttactgaacactttcatacagtcctttagtaagtatttactgaacactgggcatttcactttccagtccccaggaagaatatagacatactctcagtgtgctcatgacacaggtgaggggacagatgcagacatgtggcaacctaatagaatattctgacaagatggaacataagtcaaacattgtgagtgtgtgtgagtgaaagatgtaaacaatcatggttaaaactgttactgtacatacagggagatattaaattgactttgcaaaaacaacaatagcctgatacctattcaatggattctagagctagtgtgtaaaaatttgtaacttaacatttaatttataataattaaaactgtgtaataaatatagcaataaatttccaggaacctattcagagtaattctattaagcatatattgattattgttttactgaatagcatctaaaaatacaaaaagatttagctttgaggagactgttgtgtattttgttttacatacataggcttcttttgtacgttttgcttaggaatttttttcacatttagactatttataatattttttcatgctactacgtatatatctttctcattctctctaattgctgcatagtattttgtagtttactgtattaaatttatctaatcttttcaaatttgatgatcatttgcattgtcttcatatactaatatttacaagtaaaattaaatgaaagcttttgtctgactccttgtgtctgtctgcagctatttctctaggagggtaaccaaaatgtggaatttttactctaattgtaattttttacaatgtcctttgtttcccttcggagaaggcaatggcaccccactccagtactcttgcctggaaaatcccatggacagaggagcctggtggggctatagtccatggggttgctaagagtcggacacgagtgggcgacttcactttcacttttcactttcatgcattggagaaggcaatggcagcccactccagtgtccttgccttgagaatcccagggatggaggaggggcctggtgggctgccatctatggggtcgtacacagtcggacatgactgaagtgactttgtttcccttaaattttcagttttctttgggatttgtcttgatccttctcttcttggctattgttattggtgaacgttttttgcattgtcctttatactattaagtaaagaattataattttaggtaatagtgcatgagctttaagatgtgcatttttaagttacttggcccaaacaaatgattctctgaagtagaaggctggctgcagggtgatacaaatgaacgtaatttataaaatatcaggctttgattaaaagatgagcatatgagccagaatttaccttaattgcaggtttaaaatcagaccccagctgattacaagtctctgatttgttcaaatccatcacccactgataagatttaggacaagatgtgatgtagcttcatgataaacgtttggaggttgatggaggaaaagagaagagtcaataatgcctaaattttataattttctacagtgctcaaaacaggctcccctctgggacctcttctgattcagtcctttaggtaaaactcaggacccttaactcagcagtaatattgtatttcacacaatcttatgagctccgtttgctgagagctgcatggtgttgttcattatcactgagaaaggccactgtggtgtggtaataaacagaggaaggcatgtgctagatctaagtggcctcagatttatttctggagcttcagaagcatggtcagtgaaccaaataaaacaatctgtggtttatctttgggcagcacagctgtaccagcaaatatgaaacaaagttctctgaaaaaaattttttaaaagtctgaatagttactctgcaagtggttctcaatcttgggtgtaccttgaaatcatctgcaagacgatttcaaacgattgattgccaggcctctctgggactatttgattcagaatccctgatgataagtccaagtattggtgtatttt

SEQ ID NO: 47320 - DNA, 799 bp, Bovine  19866881621539
agattagatgaattttgcatttttaaaaacactaaagaggagatacagcagttccgttttgaatgtccatgatttacccagtgaaaaaggctttgcataaattttgatggttctgacatattcctgcagtagcttcataacacaattgagagaaaattcttcattaaaaatggcttttatcttcctaaacttgtgaacaataccagcaactgtttaagtcagttaaataaaactatgctttcataatttactaaaataaatctcattttatgtgatattttacttttttccatgaattaacataaaagattgtatcaaatgacagatgtttttagagctgggagcaaattatattagaagacttgaatgatgtttgcaaagcttttgacttgcctataaatctcttctaaatatctgaaagttctttagaacaaaaactggaaaaaaaaaactatagagaatatgaaataagtaacaattttagtaatgtacaaaatctatcaaacttaaataccataaggctgcttaattatatgggtgcatgaatgaagaataatagttccaagtttcagactgaatagggtattatatcatgatattgtaaggcagcttaggaagaatttaaataaattagataaatataatctgtatacagtaaatacatacacacacacacaagcactgtgtcttatacttgtgttatgtgtgtctgggcatatgtgttctcaatcatccttcaatcagtcatgtacatatggcttggagccataaacactgggagatatgaagtgggtttaca

SEQ ID NO: 47321 - DNA, 725 bp, Bovine  19866881839364
ttattttatagcaataaattatgctagaaattaccaattatatatttaagtacattgccattaacttgcactagtttgaattatatattgaagagaacatgctaatttgagaatatagactctatttagcataatacattgtttcttgaggaatgatattctgtatattagagaactaggttataaacagataattaaatgtgagaattaattttgtttcatggggctcaattaccttatgtgaacaatgtaaatcatttacgtttgtttttaaatatagcatgcatattcaaaaagcccatgattataatctatgaataataagtagatatatttttagtcaaataagctactatgcagaggagtgctaacgttgcttatcttcacagtgaactttcagttccaggtcaagctgcagcaaagcatctgctgtggccatatgttatctcagtaaattgccaccaggtgaaattctttatgagacacaccaaattctaaaaactatcacaggagatgctatagtacataaggctttcctccgtttggcctcctggtcccaatgggggagataattccacatttcagctaatattattttggttcctgccatgaagttggaagatatttcttgcagtatagaatctcctaccagcatctggaaagtgagcataagattgaaagtcagagaaagaattttactcaccatgggaaaatatttttgaggg

SEQ ID NO: 47322 - DNA, 2725 bp, Bovine  19866880133888
cccaaaaagataaagtctgacactgtttcccactgtttccctatctatttcccttgaagtgataggaccagatgccatgatcttagttttctgaatgttaagctttaagccaactttttcactctcctctttcactttcatcaagaggcttttgagttcctcttcactttctgccataagggtggtgtcatctgcatatctgaggttattgatatttctcctggcaatcttgattccagcttgtgtttcttccagtccagcatttctcatgatgtactctgcatagaagttgcataagcagcatgacaatatacagccttgacatactccttttcctatttggaaccagtctgttgttccatgtccagttctagctgtggcttcctgacctgcttataggtttctcaagaggcaggtcaggtggtctggtatttccatctctttcagaattttccacagtttattgtgatccacacagtcaaaggctttggcatagtcaataaagcagaaatagatgtttttctggaactctcttgctttttccatgatccagcggatgtttgcaatttgatctctggttcctctgcctcttctaaaaccagcttgaacaacagcttttgatcttagctgaactaaatcaccaatctcagtgagagtagacttaattcttaccttcttcatagtttttattcctctagaagtgcaataccttttgcaactctgtccataggttttactgtccagaacaaccgacctctcataaacagtctctgatcttccaggcattggagagcaaagagtagctcactttgcatatgtgagacagtgcagagatacttcttcagttaacatattcttccttgagatatcctagacttcttctttattgaattacaatgatattgacctatgacattgttatggttaagtacacaaggcttgggagtcagactgtccaggttaaagtctgacactgtttttctggtacatgcatacataaaatagaccaataataggaccctcttctgggatatgttatgatgactgaacgagatgatccatgtaaatgatcaatataagtatgaagtgtacagcactgagtgattaattcaaaccttaactcttattgtaaaaacccattttgtttctacattcagtaagcactgttgcccactcacagtgattaagagtagggttgagaagttactaaaccccaaatgaaggacacacccttattctactgaacaaccctcctgttcactgttactgtgaaattgaggaagagtctggaggaaagtggccacccttgtctcagggcaagttataaagtggatgtaaaagtaacaccctgaaaaaaattatgtcaaacatatgggactcaactctgacgactgggtttgtaaagcagaattaattaccacaaggcagaagagccagtcataccatgctagccacttacactatcaggtaaaatttcctatgaaattactgttgaaaagacactagaaaataatatacagagacaatctgtacatctacataactcacatacaacacacaaaattttctaggaatcgaagtcaacagaaagtatttgtacgcattatccacccagttttattcttttagtagccatgagctaatcagtttacccccaaagctgtaaacaacatactatttccatcccatcagcaagcttttcctttatctttcctgttttctccaaaacaggagaaactctctttcagtttagtcgctcagtcatgtttgactccttgtgaccccaatggactgcagcacaccaggcttccctgtctatcaccaactcccagagcttgctcaaactcatgtccatcgggtcaatgatgccatccaaccatctcatcctctgtcgtccccttctcccgccttcaatctttcccagcatcgagggtcttttctaatgagtagttcttcgcatcaagtggccaaagtattggagtttcagcttcagcatcagtgcttccagtgtatattcaggactgatttcctttaggatcaactggttggatctccttgcagtccaagggactctcaagagtcttctccaacaccacagttcaaaagcatcaattctttggctctcagctttctttatagtccaactctcacattcatacatgacgactggaaaaaacatagctttgactagatggacctttgtcagcaaagtaacgtctctgctttttaacatactgttgaggttgattatagcttttcttccaaggagcaagcatcttttaatttcatggctgtagccaccatctgcagtgattttggagcccaagaaaataaagtccaatgatacagctctaaatctagaacatacgattcttttgatttctgtcttagctggatatcttctccatgatataaagaagcaaattgaagatagttggataggtgggttagcctcttgatatcattcaggtttcaacccaattcttttaagaattaaaaataattgtacttgtcttacaaattgagtctttgtggctctagaagcaattaaagcctatctatcatttttcccaactcctaaatttgctctatttgtctcaaaaatgcttatagatattgtaaatgatcaggatagtaaaaacaaaactataattcaaaaagacacatgcactccaatgttcactgcagcattatttacaacagccaagacacggaaacaacctaa

SEQ ID NO: 47323 - DNA, 2306 bp, Bovine  19866880535357
gtagcttttatgtttacacaaaagggattaactatgaacttcatggagcaggcaatggcaccccactccatactcttgcctggaaaatcccatggatggaggagcctggtaggctgcagtccatggggtcgctaggagttggacacgactgagcgacttcacgtttacttttcactttcctgcattggagaaggaaatggcaacccactccagtgttcttgcctggagaatcccagggacgggggagccttgtgggctgccgtctatggggtcgcacagagtcggacacgactgaagcgacttagcagcagcagcagcatgaacttcactgtccatgttttctttttttaaaaatagtctgtttattaatatccatttgactgtgccagcattcagttgcaggctgcaaactcttagttgcatcttgtgggatagagttctctgaccagagatctatctccagccccctgcattgggagcaaggagtctcagccattggaccacagggaagtgccggttgtctattttttttttctcacttgaggcctgaaggccacaaagtatagtatgtcatgaatggaggacccaggtgaagaaagactgatggagtgttaacactgtagggtgaaattataactcacctagtcctgtactgacagatagttgggttgtcccctcaccccactttttcccccctattacaaataatgttgcagtgaacattcttgtaacacaacttggtgaactcttgcaggtatatctgtagggtaaattcttagctctgaaactagtctttgttgctgttgttcaattgctcagtcatgtctgactctttgtgaccaaaataggttgcagcatgccaggctttcctgtccttcaccatctccctgaatttgctcaaactcatgtccattgagtcagtgatgccatccaaccatctcatcctctgtctcctgcttctcctcttgccctcaatctttcccagcattaaaattacttcagaacatttgtttttcttgacctcagttaaatgtttttttttttttaacaagttattgttgtgagttaagcagtttacacatctctgcctcttttaccacattctataaaggggaacaccatggtctactcataagtgaaccttatctgaagacataatcattgagatcatctcatttttgtcccagtcaagagcctggacatttacttctgttgtccagttccctaagtactgtattgatcagcagccgttttcaggcttttcttaaaaagtaacaaaagcagttaaagtaaagtcatttgaggatatctgaagggtcagagcatattcaagaccttgtgctttcaagcaaaactttcatacagtttatacagcatctagttttagttgtcatttatttgtatatacatatttgaatcaagtagttcattctgatttttgaatataatatggatgttatacttgacttatacctaactgggcttctgagtcaatgtttgcctgtggtctttccaaatcagctacataagcatttaacactagcgacgcagagcacctgctctgtgaggagccaagcaccaggtgctgggaaaagtcatctttaaaaaaaaaaaattccctgtctttgagcagaaagctaaatgctagcaatcactaggtttttctgaggttgagtatcttattctgctcattgggaatttaaaaatccactcacttacttcatagtatgttgttgcaagaatcacatgaactaacatgtaatactgataataggttaatacaaatactaatagcagctaaaatttatataggacttgctatgtggcatgatttaattcaagtatattgtgcatattgattgacttaataagaaaaatatctgtgaactttcaaataagaaaaatatctgtgaactttcaaatactatagtaaaattcaaaatgtgattactattcctgagtaagaaaatatgtcaagcagaaactaacctttcaaggtgaatgtgtttctgaaatgaattttgtggtggtacacattttcatgctggagagggtcagagataatggaggccaaagaagcctggagagactggccagacctcggtgctatatttggaatatagagctagaaggccccgagtctgcatcctgctgctgctgctgctaagtcgcttcagtcgtgtctgactctgtgcgaccccatagatggcagcccaccaggctcccctgtccctgggattctcaaggcaagaacactggagtgggttgccatttccttctccaagcataagagtaaaagcgaaagt

SEQ ID NO: 47324 - DNA, 1999 bp, Bovine  19866880596078
acacacacaggaactgggataagctccaaactgattattttgttgacatatctgagtttgaaaactttgactgcaaaatattcattaaggcaaacaacttcccatctgttttgtaagtaatatttagaaaatacacttctgaaccaaggccatggtaggagtgccaatctaaggccccattttctgattcttgtaccaataaattcctgggcgatcagtgtagcctctttgattagaaaccttatttggaggaatagagagagaaggtgatggggcaggagtgaagagaaaacagaatccattttttctattttcatggagtgtcatcattattttttctgttattgtgcttatcatagtaagatacaaaaaaaaaaaaaaaaaaaacaaccaggcatcttacttggtaaaaggcaaaaagtacacaaagcaaaataatgaagagcctcttcctaatggtaggctgtctccttcagtgctctgcatggctgccaacaaagctctgccagtcactgagttattccatttcctgtaaaatgtatcctctctgctctgctttaaaatgctggacctgggactgcaaactccctttgtgcttcatcagataacttcctgttaaagtcccataagaaaaggcacaaaggaatcaagagggagaaggaattgctccttcctctggtgtttattgcctttatccacaataagctttcaccctatgacaggcagtgctaaaggatccagtttctcttattattctctgaaacatcctgctttcaaaggcagcagaatcacccagctaagttctctggaaatggtttggcggttacttggtactgaatgtgatgttgaatactttaataaaggaacaagggaaactggaaacctgcagcatacagtttcatcacaagtaagtgaattctcacctgtaggcaaatattctactagagcaaatgcccaaacgccctgagcacaaagtaatgactgcactcgacagtcgtggtggcaatgaggaccataagggctgtaagaggcccagtgccattacgcaccagaacactttctgaaggaagtaataaacttgactttaatctctgagatcaactcaatgtaaaagtaacagcttctagctccaaagatgactagaaattaatatttcttctagccataggaaaacatctctgaaaaataaatctaaattttattgtataggttgcatagttactaggcaatgagatttacagatacaaaccctgttatatgaatgttaggggattggaaagaagagcctgaatcttggaatagagacatctggatgaatttagaagctgaatatcttgaaaccttagaaactctgagtatctctcttgaaaatgaaaactgcctgccctcctatctccgaggaaactaacaatgcattgattgactctttgcaataacttcattaatcccctatgttaaattcatttttctaaatactagatttctgtttttctgagtggagtgtgactaatataatattcttctatacatttttactttccttaaaatatagtgaactttgataataatcattatccattatcactaagttttaactctatgtttttctaaaaaacataatagatgaaaatatcttttaaaatctccatgtttttcaatgcagaggtcatgttatgatataaatacagctcacagtatacaaatttctgacttctttcacatcttttctttctttcccccttcaatttgcagtgatagttgctattggccgggccaacaacttcaaacaaaacttaacagtttccacctaccctaaacctgcactttttcttgttctaccacgtttaacttcttgtttatcaaattagttgccaaattcattacagctcagcaaagattttaggtctactgggtgtcaagtatggtgcaagacacaaagctgaggaaacactaagcctatataaccctatatattccttctactccaccttaacaattt

SEQ ID NO: 47325 - DNA, 1234 bp, Bovine  19866880820252
tctatatggattttttttttagtaagtaattaatataaatagttctgactggttttagaaaccatggatactgacaaaaatagaggagtagatgatgggaagcagatggatcatttaatttatttctcaattacagttgacatatcaggcacagaaaccctgcaagtcatctatttctttatggcccattctgcagctgtgtttattgtcataacaaataaatacattatctcattaatggaacgctgaatattttttattccaaaaagcacattcaaatacaatgcttcttctacaaaaggagcacaaaatggggggagggagagggtatttgcccaactgattgctgcagaggagtggggcctgtgtggagtgaaggtttcagaaaacaagatgtagtcacagcgaaagtgtaacctgttctcatttagatatgatctactagtcattctcagagagccatgctatcaaacagagtcacacttgtaaatctttatgcatttcctagttaatgcatattgtatctgagatgcagatggataataaactttattacagtacattttagagtgtcttttcaactagaagtgccagaaagacgggaggaaatatcagagcctacttctagtgctgtatttaatgttgtaaaaacaatatacgttggattaggaacaaataggtgctttattctcaagtgaacagatggactgttacagtctaacggtttccccactagaatagtacagtttctggtgggttttgtttggagtggttgctaaagattgactctaaggatcaaaaagcatacaatttttgattacttattgtttcttcactttggattaggaactcatctggtctataagtattcaatattggtaaggattataaaaaatgggaatgtaattattgaaaacgcaatccttggttttatttgaacctataacccatcaattaaccccattcattaattctcttgattatatatcctttgttatctgaccaaattggtcacctttattcaacagttgtatccactaaaaatacatgcaatccaaatcttgggaatattatatttaatatacatattcatagagatctatatacaaatctaagtttttcacattttacttttatgaccttagattattgatctattatgttgatgcaaaggtaagtgtgattttacattgctgaaatttgccatttgatatcggaatacattcttaaataa

SEQ ID NO: 47326 - DNA, 2639 bp, Bovine  19866880850661
attccctttcacccaatatactgtctcatttcactatcggtgaatgtatttacatgcactgcaaagatagcaaaaagactatcagcattccaccctccaacaatgatggagtttccactgcctgctggtggtgtatctgttccaaaataccatttaagagtgttccctaggactacttatgactccctctacttcaagtatcaaagtcagaaactagggtttatgatgtagcctggcatgctggtactttgcttgggattgtgttttaacaagaacatctatatgggagtaaggggtacaggaagagaccggaagttgaactatgattcagttacaatagaagccacagctaattacacagaaagcactaagtttatagccagagataaccctaatggaagcaaggaccagacatttatttctctgcagcaacctgtcatttgatgaggggtgctctagaaaaggggtctaaacctgggtgaagcagtttcttttgcccaagagcatctggggagaaacttggctgagatatatcagccttcctgaagttgggatagagaatacctttgccctgaaggtgtgacctcagtaacacaccagcagtatgtaaaatagattgccttacattttccttccccacttctccagagatctcatgcttagcagagcatagcaaggatgtgaaatagaatgggaaaaaaggcaaaatgtggttaattcttaaacattatagttcctgaaatagatactccatacatggtaatgctaaagggaaaatagaatgtggtaatgctaaagggaaaattgagcctcagaatcttggaaacctagctttgacttttatgccagatatactgggcaagtaactgtatctctaggtctcagttgctccctctatacaagatggtgtttgtagtagtacttctcttaaagagttagaaaatttccctggggctgtggatctgaaaaatctctatctcaacatttcctgatactttggcaggaggaacttaatacactggatttctcactactccaaccaacaagcagtcaatgtgccaacagtgtgagtgggtttggactgaattatctatcctttacaaacaagtgtactcagaaagaatataaagaaactcttgctttgactagagatgcaagaattctgtcctggtaaaataagtttttctttttttatccatctatgaaaaggtattggcctgggaaaactccctctacaactgcagattcactatctggatgatcaactgatcacccaaatgatctttgttgaggtcaccaaaactttaatagtccagaacatgcagacatgtattacaattttagaatcatttatgagaaaattagtgagaaaaaaaaatcactagtgagaaaattatgaggaacaatggaagaaaaagagagctgactcagttttggatccctaccaggtgttccaggaaagccaactgttttctgagtaggtcacacctgtttaattagcaataatcagagcctttagatgatcacggagaaattaaatagctaaagataaatgacctaggagggttaacaatttaatcccaactaaagagcaaacagaatgcaatctaaaaacatgatggcaagcagaattgtaggttaatgaccttgcacttgataatttaatggagcacgcatagtggcaggctggaattaatggattataggaaataaatatatatactggcattttatgaataaattattctaacactaattgcaattaaattaccttgttttaatatgatatactaattaagccacaagtgatttgctgcctggttcttgcctggaaaggaaccaaacaaaagtatttgactcagctaaaatgtttgtgaatatatctccaaactttttctttcattagggtggaaattgataggaatattaattatttgctaaaaggattaccttgttcatttttccccctttaggatatgcatctgcatagagaaagcaccaatcaatcctaaaggaaatcaacccctgaatattcattggaaggacggatgctgaagctccaatactttggctacctgatgtgaagagccaactcattgtaaaagaccctaacgctggaaaagattgagtgcaacaggagagggggcaacagagaatgagatgcttggatggcatcatcgactcaatggacatgagtttgcacaaactctgggagatagtgaaggacagagaagactggcatgctctggtccatggggtcacaagcagttggacactactgagaaattgaacaacaaagagaaagcattattataacaagaaggtaaacctgtactggactctctttcatgaaagacacactgccagtgctgactcagcaatctctccaaaaggtgatggattcccccagtcattcaatttcatctaccatctatttcttaatactatataagtgtcacgctatagttaagaatcacataacaactgtccccatagttctagctatgcgtaaacctctcctggtttcatccaagtcagttgttccccttctgtacactaaaaattgtattgtgtttagctttatacactgttcttaccacatcccaatcatctgttcaagtgtctgctcatgtgggctc

SEQ ID NO: 47327 - DNA, 1530 bp, Bovine  19866880945375
cagacaatatgatggtggggaggagaatgcagagatgttagtgaaatgttgaatacttttaggtattagttctagaggtctaatgtgcagcatggtgactacagttaataatactgtattatatacttggaatttgcgaagagagtacatcttaagtgttctcaccagacatagaagaaatggaactgtgtgacgtaatggatgtgttaattagcaagattgcactcaacattttacaatgaatacatatatcaaaatactatattgtacatcttaaataagtacaattttgtgtcaattatacttcaataaaaccagaggaaaataagctcaaggcatttgattcaaagttctgggaactaatcactgtgctattgggactcttcacctatagcacataatacataagggactgagagagcagttgtagaaagatgatacagaggatgcaatgacaatggtgaattgaaaaagtcatttaacgtcttgcttttcctgccagaatatgaaagattatctgccaaggtctctatcagatatgtaagtgaggatagagccctttgaccctgaatttttatgattctccagcagtttgccaattcctctcctctaaaacaatgttgcccccttaggaggaaaaaaacaaacaaacaagaaaatgtatttgtaacttgcattttgaatgaagggaaattggcaggtgatatcttaaaattccatttatttcaatttgccttctctgagagcagagacagtgtttcttaacactgtggtaattaatacgtgatgtgcaacgtctcattttattcagtgtatagttattaagctcctgccaagaggcaataaaagaaaattaaaatggccagggaggcataatatatagcattttttcctctgaagcatgcttttaaataacattcagtcagtacagtgtcatccaggccatttgaggattacacattgtgttattaataaattgtttgactgagatgaattgaactagcagggctaatgcaagttagatgtatctttcaaagactgtgaagaaactgttgcatatggaagggagtggcactcacatcacctgatgacaaattaacccaagtcaacatggcgggtgataagaattgggaaaaggtctatccttgttcactttctttcttcccaaactttgtaaatacaagcagcctgttgtaaggtgcatttcctgaaggctacacccaaagagagtgggtgtagtgtctagattatacagaagagccagtggtcataggcttctgcctccaccagtagcttagaagggttatgatctcaaagaatctatggtctttaaataggtctttgtccctatcaacaacccctgatcctaaatattcccttataaatacctgggtagggtacagagttatcattcttgtaaacccatgtcttcctgtgtggaaatatagaataagcaaaaataggaaaatatataaagaaacagagttacaagaatgttaggttttctgttaatatttgctaggatgagga

SEQ ID NO: 47328 - DNA, 894 bp, Bovine  19866881124762
aatccattatggcacactaaatgatcacctgaagtgataaaatcttactgggatccatatctctggagactgacaatttactaatagaacactgtaaatctctcttctccctttcttgcacattttgaatggaaaccaacgtgttctgtgtagggagagggagagaatcctgaatgtgtttagtagatacaggaacataggaagggcttatctgtgaacagtagctgtaacttcctgggctaagatgtgtttatctgttttcaaacctggcacaccttcttggtcactgtgaggtggggcaggaggataagacacgcaaacccacaggcttccttttctgatgagaaagtaaactctgtgctctagaggcagccgtggtgcctcccgatgtctcatgtctctgtactgcctcaaaaatccagagtttcttatatgcatgcagacattctgctgctcagagcaataacccagttctgccaaaagaggtggtaacaacagcatttctgtgtcttggtcttgcccttctaattgtgatggctcatgaagatactggccttcagtctatctttggaatcagcagaaaacaaccatttcccattctgaaacaggcatgatgactgattggagtaggtataaaaatcactctctgctttatgatgtgtggattaatgaaagtattaaaccattctaatgatagataaggaaattatttccactgtagttggaagaaataaaactgttcaatcttaaattaaagaggtctaaaactttgcaagctcatcaaaagtgcatgagcaacaaagaggtacaagtttataacccattctggagtaccttaggttcttaacatccatcatttttctgcttcattactgttggtgtgcttctcaaaag

SEQ ID NO: 47329 - DNA, 3691 bp, Bovine  19866881275936
tgcagaagagccgaaaaagaaaaaggtaataagttttcatcattctgtatttactctaggaaataatatgtaaaatcattttgttcacaggtctcttgaagtaacattcataatattgcttataagtagtattcaatagttatcaacttaatctgtatgttttgcttatttttgcagaggactctttgggatactattaataagaagaaagcatcagcctcttcaagacataacaagaaggcttcaaatattcaaaatgtgaataaaacatttaatgtttcccccaaagctgacagagttaggagcccactacaagcctgtgagaatctggctacaaatggaaactgttccccaccagaaagcaatcctttaatccttgaagaaaataaactccccatatcacctatcagccccgcttcccaagagtgccacagggggacctgcttgccacttcctgttcgtcgatctacaacctacacatccctccctgcttctgaaaatgggggactggtgaaagcagacggtgccaacactgcagaagattttcattttaatgagaaaggcataactgaaacctcctttgactccatagacaacgttaatagtcaaattgaagagaatggtaaacttactcttaccccaaattattcttcaagtttgaacatcacacaaagccaaggacattttctaagtccggattcttttgtgaataatagccatgcatctaataatgaaccagaattcgtgaagtgcctctcaccagatatgtttgtgaaaggtaatacaaggcctgtgattttggaatcaaaaagggtacatgaaatctgtcggaaaattctaagtccagattctttcataaatgataattatggactaaatgaggatctagaaacagagtccatcaacccaattctctccccaaatcaatttttaaaagataatatggcatatatatgtgtatctcagcaaacatgtcaattgccattatcaactggacattttcaggactcacagcctcctcaagatgagagaaaaaatgcagctgtaccttgtatttctgaatgtcagcagttagaatctccaaaagctacttttgaagcatccaaagctttagaagtgatgtcaaactcttacacttttaaaaaacagaaccagcctaaattttcggcagttcaggatatttctagtcacagccgcaaaaaacctattaagagacgcccaatactttctgccactgtgactaaaagaaagcccacttgcgctgtagaaaaccaaatggagactgttaaaccaaaggcaaaaagatgtctcaatgtcgtagtgggtgactgcaaaaaggaaacagatgatcaaaaagagaaagatgattttcatccttttcttccaattagagatttaatacagagtagacctaagagctctaaaaacatagtaactcctccctgcaaggtagcttcagttgctcgtaaaagaaagagtgagggacacacaggagatgaaaatgtgaggataacagttacagaatgcatggaagcacaagaggtcaaaaggccccatttttctcctgtggagtctaaaacatcaactgttaaacacacaaaaaaagtggtaacctcctccttgaaacgtgttagccacagagagaaattaaacctgaagaagaaaacaggtgagtctcattcataaaatctttcatgaaagtatacctatatggggaatagtttctatttcttttggtttagtaaattgctattgagaagcttgaatcaacttgtacttttcattcaccggttggctttagtggaagatgagtcagacatagagtagggccgaattctgaaatcactgtgatctcattcttatttacatttttgatgtttcattcatcatggtttttctgcagtaatttttaaaaactattgtgttaaaatgctttctttatatatatatatttttttgtctttatattaaaaaaaattttttttaacatatttgtttatttggttgtatcttagttgcagcatgcgaactcttttttttccctgaaactttaagttttattttgtattggggtatagctgattaataatgtggtgatagtttcagatgaacagctgaagggacttagccgtacatttacatgtatccattctcccgcaaactcccccctcccatccaggctgccacataacgtgcagagttccatgtgctatacaataggtccttgttggtcatccattttaaatagagcagtgtgtacttaacttttccaaggtccctaactatgccttcccttccagcagccgtggttcattttctgtgagtctgtctctctgttttgtaagtgcattgatatgatttctttttagattccacatataaggcatgtcataagatatttctccctctctgtctgacttacttcactcagtatgacactctctaggcccacccatattactgcaaatgacattgcttcattctttttaatggttgagtaatattccattgtttgtgccacatcttctttatccattcctctgttgatttagactgtgtttccatgtcctggccactgtaaacagtgcttcagtgaacactggggtgagtatatccttttgaaccaattatttattagacccaaatacccttccctatttgtttaggatggtttcttttgtgaccaaaggaacctaatgtgtattctgcactctccacagcttttgagcagctgctagatatttaaatccatatctaatagactccaagatttggaactatttcttttcacatcccaaacagttttaatgatacataattccttagttgaaaataatattatgttaaatacttggtttgaagaataacactgatgcttttgttaatttattctttattggtttctgttgctttaaatcaagtatattcaattcatttttaatttaattaagttttaaatggaaagacattctaatcactaaagaattttttgtttcattttctccactgtctggttacccttaagcacataactaagcttaaagcagtttcttgagagtttgaagattgtatgcttttctttcctgagattttctagaaaaggtaaaattattcacacagttcaagtgagcaaatgttgtggtccctgccttccatatcattcagaatgcagctagttctcacacacgattggttacagtgtgcagggatttcacaaaagtgactgataacactggacttttttctttttaaagatcattttacttttggaattaaagtcactgatcccagctcaccagcacatacctgctgttcattgatagcagcatcaggcatgcctaattcagctgtgaaagctgctgtgtagtttcctcctgaaaaatgtttattctgaaatgacatgctgaaagtacagtcccaatagtctaggtttgctgaaatgaacgaacttatttgtcttctccctgttcttgaatggactgttctgatgccttcacctgtttgtggttgacttgtatttgtttattatatttgagaaaatacatattaataggcttgatgagcagcttgagaataaatgtgcttatcagcattttacctaaagctaatgggcatgtagtttataatctgaataatttatttagaaggatgattatgacaagggggggttgagccgcagctatcacatgac

SEQ ID NO: 47330 - DNA, 1439 bp, Bovine  19866881384479
aatgtttattctttttaagttttattttatttttaaactttaccccaattgtattagttttgcccaaatatcaaaatgaatccgccaccaggtatacatgtgttccccagagaatcttttttaacactaggttaatgccacagtgatggtgccctctaagctgatttgtggccttttaaagtttatcaagaagaaaatgcttggtattacagtttaataagctcaatagttctaatgatatatcttcttcctttagcaaacaaagctaatttccatggttgtagagtcaagtaaattttatgcttctttattgctttagctttaatctctgttgtttgagacatactgtcagttgaacacagacccaaattgtcccctactttcctcataggaatgaattatattttcttatactcagctttcagtctgtcactgaaggaccaaatgcaaaacaggctgataccatgctggtttagggccatttcacattacattgataaatcatgcaggcacaagtcatttgtcaaaaatacatttacttgaatcaaatttactttgcgtgcaggaggtgctggattcatatctagctgtcactaaataatttatcaaactctgatttgaaatataatacaaagtccttaataaaattaaacaaacttttctttacctaggaattgtatattgggtgaaacatacagctcatcactgtattacaatatcattttggtgatttcaatagttgagaggttggtgatgtattgcaaactagacaaaataaattcaatttaatatatgttacaaattactgttgatttcaaaatgcttgatattcttcacttcatgtgtttctacccattcatacctcttttcttctatgaaatggggaaaaattactaatctcatgtgctaaagacaagggattttcttttttatttggtctttgaacttcagtacttgaggcagtattaggtctagttcattaatgaaacactctcatgtacaaagggaaaagatagtacttagtatttataaaacttgaagctttttggggttttgagagaaaaaatatgtatacttgcctgttttgaaataatgggaagagggatgtctgtgccctttgagctggtgagcatgggatgtttccctgtcctcagccaaaggtatcctaggaagtagctgctaagtcgcctcagtcgtgtccaactctgcgcgaccccatagacggcagtccactaggctcccccatccctgggatcctccaggcaagaacactggagtgggttgccatttccttctccacctaggaagtagagaggtcactaaaatataatggctaactatattacctaactgtatataggctctagaatgtggcagtacatctttgaatcatcgttctgtcgttatcttagttatcaatcttaaatagcttacttaac

SEQ ID NO: 47331 - DNA, 1287 bp, Bovine  19866881392691
atgtatgatgcaaatgttatatatttatataatcatacattatataacatatatggattatatatacatatttgtatacacatatacaaatgtatgtatggtctataaatatacatagtatatatcatatcaagaaaaagaaacataataagatgtttagcacaattgagttcagcccaaatcaacagaatggacttcacttgctcctggcccataatgcctcttatacattatcccttaattagtataagaataaaggaagatttttgcatgtttgatttcattctgtagtatttcctatgggtacttcaacataaatctctaaaatataagataatatattcagatagcaatgccttaaaattggtgcagctcagatcagtaagtaggtacttgggatagtagagttaacttgagtctaatgattttttgtcacatcccgtgattcattggttttagatcttgggaaagtcatgaaataattgtaaaacacacatttttgtttgtagaaagctaacaattgtgcttacttatctgatagtaagtaaggggcttctctggtggctcagacagtaaagaatccccctgcattgcaggagacccgggttccatccctgggttgggaagataccctgggggagggcatggaaacccactccaggattcttgcctggagaatccccaaggacagggttaatctggcaggctccagtccttggggtcacaaagagttggagtcgacggagtgacaccacacagcacacatctaatagataggtcaggcaaggtttaaatgaaaaattgcttttgaattgcaaagcattacacataaaggaaccagtttgaggataaattaaataataatgttaaagtataaaagaatatgttgattaacttcagtgaaaaagctgttttccatcattctggaacattgcaccctaacaataaatatgctaataacaaatcttcaagagaagttcattaaacaaggtgctttctgtggaacattttcttataacattttgttaattagattctagttattgtaacttttaaatatgcctcaaaaattggcctttccagcaattcaatttattgtcattttaattaatctaaattagtgagctagtgttctaatcacttcagtgcctgatttgacaagcttcagatctagaaacctatgttgaaatacaaacccctctaccttctagaaacaataaaaggtactcctgtaagtttagtgaatttcttctttctctaagaaattactttaaggaaaagttagag

SEQ ID NO: 47332 - DNA, 905 bp, Bovine  19866881656724
ccccacactctgcacagctttggctaaaaggcactcttggtccagccttgacatttgcagctgtcacatccttttctgcatacttaacagctaagaaacgtggatgggggtattgctatttaaaataatgctgataatgctatctatgggaaagtccatattgtcatgagctcctgaaggtaatgtggctctccacaagtaagcatagaaaggcccctctagaatctgtatcatctggccctgctgagctctctagctacagctttcccacgtctgtccttaaattctattattctgccacactgagctacttaatgtttcctactgcgttataatcccttttgtctctgtgttttatacttctcactagaacactttctcctccttaccccttggtgccactcaatcttcaccattcttcttactaatctgagcttcaagttctccacttccccccagaattctccattttccttagatgaggtcacatccccacccagctttctcagtagcactacgtctttggcaattgtgcatttgttttcatctctggtctgtgagctgctgaaggagctagtattcctcagtttaggtgactgcataagatacaaaggcacaatggatatgaatttaaaaattatgcttttataatgctattgctcctataatttctaattaaccagggctctttgttccctgtattccatagtgctgttccttttcataggtgttaacagaaaataaattgctatcgatgtgattcttatatatagtgtaaaactggccattaagctcagctccatgccaacaaggtttaaatacagtgaactgtagggaagaatttccaagaagtaaactaattattactacatgctttgcctaacaatatttctgcttttctttgc

SEQ ID NO: 47333 - DNA, 782 bp, Bovine  19866881721577
ataatgctgggaatgtaaactactcctaaaaataaagtctattaaaaactggcatagagattatctttattttcttcatttgcctttgactagattataaccctaatatattccttaaatatattataagatgttttattttagaaacatcttccaaaatatctattgttcttactataggaaaatgcttctttaaaaatggcctttatttttttctagccaaaattgaagaaaagaaaggtgaatggttaggaaattttattcaagcttttaaaaattaattttccacttattattttatataaacccaataagaatacatttgttctaaatacaaaatgctaattgtgatttcacttatttggagcagaatgtcatattcagaatgctatttcaggaatacattgttatttcccaaagaagtaatatgtttcatttaattttcatgttgtatgcctttacatataattagaagaaatttaatcagctacaaataccatcacaaagaagcctgggaacttggctactggtaattggaattgcttttcaactgcaaattgctcactttgtgaaggtttcattcacagaccttttcttaatacatttcaaaacaacacttgaagttcaatttattttactgatgcatacaattttgggggatggaaatataggaaattggtggaaaatgatgaaagttatgcctattgggagtcaccgaagcatatctcaaaacaaaaaggaaacacacatgagtaaactaaatttattaggaagaactgggc

SEQ ID NO: 47334 - DNA, 1854 bp, Bovine  19866881745741
ttcttttcttagctatttgtaaggcctcctcaggcaaccattttacctttgcatttctttttctttgggatagttttgatcatgtctcctgtacaatgttataaaccctagagtaccagaactatggatggaggtccttaaaggcaaatatagttgtatattctattgggttaaccaaaaacatggataaccttgaacaaactttttgcccaacccaacagttacatacagtatgaaggtaaaatatgtgtcagtatggttttactattctgttaccttagttaagaaaacctttatttgtatgtctatgcagaatagcccaggtatatatgtgcataagtattttcatattttcttctatttcatagtgtttggcttaaatagcaggttaatttgtaaagacattactccaaatcaaataaattctcattccatttgttataaaatcattttgttaagtattattcaaaataattcaataaataattatgtgagaagacaaacataaaacaaaaatattatttaacaagaggttttagaaattgccatttaagaggtcttctttttctaaatggcttatcttttatagtgaaacagtacatgggaactcaaatgcaatagtcaaaagagtagaactattttgactatccagtcaagaagagtagtaccactcaaaattctcaattcctcaagctctgttgtattattattcctgtatagtccccaaaaatataccggagatgatgaaatattattccttctagaggaaaataaaggagtcagaagtgtttttgcaatagttaaatgttatatataaaccatgttctttggaataaagataaatagagaaagtgggttggactagaaaggttttaagagagataaataagaaggaaaggaaagcactagatttggaaaatcaaactataaattgacagacagaaattctggacttctctcaagtttctgtgtctacaaataattatattattaattgccagataacccagagcaaacaggaggaaaagtcacagaaataatttggactcaaaagcaaggatttaggaaaatgaaacttattaggctgaaaaatccagatagaaagtttggaagtgttttgttaaaagccagccctcttgtgcattccctgatcaatgagcaagtttaggggatttgaataagaaacaaaatatacggaaaaacaatctcctttgtgaattgtaaatactgtctcaaggtcaaatagcatattcttaataccaaaaatggtgatatttctagaaagaacaaagcagtcaaactaataaaggctgctttgaaagcccatgtgcttaaaataggaaatgggcctcattctcatgtttattgctcttggaaatttagaaaattggcagatttagcaaaatgtagatatcatatacggagaaggcgatggcacccgactccagtactcttgcctggaaaatcccatggacggaggagcctggtaggctgcagtccatggggtcgctaagagtcagacacgactgagcaacttcagtttcacttttcactttcattcgttggagaaggaaatggcaacccattccagtgttcttgcctggagaatcccagggatgggggagcctggtgggctgccatctatggggtcgcacagagtcggacatgactgaagtgacttagcagcagcagcagcagcagcagcaatcttttttccatcagatgttgatgatgataatttcccaacatcttgatttctcaattctgatatttttcatcataaatcaacctatgcatgattctttgactgtgggttgaaatcaattgaatgctttagaatcaaaaagtcaactg

SEQ ID NO: 47335 - DNA, 2954 bp, Bovine  19866880444479
ctggactgtaagggaagtctctcctatttttttaaggttgttctttacttttaaaaaatattactatttatctatttattttggctgcactgagtcttcattgctgcgcttgggctgtctctagttgcggtgaacgggcttcattgctacgcttgggcttctcgttgcaatggctgctcttgttttggagcgtgggttctaggggcgcagacttcaggagtggtagcatgcaggctcagtagctgtggtgcatggctttgttgccccgtggcatgtgaaatcttcccggactagggattgaacccttgttccctgctttggaaggggaattcgtaaccactggcctaccaggtaagtcccggaagtccctcttgatggggttttaacaaaggagatggaatcccaggatctgatgactgtaaaacacctactaaccttggggtcctctgattccgggactcagcaatggaatactgggaaagaatatcatataatgtgtttaacagtgatagaatcagaactcaaagaaggggagtgggaatctagcaaattttcactggagtgcacatcccaacctggagggagggtgctggtggagagcaacaggagtcctattttcggaatctatggatcatactttttaaaggcctaacacaaagctggcatggaggcaggatccaggagtgaaggaagacttaagccatctgggcatcagccggagtctcaggcagctaaaaacagataacgtcttgtcttgccttgctgacaatttcatctccaaagggagagaaagcaaagagaaaaactggtaattgggacaagaaggagtctatttggggtaggagaagacaagaaccttgaggactgtggccccagccttggggtccatctaggagggaagagaggctgagaagggagtggcatgttagtcatatgtgagcaggtcctggtgcaaaggtgtcagagagaagaggggtgattcttctccctaaactataaaaggtgatctggttgcaagggcaggagacactcgacggccattctgcttatgtagtcataagtgacctagaaagaaagaggagaaggctcgcaaagaagccagtacagccgcatggaaaaggaaagcaggagtgtcttagtcagagttctccaaataggatagacacgtgtgcacgcaaacctgctcacactcctatatacacacatccatgtaattcttttaaggaattgactcctgtgattgcgggattggaaagtccaaaatccatagaacaagccagattggaagttcagatgagagttgattttgcaggccggagtccaaattcttcagggcagcaggttggaaattcaggcaaagttcctacatggcagcctggggggagaattccttctactttagggaacctcagtctgtgcccttaaagccttcaacctattggatgaggcccatgtacaatattgggggggtggaatctcctttcctcaagtgtattgatttaaatgttactttcatctaaaaaccaggcaacatcaagattggtgtttgacccaaaaatggggcaccgtaccttagccctattgacaggtaagtaaccctcaccagaaacatgtagccaaggaccaattcaagaacactgcctggccacaggatgaaccccaggaaggctatggtgggatgtggctgaaaggacacggtggggacactgagaattagtgtgcagtggatagagggggcactgataacaagatgcagatcgctttcttcttggttgaggaggaatctctgtaacctggatagggaacgcgagagatcggataccacataagatggtgaaagttactgacctattcccgatgcgctgtcagagttgaaaaccatcagcttcagcttgtatgtaagaatgactgaaggatctgggaaacagagcgttttttgtttaaattacattttactaatattacacagtcctgaatttctcctgagggagtcatcatggatatgtccaaagattttgttgcaaagccttgtgcataacagtaagacaggcagagaacctaaacatctttaataaaaggatattacgtgaaataattatgggatattgtcacagtgcaatactatactgtgcaaccattaaacatgacaggaagatttcttaatggatgttgtctacagcatttggtcaaataaacaaagcaggttataaaaaatgagaaagatctgaggctgaagataagaagagagacctgcacaccttgaagtctaccagccccttggctaagacccattttgactcaggctgctgcaactttctggggatgtgcttggtgaactcctatcgagaattcagagagatcacagagagcccagaggggatgagagggatgcagggtagcattcagcttttcatgcagggaacataactggatataaatcgttagccaatttctaaaataaattacaagccaaattgctcagaaactaaattctgagcatttagaaatacaagttgcagagggaggaggtagcctggggtaacaggtttgagatggatcacccacttgtgcatagggactcctcaccccgtcctcccagccctgggcacggggctgcctttctttattctccttggtatcccttctgagagccaagcacagtcagagggcatggacccagtcagcctgagatcccgcagctggacatttaggacccaggacatcagtagggcttatgttcctttttcttactctccaccagggctggcaaactatggccatgggctgaatccaggcccctggctatttctgtatgttctgtgagctaagaatggatttaaaatggttgcgaaaaaaatattttgcgacatgtgaaaatgatatgaaattcaaattttggtgcccataaataaagttttgtggaacacagccatgccctttgtttatatatcgtc

SEQ ID NO: 47336 - DNA, 793 bp, Bovine  19866880553776
ttaaatgcaagtgatagtcttaataataagtaaactccagccaaccattagttagttgattgtgaagtgtgctttgttggaagatttgtgtgctgtatatgtgtctttgcagctctcactcactattactttttaagtatttatctcatttatgtacattggcaaattagtatgtttagaaaactttttgtattattttctaggtatcctcaattcctattatatcaactagaacaaaaggcctacttggtacgcctttgttgctggatggcattgaatcaggtaaggagagtaaaatgttctttattaaacaaaacctatcaattagtatattgaaatacagttttgacaaaagaattgtgaaagtgttgtagtatttgactggttttatttctagttgtgctactaaccaacagtgagactttaaatcatttatttttatttatggctgagtttctttgtttgtatgaaagtgtttttgtgattgacagtgtttaagattctaaataagctccttttttttggccctgatctctacttgagtcttttctttatctctggtctaactgatcttttttgatttagaactggaatgtaaacttgatgaaggcaaggataatgtctgtcctggtcactctagtatccttagtggctagaacagactgatatgtgatagatgatatccaataaatattttattgaaaagtgaatgaataagctgaagtgaaaagcaatcagaaatggttgaagaaggaaatagaaaggcaatttgattttatatatgattatctca

SEQ ID NO: 47337 - DNA, 1016 bp, Bovine  19866880607552
atcaagattgcattatcccacataatcagcattagttaataattatttatggttagtcctaaccaatcagttatttatattgttactttcaccatatccctaacagcaggatattagaagcagtgtagaaacttacagataacatatacacaagtgacaagatttactttactagaacttttatggttcccatttatgtttcttcagatgactctctaagaccaaatatgattttaaatgccaagatcacggatccagaagtggtttttgttgccaacctgacaaaggctgatgctcctgctctaacagcttcattccagtgtgacttctttctatcaacatccaaacttgaacagataatgacagcttctctgggagatcttaaagtgcttgcttgcccttttctcagagaaaagagaggaaaaaatattaccacagtaagaatgactttatatcctaagcttgaattgaaggatggcagaaatggttgattcatagaatcctaaaatatgagggctctatatttactccagcttgagatgatacagataaagatgttgaattccaaagatgttaaatgatttacccatgtttgtagtgacagaactatagactatttccagacttattttcattataccatcttttgctgaacagtatttgaattttagtacatacaaatcaatattccgtttcaactgttgctttttttcaccactatatatccaatgaatgactgagtggatgaatgaaccaaacattcagtggagtcacatgcccaaaagagattgtttttctttattacaaattaacttcaatggtgctttcacattactgtcaaaaaatgtgattttggttaaatgaattaactatcacaccatttggtttttaatattaaattgattattttatgttaaagagcatcattatataatgtgacttatttgcagtgttattttaagtttacaaaaaaatggatggataaagtgacttgtgtaaagaaatacagtgctgag

SEQ ID NO: 47338 - DNA, 1543 bp, Bovine  19866880661375
tacccatatgggatgggccacaactgttctgaaggcccccagctacatcacctaagtagcattaagtcaacccaagattttttttaagcacacagttcagtgaatttaggcaagtctatttgttcatagaacaacatgagaacgttcccatcagctcggcatgttccctcgtgctgtttttcggtcaatctccccctctccactggccctaccattctgatatctatccccatggatgcattatgcccgttctagaacagtgacgtcaatagaatcatgccgcctgtgctcttggtgtctctgcttctctcaatcaacatgatgtctgcagattcaccgtgccttggtatctgtcagccattggctctggaccacttggtaaatgttgggagctcactagacaatcccacctgcccacagaggcacttgggttcctgagcaaacaaagccttgacatcccaggagctccgagcaccaaagcagcaattcttctagttgtggagttcatggggatgtgaaggaccttggctttctgtgagtcattaactccctgcctcttctccatccttccccacggcagctccccagttctgatgcagagcaggggtttcccaagcagcctcttgcggtccccaagtagttcaggatcttgatgcatgtgccatgagcaaggaggggaagaatgtggaggtgctgatggtgaaaggttttattagctgtgatgagaagccagtggtgggggccagggagggcactgctttcctgggcctgcagagtctgtgctaatttatccttcctctcaattgcctccaaacttcggtaataagcacgctggtagttcgctgatgaaatatattcttccaaagcaattttaataatcgtagtgtgtgctaaacccttaacaaaaaaaaaaaaaaaaaagtagaagaaagaaagagaaaaccctgcagccaagtcaccctagactgagcggcaacgacagaatttcataattaggaaatgcagtgtcatttcccaacgttattgcacctttgaaaaatggtatcaaactgaggcctgcatatttgatacccaattgatttcagattgcaagtcaactgcagcaaaataatgagctgcctctgccctggcggctgagctccagctcagagggcctgggagggaaggtaggaagggggaccaagccccagggctccaagacctctgaaacaaagctggggccactgggctggcaggcaggcaggaccgcacactgtcgtctgtgctaatttttttgcccaaggggctgattttgaactcttcaattgtgcttcaattttgctcaccagggctgatgttgggaatcagaggatcaaagccctagatgagaatggcctgcagttccccaccctcttatctaggctggccccagcccagggagcctgggggactgtgtgcacagcaccatctcacagacccccaacccttctccatcaccaccaggcccatcacccagtactgggtgctccaacatccattagggtttcattcataaaatagagct

SEQ ID NO: 47339 - DNA, 3334 bp, Bovine  19866880817418
tccgtgtataccttcttatatgaacttcagaacagaatcgattgcatatttccacctgtaaaccaaattttgttaatgcacattggaatatgaaggtttaaaaagcaggaaaacagcactgacattttacagctacactgttacttattttgttcttattaactgtattcttacaaaggttcagccataatatttcagttccccaatacttcaattctctgacttaaatacattatgaaataagcaaaccattcgaggaagagggtgtgtcaaagcaaaataatagagacacaaaatgacatgctgtgtgaaattaataatatcccaatatatttgtgacactgagttcacatgcatgactgaagggcaatatgatcaaaaaaatgttgaaagtcttgaatgctgagttaagaatttaatctaggagcaagagtacaggagaatgtgtttataaaaaaagtaacaaggacataatataaaagccctctaatgtctattaaaaaaaaaagtggctttgttacatgtctttcaaggtctgttagctctgagagttcctaatcatatgattacataaaatatttttttaaaaattctaacttaccattgtcgaccattggtatgaagtggtaaataaggcttatattttctgtaaggagcatttctaaccatgtaatccactgactccaaaaggtcgatcatacttaagtactataaaaacaaaaaccaagttacatctgttacatcacaacatggataaataccaaattttattatattttctgcctagtgagatttcaaattatctgaacaatgaataccatagctgcttggtaattcaataatatatttcatcaaagttaagaaaccaccaattgtaagataatattaagcactgctgattaaacatcataccactaataataatatacatgccattttcagatatattaaagtgtgatataaatgtaaatcttagaaccaatgaaatacggtatctgttactactgacatgaaactcgcttagtgctaaaaccaaacatactttcctctggaccatcatttcaagtagtggcaacctataagctaagtttccaaattgctccagggaattattgcataactaaagcaagataaaattatttaaccaccaatacaaacaactcacatggaggaaaacacacacacacacaatgagaagataaagaaaggagaggtctaacctaagagtaaccagtacttatcatgtggatagcatgaacttaaaatgtatttgtaagtgtaaaacatactccaaattttgaagacttaaaaaataaaaggatataaaatattgtaacaatttctaattttgattacatgttgaaatgtaatcaccacttccctggtggctcagatggtaaagcctacaatgcagaagacacgggtttgattcatgggtcgggaagatcctatggagaaggaaatggcacccaactccagttctcttgcctggaaaatcccatggacagaggagcctggtagactacagtccgtggggatgcaaagagctggacacaactgagtgacttcacttttcacatgttgaaatgataatatttgggtaggttaagttaaataaaatgttattaattttagtaattaatttcctcttttcttactttgctaatgtagttactagaaaatttaaaattccacatataacttgcattatatgtgtactggactgcactgagccaaaagttcaattaactataaagccctcatcctcctttcacttccagttctccaaattagttattgaaactccttaggtacataaccaaacttgagaaacaagtaaaggaaaaaaaactgccaacacagctgttctaaaaattaagtaaacaatatttaatgtaagagtgtctgctattaaaatctgaggaaggaaaataaaaccattaaaatttttcatcaagaactgggaattaaatggaaccatgccatgtactataatttggtaggattctctaccaataagatgaaaatcataaaaaatgaaagaaaactatttcttatatttggtatttattttaaaataatacatataatctattttgaggaatcaaaactcaacaataacaaaccaaaagaaccaccagagcagtgaagaaggaacagtcacagaggacaaaagctgttgagattcaaggctactcaaagctggaagtccttaaatgaatcttacctgaggtttggtcagttcaattgcaatattttgtacttctatgttccaatcaagtttaggtgttttgagctctgtttctgcataaggattcatgtaaagttttgcagaggctgatattggctgaaaaacttacacaagatgggaagacataagatatgtttatatgcccttacctatgaaaaactgtaaataattatgagaacactgttaccttgaaagtaaagaaaaatcatcaaaaatatatttttaaaaatattaaaaaaaaatcatcaccaaaaactacttaagcacctatttatctacataatcggagaaggcagtggcaccccactccagtactcttacctggaaaatcccatggatggaggagcctggtaggctgcagtccatggggtcgctaagagtcggacgtgactgagcgacttccctttcacttttcactttcatgcattgaagaaggaaatggcaacccaccccagtgttcttgcctagagaatcccagggacaggggagcctggtaggctgctgtctatggagtcacacagagtcggacacgactgaagtgacttagcatagcatagcatatctacataataagaattcccaactcaatggtaaaagtagaatctccaaggaggaagattgtgttctatgcctctaagtaagaaatgcacaaaatatacacaatctaatcttgattatttacagtctatgtaaaactatgtttctcttccttgctgcaagatatttaatgattttattattcattaaaagtactaatacaggggtatggataaattgggacattgggactgacatatacacattactataatatataaaacagataactaataaggacctactgtatagcacagggagctctgctcaatactctgtaatggcttatatgggaaaagaatctaaaaaaagtggatatatatatatatatagatagatagatagatagataactgatttactttggtgcacacatgaaactaacaaaacactgtaaatcaactatactccaataaaattttttttttaaatagtcattattgcctgagatgcccccacaaaaaataacaatacaagacaggaaat

SEQ ID NO: 47340 - DNA, 981 bp, Bovine  19866880822782
tcatgtggatgggtcaaacaattctttcatgatcagatatttataaattttgacataataatcagagttgccatgtgtattctgaatataactttggctgcatttcaagattattttctgaccgaattcctacccaaaataattactgagtgaaagactacaaaaacgtttaagactcttgagatatatccctctccactcgtacatatgataaaaacaaagtccatttcttagatgcacttctctctagtactaggatttctcatattttgaaaatctttgataatttgctttaatttgcatatattctttgataaataataaagctaaacatttctaatatctattagccactgtatcttcccttttatgaattagttaacattgttctctagtacctacagcattcgaatttttaggttaaaaattaaattattaatcttttgctatacttgtcatatcatcccagttctttgttttttaattattttcattgattttgttttaagagtctaatttttatgtagtcaaattaatttttatttttccatcaggatttttgccattgcttttaaacataggaaggtttccttttatttagagatttgatagcaattaacttgtttttccttagtctttctcttttcatttgaatttaatatttaagcctttgagtcctataaaatttgatagtgtacaaggtaaaaatagtattaatgaattttttctctaataccactgttgaacattcaattctataaatattcattgaatttatatgtatctggcacacacaaatattcttatattaaaggtagcaaggagctattatctatactttgccacaaattatactgaaatctaatcctactgctatatatttctaaatataatttcacttaaaacatggtccatttataacatactactaaaataattcaatgtttatactatattcaggtattatctagatgctgataa

SEQ ID NO: 47341 - DNA, 874 bp, Bovine  19866881066696
atttctttaaaagttttagtagatcactctacttaaatttaaagaaaagactctacaggattaaaaaaagttttagcagaaatggaatccctaattttcacatttatcaactcatttttgaaagagtaattcatatcaccctattggaaagtgagagacacgcaactttagtggcctaataatatttttattcctttcacaaataatgagatacataatatttttgttcttgattatttttggagaaaaactgttctgctgcttgagccctttgtctttctaagagatgaataaatgagggaagagtgctttcatgcatccagcttttctagtttgcaaactttgtgtcttggcaagggtgcctagcctagcagtctaggcgagggtgataaagaccatgcttctgtttcatagcctgctttttgcagcatgcttgaggctgtgtggaaactgtcattgcagacccttgatgaacactgccagatttgaattacatggactaacttgggagtcagttgtatcgaatgatctttggagataattccttcaaggaggttttattttataaaataaagaggttgtcttttaaattttgtggggctacaataatgtgttttgccaaacttcctttcagtggtcattgatttgtttttctagtattgcgttataattataaaatgctcttatgattacttattaccatgaaccttggctgtggaggttaggagaccctgtcttggttgctgattagctaattagattgcagttaacactgatctgttttctatacaggttggaaactgaaaggtgaaagaaaagctattacaagacacttagaaaatttttcatctttttaagtgttttagcaggaata

SEQ ID NO: 47342 - DNA, 744 bp, Bovine  19866881297991
ttcctcaggtctgctgatgccggaccactgcttatctctgttgatgagctttacttagcacttcctgtgttctcccatgctgggctggtgctgggggaacctgcagtgagcaaggccatttccccatggagtttctggtctagaagaaacccaaaacaacataaatattcatcagagtgggggcagctccatcatcgttatatttgcttctgtcccgtggccccgctgcttcttgggaaagtctgggtctgtgcgtggatgagccccttttgcttacttgaatggtctcgtgtagcccctctccactgggtccctcctgggaaccacagaacacagataataatctgagggacacttttctcagctctgcccgggatggcccctaacgaggactgtccgggtgcacaggagagcagtgaattccccacatgcagctgatgccttagggcactaggctttttctttttttcttcttctttgctcctttgtgacacattcttccgttttctaaactctgaacgttggtttcccttgtttcctgcctcttctgaaccttttcttttttaatctccctgcttggattatttcttctatcctttattcccctgagcacagagggagaaagcagaaacacagggctgaggtggggtactttcattagtgatgggtgatgattctgcttgatttgaaagtctgcacatggagggggtgggatctaagacaaacacacgttgccatctgtaa

SEQ ID NO: 47343 - DNA, 775 bp, Bovine  19866881596445
gggactgggacagggtagagagaggaaccagacataaacatgtttatatgagggaaagcgtcacacagagggacttggaagaaaaaaatttcccctaaaaatcccttcatcgttaaatagttgtgtagaggttatattctgtctctgagttaagcataataaatttttaaacaattgaatgctacttttaaaatctgaaatatatgctttgaaacaaacttccttaatgttaaacctctgctgtttttctggtgatattaagagttattgaagatttttaagctttgataattgaaacgttgatagatgaatcattctatttgcacatgggcttcattaacatatgtacatagaaaaacccataagtcctttttaatatcatttgtgatacatgtaattacagttgtctttgtgaggacagtgattagggtgggaggaagcagtttgctgataataggcatcatctggagagagttttggtttttgccatccagagagaggggtctactggcagccaatgggtagaggccggtgatgccactgaacagcctgtagtgcttgggactgctcctccctggaaaggatgacccagccccagatgtcattggtgccaaggttgagaaaccttgccttaagtgtagtttaaaaattgattgtatatctcagactttgagatttagtctgacaccatccgtcagactaggacttttgggaattaggtagaaccactttttttttttttccctagctgtctgaaatccactagaatatatgg

SEQ ID NO: 47344 - DNA, 1578 bp, Bovine  19866880141820
tggcatgttgagtgcagaactctccccagcatcatcttttaggatttgaaatagctccactggaattccatcacctccactagctttgttcgtagtgatgctttgtaaggcccacttgacttcacattccaggatgtctggctctagatgagtgatcacaccatcgtgattatctgggtcgtgaagctcttttttgtacagtttttctgtgtattcttgccacctcttcttaatatcttctgcttctgttaggtccataccatttctgtcctttatcgagcccatctttgcatgaaatattcccttggtatctctaattttcttgaagatatctctggtcttttccattctgttgtttttctctatttctttgcattgatcgctgagtaaggctttcttatctctccttgctattctttggaactcttcatttagatacttagggcccacttaatgaccttactttaacttaattatcctagtaaagaccatgtctctaaacaaggtcactttcagagacattaaggattaggacttaaagatataagtttcaggcttcccaggtggcactagtggtaacaaacctgcccaccaattcaggagacataagaaatgcaggtttgatctctgggtcaggaagatgccctggaggagggcttggcagcctactctagtattcttgcctggagaatcccatggacagaggagcctgatgggctacagtccttagggtcacaaacagttagatacaactgaagtgacttgacaagcatatgatttcaggggacacgcaattcaaccaataacacctctctacccaggagtattgaaagtttgatgtgtttttcatacatttcaatccactctttaatgaacctgtaatattttagcagcaacaatacatcttgtgtatgaaaaaattctctgaaaaccaagttatacctgtttgtttaattcattttcatgtgtgaaattaaaatatgtatttggggacaacagccaattaatgttatcaactttatatgtctctaaaggacaatgaaaattattttgaagatcataaatttatacatatatgtatcattattttattcgtcataatatcaatgctatattaccagcaaaataaattttaaaatagataaatttgctgtttatttctagattcatagtttacagtcagggaaaatgagattgctggatgggtttaagcagatggtaaaagaaggaggaattctttctctttggcgaggaaatggtgtaaatgttttaaaaattgcacctgagacagcactcaaggttgggacctatgaacaggtaaaatattactgtctgtggaattttagaagacatattttaaattttaaaaattttagacttttatgagagaaaacataaaacattgctggagtgtgctcaagcaatagatatgaatttaaatataagtgactttatttattcttatttatttttgatattttcatattgcttttgtttcaagaggtaatccagggaccatattataactgtaatataatctattctattgtctattagtagttcttgatttcagttttc

SEQ ID NO: 47345 - DNA, 1609 bp, Bovine  19866880548033
acaaaaaaaaaagatgtcatctagtattggctttaagaaatctatcctcttggtatcgagcagtcaaatcaacttttgttatggtttatttagaatttaaaattccagtaaactagatctaatatagaagatgtcagtgaaaaaaaaaaaaatgaaagtgaaatcagtaataaaagttagattttttttggtgatgtgttgttaatactcaaagagaagcatttttttaaaaggggaagataatgttttttggtaaatgtttaatggtaaatgataatgttttttggtaatgtttaatggtaaacattttaccagataatgtttaatttatttcttctagttatagtcaggtaagactgcctccatgttttattttgtttaaagttgaatcacttttggttggataacttgttttaatgacattactatggaaagatttttaagaattgagaccaatcatttttaattgaaatgagaggtcatgatatttagaagcatgtttatttgtttaaactggattatttaatgaatattcagttgagttcagttcagtcgtgtccaccaggcttatgcatcttttaatacctttccctagtgtatgtcagtgtcatactgaatgtccaagagtagtagattattaaatctgattaatgaattagattttaaatagtggtcagttattgttttccttaaagagagtaatgctgtttttgcttattatgaatacttaatctttttttttttgcccttaaatgctgacccaaggctgcattacaggtaaaaaaaggataagacctaatcaaactaaaaagcaaggaaaagtatgtctaatgtaattatttagactttttggaattgaaatcaatcagttgaagaaacagtggtgcagtgcacattcatgtacatgccttttggatatgtgcacgaatttctgatagatttagacctaggaataaaattgctggatcatagcgtatgtgcatgtgtgtgtatatgttccatgttagtagataatgctgttatttttcaaaatgttataccgttcctggtaagcagaactgtgtgagagttcccattgctccttgccacctcatcatattgcgagagttttcaattttttgcctattttggtgggtagatatggacatcttgtggttttaatttatgctttagtcactaatgaccttctctgatgtttattggtcatttggatatcttccttgttaaatgtctgttagtctttctcccatttttccaccaggttgtctaactaactgttgatcgtatcctcaaatattctagacattagtcccactttggggtatacacattttaaattttcacatagttttaaaaatatcttttctgttaggtgccttttgtgtccttcccaacccaagatcacaacagtgtatctcctgtaaaatcttgtgtttgtgcatgcatgctaggtcacttcagttgtgtctgactctttgagactctatggactgtaacctgccaggcttctgtccatgggaatctccaggcaagaatactgcagtgggttttcatgctctcttcacaatccagggtttgagtctgcgtcttggcaggaggattcttcttc

SEQ ID NO: 47346 - DNA, 721 bp, Bovine  19866880742365
cagtagtttttttttttttttaattatttggaggcttttcttgattggtgctatacttttaagtatttgcatcgaatagaaacaatttaaaattaaacttcaaagatgacaacagagccataaatatattgatactctggttagtagcattatgttctctaccttgtttcctgcttaaaaaattatagttcaagtattaatttatagtgtgtttgtcatcttagtatggtagctgatgatgaagatgcattgagtgattcagaaaccactgaagccctgaccccagatatcttagctcggaagtaagtattggtaactataaagcatattccacaactgtaaagctgtgtttaattttgcagagttaaagacattttactttacttgtacaagtgtaaataaaaagcatgtgctaaatgaattaagtttcatctagatttttcatagcaacctgtatagtcttatttctaggttaaaatcaaagtatgtagatgagtaccagaagctggtatacagattccctatgttgattgcctgcatagagatttttttttttttttttaatatcctgctacctgggtattaaagatacaagtgagataggtaaaaataagttgaattcctaaaaaagttctgttcctttgctgttcatagatttgtctccacttttcttgtttattgttttctatacctattaccattctctggcttttttttcccc

SEQ ID NO: 47347 - DNA, 1724 bp, Bovine  19866881114336
ctggtaggtttgtaataggttgctctggtggtttggtttgtctttatgagggtcggtataggggaaaagcaaagcaagagaaggaacatggagtgaatgcagctccctttagagcctggttacatggactcgggacagttcacctgatctgtgatcgtcattttctcaacttcaatgttattagaggtcaggatatctttgagataggtcactgtttctggagggagataagggtttcttcccaagatccaaacatgatccatgtgaaaaagccagatgattgtggtacaggagtacacgagggcgtagttctcatagtcggtggccaggacccagtacggagctgacggcatgactgagaaccagaggaaggcagtattaggagggaccagggcaagagaaaccttcatctccagggtcctggaagccaggctctgggattctagttcttctacatcagtgggtcttcattctggcttcatgtgggaatcatatgggacctctgaaaaacaccaggcgcatctctccccaccccaactcccaaaggccgaactggagcttgttggtactttggaaagcttcccagtaattccaatgtgcagccagagttcagagccaccattctggatccccattccctgactgcaggctggtacctggaagcccgtaatatctggaagttgggccggatcccctggactgacaggtgcactgagcacaagtgcctatggagccgttactcagtaagtgcagttaggaatgcacagtcaggggccccaggctttccaggtttgtaccatccagcttcctctataatccacctacaggaggaggtagaggctaatgttggcttgcttgtttttcttcttgtgtgaactttgaaaaccccactattcttaagaatatggtaaatcaggtgatggctgttgtttagtcactcggtcatgtctgactctttgtgaccctatggactgtagcccatcaggctcctctgtccatgtgatttctcaagcaagaatactggagtgagttgccatttcctgctccaaaggatcttccaaagccaagggtcgaacccgcatctccttcatctcctgcattagcaggtgagtttttcaccactgagccgctggggaagcccaaataaggtggtaacaggttacaaattcttcctaaagagcctatagagattcactgattgacatctgagtagtgttgaaagttcagtattaaaagggtctttaagaagacagatggagggtttacttttccatttgaatccagaaatttcctttgtgaacttgacctccacagccaagccaagtgtgtggctcaatggcactggctccattgtgtcagctccatcttaggcctgcactcctagccctcccctttttcgccctactgggctttagcttactcacaaggaaagcacccaagccaaataagttccctacagtctttatctcacacgaaaactgaaagaatgtcttttgctgacacaggtggttaatggtcatgagacccctggggtgagggtaggaggaggcaaatccctcagtttccgtcagtgtggacatgcttcctctagtagtcagattctatttttagctgtggccccattaagcatccctgtcccccttttggcagaacgcagtgcagctgggaatgcctctgatggtcgtctacatgattctgtctggatgtaagttacccataataaa

SEQ ID NO: 47348 - DNA, 1213 bp, Bovine  19866880158032
atgttggaaatttggtctctggttcttctgccttttctaaaaccgcttgaatatcaggaagttcactgttcacatattgctgaagcctggcttggagaattttgagcattactttactagcgtgtgagatgagtgcaattgtgcgatactttgagctttctttggcattgcctttctttgggattgaaatgaaaactgacgttttccagtcctgtggccactgctgagttttccaaatttgctggcatattgagtgcagcactttcacagcatcatctttcaggatttgaaatagctcaactggaattccattacctccactagctttgttcgtagtgatggtttctaaggcccatttgacttcacattccaggatatctggctctagttgagtgatcacaccatcgtgattatctgggtcatgaagatcttttttgtacagttcttctgtttattcttgccatctcttcttaatattttctgcttctgttaagtccataccttttctgtcctttatcgagaccatctttgcatgaaatgttcccttggtatctactagaaggatttaagggataaaaagcactttcttttaaaagcaataagggaattttaattggagtaagtgtatgaataatacatcaaatatattctatcatttttattatacagaaactgctgaggtcttagagatgatgactgttaattaagtttattaagtcaaagccttaacagataaagaaaatgttaggatgaattaaaaataatatgaaatgagcttttttatcagtaaaaggagatttttgtagtaaaatgtctataagtaactggtactttagttgttcagcaggtacagtatacatagatcattggattaaaaaataattctatacttaatttaatgaggtgttcagaagttacaagtagttactttcagtctcattattcttcatacagtttagcaccgtcataccttttaggatgtttctgtcattgaaaatgacaaacatgttaaatataaaactacacatgatgacatggtttagaaaattatggatgtatttcagataggttccatatttttctgtatttattttttaataattcaacaaagtccagtttaataacatctcaattgctatgcttttgcttttttatactgcttagggggttctcacagcaagaatacggagtaattttccatttcctccttcat

SEQ ID NO: 47349 - DNA, 1358 bp, Bovine  19866881006478
tattagttatatattcttctctgtctctattttgaagcagttatttggaactcttcttttatagaaaattacaaaaattactgaattctaaaaattaatacatacacaatccttctatgtattttcattgattaagagtagatatcttcatgagtacacattatggctagtgctacagttatattagttttataataaaattattttactaaatgtcagctttgtctccacagaaaatgccacttaaaatactaaataagtaattatagtaattaaaaaaacaacagcaaatgcatatataatgcttaccattacaagcactatatactttaagtcactcttctttacaaaaattttgtgaagattattataatattaatctaaattgacaaataactaatcctaaaaaggaaagtaataacttatctaagggaacacagttataagtggcaaaatcatgatataagctcattcatctagtttcaaggtctggtctcttaaacttgtaaccataaatgtaatctaaatcttcaccttgcccttgccctcactgctgacaattaagccacctacctttgtgcccagctttgagtctccaatgtccagagcactgcagagtcacaacatgaccttaatatgcctagtgctgagttgctgcagagcaaaacaacaaaaaacactaatgaactaatgttacttgaagaaaagtggaaatcaataaagtaaaaatggaccattgattttaaggttcattgtttgatggaggtggcttcatctactttgttattaattttattggttcttaatcaggtttagagtgctttgggtatacaagatgtatatagtatgtctataccacgcttagaaacgttgttattttgcatccacagttaacctttaaaatatgttgcccctttcttagcttattaacattcaatcttgtattaatttccacctagttaggttaccaggtgtagcccaaattaaccaagcaaagggaaaaaacagaatgctcaattaaattttcattccagaaaaggaaaacacatacacacacacatactccatgcagtcttcaaaacatacttatactaaaaaatgacttgttaatatgaattccaaatttaactagatgtatattttacctgtcatatatttatctaacataaattggggatatgggatataatcaaggaaaagttgctctgaatctaaatgtggaattgtctctggtttaatgtggaaattctcatttacttatccagcacccttggatcatggtacctgtttgaacctttgtcttggtaaaaatggaatcatgagatgctcccccaatcatggaaattgaagggaataaa

SEQ ID NO: 47350 - DNA, 1589 bp, Bovine  19866880821671
gctactatttagtgctagaatgtcactaatgttatagaccacttctatactcagtcactgtcttatacctctttccttttcacacaaaaaacagctgcaaaaccacgtttttctaaaaccagtcaggagtaaacttttttctcatttgtcttctagacacgaagatcgattgagaagttattagaatgggaaaacaataggttataccacaaggtgagtaccatggggagcagcttcatactgttgaggtctgaactgcacagtatggaaacagatgcttttgttgaactaaaaatatgaaagatggacaaatgggttagtctgtgtgctgcaataaaatagagctcatttttcttcttttactctcctacttgtctagctgtgcttgcactggagactgagcaaaaggaaatgtgaaacgaataacatgatggaatatgtaagttaaagggctgttttgtgagtttctctattaaatgatcatttattttgcttctgatcttattctttccatgattattaatcagcaaaggtgtcagaagcttaatctcctgagtgcaaggattttctacggttcacagatgcatggtttcatgtgcaagactgatttataaagttatgaatgacttgaaaacaaggcttcactgtgttctgaaaaataataaattaattgccaagataaaataggctgaacatgtgttgatggagtgtgaaattttagatgctgtataaagaataaccacaactttggttacgcagcaagtcagatatggcttttttatataatgctaatcaggtttccaagtatggaagaaaacctttcagccaagccgctggagcttaagaaacctttagcctttatagattttaactgccgatacctcagtggcctttaaagaatctttcaaagtgttgttgggatattattctgtaaaaattatcttaaaagtaaacaggagataagatgttgctcaccctgtgtttattctttaaaagatatctaatgggtatgtgtatacagtcagttttagagcttagaataggatttaatttaccaactacttgatttacttgaaaattttttctcagtttgaaaagttcagaataatatagaaaaagtgtcaatttttattctcccttgagcctgggtgttttatgttaaatatgaagattaatatatgaaaagaagaactgagcacggggttgagtatctagcacatcatttctgacaaattttgtctattctttgacacagcatagccatcataggtagcgtgtgtgtgtgtgtgtgtgtgtgtgtgtataaaagattaatgaaaacagtgcctggatactggaaatagttggaaattatcataaaatcatttttctctgtagcattttctctttctttcattatcacacaatcaaatcccatttctagccttgaacataaaagatgtctttaaaatgtctcttttttcatagaatagctctattcagtgaactaaataatgtagattttatcattatctattatatcaaacatgttaatttatgatggtaaaaaggcacttgatacttttgtataatgataaaagcacattcaa

SEQ ID NO: 47351 - DNA, 1711 bp, Bovine  19866880831652
tgcggggcctctgggctgggggaggctgcactgagaggcctttcagttcttttctgtgagaaatgtgtgtctgggatgccgagctcaggattgtggcatttaagagcccagggagccttgaatggtggggagggaagcttcctttttgtcccatgaatttcaatgcaaagaaaagaaattaaccacaacttaactgaaagagaaatgcaaagagactctgtgtcaccttgaaatgcctttccttccgggaaagcagatttcagctaacatttgagctccggaaatcctcagtgtatttaaacaactttggaaggtgaattacctggtatcattgcttaaaaacacacacgggcttcttgtcttaggctctgtgccctagggattaggacgcgtaagcagcttctatatttgcagcgggatccaggtgtcctttgaattgattctagaatgtcatctggcttccattccaatcaggataattctgggttagaagggtcagaaacagtcagactaagtgccaaatagagatgtccctctcttgatgattgaatcagaccccctaccctctgctagagggggagtaaggagcccttgtaaacctctatccacctgtctctgtcctggacccagctttctacttagaatttcatgtggaatctatgtgaacttattgatgaaattattgaaattgttagtgaaaaattagtgaaattattgatcactgaggagtctctctcaagagttttacactcacatcaagaatctgttggggacttcccttggtggctcagtggataagaatccacctgtcagtacagggacatggattcgatccctggttcaggaagattctacatgctgccaagcaactctaatcttgtgcaccacaacaactgagtccatgtgctctagggcccatgaagcacaactgttgaagcatgagagccctagagtctgtgctctacaacaagaaaagccgctacaatgagaggccagtacaccgcaactatagagtagcccccactgtccacaattagagaaagcccaagtgcagcaacgaagacccagtgcggtcataaataaataaataattaaaacaaaacagaaaactctgttgagggaggaggacccctcaaagctgtaggacagtttaaaaaaaaaaagaaaatacaagcagaattattgcagcatgtctttttatgtcagtttctgtaacagtgcatccaatcctgaacaggccattgtattcctgacttgtcaatgagacttataggtcatgcctgtgaaaaggttaagatcttggaaaatatttccaaatattttctttttttttgcagcagttgtgcagaaggtccctggtaatgctgacaggatgaagaagtgcttggagatagaccaagtatagcccattctcattatttgcagtaattatgctccagaaagtcactgtgaaccacaaattagcaaattctgaactgttgttcttggagaaatacagagttagcttctttggagtctctgctcacaacaaggctttcatccatcaagcaatatataactttgctttatgtatgtttccatgtaaagacaacttatttaatatatacatagatagagctgattcattcattttgaactcatggccaacagcaccataaagcatgcctgaaggaagcttgtctaacttttctccttaaggcagtctcagcct

SEQ ID NO: 47352 - DNA, 1500 bp, Bovine  19866881004655
ttagaattatgtatgtatatacacacacatacacacttttttccgtatatacggaactttttaaaggtttgcactggaacctgggtcaatctagtaaaatgaaaaaaatagcttatatgacaaaaagtcacttgatacagtataacaaactttacctaagtgctaaatatgtatatttacaggagtagtgattagaattatatgtttccccccaaaacttcaatatcaatgctaaactttaatagctatattggcttttaaaacttaaggacaacttaaataagatctttggagggaaaaaaagctaatataaaaactgtacttttgttttccaactataaagcaagtttccaactataaagaacacaataatatacaattttctttaataaagtttgttgctcacagttcctaaactcatatttgtaatgtctaatattttattcccaaaaacatgtgtgtgtgtattcactcacacagtcatttcaacagacatgactacctttggtcaatttcttttaaagtgatttgctctctaaattccagactcccttttccaacttcacctaaattgacttaaatttttatttaacacgttatatagtctttagggaccaaatgctgtgaattagcccatatttcagttttgagcatagaatcatgttttgaagtcatgtgctacaacagattcacttaagaataataaaaactcaactaggcaaagtaagcaagtaaaaaacaaacaaacaaaaaacgcctagctcaaattaggtctccatttgtttactagaaaaaaatcaatgtcaatgaagacttaattttacacgactaaatattctgcagccaagactggaacaaagaccaagccaccttaaatacagatttttttcacaattataaaaaccaacaaatttttatcaaaagaaaaatctcatcaacaaaaacagatgatactcatttgacaatggctttaatttctcaataaagaaaaatatctatctttaaaattcaactgcatatttaccaatttaccaataattttcattactagacttagctgggggtaattagaataaactgaaggtataactcatagggaccttgatcatgggtctgcataactgctcactcatcaaaaatttttaatgaattagtttatttgaaaactattccatgctcattaaggacataggaacaaattcctaaaatcctttatttggtactcttcaaactgtttgtcacacttaaattataaaagataaacagaagaatactgtattcaaggtagcctccaatcttctcataaaacattatatagcaagaggaaaactttagaacaatatttttcttaaaaaaaaaaaaaaaaatacttcccagtgccctgtaatacataaagcatatataaaaggaagtataaagctgtgtgcaattcctggccattgcgtaactttcccctttgtaaaccaaattgtagaataacaatgcagttatttctctcca

SEQ ID NO: 47353 - DNA, 934 bp, Bovine  19866881309391
attacatagcctatttctattaatatcttccctattttttggttgtatactccatatgatcatctcttcaaatgacaattctgtaatatcattttcaaggaaagaaggtaaagcaattcaaatgctttttgaaataccattatattggattgagatacataattgcttaatcaaattacctttaaactacctacaataacttataggtgaatatgcatagcagtttagtcatgggaacacataggttgctttgctgtgattttagggcttttgaatgtcattttttttctctctctgaaattgccaggcttcatcaggacaaggcatctcagatatgctaagattggccccatgggaattggttgggttcctcctcagtttttatgttgggaggcataaaaattcaatttggcatgcacaaaactcctactttgcagtttgtagtagtgttactgttttgtgccctactaacacaagaaagtgaaaggaatgctagtcgctcagttgtgtctgattcttgtgaccccacggactgtaacctgccaggctcctctgtccatggaattctccaggcaagaatactgatgcaattggagaaaggtgggaggggggttcaggatgggggacacatgtatatctgtggctgattcatgtgtggcaatgtatggcaaaaccaccacaatattgtaaagtaattagcctcctattaaaaatatatattaattttttaaaaaagaaaaaaaaagaatgtttgtgtctatgttcatcagggatataattttattttttatctggtcttttatctgtgtctttatctggtttaggcatcatgatatgtccaggtgtgagtttataggggttcatttgtttgaatctttctgtaatccctgtaccggatttctgtttcctgcttcagactcaggaaattttcagc

SEQ ID NO: 47354 - DNA, 1014 bp, Bovine  19866881489865
atagcttacatatacgcatataatggaagaaatctttactaaggatgtcttccaagtgctttacctagctgtagtaattaattctcacaaaactctgtgagatagataacattaccactattttgctgatgaggaaactaaggttgagaaggttaattaacttgccacagctattaagcagctgagcaaagacctgactgagttcaagtctcacaccaactcatgagtccttgtgcaacaccacaaagcaccacggaacttaacccacagatacaggctcagttgacctgcagaataaaccattttctctgccagtccctgtcacaaccccacccagctggctcaccaagaacctggaagggcggcttcactacagaggtcacaaaaacatgggaaatcttgactggcagtagccaccttctccttcagtcctccaggctaagtgatcaagctctggggggattaggtaatctttggcgaaagtgagatcctggttgccaggattcattggagcctctcaatttctggtgtttattgtacacttaccctgttggagttcctgttttctagccagcaataagactgaatttggggctaattcatccatttaccatttaccaagtgatacagattcatctgtctgcgaggtagacaaaagaaccatccgaattcttttccttccgttagatgctcagcaatgggcgagcgtttgcagtcttgtccatcctggctcggcaggtctcattctccagggccttccagagagctctgggaaaaagggatgctgagtggccttctgcagctcactcgtagccagatttggataacatccaagacctcataactgatccctttctcttcttttttggatgccatcaaccaaggggtgtttaggaatgtgttaataattcccaggagaaattggccaggattacctagtcatgactaatgaagctgtcatctgccattccttcctgctgtttcataatgctgtccaaggagtgctttatgaag

SEQ ID NO: 47355 - DNA, 1812 bp, Bovine  19866880166937
tgcttttgaactgtggtgttggagaagactcttgagagtcccttggactgcaaggagatccaaccagtccattctgaaggagatcagtcctgggtgttctttggaaggaatgatgctaaagctgacactccagtactttggccacctcatgggaagagttgactcattggaaaagactctgatgctgggagggattgggggcaggaggagcaggggacaacagaggatgagatggctggatggcatcactgactcgatggacgtgagtctgagtgaactctgggagttggtgatggacagggaggcctggcgtctgtgattcatgaggttgcagagttggacacgactgactgaactaaactgaactgaatatgtcacctaagagatgaacactactcgtccctcaaaataatagttctcttttgtgcttagaggagataatgaatggaaagtgagtaattttctggtctttttggataatctggatttaaaacttacagattctccaaaggcaggattatttaatcagttggcataatggatagtaactctttcttcttttttttctccagaaagaaatgtctccaggtagaaaaagcgatttaaatagagtcagaggcaggactccagactctgcccaagtcactgcctactcttcttagctgtcttccaggtcaatacactgataatgtgcctagagagtcagggcagtgaaatagttgagactgggctgttctctgttggaatcctagtgtttcctttcaccagctgtgaggccaccagcaagttctgacatcaagcatcagtttcttcatccattaaatgaggaatttatgataggtttggacacaagagtgtccagtattgggtctggcacgatgcttgagtaggcagtcaaccaatgccaggtgttcctgtttcactggattatttgttcctatttaaagaatctttcatcaaggtttactgccaatagatgtagtatttctatgtgacagagttaaatagacccagatttgacttgatgtcttaaatcaccggggagatggaattgtgagatatttgttatgcaactgtatatttgttgtaagttcaattttgagtcctttatcatagaaggtagtttgactaataagtgtagttgacctgaagtcaaaatcaactctctgggtgcgtctaagtatatataaattatcaaattatgctgaaaataacctctgacaggctcactagaagttgaaaaatgaactgtttcaaatcaatggagatagtatagacaccatgggatgacgagcaggatttttgttggtatttatatacatgtgggctgactggtcaacccacagtactcaagctccctggttgaggatgggagcttgcgctctaatcagaaaagatccaggcatctttgttacatcatttaaccttatcctaaattgcacaaaaggtggaaaagtccagcagagggggagctgtacagagctccagattccacaaaccagggctcaagctctgcccctctcactcaacctcttaccttgagcaactgacttatatcttttgactttgtctattcatctccaaaaataatagtacctatctcaacagaccaatataaggcttaaatgaaataaaaagtttggtgcagtgggtggcatagagtacatactagctattatattgtcataatcatcattattattagattcagggactctttccagagcagaggaaggtcaggggaaaggaaattaaaacttattcagaaagaagaaaaccgagctgtatgtgtatgagaacatactctaccag

SEQ ID NO: 47356 - DNA, 1562 bp, Bovine  19866880358547
cggagggcatcttatctgcagtcctacccacgtcctgcactgaaggacagcagcatcttttctaagtgtagtaactacagagagataaaatgtttaccgatcccagaatcaaaacaaaatttaagaaaagaaaaaaagtcaaatatgcaagtttgtgtatcacagaagagttcaaacatatggcacactgtgtgaggaccccccagctcaaaactaaattcttcaggttcttttcatactgggttagaaatgcatatactagtaagtcttgagactcaaggacatgttaaaatgactgtgaaagtgaaagtgaagtttctcagtcgcgtccgactctttgcgaccccatggactgtagcctatcaggcccctccgttcatgggattttccaggcaagactgctggagtggattgccatttccttctccaggggatcttcccgacccaggaatcgaacccaggtctcccgcattgcaggcagacgctttaccatctgagccacaactcattaacatcaggatctccgtcctccatttagtaaaatcttattctggaggtttctgggaaggtaatttttttaaatagtattgaactagagatgtatttgtcgctcccttcattcttattatcctctctggaaaagctatttgcaactcagagccccaggaatgaaaaaaggagtcagtaaaatttatctttgttagcaaactaacatttgcttcgtcatcacaggttttgagctctgcctaaatgttattttatctaatttaaccgttaaaaaacccttgattaatttctccagtgtagtgttaaggaaagctaactatactgaggttctctagcaaggaattaataaaggaatcaagcacttggctctcaataagacaagactacccagatttctagcgggaatattccagagcacaaacatgttttctttggggagtttaactcaccaaaattattaaaaattgagatcaaacactagtgcaaagccccaaaggaaatcatactagagtggagagatttttatcaaatgaaaacctgaaaaggtaaagtttttatagtgagaaataaaaggctttctgccttacaagaaaaaaatcctgctgccctatatctatgtttagggttcaaatagcaaaacatatacagatatttaataagtgtgtaaagattgtcactgtgaaatgaatgcaaatttcacaaagccaagcttaaacagacaggcagccattaccatcctttcccaaccactaaaagccattctcattcttgtacctaacaaatgcctccactgagatgtaatagcaaccaggtccttgaaatggctaacactgggaggtaaaaaagaaaagaacaggaggggagagcaagaaagccaaaatcatactgtgtattctgcagttccctaaggggacactgagctctctagattgcagtacataggatattattattgtgactgaaatgaagtttaataaaacccagcatacagactggggaaactcaggtccccactgatggaatacttcccacacaacgtattttaagcatatatg

SEQ ID NO: 47357 - DNA, 5028 bp, Bovine  19866880421328
cttaaactgaatggccatgctttcggcactgtgttatagttccagataggaattaaaattttatagtaatctgttctgggtctatctatttactgctttaaagtagggtcactgatttgctaggtttattgttttaatagttggaattagctttctacttctcattcttcatggggttgttccagtgtttttgctgagcagaattcgccctatgagtgactaaaactttacaacacaccacctcccaaattaaacatctagggttagctactggttggaagtgaaatgtcaggcagctgggttccacttctcccagacttttcctgtcccggggagcacaaagaaccctgttttcctgagtaacttgctcttccataattgttatgttccttaaataatagtctaattgcattttcaagaaagcagtacaatctcttcaggtcctgctgtgggttactggtagaccccttgtttttcagctcctaaaactgagtagaaggcactttgcccaatgctactctgtggatgaagggaagaagcaggattagctctgttacttacatcaggaccagtacttctcactgatggaagcttctgcactgctcagtgctcggaaaccactaacatcactaatataaattacatttctttaggcctgtttttaaaggtttagggacagcagggtactcctcatgtacattgtcatattcttttccttctgctgaaattaaataaagataggaacattataaaacctttagcaccttggccttttcttgatgttctgataggaaaatgatactaaacataatatttttgaacataaagcttagttgtctttaaaaaaatggatcaatttattgctatggaattgttagtgtatcttcttgccattgttctattggccaactcagtgtggctattttcttcctccttctctactttcttctttccttccttctttccactcttctttttttcagtaatctgaaacactttcttttttaagctgaaagaatttagggcattagctaataaattttgtgtcggggaaaactaattaaatatgagcaacgtggagcattgagggaagcaaaatagacttaagttgatgccttccacatgcatcatgccttctctctcatccataaaaaacagcaataaacttaaatgaagacacttgtggacattgaggtgtcattgttttaatgaagttccttatcatatttcatctgtgagaagggaatacctttctttatacttttataggcatctagcaaagtctggctttaggtaaagatgattcaaattgactgataaaactgggacttccctgtggtccaggggttaaagctatatgcttccactgcaggggtgctacttatttattcaacaaatattggttgggctccctcagtgtgccaggtattggtctaggcactatgtatataatagtaaataaaacagaatttcatacatatatagagcagctttccattttactcacatagattgcattttaaaacagacttcattttccctttgccttgccttaatctagaattcagactacggtttagtagaatccataagccttactattcagtcttcttgggtggcactagtaaagaacccgcctcgcagtgtaggagatgtgaatttgatccctgggtcaggaagatcccttggaggaaggcatggcaacccactctagtattcttgcctggagaatcccatggacagaggagcctggagggctacagtctatagggtcaccaggggtcagacacaactgaagcgacttagcatgcacacacacaagcctttctattcactgtttcaggaataagaggatcttgtaaagaaagaaaccaccttctatttctattttcaatgaacctttgaccaaatgggaaaaaagatgatagagtaaagaaaagggcctggaagtgaccttgactccagttaccaggctgatcatgtgactttggacaggagttttatcctttagagtttccttttactattttgtaaactgttagattatggattaggtgatctccatctgaaacactgattctgtaaattggttcatctatttctgatcctcacttgaggattttaatgcaaatgaaaaaaacaaaaaataaaacacattacccctggaaggtttaagtgcatttcggaaaaacaaattagcaacaaaataacaaattatgaacaccttatatgggctcagagagatatagttgattttcttatgattgatagttatgacaattacaagagaaagccagccactgagttttaaactatcatagccaaacctacctactgtggcttctcagatgtttctggttagtgtggaaatctaatgtagctgaaaactactgctgatttttattaagttgaagtctggaacttccccttgtaatgatagacaaacttactttcaatgaaaggaaaactgccaaagttctgaaattcatttattttattattactcggtttaaccctagaaatgggagatcaagaaaactagatagatttgacagttctgaggtcacaagttcaatttcctcacaagttgtttctagatcgaattcactgcaaatcatataacccttcacctcttgacatggaatcttttagggaattgtgtatcacatcaaggtcatcctgatcagtctggggctgggaaaatgacaggtaagttggatcaggtgaaggaattccagtgaccaagtctggaaagcctaggaggtatgagtatcactttctataacagatcagggtatactggagtaagcttacacagtgagcagaaattgatgtttttaggacttttggaagctggtttttacattgttagtagaatggaactggccttggtcaaattattcacactacaagaactggcaaatgattcatttgggactttttttctctagagagccagttgttaaatatttaccagcataacactgaatagactccagttagatttttttttaaagccttgtggatatccatgtacttatttttcataagtaagatatgctaaaacccattgtatgaaagaaaggttaggtgtttccagaactgaatggctgattggtattacagctcacttgttcactcaggtgtcaaaggaagtgttagtacctcagctgtgttcgattctgtgatccccatggattgtagcctctgtccatggaattctccaggcaaggatactggagtgggtagccgttcccttctccatggcatcttctcgacccagggatcacacctaggtctcccacattgcagattctttactgtctgaatcatcaaaaatagttatatatttaagcagtagttgtttctactcattccccttcatgctttcctttagtttaaatccgtttcttcatgttcatggcatttgtctttgtattgccttctgtatgtggtataaaaggctaacttgagtatctggttagattcattttgcagaatcagaaccatgtacataatgagttcatagtctgggattccctggtgccaaacacccaacagatttgggtgaaaacaggggaagttattttaacagagtactttcttagatttgatgaagtgaaccctcacagtgcacttcaaaatgaggagtcaattatttttttaaagtactctaaacttagggagctaaaaatctatgatatgaatgcttaaatatgtgtggatatggaaaggccttcctatttctattacgatctgaatgaacagaatgtgccaaagtgagcatatactgtttaagtacaatatatacatgcaaatggtttcttaaatatagtttttctcatttcagctcttttgacaattcatgtcaacagtgtactcataagtgtggtgctagaagagcaaacagggaattgtggtcgacaaatgtcaagcatttccatgtaggtgtaattttaggagtacttttgagagaaatccttctttgagtttgtgcttcatgtgaaatgaaagcctcccaaagagatagagctaaagtagtcaaacagtgtgtgtagtactttaatacagttatttccttaggaatgaaaggagagaaccaaattgacagattcttttgcttgtaaaacataatctggatcaaatgcatcagtatgttctatcagttgacgattctttgatatatctgtattttagaactactgatgtaccaagggagaagttttcttgtcactttacttgcaagatatcaaccagtttatttgcagctcctagaaacagatatactagggatggcactctgtactccagtagtctcttgtatttgcatatttgaagcagcgttgtccagtacactctatgaacatgtaacgtcctctgtgttgccattactcacatgtagaacgtgtctgtaatcagttgttattttatgtcacattcatctgcatttgcagcatttcaaagactagtctgcaacatcttggcacagatggggaaagcagagttggttataagttccagaactacaaagacacagatcaaacatacgatattaataaatagcttggatggggggtggggagaggggaaggattaaaaattaggttatttatttagaaagttgaaagtctccatttgtgatcattactctgttcttgaaaggaaataggtgctggattttatgttttgttttttgctccagtcctcatgtttccctccttccccttcctcctgttttaaattaaaatctaaagacagcccgaaagagtatatataactgcaaaaaggatgtggtaaatcatggcagaggtttgtgatctcacagacgtggtggtgtcagggatgaagaccaaaggcgaatccttagcttccagtggatttacttgaaatccctcacccttgtagcctatcatggataatagcatatcatggataattacatttttacaaacggtagagaaaatcattttgacacacacatagtgttttccagccagacaggcttttcaatcttttacagctttcatg

SEQ ID NO: 47358 - DNA, 759 bp, Bovine  19866880642107
cataatataaataaaattgtttatatctagaccaaatctttcactaaaatgcagaggaccaatcccattcttcatatgacgcctttagaccaaataacaaaatacaattgcaggtaaatttcccattagtgacataaaattaggttgcgaatggaagcgatttttgtctaaaattaaaaacatgcaatcatggaaaccagttttttactctctcaatgcagtgtttctgccaaagagtgaatatatcacaaaagaaatatcaatacttgcttgtgttcatttgtatttgttatttttatcagtttataacctgtcttaaagacaccaaatactcttctcagtaaatgcataattcatatcactagtattatttaactatgtgaaaacaagcgtggagataatacacattagagttaatcaatatttgactcaaatttttagaaagttgatcacttctgaggataatacaatataatcaataaaacatcaaaagggtttatgttaagcactagttattcgttcatttaacaaatttttcttttgtgtctccagcataagtcactaagatgaaaacataacccaatacacattatccctgtaattatggagctcacagttgagtagagtagcttattattgctaaacacatacctaagtgaaaccattcttaaaataaaccaaaatgacagttttaccccctgtacctcaaatataagaaatgtttatttcatgaacacctgcagcagatcgcctataaag

SEQ ID NO: 47359 - DNA, 2356 bp, Bovine  19866880658587
ctagttgactagtgtaaaaatgtgaaggcttaaatttccttaaaggtagtcttcatctaagttttccaaaaggcttttccactgtcactagtcatttcaaactaaataattcacagaagtataatttttttaaagtaagaaattaggcaaatgaaaacttgaaccatacactcagaatgacccataagaaaattcagattaaaagcaaatttcatgattaatatttaattttaaagtaaatgaaaactctgtcttcatccaaatgttcttgtactattctttgcatgactatgaaaataaatcattttttaaaaatattaaccatacattttctcagtaagagaatagctatttcatttaaaaccaagttcactggaactaaccctcatgtaacaattttaggagttcttgggggagctaatattctataaagtcagtttgtaattggctaaataaagaaaatattttctttaatgacaaccagatccttaagacggaaataatagatggatttaagagttaagttttctttgtattcctaagtacttttctcatggttggagccatgggaatgcttgcttgtgcccatggcgcagtttaaaacagaatgggccagcacctcaacaggtgttaaaattattgtttccaaaattttcatactagaaccagaaatctgagaaacgaccattgtgaagaaaaattttcagtcaatggaactcattgggcaaatgaatattttaagtctcctgtgttttgagtgatcacacactataggccaaagacaaacctgttcggattaaatgcaaggtctagtgaaaagctgccccaggtaattcaaatgtgacctaacaaaatttggtggtgtatggtaacttcaacagcacatctgaactagagaaatcagcacaaacaacgtggcaaatatgtatttagaccaacagcaacaaccaccaccaaaagaataccaccagctttatgaggcatgggacattaaatttaataagtaataaaccatgattaagctacaaacatatttttattacacagtaacgatgaagagccatgcttgttaggtttagttgcaagagccaacatgcacctataaacctgcagtggaaacagcagaatctccatgtgaaagaacaaccacgggttcaggagcctgaagcagccttgcttgcagtgcaagggagaacctatgcatcagccttattccaccctctcagaactctctgaccacagttgctaaaagcaatccgattttccctccggtgtgactgaatgtggaaaatcactttgttttacaaatccccaataggaaactatctgatggaatataagacactgattcatcttcctaagatgtttaggggagaaaaatgagcaacatttttagcctggaatagtttaaaggaacattcttgcacactttaacacttagagagcaaaagatttcatttgttggattaagtctgaaatcatagtttgaaagctggtgtcctatagtcgggatctgactaatagacatagtattttttttaattgtatttgttacagcaaaagctgtaagtatacagtcttaatctgacaatagtcttctagagtcaggcactgctgagctgccactgttgatcaggtgggatccaccagttcactgggggctttcctggttctcttctttcatacgtactccctgcccggatacatctgaatttttaagaaaatttcattctattatttcatgtcttttcctacctcacgaactcagagttttacttgcaacttctgccaacacacagtccattcctttttccaaacctcacctctttgaaaaagtaaaatctcctttaaacaaggaagtagtagcctaaattattcttgtaaaaatttaagatataaagaaaatagatgaactatgaatatatgtataatttgaatctcagggtgtaaagatactttttaattcacctgctcttgccaacaaaccataaaaagaattattacaaccacatctctgatagatggttatttggcttcttttcagtgccaagaagtttttactcacagggaaaaaaaatggcttctgctattggaaatatactaaaataatgcttcttaaagtgtatttataaactgtatttataaatatattaaacaaattcagcatgggaaacaaatctggtagcatagaatgatatgtcttgctgacactggactgagtatcgaactgattataggacctttctgataaaagtgagttatcggtatgaaatgaactttgattgcatattacatgtttgtctaagtgcttttctttatatgtcctttcatcttatctatgatacaattaattgtt

SEQ ID NO: 47360 - DNA, 1856 bp, Bovine  19866880670787
attttggaggtgttcttttttctaaatatttgatgctttctggttgtataccaatatttttaattgagatcccctactgactctgagtttgactgctgtaaatgttatcaaagagtgctcttaatgatttttagggaaagagtggttgtactaatgataggtttgccagttacttgtctattgggatttgagagatccaaattatttggggtaattccagtcactcagggcacaaaactccgttaacctaaaccacaatttctattccaaattgctacatgttcctctgcaaaaaagtctgattcatttggctactcttactatgatcccccaataaatcatcctggtatcacccgagagtcacttttgcttagcatgtgtcatctctaactctacagcacctttgcacatgctgttacctattgtaaaagcctacacagattggggtctgtgaatttatgttcaatctgacaccagttacttcctctcattccagaacagttcatgatttctgcttcaaggaaggtatttttcttgttattcaacactaatatgtctgtgtgtgtgtgtgcatgtgaaaggtggatagagcttgtatatatgatgttactaaaattttagactgtcacattaatgtgtgtgtttgtgtgtatagatacatatatatacacacacatatacatgtaatataaaatataaatgtaaacaaataatgttttctaatttaagattttaagactaataaggaaagatgtctgcagtattttaatatcccacatgatgtcttcagtgttttaataatctaatcctaattttttaataaaaattgagttttagagcagttttaggtcacagcaaaattgggtggtggatccagagatttcccatacacccttggcttccacctatgcacagcctctgccattgttaacacaccccagagtggcacatttgttacacttgatgaacccacattggcttatcattatcacctgaagtctatagtttacattagggttcactgttgtacattctatggcttttgataaatacataatacatctatccaccattattgtattatacagactagtttcactgccttaaaagtcttctgtgctccatgtattcattcctcccttcctctgacccttgaaaaccaactcttctttttagtttctccatcattttgctttttccaaatgacatatagttggaatcatactgtatgcagccttttcagattgccttctttcccctggtaagaatttttaaatgtttagcctttaaaagtatcaagtaatgtacaaataagctttcctctttgagctgtactcccactttatttcagcctccattctctcactgaacatccgtagaattttttgagaaactagcaaaagtctttgacatttattttatctgtcactgtcaaatagattgcctgactcagacctaatctgacccagcatgctttgtttgacctactgatatttccatcttctaaagttatgtcagtttttttgacatatcaaggaaaagaacttcaagagtttcctgcttggccaactgacagtctttttatataaaaatacataagagctcttatttattacattaatagagaacagaagaaaaatttgcattttgagtgctgtggaaaaagatcccaaagtcatcagttgctctgagtaacatattgtacatgttaccacatgacaattgagatacacactcatttgttaatctctagagtggcagctcttaccattctggatggagcaaaccttattccaagagggtcatctgaaataagttaagggtaatagcattattagtgcttcccaggtgatgca

SEQ ID NO: 47361 - DNA, 905 bp, Bovine  19866880694084
aaaattatgccagtaaagctcatgtgcttccctaaattaagacagtaagggcaggcaactgaaggaaatagatgaaatggagtagtctgtgatgtttcattgggaaaataaattttaaaaaattttttaaagtttgttaggaaaaaatggactattaaatgtcaaggatttttattctatataatattcagaagtcaatcttatattgaattaataataccaaccagtgaaatattaatagatctaagaatgatcttgctttgtaataattattatttgctagattacaaaaaataagtccttgcactatacttggatggagaagatagtaaatgaatatatatatttggaattttctttttatgatagctttctaagtattgcttactgtctgtactgaatagatctaattttactttttcttttcaaacactaaatattaaatgacatgtttatagtagaagtaaaatgtcatttttggagaagacaaactcttatgcacaaactcctacatagtacaaaagataattaatgatcagtatactgtgaatatgcaataaattatgtaaaaaaaaatctaattgaaaatagtgatgagatccctgattttggattcttgagcccacactcccttaaatagtagtgccagttttcacgagaggaagtttagaattatcagaataaaattaattttaattcactttaattaaaaattcacgtatttgaatatatacaaatgtatctcctcaagatcatttttaggaagagggagaacataaagaaaggaaatagacttctatcgaatgtctagtgtaaggttaccttttagtctcctggccatcctgtaatgctggctttattatctctgcttttacagaaggaatacggccttctggagagtttaa

SEQ ID NO: 47362 - DNA, 2216 bp, Bovine  19866880727411
tttcttactgcgattaaatttgtaagatggctacactcagaaacaaacattcactttcaatcaacatgagcttgagttcatgggcctgccttgaggatttcaagtggaaaatgcataggaatgtatgagtatttcattttaaatttctgcttttaatttgggaaagctttttatccctctgggatcataacctgttgtgtataaagcccagcctaatcaaggtagatggtattgacagaatgacatagtttgaacctaagctggaggtcaacaggcagattgtttctgctgtatatgctgtagtcactacagcaaaggttggacagctgggtttcaccagcaacattgttaaatggaagatatggtctactatgccccatgaaaccaaccatggattttccaaataataggctctcttgaatggaatcagaaatatgtgagtgataaaataacttgttaaaaaataaaaattaactttgtagataataacataaatgagttgttaatctgtggacagtaatgaatctcaacatttttttttttttcttcaaagcaaacagaatcagaaccatttatttttgatggacacctaagacgagttctagtcttgtactcagttgttttactgatatgtagtatatgcttgggctttttcagtggctcggtgggtaaaaaatccacttgcagtgcaggagatgcactgatcccctggagcatattctcagtttactgagtacttttcataaatagttcatgatatctattattcacttattatcaaattcagtaaaaagcattttgatttgttacactatagtttgtgttcctggatttgttcttgatgattggaccaagaataaatctagtaattaatttctctgttttgtatgtgtgtatgtgtacatgtagaacaaaaatcacatgcacagcgttcacaaatgaattgagttgttaaaaaaaaaagcctagttcttcatgtttaagacttccagatgaaagactgaaattcataataaatagcgtttgaaaaagcagttcttcaaggaagaacttaattactttgtatgtctgatccattgtcactatatcatttgttgatgtaaaataacaaaattaagggggaaggaaccgtatttccaagaacttgctttttaatacattttaattcttatcagcttgtcttttaaaaacagaaaatacatttgtttgataaaatgatctcctacccatacttcttgacaaggtcctgacttctgccagagtcagagatcgacaaccttttgccattctgattttatttactattatttcttacacttctctgttagtttgttaatactgtctaaactaagaacataaattaagtcacatgttccaggcaagggaaacagcacatttgagatcatgcagtaccaggatattgaatcttcagcgtgagcatgagactaatataattccagatacagggagtggcagtgtggtgcatcatgtctgtgccatacgcatgatttgttgttgttgttcagctgctgagttgtgtctgactctttgctaccccctggactgtagcccaccaggcttctctgtccatgagatttcccaggcaataatactggagtgggttaccatttcctccttcaggggatcttccccatccagggatcaaacccacatcttctgcattgcaggcagattctttactactgagccagcagagaagctccatcttacacggtggaagcctatttttgccattctgaccttatataaaatatactctgagcacatcactttttcctttgctagtcttctgaaagaaaaggttagccctacttctggagacttttatgacaaatgggagcctatgagaatagtaggagaaaagtgatattttctgacttggtcattaatattctggcaatcctatgacacattactaagcatttctgttacctgtggtcacaaagtgctatgatacacaggaggaggctgaggcagatcacaagcctcctctggtttccatccttcactcctccagcaccgcctcctatcctacttctaagtcatggtgtctgctggtgggctcttcattcaaaggactttcctcagcctactggattttcctttgcttgcagtgacagagagctggaagcgcttaataggtgtctgataggtgcaggaggatgaaagcccagcttcttgcctcctgtcgcaag

SEQ ID NO: 47363 - DNA, 2666 bp, Bovine  19866880733013
ccgtagcacccccaagttataataatcaaaatgtctccgacactgcccatatccatgagggaaaagtcagcactggttgacattagcacaaggattcaatagctgagaaaatactgagaatcccctgagtgggcagcaacccagacgagccgaggtatgaggctagagtcagctgtcctccaccaggtctcacattcttactcagcgtatggcatggaattttaaaacaaggacttgtcaggaaaccacatagcagcaaactcagaattcctgaacttacaaaataacccctggaaacactgtggtggaaatataataaaacaataaagcacaaactacacagacacgaacaatttggcaaatgctctccaatcagccccactcagtgacctagtcataacatgagcaatgtcctttcttctctgctgcattaagggagaagtgtggtcagagggaagactggatgccacaagcgcctgtgttttcattcagctggcgattctggctgcaggcaaggccctccgtctttgctccagtttttccaattgtaaaatagagttggtaataatgaataccctggcctaactagtttttgattctaaggtgaggatatccattccctatagggcctcgggttgtaataaccactagggggaatatcactacaaccacaagaaataattttgtctccaatctttttggtgtgaaaaaaaaatttattgggtctttttcatggaatgttttcgtttgtcataccatctcatttcatctattttggtctttgtgctatcaatacatgaactataagcattatgtatgttagcatttcacaacatttttcattattattccccataggaccctttttaggcattttttcctaatcatctccccaccgtgtcatgaaattttaataccaggtatacagaacatctctttatgtactatgtccctttggagagcaataaacaattgtaaactgaagatttttatgcaccccaagaatcaatttttactccccggggcaatactgcctccactgaagggccataagtgtaggtgaatctagtttataaagtgtattcagagactggaaggtcaccttctagatagcaggatcttaaatgggggtttcaaaaaagaataccaacaagaaaactggagaaattagataactccatatgacatcaaatctatatcacctggagagatctgaatttctaaagaaaaaaatcttgacctcccaggacccccaagtctctggggctgactatacccctcaatggccccaagcccaactataacctaggttcatcccaaaagggaagttccatcaaatatgcatttcaaggactctgaggtgttagaattagaaaaataaatggcgcacaagggctactatggaagaaccgcagggcaaggcacgtgtggctttaggactcttggggcaggctggcctcacagggacgcggtgatgggacaggagcagcctaaatgaacaaagtgaattggatgtgtgtgcatggcagacagagtgtgagtggtggggcctgtgcagtaggatagactgctatcctgtgtgtgcccagaatggagaccaccagctccagccatgtggcccactgggtcagatctcctaaatttctggattgtgaaatctggatttctaagtgaaatttctcaatttctaaatgggggcttgaatctttaaaaatctttcatgggcttaaaaaaagaaacacatctgcatgcaatataagactaccaattagtaaactatttgcaaacaaaaggcaagaaaaatttcctcccttctgggaggaaagaggctctgactctaagggacttcacagaattcactgaaggggaggggcttattccaagcttcttcttttatccaatacatctgtggagccctaattcgacagattcctctggtgggtaattatgtacaaaggtcactacttcatatctttataatttaagaaaaactggggaatagtgtcccctaactacttaaagaaatttaaatggcactcttccataaccacaagtagggtggatttctgtgtgcattttaatgtgctgcataatcagagactcttaataatccctgatttcactcatacttaacaatttaatagcagtgcattttctgcctaattagacaaaatgcaacatcacctaatactactaatgtacaaattttttaatccctaaaatgtgtaagcaattatgtttctctaaaattttaattgatacaagggcaccagtgaatctcaatcctgagtccaatgacttaacttttggacaatcacagacactttttagtagtctggaatctttctgaatacaatctgtccaaagccatagaagctgtgctaactttattctccagtttcaagagttctgttgtctagttcaagttctcttcatttttcctatcatgactgtaataaattacaatttattacaattgtaataaatcaaattaatcaaatgctttctattttgccacaaaacatgaatgcagcattgaaagcagtgtcactgagagagaaatcacacacacacacacacaccaatgatatattgaagagttctacagttatgagatcaaggtcaatggctgagaaaaagtcaatgtagaaaaaattaccttattt

SEQ ID NO: 47364 - DNA, 1364 bp, Bovine  19866880750608
ggacccaccccctccttctatccctctccctgccttggatcccccagccagtgattgactgctacaggattatgaaaacctggttcccttgctttagatggagacagacatggggacaaaaactggggattctcagcaggatcaggctgaagctgggccttttcttgaattgcattcttacttggtttcattccctttgcttcctcccctccctcactggattttcctgggttcacctaattaataagtcccttgcacacgtatccttgtctcagggtctgattctccccaatgacatatatatatacgacacacacacacacacacacacacgtatatatatatatatatctgtgcatttttcttgaatacatctcaattttaaatacaattcaagaatgtaaaatgcatgctataaaggaaaggagaaacgtgtgtgtatataatactggagtgggttgccatttccttctccagggtatcttcccaacccagggattgaacccgggtctcctgcattgcaggaagacgctttatcctctgagccaccagggaagccccatatatatgtatacacacacacaatagagtagcaggaattagaattatagatccaggaaagctaaaatccttcaggatctcagacttgctaaaacaacaacaacaacaataacaacaaaaaacaaacaaacactcaagctgtgtttgcaaaaggaaaagaaacaatgaaaaactaggaaagtttacaatgtaaaaagtgacacagtgaacccctcaactcttgtgttgactccatctggtgtattaaagaaaataatttcctcaaactagaaagagtagagcaaggttgtttaagaaaatagggaaggtagtgtgtcgtaaagtagaatatatcattttgggtgtgtcttcatcacaaggctcaggcaaggcacagcccagaatttttaatattttaggtgtgaattcataaacacctgtggatttttaagaaatcataaaggaataggggcagggattgcttaaagaatggagttggaaaaatacatccttcattttcagaaatgggaaaaatgtacaatggaaaatttgattgttaattgcttccaagttcaagagtgtgtaatcaaagagacaaatacttagaaaagaatggagtgattactaggtgctaacataggatcactaagaaccttcatgattaggaatttgtcatttttttattcactcaatgtgaaatgttctcaacatagtgaacatcatcaataacgtgtctgataaagtcacacataattgccttgtggagaagataaggaaatgtcattttatgattgtaaagtgcagttagagcaggcatcaattaa

SEQ ID NO: 47365 - DNA, 1946 bp, Bovine  19866880800477
aactgaggctatcagaggtcacataatttgcccaaggtcacatatgtagtgaacgatatagccaagattttaacccaagcagttttctccagaatcaatcatcttaattactgcattaacctataacctgtaatcttacactctggagggggcaaagtagcagaaaaagagagtaaacaaattcttcacttaaggagtgagaagaaggcagattttctgtacaatgtctagtgagtctaattattactaaattattgatccattcccctaaaagaatataggacattaataaggcaatttcattttatatttaaagcaatcaaatgcagtttgatcttcaaagaaattactaaaagagactgttttgttttgctatttaccaagttagtagagcatcaacctctaattccaccctcaacctctaacacactcatgcctatacacatgtgcacacacacacacacatttctggtctatctaggtaatttgatgtttctggaaacagaaggctgctgagaagaacaatgtccctactgtataatgtgctttccagttctgtgctttcctcataaaaaccataggcaggtgatacagtttttagtaattgactgatgtggttctgtgagatttgggaggcaaaaagaccagggtgagaaggcagctcttccacttactcactgagttacctcaagcaatttatttaatttccctgagctttaggtcccttgtctaaaagatgagaatgataatatctacctcataaagttatcatatgtaggcccgcccaggacaagaatacaaatagagacccacataccatatgtctaaatatttaaaagttataaatcaagccaacagttaaataaaatatgttctgtcctcctaccttgacaaatacacctttataatgacaaaatccaaaacaatatgtgttaagctatgatttttataggaccaaaagttggcaaatatcaaggaccaggccttctgttgatgggccaacagtttggggatgagtaataaaataaaaacttatatgatgcaaattttgattcatttattccataacactattttgggcttcatttcagccacatgattaggttgtttttaaaaaattaagatttttttacacattttctattgactatgatgatctaaagtctctttaaaattacatataattaaattcaaaatatctacaagacatatactttaacagactatataacttaaatataaaaatcaaaataaatgttgaagttatctctttcaaacgcttatcaatattaagtatcaaacttacaaatcaaaattatttaaaacaataaacacttttgttttaaaatataaataaatataaagtcttattaactattttaataaacttatttataaattcaaatattcagtccctctaattgctaatataaaaaatgaatatcatatttattatatgttacatatatatacacacaaatttaagagtaatatagattgtttttatagcaaaattcttccatatacaagtgctatacaatctatgttaattaatgagtactactgtaaccactaatcagaacacataaagaaagaaaaaaaatgaagctcaaaacttctgggaaacaatgtttgttatgcaagaatcttgcacttccgacattagagaaagaatctgactctcacaagaatcttttcattctcgaatcctcaccatactccaaagcagtattcatctctgaggtcagcaacagcacttcacagcatttggaaactttatccttcatttcagagacacagagcaaggagatgtggaaaagtattgctctaggatcggggaacagatgtttaaggctaagagccatattttgtccatgctgcgtgcctgtcctcaaggaattcagtctccaacctaacactgaaaatgccaatgaatctttaaaaat

SEQ ID NO: 47366 - DNA, 1115 bp, Bovine  19866880808839
gggatgcgaactcaaactggggaggctgatttcataaaggggacaggactgtgtgtgtggtcagagaggaggaaaagtgtgcatgactcctctgctttgggagaacagcctcccttagaagtggagtccagggaccagaaagttaaacaaaaccgtacaaattgctaaaaagaaaaaaaaagtcaacaacctaaatggatctgattaataatcaaagatgtaattattttcctgttacaaagtctctcgttatccacaggcctcacaaaagtgaccaaagagcaagaagcaaagagcaaatcattccttaggaactttacactgaagggtttacacggagtttttttttttttttttttttccggaagagtggttgttatagaaccgcgggagagagtgagaaaactgaacatatagcagggtccctctccaagaggaagaggctgagaaaatttaataaaacaaaatatacccactcccccaaacatcgagccacactgtttttcggaggaaagagaaagagaacgacgattcttatcaaaaccaatatggtgctgcatttgaggggtacaatggggaaagttaccgctgtgctacgggtgggtttcttttctctctttctaggtggcaaaggcagcagtcatttgaatgccgtcgaacggcttttcagctaacacaaaagagcagacggttccacttatttctgaaattagatgcaatcatatctgtgaatcacgcagcagcaaaccaccgtaatctgcattataatacattatccggcaagctccctaactgcagcctaccgcggcaacagaaaacactttgcggtgacctgaaccgcgtctgccaaaagcgcggagccgcgtgaaggcaggaaggcgacagaaaagaaccgctttctgctgcgaaaaaagagcaaattataacaggagtcaagtctcagctaatgcaagactagcatcttcttgttcacagtttgcataattagatatcatgaataggggtttctttctttttttttattgttctaaaaatactccagctttgtttaaatcagctatttccttaacagcatgactttgctaccagaattagtgaggtagttaggggcagag

SEQ ID NO: 47367 - DNA, 2322 bp, Bovine  19866880839476
atttttcaagtagtcatgtatgggtgtgaaagttgatccataaagaaatctcagtgccaaagaaccaatgatttctaaatgtggtgttggagaagactcttgagagtcccttgaccagcaaagagatcaaaccagtcaatcctaaaggaaatcagtcctgaatatgcattggaagaactgatactgaagatgatgctccaacactttggctacctgatacaaagagccgactcatgagaaagaccttgaggctggagaaagattaagggcagaggagaagggggaaacaggggatgagatggttggatggcatcaccaccccaaggacatgagactgagcaaactgcaggagatagtgaaggacggggaaggctggcatactctagtccatggggttgcaaagagtcagatacaactgagcaactaaacaacagcaacatgtatatttggtggtacatagatgatatgaacacttaaaaacctaacattttgttctcaataatgggtacttagagacaactgagataacagcatcacacttcacatcctgtaacatgtggattttgattaaatagtatacattcttgattttatggtcacatatttagggggcatacaggaaattatatacctatgtaaaataaatgactaaaggatggaaaagacctttccaataacaatctctagccaacccacaccactgaagatgtatttctagttggcaagtcgtacattgaagaattaaagttcttttataatagcattatggtagctatagttttgtggcactgcatggagtctggaataaaattagtcattgtttctgtacagtcaataaaatgagttgagctcattgtattcacaaagcaggcatgtgtaaccagcacatctggcagtgtctgaaatgtaggtgaatccccaaagatggaaatttaattttcttctgacttgtagagagacaaactatacccactacagccaacagaccagagaaatttcaaaaattttaactgagaaaggggcacactgatttgagttataggactccaaagaagaaataacatatagcttaaaccgggtacttctatgttcaaactctgttgagaaaataccatttgggctcttgactaggcaatgaggagaagagtaagacccctcatcccaatcaaggggattatatttttactgggaagtgagagatttaaagactcaatcagtgtatgtctacatcagctgaatatcaaataaaaacaaatatctaatacaaactatggtcacttcatggacattcaataaacatttgttaaatagattgataaacaaacaaataaatagtgaagtgatttgactgagctgtcccagggcaccagaaatattcaggaaagatctcatgggtcaacagagaagattcttggtgttttattttactcattaactcctaatcgatatggctgccatatgatgaatgaaattgttttgcttggataggatagatttcactctttcagagacttcagtaggagaaaagattgactcaatgccttgggaatgaaatagatggaggaaatgaaggaataaatcagatgaagatgaaaaccctcagcttgggagctgtcttttatattcagaaataaaatcactgcagagtccttccaactctaattttcaggttaatttgacaaacacagttcataagtgggaatggaggtagagtattgtttattttttaatgttgaagaattttaaaaatcatttcagtacacaggtgggtagatttggccagaagctgcaaattgaaggtgcttttttcatgttttgaagaagagcagagctgtcctaacaaatttattgtaagaagtttttcctaaatgaaattcagattttgagaaaggcaattgaaaagaatgagaagtgggagaggggtggagcaggtttgatttaaccagtgcagaggtccactgcttaagggaagtatatctcaggctttccagaagtgaggcaagaaaatacttcattcaaacaggaaaaataccatgaagaagtactgactagctgcatcattaccatcatacagcaaaagctacataaatttttggctttttggtttcctctgctgtgaactttattgctgattttccatcctaaatgtattccccaatttttaagtatctatgggcggtggtggtgggtttagtcattaagtcatgtctagctcttagactgtagagccccaggctcctttctccttgggatctatgggtagagtgcttctaaatgtcaaaacctgaaagtaaacccttggatttttgcttctatattata

SEQ ID NO: 47368 - DNA, 771 bp, Bovine  19866880861697
aatacaatgtgagctttgaaaatgtgtgtgcatcagagataaatgtgaaatgttgtaacaaatatgttacaacacacaatggttagaacaactgagctacagcagcgcataatccaatagcagatgacagggaaatagatgaccttatttcagcttagtgagagcaggaattacgtccgtttggctcatccctataaccccaggatagagctaagagcatcacataatatttcaattaatatttttttaaattttgagttaattgagaaaaactttgaagacttgatataagtcaaagaggccttaaaataataaacagaaagaagaaaaactcgacaaatttaagatagtcaccttgcagatatggagtggacaggaagaagtctgagaagggtgtaagagtcctacagaggtccacttactgcttttattttgaagagctctgcaggttaaagaggaaaccaggccctcatgaaaagctgtaggaagcaaacacgaaaaccatggatttttcaaacttctttcatgctcatttcttcccatcgtatttacacttcgtaatttcaggtgctgcctgttcctgggaaaatgcttctcagatgccagcttcaggcaaacagtggttggacaagggtttttgtttatttgggtgttttggggtttgacgtttctttttttttttttttttttagtggattcagatatcacaatctgccacaaatgtgacgtttctttttttttttttttaggggattcagatatcacaatctg

SEQ ID NO: 47369 - DNA, 1085 bp, Bovine  19866880886936
aaccgcactggtacatatcggggcaagtgacaccctgggttcctctccctacccccaccctgtaggactgaggtttttattctgccagctgttaagagcgttgcctctgatggctcacagtgtgtcactccccaggaactgccatttgctgaaaggagccgcctcacacgtttgtctttacttcaaggactgccatgtccaaagacattgtggtcaataagggagcaacaaagttcctgccccctcattttacttcatcagctctgaaaggccattctggacccataggggatcagctggggcctctgttgcaacttcactgtagttcagtttttccctctgctcagtcctattccctatctttcccccatacatattgctcccaagaatacttccatcagaatccttgtatgcaaatctccatctcagagtcagctgccttggtaattcaacttgagaccttggtgccaggaagtcatcagtccccgatgacagtcccagaaagtcatctgtaaaatgggatttagaaactatgtcatctgccagctggctggcagtgaggtctccgtccctgataactgatggaatgtgggcagtccttagcttgtcgcagaagtgcaattgttaaaaccttcactgactgtgaactgggatgaggtacacaaggaaaggaatacactggcaggcacaacatctcagagatctaggaaaagaagtaattataaagacaacggaattaggttgcttttgctgagtgtaatcaatgctgtggagaaagataatgaaaaatgtgtgtgtgttcagtcgctcagctgtgtgtgactctttgtgcccctgtggactgtagcccaccaaactcctctgtccatgggattttctagacaaaaatgttggagagggttgccatttccgcctccagggaatcttcccaatctaggagcaaacctgagtttcctgcatgggcaggcggattctttaccactgagccacctgggaagcccaatgaaaagggtagggtgattaattaccaatttaaggcaaattgtaagttcagagggctttctcagaagcacataaagaacaat

SEQ ID NO: 47370 - DNA, 861 bp, Bovine  19866880906097
ctgttaaacatgtgtttacagttctaatggcagatttataaagtactgtgtttaacaacggtttctctatcatggttttttttcttttgacagaatcgaaaaccctctttcttttttgagcttaatgttgaggttcccatggtaactgcctttttatttggtttcctttcttagcctttgttgttctattgctgcgcttttaagttggaaaaatattttgcttaaaaatacagtataagaaaatcaacaagctattattcagtgtatatagtaattatgaagacttctcatttcaagaaaaaaacagacttcttttaaagttttgtgttaggtcacaatactaaaaagcattacactggaatcataggagtggagcaagtggctgaaatactagattgaacaattcagtgttccatttccttacattgttctacattttttattttcttaatgtttataatctatcaatagtttgtaaaaattaattatagagaagcactgaacattgtgagaatcttcaaacatttgcaactacaaatacatgcttaagtagtccatggtcaaagggaaatagctataaaaatacggagaattaaatgaaagtgaaaatacagcatgtaagtcttaagatacccctaaagcagcactgagagggaaggtcatagtgctaaatacttacagacaaagaaatgcttcagatcaataatttaagtttctatctgaataggaaaaagaagagcaaactatatccaaagaaagtagaaaaataaataataaatgtaagaacagaaatcaatgaaatttaaaacagtaaaataaacaaaattaataaagcaaatccttgttcttaaaaaaaaaaaa

SEQ ID NO: 47371 - DNA, 1053 bp, Bovine  19866880909469
catgtataggcccagatttttattttatgttcattttaacttgatcagcagtatattatcaggtcttccctgacagtccagtggttaagactctttgttcccaatgcagggggcatggatctgatccctggtcagggaactaagatccactcccccccatcccaaaaaaaggaaaaacagtgtattgtcatattcactttataatgattcaccaataaactggacatttatttcatgtttatcatgatattgctaggctgctatactggaagaaggcagttaaccaagttatccaatattacattaaaattaatttgcatcagcaacaagaataactttatgttctgataaaacacttatctatatcattcatagttcattaaatttacttaagttaaaacacccatggacatttatcaatttgtggtttttacacacttggaaacatttcagaactagctgcaatcaatcagtgattatatatctcatttatctgaatgcctcacctgatgactggcactcactacagcctcaaaaaaaaaaaaaaaaagctcacacaatattactatattactgacatatcattatatctaagaactatgactccaaaaatgattgcaaatttcttccccaatcacatctatgtgactattaattttagcattcaattttcattattccatgtaaaataaagaaattagaaataagaactttgtaattcttgttcctgccactaaattacttgacggtaatcacttaattactcaaaatactgggttcagtggtacacgtaatgatgcttacaataaaccagaatgagaccttaaaaacaaaatttttattcatccatgcatgtgtgcatgctaagttgcttcagttgtgtctgactttttgtgattctatggactgtagcctgccaggctcctctgtccatgggcttctccaggcaataatactggagtggatcaccaggccctgcttcaggggatcttcctgactcagggattgaacctgcaactcctaaggctcccgcattgcaggtggattctttac

SEQ ID NO: 47372 - DNA, 2191 bp, Bovine  19866880925180
cttttggacattcatgggccaagtctgggtcagtctcttcttggtcactgctccttcccttcctgggtgtggggtgcacaaggttctgtttgtgccctccaagccctctctatccccagtcttgtgtaagttctggcagctctatggtggggttaatggcaacctcctccaagagggcttatgatatgcccaggtctattgcatccagggcccctgcccctgcagcagtccactgctgacccgtaactgtgcaggagacacagttctgtctcagtctctgtggggtctctgggtcctggtgtgcacaatgtttgtttgagcccttcaagcatctctggtgggtatggggtttgattctaaacgtgatttcacccctcctaccatcttattgggacttctcccttgctgttggatatggggtatcatttttgtaggatccaacattctcctgccaatgttcgttcagcagcaagttgtaattttggagttcttgcagaagaagatgagcacaggtctttctactccaccatcttggagtcaaaaatttcactattgcaactagtcctacgaccggtattctggcacccacataggtaagtactcctgtaggatgtcttgtcagaaatagggctctgagttcaaggctgcttacatgtctggtactctccctgcctttcaacaacaatttagagattttaaaagatgcatccttctcaccctcttgtcattggctcttctccagatttgctgaccctaaatggcaccctactccagtactcttgcctgaaaaatcccatggacagaggagcctggtaggctgcagtccatggggtcgctgagggtcagacacgactgagcgacttcagtttcacttttcactttcctgcattggagaaggaaatggcaacccactccagtgttcttgcctggagaatcccagggacgggggagcctggtgggctgccgtctatggggtcgcaccgagtcggacacgactgaagcgacttagcagcagcagagattcttaaccctgctgcacatcatcatcttcatcatggggcttttgaaaataccagtctcagaggattctgttctaatgggtgattctaacatgtaaccgatgaggtctatattctcagtcttactactcctttttagggcacccttcagtttgtcctaggcagaaagtaacactaaatgatgaagaaagcactgttgaattgtggattatttatatgataaatatataaattatttatattccttcagacagaatagaggttcctctttctttctccttgctcttagctccctcttttgccttttaactggttcaccttgaatagccctagagatatttccaagtcttctgctgccttattaaatatgagccaaagatcagttttagttgaaatgaggagcaaatcaagagtggaggacaagagtccattaatctgaactccttgctacataactgttagagatccttggtttttctcctttttacacatacacacacacacacatttttcattctatcttgccttccttctcttcttatcctttttttttttttttttcttgcttctgtttgtcaccaatatagaagcttattgctatgaagatcagattgtggccgatagtacccagtctcaataattccctaatgtttgtgtctaatggggtgaagtcattatgtaaacttccctgtgcttaatgttgcaaagcacctttcgttattctttgacagtcattcatggttagaaactcgttggctccagaggaaagctggtgaaatacgtaaccctttgctttagctgttcatttacagatgctggaagctccggtcggggtgcctttataaagctgctctataacaattaagctagctgtggtaggaaattagttccagcgtgttttatgggtagctacagttttggttcaaaggaaggagtgggtaatctcagcaattccaaaagagtaatattataggcaaattccgacacatttccatctcatggctgtttctgaggccactgactcctcacatccctgtgcttcttcgtatgtactaagttaataggttgacaataatggatgaactgggtaagggatgggggcggaagctgttctctgctgggagtggaacaatgtgcccttagtatgataagctgattccattccattaaat

SEQ ID NO: 47373 - DNA, 749 bp, Bovine  19866880969997
acttattaaggaaaaaaaatctcactagtaattctttatattcattacatattgaaatttaaaaatggatatactggctaaataaaacctattattaaaattgatgctacttgttttaaaaaatttttaactatggctactagaaaattttaagttctgtatatggcattgtatctctgtttcctggaggagatcatgacaacccactccagtattcttgcctggagaatcccacgaacagaggaacctgaggggctacagtccatagtgttgcaaagagccagacaggactgaagtgacttagcaggcatgcacatatcttattggacagcattgctgtagtggtaggaagaaagatcccaccctagagggcgctgaaatccagtgcataggcagaggtgccagtggaatgaggctgcaaaggcagaaatgtcactgggggtaaagggtggcctcaaggtaggagtgtgggtctgtttggcagcctggctaagtacacagggactcgcatcatcctttcctatctcagtgtctttaaatcagttggctgatttcccttatgctgactcctgtggcagaggaagagagtagggaagagggacagatccttatggttctaagatttggcttgggattagtttctggggtgatcccttgcgttttctggtcccaggttctacactgtaggttactgacgttagtaatgagctcaatattcctagtcaagcttgggaagaccaataattcta

SEQ ID NO: 47374 - DNA, 718 bp, Bovine  19866880971111
gagctgctccgtcgatcatagactcgctgcagagatcagctcatcctgcctttgttaatttcttgacattggatgaaatgaaaagagaaaaaaaagaagaggaggggaagggggcccttcaccaggcatctttatagtccacattccaactgttttatgttttgttttcagaagcagtgaagtggtaacttaggggaagcttgataaatcattaaaaatctgcagcccataaaggggcactttccaaagcccctaatttaatgagtcctctggttaaatgcttagtacataatacttgaagaatcaacacctctgctgtttcaggcttgtgtttgaggggtgggttgggtgcctgagtagcctgcttacccagagggcgctggcactggactttgctttcctctttggtagcctgcagaagttctgggaatggttcctttttttcagatacagcactcaagacaaaacataccgttaaagaatctagaggttctctgccataccttgtgttgtaaagtgcctgcaagttatatcccttatattgtcctttcctctataggttttgaatttaccccctttcagagaatttgcactttaatagggacctaccattcctgtccttgtctaggaatactttaatgtctttagttattttttggttaggtaagtaacatctctagattgttctgtgagggttaaggggaaagtaaagtaggcc

SEQ ID NO: 47375 - DNA, 1606 bp, Bovine  19866880971462
tataactgaaaagttttccctgtgtgtctggctcctggccctgcaaccactgagcccactttagagggtgcagagaagcgtcccaagaacagggcacaaggccccatttctcctggacttcggcaggtcgtgtgttttccctgaaaacctgggcccaactctcagtttgctcctctgaggattccatgccctaagttttctctgtaatgctagaagttggcctggatttccaacatttcagcattcctaattaaaggaggattgtctttatcgggctggcagatggtgttcggcagtctgctaaaacagaaacgtgtttatgaggccttctctgtcgagttttatcaggagaagcaaatgcaccaggcgtaccttgcctgtgagtaactgggtgagtagacgggtcctgaaagtgggagagagagagagagagagggagaggaacaaggtgcagacagagagatggggataaacataggactggtattacaacttcaaggtctttccaacctggatccctcttaccattccctgcaggagccagttgaaggtaggagctaatatcagagacctgaaatccaacagactctaccttgaatccttggtcggccacttacagaagggcaaggtctttaacttctccacacgtccgttttctgatgcatacaatggggacaacgcaactcccccagagggatgtggtcaggatcacgcgaggtactgtatatgaggaggttattttacaactgatgttgatactatgaaaaactttataccgttaaatgtaagttaattgagtttacctctatctcagatattgggggtgtaaattaacttatttttatagagttttggcccaaatattgattttgttagaaacagagatgtggcttaccagaatgtgctgttaacatagcataaaaatactggattaattgctttctgtctggggtatagccttaattttttcccttgcagttttattgaaataaaattgactacagtactatataaggttatagtatacagaataatgatttgatttacctacatgagatgtgattaccacaagtttggtgaacatttatcatctcatagaaatataaaattaaatagaaaaactttttcttgtgatgagaactttagaattttctcttaacaactttcatatataacatcccgctgctgctgctgttgctaagtcgcttcagtcgtgtctgactctgtgtgaccccatagacggcaagccccaggctcccccacccctgggattctccaggcaagaacactggaatgggttgccatttccttctccaacgcatgaaagtgaaaagtgaaagtgaagtcactgagtcttgtccgactcttagcgaccccatggactgcgacccaccaggctcctccgtccatgggatttttcaggcaagagtactggagtggggtgccattgccttctccataacatcctgcagtgttaattatatttatcatgttgtacattacattcctagtactcatttatcttataactgaaagtttataccttttgatcaccttcctccactttcctcctttggtaaccaaaaatctgatctctttttctacg

SEQ ID NO: 47376 - DNA, 2045 bp, Bovine  19866880995816
tttttttatgttttcctgtttcttaaattacttagaaaacctacggacacttccttcccccaaagtcttatttcacagtctaacttaagactgatgctaaatataccgaactgctgatttcatagacaaaaaaaaaaaaaaaaaagcaagtcttaagtaaatataagattcagttttgaattgtacaagaaaattcctgtgtgtgggctcagcacacacacagtcacatcctggttgtggtgcgaaccccagtgtgaatagcatttggagctgaagaagcaatgagaattcacttctaaattcacatttcaccaggcggagggcttgtgttccatagcacaatgactgaccacagatcagaaacagcagagatgccttcaacttcctttttttacccctttgatagttcctcagccttttttacagtgacagtggtacccttcccctgtgctacatatggtaaacactcgtgacaatggagagaataaaaatcctggtcagacctggacagattcacaggacagcttcagcaaggcatgatgaaaatgctaggctattcaccagatggaccttatctggagcacagggcacccatacactgataacaaaatataaagagaaacccatttcacaaacaacacagagaaacaaacattttatttgtatgctacaaaaaaatccaaaggtccccttagatgtcaaaaactgccacacatcccacacagccatgcttcagtgatagacgaggaacagcatttttatttttattattggcaacacagggtgagttccagctacattgttctttcaaaaaatatattttatcatcaaagagagataacacctgtatacccaagtaaacctttaaaagcttcacaagatgctgctttatagctatggggcaaaattccaatcataggaaatgaactttctggtcagggcatgtcctgtccaagatgaaatcaatgaatgcgcaatgcttgacataatgcttgaaaacagggaataaacagaacaaaaatattaaaatgatgcactgtttcagtattaagatttaacaatctggtgctgaatatgctgcagtataaatagtgcctggactcagatccaataaagtaacacagctctcattcatagtaccgtatgtctccagttctggctccttaagtcatatttcacttgccaagaaaagctgttttcttgtggggatagttttcctaacattctctctcatgacaatgaaaagtgcacagcacacagcatggagtagtcatgaaatgaacatccagcacccactggacagccatccacagaggccaggtctgcttccttgcttcctttactgcttctgacttttgaaagtactaaaaagataccatgggacatgtctaacatatttcctttaaaaaaaaaaaaaaaaccacttccacagttttaaattccctttaaaaatccattatcgtgatagcccataagttgagtataacctgtgtgtgcatgctaagtcgcttcagttgtgtctgactctttgcaaccctaaggactggagcctgccaggttcctctgtccatgggattctccaggcaagaatactgaagtggttgctgagccctcctccagggaatcttcctgagccagggattgaacccactctcttgcgtatttcccgcactggccggtgggttctttaccactaacaccacctgggaagcctgagtataacctgaccatctcctaaaggtggtattctattataagagattagagggagaaaaaacaaagccagcaactcctaaacaaatagaagacaactgtgtgggtcatttggttactaagaatacaaaggtaacatgaagccatcgaattctgtaaactttaacacacacctctagaggtgattcatgcatgctattgtgtgctgttgttcatttctttttattgttgtggagtgttctgctgcaagtttataccacaatgcagccagacacaacagaatatctcctaatgctctcatttatataaaatacaagaacaagcaagactca

SEQ ID NO: 47377 - DNA, 1593 bp, Bovine  19866881015571
ttgtgagtactttgttttctgccccagtttaaggggaactctacatgtgcttataaatctttactactttctggttttgaattctctgaagctgaaaagttactaaaattattttgaaggattatataaaacctgaacatatgcaatgtacaatacttcaaaaattgtaatgaagaacatattaacatttagtataaaaatcgtttggtgtcaatgggaaaataaacagtatattatactccacatttattatattgaagatcttgttcctcaaactgaacaatatatagcaggaaataaagtaatatgacatccagttattgtatgcttgttaagtatttgcaagcaatgctttgtttttcttcagtgcttagacttatattggattagttgatatgctcaccatatctgcacacttgtggagattgtaaaatcagaaaactggttgatagtatttttagggctttctgcatttcataaatgcatcactgtgggcttaaatcttctagcaagagagagtaaaatagttatataccagtattgccttgagcattctgacacaggttcagagaagagaagcaattatgttagatcttaagttaagatttgacaatattatgttaatggtgctttacctttaaaatgtggtgctttcctaagaagcccctgcgactgttgtatactgaactgcaataccatttttctaggcaggttgcacttgataggggcttagaaaagctgatctacgtttgggggatttttctgaaatctattgagaggtaggaggattattctttccctattaccccctggctaggatagataatgtggtgaattatcacccatgtaaatactccaccagacttcttactctagaggaactctgtgtacctagaaaatattactttgcccagcattctgcatttatctatgctatgcaaaccctgtaggaaaaaattttataaaactaataaccaaatagctgtcataagtctaccacatttacacctttttaaagacttgagcagtcttgtttggaaactttgttgatcttgtccattcagtatgcaacaaagcaaaaacctatatgttattcaggaacttgataagattgtaataccgatcatcagttctcaaacagaatggtcttgtttcggatattctgataaacagaggtgccatttagtttttaaagaactagaatataataaaatatagttcataatcactttatgaaactggtaatgtgaaaattaattctggtttgtgtgagatttctgatcatttgaattctatatacattagaattcacaattaccacttcttaaacattagttaaccctttacaaaaggaatgggatagactaggcaaaactaggatttataaaaagggaaatccactcaaatttatataggagattataatagacaaacaagtagactgaatggaagatataaatttgattatatacataattatgcactcacagatgtgtgggtgtatctggttggggaggtgttcaattggatctagaaggttggtttatagatttattcttatatatatacaaggtttaggttcaacgaaggcat

SEQ ID NO: 47378 - DNA, 2695 bp, Bovine  19866881095359
tacctttataataaacttaattttgtatcctttaagtgtgtttttcttagtagtcaaattttgttgcaatgagtagtctacataagactatagaactacattgaaatgattgtggactgattatgaacagaactgacactcatatgtttcccattgaactgctgaataaaaattatactccaagaaggttaagagagaagggtcagggacacatcttcaagcccatctcttctctctgctgaataggtaggtctttggtagagtctgccagttaaagtacggcatttcattgggagaataaaattatgttgtaaatacttcattcaaatgatctcttatgttatatgaaaaccatgtttgtaatatgaaaacattacctcatattttgaaagatttgattcaaatagcatcttttcttaaaagggagacattcttctgaaaaaataaaaggcaaagatttcagcctactagcttgaatgagactttgggtgtaaataagtcattagagctaatgagaagtatgcttacactatatattactatttctctgaattaaattatttgaccatctcattgctcctggcctagagcaagtacaaataaagtggacaatcatggtaatggtgatggttagatgtcaatttgcacagaccccatctttctcatccttttctacttttatatttaagtaggcattggtataggaattccaaacatcatattttcatcctggataaaagaggttttcattctgagctggtgcagtaaattgtctcttgggttaaaacaaaaccatctgctccttgttttgattttcaatcaaatgtataccttgttacataaatataatctatgcatgtattcttaataaaataacaccctatttatttaatggaaatttagaaggtgatagataaatggccagtcacatgatcaaaagaatgcttttcatttggtttaaagctcttttttcatgtctagaacttagcttttcaatttacctatgaagaaatgtaatgaaattgttttttttgctaatccagaaatagaaaatggaaggcttcagtaattagtttttgaaagagtagttatctaatgttatttaactttattttacttcctgtttaaggaatttcacaaagatgcactcacacaataaactacaggaaaaaaaaaacacatggaaaatttattctattggaaagcacaccttttccttatcagactaaaagttttgtcagtgttttacaggtagtaagcatattattgacaaaaaatattttaaatagttatataattttttgttatgtttaacacagctatttgaaattgtgattttatccatatagtaatttaatacattattttatgagatcatatacttaaccaatacattctcttaggttatttctatattaaatgattagatttcaattacttatataaatgactgctactgctaagtcgcttcagtcgtgtctgactctgtgcgaccccagagacggcagcccaccaggcttccccgtccctgggattctccaggcaagaacactggagtgggttgccatttccttctccaatgcatgaaagtgaaaagtcaaagtgaagatataaatgactaggatatttaacttaaactttgttgtctctcctcaggttttctagttccatggcactatttagatccttagtttaactctacatgggaaaaccaaccctttctaaatattcttctcactctattctcggttttttcctagcccttcccagtggttctttctgatgtttctcagaaattctcctgtgccaagtaaacatgaggttattcttagtatattaacagttattatcatgggagaagaattattttaatattaataaaaataatttccacttactgctggaagaaattagcttatttttaaaagttggttcaatgattgatatttttagaatgttcatttaaaaaaacagcaactctgtgtggagtcagtcagtttttagcatctttgcctactcttcacaataagaacccagaaatcattatgcacatcaaatggaaacccaatcttataaagctaaataataaccccctagtactgacggcctattattcttttcggagtcaaatcacttaaaaagaattaacaaataaaattttcaggactcctctgaggcaggtaaatgttttcttgcttattttttcagagactacatttcggtttacttgctaaatctaaatggtccttgttgctgattccagcagtgccaagaatcttccggttgttagttcagtccttagaaaattataattagagattgatataaatgacacctagttatgcatttggttcaaattaacattgaagtttcttgacccatttaagttactttagagttaatagaattggaaagttggaaaagtccttggagatgatctagtccaatcttttattttacaaatgctgaaactgaagctcagagatgtaaaatcctgttcaggtctcagtcttcccttcaacagactggactggtgtgcaaagatcagataaccacggctcgatattgaaatttcttggtagttcaacagattttccaagtgacgccattagatctacagagaaatgggtcatggaaaaaaaaatggcagggggtggggggcattttagaaagagagaggatttgggggaggggg

SEQ ID NO: 47379 - DNA, 1104 bp, Bovine  19866881110011
gaataaaagaaattcttccttttttaagttaatcattaacatttctccaggaaacaaacaactgagactattgtcttatttccaaaggttgcccaggggtgagcaaaaaagctaatttcattagatgcaaaacataatccaagggtggtcatacaatcactgcctgcatctgtgcctgcccataaaaataccccaaggactaggaagtttcaaagtaaatgtaaaaataggatacacgaggacattttcacacagtggttaaatatgtatatatttaaataaaatgcacaactagtgtattcatcatttatgaaagccgattggctattattcagtgcatgtcagatgtcaagagggtagaaacctacttccttttaaatgctgtttttgcattcttaaaacaagaagtagagaaactttgggaataatacattatacaaaataatcaagtaaagcagcaagagtgggggggggaatcagaataagtaaatcaggatttaaaaggagagatctttctatattttttctcaaagttacacagtcagtaaagttatgggttaaatgtttctcattgctaaatgttattaaattccaataaattttataactatcaatatagcaccttataatataaggaaagcccttagcacagtgcctagttcatgtaagaacctgtgatttttattaactgttatttccttttcctgaaattgattttaacaatgggaatatgtcacagattttcctggtctgaatgtttctttgctggaaagcaaataataaaggaatatagttgcctccttgggataaatcctcaaaaaagagattcaaatcatgttaaaccatgaagacacacaactcatactcagaagccttggctacttttatttgttgaggctcccaatgaaatagaaatgccataacaagattgcaaaatttacacagtgaattctacatgtttatcttttgcaaatttacaattttaacacacacacacacaaatacaatgcagtgtattcgcaacataatggcaaagtttacttttaagagattgaaatgtatggcactgtagttggaaagacattcacatttgtctgacgtctg

SEQ ID NO: 47380 - DNA, 800 bp, Bovine  19866881122153
ctctttatacagatatgatttaagattaaagtgaatgttctaaagagtaaaaacctaccttgtttgtttttgtcaataatatttgaattgttacaggcagagctttctctgtgagtatgtttgtgtgtgtatgtatttttagatgaactcatttaaccagtgcagcctcagtatttattctcaattgccaaaatatttatttttgtcctatattttcttttgtattgttataaattcaggattaagtgtattgtaggttcccagacaagtatgttctgagatttcattaatttgtgtaagttgtaatggtacttgaaaaatgtaagaaatgctggaagaatgctatttcatttaccatttacttttacctcaatgcaagacatctgaaatatggatagtctttaaaatcaaagctgaaagtgtaggagagtttcactaagttttactggggtactgctaagctatgtattcaaaaggaaaatgtgtgcatttcaaaaaccatttttgttttgcctttttttctccttcctcattgaaaagtcattcttaccacaggtttaacaataataactacaatttatgcctttatgctgctacaatttgatgatataccacagtcaggccacaggttagaaacacaggctgagttattatatgctgctgggtagtgatttcctgtgaactgatttatggataaataattctatgttcttattatataggatagacagtttttaatttctttaacaaagcttagcgaacaacagaaaattacatgctatagcacagggacacaacca

SEQ ID NO: 47381 - DNA, 810 bp, Bovine  19866881176150
cttttcttttttttttgtgttaaagatggtaagatggaggctcaaggaaattaagtgacttgcctcagtcaccgagaggacagtttccaagcccaggcgctgttgactatatcaggtgacttgccatattggccggtgacattttaggagattcacgtttttacttaagtaaaaacattctaaaaaaatgtaatgcttacctcttttatggtaactcacaattcatgaatgccagcatatgtttatacagcactttataattttcagtgccatttagctcatgttattataattaccattttgtgagtcaggcaagggatttttcattggtggtgattttattctggttttgcttttaaatccccattttatagaagaaaaaaagaggtgtccagagaggttaagtgagttgttcatagatgcagagctacagccaacaaatggcagctcaggaccagacctggatatcctgcttcccagtttgccctctctcagaaaagtgtctttcttgtttgtcatgcacaccctgtattttaggcatcctcgtgcttacagggctgtagttggggttgtatgaaacagttaaactggcactgcccttgccttctggcagcacataatcaaagtaaagtaaaaagtttttggagtttatgcctatacaggaaactgttttcttctgttaatattacctcttcatcccaggggtgggggagcctggtgggctgccgtctatggggtcgcacagagttggacatgactgaagtgacttagcagcagcagcccatgccaaatcctgcaaacttaaggaga

SEQ ID NO: 47382 - DNA, 1161 bp, Bovine  19866881199424
tcaactaggacttggatccttcccactgagtgtgtgaaagtgctagtcgctcagttgtgtccaattctttgggaccccatggactgtagtctgccaggctcctctgtccatggaatcctccaggcaagaaaatggtgtgggtggtgtggatagccattctcttccccaggggatcttgccaacctgtctgtcctgcactgcaggcagattctttaccatctgagccatcagacactatagaaagagggtgatgaaagacagaagctccccagctatagcagaaagagagagaaaggcaaggctgtgctaggaatccatctcttgctttttcttcatataaagactgtcatggtgatggacgattggtggcgtgaccactgtgcttccttatgaagatgctggaaggagcacagaggaaacactggtgggaaatcttcactttaggatgcaacacacctctgttcctcacagaagagttgagaaacatcagaaacactccctgacccagggtctctcaaaccttagtcacttaccactgtcatcatttttgttctatgcaagtaacagctgtatttgttcttctttgatatttttctataaatacatctacatgttttgacctaatactagagcttaacaccaagtgttcagtatataagcaattatttttctggatacaacaaaatagcctcagttttgtgctgtattttgtggcctgaaagtgcattttttcactatgatatttctttgaatacttaggttcttggggaatgacatcactctgaacagaaactggggaaacgctttgtacaaaattttttaatgtggttaaaatttggggaaaaaacagattcttccaattaatgatagctttggaagaaagtggtatacccgaaacctctcctctcccccaagcctggctgagcaagcagggaaagaggtgactttcattcagaaaatgaagtacagcaagaataatgtgaatttgctcaaaataataaggaaaggaaaacatttcttaaaggcaaaaataatacaagtcaatttgtatgtctctaaaaaaaaaacttggccaaggtaaaacattgtagctatttcagattcttgctgaagattcttcattcctagcaaggtgagtcacaggaagggaatttacaggta

SEQ ID NO: 47383 - DNA, 1546 bp, Bovine  19866881222375
atgttattatggaaatagtatagaggtttttatggtccccctttggtttaaaaatattatcagtgttgagcctggtaggctgtagtccatggggtcgctaggagtcggacacaaattgagcgacttcactttcacttttcactttcatgcattggagaaggaaatggcaacccactccagtgttcttgcctggagaatcccagggacagggtagcctggtgggctgccatctctggggtcgcagagagttggacacgactgaagcgacttagcagcagcagcatagaattatataggttttttttttttttctttactgtactactttctcttaaatacattataactattgtgatttttaactgagtcccctgaattcaatgggctggtgtggatattagccagatttacttatagatgttgaatgtggagggattggttagagggaggggagagaaagagaaggaatgagacagaaacagacattggatatgaggccctatgagatctttcagacttgacataaaaccatccttactgaatctcaaaggtgcattatgtgatttacttgagtttcaaagtagctttgcttctctgtcctgccctatctccagtgctctgtcaatgatgcaaatgggttctgttagactgataattttgagaagaggacctctgtagggttttatttttttttgcatattcattttcccttgcttctatcccaaatttattttagcattggcacacttagcagccctatggacatgaaataagttgcctggctattttctgtgtttacctctttgcattttgacatttggttatgaatcctaacctatagcattcttttgccccttgtcactttatggacttaagaaaatcagtaagaggcttttgaagatatgaaaaggtttgtgactattttacaacttaatattacccaggaatggttgtgggatgtccactgacctataataagaatggtttcatgaaatatgtacaatgaatcttccttaatagataaactattctctaatttatttaaaatccaatgacctacatattcatgtgttcagaaatcccccatttactagcatcgtttctcctttgagaccttccatttgagcaaatctgttaaatgaagtagagaggaagctttgatccaaactaggctaaatccattggaacaaatgccctgccacatgtgaatgggagcattagaatgccagcaaagggaaatgaagggttattctctgtccctctctgcacctctatccccttacccctctatccccttcaaaggtggggttcaggaaacagccatgcacatggaattggcaataaaaagtttgtatcatttgaacgaaacttttgccacattcacttttggcgaagtgcagttatttttcttttttctctagcagattatatgccataactgggaaagttcagactcattttgtgtccaggtagctcttctgagtcagttcttagaagcatgttttcattagaagtctatgtgtattttgcaaaatgtgttagtctt

SEQ ID NO: 47384 - DNA, 1322 bp, Bovine  19866881262486
tactaattagtttaatttgcaataacacaaagcacttaactctccaaataatctaagttagtgagtcagtttttatattatgacaatgacatgtttaagagactccagagcactgcttttttgacctttgacacacatttctgataaaggagcacatcaaaagatgtttcgttttccttctgcatgattctttcatctgtttcggtgccaattatttgatcagtgagacggtttggtagccttccataacagaaaagcatctgagactgatatcttaagaggcatacattagccaaaggattatatttgcaaaaagaaactattactattccaagcggtgactcttcttagatcactaaatcccttagaattcgtgtgttcacatttaattttatccatttcctcccctttgccctcttttggggcttgtctgcttgggagaggtgagctcagctggtgagttccactttcttctcttattccatctcttctctgttcccaggctctgcggctactaccatttctgccccttcccctgacagacaaatgtttaatgtctctctctcctttccctttcccctacatttggtagcaacatccctttcagaagcctgagagggaaaggctctcaaaaacattctcctccctgttaaattatcttcatctggggtgtccccggtccctccagcttgggagttggacatcctttcgtgtttctctggagttgttccttcctttgtgtcctattcattttcatttcacacaagaccaggggtttgtgaagcacaggaacaattccggacctgaatggaatcctcgcctgattatctgtttagatcaggagaggcaatctcgatgaactgaaattcctgctcttgggcccctgggctacaaatggctttatataagggcttgctattttcatcagagcctcaatttctcagtcatgttctttttttaaaaaatttcattataaagcttaaccctggtctgtgaagtctgttaagacttcagaaagaaaagtactaggaatttctgctgttattcaaatgggagaaaacttgtctggcctcttggagaaattttattcatagccacccaggtttgaactcaagatagcgattttcaaaggaagggttagattttaagttcccctttcccccccaattgtggttctgaggtaaaagcaaaatgttactctcttctggaagatttaatcctagtcaatgagagctaaatttaagatcaaacatcaaatggctgctaagtcttgttttttaaatcaattactggagaaataagcacacgttttacaagtttaa

SEQ ID NO: 47385 - DNA, 1276 bp, Bovine  19866881262834
tgtttcaggtttaaaatttactcaaacacagcaaaatattttgagtgtatacatatttccttgtagggtagaaattgccatgctaaatatcaaatcttgaaatatcaattattgaaattgttcacaatggttaagggcaagcaaccgttcaatggtgtgtccttttactaaaatgattgttaagtaactgtccagcctttaagacccttatagtgaaaatatagaactatttatggaattcatgtttgaaatttccaagagtatttggacttatttggagctcaagtttatataataaaaacacattcttaacaatttatttaactaaatttggagctccaagctttcaatggatgtatgaatcataggagccttgccagatgttttggagtgtggaattcaaaacgcattagcagcatggcacgtcatgaagtttgatgcaaaacatttcttctctctttccaaaaagccttgtttggcttctattgtaaggcatgaactatggtgacagttcatagctctagggagacatctaaaatccttaagtagtatctacccagacagtggaagcatgaggcaattatctacacaatcagtgtcataaaaaagcttgcccacctggccatatccagaaaactaagtccaaaatgtatttacctgttaaagtttatttcgtttttttatacctaatattcagtagacaatcttttgttccttcctccattttcatccgctcacatcaatggatgaccttctctattatttacaaagaaaacacaattaactagaaaaatcttctggagagtcccatagttctaccaacacagctgtcagaatctctatttctctggatactgctataccatttataccttcttttacttatcctttgcctttgaatcttttctctcagcttgtaattttgtcccagtattcaagatcgagggcaagaagagaaggggtgacagaggatgagatgttggatggcatcactgattcagtggacatgagtttgagcaaactcagggagatagtgaaggacagggaagcctggtgtgttgcagttcatgcagtcacaaagagtcaaacacaatttagtgattgaacaacaacagcaacagtatttaatagcatcaaatttgatatgaaatagtgggcttttaataaaagtataagatgaaggctttattctcaagcattttagaaaaacaaatataacacattcaagtatcttcttttgatactgtgatcccttgaagatgtcatttgttttccc

SEQ ID NO: 47386 - DNA, 1298 bp, Bovine  19866881266418
cccttcttgttagagaatagtgacattgtaaaaccatcatcgaaaggcatgttttttttttttttgtaaaaataaaaggccctgaattttatttatttaggccatacccatagcttatgggatcttagttccccaaccagggattgaacccttgcccttggcaatgagcatgcagagaattcagggaattccccttgaattctctgtaactcagatggtaaagagtctgcctgcaatgcgggagatctgggttcaatctctgggtttggaagatcccctggggaagggaacagataccctactccagtattctggcctgcagaattggggtcccagagctgctgctgctgctaagtcacttcagtcgtgtctgactctgtgcaacctcatagacagcagcccaccaggctcctctgttcctgggattctccaggcaagaacactggagtatgttgccatttccttctccaatgcatgaaagtgaaaagtaaaagtgaagtcgttcagtcgtgtctgactcttagcgaccccatggacttcagcctaccaggctcctccatccatgggattttccaggcaagagtactggagtggggtgccatcgccttctctgggggtcccagagagttggacacaattgagcggttctcactttctttcactttgtaacagttcagtaactattttttaaggatttttcacactgatcagggatgaaaggaatagaacactgtactatcatatctgtatcctctgattctttggtacaagttttgtgaaggaggtggataaaaggagcctttatattttcttttacatgaaatgttctgtttcaactagatttaggagtgggaatacgctagtatactgaatcaaatttctctttacccagagcacaaacagacccagcttatcccccatgctttttgcccaaaattgcctaaaaggtgctaattaacgatagtctttatatgtaaggagggactaaattgagaccactatcctgagggccatccttaagtcactgaataactttgagacactgctgtcttgggagatattaatattattataatctttaaatctatgaattcaagccagtgattctgaaatgaaagagtacctattttatgaagcttgcaggaccctcttttcctactttattaatttaatgttgaaatcaaaagagggcatattatttgcttcaaaactcaataacatgttcatgcctgatctgtggcatttcatatttacagcccatctttcagtggctggatttcctttttctcacaggttcc

SEQ ID NO: 47387 - DNA, 2127 bp, Bovine  19866881278763
atttaatataaataaataaataaataaaaaccctgtacattcaaaaagtctttttaaatattttgcctccatctttttttttcctgcaaagtcaatttctacttatttttgctgtagtgcagagacagaaaatataatctgcacattagcacttgatgcacttgaaaccttactatattaggaaaatctgaaattttatctgcctaaagtaaatagttcttactaaaataccatttttctctttttctgcttttctttattggcaattctatcaaaataatgaataaggggaaaaaactgtaccaccagaggtaattaaataaagaacaataagcagctttgggtttataactagcaagggtatgtgtcaggctgttcggtcaaatgttgctgggaaacattatctgggaagactttatgggaagaagatgacttccaaagaaggctcaagtttataatggaaaagttaaatatgagctttttaatagttggcaaaaatacttcaacacaacacaatactatttcaagcttctcatgaattatgttatgttacagggataatgaaagacatgcttacttacggcttttattgacaagttccatgatctatttccatgtgccaaagactcagcacagtttcacctcacagatgaccatggttcctctaatgcagggtctgtatcttcaaatagatttacaaaatgaaccaaccctcccaaattttttctaagggttggagaactggttcctggaccttcctttaggtctgccacaactcatgttacacggagaaagctctttttgtatttttcacctatagctctttttgtgttgttaaagtcagtttctacttactttggccttggtaaagatactgaaaatttgatctgtgcattagcactttatgcattactatattaggacaatctgaaattttatttggctaaaataaatcatcctaattccatttacttacttctcctcaaataccctattacacaagcctcgaattatctttttttttaatttttttatttttcgaattatctttattataaccttttaggcctctttacggagaaggcaatggcaccccactccaatactcttgcctggaaaatcccatggacagaggagcccggtaggctcccgtccgtggggtcgctaagagtcagacatgactgagcgacttcactttcacttttcactttcatgcattggagaaggaaatgggcaacccactccagtgttcttgcctggagaatcccagggacagaggagcctggtgggctgtcatctatggggtcgcacagagtcggacacgactgaagagacttagcagcagcagcagcagcagtcctctttaaccttttcatgtccttctcagttgtgtttctaaaatttaagtacaattatttgttaaggtcccagaaggagacagttaatattcttaaggctcctatagactgccttttcacgtaaataactcagacttgatacagtttgttttcttatgacaaacccttgtttatgatggttcctcctctggagccttgagaaggagtctggcctgcccacaccttggtctaggcccaatgaaacgcctccagaaccatgagagaataaatttctgttgtttaaaaacagaaatgaacaaacattttgtttaaaaagtggggatttaccttctagttaaaaatggcagactgagcacagacatctacctcccctttcttccaaagatccctttgaaatgacagtaaaggctttttgttttgttttgtttttttaataaaagtggaacaatgctgggaaccatctgtcagtcaaaaatgttgaggaattcctagaatactgaaaacatatgtgatcggaatagacagagaaagagcagaggaaaccacagcccaagatatcagaagtaaataaaggccatccacaggaatcccagaaatctccaagttcaaagtcactgaacgcaaagggtatggcaggccagttaccaggttaattctttaaaagagcatccctctcccactcccactgtaaagtagttggcaatgaaagctttcgcccttaagctaaagccagaatattccattccaaagatgtgatttgtgcccaaag

SEQ ID NO: 47388 - DNA, 1894 bp, Bovine  19866881286704
ataacaacagttcgtgtgtgtgtgtgtgtgtaggtgtgtgtgcgtgcatgcgtgtgcgtgctcagtcatgcccatctctttgcgaccccgtggactgttgcccaccagacttctctgtccatgggattttccaggcaaggatactggactgggttgccttttcccactgtagataacaacagtatttttacctatttactgtttctagaatctgctcccaaaccatattgtccaccttctgaaaatctgaaagctttgttacttcagtctcctgacatatcttagggtctccttgattcagtgatgacctccaagtcacccacaatcatgcctacaagttcccttagaatcctggggtgcaagtcctctggggatggaatgtaggattcatttaagcatcccattctttctggaaatttgtgtatcctttcaacccatgctggacttaagttttgaagataattttccttgattgaaacacttctcttatctactagcattataccatcatctccagtattattcattttactttcttgttcacatctgtgatctgaacagaattgaaatgataggttttattgcctttgtcacttttgtaagctttggcttatcagtgcattaacgattctgacaattttcttatacatttcacaattcgcgtccttggttatatgaccttcctttccattatatatgtattcttccaaaacctaaactcatcggaaagtttctgggcagtcttactgacgtctttatctccacatttattcatcataatgtagtcagaatttcatttttagaactctcgtctctcttatgccatattctctttccgagtttctctttataaaaccatatttgaactttctctaagctgcttttcaaacttttttttactcctaaagcattgggtacatgcctgactttgatcaaaaatctacgtcttagatattagcagttccaagatggcatgatcacgttcctgcagtccctactgcttttctgtttcctgaaaatgaaagatttaaaggaatagtatacattgtcaagataattaggctcagtaatttatatcagtgagtagctttgtagaaagggtttgcttggtcctgattgcttagttttattctgtaacacaaagtgagagctgtcaatttggggttttgcccttagagaaatgcaacatgactggtccggcaacttcagccatagcttcatttgaaaagctttagagtctacatgcgcattgtataagagcatacatactacacacatagctcattgaaatcaagactccaaagtacctcaacatgcttctccagggccctgtaattcatgaccacaatgagcagaacagcagtgttccttgtttattccatctgagtaacccaatagtagtaaaattgaaacttcataaacaagaagacattgaattctttaacaaattcaactatgttgtgaaaaagcccaaatgagtttttcaatgcagacgttttgtcgagacgcttaatttgtttgtcagacccaaaatgtgggagtttcaacaattgttatttattttccatgtggaacatgacaacataacaacttacactgttagcattttgtcctagtcttctctgttagaggttttgtttgaattctcaattgaaacgatgatatgtgtgatagctaaagagtgtaagtcagtcaagatatttaacatctatgagatgggggtttgcctgagaaagtccactggtgtaaaggaagaaaatagaactttaatttatattcatttttaatctcttcaattttcattctgtagatattttataacatatataatatagtaacatacttataaatatattaatagatgcatataaatatatcacaggtgttataattt

SEQ ID NO: 47389 - DNA, 1833 bp, Bovine  19866881356230
aaagaaaggctgcgaatatattcaaagagatatcaacttcaaaataaagcccaacacctccttgcccagtaacaaagcgcaataaggatatatgttgtttttctgccttagagatggaaaattttaaaaacacaaggacaaaatggtaccatgacaaagactgactaagaaagataaagcagctcttcttaaactgctcagtgttcaaatagattttgaaggcctcaatgaaaaccagctgggagccatgtgtaaaatataatggcttttgcctgcagggaaggaagtgagatcctgaatgattaagtttaggaaagtatataattcactgtatcattatggggtgaactggattacttataatatgccaagactttgtggtcttttttatatagagaaaatgagaaattattaaggaggtgactatagagggtggttgatctagtggggtaataggtaatgggttaaaatgggctcccagatggccgcatccctctctctctgacaagcctcacccgcaggagtgagagtgtcgccagagcttcatgttgtccatggtggtgaacatcaataggagatgacttctaactgcatttgagtcaataacagaattctttttacttgtttaattttacctcatttaaaataacagaatgttgacaaaaataacagaaggtaaaatagtttatccaaagaaggaaagcattcttctactaaaaattctgagaaagtatacttaacaggcaataagaaaaactggttagaacaactggaaagccctcatgcataactcaattagaatttgttaaatgaatgagtcagtgctgctatttttaaagtatactatatataaaaaatataactgagatatttgtcttaaatttcaaattttcccttttttttcaaaatcagcatctaagacttttaattttggctcaaaactcaatgggggagaatttagcattagtaattaataattaatgtaactatcatacgtctctctcatctgttggactgtgagctacacattggcacacctaagtgctcagtgcatctttcttctgctgtactagattaatccatattctctcttcctttaattgcaggccagttactatttttgttctgtgcaacttactttttcttgctattattcatctttagcaaaactatgctttaaagtaaagaaaccattactcattacaggaacttatacctaacaatttgtttgtctttaccattttgtgtgtgtgtgtgtgttaaaatcagctccagggcactgcataatccttaaggttgcttttatataaaagttgttagcaggagttgtgaggttacaaagttctggttttgcatccagtcttcatcctaaaaagcacatctgcttactagctgtgcaactctgaacaagttactttctcagaaccacagtgtttattaatctataaaatcttccttgcagttttataaggattaagagagataacacacttctgtgacatacctaagtaaaatggttctcatgagaaagaagtgaaatgaaagtcactcagtaatgtccaactctttgcaaccccatggactgtagtctgccaggctcctctgttcatggaattctccagacaaaaatactggggtacatagccattcccttctccaggggatcttcccaacccatggatagaaccctgggtgtcttgcattgcaggcagattctttactgtctgagcaaagagcatttgtgcaactgtgtgagttgagagctgaactagcacctttgtaatgaaataaatatcatttttatttgaaataacaaccaacaggcatactata

SEQ ID NO: 47390 - DNA, 2115 bp, Bovine  19866881366790
cctgtatggaagagtttattctcttagtgttgtgtgtctgttagaggaacactgctatgtgaagttaatcgagaggatgtcttcttttagacaaactctccaaccatctcactcacaagcattctgatttgtgtttaagtattatactgatgtgtgtgtgtaggttaaaaatcattcaactccacacaagactgcaaggttgtactgtttcttttttattcttctgttgatgtttgtttgaatttgtgtattggaattcacatctatggggcatattttaggttataaattcttagaggacagaaattgttactctctgattaactttgtatatcttctcatttgggtctatgtatatacaaaagcttaatgttttcaatctgttgaaaaattaccaggcctgggatttttcaagggtaaaactgtattccatgatatttttatttaaatttggaattcatccagattgattctttcacagagttgccctaatgtgagattatatatacaggagaatgaaagcaaaatgctctcattttaccaacatgtaagacagagcagaggggagatgattcacatttaatgtgcatctgctgtgggtcaggtaatctaactgttttggacaggtttcctcggtgactattcacaaggtaagcagtaaaggataatgacgtgtatctgaaagattatgttgcttgttgtttagttgctcaatcatgcaactaaccatggactgcagtcaaccccatggactgcagtctaccaggctcctctgtccatgggattctccaggcaagaatactggagtgggttgccatttccttctccactgaaagatcatagtattcaaaatagacttacctgaatttgaattcctgttctactaggctgtgtaatcttgagaattttacttaacttctctgaaagctgtcaattataataccccataacatcattatataaatttcaagtggattttattgttgtcatggtaagagttgctatattcatttgataaagacactgaagacagtagcattacatgatttacccatcatcccactggaaatgcttggcaggttttctattccaagtcttataaaaatgtaagagcttaatagtacttaaaaggctgtaattaacttgggctgtgggtgtgatcatgcagagaagtgttcttagcactgaaggaggagcagtcatgacatcagagtggcatcagaattagagaagtgagactagggtgctgctatttacattagttaagatgagatttggtcattagtgaaagaagacccaaaacaacggtggatttaaaaagatagaagtatgcttcttcctcatataaatgaagtcagtctagtgttgatatgctagctcaaaaatgactggggacgtaggctctctctgttgtatgttctgccacttaaaacacccagctcccacctcgtgttttagcatgattgctccctgtccagtaagcccatctacgttctgctgcattctagagggaaggagtacaaatgaaggagaaggtgtgctctcgcccttttagaacactcccggagtgttgtgaccacaacataagttctgcttctattctgttggccacaatgtggtcacatgactatagtagctgtaagaaactgtggtcatgaactaactggagaatcttgtgactggaaaatggaagggcatggatgtcaaaggacagcaccacttatttatgggttttgtgtttgcaaaactagtttgtacaaagctatttcttctctactagtttctatgctttcaatttgattaagaaactattttcactaaggagagattacagggtttcaactacagatacaatttattcaaaggaacatattaaatcttctacaaattataattttttattagtaataagatgttatcaaaacagcctaattttaatgataaagttttacacttaataagtatgatacatagtaaggactatttaaggaaatgaatgaataattaatacttattttagtaagatttaactattctttctatatttaatctaaacttgtagctatccttgagtagatcaacgttaacttgctagactgtaatcaaaagccattt

SEQ ID NO: 47391 - DNA, 800 bp, Bovine  19866881432883
taggcattttgtagtagcataattcagaaccagatgaggggagattaaaagtgcacaacactatgttagacagagaagtgaaataatcataacactaatcacaaatccattttataccagtaggagcttcccaagtgcctttgtggaatgatctccctgtgcttacttaggtgtgtttctttgttcctgtgtttgtttaaacatataagtttgtcacatcctgttatcaatcataatagccacagtgagaaattcagtttatgaaacagaaagccttgaccctaattaacaaccaggtgagtgaagctacctttgagcttagaaatggtatatatcagcatatcatcagtcaaactctacttattatctggagactacgactagcttataatcatatactttcccaacttttggcaaaagcactggaattctggctgtatttgccaatagacctaaatgctggaaaggcaatgccagtgtttgaatggtttaagagctgtgatagagtcactttaatgggtgctgcccagcctttacacagagatagggtttatacaagttagtcaatccaaattacatgattcttagaaataagtggataaaaattattccctgtcataactggggatagcaaggtgtttgtaagattgttgagcaattcacaatacagctacataccaggatttgattctttacatcagcaatctctgctctgagttccttttaatcctgataaatttatcagagaaatcattcatttattcatacatgcaaacagcagctgcttttaggaaagtctg

SEQ ID NO: 47392 - DNA, 725 bp, Bovine  19866881477776
ctgatattttctattcttgtttaaaatgctggtagacacatgcaaaattgatttcatgaactactaatggattacaaagctcttcctttaaatttttttaaatttatttatttgaatttattttcaaatacatacccgtacacacacacatttttgcatatactgtgtcaatatgtacaagggttatatgtccattcaccccaggcaaatgagtttgaaaggtactgttctaaatcagtgctgaattctcttccccagtccttccttagaaacatctggtatgtcctgtggctgcagaccatctcatcaggtccccaagcccatttgtagcctgaaggcagatcttatttctgcacaaatggcaggatttctgcacatattattgatggagaggtctgtcttgatcgaggcatccagaagatcagcagatatttccttttctggaaaaatactccagggcaaggaggggcaggggatgaggtttttttttttaactaatttggatggcaactcttcttttccccttcttttttgagcatggcttataaatataattgttctagtatttctcaagcatcatgggggtggaacttaatacaattctgttttattaaccaatttccccttttcttgttaattgtactttaaaaatgactatgtgtaagaacgtctttcccagatgggctgccggggaaaagagcattatttcatcatttaattcagca

SEQ ID NO: 47393 - DNA, 844 bp, Bovine  19866881501604
tgattataagccttttaatttagataccaaaatatttgagtcgatttttggttgtattctgtgtaaacagacacctgattgacttcagtgtagattcaactctggtattttgctcacaacagccctagatactttggagaatttcaaaggatagatttctcttgtcactgtggggcctagtagaggaacatgcatgcacacacaaaacatattcaaaattattttttcaaatacacttattgagcatgtcttgtaagttccaggttatgtgagaaaatcaaaaggattaagacacaccccttctcaagctcagtttagtgcaggagacagatttctatatgggagtagaaggacattataagaaaacacagtagaataaaaattcaaggctaatttctatgtgctcttttaattactttgtttccacaagcgaaaattcctttggcctttattgtttaaatggtgaaacaaatactaaattctgcttgtccttgtaggtagctggtgagagctctccaagaggttatgtatcagtgcctttaggtttccttttgaagccaggtttaaagaaaaacatactagactatagatagtataaatgtttgagggtaactgaatacttcttttcaaattttcccttcctcattgttcctatcttctttccttctgaatggttgcttattatatatatttttatatatctatatatggagaagatgggcctgaaagcatattatgaagcataattacaagataccgcaaaagccacgagaaggacagaaagcttaaaagaaagaacaaagctaaaactaaatcttcatattttatatccagtaattcaagt

SEQ ID NO: 47394 - DNA, 1838 bp, Bovine  19866881503992
attccagatatgtgtatataaattaaaaaatttaaatagcatttaatggaagtagtatttttgatccaattattaaaattcaaggagtttatcttagaaaataacaatgaatgaagacaaagaactaagtttaatgatttaatagcagcataatttgtaacattaaaaatgtaaaactgtaaaacagagtaaattaaatatcaaatacagttgtgacatatttaattttcatgagaaaaatatctaatgacatggttagaatgctaagaattaatttaatgtgaaaataagtgtacataaaatagtacatataggatgactacaattttatagaacaactttaaaataagcgtaagtaaatataaaaacaaagcaaatgtcaacagacgttgtccatggatggtagaaatctgaatggtttttactgtgattttgtacttctctgtatgctttttacattgtatctacattataatttctaaaatgtcttttactaaaatcagttctaaaagcagaagaaaaacttatgcaagtattacaaatgtagcacgtaaaagatttttaaaaaggaattcacttgaactaaaccatgaattataagaaaaaatgatgacttgagcttaatgttggtttgatgaaagaatgcatataccaaacaaaatttatgtggaaagccatttaaagaacactgtcctttgaatgtattatgtgtgatcccaatctctacccttaagttcttctactaaaacaaatttactttcagagacatgagtttcaactaaaactaaattaaactaaaattaaaaaaaattattaagctaagacatcatgaaaagttcagcatgcaattaaaaaattgtcatatatctccctaatgtgcttgctgtaaatatttagaatgcaatgagaaatctgaaactttgtgccaaggagtcagttgtttcatactctgccacagtcttggtgtcactgcaagaatgtatcaccttctgaaaatagtccccaagatgtttaccttctgtgtttctgcttcacctgccctagcaacgcagtctctcctttctctttcattgtggttgtaagaggagttctaatcagccacaaagaattagcacttatggcaaatattctaattgtttgattccaaacaaatgctatgttttagggcctttgtaatgtttcctgcaacaaataaagcaataatctgttatgataatgtgaaatgtttttgattcgtcttttaaagaacactggttaagtgagttggataaaacaacattgtagaggctcaaaattatatcaggcttcatgcatgggcctgagaatctgtggataaactgacttgaggaaaacagctctgttccacagtcacacattttctttttaacatctggtcagtcatcttgtaaaggtgttacaagtaaaaaatgtcactgaatcagcagagattcatgcccatactcaaaataccttttttaaatgttcatttctgcatattatgtgttagacattcagagaaaccatgtcagttatagcaaaactaatgctgaaataaattaaaaataatattttacaatagtaacaaaattggtcccccaaaagggaaatcttcagaggtcagaaattctatataaatataaatcaatggaattagtggatcctggagctggcacttgactcatgggcatctgctttgttaatagtagaacactgggtaatatgggtcatatgaaggtgtagtaaattatattacaccagacactctctcataaagctaggcttatctaagaatgagactttcaagaaagtgtacttggaaggaaacattccttgaaaag

SEQ ID NO: 47395 - DNA, 1087 bp, Bovine  19866881605035
tgcatgaaaattacaactttctgaaagaagtccaaccacatgtggaagataataaaaatctagaagaagatgatttttatgacaccatggcctattactatgaaaaatatgataaggcaagttgaacaatattatggtcatagaaatattaggtaaaatagggatgggaactggaaaaatagaagtcctatattactgcacaaatatcttccataattagaaaatgtagcagaggaaaaaaagtacaatatcaaagtgaaaggtaaatagatttgtgtttgatcggcttgaaaattatcctcatcaccaaaagggtgtcttcaaatgtgaaatatagagatgattactttttactcaagtgtacatttttttatataacactttgaactcctcagtctccaccatctgtagaactcaatttccgtttcgtaaaaaaaattgctgacatctgtttaaaccctaatatctccacaaccatgtagaatgttaactcaggcttggtgtcatgttaaaccgttttaactttaaaataatattaaacttatggttctgtttcaactttgccatgatactagtatttaacccttcagatattctaaactgctcaccaaagaaaaaatcttggatggaaaaaatgaagtcaaatgtgaactcctcatctttacaggacactggagagatttgtctgctgctgctgctaagtcacttcagtcgtgtccgactctgtgtgaccccatagatggcagcccaccaggctccacagtccctgggattctccaggcaagaacactggagtgggttgccatttccttctccaatgcatgaaagtgaaaagtgaaagtgaagtcactcagtcgtgtctaactcttagcgacctcatggactccagcctaccaggctcctccatccatgggattttccaggcaagagtactggaatggggtgccattgccttctccgagagatttgtctaaaatctactaaaaatttggagtcttggaataatatgacagactgttggaaggccagtgacttgactaaaacacagaacagtcagacttaaagagatcttgtgctactgactgtg

SEQ ID NO: 47396 - DNA, 758 bp, Bovine  19866881654093
cccagcttcacaaagcaagtccgattttgtctctgtgccacgttgcattggcttttctaagcatatttgcttatcctgtgtaggtcgtcctcagaaactagacctgtaaagtcattatacttccaaatgtgaagctgcttaggggtggatttaatttaatagccgaaaactcagtgcaaaacaaacacacttacaactgacattatcagggaatcaatcattaacgctctcgactgctgttccaagaccctcaaattgccccagctatgatctgagagttctcattgactccttcccccgacctgaacctccaacatctagccaatcccacctgctgctgattatcccttttaaatagttgctgggttaatttccccctctccatcctactctcactgctgttatatagacctttatatgtataatctcttgcctgagttagtttacttcccaacaggcctccctgccacagccaacacaacgtcttgccaaggtcttcaaggcctctcacgaattccagacagctgggtgccctgtctgcagcgtgtgccccagccctgtctgtgctcctcgacagcagcctttcaggctgtgctccaatgactctaaaagctccagtcctcacacttgaactctaatctcaatgcctttgcctcccctgtcccctctgtctggaaagtgcctctagtgaggaattctggaagggacccagagcagcactacttccgggaaacctctgggtcccccagcccaccagg

SEQ ID NO: 47397 - DNA, 1418 bp, Bovine  19866880051529
tgtcagactttatttttctgggctccaaaatcactgcagatggtgactgcagccatgaacttaaaagacgcttactccttggaaggaaagttatgaccaacctagatagcatattcaaaagcagagacattgctttgccaacaaagtccgtctagtcaaggctatggtttttcctgtggtcatgtatggatgtgagagttggactgtgaagaaggctgagcgccgaagaactgatgcttttgaactgtggtattggagaagactcttgagactcccttggactgcaagaagatccaaccagtccattctgaaagagatcagccctgggatttctctggaaggaatgatgctaaagctgaaactccagtactttggccacctcatgcaaagagttgactcattggaaaagactctgatgctgggagggactgggggcaggaggagaaggggacgacagaggatgagatggctggatggcatcactgacttgatggacgtgagtctcagtgaactccgggagttggtgatggacagggaggcctggcgtgctgcgattcatggggtcgcaaagagtcggacatgactgagcgactgatctgatctgtcgtagtgaattctaataaaggagaaacaacaaattcactgagaacttagataatgagataatagagaaactattttttctaatatgtttagctcattttcttataattaagctacaagattattccttcacctacaaaatggataaattcttcatcagattgacttgttcgaaaagatagcttaaatggaatgaatttcccttaaatgtgattttctcgcaagattagattctaatatggaataatcctaaattgagagctctaattgaacagtgcaggaatcaagcgtgaggcaaagatattatccgtttacaaatgtcaatcaatgaagagccatgcattggtggaaacatttctatcagaattttctaatttatctcattgaaaactatacatgttttaaattaacaaagtaagtactatttaaccaataaacaaacatcatttatataaatcaatataaacacttaaatatatataagaaaaataaaatcatatatagtttaacttattaataaaataaaatgttttatgaaataaaaaaaaaagagacacccattggggcatcggagggctctcagaacatcatgcaatggggaatgatcataaatgacattgagtgtctgctgtgtgtcaggcagcccagcctcctcgaagcctcatgcctgcaccagatgtagattttccattcacagtgagggaattctctagccagcaagccagcattcccatctgctcttcgaagcatccttttctcaggatgtgaggacctgcacagcagcctctgtcatcagcgtgcatcccagcaaaggg

SEQ ID NO: 47398 - DNA, 1190 bp, Bovine  19866880142219
atcaaagctatggtttttccagtagtcatgtttagatgtgagagttggactctacagaaagctgagtgctgaagaattgatgcttttgaactgtggtgttggagaagactcttgagagtcccttggactgcaaggagatccaaccagtccatcctaaaggagatcagtcctgaatatgcattggaaggactgatgctgaagctgaaatgccaatactttggccccctgatgcaaagaattgactcattggaaaagaccctgatgctggggaagattgaagatgggatgagaaggggacaacagaggatgagatgattggatggcatcaccgactcagtggacatgagtttgagtaagctccgggagttggtgatggacagggaggcctggcgtgctgcagtccatggggtcacaaagagttggacacaactgagcaactgaactgaactgaacagaggttgtcaggaaggtttcccagagggagtgacatatagagtgagaccaccaagtagaagctagtttagcaatgagcggaaggaacagtgtctgagaaagccaggggccatcagagaatcactgtgaaggtcaaagtgataaactgacacactaacacagtctgtggccaggactcagtccagggttcctttgcttctttcagtctctccctttgttcttcccagccctacttccttcccattaatgttctttatcctacaatacactgtgttgaaggacaacagtcaatccttcaacttttaataattatctggaagaactcctccctgtcacccatcagctagtgaactcttcaaatctcctcttctcaggctagtactagccagcctcttgctcccttgctgcattgcctcactacagcggcagtggaggggggatgtcttgcacccttgtctgcatgatttgatcagtgtattctccacaatcctccaccttccggaacacgaagacaaaatgcatcctcctcagacacttgatttgttttgagaaagctcagtacccccccaactgagaaccacaatggatgtgtttgataaataaccacttagagttaccataaatcctcttctttgagagagactgttagtgttaagatagagtttaaagtttgacatttccctgaggtcggagaaggtcacagacatgtaccatattcagtaagatttaagttcatg

SEQ ID NO: 47399 - DNA, 1049 bp, Bovine  19866880168367
gttctcgtagaaatgtactgaagtataatctgcatgaagcccgagcctcatttcaagttatctgttaattacatacccctctttttcagtgcctctgtgattgtggcaatggtctggttcattttatcccattgctcaacagattttaattgcagctgctgcagcagacaccttgaggtgcttttcctatagagaccgtggcagcctgctgctgctgctgctgctgctgctgctgctgctgctaagtcacttcagtcgtgtccgactctgtgcgaccccatagatggcagcccaccaggctcccccgtccctgggattctccaggcaagaacactggagtgggttgccatttctttctccaatgcatgaagtgaaaagtgaaagtgaagtcgctctgtcatgccaactcttagcaaccccatggactatagcctaccaggctcctccgtccatgggattttccaggcaagagtactggagtgaggtgccattgccttctcctggcagcctgctagactggcccaatgatgattaacttcaatgacttgaatcgctgaggaagagggaagctgcttccattttaattatgtctacaggagtacagcacttttaccccagttcattgtcctgaaacaaaagacttcctgaaaggaagattaaaaaacccaaagtgtggtggtctttacttacaaagatcttttttcagtccattcagagccacaacttagctctatattgggaactcttggcaagccattggggtttgcaagcagatcagaagatagaaagaaagcatcattcagtttattttacttgggcaattaaaatgcattgagctggtccagatatgaaatagcatctcgccatagtatgtgttctgcataaaaggaactctgacatgcagtgtttttttattgtcccatagagacagagccaaagacagcccaagctggtttcttctctctccttttccatttggatacatagtctcttccagcaaagctcagctcagttgccacttcctctgccttgcccgctctgcagtaaga

SEQ ID NO: 47400 - DNA, 2133 bp, Bovine  19866880426602
caggaggtgctcaataaatgttagagagtgagcagacaagaatggcagaacagtgttcatggagggattcaggggaagaagaggctggtcagtgactctggtaagggacagagggagactttagtgctctgatcaggattctggacttgatctggaaggtgatggagggcccccttcaagtttgatgtgtaagtggtgttgctcagctgtgtatgaggacagcaattcttatgccagtgtgaggaagatcacagggaggagctaggggaacagtacaaggttcctgcaacagtgagacaagaagtgtccgtgaataaggcagcaaatgtaaagctagtgaaggaaagaagagacagacctcgcaaatgatgatgatgttggagaggtagctgcagttgaacttggcccatctgagatggtagagtgcagtactcagatcgcagatgcttctgtttaaattccagctctgtcacttaccctgtgaccttgagcaagttacttaacctctcggtaccttgaagtcctcctcagtatcctgtccatggggttgctctgaggattaaataagtatttgtaatgtacccagagcagggcttggtgctgggctgttactactgcctaccaccaatcattgttttatgaagttgaactccccaaatggtttaccaagtgactgtctccttcagagtaaggcaacccacatctcagaccctcccaggaggtgacaagtgagtgtcgtaaatctagtaacaaagctatggaaagagaggatcacttcaagggacaaacttttatcagacttaagggcataggacttccctctgatggggtctgtaaacatctattcacagaggctttttctttcagtcagtcactaccttgctataacagtttgcagtactgtagcatgccagggaaactaagtgccgggtcattcatttgcagggagaaagctagtaagaatgcctggaaaacctgtaatttagaaatgttcaaatctttgcatccaaataaaaaagaaacggtgtcaggtttgtgccaaaaggaaagtcataattgctcagtgcttcccttcccagccctcctgggcaacggaacataatcagctaagtgggcttcagaactgtcatctacagaaactgagcagactgtgccacttatactactgagccaccttctcccaggaatattacccaaacagagtaaggcaaaagcccatttttccaagtgagggctctgcaacaaagttagcatctcctctttcatatttcctgaattctgatgccagattgaagcatccttactaacttttttagtgaactttcctcccagcatgtcagtccagagtttaatactcactaatggctcccttactccttttgaatcaagatcaacctctttatcttgatactgaagaacttctatgatttagcagtggatcttggcccacaaagaccttctaatttcaccaagtctgtctgtttactgtcacccagaagtaccatatttactctccgctccaacttctcagagcagttttctccctgtccacccccttcacttggaatgacctcttcccttctgtccatttacccaaaccctactactttcttcaacatatcaactaacctttctaaggacttctggtgctcccattattacattcttcatgcatctactttctgactaaccaagtttaatttgtccccagttcatgtctgttttagattcattaacttttgcatacacatttttatttataccacaactagatttcagcatagtgtcttggaagtcaggagccttgtttatactctgagactttctcagcgctggtcaactcggggtacctagtatatgtacaatggatactgattgggtgactggtttttccaacactaccttccatatgaaaaagaaggaaactttctcagctagacaacttgagtgtttctcaacttgagtcaaggcatcagtttgaatcctgtacttcccattatactaaaaaggaactataatagtattccccttaaaatcaggaataagcatgaatgccaccatttaatattgtactagaggtgacagataatcaactaaaacataaaaaggaacaaaggtatatttatacttccc

SEQ ID NO: 47401 - DNA, 1338 bp, Bovine  19866880545047
aaaactgctagtcccttggactgcaaggagatccaaccaggccatcctaaaggaaatcagtcctgggtgttcattgggaggactgatgctgagactgaaactccaatactttggccacctcatgggaagagttgactcattggaaaagaccctgattgctgggagggattgggggcaggaggagaaggggatgacagaggatgagatggctggatggcatcaccaactctatgcacatgagtttgggcgaactccaggagttggtgatggacagggaggcctggcgtgctgtgattcatggggttgcaaagagttggacacgactgagtgactgaactgaactgaactgaaaaagactaaagaaaccgttgcccaatctacattcataaggtttaattttatgttttcttcttagaattgcattgttttagctcttgtgtttatgtttttgatccattttgaattaatttttctacatgatttaagaaagggggtccaacttcatgtacattatttgacatgcttaaaaagattctgaaagggaatcacaggcttcaccagactgacaaggtggtccatagcacagaaaaagggaggcatctttgctctaaaatggactatacccttgtttctctggatctcagtttcttcccctgtaaaactcatggatggggttgaattgggaagtccctttcagttctgtggtgctcttaactatgtacaccttatggagatcaatgattcttttctcaagaaaatacctgtatatgacaccagctgcttctaagtttatttaaaaggaagccattgtctggcaatccagggagggctcagtcagagctctggaaagtgttttaaggggtagaggtgacacaataggggaaggaaatgttttctattgaaaagcagtcaattgccttcaacaagttgccaacaaactgggaaaaggctttttcttttttttttttttgctctggtttcagttgaatgccaactttcggaaggtaaaggggctagattaaagggtcacaaacacgaccaaatgagggaggaagtttttttctaggaagttagcaggagagatgccatacatgcaaataagatgccataactgaagtcattaaaggaaaatcaggaaaatacattcaaatctttgctttcacaattgtaaagggacttctacagttttacaatcgttcttccatattccttaccttaaaaaaaatgttttaaacatggtatgaagggtcttaagtatatattggttggggctttttcaaaattagttaattaattaattgattatgagataaattattggaattttttaaagcttta

SEQ ID NO: 47402 - DNA, 2085 bp, Bovine  19866880550533
tttaaatttgacattttagtacacatcttttgctcacagatttcaaggatttaaattaaaaaaatatcttcatgcttgttagcattcagctgctatttatagtttgttacagcatctctttttcagaaaggactattttattttcattcagtctccctattttaagtaagatgaaaaactgaataattgttatgaaaattaatagcaccaaagagtagaatgtctgccttccttgatgctgtgttgtaattggagatcgcatttttatgtttataattgtatttggaatgtactgtccctttcttaaggacataaatatttaactgcggggaaagggggccgactgcacagtcctagtacagtttaatatttaatcctttaaactgaaacatgtgggctgtttgttaggtcacagaagtaatttgacattgcagatttttgtgtcttgacattttagctgtggacttgacctggattggagaattgtggtcatgtgagaatgtatagtatatccttacttcctggaataagtacagagaccttgactatgtataaaacatgtttaatatacaaagtcccaattaaaaacagcacaacatcatttaattttttttcagttctgggtctgaagaagcccaggatttatttttatttgttacaacagagtatcttcaaataatgcatcagcaaggtgacaggtgagtgaccccatgtctgattggggaatatatctctgatcttattttcattttaaaatgtggatgtaaattgaagtctgagtggtttggccttgataaaaatacacacaattatagttgttctttgtatggcagtttttactgggtgtcttacgatatgtttactatctcaagtggaagtccaaacaaattttattttgtagtaaaaagtctttatttccaaaagattggttaaccagaaaaactgtaaaccacctaacacaagactttggtaagaaagagatttgacgttttgtataaattcccccttgtgcaaacaaaaaagagttaacacttacgtaacaagaaacatgttacccattcttattcattaaccagttgcctggttttaagtctccaaaatttggattaaaatttacccaaacaggaccaaacaagaacttgagatactagggttgcttgtccttagttacttagaaattgccactctgtggaactttgattttcatgggttgggaggaaggatgcatttagatagctgagagtaatgttggaaaagcaagcagattctatatcagggctttttcttttgtgcaaatagaaattaaacctcttatttatttatattttgtactgctttgtacaagggaggagaaagcagttcacttgaaggattaaaaaaataatgttggaaacaattcagacccccagaaagctcagcaatggagtagtggtccctccagaatgagggtgcaaaaggcatatctcttactgagtatgactgaaatggataacaattgtaaaaaaaaaaaagacccaaccttctgaacactgaattagtttaaaacacaaaagacagacccaatgagttttttattgaatagtctctctcgtagttaaaacagtacagattcaaggctgtagcatatatatatatatatataatgttgtgtttggaatatcctgaagtattcaatgcaaattcttaaagtagtgtattcaaagcattgtatgcatctcatccatggtacatatttggattaagcacgataaagaaggcctgcaacaagagcagaacagtgattttaacagtaaatgagtgagtagaaactgctgatggactcaagttggtaaaacgtccttttacactaatccttggtagtcagtctccctgaatttggtgtgcttgtgtgtggaagggaacggaaaaccatgaccctccctgtggtggtgtcagaggaccagacccttggtgtggagggctgatgtatgtacgtttgacttcccaccagatttttctgctaacttgattctgtgacattcctttctccctggatttgtcttggtctctgaaacactttttctctctacatataaaattttatga

SEQ ID NO: 47403 - DNA, 1544 bp, Bovine  19866880588893
cctctctggcactggctttgcatttgtgactttagaactgaaacctttcccttgaccctctccatctccccgctctgttcagaccttcattcccctgatttcaactatcccacttgcttctctgcatttgcctggctctcaaatgcacaagattgtgtttgcaggccatgaccttgtctctttgcaactaagatgatgaaaataaggactcgccatccagctatgttgtctcaggccagtttgggcaattcctccccattggatcgagccctcaggactcttctttctgtgaaaaatgtagtgagctagacaagcatttaggagagatttgtccccagtggggataggatatcattactcagaaaataggctgaggtcatctaaatgcagaaagaacaaaaaggtccatcacttctgaacataaatgtctaatgactgatactgataactgacagattgcaacgggattttcacagaacagtaaaatgctacttgcatgagaaagtatatgtgaggaaaaaaaaaacacatggagtttagagatcaactttttctcttagtaaatctgaatcaaacccgggtctcctgcattacagacagacgctttaccgtctaagccactaggggagcccacagtaaatctgaagaaaagtccaattaaagggggacatagtttagaataagtcatctgatgttagtttaatgctctttttttgaaatgtgcattttgttcctgagaaaacaattttacttcccttttcattttgaggagaggggcaaaaacttgggagcgtcattcctgtgttctagtgccaaaagaaaatggttggcatgagaaatgttatgaatttatgaaaaacaatagttttttcccctaattagaatgctgtgtttttcactattttcccccatcaccatgagagtacatgtacaaaaaaatggcatcttcgcatacaaccctttgaccagatttcataatttttgttctatgctaataagcagtctttactagtttcagtctttacaaataagtctgtaagtttctgaggcagcgaatatcagtaggtcttctctgtcctctgtctcttgacccctagctgaaaccctctattcacctaaaaaggtgaagctagaccctattctacagagcattttttccttatggtgccacataaaaccgtggggactccactctggccgaagagaccgagactggctgccgaccagttcagctggcttgagagacgccagcttccttgtcctctcacagacagtcccttctgtgctgacctttgactaattggcagggctctggagctctgaccctacttcctctctggccacactcttcttccccacattgttggtcctttttggaagtgggaagagcctgagggaaaaggtgctggggaaggggaaggtgtaagtcctgacattcaagctcctaaggatattttccccatccttgataaatggttactggtcatttaaatgggatgtcaacaaaagatttgcaaattagtggaaacatagagaattttagt

SEQ ID NO: 47404 - DNA, 1155 bp, Bovine  19866880619549
cctgccatgcaggagacataagagatttgggttcgatccctgggtcaggaagatcccctggaggagggcatggcaacccactccagtatccttgcctggagagtcccgtggacagaggaacctggtgtgctatatatagctcatagggtcgccaagagtcagacatggctgagcgactgagcacgcacagtgtatacttacaggatagcaatctttcaggaaaaaatacactaatattttaattgaattttttcaaaggtagttttgtaggtaatttttattgcttcttttatatttttctgcatttcccccagtgtcctatagtgatatatttatgcatcctttttataattgaaaacattttaataaaaaacacgtgcacaaattaattttcctacatacttttcttgtataaatttgcgatccataagttacctcctctggagtcagcaacaaagaaacaatggaacagctgacaaagcaggtaaaatcactttgattgtcatcaaaatgtgacctgtaatactctatgattatatccatctggtcagaccattttatttattaagagaatattttatactttataataaactttcatatacattatctcatgtattaattgctgagctattttaggtccttttatttatttattcatttttaactttttattttgtattgggatatagccaattaacactgttgtgaaagtttggagtgaactgcaaagggactcagtcatatatatgtatccattctcaccccccaatcccccctcatccaggctgccacatacactgatcagagttccatgtgctacacaataggtttctttatgtcattttaatctgaccatggagaaaaccttaacaatttcactgaaaactgaagtcagctttttcaacctctctttccttgcggtaagcaccctgcgctaaaaagggctgaagcccgagactccaaaggctagggtctgattgcctttctgctccctatcagcagtgtgcagtcacagcctgtgagtacttcattttcctggtcttcaaaacaaaggattcctaaggtttcgttgatctgcgttaggctgtgattctgagatgatatgtcagtcccttccgtgtcccatctgcgcagatcagtaacatcagtgcc

SEQ ID NO: 47405 - DNA, 1770 bp, Bovine  19866880649604
aagccctgatgcttctgggccccgagatctatgaagcctaaacggattctttacagatagataatactcttgttgacaatatttatttcagaagaaatgtattttatttcacagtgaaatgagtttattttcacagtgaactcacagataaagagttccttatgatcatattctatttccatcacagttaccttaattcagacccttgttgccttgccctgaaccacaaaactagctgcaaagtgtaccctttacctgcaacttctccaccatccaagatggaaatgggaagagtgtcctgaactgtatgccaaaattcaccttccaaaaatgtgggttttgatcacattgttgttgtttaatcactacgtcgtgtctgattctttgcgaccccgtggactgcagccctccaggctcctctgtccaggggattctccaggcaagaatactggactgggttaccatttcctcctccaggggatcttcctgacccagggattgaacccacgtctcctgcatgacaggttgattctttaccattgagccacctgggaagccctttgatcgtattgttcctcatgattataatcatcttgaaaccttcactggctccctttgtcaatagggtcaaatataagaaatgtggctgctgaagtcttctggatctaacctgactgccccaccaataatccttgtgtcgcatccctggtggcccaggtttgctgcaggatggagtgtgtgacagtgtctaagtttctaagggttgactacagtaaaacaccctatccaagggtaactaaagaggaaagaaccaatggggtaggttagacaataaggggctgtattgtctacctagtggttagggatcaggctccggggtcagacagcttggattcaaattctgactctaccatttacgagcaatgcgatgttggaccttctcatcttaagcactcatatgcccacaaaggcccacataagtgttagctttgattctataggcttgagttggaattgcgaaatgaacctcggaggtcaaacattagaatcaagttctcagggtctgagtaggggtggaaatggaagcaaggttaggagtctagctgagttgggatggcaaagggcagggaggcagtgagagggagggggtgatgggcaaaagacatggccaggattggagcttgtttttcggttagagcatgtggcataggtatgtagggcttgtttaaaggcatagagtcagaacaaatatcattcacaatttctcactacatccatgctctgctcttcctactagcccccaccaccaactttctctgaataccccattgcctatcggtccatccattgttatataacttatcattcctggaatgtttccccccatcccctgacctaccagcccaatcccatctgtcctccaagactcagaagaaaactctagtattctccacagccttgctaaagcctcattctacccttcccccaccagctagagcccaaccctccctggttcgtattcttctggcaatgattcttttcacaattcacttggcaattaatcacatactgtctcgtgatgtgcttactgttgttggcttaaacagataaaaatatcttctatgcctgtttaacttgtcacatgtgtctggcttgcctttctgaaggggagtccaaagaacaagccaggaatcactaaataggggagagctccttgaagaaagaagtaataataacaatcagagagaaagaatacacttttcaaactca

SEQ ID NO: 47406 - DNA, 1837 bp, Bovine  19866880666525
tttatgtatgaaatagtgagggaaaatctatacaaaatacaacataaaaataagcatatttcaggttacatacgcacacgctgccccacccccccgcccccaacacacacacacacacactgaagcaagcactgcagcttttgagtctaggccgtactgatttctgtacctacaacaaggctttgccttgatatgcattttgcagcttcacacacacacacacacacacccctgactatctttcaaagcttcttctacttgccgcaatggagaaaggttaaattttaagtattaataaacttgaaaactatcctcttaaccatccctaattctccaaaaaaaagaaacgaaatgaagtgaaaatgaaaaaaaaaaaaaagaaaactatgacaaccctaaatagtgtattaaaaagcagagacattactttgccaacaaaggtacatatagtcaaagctattgtttttccagtagtcatgtatggatgtgagagttggaccacaaagaatgctgagcactgaagaactgatgcttttgaattgtggtgctggagaagactcttgagagtcccctgaacagcaaagagatcaaagccaattctttacttccaacaccaagaatgactaaggtcaactcatcataagaggataaatttaaaaaacacattctgccactcaagaaaaaacccttccctggcaagaattttttctttaagcagtaccaagctttaaaaatatcagttatgtggccttaagacaaaagaacatcaccactgattactataagactgaaatatcaagggtattatatctgtttaagagagtactttgatctgacatccagaaatttcagtgatacagaaggcaaatgtgacaaattcttgaatggagacaaactatcttagccttttcattgattaacttaagaatatatgaaacaatgatttcaaagaatcaatgcacaaataggtatttcagaagataattgagaaaatgacttcaaaaatgaagaagaaaactttcccagacctgagaatgtttcattatttctcagggaaaactagtgaacagagaaatacttccagtcatatcctgacaaatgtttccatttccaatgataaaagaaggctacaagcatacaaacagaaaacaagttattcctgcagaatagaaacttgaggctagtgagctaaaagcaaagacatgaaagataagtaaagcaatatctccaactgtttcaatacaaaaatcttaggacccaataattttatactcattatttatcatccaaaagtaaaattttaatattaaaattaaatcttaaaaattaatgtaaggttaatctttaaattttaaaagtacttgaaagtgttctctaaataacaattcaaaataaaaaccagctgttcgtgaggattgcttgttaggactgaaattagttagaatggtaagaaatggcaaataaaagcaatagttcttaatgagaaaggagagggcaggatggttggatggcatcactgactcaatgaacataaatctgagcaagctccagaagatgaaggagacagaagcctggcaggctgcagtctatgggtcacaaagagttggacacaactgagccactgaacaacaatatttactattacaattataataacaaaatcaaatgcaaaagacaaaaaacaatctcttaaaacagtgcagtcacacacacttttggttactttaaagaccggagatccaaccagcccatcctaaaggatatcagtcctgggtgttcattggaaggattgatgctaaagccgaaactccaatactttggccacctgatgcgaaga

SEQ ID NO: 47407 - DNA, 1162 bp, Bovine  19866880723398
cggcttgcggccgcccggagaccgatccaggttgggaggaatgggagggacccttttcggatagaagggggcaagcccgccatcctgggattccccccaggcgctcaggttcctttggggtaagtcacagacctcaggcaggctccgacaggttaccactgggggcgtagggaaagagggcgcttatggtccccaaggggagtgcctagtagagaaaccgagttgaggtggggaggcgacgggtcccgcctttacccccatcccagtttagggtggacccttgagatgtccaagccgagctgcgacctggtaagtgccagtccccaccaaagtcatggggaagaagccttgatcactgtggctaggtctgtccttaacagcagcggggattcttgagccatgcagcaggcccttgcagtggctttttagggaggagcacgtacgtcgagcgctccctgggagcatcctagtcggtattaccgagtctgtcttcctcaagaaccatcttaataaagggaggagctaccgtcccatcgtccctgcacccttgccaaactaccagtgggtccacatctgtttctgcctcaggaagcatggaaaatctgttgtcgaaaagatcttcccacattgaaggctttccactgtaactgcatattgggggtggggggaatgggaggattaggagttcactccaagaccattgccaggtttggatcagttggccgtgagagaagccaaataagatgctatctgtgaattactgatgaaactagctacatgtgggaaacacggactcgaaagcgggaagaactgctgtacggaagggactgctctggaatctcaccaatcataactatcttagtgactgaactgtgtttccctcctccaaaactctcccttccacctcatgacaggcctgcatgtctcaaagagctaattccacatttttccagggagatgtgaaaccttactgtgtggtaaatcccacaaacaggcccatttttcaccaattaatctttgcccacagccaagaccatttttgtatatggtcatagttcacatgcatagcagaaatcacagtgaaattagcacaagaattggaccaagatgaaaaaagaccagaatttttgtctgcttcttagataaaggaaaaaatatgtaa

SEQ ID NO: 47408 - DNA, 1628 bp, Bovine  19866880770341
aaaatgtccatgacctcttcttttgattctgattgtgggtcagaatatatctgatcaagtatggaattgttaatgtattctgattttttgctatgtttgtgtatgtatgaaaaaaagactagagaaaaagaccaaaaactgaagctgagaatgtaaggaagttttctttataaaatttctgctaatgttgtggtagtgatttaatcagtgaaagaatactgccagaccaagtcaagtaggctttaattcatgttagtctattcaacagatagtgagtctgataaatactgtatgcccgatactctgtgagctgctggatatacaataatgaagaaaataaaaatagtctctttcttcatagagcttaaggtctggtgtaggaggcagtcaaacaactctaaacaaagaatatagaaatgcaaattaggataagtgctgtttctttaagatcaagtttatcgagatacagacaacactaaagctcacacattttacatgtatagttctgcgagtatcaacaggttcatacagtgatgtatgaataagtggtgaataagctgctttaagtggtgataatttacctgtgctgtttagtcttgcttatgtgtagttctctagtattaagtttatcccaaatttcttgcaggcactttctggttactgtggctttatggcagccaacctctatgctcgttccatatttggagaagatgcacttgcaaacgttagcattgaaaagccgatacaacagggaccagaggcccctgttactggccacataagaatccgtgcaaagagtcaggtaacggttgctttttttgagatggtctctgaactgaatacaaagagaaagaatctgtgtctctctcatttctatatatagtgtcctctggcatactagtgttttgtgcattgctagtgctcagttgctcacttgtgtctgactctttgcaaccccgtggactgtagcctgccaggctcctctgtccgtgtgattttccaggcaagaatactggagtgagttgcctttcccttctctgggggtcttcccgacccaaagattgaacccacatttccttcattggcaggtggattctttaccactgagctacgtgggatgccaaccatcttatgtaaagtccatttaaatatacaattttatatactttcatctcaattctgtaaatttttatccctttaacctttgttttcatttgggatccaatcaacaagcttggtcttagagagaggagttttataagttttttttttttctttttccctgtccattttagtgacctttgtataaaaagttctggcatctccagagtgagattgagctgaggagttcttgccctttggtctaactgttgccccaataattactggtcaaatatctcagtgcaaatttttgtagcctcttaaatgcatattttaaaactgggtaaatagaacagatgtgtttggctgttaatgttggggaccagtgggggtcccttttggcccatttaacctcaggtagggtataatatcaaatcttgctttaatcacataaatgcccattttatttatcccattttaaataaccactaaagatttctttattcttgtaaataactcttcctaag

SEQ ID NO: 47409 - DNA, 1540 bp, Bovine  19866880780565
tggagaagctctgtatgcactgtgatctttctgtgcaccaattacaccatgtcactctcttgtttaaagaacaccagtggttccccatcatttataggataaaacctttagcttagtattgaatatgtacaggctcttcacagtctgcctccagattcctttttagcctcctgctcctcccagacacatttttcccaaatgcagcatcccttctacctctttacatgctcttctttctgtctggaaagttcttcccaattttctctgtttgacaaatgccttctgatatttcaagatatagcttaagtgcccacttcttcagtgaatctttcctggaaccattcaaaaaacccatcctgtcgcgccctggcagttccttcactcagctatcactgcactagtcacagtggcctgaggtcatgcatttacatctatttctcctagtagactgtgttcttcaaaagcagtggccatcttactccctattatgtacttatctctctagcaagggctcagtataatagtacagataagtattcagtaaagtaagtacacacaccgaacacgcaagagcactcagtaaatgtttgtatcatactgcttcctaactgagatccacaacaggctttggagggccccttgagctttctatattgtatgtgaaattaagtattttgaggatattttcctaaaaagaagatccattctagtcaagagattttcagagggcatctggattcacccgaatttaagtacttctaccaggaagttgttttcagaaacctgaatctcagttcagagcttcaacttcaccttgggaatgaggtgacttctacagctactcacgtcactccgttctggagtgaggagagagctggagctgggtgtttgcagaaagtctgtgtccccatcgcagaccaggacatgcagaaagttgacttctcaaggcactgtactctcctctctcatgttcttgagcacacataccagaatgaatgcaaactcaaaatttaaatgcgaatgcatcgcacacacccacaaacatgcagccaggcacacacaaacacattcatctgcacgcacacagatacacacggtcgcacaaatcggccgcctacaaatgtggggcctgagtggctcacagcctggcccacccctgctccatatgtagccacacatgcacatacacagccacgcatgtgagaatcacaggacctggctcctgccctccccactgcaaagagcaagcgctggccctggcatcgggcccagggagacagccgagtggagccatctgtcaagctgaggttcctgcgccgcccatcctgcctgagctcagacgctcggcatgccgagcatgcaggctcgctattctctctggctgaatcatgctgagtgagctggccccgccagagtttatcaaatcagaacagaattttggcaaaacagatgacttgtgagcttggcatttgtgggcctgggaggcggagaccggtagggggaggaaggaggagtggaggtgaggagagaggaaaatact

SEQ ID NO: 47410 - DNA, 1005 bp, Bovine  19866880784802
ctgcattgtaagcgatgcttttaccgtctgagccggaaagtctggaaggcatctttcagtatggagcctcaaaatctccttctctgattcctcaagagcattactccttgcccaatactccacccttggtctgggttagtttccctcctctgagctcgttcagtacactgagcttacttacttttctagctttcaccatgaaccctgaagggaaggaatcccatctttcatcattgtatctttgtcagctagcacagtccccagcacaatgtcaggcacttgataaacgttgaatgaatgaatgcattcattacgggagagaggttcatcgctggcagaagggaatggtgcgtaggagagccgaggaagtaaaagaagtgagggattaaatatagagatgagagagaaaagaagtgagggattaaatatagagatgagagagagaaggtgggcagaggggagagagggaggaagacagccatccagatactggggagaggacaaaacttgaaaacgagctgagatgaccacacaggagggagactccagagaagaatgactctctcctttcttaatagttctcaagcacattcccaagttttttttttttttaatcatgtattctcttgtgctctttaaagatctatgtacataggccctacctcccacataaaactgcatcttgaggaagcttctagaagtttctacagtagtttttaattattctgactagcatctagcatgacgctctgcatatagagggcaatcaataaatacttgttgagatgatctaaagagtgagtcaaagtgaggttcagattctgagatgagtattagctggaagaaaaataggtagtattaacacacttagatggagaaggcaatggcaccccactccagtactctggcctggaaaatcccatggatggaggagcctggtaggctgcagtccatggggttgctaagagttggacacgactgagcgacttcactttcactttcatg

SEQ ID NO: 47411 - DNA, 1023 bp, Bovine  19866880831838
tcacagatgggactaagtcaggaagactctggggctctcatcaaacaaaacagaagagggcacgtctgcgtgtgcacagcacaaattactcattgtagtgcaatgtggatgagaaatatcacattttccatttcttgaacatctaggctaggggtttgcaaactgtagtgtgggttagagtcaccagggggcttgttaaaacagactgctggacagctgtcccccaaatttctgactcagtgggtttgaggtggagtctggggagaatctgcatttctaacaagtgcccaagggccaaccactgacctagatagttcctgtcacataaggataaatggaagttacgaatggcattaggcactgtgcttagtgctttaatacaccagctaatttaaccctcataatagcactatattgcagaaattatactatatcattctgttatacacaagaaaatggagactcatagatctcaatatttgcctagggttacagaactaataagtggcagggatgagatttaaacctcagcatttttgagtggagaacccatgtttttctgttagtttattctccctcttaactagagaaacattttttcttcctttttttaatatatagaaactaaagagacgtgactataaataagtgaattctagagtcataatacccttattccatttcaaatacatccccaaatatattattgtgattgtaccacaagagacagcgacaagaccatttatttcttgaaaatcgttgtgaaaatatttgagagagtgggagctggcagtgccctgagcccaaggagcctcctaagccagcagccatcaatcctcttttaaaagtaatggagcacattttgttaaataaaagtatattcagaagcacaatatataagcagacagaaacttttcagtcttatgaaatagatggggggtgctggcagaaacgagcacttgagcactgtgggcagaaactgagatctcttcccacagaagcatcagctctgatgcaaacaag

SEQ ID NO: 47412 - DNA, 1043 bp, Bovine  19866880833860
tttagaagggcttcagcaagggaaggaaggacatttgccctgtgtggggctcagagaaacactgctgtcccctgggaggaagcctgctgtggaggctgctagagaatttctggttttctgctttgggccttagtaattcagggatgatgtgataggagcctgaggggagcagttttcaatttcacccctaatagcattggcttgggctctgaagcttgggccacctctgactcacagctgagttaaggaattaaatccactgcctcccagacttggcaagggacggccatgggcggtggctgcacaggccctgggagtcccctaggcaggcagagtgggctgcactgggccatatgcgggtggggtagagggcctgaaaacttcattcccagcacgccttccccagctgctctaaatgcctaaaataagccagcagaccttccctttacctttggagtctttgatcccaatcaaaatgccactctgtactgctcaagatggtcctcaaagctgacctcaatcccatgggctttatgagttttacatctttccttcttatctggtttggagagagagatagtgggaccagtgggcgcctctgtgtatgtgtgttggaagatgatatgggaggtggaaatgacagaggaaacaagctcagaataggggctggagcctacagaaggcaggtgtacctttaataaagacctaggtctaatcttggccatgccgttaactctctgtgtccttcagcaaactgcttaatctctcgggacctcagtttcctcatttgcaaaatgaaaggttgagtaaggaagtctctaagggcctttccagttctgaatcattgaatctgaagcaaatgccttctggagagaaagccagtaagagtcagaagtttccactggaatctctccttttaggctttgaaagagtaagcagcagcagggactcatgcccagaaagctggaaaacgggaaaggtcttatagctaaactaagactgctccagcttccagccccaaattccagcacctgtcattttca

SEQ ID NO: 47413 - DNA, 1233 bp, Bovine  19866880835588
ggtggggggagttgattggggctacctgggtgacaggatcttcctctctccacttatggaaatggcagacaagcctagggtcaggatggcaaatagattttatctcatgtgccaagccaacacattggtaatggctgcctggaagactctataaagaagaatttcactcctctgtctagactctgggaagaagttcctatgattgattagttgccatagagaccaattctatttggagaagttttaccccatcacacagattgtgagttaggagattttggggtgatacccaatgaattagttgccttctgagacagtagaatatcattacacggtacacagaatttttcatgatatggtcctatagattgtccagcattgctttccatgctactcccacctctagctttatatacccaccgtgggtctctgaacacagttttgggcagacaggaaatccaaattagagactcttggagctctactccttcagagaccagggcagaagccccccctggcacactgcagatgctggaggcccagtgcctggagctcagatcctctgggagagcaggtgctgggggcaagggtggggtgcaaagggtggcccaaggcaataatacaaggtgagccatgttcaaccagacccagcaaagccttcagaccagaaaggacatcagaagagaagagttaactgggcaatgaaaagacccagtcctgtcatttgagaaaagccatcagtcagatatggatggggctaagctgaacttttgggtgaaggatagaggaaactaggtatttccctgagcagtgccccctggaagagaggaacaagatccatgtacatgtaatacagaagaggacatgaagtctaggtcctcaacccacccatcacagtactcagccaaaagacaacactgggctaggctctgcagtccacacctcagctgtaagacccacaggcacatcatttaaaccctgagtttcagtcccttcatctataaaatgggaacaagaagaccaacgccacagggttactgcccactaatttatccattcattgccaattgattatgcacctgcaaagtgtcaagctctcagagagtggctggatgaacaagacacagtctctgccctctagctaggaatttgggtacaaagactgaaagtcgtaaaacaaagaccataaagtgaataataatgacagtaaagaagactaacactgagcctggg

SEQ ID NO: 47414 - DNA, 2353 bp, Bovine  19866880836614
aatggttgtgggtgcaagctgggagcagagtgtgcagaaagggagtgcgggacccaggctgtgtggagaaggactggcatggaagcgggatggtaggctaggaagactgtgcacattcaacaggatggaccgtgtgcttgggggtgggcactgcgttagggactatgggagaggactatgggaacagagacaagagaagactccaggggttcatgatctagagaggaagacagacgtagccaacagtgattctatgtgacaagtgggaaacccaaagatggaatattgcaatagtaagaattacaataatttttaaaagtgcttatgaagaaggttactgaaaatatgtggagacagtgaaagagtttgaggttcaaattctaactcttgtcccttttaaggtatgtgacctagcacaagtcctgtagttctatttaagcttcggttagcatatctgttgagttggcaataaggttcacttggttttccagtaggctagtacttaaaaacctgaacaaactttttggccaacccaatacaaagtggatataacacctacttcacaatgtttcataattattaaaataagatacatgcaggtttttaaacacactgtctggcacaacaaccactttctgaatattagttgcaattccaactactacaacttcaactcatacttgccaggcactgtgctgagggctcttgcctatgctacttaatttttgcatacattctgctagctagttatttttattcagacttaataaatgagaaaatggattctttaagtgtttagataacatagtaagtatttagcagattcaagactcatttccaggtgtgtccagtttcagattccccactcgttgtcttgctgctttattattatatcttaggcacctgtgcaaactgcctaggttagtgcttggataataattatattagtagcaaaacgaatgtatttaaaaattatatatttatatgtatagcaattatgtatttataataattattatagtaattgttaggctgaggtacttttttattgttaactgaggtacttttcatacattaatttatttaatctttataatatcttatgaatcaagaactattatctattttatgggtaaaattaagtaatttgcccaaggtcacatacgtataaagtggtagagttgcagttgaaatgggaaactggggggagtgactccagattctgtgtgtttcgtcctactccaactttagtctaaggagctttctctttctccagtctttcctttatcctttcttacccttcttcttttctcgctggtgtctcaagggaacttctctccaccattttcataatcaggttagacagtctctcaaaaaggaacacaaatctgggaaaatagcatttagcctcactaataagcaaagaaatgcaaattaaaatgagaatggtattaactctggcaaaattgtttaaaagaagaatacccaagtctatagggaaacgggtcccatttcctgtgacaatgtaagctggcacagccctttggcaggaaatttgcagtagacagtcacaaaagggcgattccacttaacagtcacttattcattcagcacacagcaatagggctgcctgggaattcatcataacgccatgatggaaattactttcttctcttgggagttctgcttaagaaggggttgtaggctactatttactcttctcccagccatctctcagtttgctatctctcccctgcggctggctcagcttcagggttgcactcaacaccccaggcactaggatgctgtgtctacagaggggatccgggtggagcgggggctcatttgtccaccaaggatgctacttaaagtagaaagtagtcccatcctgatgtggacagccagcatggagaaactgtcggccttccagcagaccactcggctctctaaagagtgtcagcctagctttgtcacctgtcatggcttcttgctgaccagccatcccatcactcctgcctcaaaggatacggctgtctctcttacatcctcactctattccttctggaaggaggggccaaccattttgttccaaagactctttcttcatcatcccaggccaaagcccaagtcccttctcagcagcctgggagtcctgagcaaataaatctgtggtcatgacctttccctgtagtctctgtagagctggtcagctccattcttgatgccctgcaggtcttgggcagcacgcttttaaacctgagtgctgttagctctgactgcagcgggggcagggggacagtgaaggggagcccggcagaagcaggaagcattctcctgccccctgcattacctg

SEQ ID NO: 47415 - DNA, 1628 bp, Bovine  19866880845319
cagtaatatgcctcaaaccaaaaatagaatgcaaaaaatgactccttagataaggaaatgcttctgtcagaaatggctttcagccaaacaaattaaagggagtggaggaagacttaaaaagcctctgtgaggtaggttggtttagccagcatgaagtcagcttaaaatcccaacattttccacgtttccctctcaagtattacagcctctgcccttcaaggtaaaatgtcaaagctatgtctttgcttttcaccttccctctttgatatatattgacccctctcttatcgcttctacaacccactactcagtcctgacactccaatatgtcaaagccaagtttatcaccaaagaatcatacaattaccactgataccatgacccatgtttgtagctgtttcttgggaagttttgaggccaaaaagaatggatatggtaggtcacctcaaagcctaggaacactgtcaaatgtatggatcagcagtaaacaagcctgtttaaattagtcttaatacctacatgaccagatttattttgacaggatctcaccctctaccacagccaaccagcttttgttgctcttgctttagcaaagggaattagccttctttagaacacaatttaggaaacattaatgtccccttctggttcatagctacagcccttctcacattcccaatttttctggcaagacttactcaggagatctcaccccagtctcctcccctaaagagttctattttaagaaatacagtttgacaataaaaatacagtcaggataggaactctaacagtccctgccagtgcagtcatctcattaggcatcagtagtgccctgagacagtggcactctcaaattttcatataaaattaaagcaaacctattttaggtaagagtaggtggctttttgttttgtgtgacagttccttatggaactcaaatagttgttgtctgagaagctacctcatcagcaaactttggtcttttggagatgttatatgatattcagaataatttacatcagagagaaatgtcttgtttgaagaaccctgagtggcttcttccttcaaaatatgtcatcctgtctaaccctatcaaaggaatctgagcacagctctatccagagcctgtaaaagaggtaaaattttaaattttcattattcagtcgttagttagtgggtaaacatttatggagcacctattttgtgccagattccattcctaatgctggaaataacaggtgaacaaagacaggaaagatccatgagcacttggctcctatgctccagcagaaaggagcaggaagtaaatgaaagaatctcagagtaatgaacactctgggaggaaataaagcagggtcacgggaagacggctttcagttgcaggagaagagaggtctctctgaggaggtgatattaaactgaaatcagaatgagctgatggagaaggcctgcggtaagggaagaagactgcacagaaggggcaccaattgcaaaaggcctgaggtgggagcaagcttgggttttccaggtacagaaagaatgtttgtgtgcctgtatgtgtaacaagggagggagatcttgggtatgcatttagaggggtgctcagggaccagaccaggtagggt

SEQ ID NO: 47416 - DNA, 1722 bp, Bovine  19866880880472
aatagcgattcaaattagactctgttctttcctcctccccctgcccaaatgaaaatgtgattaaatttcgttgtctctacttcctgctccagattcattccctccttttggtccttactgctaactgtcttgatccacacgtggtttcttcatgaatgaaattaatgcatccttaccccctcccatcttacccccttcattgcacctccatgaggatttcatggtgatctttcttgtccttctcctatagggtgatcaaccatcctactttgcccaggactgaagaggttcctaggatgtggatctttgagttttaaactcaggacagtcctgggcaaaccagaacaaactaatcatcctaaatcttttacttaaaatttctccccagttcttcaaagttttcaagatgaactgaaattaatcagtgtgatacacagaactctttgtaatcagccccgtcttcctctctacctaccttcatcctcaccaccaagcccttactcatcacacagacacacattctctgctttggcaaaactaggcttctggagtgtctttcaaagatatttcatgttctgccccagcccctttgttatctttgcctttgcagttcctttggactgcaaggagatccaaccagtccattctgaaggagatcagccctgggatttctttggaaggaatgatgctaacgctgaaactccagtactttggccacctcattcgaagagttgactcattggaaaagactctgatgctgggagggatttggggcaggaggggagaaggggatgacagaggatgagatggctgggtggcatcactgactcgatggacatgagtctgagtgaactctgactcagagttggtgatggacagggaggcctggcgtgctgcgattcatggggtcgcaaagagttggacatgactgagcgactgaactgaactgaactacctggagtgtgcattcccctactcctttcatctggccaactccttcaaaccctaatatatcaccttctctaagaagtctcctcttagcacctgcttaacatagatactcctgccccaaactcccatagcatcctgattttgcctctaaacggatgcctactacgcttcactatgtctaccctaacagactgagagaccctgagggcaggggctgtatctttatctttgtaactccaggagctgacacacagtaagtgttcactgaatgaatgaataaatgagaggcactcatttgcctccctacccccccaccactgtgtgaactcctcagaagcagaaagaacatgtggcttgattttctttgatttctttattcccccccccccccccagcacttggtcacttcaggccttcattcatattttgaatcaatgaataaataaatgtacaaacaagtacatctttatttaggtttgagccaggcaatgaacgttcacgatgaaataaacttcccttcagttcaagccctccccagccatgtgccctggacaaggcaccagttgtcagaagtaaacctggccctgtgctgtccccaggtagctatcagctggaaatcactggggtcatgacctctcctgtaaacacgaactccagaagaaaaatggtttctgtccaaaggctggtttcagatctaaggaaattctccactggattccctgcacaattgagtataaaggccactagcacatgggaagagagctacagcag

SEQ ID NO: 47417 - DNA, 1832 bp, Bovine  19866880893448
tttttgttaagtatgcatgttcaatatctaaggtaaccttaaaaagaaaattcataagagtttaagtttcaaactaacagaaagcaaaatgtagaatggcaaaaagtagaagagactatttgaaaaacaatttctgagacgttttccttaaaacttaaaacagtatttggggggggaaatgcataaaaattctctttgaacctgacattaaaagagaaaaagagaatcaacatttcaatcatgctttgaaaatatttctgctactctcatacttaattaaaaaattctaaaataaagcaactttattttattaccaattatgattgaaaatgggacactataaatagatcaactttcttattgcataatggttgtagaaaatatccaactatttctcaggttgctaattagcatactctaattagtatgcttcttattttctaatataaaaaaatacttgcctttttatcttcagggtttagttgattcattaacatattgacattgtcagtactccaaacccaagaattacttgtgaaatattcaagaaacaccatagctttgtgaagacgagttattgttttcatcatcctgtattttaagaaaaattgagattcataatttgcatagataaggaaaaatctcaccaccacccagggaaccagtttctattttgagacactgacagtaaaattgtaacacgtagttcaataagtgtaccaaatcaccaggaaataagaatatttctgcatcttggaacattatataaatgcaaaacaaagaaaaaaaattaagcagcagtaaatgaatttaatattgcctaaggagagttctgctgatatatgaaatggaatatttcaaggccaaattttctacatataatactaagcaaataaatgaattcaattagcattcttttccttttttgttccttaaatcacattttagttcagcttcgttttagtaagattttctgtgaattcataacatactgttacattttaatctcaactcttcagcatcatggaagcaaagtatacagaaatattcatttgccatttagttaactctctctatatattttaaacaacttgctcttgaacaccaacaggcgcctggatgtgccatgaaatcaatgactcatggtgacaactttctcaaatagatattcaatatattccctaaacttcccaaatcccccaatatccatctttataaaaataagaaaatttgatactttgtttctttttaaaagggtgaggggctttaatctttaaatttggcattttatatatcatggttcactgtaagtcattaatatcataacactaaccagaacagtaacatctaaccaataataattatcaatgatagggagagaaatagaaggcagaactttttgaaacacacacaccaaaaattcctaatctctgataaaaagaaaaattatatgtgaagaaatactttaaaagaattctatttatagtcccacaattaggattagcattatgcagtttagagatctccaaatcagggcttaagaaatgcgagaaatagaagaaaatgagaacattagaaatgaggaggaaaccaaaagagtaacattagctaagcaattctgacattttcaacacatttagaaagaaatccggaatacagaatactgaaacacaatgagacaacgtggacaatgtatgtaaagaagaactgtacttcattaaagaaagtaattacaaaataaaacctccattaaacacagaaagaattagtgagcatcaaaggctaaatctagacaggaatgttcaaacagaaagaattgaagggaggagaag

SEQ ID NO: 47418 - DNA, 1258 bp, Bovine  19866881028555
caaccccagtggaacctgcttgtcccccacaaccccaccccacaggagcccaacactgtaatcctatagcatgaaggaacaggatagagggcgtgctgtctgtggatcccaagttaaaatgaaacaggaaggggcagagagaagcatttaaaaattattctaactcatcaggaagaaaaccactccctctttccctgtggaaggaaacaggggtcgacagagagtggacaaagggtattacattagtgaagctccttctaaaatgaaaatatcagaataagaggaagaaagttgtacccctaaacatttcccagacatttgttctcttaatccactggacttgaccatttaacttataatcaaccaggctctctggctgtgcccttgaggggaaaagatgagcagattttcaggacagtacagttcttactttcatagggttgttccatcagaggagttagtcatgctcttctatgggtcctcctggtataccccaggtccatagtgttgcttctaccctagaatgttctgaaacaggccagaagagtacattaaataaattaacttaaaggtgacccttgtgccccaggatgaaaataaattctttacttatttcccaacctactttgtttaatactctaaccatcctcagctgttggctgggagtagctggttggaaagctggccttagtgtaaacatggtggtggatccagagactgtcagtccatcgaacttcctgcagatggagatctgagcagtgcatgttcatggctatagtatgcatatagctcattaggattccacaatggtaccaagtgatgacataaaaatactccaaataacatcctaacaataagatacttcacatcccataatcaaattctatggagaaattatatttaaaaaaaattagattcccccttcttggaagtaaagtccaaataagttaaagtccaaaaggattaaaaccctagatcaaattctcttaactttatgagttaaagttaaaaacattaaaatccaaaatttatttcctctcattttcctatcctcttaatcttagtcaagagaaagcagatatgtgggtgtgtcccttcagcaccgaatcacctgaaatcgatatggttccttcaagaacccaaaattagaatttgtcttcatgatcccgactcctattaaaaagtccaaagaattcctagaacatacagattaaaagagtcttagctcaaaaactatacaatttataaagcaaactaa

SEQ ID NO: 47419 - DNA, 1458 bp, Bovine  19866881116327
ataattcttgactctgattgagctaaaaattagaaaatttgttagtttcaaaaaaaaaaaaatcattaaaatataacaatactctatgaacttacatcataaccagcaatgagcagcccaacaccatatggtctccggccatatcgctgtgttggtatctgggtttcttaaactagtcaaagagtttgttctaacaagaagtaaagtactgtctttaatttcaaattaaacattatcaacaaagagttctggtttttttaattgctgcataatccactatcccaagaagaagaaaataaaacaaatatttctttggcttagtgttaaaagatgtttgactatccaccaaacccgaagtgagtgctagcaagatgatcttttctggtatagagaatttcattcattttggatataagggacaaggatttagggggagcatctataaccaccaataaacaaacattaaatctcttctaaaattgatgctcagttttttatgaaattaggcttatctatatctggaacatattaattgcttatctataaaggttgataaaaagaaccacccaactcatttagaatctattcttccatagtaaaactccctacaactctccttctaaagactttaagcattcttttactgaaaagtgactcaacttaaagtttgcacaatcttacctatgttatatatcatattcctaataagtaacataacaataaagtatcaagaccctttaaagtctacatccataaatgctacaataaatatataaataaaaaggatactgcttccaattagagatacaagacgagacacaggaagaggtctgtcaaatacaaatctggaatccaaacactcctggcgcataaaattactgaaaaagaaacaagaaaaactggtaatttcaaatcacagagtcattctaatcaaacgaagtaatttggtttctttttgctttcttccagatgtttacatgaattacaaccatacaatggaaccataaatatataatgacaaggatgcatttttctatcaaatctctatattttaaatgttctattattgaaagtgactaaccttaaagttttcacaattttacctaagtttgtgactatacgtttcttagctctagataacctttgcctcagagcactttacagaagagaagaaaaggctgcacaataggaaaagagcaatctctcttctcttacccttcccactgtcaacaagactgtcttaattccatgtcttgagctagcaaaaagaataactttgcttttttccttgaaagctgacaaaaatttccccaatagaacaaacagaagaaactgaatccatactagggcgctgttaacatgttcctgtcaatgttacttctatccatagcagtactctagaggagacactacactggtaagtctcttaaatccaacaagatgcaagcaaatgcaaca

SEQ ID NO: 47420 - DNA, 767 bp, Bovine  19866881124233
tacgtaactcatattttaaggcatgggacaagagagatcgctaaaggcagtgtggctagaaaagagaagagcacggagagcttgaggccagggacacttcagtgtttgcagaaagatgaagagggtcagcacaggaggctgagaaggaacgaggtgaggagaaaatgaaaaggcagcaggagctaggccagaaggtgtttcaaggcagagggagtgagcagctgtgtcagacggtcacggaagctacaagctgggcactgacctttggcagggagagaggcgagtctcactcacttcctgtgagaaagggggaccacttgcctgccttcctcagaagactatggtacagcccacaggagaccatgggcaaactgtagagctcactgaatgtgagctgtctgtttttatttatgacccactaaacccagaacctgttgaaatgatgggaggacgtgttaggcacaattgattttaaagatgcttctggctccattatcgcctcataaaaaggctcatttcctgctgctcttcacgaggacactcatgcaaggatgaaaaagtccccctcagaggtggaagccatcaggactgatattttttatgggtggttagtggaaactctgggaaagggtagaagcaaataatggaaccaaacacggctcactgggtctttacgcaagatgacaggcgctgcccttccagagggaatcgagtgaccctgtgcctcacagcaagggctccgggagaaaactatcaaccaggggcag

SEQ ID NO: 47421 - DNA, 711 bp, Bovine  19866881129894
aacctctgtgtgcttagtacccagtctgtccagctctttgcgatcccatggcctggagcctgccagggtcctctgtccatggggattctctaggcaagaatactggagtgggttgccatgccctcctccaggggatcttcccaacccagggatcaaacccaagtctcccgcattgcaagaggattccttactgtctgagccaccaagggagccaagaatgatggagtggatagcctatcctttctccaggggatcttcctgacccaggaattgaaccagggtttcctgcattggaggcagattctttaccagctaagctaccagggaagcccctggcctctcgctattccctcactatttttctcctagaagaatagtaacttacatgattggtaagtttagactaaagaattacttaagcataattctacctgttgcttttttgctcttgggggcctacctgctagcctggaagtaattctcaagtgctcctccacagatgggctctcctagcaagcagggaggatgttcctggccctgtcctgcctgtgtgcaggtatatctatttagctctaggctttatgactagaaagcaaaactgcctgcatacataacctatgtcctgcaacatgagctttatcaggaataaaggtggtattctgatctctcatctgtcactcttttctcagtttgttcagaatttgggaaaga

SEQ ID NO: 47422 - DNA, 1595 bp, Bovine  19866881158263
cctcaggtcatggggtgatgcccgtcctcagagtgccagagacaggtgtgggtgcaagggcagtgggcgggcccaggcagctctctctgatgggcccttccttctcctgcatcagaaacaccaagctgctttcacaaaaccatcttgcgggaaaactattatctacgggcattatgcaattttcctatcagaattacaggctgtgtttgaaaagaaataaaaagaaattgaatttgaaatgcttctgtgaaaccacatcaccttcttacaggtctgttcatgggcttcagataccttctctggcttttaaatagctgatcagacagtagcttatgatggcagcagcttccagggtgcaaggtgggctctcggcacttataaacagtcagcctaggtcactggggcatgcatctgaggcagactcagagccttgcagctgactgtgggtcctaaggaggccctatctcttcctcttcctttttttagtgccaggtctctggttggcactcgccacagctcacccagtgcccactagctcagtgcccatgtctgttggtgtcactttactcagctctggctccacactgtgccatagagtcctgggactcagaaagacaccagacgcttcctcatcacagcctctcattcaaacagcaaagacgggggcctctctagtggttcagaggttaagacatctctcccaatgcaggggatgtgggtttgagccctggttggggaactaagatcgcatttgtcttgtgcccaaaaaacaaaacaaaacaaaacaaaacagaaacaatattgtaacaaactcagtgaagactttaaaagtggtccacatcaaaaaaaaaaaaaaaaacttaaaaaaaaaaagcaaagattgagcatactctaaacactgatagtacagcagtgagtgagcagaatagacaaagcctttgcccatagaaaatgcctattctagtaaaagtagaaaagataaaaagtaagaaagcaaaatgcataggatactgtgtgcgttaagtcgcttcgtcatgtcaaactcttcgcaaccctatggactgtagtctgccaggctcctctgtccatggggattctccaggcaagaatactggagtgggttgccattgcccccctctagggtatcttagtataccagatggtgacaaatgttatggagaaaagacaatcagataaagtgagagcagggtgccaggttgaggaaggggcagggaattgctattttgaatcgtgtggtcagcagaggcctcactgagaagatgacatttgagcaaagacctagaggaggcagaggaatgagtgctctagtatctaagaggacatctccccaggctcagggatctgtaagtgctaagtgtgtctagcatatctgaggagatgtccaggtggctggagcaaagtgagcaaaagggcgagtaataaaagaggaagctggtgaggtaacagggaggcagagcagatcatgaggggccatggcagccatggccaaggtccccatttcctgtgcaacatgataccattagaggattttgacaagaaaaacggcatgatgtggctactgcgtgaagaagagc

SEQ ID NO: 47423 - DNA, 752 bp, Bovine  19866881189080
cttatagatccaaaccccgggataaaagcatcctttcctggtaatcccacggacaattttgtagaatttctagggttgcaaggagcagagtttaaaatctgctgttttaggattaatcctttgaactggaattaagggaccaaggtacaatttaaagtttcttgataattattgccaaagaaggttccaaaagaattgtgtaaatttacttaaccacaaacgctgcgtattctcattgttttatttttttcctggtataatggcagggaaatgactcctgttaatgttttaatttgcacatacttgaaaatatgaagctaaacacatttccttatgttgacttatggttgtatttctatttatggaagaggtctattgattcaagctttaatttcatgatatcaatttcatataacttatatattaattattcgaatactttctcaaacattttctgttttattttccttttgttacttttctttgtgcagaagcttcacatttttacatagtaaaatctgttcatcttttcctttgcgatttcttcttttgcttcaatgcttgaaaagttactattcatccaaagatctgataaatagtgagttcaatttcctgccagtctttctgtgatttggctttcatatatttaactcttttatctatcagagatgtatttttgagtattgtgtaaaagatatgaatccaaatgatcacactgggttttagattgatatgcttttgtgaataagtca

SEQ ID NO: 47424 - DNA, 1035 bp, Bovine  19866881350636
acacacacacacacacacacacacacaagtaagcctacagagctgtgttatcatttatttataatagattcccaaaagcagtactagttagtcagtgtgtgtatcttcttcaattgtaataggcattagcaagttgcttcccacatattacacacattcatgcaccagccaaccataggtgatgcccttctcccttcttcctcaccagtgctctaagttcctgtcttttttttttttttttttttactgttgctggtcttatagacaaagctattactgttttaattcacatccccctgactcatcaaaatgttgagtatctcacacttctgtatgtttattggccattagcacttattttttaattacccctccacgggctttgttatcatcggctctgttacttctgactcgttgcaggccagttaagaagccagcatcatgcttgacccttgacatgcattgttgtgtttaatccaataacccgggcacgaggggagcgccctgcacagtgtgtgaacgggcaggcacattgtgctcttcgtgaacgtccaggacggagcgcacacattgtgaaataataaatggaatggaagagacggcaagggctgaataactttttggctccaggaatgtcttccagggtcagttagcatccagttcactctttcaaatagtcctgagccaagagatgccaaatcaaagcaaaactctatcaagagaattctgatttaaaacttaaggaaacagcctctacatatttttagaacagcgcagaaaaggatacatctgtgactcgaaacagctggaaatcttttttgccaaaaatcgtgccgattatgaaagccataatggtcagacaagaggcagtcaagatgcaagctgtcctgtatttttcatacattcagcttttgaataaccttcactttggtacattaaatactgacccctataaactgccttttgaacatcaaatgccagccagctacacagtttgtacagcagtgtttgtaccattattgaggatttcattat

SEQ ID NO: 47425 - DNA, 920 bp, Bovine  19866881372704
cagtcagctactctgttaccagaagtgggaggatggtgctagacaggcaaagactacaggtgtgtgcaccagccacatgaagtcaggcaggaaccgactcatgggagccagaaccacacatgagccaaaactatgaaggtgttaggaagccagaaaaagcagaggaaacctgtctgctgagagaagctgagaagtatagcagacgatcagagaggagcagatgatggcagatggtgccactgtgttcaagctgggactatatgtaattttcctttttcagtcccatccccaggtgtcctggctaggctgacccctgcattttagtgtccccagaatacctcctttagatgttcaaaatatcctcttttctttttttttttaagttgaagtatagttgatttacaatattacattagttacaggtgtacagcttagtgattcagtatttttatacattatactctatttaaagttattataaaataatggctgtaattccttgtgctgtacagtatatccttatttatctattttatacacagtagtttgtatctcttaaccacataccgttgtcttaaaccccccctcctccccatttgtaaccactagtttattttctatatctgtgagtttgtttttgttttgttatattcattcttttatttttttttagattctacatataagtgacaacaaagagtttgtgtttgacgtatcactaagcatagtaccctctaggtccatctgttgctgttgctgctgctaagtcgattcagtcatgtccgactctgtgcggccccatagatggcagcccaccagggtcccccgtccctgggattctccaggcaagaacactggagtgggttgccatttccttccccaattcacgaaagtgaaaaggaaaggaagtcgctcagtcg

SEQ ID NO: 47426 - DNA, 1239 bp, Bovine  19866881386627
tgccaggtatcttggagggacagctagaaggatggctgggcctctgtccatgtagtctcagggcctctccttcaccagagtatctctggcaggaagcagctcagaggttgcaaaagttcaaaagctcagaagcgcaagctgccaggcattcttaaggctgaggcccagaactggcacagcatttcctctttacattctgttggttaaggcaagtcatagggctagccgcgattctatcagagctgggactgagagaaaactcactggtgaccagcttgggaaactaagttgactctttcacaaatattgagaaaaggatcaagaagtactggtgaatctcaggttaaatactggccttttttgtcaaaatttgaatacacatttgcttttataggtgcttatttaatagctgtgtaattggggaaaaaagtacagaaatttcttctacagcatgaattctttttttaacttgaaaaagatgttggtatttggagcagtaagatttgcattatttaactgctgttggaaacagtgcaggatagtacctcacagctgctttgttggaaaatattcttgctgtgtttattagtgctaaggaggaaaagaatgtctaaagtgtgctggttctatttttaaggctagtagtgataagaaaagcctttattcttaagcacaacaaagtatgatgaaatgctggaattgttcattgctttttattatgtaatatttgtgagtaaaagtgtatattggttaagtgttctttttacatactttcttttttcttcctctcttaagcctactcaacctgctgatgaacctgcagaaaaggctgatgaaccaatggaacattaaacaataaaccagtctatatatgtattgtcatacatgtaagaatgcaggagcacattctgatgacagtcatctacactttgaaccaaaagatgcagaatggtgggatagaatggtatgttttaggaatcagttcagatgtgagtttttcctaagctgccaccaaaaccatataattgggttcatttttctttaagagggcctctataatcattttctagaaagtatagttctctctactaatgtttttatatgaagaacatagtgtctttgtggttttaaagacaactgtgaaataaaattgtttcacctgctgatgtattggggttttgctttttaagtagcttcaactgtaaatagtagtctgtgattacagctgtgtcatcatca

SEQ ID NO: 47427 - DNA, 1334 bp, Bovine  19866881806107
atttggcaatagggagttcatgatctgagccacactcagctcccggtcttgtttttgctgactgtatagagcttctccatctttggctgcaaagaatataatcaatcagattttggtgttgaccatctcgtgatgctgataggtatgctaagccagatttgaacccaggtcttattccagagtcttgtttttaatcccacttcacttcaggatgtatgaatttaaaaaatattattcacacatatttttccatgcttttatagttctcataatttttttaatggctgtattctttcattgtgttaaaaatacctactttattaaatcatatcatagtgaatgtttgagctctagccttttgctatttctaggtagtgccttatcagttattattctgcgtatatacttttgcatttgtgaaatttttgcctcaaaataaatttcaagaagggaatatatagaccttgggatcttgcatgtcactcttgtaacaaatgtaccagttttgttcttaacacccctttgcattgtgtagccttaaaaaggcggttaggttaattgctactaaaagagagataaacatttttatttgattttatgttaataaattttaaggtttttgcgttttctttgactgttttgtcctgattgattactctaccatagcattttaaaattacttattcttttctttgtatgtggtatagtcagttcataaaacagtatgctttcaaaaatcaagatgcaaaaaaagtgtaaaatgactttgaaatgtatgcataaaagccaaagactgaaattatctgtgtctatttctgggaaatttcaaataatcagaaaaattttaaatacaactgatagaatggctgtacttcatgttaaaataacaaacaaaatctgagctaagggattagttgtaaagaaacaaatacctctttgtccctttctatctttgatactctaaaatggaaataagtttttttttagtgggtgaaagaaagacatagcttcccaattttttattgtgactttttgttttacagagatgctgttcagttaaatgtgattgctacacgacagcttattctgcttgcacaacagatgaagaatctggaagtgttcatgcatgtatcaacggcatatgcctactgcaatcgaaagcatattgatgaagtagtctatccaccccctgtggatcccaagaagctgattgattctttagagtatgtttgtttgaaatttattcaaatttgctttgaccccaaactttggatccagatttatctatttacatgtatctcttgtctgttagtttctctctctctccatccaca

SEQ ID NO: 47428 - DNA, 888 bp, Bovine  19866881929148
cttgcgctcacctctggacctgtctttagttctggaggtgatagatggatgctgagctaggagaaatgtgtgtggagggtgcccaagagaagtggggataagctgaggggcctgcttccccacccgttcctgctgcccacattgcttctaagaacagttgtccacatggaggtatcccctagggaatgtttccaggggtggaagggggcagccagtgagggcctctccaactcctgggaggcaggaagtgggggcttcttagaactgtcaaggtttcctggaagcctatgagagctgaggccatctggctttctgcagcttgcttttgggcgtgtttggaacccggaggagggcggcccctctggggacacaagctcactagttgtaaaccctgaggccggcagggtgttcgtgttggtctggagaaggaggctttcaagctgcagctcttcctctctcactgctggtcatcacaagcccacacacctgccctctttgcagcctgcacttgtcaaatcaaactatgccttctgagaaatacgatcgttttcaaggctcttcctttgagaaacccttgaactgaggaaggcaggaagccacaggcttctgggtgggcagagcctacctgggttacccgccccccacctcagaggggagcgcagctgttctgagtcatcaaagaagcctaacaaataacaccttcttgcatgttaacaccatcaaagaggtcggtgaaggccagtttatagctggcatgagggcgctgaaaagaacagagactttgaggctgcaaggcccagtttccagctccggctccttcacctcctgtccatatctcacaggtgacctctctcagctgtgaaagccatcatggtcagatgtgtgata

SEQ ID NO: 47429 - DNA, 906 bp, Bovine  19866882156277
acagttttagactggatgactataagatctttgcagcatgccaggcaaagccagagtgttgaaaataaagggggtaaaaaaatctcaattcagtggtaagtctggtttcatggttggaacagtcttcagaggttggaaaattatgctgcaataaaattgaaaagacagaaggtaatgttttaagagaaaactttggtggcagcttaaagtgtctgtgagtcccaagaacaggcattactttgggtatgttggctgctctctaaaacttcattgataggaaaagagctacagcctataaactctcaatagggtagtagaaacaagaggctaagacataaaataagatgagctacagtcttaccaatctccatttagttatttatcattctcaggctgctggtttagcaaaagaattgaaataacttttaatgaaagattcaaagaccttagcatcctaaaataaaataacaccaccaaaaataaccacgtaattaaaggaaggatatttggtccttcatgcaaactcgaacctctcaggtttgccctcacactgggcaagagaaccacctaaaatcaggtgttcaatacctccaaggtttttgctctgaagccccagccctgacctggtcctgatgctccgggcttcggactttccctcccctgcacccctgtacacattgctctggccccaccccagggccctctgctcagcaccactcctttcctttgaccttcagtctctctctcaggttatccctctggcttattatgcaggaggaaattgatccaagatcaaggagagagatttaatacaaatcgctactgacatggtacgccaatttaaacacttattgactctaacaaactatgttcagccaggccaaagctgcacactcattgaaagcg

SEQ ID NO: 47430 - DNA, 1714 bp, Bovine  19866880179380
tgtgcctggagaaggcaatggcaccccactccatactcttgcctggaaaatcccatggacagaggagcccagtaggctgcagtccatggggtcgctaagagtcggacacgactgagagacttcactttcacttttcactttcatgcattggagaaggaaatggcaacccactccagtgttcttgcctggagaatcccagggacgggggagcctgatgggctgccatctatggggtcacacagagtcggacacgactgaagcgacttagcaggagcagcatcatgtgtccctatcacctcactcagtactaggtattgagtcacctacaacttactaaaggcaaggtagctaccacctaacacatatacctattgttgtgagctgtgtttccaggaatcttccaagaagccctttaaaaaaaaatcagaaaatgtcccagaaattactaaatctttgcactggagcacatgtgtcttggttggggagctcacaaatcagccatgaatgttcagcctgagaggggctacctagaggaagatatttaaagaagatagaagtgagttccctgaaaatctatggtccataacaccacatccatttttatagttgcaatcaacaagaaagcttgttctatttgctttccttgcttgataatataatttcagagatggatgaaaaatgctttcagcactagaatcaatacttctgattacggctgcttttgtgctcgtctctccccagtggaaacatagccaggaaagataggaagatctatggaaagtctacaaccctgattttttttatctcttccaaagttgtctgttctcatcaaatgctgcatttattttgaagaatttgaaggcagcctagggctcacagaagagacatggtaacttggaggcatttgctatatgagctgtgctacctgaaaaactacagacccattcacccacctctgctacagaatcacatctttcccttcagattccacaccaaaggcatcttctgaaagctcttagtgtagttgagaggtgctccattgtcctcttaatctctgctcccaaggaattcttgttcaggatggaagaggaaacacttccattgggagaaggggcctctgcctcccccaagggctgaagtccactgaagggctgcaatctcaagccaaacaattcaggtgagcaagaaatgccacttcctctaacttgtctttaattgagttaatttcccttttatgtttggccgggctgcgggagcttgtgcttggtcatttcagagtttttcttcattttatttcaggatttcatctcagttctaggaaactacagagggccaaggtgtccggagatgagggatcaagggaagccgtgcacttttgatttgtaatatgaaatatgtatattggtctttgaccctggttccttccacagggctcctgaaacccttgtaatttcctgattcataggagcatcttttgtttaaatgaggtgactgggtgagatcctggagcagggctggtcgatagaaagaatgagccatgattagaagcttggaattttcagttcatcctccaccttccagataagggggaaggaccgacaatggagtcagtgatccatcatattaaaggatgaagctgccataaaatccccaaaacggggttggagagcttctgggttacatccacatgggggagtagcaccccaactccaca

SEQ ID NO: 47431 - DNA, 1857 bp, Bovine  19866880464718
tgtggctccagcctgtccacagataaacggggtggccacgagcaaggggcagccgcagaggcaatcagcaccagggaacacggggtggccagtgtgtggtgggctggtggggtataggccctcaagttcagggaagcctaaatggaagcagagctgagggtggggcgggagtccctggagggaggggaaggtgggcccactccaggcagcactgcctctgtattcatcttcactacaggacactcacagcggagggtgcaggccccccccggcatgaggcgactgaaccagaaggtcaagggctgtggaggacaaggctgagaagcaagaggccaagggaagtcagggctgagccaggagaagctgaggaagggagggcaaggcatggccaggactcagaacatcccctggctgggatcagaggtgggacaaggtgctgctggggtaaccatcacccaagacagaggtggagacctctgccagctgactggggggctgggtcagatggagacggctatggtggtgggcggtccagcactcactgctgaaacatctttaaaggcgggtcccttcagcctgtggaacaatccagtggacggtgacataaaacacgaaatgaaggagcaactccagggtgctgcagacaccagccagtcccagacttgcaccacggtccacacagtcagcattccagccaccttgagattctgctctttccggagaagctcagcagagggcatggctctgcggctggggatacccgtccaggctgagagggtgtgaagggggagacacagagacgtgtgtctgctgttgccaccacacgcctgcccctctcaggaacatccaaccacccagctgacaggcgcgagcagccgtgtcagagggaccgagaaaagtgatttctttacatttctgaacataacaggtacccaggaacccctgatggaagggtccctcctggagcaaaacggtgcctcagacttgcttctaacacaattttgcaaaaaggtgtgaataattacaacttctaaagtgtttctgtatgttctcacaaatcccacaaaaaccatttcaggtcttcttgactttcagatgacagccgactaaaaggagcacctccctcctcaaagggtccacgagtgtgacctgaaatgttaatttcctcccttaaaagtctgtcttcacaccagggaaacaaatggccccttagatggtgacaaccaatttgtcaccttgagcattctgagaagtcaagagcaggtcatcttattcccagattgattttgagcaccacggaggggtggagtcaattgagagagcaagctcaaggccacggccaggccggggaaagcgccaggcctccggactcccagccgagcttcctgttgacctggctccttaggagccaaagctcacctggacaggggcttctgaggtcagccctagcgctggggcagccaaacctgtgctgtccttacgagggtggtaccaggtatagtcttgcccttgagatatttcaatgctggttatttcctgttagactgttctgtcctgcacatgagcagaatctaatcagagagtgaaggaaataacaaaagaaaagctcaagccccatgaagtcagttactaggatttttatagaccatggtgtagatggaaaagttctgttccaacccaccccttgcaaagattccacgaaagtcttatggtgcaagtcatcgagatcaaatgtctcctctgcaattacgttttaaaacaccacgaggtaacgatggctctgcagacactggcccacacctgctgacatcaggaggcacgagcgggcaacctcaggaagctgctgaggaggggaca

SEQ ID NO: 47432 - DNA, 736 bp, Bovine  19866880485329
tgtgcagtttggtagtgttgagtatgttcaattgttgagcagcaaatctcagccactttcacctcagtaaagaatggtcatctttcagctctcccctccctgttccccggccatgggctgccatcccagcctcagctcactgcgcctgaaggccttggtcctgagggctggttcttctgtctacgggtggtggcagttctgctctctgggggtctaggaaggtgacagttatgtgctttgttcttttttctttgtaaatgcagttcatgttccatcttagaaggtctccattccttcaagtcttcaacaatagccctgacgagtcttcgtattatcggcaccactttgcccggcaggacctcacccagtccctcatcatgatccagcccatcctgtattcctactctttccacggccccccagaggtaagggacctaggcactaggaatcagctgatatggagtgcttttagtctagcaagttcactcttcgagcaaaactataagaaagaaatcttttgagtccttatagtaatttagcagcatttctgagtattaaaaaaacgtgcataggaaaaagtcacaggatgcataaaattagaaagcagtccaaatgttcaatgtagggaagttaagtaatcagaaatattcacaaagtttatgtaatagaataaagtaaatccttatgttagattaaagagatttttaaaaagccaccaggaataaaactataaaaa

SEQ ID NO: 47433 - DNA, 3741 bp, Bovine  19866880803531
actttgggggaaaaaaagaagatttgcttctgtgtttgggccaaaataaacttcctaagttgctatttgatagcagtgtttgtaaaataatattataactctgtattgtaaagaattttaggttcagaaaaagcctctgagtatacaaggattcttttaaagatttgttattcttttagactatatgagtcgtcttccctgcccttaaaaacttttgggttggtggcggaactccgttggttaaacttagtatgtaagcatcacattgttagcagaagtggtcatggtgaatcctgtagtctgtaatcctttaatcgatacgtgggccgactggggtgtgtcattacaatcatacagaaaacacctgttgtgagaggacagacaggtgctgctcagcccatcctcatggttcctcggtatagatgcttcttgcttctgagccaagaggtgagcgtcttctgccaccagcgggtcctgtctgaagcttctcactattgcgggcactaagcatgatgcttgtcaggtgtgtggtcggtgctcagcagctgcttgtccgatgagtgactcgacagacagcgtacaagtcaccagatgtcatgtgtccgcagggagtgctgcccgctgtccacggtgctgtcatcacctgcgagtgttaaccggcagccaccacacaggttaatctgtccgggatattcaagtcctaaactggaattctgaggttttcttaaacgttagtgtgatttttgtttttatgtgatgttttaaaccatttgaggtcaatggatcaacttttttttttttttgtattcacctaagcagtactcttgcctggaaaatcctatggacggaggagcctggtaggctatggtccatggggtcacaaagagtcggacacgactgagcgacttcactttcacttttcactttcatgcattggagaaggaaatggcagcccactccattgttcttgcctgaagaatcccagggacgggggatcctggttggctgccgtctctggggtcgcacagagttggacacgactgaagcgacttagcagcagcagcagcagcaagcaccttatggttaataaaatgtcaaaccttttctggtgtgaaaaatgctacaaatcaatgctacatggtagataatgtctatgagtcatatattattttgtgcttgttactcatttccacatgttattgggggaaggagtgggagggacttaattctttgcaggttccgactcttatgtaataaaaagggaaggatctagaggtcttaacttcttgtcaagtttccgagtctaactctgcagaataacgtctgtcccagttgatgaggagggtgagagtaagttcctctgaaatgctgtcactcctctgtctcagaactttagctctttaaaatctgggtcacatctgaatcgacccttagaagccttacttttcagggcaggagaagcagcatttccagcttgcatccagggaggtcagtacaggaggctttgagggctgagtggactagagtgtttttcagccaagggtcctgccaaactgcctggcaacatttatctgatcatttttctccattaaaaaaaaaatctgtccaagatgataataaaaccttacatggagatattttttctgtttagacttcattatgaaaacattttgctatattctattctgatactaaccattacagagtccctttttcaaaaatattggtagtaaagggggagaagatgcctagtttctcttttttaaaaaaatgaatcgctttatgttctttttttttttaatatttatttggctgcaccaggtcttaactgcagcatgtggaatctatatgcctcaccaggaattgaatccaagccccctgcactggagctcgaagtcttagccactggaccaccagggaagtccctttagtttctcttcctaagtcaccaaattaaatttctcaggtttgcttttttcctgtatttgcattgctcaatttctgtttttctccatggatttatatcagaggtacttctttcctactttggtgatttcttttttcttttttgccagtttagtgatttggtgatatatacggaaactattgcactattctgagcaataataattttattgacttggaagcctgagttgtctcgacttccagtggttgtttgcattgcagtgtttaaaataactgacaaccctgagatccttaccaaaagtttatgacagaaaggaaaaaaaaaaaaaggaaagagtagggcagggagtggaaaaaatgctgtttaaattacaaactgcttgtgcttgtagcatttacatagagagggcagttaacccaagtcacttaaaaaatggtcataacattgagagttaaaaataatcttacttgtagaatgacttggagcagaaatcggaagtccagatgagcgaacagttcacatgaggagttgttgggtggcaggcacgattttgagtgttacattgtggaagctggttggtgctgctgggggctgggcctgcagtttggggccacatgtgtgatcttgattgattcagagcccaggttgattcagaggtctctttgttgataagctcaaatgctgtctcctcggggggtggggttggtgtcccgtcctctactgtcccatttagagtgttcaccaagcactgttggaagctggctggcctcccaggtcactggtggagccctggaccccggtggcagaaaaaagtccccacccctgtttccagggacacaccttgcagccatgtgggtgatggcccccctgcccctgcgaagtgaagcctgcctggatcacgggggtcatgctttaagccagacagcatctgtgttcattatctagtgctgtgcagagaactaccccaaactcagcggcttgacacaacaatagacgtttttcatactgtttctgtgagtcaggaatgtggaccatggagctggatggttctgccagggagggaactctggttaggtcgcagccactgtgtcggcagggcccgtctcctgcatagcccttggggttggcaagctggtgctggctgttagccagaggcctcagtttttttgccacatggacagggctactcagatgtcttcccaacatgacagctggcttccctagagccctggcctttgaagtcacacactgtcatctctgtggtgtcctgtggttacactggttagccctgtgcagtgtggcttcacaaggtcacaaggtcctagggaatcttgaaggctggccttcccaccatcccaggtgtcccttccggtcggtaagatccatcctgtcttcccattgtgagcttaaacaggatgcttcctgagtgtgggtaccacatagtgaatcgtgtcctaggaggttgcagggcggctgctcagatgtaacagaggacaggttcgtccttgctgagtgcacggtgggagcattttattcaaacactcttcttttgaaatcagtgatgatactcaatcttatcttttcaaagaagaaaataaaatcaccttttaattctcccctccatgggaacctggcattgtagctcagctggtaaagaatccacctacaatgcaggagacctgggttcaatccctgggttgggaagatcccctgaagatctggaaacggcaacccactccagtattcttgactagagaattccatggacataggagcctggcaggtgacagtccatggggttgcaaagagtcgga

SEQ ID NO: 47434 - DNA, 2270 bp, Bovine  19866880351309
acacaggttgtggaccatggaaggcttagattttgtggccaaaagtgaaaatgaagttgctcagtcgttcgtgtctgactctttgcgaccgcatagactgtagcctaccaggcgcctctgtccatgggattttccaggcaagagtactggagtggattgccatttccttctccaggggatcttcccaacccaggacttgaacccaggtttcccgcattgtagacagacgctttactgtctgagccaccagggaaggccatttctttttgtgtccaggttggcatcaaattaaattctggctttgatgttctcagatgtgtgtccttgagcaagtgtcttcaactctctgagcctttactgtgtcatttgtaaaacaggggatcagtcagtacttaccataaagggtttctatgagagatgacatgagatggtacagaagtatctagcatcatgcctgacacttttaaggatttgagaaattattgctgctatttgatttcttctcaaagcccctgcactttggtaggtttgctcacttggctcagctttatctgtttagagcgcttgaattgaactgaaataaggggactgtagcaatcaagttagggcagattttattgccaacgtgtatgtcttgggagtttgcaaatgactttgttgattcccacctaagcaattcaggaagactcactcttattctctacctcacagagaagacttgtcccaggactgcagctgtaacatgagcagctaaccaggaatgagcctattggaaacttcaggagtcctatgatttctttcaggagagcaatcagctttattcattaataaacaaaactccactttattgtattttaatgaggaaagtcaaatatatacatgatagaaattcaaatatgatagaattacaatgtgtgatgtaaacagtaagaaagagcctttctctattcgatactgttttccaggggtgaacactatgaaaaatttgctaggtttccttatggaccttctaaatatcatcatcataatcttagaagcactttttgagtgctttgtgtgccaagccaatgtaaatcccttccatccatctctcatttcaccctcacaccacatcatggattggatgggtagtacgatttctctttattttacaggtgaaggatctggtgctcagagaggttaagaaaatcgagggtcatacagctaggaaagtaatagaattgggatgtaaattccagttgattcgaccagggtccatatccttagcgattattacgcaagcacaacacacccatcacaatttcctatcaccagatagcgtcatattatccccagtggtttgcagcttgtcttttttccttagctgtatatcacgaacacccttccttgacaggacctatagcctgagctcattctttttaacagctgcatacattccattatggggatgaacataatttatttaaccagtttccttctgatgggcatttatccatttgcgactattccctgtccttccttgggcccagaagagctaagctttctctagctttctggctttcagaggagaatcagcatcgcatctccatcagtctaagctgtatggtctttaaaaatacataaacctccaaaataaggctccattaaacaaacttataaaatatgaataggttgcttaccctaccttccgtccaagagcataagggtcaccgccccaccctggaacttatggagcttctccggtcttcctcctgaggtttacaagaagggtgcaccctctcaggtgtggggtcttgaacccaaatgaattgcgtgccttaaatggaaaggacttaggtaatttgctgagccatgaagcacagctaaatgtgcttgactggtgtgtgtgtgtgtgtgtgtgtgttcatgtacgcttgtatcatatcatgctgtactaaacaaaactgtgttcagataaactctcaggaaagcagtgagttggccagtgatggggaggctggggcgctcagatgtgaaacaagaccacctggtttgaaggctaactctgccatgtgtcaactttataatcttgggcagtcacttaatctctgtgcctcagtttcctcatctggaaaatggagataaaaaatgtccctacctggtcggggtgattgtgaggataaatgaattcaaacaaataaaacagcaagtgcctgatgcacagtatcacctctgggttagcttttataactattggatatgtgttgctgctgctgctgcggatatgtgta

SEQ ID NO: 47435 - DNA, 911 bp, Bovine  19866880708376
tctccgagtccatttttgtaacagcctcatatgcaagtactgggacccacggagtatttactaagtccttgttggacacggtggacttctcgggtggcccaatggtgaagaattcacctgccaatgcaggagacgcaagagacgcaggttcaatccctaggtcaggaggatcctcatggagcaagaaatggcgacccagtccagtattcttgcccagaaagtcccatggacagaggagcctggcaggctacaatccattgggttgcaaaaagtcagactcgactgagcacacgctggacacgccaggtgctataagcactctataaaatgcaggcagagtccaaggaatgactgtctaggatggtcgaatcatcgtgacggtgcaaagatgctcatcactgcctgcactccttttttaatttttttggccacactgcatagcacatggtaacctagttgccctaccagggatcaaacccctgtcccctgcagtagaagcaaggcgtcccaaccactggaccaccaaggaagcccctgcacttctaatagctacaaatcgctgttttgtagtgcctgaagcaaggcaggtgagtggaaaaagcagataatctcatctctcagggtttagcatccacaaccttcccacctgttcacgaaacaaactttctctgcatcttcttcctgctctgaatgcatattcttaaggtgagaatgaactgccctcccccataacttcagaaccatcagtgtcactgggggcagaggtgcgcatggagcctgacagtcttctccgatgggacccagcccaatccctcttatgtcagaatgccttgtttacccattagtggagcattggacaccagcagcagacaggctggctccagggcatttaaaaggtcacggattgagag

SEQ ID NO: 47436 - DNA, 939 bp, Bovine  19866880885396
acaaccacgcaccctcccgaagatgggctgatcgatgtctggagcaatcccatgtgaaatattactgttgcttaaatggtgctcgtgggatttacggctgggtattaatcggccctgcttaatgcattgacctttgccctccagcaattcagggaatggcactggtggggccagaagctaattctgtggattaaagcagaaagagccccctgcatttggaagtgtcagggacagtttaggcaccggcagaatgtctatggctttcctcatcacagcaggcagcagtgggggcttcctagcaggatacgtgctagaaatgatgctctatgccatcagtttcttttttattttatttattgatttatttgtttatttttggctgtgctgggtttttcgttgctgcatgctgacttttctctagttgcggcaagtgagggctcctctcgttgcagcatgcaggcttctcgttgcagtggcttctcttgttgccgagcatgggcggtagagtgtgggctcagtatgtgcggctcacgggcttagccgccctgtgtggcatgtggaccgggaatcgaacccgtgtcccctgcattggcaggaggattcttcacccctggaccagcaggacggtcccactaatttctctgtctcgttcagccctatgtttacttaatccctctccccttctgctccaggacttttcacatctgtttcctccccctgcaatccccttctttccatgcatcctcagttctaaccttagatgtcacttccttcaggcagccttcctgacccccaagtcttgttcagcctgtcatcaagatcccaagattgtttcacaattgtcattatggtttttctagcctggctcttctgacaacctataagttgctggaaggcaggagctgaaatattacccagatcgcctgcatacagaccaag

SEQ ID NO: 47437 - DNA, 1379 bp, Bovine  19866880888841
tatgcactacgagattgcctttcgacttggaggagccgttcaaagtcttggcgtctgccagtgctggaagtgtttataagagacttccttgggaaagaaaggtcatcagggaaaaccagaaacagatttcttttctttctctggctcacttctgtcaggcacctccaagaagtttactaacacctaaatcgtggacatggaacttttagaagaagagatgggagaagccgttgatggcattgcaagtaggcctgtgccgagggtcagtccaggctgtggtctggagcagaaggcacaactgaggaaggaaggaaagaagggagaaaggatagaagggagggggaggggaaatgaaagaagagagggagaaatgggtggatagacagatgtgtgaaaggataaaatagcggcagggtagatggacaaaagaatagggttgaggggtaagtggacatatggatgggtttgtaaacaggcagataaatgaatggatgactacagggttggatggatggatagataaatgggtgggtagatggatgaatggtgggttgatggatgagtggatggatgaatgagtgggtggatggatggatacatgaatgggtgggtggatggacggatggatgggtggatggacagatgagcgggtggatgaatggatgagcgggtggatggatggatgggtgggtaggtgaaaagaaagaaggaaggatagaagaatggaagaatagatgtttgggagggtgaatggtggggggatgtgtgggcaggcagatggcagatgggtgagagtggatggatagattgatccatctcaaagatttatctttatgtaaggttgtaaatgggtggttcccttgctgagtatggcagccagtatgtcttatttgctcactccatgcccttaaagagtggctctcaatcttagcgatgcactagaatcaactgtagaacagattaaaatctgttgttagggtaccatcacccacaccaactatgtcacagtctctgggcatgaaacctgacgtcactacttttttgaatcctcacatgattcaaatggcagtcacactagagaaccaacataaattcaaaaggcaaagcaacaggctaatgttatgcttgatcaaaatgcatgcaattctttacctcttgtcttatgccagttccagtagagttacttgcctggccttggtaaatacctgaatgtgtagccaaactttggtgcaaaactcaagttaatatcctcccctatatcaagagactgtgtgacttcagtccaatggcttagatgctctgtgcctctggtttgccatctgcaaagttggagcccatgaaaaataaacatcctgtagtgttttgcaaggagcaaagga

SEQ ID NO: 47438 - DNA, 1334 bp, Bovine  19866881242036
ggattgtctaccagagtactagagtgggttgccatttccttctccagggagaagaaagtcataaatcatgactgaggttaaactcttagtgtcccaagatctacacaccctcctgaaagcctaggtcttatttcaattttctgatatgtctaacacctccagtttctaagtctagttctctgctcttatgtgatcagtttagaatggtaacaaaaaaaaaacaaaaacaagactccacacaaacctaatgccatattttaaatacatctttgaaaggttgaatggttactagaaaacctcccatttctggtcccaaaagcccttgtttatttaactgatacataataagcccatttgcttttacctttaacctgctaaaacgctctgtggttttcatagatttccttttcacatgtgcagtgatacccacttccattttcattacatagaaaagcttatacttttcatcaaccttgcttttttttcccaataagaatccatttcagggtatttcagagcaatgtagactctctctttgaaagttaaagaagtttttttcccctctctacatttggatctgtacaatgggattactgcacaatgccatggaagtgtaagggcttcctaggtggctcagtgggtaaagaatctgcctgcaatgcagaagacctgggtttgatccctgggtcaggaagatctcctggaggagggcatggcaacccattccagtattcttgcctggagaatcctatggacagaggcgcctagaggattatagtccatagagtcgaaaagagtcagacacgactgaagcaactgaacatgcaggcacgtcatggaggtgtgaacctttgaaatatttatttaaagaacaaaaatttctgtggtccagtttctagtgcccatcactgtatcagtcagataggatgccttttgttgcagtaacaacaatccccactttcagggtcttgtaacagtgaagatctatttctcattcatgctacactgctcttgtaggtcacctgagggctcggccctatatcctcactctgataccaggctgacagagcatccaacatccagatccttgctggtcaccatggcagagagaaagatagatgtggtcaattgcacaccagctcttaaaacatctactcaaaagtgacatatcacttccacttaaatttttggccaaagtaaatcatttggtcatggccattcctaaccccaaccttcagaaaagagcaaaccctccaaaacaaggttagtactggagtgagcagccatttccttctccaggggatcttcccaactcagggatcgaacccatgtct

SEQ ID NO: 47439 - DNA, 874 bp, Bovine  19866881464285
cccagccccaagcctggaaaccatttcttaaatattcaaacatggcctctaagctgggagattaaccaagacgcagcattcttattgcaggtaggactttcagaggccctcctggtagaaccgtaacaggatccctccaggaggggaactaatcaccctgaaagcttctgagcgtggaggggaggcaggagcagagagtctgccccacccgggccagcctcattcccgcagtgacccacgtacagggaagaaacctacctgctgcaagactgggccccagcctccccgaacgtgcagaacccagagctgaagacatgagacacaagcgatagccagacccatttcatagatggggttcatcaaatcatgctcagtaagccctccaaagcctgggatgcccagggtcctcttgcagttgtccaatccagcatggctggcctaccgtcccatctgaaggatgctccaggtgcgtgctggacaaggatggttagagagtcaggggttttgtgagtcagtagttgaactgtcggtagcttgaactcaaccagggcaatcctcctggcattttttgctcagagcacaggcatcctttggaagcccacatgcctgggttatcaccctaaaggcagaatgagataacaaagaatttgaactttagaaccccacgttgcctctatcaagcatatactctgagcaagaattgcacaatgagaaacatggggataaagggatgagctggggtgtctggacgtgagggagactgaggatttgcaagggaaacaggaccaagctctcaactatcaagctgcaggtcttttccgagtcccaggcttcctcatctgtaaacaagttccaggattcacgtcgtgggatt

SEQ ID NO: 47440 - DNA, 1795 bp, Bovine  19866881681303
cccttgccttccctagaagcctccaagagactttgcagccgactgcctaggagatcagaggtgttgtttctccccactttggacactccccccgccttgagggttttcattccagagagggctaagtcaactctctccaggttttataagctgatagaacagggctgtcaaatgctttttatgggagaagaaacaggaagatggtttgttttgcagacagcgggttattgggtaattacatttttatagagcggttgtgggacaaatcacggggcctgctgtctcctttgatgctaaaaggcagacggccccataaagatcagaacaagggaaggtgaaaagggtcagggacagagctgccccttggggatcagcttctgcctggaagccccccaaccaggtgccccttggggaaatgacctccttctcttagaggttttggttagagtcatattcatcccaaactctactacctaaaggaaagacagaaaaaaacatgggaacccttgggcgatccctgagggaaccatcactattccttctcagtcttttatgtactcattcactcatttagtcactcattcattcattcatacacccattcattctcattcactcattcattcatctgtcatgcattctttggctcattcattctctcatccatccactcattcattcattcattcattctcttagtcatttctcattcattcattctttcatttgctcattgaggcatacaatcaagggtttggacacttacctaaggtatactcacatttttttccctccagggtccatttatttattcatcaaacagatattagttgagggcctactatgtgtcaggcactatggccctcatggtgagcatggcaattaacggtcacacctgaatcaggtgtgaaatgcccgctgtgataagcatggacagtgtacattgtggagacagggcatgtacagtagagcccattacacagtatctgaattgtcacagtgatcagaggaggcttccctggtggactgaggtctaaaagatgaggtcgtggtggtggaggtagtgggggtggtcaggagagaatattgagaatgttccagacgaaatgagataagtctgcctggctctgtggaaggagagagcatgcagctttcaagataggtaagcaccagtgcgcgaggcaacctggctcttggagaggtcccctcctggatgtactggggccaggaattccctgttcagacctcgtcttggctccattccacagacaacctccctttgcagaaacaaagcgtgctgcagggctatcattttagcccaagccagaaagtcagaggaagctgtgtggggacacgtctggtggaggctcaggctgtgtacccagcctggtggcctggagaaggcctgtctttctgccctgggaggttctaggaaaccattcattgcacttccttttcctgcgaggtttgaatccaggttgagggccgctgtttttactggtcccatctggagacaagtgtttcaaatcaagctttcttcccagctctctcttcaagatgcctgctctcttagggagggaaggctccgacccccatgctggtttcctgctgcagagacaagtaccttaataaatgtctatttatctggctggaccgcccttctgtgtgtgttggcttcctgctgagacctccagcctgagtccagaggtgtctttcttaaaggggtagaagagatgcaggtcttttcctatatatatatatatatatatatatatataaaataggtggccaaaaa

SEQ ID NO: 47441 - DNA, 1344 bp, Bovine  19866880870029
gctttaaagaaattgctatgactcatgaattcttgtatattttaggggaaaagggaagtcacagagcccatgcagtttgaccatggtgtattagagtcagttaatgtttttcagaatttctagttctagcacagttttatagccctaaccatagacttattggcagttagagtctgaactaaggatatcatctatgggtttttactatcttattcttgaaccgcaaaaagaaaacaaaatcaacatctttcatctgctcttaatcaaaacacttctatgtctataaatacatggacaaaacagtgtttggaataccattagctggatgaaatacggttacaggagtgctctaacacaaacaaggcaaatttggcacctttaaagctcaataaattcaaaccactgtcttgtgatattaacatcttgaaaattgtgttaacttgctgtgttctgcttacagactttcaacactgaggcccccaaatgaattttcagtaggtcttatctgtcttgcactttgcatttattgctctgcattttattacctgaatctgcttccatatttacacatgcaaaacatggtagagaatcgaaatcatttttctggataatccaaaccaaattagtggcctcagctcctacatatttcagatgtagttgtatttctcttagtttgagttttaggataattattatagttctgtatttgatgtgcacaggcaaatccttagaattcagagtgtgggaaagtgctgagggcagtgatttcaaaatgaaaggaaggaatctattttaaagtgcagtaagaatttgaatttatggttataattttggcttaaagtcagaaaactttctctttttaatatttcattaacattttagtgatctagagatctaaagatctcttcaagaaaattagtgatgccagggaacatttcatcacgttcagttcagtttagttcagtcactcagtcacgtccagctcttcatgatcccatggactgcagcacgccaggcccccctgtaaatcaccaactcccagagtttacccaaactcatgtctgttgagtcggtgatgccatccaaccatctcatcctctgtcgtccccttatcctcccaccttcaatctttcccagcatcagggtcttttcaaatgagtcagctctttgcaacagatggccaaagtattgaagtttcagcttcaacatcagtccctccaatgaacgctcaagactgatttcctttaagatggacaagttggatctccttgctgtacaaaggactctcaagagtcttctccaacaccacagttcaaaagcatcaattctttggtgctaagcttt

SEQ ID NO: 47442 - DNA, 1027 bp, Bovine  19866880998399
ccctcccctttattcctccacaattcttagcaagcgttaaatatggtcagtgctcaataaatatttgttgatcagacccttaccagatgagagaaagatcaaggaaggggaaggggtgagcgagagcaagaaggtggcgtgtgaagcaggcaggctgaaacagacttcaaagactgtttcgggagaccctgcagtacagcgagtgatggacagtggagagggtgaggttgcgcgaggtccttgatgctgttgagaaggtacattgcaaaccagagctgcgagcaggctgatttcactcttcgttagtggtggcacagactgtaaaatatttatgttcatattctaaatatgtattcctggagtaaataaataatttactgttcaggttataaattatttacttagttattctaaatatatgtatatactatttgcattttgctggaagcaaaacggtagactgatggtctttaaggggtcctaaaagaaaaaataaataaatcaagacttaagctacaagaggaagtgttctattaaagagatagagagagcagaagatagccccaaatacattgccttccttgtagaaaatatcgattttatctgataaccccagtgcccaacatgaattttgtggattttgtttgaaatttttaagttgggcttctggattagaaaattcgatattacaaaaaacttttttaaaaattactttaattccttaaggcttgctgtgacttcaaagcaataggtaagatattgtcctgttcgggttgggggcaccatctaacgggctttggggccggttcattcattggaatcactctgtcaaagatttcagatccccagaaatgactcggagaaaagcttcttcttgaataaccttgctttcttcttaagcatattatctgttgattggacaaacaattcagactcattctcttggcaagcggaattctgagtcagagtcgtttggggacacatctgttcccaatatcaagcaggaatcatgccttcttgcctccca

SEQ ID NO: 47443 - DNA, 1238 bp, Bovine  19866881264155
tattatattattactcctgggtatctttggggtgcaacataagtcgtctctggcaggaagcaaacccgaagcagacactttaacatctcttctcgttctacacttgagacggtagtgtcagacatctgaagccgcgggaagttcctggaaagtgatttctcagcgttcacagtgcgctgaagccctcacacctgcccgtaacaggcgtccctggcgctggtttgcagatcagcagcctgctctcacaaggcccctcctagggagaggctcttgaggcaacactctaactctggcatgctctggaatgcaaccagcatctccagagcgtgagtcacgttggcaggttacatttaatttataaatcaaataacatgttcgttatctccaaggtcctggaaattagcactggaaattaagttgagtttcaggccaccctctgttctgctttgaggaaaacagcagggaattggaaatgtttcgtggacacaggtaatactgtcataaaggaacgttcccccagggaaactagcgctgtacacatgttgaaaatagtaacgaggattacaaccaaactgttattcccttttcagaaaattcacagttgggcaggtaaatcatattaatggaacttagatcctgaacagcgtttgatcacatgctctttttacatagcacagcaggaggaacattctagattcggcccctgtccctcaaggctgatatactcaggacaactcagtaggaaaaagtagctcgcatgctttaaagcaggcacatctgccagtttccagttttgtctcttcaaatattgttgttgttctagacccgtaggcattgtatgtgtgtaacaggacagtatgctaaataatcttgtttgatttttccaaagttgtttcccatcagatagacagcctcttaggatttcccactttaggatgtctttgaagaccccagagcagaagtcagaggctgtttctgccccttttgcaatgctgtaagttctttgaaggaatgatggttgtatctcagagggaagaaggagaacatgggcttctcaggagaaaccagtgcaaacgtgccacaccgcccacagcaaaacccaaggggaggggagaggcctgcctgcggcagggctcagagtgggttaaaaacacactttgcgttaaatatatgttatattggatatattatattatatactatagaatatattttaaaaaatattaaatacatatttt

SEQ ID NO: 47444 - DNA, 1042 bp, Bovine  19866881723096
tttctttattctacttggagcctgttacttggcatttgttaaactttgtgatctgtggatggatattttttgttaattttttttttttagtttttagccataaaacatgctttctgcctcatacttttatttctctcgattcctcacttccaaagcaggggctgtgggtttgatctctggtctgggagctaacaccccacggaagacagacataaggtgaatccgtgagccctgcgtaaaggtccgttctgatcacacactccctcctcccacctacccctcactcccttcccgctccacacaccacggagagtcagtttagagatcctgtcagctccccttgacaggcccaagctgcacatggaatatttccagttgactgctttcaaaggcttttggattacattaagaaatagaggttcctagaatatacaaaattcaactcggttttgaattcattagctcaaatccctatgtgttcctattgtaattcttccctccggcataaataattcctctgctttcaacaagtctttgtagcaagtctgcagctcacaagctttagatatcctctgatatcagttttaaatctcctgagccgtaaatggtccctggcagctctctgccaagcaatcgttttagcttctgacaatctgtggatagctgaagctactgatcaaaacaagaatatggggcatccttagttatcccagaaaatcctgtggggaaaatgagtgttctgtcccaaggccaccatagattagtggattttatctagctgagggtaatggtaaagagggccattcatactgaggcaaaactgtcaaaaatattttaacgcttagatttatttctctaccttagtagagtagtgtaagtaggctttctaattctgctcacaatctaagagatttattacttgcaattttctctggtactgaagtaccaagaccaatccttttctattcacacgggggcctcaaacctacgtaagaagccaggctgtgggtatatgtctttatacccacgaaggcagtctgtg

SEQ ID NO: 47445 - DNA, 2617 bp, Bovine  19866880440424
acccttatggcagaaagtgaagaggaactaaaaagccagagtgaaaaagctggtttacaactcaacattaaaaaaatgaagatcttggctttcagtcccattaccccatgggaaatagatggggaaacaatagaaacagtgaaagactttattttcttgggatccaaaatcactgcagattgtgactgcagcaatgaaattaaaagacgcttgctccttggaagaaaaactataacaatcctagatagcaaattaaaaagtagaaacattactttgccaacaaagatccatctagtcaaagctatcatttctccagtagtcaagtatgaatgtgagagttgggccataaagaaagctgagcaccaaagtattgatgcttttgacctgtggtgttggagaagactcttgagagtccgttggactgaaaggagattgaaccagtcagtcttaaaggaaatcagtcctgaatattcattggaaggactgatgctgaagctgaagctccaatatttgaccacctgatgtgaaggactgcttcattggaaaagaccctgatgctgggaaagattgaaggcaggagaaggggactacagaggatgaaatgtttgggtggcattactgatttgatggacatgagattgagcaagctccacaagttggtgatggacagggaagcctggcgtgctacagtccatgggttgcgaagggttggacatggctgagtgactgaactgtactgagtctcatagatgatcaagtattttttatgcttctctatctggaagatagtgtgtggaattagtatcatttcttcctaaatattttcagaattcatcagtgaatacacctggacttgctacttttttttttttttggaaggttttaaatagttgatttaaaatttgatggataggtattcaagtcatctatttttcttgtgtgaacctgtctctttgaagtaattagttattgctttggtacacattttacccctttctccccaccttcacccttgtcttttcattggagacagtgtttacaatttatattcttgaaacccttagtcctgtgggctatattcctgacccttccttagatgatgcaagaggccagagaaggttaactggtaggaatttccttttcccatatgagataaagatatcatcttatctaatgtggtctcctggatagtagacctttgttacgaagaaggtcctgggcatatttctttatagttactctttgcttccccctgccaaagttaggagatgagtcttttaggatcttcaccatgagaatatagtagggtctccaaatataaaggccaaaagtaaatagggtcatctttaagactgtggcccctagaaatttctccctttcatgctagtccacacccagcctccagtaattcatcaaaattacccttttagtgttcctaccactttatgactccagtagcttttgccccatttggataagatgatctccgttctttcttcctggatgtacctgtccccacatattttggagtgacagtcttgcaacgttggctctgtgatgattctttaaaaagttgttaattttcactttgcctagctttcatttgttttaaggacaagagtgatgatctccagactctacatgttggaacaaaaaccaaagtcactcatccttcctgaacttcttggggtcttgtagaacttggtgcattttcattggcaaaactgaggggtgaagttggtaattgcagctgggagtcagagagtcagcactataagaccaaggactagttctgttcacctttacaccaggttaagagtttacttttgatacttgacagtctggcttcaatttcttatacattgattacatgacttaagatacctaggttctttaatcctaaaaattaatgctcaaacaagctcaaaaattgccaaagaggcccagtccaggaaaagtctcaatctgtgtacctctactttaaatccaggcccctcagcagccctcctgccggtcacccctcatcttggcccaggcagagctccaagggtgcctgtctctgtcactaaggctctgtcctggacctttctgagaggtggggactgatgttcaccctccatgtcatgatgaagcagagctcaaagaggccatgtggtagaggccctgaccccgctgactgtggtaaccacaaggaagtgggggctcttttcctgcccaccaagtaaagactctctcctcagcctgtgaaccttcttacccagagccttcacctgggtgtgtccctgtctctgatggtttatatccatctctttactcagttgtttgttcaacaaatattctttaagtgttgctgtatgttggccaccagaagatgagcaggtgaccaggtagacactgcccctagcctgaggaaacagtggtgccagggggctctggtcctagagacacaattgcaataaagagtgagaaagctttgcatgatgccataggaacaaatacctttgttcaggggcccaggaagacttctctgctgtattgatgtcttcagacaagttctggaggatgagaaagagtggctttgtaagaggggaaaaatgtcctatacataaataaggat

SEQ ID NO: 47446 - DNA, 1877 bp, Bovine  19866880487304
atgagagttggctagacatctgttggcaagcagaaaatgccaccataaagcatcttctgttatctcctgcagggtcaatcaaaggtttggtatcctccagagtaaatctccaggaatcctggtgtatagtaggtgctattggtgtcctctcctggctgcctgttactggatggtggatccatttcccagctccagtaggccactgatggcccccagtggtcaccttcccttgggtcaccttcacccaagacaaacccttggctgaaaaggagcctcctgcctgggagtttgttcactgctcgtctcaggcagcctgatcagtatgaacgacaaagagatacgaaatgctgggctcccatagcatcaggcaagatttctctcaccaacctccacttctcatgaaagcacaccctcaataagtcacattcacccaaagtcccaggctctgcttccggagaacttgacccaagaacctgcatgtatggcaggaataagccttcctcaggggaaggcattacagctcacttggttcttcccagacctctaatgattctctggggaagatgaagaaggactttccaccttcctgaaacacttagtagcctcctgcagactttctcacaatctgctgctgatctaagtataacgtgctgcctgaactggccccatccacttaagagccaggaggccactggctgttaaggtggacgtgacctctggcagaaacaaatctccaataatagtagcacaaagacattggaattgtcctttgggccaaaatgctccacccatacacagaggaaataatgagccaggtgacgttctgaggggcctaaaaatggatctgcgggaaggcttagaaagaaaagaaccataaaaatttttatatgccaaatctcaggatcaatggaagggattgatgtgtgggaaacccttgttccaggtcctaagtgccttgcctgaaccctctgttaaactaaaaacaaagtaaaacaaagcatggtccttccatgcctaatactccccagatgactttaaatgaatacacagagactcttttcttttttttggttctttcctgtttttgtgttttcttttaaaggagcattcttcaaactcattgtgacttgtaatgcctgaagatactttgtggggtctctctttttctgctactatgtagtttttgctcaatgaagggaaacatgcttcagcttcagtctgaggaggcttaagtagaaagtttatctgtaactcaggtatacatgatcccctagaggaaggtatggaaacccattccagtactcttgcctgaaaaatcccgtgaacagaggagcctggtgggctacagtccgtggggtcacaaagagtcagacatgactaaagcacagcagttaaacatgtagggttcctgaatgcaattctaattcaagaagcagtggtgtggccccgtaagagcctagatatatctgggactccagcaccaagcaattggccagttacacatgaagcccttagaaagtatcctcaggaagtgtgctgtataatataatccaacaataccactcttagaaatacacctgacagaaatgcaagtatatgttatcaaaagacatatgtcagagcattcctagcagcatttttggtaaaagccccaaactggaaactacccagatgttagacaacattaaactgtgacatttatatataatggtctactggacagagtcaagaatgaacaatctccacatatatattaccatttgaatgaattttaaaacaaaatgttgattgaatgaagacagatacaaataagcatacaaataggcaaaaactaatctgtagtgttacatgccaggacatggtctaaccttgaggag

SEQ ID NO: 47447 - DNA, 3908 bp, Bovine  19866880584558
tggatgtctgcctgttgtgcttacagagaaaatataatttgggctatatttatttatttattaaataaaagtaagtcaaacaaaaagaggtccctgtttatagaaacttacagaaaagtatcagaccaagttaaggtgtgttttcattaagaaaataaaatgattaaaatatattctaagaattacatgaacaaaacctttttgactatcaataactaaccccaaacctagcttgcaaatatctaaatgccgttcatgacaacaaaactctctgattctataaaattcaaaaatgtggtactagatgtaatacagggccttcaaaatttctttttccccagatcatcagactttccctttcctctctaattcatcctaattggaccaccattagctaagaaactgatgcaaactaaggaaaagagggaacccccaaatcatgaggctgccctggaaaaatcctgtaattggaggataaactgaacttaccagcatttttgggcttccctggcagctcagctggtaaagaatctgcctgcaatgcaggagaccccagttcgatttctgagtcaggaagatcacctagagaaggaataggctccccactcctatattcttgggcttccctggaggctcagatggtaaagaatcctcctgcaatgcaggagaactgggttcaatccctgggttggaaagatccccctgtaggagggcatggcaacccactccagtattcttgcctggagaatccccatggacagaggagcctggtgggctatggtctatggagttgcaaagagtcagacacgacagagtgactaagcacacagcccaccagcagttttgttcatcacagtctggaatcatactaactcatcacgtttgaaggattcccaggcacaagcccccaacacttgcatgcgagagagaaacagaacaatgtgatctgggaccttacagccctatttaatgagcatgttgggcaactgtatctaaatacataaaacaaaaagaaccctttccccctaaagcagtaagaaaactgtaagaaatcgttgctttcaccactgggtgggcaagtcttcaaacactcgtcaatttcatacaccttttaagactacctggaaaatgacatacagcctcccagatggaaccagcttagagaatattttaaccttttcacctttcaacaaattgcttgttttcccattggaacaatatcctattgcttgccccgaagtacggtacatgactagtcaagtcaggaagtaaatgaattgttgtgctgtcaagaagatttttcccccacatacctttatatctaggaattccaaagttagaaagtgaagaaaatgcccacggctttcatttactttcatttttctgtgttctactagggtttctttgcaatgtgaaattactaggaggaggaagagtaactgcaatattcatacaagtttgtgagtggaccctgggataccccttgtcacagtccggtgagaattttgacccatggtactttctgtattttatttaagcccagtttcccaggtggctcagtggtaaagaatctgcttaaatatctgcctgccaacacaggagacataggttcaattcttgggtggggaagatcccttggagaaggaaatggcaacccaccccagtattcttgcctgggaaatcccatggacagaggaacctggcaggttacagtccatggggttgcaagagtcaaacatgacttagagactgaaccacaccaccacattatgcctgttctaggtacccagggtacatcaaaaaacagaacagggtaagaatccctgccactgtagagcttatgttctggtgagaagagagagaaaacaagcaataaatataatactcaataaattatgctatatagaaagggtggtaaatattgaaggggggggggatccaaacaagagaagagattaggagtgcagaagagtggcaggatgcaatttcaaaggcctcattttaaaaggtgatgtttcagcaaatacttgcaaatgtaggacgttcagccacatggatatctgagagaagagcattctagggagaggtttcagcccatacaaagccctaaggcaggaacatgcctgtgtgttcaaagaacagcaaggacatatgggaatttgagcttttatctgagtgagatagagtcattggagagttttgaacagagggtaacatgatatgacttacactttaaagggatcgttctgactgctttgtgaagtgtagacggttaggaaaggcaggaatgaagcatggagacccataggaggcagctgaagtatcccagtgagagatggctcaggcaagagtagtaacaggaaatggtaagaagtggttggagtcatgatatattttgaaagtaacgacaacagtcctagtgaattagatgtggatctgagagaagagaagaatcaagaaaggtttcaagatttctaaattgagcaaacttaaggatggagttgtcataacctgagatggggagggagactggaagttgtataagtttgactgagcatcaggggtagagtggagctcataggttcagtttcagatgtgctaaatggatgtatctactagacactcaagtcagggagtcaaaggcaatagtatttgaatctggagttcaggaaagaggtataatttggagataaaatgtttctaagtcttgagctaagagccccgtagatgttatatcccaagggctcagtgtatttcctcctgaggattttatatctgaagtgtttacagttgtcactgatgccattgtcactatcatgactaaacttctgctagattaaaagtactttgtaaagttttctgggcatctgggtgtccctgtgtccttggtctgcccagatgcacacagggtaccttcacattactctgaagtatggttccattagaatggattatggcatacagcccaatgctgtcatgttctgacattacaagacaaaaaggcatagtaggtattaaagcagtaccttggggttgcagaaatgtcacttcatcttttgtagttatcagttctatttttatcacccaatttacctgatccccaaaaggcaatctcagtcaacttaaagtagattcagccattttgagtttatagtcggtaaattatgaatttttcttatcttttcttctaccaggttggtttgtaagttctggagtgcatattctagatggagataagtgtctggtgaatctgtaaacatgcagagatgtacccctccctgagtgtcagagatggacacaaggtctccccgctctgtgcacagggctctgctcagctgacagcggaaagctttagaaacacctgttaactctgccagttaaagttaaaaagaaaattctaagaagaactttccattcatataaagttttaaaatattctctgtcagacctaaaattatttattaaatgaccaaacaaacacaccgtgtcttgagcacaaatctctaacgaaaggcgggaatgtagcctgtaagagatgccgcacagggtggggagccccgagtgtgtcctggtgccacgcagcccagtctgtgagcctctgtggtatgtgtcttcctgtggactcctgcagttcactcttggtgcaaatttttttctgttattaatgtgcaaagacaattgttttcctaaacctattatttataccaagtttatagaagcttaatagctagaaagtagcttctttattttctctcgtatttttggtatgactactgttcctggtacagtaaaaatcatggtgtagttcaaaggaatgagacgaggaagggtactacagagaggggtaaacctgagggatttttgaagacaaaatcatgaatatacccaatattattcagccacagaat

SEQ ID NO: 47448 - DNA, 1539 bp, Bovine  19866880596983
tagttctcacctgtgagaacaaagcagaataatgcctagactatttcaaaggaaaaccacctttatttcctctatttatttttagttgttcaaaaggcacacctggggatttccaaggggatatggtgagagccaagtgactattaatgtgtttcctgagactatgtggaagtaagacccactgcctgcctctgcctagatcatcaggaaattgcatcctctctccctgggtttaggaggctgggttagggtgagggccaggttctgggagtaggatagctttggagtgtgtttcaactctttttcagcttctagtctttgcgtaagaggacaatgccaatacaagggaagaaaagcaaagaatgagggatcccaggaaggcacccccagcgtgagtgagcatgggagtgtgtctgcagatcacgctggttgggtctgcagttgttgcccaactcgggctcatgtggagaactgatgccctgcccgtgaatcgtgggaattttaggcacagttagcaatgcagccttttctctgctccattgttccctcccagactccccactcctggaactttgggctttttttttcttttctttgccgtctttggactgaagggcaaactccctcccaggcagctaggagacattttttcccttgagtaataactgtgttggacatgactaaatttgttcaagtctgtaatgggagcaacgtccccagatggcctcaaggctgtgaagagatgaagggaagcatgcacccacatatgttagaatggtctgtgtctttatcacgggaaacttccaccgtagagaggaaccctgcacataggcagcccttcagcccagagtcagcgtgtcgaggtggttcacagtgtccttggatggaatgaggaaccgctgggcctctgccaacatacctttccctttcctcggctccttcctttggctgagcctgggcttgtccctgactgcttcctttgttccatttcttctttctcatcttccctcaggcctctgtgtctggaacaagctcttccttgcagtctgccaatccggcaggctcctttactgacctgctctcagtgctttatctctaaaacactgcgttagctgcttctctccactaaggtcagggatgtggagaaagaaggaggttcagggcaagcttcaaattaggagacaatgaaaataataatgtctttgtctttggatccactcactttcatatcattttactgttatttacgtgagttgtttcttttaaactaataccaagactgttgttgccgactaaaatctagaaagtttacataaaataatcttttttttttttttttctctttttatgttttaaaaatacaccaggacttcccaggtggtccagtggttaagaatgcctaccagtgctgggggcattgattcaatccctggttgggaaggttccccatgccatggggcaactaaatccatgtgccataactgctaatgccctctcactctagacctcctcaacaagagaagccaatgcaataagaca

SEQ ID NO: 47449 - DNA, 1731 bp, Bovine  19866880951067
gaaaaccaacccactactggaaaactaacccactgggccaccagagaattccttgtgaagctattttaatatagttcattaaaaataaataaactggagaataaacatgtcctttaaaaggagcacacatttacactggaaggtttggggtgattgtgttaggctgtggtttatgggtcagctggggaagttttgattcacctgctttagactgtttggaatcctggctgtgagaccccatttacccaggtgatactcttctcctgatatcaggattgcaagaagccaactaaacaaacatgtctgaagcctttgttcatcttatatctgccaatatcctatcaataaaatcaagccatatagtaaagcccaaagtcaaccaatgccaaccatgagacgatggcaatagtgtaggtgtctaatcctaccacaagggagagaaagagaaccacagtgatatgaactgaactgaagtcgctcagtcgtgtccaactctttgtgaccccatggactgtagcctaccaggctcctccatccatggggttttccaggcaagagtactggagcgggttgccatttccttctccagggaatcttcccaacccagggatcgaacccaggtcttccatactgcaggcagaccctttaccatctgagccaccagggagactggtgatacagttgactgcaaaatacatcagaccaggaataccgatgacagtcttcaacaaaaagaaccaatctgaagagctaacattataagatatcaagatgtattacaaaaatatcaaaatagcatcatgttggcatgaagacaaataaatattccacttcaatataaggaagattccagaaacagacttacttattatagcagagaagataccagagggccttggtgtgaagacttaccacataaaattgatgattacaggaggattatagatctaaatataaacagtaaattaataaggcttccagaagataccatattcaaacatctttataatttttggtaaataaaagatttattaaataagacaccagaagcatagaacatgaaggttgagagttgtgagaatgtggtattgtggagtcacatttgcatgttaaaattaaatatgacaaatttttaaaatcaaaattttagttgtattgacttatttgctccaattttctgtttataatatttaaaagtgtgaatcttattatctgaggttcagaggataaatatatgctgtacagccatgagtatggcatgttaacttggtataattcttagtgaattcaagaagggtttaattctgtcttgaaaaataaactaataagtgaaaaattaggggaagtttcagtatatgatgtatgtttagtaaatggtagataacttttagttgttcaagaaatagccttgggtgctaccatgtaacagaattctcaactagaacgcctactgctttgaacctattttgacatttcccatgttctgagaaatgctgatgttaacaaatttctgtaatttcttcatttctttagataatgccattttattattcctttagaaacaacttcctatttcacttgaaaaaccacaatgaaatgttttatgagtgtcgtgaggtccccatagcaaaagactcacattgctaatgcttctttgttcagaaggaaccagactgccaaatttcagagaattacagtatttgatttctagattagcaaggaatgaaattg

SEQ ID NO: 47450 - DNA, 585 bp, Bovine  19866881223217
tagtgatatagttactgaatagtatgattttagggggcaaaaaaaaaaaaacatttagctcagtccttagtggtactcatacagacagagagcgttttgcctcttctaattagagtgtacttgcattccccatggtaaggggttgccctttgaacactgacctttatataccacacaaaactacaagcagattcatctgaatgtctcatttatttcactggaggtccctgaatgtggtagttacataaaaaaaaaagtctgaaatctcaaagtattttgcaaagtcaaaaatccatgacaacctaaggaaaacttagcatctaggtcaaaggaagacaaagtagcattttcataggcaacaaaaaattaactatagcctctacccaacaagtgtgtgtcactgtggtgaaggagagccaaacgtgaaacaaatcaaatttgcaatcatcgaaaacacatgacttattagtgagtgactctaaggaaaccattagacaagaaattaaaggcttgtaaggtaatgccaaccacatgtttagaactattggtgacgactagtcatccaagtctcaatggacatgagtt

SEQ ID NO: 47451 - DNA, 1473 bp, Bovine  19866881236176
attttattcaaattctatggctttattcaataaagtcactggaagtgattcactatgaaagtggaaatcttggtttgaaatttgtgctgtgtatgtgaggacagtggaaagaggtgactgggtatttagggaccagatccttaactgctgtttctccatgcttgctccatcatttacctcatggatcaaaaatttttaagtcaccaaactagtattttagagcaaattcaataggacctgccttaaagatgaatagtctatggccatgttgcattttatacttacatgtcatgagatgcttttcagagttttattatataaatatcttgattgtggcaagtaatttgtctgatagaatttagaagagatgattaaaggtgtaattacatctctgagagaagctcttagtactagaattacagatgatttattttcccatattaatctcctgagtcaaattttccctataattgtcatagttaagttgtgaatgtctaactagcatctcaaaaataacatacagatagacagactctgatttccccacaggacctgctctactctgtatttctcttatcagttacaacaaaatgatctattcaatatctcaggccacaaactcaggggtattgctagatttctctatctgcttctctacctacttcctatctacatacatcctgttgcctctgcctccaaaagtctgatctgaccacttcatactctcctggatgtcaccctctgtcccaggaaacctgaaataattttctatttgatctccctatttccagtattacttccctaccatccattgttcatgtggccacctagagtgatggtttctaacatccaggtcacatccaaatcagattgcatcacttccctgcttgaaaactgccaatgcagcccattgacattagaatacagtacacattttttactcctgcgttgacaaccttattgtatggtccttggctgaatttttcattttattttggccacacctcatgatgtgtggagtttcagttcgctgatcatggatcaaacccacacaccttgcagtggaagtgtggagtcttaaccactggactgccagggaagttcctaaatacttggtctcatatttctcttccctttgtttgctatgctcattatacattgaccattttagtcctcaagatctctaactgtgtttctgatttcagagtctcatgctggctcttctgctgcctgggacaccctccctccagatcttcctatgctttgcccctttgaatatgtcaggtctagtcttctttcaaaaggccttccctgaccacctcatagtttacccaagtaactctctactccattaccctattctctttgctttattacacttagctctctctgaaactattgtaccaaattttagttctttattgttcatgtcccatgagtaaaatgaagcttcttaagaacaaaaacacttat

SEQ ID NO: 47452 - DNA, 1572 bp, Bovine  19866881500689
ttgccagccactttatagagaggcaaaagagaggttattatttactaagtacagagtttcagctttacaagattaaaagttccagagataaatagtggtgatggttgcacaaaaatgcaatgtaatatcactaacctgaacacttaacaatagttaaaattggtatttccctggtggtccagtggttaaaaatgtgaaaaagtagtagtggtcaactgtccaatatagagagttcaggtacaaaaatagaacacatctctgtagggttggcaatttgggtgacataatgtttgcagtttaagtggaacaatggaaggatacatccacagaataaatagaagatgaaaagaaatgagaataggcatctctagtgagaatttggcaaagatgttaaaagacagtttctccatggtaaatttattccagaaacttgggtgtactgttacgtctacaatgtactttctttctttagctgcagagttagccaacttgcaaagtaacagatttcaaagggtggcttaggcaatttatatctttttcatattttactgttaaaataatctctttatattaacactgggttttccatgttgctctgatggtaaagaatctgcctgcaatgcagaagacctgggttcgatccctgggtaaggaagatcccttggagaatggaataactactcacttcagtattcttgcctagagaattccatggacagaggagcctggtgggctacagtccatggggtcacaaagagtcgacataccaacaccattgcccataaaaacaatgactttttattaggtttacaaaatatatcttttttaaattttcaaatagtcttgaaatgcaggcattattaccttctttgacagatttttaaaaaattaagttgagtaattgcatggtcacaaagcaagtgcttgaatgactgcttgtgtaatttgaagctaatattcctgaacttgagagtgtagctacagagtgatgatccttagatgtgcctgctcacgagggtgcagagacatgagacaatgtcacttatcatgtgatggcccacccactcaccttgcacaagtcggttctaggtaggtaaacactccagggacaggagacgtgccctgcaagtactaaggcaccctagaaaacagaaaggaagatggacgggcaaagaaacccactgaatctgacacaaacatattcctccctggctttaaaaaaataaaagaagctgtgagagaccaaaaatatgacctttattctccaaggagcatggtggtagagttactttgagtctcccagttaccgtgagaaaatcatggctggcaggaccccctgatagaacagaactgactctttgtgtgagatttaaaacatttttaatttgaaagcaaacctaattgcacatactacttatacacacaccatgtggaaataataaatgcacttatgatggaaatgtttgcttcatttattatgctaggagtttttccaagaaatggaaacaattgttagaagtgacattaaatattcaactgagtttctttttcttagtatttttagaattcata

SEQ ID NO: 47453 - DNA, 1872 bp, Bovine  19866881514782
attcctttattaccgattttaaaaaggaaattctaaatgaaatgagttgtcaacaatgcaaacttaaatacagatatgtgaacagtccttgacatttggcaattaaagaatatgagctaatactgataaataactttaaacaaagctctaaaatttattgagattttctttttaaaaaatttgagagaatagcattgaaacacatatattaccatatgagaaatagatcgccggtccaggtttgatgcatgagacagggtgctcagagacggtgcactgggacgaccctgagggatgggatggggaggaaagtaggaggggggttcaggatggggaacatatgtacacccatggctgattcatgtcaatatatggcaaaaaccactacaatattgtaaagtaattagcctccaattaaaataaataaatttaaaaaattaactgttgaatcaaaaaaaaaatgatatagaagaaagaaaagggatttgaatcccttaatcagtggtaaaagaactggatataaatatttgaaattagagatataaaatttattgtcttatggaaccagattatttcatagaagagagaaatattcttttgtcggtttgatatttataaattatactgtttcttacattcttgcatcagcttgtggatcaaggatgagaatcatagttatatatagaattgtctgggtactttaaaaaattatcatgagttttggctccacactagaacaaaaaaaaaattagatttgggggagtgaggcttagacagtgatattttctaaaagctctttcattgactcccatgtacaacccagggtggagaattactgatttaggcagttttgaaaaccccaatgtcctagagaggagaccaacctcagcattgatgaggatatccttgaatactcttaggaagcaggcgattattttggggagctttactcttgggcataagttctcttgattgtatgagaggaaaaaaagaccagatcaggataagctgacaaagcacaatgtcctagaacattaggtcagagtgcagtgtgaaacccagctttacagggaagcagggttagtaacagcaaaaccaagagttagctgttgtaatacttaagccggagcttcctacttcaggaacagaattaaccactctggggactcagaagcacaagtccgtctgtgatcagtgcaactcagttacaagtttcactggatttagggttgatactgctgccaaaccttaattatcagttatgcagtgatcattaatttttaacccacaatagtttggaaattgcaatgcattttatcatcagtgagtacacttaatgtagtattcttttccattattgctaaattgatggtctgtcttaaaatttctgacatcttagatttagggaaatatggtgtttccagggttatcccgaactgggcttgtgggtgagacacggtattaagagttagctgtgagaatttagggactttgaaaggaaaaagagaccagaactgaaatgacagatcataacaaaatcaagatattgaacaaggacggcttctggttcttaaaagcttgtgctctagtatgagaaacaggctgagataagtgatgtaccctgagaatattgtcccccaggtacaaagcggtttgttcatgagaccactttttcagctgcttacgccctctgttggtggtaggcagagtggatacatttctgccttggtacagttttgcttttatctttccaagtctgtaagtgggaaggtgggaagttgtggagtgtcactgccaagttctgtggaaaacactgtatgctttaaaaactgtaaaggatcaagatcgaaaaggactagggaagggctaatg

SEQ ID NO: 47454 - DNA, 3989 bp, Bovine  19866880350466
tgatgtttctctatcctgtatttttctacataatccaaggtgactaaggaggacattatggaaaacaatacagcaaaactctcaaaacatgtaggcccttaaaatccagtctattcccaaggcaccaaggatcaacggggtgcaaagttcccctttgggaaaggtgactttttgtaatacttataaactaatggaattttattttgcagcttcgtatatcttatttggtgctgtcagtatacttaattacctacttttacacttgtcttctaagatggcaacaatatacaagctaaatagagtaccaggtatttctatttcaaagttgtgcaaaactgccacaatcttgctcaaggtgtctaagtatccacatggtagcaaatgggctgcattaagctgtatatatccacattgcatgtgaagaagaaatgaaatttatgcccagttatgaacagaaatgttacaaagaatatcatatactgagaataacctgcaaggttctttaaatagtatcccttagtggtttcaataaaatgtcactaaccacttatccctaagcctcaagttctcttcataagaatgctgtagaactgcattagtactttatattgattataaattaagccaaatttctatctaaatacacaagtatgtgcttcaagcactaatttgtggcaaacacacaaaacataattctcttaagaattattgtccttacgataatgcacttttaaagctttcatttcatagtttggtaattaagatccacatgaaacacaatgctttgctgaacatagaaaacgtatctgcattatgattatgtaacccggcctttgctggcaacttgaaacttaaaaaacagccatctgtagttcaaccagctccaaacaaggtttttcaagtggtaattattttgcagcatttataggtctatatatcagtctgaattgcaacttttaattccattgtctgatgtgagtggttgttatttgtttcttttagtgcactgccaaaatataaatcaacactgggttttattccactgttaccatgttcttcggcaatatggttcaactgtggaacttctgaacatgaagcagtttgggtaagcacagaaatgctacactgatggggggaattttccagtcggtcattttctacctcaggaagaatgttaacagtagcaaagcgggcgtgataatcagtggaaccatgactacaagaagttttcatgctttctaggtcagaacaactaaactcagaaaagtgactagagtgggaatctgctacggacggcatactgtcactgagggacggagcctcaaattcacttgagttcgtgctttgttgttctaacaactgtgcatccatgtcctctcgggtctcgtttatcttcatgttactctttttcctcaatttaccactttttgatttctttcctgctgttgcttctttggaccacttggtggcgctggatttaccttcaggcaagccaccggacgagcccccaggatggcttcgggtggcactgccatcctccacactgctgcttccactgttgtgcctgaacttggatggctttgattcaatatctacctgaacctccatactgttgccttctctggaacagaagtgaaacaaatataaatttttgacttcctctttttttattttttattaaatacaaatgtatcaaagggggagagtttctgggtgaaatgttaaaagactgtataaaagcatcagaacaaattaatgcaggatacattctactaatggaaaaaagctgcttgaaataagagaactgtctttataacaatgcttcaaataggggaaaaaagaaaaaaccaaaagcaaccatgctcacttcttacactgttccaggtactacgctaccttctccattttttttccagaacagttgtattgagagagaatttgcatatcataaatccacctgtttaaagtacacaattcagtggtttgtagtatattcacagttgtccagtcatcaccatgaccgaactcaagaacattttcattgtccgccaaagaagccctgtaccattagcagccagttcccattctccctgcccctcaaccccgagcaaccactaatctcctttctgtctctatggatctgcctgttttggacatctctcactacttacatttttcagagaacctaacagaagagataacaattatttaccataattctgcttaatgatagggatacaaattaatctaaaaatgcttttgactttacaacaactttttccttacttgtccagtgggatataggaattcagaatggatcctgccattgccttggtgctggcattatcactaactgtccccaagctgactgtgccggactctccacttaggctgtaccgttctttctgtacatctgcttgtacttccaaccttaaagagaggggtatcagaaaaagacaaaaattatacatagtatcagcactactatgagaatgcttatcttcaagtaactgagtaacaagaagctaatttagagacaactataaacattatttttttcagcttccttttatttgattattcaaattctactgcagtatactgaagagtaccagttatctgaataaaatgggaaaattagctgtctgccaggtaaggtagttacagagtaacacaaatagaatagaaaggattttagaatggatgcttaaacatgctccatcattctcacttagggtgtggcactctgcttccctgctgctgctgttgctaagtcacttcagtcgtgtccgactctgtgcgacccaagacagcagcccaccaggctcacccgtccctgggattctccagggaagaacactggagtgggttgccatttccttctccaatgcgttaaagtgaaaagtgaaagtgaagtcactcaattgtgtccgactcctagcgaccccacggactgcagcctaccagcaaaacaccaaatctgaatacattagaacccattctaagatcaatgaatcaaaaaattctggggatctgtatattaaaaatggttctaaatttaacacctgactcttaaaaaaataataatatacaccactgtaacttaagagtttgtgtttaaaagcacaatacctaaaaataactataactgatttatcttttaattcatgtattttcccctacatttaaaaaacccctaaagctaataaaagtgaattaaagaggaaataagagaagataaaaatgcttaacttatcctacctattatctacatagcttttggtaaaagactttgtgagaattaaataaccattaatacagaaaagggcccaggcagactcttggactcagcctgtgcactcccgacatcctgacaccacctgtcccctcaggcttcagccagtgtctcatttcccaacatccagctgtggctgcctcccaagagatgtaagtacaggcttaatcactgcctttacagtgttcaccagagaaggtccagcactgactcataaaatctgacaagtgtagtgaacaaaaaaatggcataatgttatccctaagatttggtttttacctcatcagatctcctcattcactgttcaccactaaatttcattttctgaaaccttaaaacttacttgaaaccttattgttttcaaccctgacacagtaggattatatgtaatcatcgtgctttgtgttcaaaattctcatctaattagtttacagttaaagcaaaacaatgcagttttcttacctgttgaaacagtttaccatggcacttcctgacagactccctgtgatactggctccggcgagcgccatggtgctggccgtctcacttaggttgtcccggatggctcctattcgaatccatgtggctcccgcttgcactcaaactgccagtcaaaccaccaacacttccctcccctatgctggggttgtgtcttgcttctgctactgaaagttgtgtctaaatgcaaatattt

SEQ ID NO: 47455 - DNA, 2121 bp, Bovine  19866880371199
tgtgaatcttaaaggtggatttttatcaatttagttaataatctgaccaatgaaggaattccttctttaaactgaaatactctaataaaggatgcttactctgttgtacacttggacagggctagccattagtgattcctcttaatagcttcctcccactagttttagctttatcttgtacaataacacaaaataagtttacttctcttctgtataaaggctgagtctagttgaaaataaggtagtacaagtaccataaaaactatgtaagtgagaacatgactgctacaaatagagtatatctgacactggtattcgagaggctgcactgtgatgagttcgaagctccaagagattagcacccacaattatgtcacaacatgcaggaccaataacagggtatcatttagattaaagccacaatgaccatcatcataggtatcaactagtgattgctgttattcttctttctaaacttcttttcatattcttctgatcatcttgggacagaacaatggaaacagcacaaaacaagatcttaagagtctggttcatcatgcacagttgacaggtttttttggtaagttacaattttactttattcaccgacactgttaaccacagacctttcagcctttcctggcattagtgtcttttccaatcctaggaaaatgactttgtaaagggccagtctgtttgccatccaaactttttttatatgataaaaaatgtttatcttctgaataggagaagacattttcaatgggaatttataacaatacaaaaatttgaagaaaactctagcaagttcaaagataagattagaactctgagaagttcaggagaggttaatttttttttttttttggctcacttctctatttattaaataaccacatgtggagaggcacaaagcacttaagttttatatgactacaaagttatcacaaatcccaaacttcttagccacagatatttcacttactctgtttaaaaaaaaggcttttaaaacatctgagttagcttgatacacagagaccctgaactacatatttttaaatgcttgtacttcctgctctaataatgtcttcattttgacttacatgaaatttactgactacatctgattcaaaatgctctcatacttaaaggtgttagatatacaggtatcccccactttttgaaagttcactttatgccacctcacttttaagaaacatctactatactacctgtatttgctaattaaaagaaatcccaagaggatttttgcttttataggaagaaaggcataaagcaaaacagtgttcagcatttgtcttgcagcaagactggccccgcccagctccttccccaggaacctcacagcatctcggtgtccagctgcccagccctgaacggtgcttgaagcacctgtgttttatctcagtttcttttgtgcgtctgttagtaagatgagtcctaaggttcttcactttatgccatctcgacttaaggaaaagttccctaggaacattctacttttggatagtgggggtgggggtggggacctataaaatgagacttcagtcgcgccttctctaagagctcatgaagttctgacactctgaactgtctattgtgacttgatccaatgaaatatttcccactatctaggaaatgtgtgattctagtatgatggtctgtgtgtacaatgtttaatttttttgtacactgcgtctacaccgtctctgtcagcccatacctaacataaaaaggaactaaattaaacttaggttaaatggtgtagggaaatatttttcatcaacttgatttataggcccttaagaagttatgctatgttttagggaattataagggaacaggaaaatactaaatacattcaaagtcttgctttatctcctgttctagaaaaggctaatcatcacatagctatgccacaatgccatgtactagccaacacctttaagcttccccctcactttaagttgacgtaattcatataccataaaattcatctttctaaagtacatgatttagtgttatttagaaaattcacaaagctgcagaaccacctccactatctaatgtcatcttgcctctataaatgaaccctgtgcc

SEQ ID NO: 47456 - DNA, 2607 bp, Bovine  19866880422604
tgcccagttattatcgcaaaaagaatttatttttaaaccatagatgagtctgaatttcataatcatcagtctgagtaactgccacaaggaaacatgcatcagctgcataaatgtgagctgatgcagagtggaaaactgaatggatagcagtgctttatatttctaccacatgttatgtttccatgttctcccaaattatcgcattcgcatgttacaataacttgttgagacaggcagaattgatatttttatttccattttataggcttagttcatcaaatacttattgattcctttttatatacctggccctacactgggtcctggtgatactgagagaaaggtaatacaatttctatcctcaatttgctcacagtctggcaggagacatgaatataacaactaactaaattatgtgtggtgaacattatgcaagtgatgggaacaaaatgttataggtgccaagaggaaggagtggaactgggggtggggcaaagcaaatatcactgactgactacaaagtgccaggttctgagctggggccttcctactccatgtgtggtctgtggaccatcggaggctacatctcctgggcccttgttagaaatgcataatcctaggccctactccagacccactgattcagaatctgcattttatcaagatgttcaggacatatctctgcctgctaaaggttgaggagcatgggcctaggtgacttacagattttatttaatagacagccagtgaatttatttctattagccctatattatagataggagttggagttacaaaattctaagtcacacagctatgtcatggagctggaattcgaactaggcagatgggctgggcttctgtcattaccctgatgttatttactctctaggggtatcagaaagacctcacagatgatgtctgagctagatttggaaggtcctcgatggaaggaaggagggccttccagtcaaaacgcctcttgagtgaattctcggtatggcaatggaataagtcccatagtgggcagtgtggcaagtatggtgaacaaagaagattgaaatcaaattacacagtttgaatgtcaccctaaggaacttgagtctatcccatgagtcggtttggcaaactgctgtggaactgtgattatgtggagatggctatgtcggaagtccagcctcaccagtcactagctctgtgattccaagcagcgttgctggtggggttctctggaggcagatactgagatgcacttgggagaatggttattagaaatcaaggtttgggagaaagaagaagaaaacagggttgggcagaggaggaaaataagatcagcccctgaaagtcttggccagcctgacagggagctccagagtgaggatattggccagtccaggttgtggcaggtcagggtgaaacagccaggcctttacctccaccccgccccggcgtcagaggccaggccagacatgagctcaggtgatgtgggtctctgtggctggagcagaccccgaaggaggcagtcgtctgcagacagcggggcagcaagtcctcccttggggggactctgagcagggcactctcggggtctgccacaaagttttcttacttctttgtctctgtcttctcattggcaaaatggaaatattatagtagatcacccatggggcaattatatgcctggcatgtaactcccaggctgctagggttatctgctcttttggttatctaccctgacaagatagggtcttgtcactgtttctcccttgcagcacttaaaatttgaaaatatcttaccgcggcctgaggaatagaagacgatcctgtccaattcccagtttgcctgaagttccgccattttctcatgatgttccaggcctcgtcatttgtccggagatcctggttgagttaagctgtgctaggcaaaaggcgagatttgagaaatgtaaagtaaatcaatggtttgaaaatacctaagttgaatcataaaggagggaatacaggctgcattttaggggtatagaccaggcttctgtaccatgaagactcaaaataagactcaaacaggagagtttccttcttcctcatgtaagagtctaaaaatgagtggtcaaaggccatgtaagtgacactattccataaggccacttgggaactgagatcccttttgatcttgttgctctactatcccccaagacagtggttcttaaagtgtagtccctagactagcagcatcagaatcacctgggaactttattagaaacccatatggtagggcccagaaatctgttttaccaagctcttcaggtgattctgttgcttcagttgctcagtcatgtccaactctttgtgaccccatggactgcagcacaccaggcttccctgtccttcaccatctccccgagtttgctcaaactcatgtacattgagttggtaatacattcaactatctcatctctgtcgtgcccttctcctcctgccttccatctttcccagcatcagggtatttttcaatgagtcagctgttcatgtcaggtggccaaagtattggagcttccacttcagcatcagttcttccaagaatattcagggttattttcatttagg

SEQ ID NO: 47457 - DNA, 3460 bp, Bovine  19866880429879
ttttatcacagacctgaagaaaccatgttttgctccttaaatagtcttttaacaaaaatgttccttgagcattcagtatacagttgacccttgcacaacatgattttgaactatacagttccacttatatgcagatatttttcagtagtaaacgttacagtactcctggatctgtggctggttgaatccacagatgcagaactgcgtatatggaggagccatggatacagggatctgctataagttatacagagaatttcaactttatggtgcccctaacctctgtgttgttcaagggtcagctgtatttggttggcagatacattcagcaagtggctagggatattcctagcaataaattgacccaaaatatagagggaagagccttcctcatcttgtccctatccctattcccaactctaaagaagctgtattttaaatctgtgtggctttcagacttcagtgtgcatgaaactcactgtaacatttgctagcaatgcagattcctgggctcactctctgagagtttgattctgtagttcttggacagaacccaggaatccccctctttaatggacatcctagttgtccgtgtgataaactgttagggtagcaagagaagagttttaaaaggcaaaagctcccttattaactagagacagtaacaaatctgcctgcaacgcgggagacctgagtttgatccctgggttgggaagatcctctggagaagggcatggcaacccactccagtgttcttgcctggagaattccatggacagaggagcctggtgggctacagaccatgaggttgcaaagattcggacacaactgagcgactgacacacacacttgtagcagaggaaacccagacatacatctacgtatcttctttcctagagggaaaggagaatctgtaagaaattatctgggaggatgaaccttcatcatctgtttgccttgggactcagaaactccaaggactgtgacctgggttagcagattggaagcattagacttccactttactatcgtcccagaaagtatattcaaagtggaaactaccattcctaattctttaaagagttaagcattgtatagaggggagagcatcaggagaaagacttcagagatcccacttgttttctaaagcagtgggtttggacacctttttttttttaagcatcagaaccctatagtttcctctgttcccatactccccaataccctatattagtcaagaagtttgtatttgttttccattcattgcctttttttaattccattcgttttctgccttttgattttaagtaagccactccagtactcttgcctagaaaatcctatggatggaggagcctggtaggctgcagtccatggggtcgctaagagtcagacacgactgagcgacttcactttcccttttcactttcatgcattggagaaggaaatggcaacccactccagtgttcttgcctggagaatcccaaggacaggggagcctggtaggctgccatctatagggttgcacagagtcggacacgactgaagtgacttagcagcagcagcaagcattttctgtgattccattttctccttatcagttatacatctttttaaagttgtctagttagttgccctagaatttgcagtatacatttacagctaataaaagtctacattcaaataatattctgctgcttcatgactgcttcatgggtaatgcaagtataataccttttaacagaattttgcaattccctccctcctatctcttatcgtattgctgtcagttaatttcacttatctataagctataattgctgaatgtattgttgatgttattatttttaacaactgttttctcctaggtcaactcataataaggaaataaaaggtattatttttccttcatttattcccctaatacgctttcattctttgtgtagatctgagtttctgacctataccatttcccttctctctgaagaacttcttttaatatttcttttaaggaaggtctattgtttgccttaaaatatctttatttctcctttaattttgaagggtagtttcactggatacaaaattctaagtatttctttttctctttcaacctttcaaacacttcactctctttttgcgtggtttctaaagagaaggcaagtgcaattcttttcttgactctcagattccttcaagattttctcttcatctttgactttctgcagttcaaacatgataggtgtagatttttgtataaatgtcctgctgtaatcgccgagctttttggatcagtagttttgtgtctttcattaatttttgaaaattccatcattattacttcaagtgttctgttccttttctccctgctatttcattatgtacatgtcacatcttttgtaatagtcccatagttcttggatattcttttctttttcattgttttttttcctctttgcatttcagttttggaattttctgttaacttctctttaagcccactgattctttcctctgctgtatttagtctattgataaactcatccaagacattcttcatttttgtttcagtgctttcagttagttactagcattttcttttgattctttgtttggatttctgtctctctgcttatgttactcagatgttcttgcatgttgtacacttctttctattaaaatctcttaacacatgaatcatagtgattttaagtttttggtctgatcattctgaagtctctgtcatactgattatgatttgatgcttgctttttgtctcttcagatatgtttttatgccttttaacatgctttgtagtattttttgaaagtaagatatgaggcatcaggtaaaaggaagtgaggtttatggacctttagtgtgtgagattttgtatttatctgactaggagttaggctgtatttaatgtttgctgtatctgtggtgccagtgactgaaatttcctctatgtctttgttattttcttcctgtgcttttgggttttcttagagatctcttaatagggtctgaggcttgcagttcttttatctgtaatccccgacattatacaggagtgctgttgatgtggtgatagaatgtgggaggaggagggtgttgtatagtcccatgattagatctctttcctttagtgagcctggttgggtatttcccccctcccatgtcagttaggctttggtgaaaaccacagcctgttaggctgtcgcagaatagtttctgttgagggcaggcattgttaggaagaatggatatattgcaaaattgtcactctgtccttccccctaggagaagcaggagaggggagttttctccgatggaaatttttatattataaatacttgcatgttcatttttggcctaccctgaaagcatctcacagcatgagttagtctcaacttatgccactagagtcggtttccttatattagtgctcaggaagaat

SEQ ID NO: 47458 - DNA, 871 bp, Bovine  19866880444534
tattgatggagactttaactactcccaagaggctttggaaagtggctttgacccaaatatttcgtgacagcaggggcaggaacagggccttcacctcgccagcagccagagggaatgtagacatctgccagttgttacataaatttggtgctgatctcctggccactgattatccagggaaacacggctcttcatctctgtggccatgtggatactattcaattcttggtttccaatggactcaaaattgatatttggtaagttctgtggtttttgaagtctcgtcacttcctccccattagcctctcagccagtggtctaatcttggaatctattgattttgtttcctcattgatcaagtgtagtgacaagctcagaaaggtatgaggacaacgagtgagggaacaagagcctgacttctagatttgtgctgaagcagtgtaaagttttctatgaaaatagtggctaagttctgctactaaataattatgtattataagacggaaaaagaagaactaacatttgttgaaaatctgttatgacctgggcactgcgtttactgtgttagctcatttaatcttcagaatgaatagctcttaagtatttgttttatagatgaaatagttgagacaagaattctgggttaaatgacttaacacagttggaatttaaaactagttccacctggttccaaagcttgtttaccttctatcgtgtaatataccagactagcttcattatctctctggactcatgaagtataagagtccttcttatactgaacaatttgaagaagtagtgttttttgttttgttttagtgataccttgtctcttgagtgggaacaatatcaggtcactttaaaaataaac

SEQ ID NO: 47459 - DNA, 1558 bp, Bovine  19866880447288
actgcagcacgccggcctccctgtcctcaccaacttccggagctgactcaactcatgtccattgagttggtgatgccatccaaccatctcatcctccattgtccccttctcctcccaccttcaatctttcccagcatcagggtcttttcaaatgggtcacttctttgcatcaggtggccaaagtattggagtttcagcttcaacatcagtccttccaatgaacattcaggactgatttcctttaggatggactggttggatctccttgcagtccaagggactctcaagagtcttctctaacaccacagttcaaaaacatcagttcttcagtgctcagctttctttacagtccaactctatgaagaggttactgtacgcttacacaggcagcacgttgtactgagaataccatatgcatatctccacttattcctgagcataactccgtgagacagttattcacatctccccctttcacatacatgaagacactggaggtgggcagcaactccttaagactctgcagttagacagagggagagcagggtcttgaacttaaacccaggtctgacgcctgatatcacgcacttaccctcccgctctactgagaaaataacatgcacagctgacaataaccctcagaagaaatgagtgcaggcttcccctacctggcatgcccggctggggatggcaacaggaatctcccacttggtctgggggcgtctctgctgcaggccgccaagcccgcacttgtgtggaggtgggcacagcaggaatgggcggcagcttctcccgccagtttgggccatccagagcgatcaaaatctttgttatcctaaaaagaaaatcagttttctctgtcgatcatgcagtttgcttttttatattactgaagggtacatcaaggtaaaacttacaaatgctacacagctcacggggtcacagagagttggacacgacttggcgactgaacaacaacatgcatttgtatacttccctgtagaaaacacagcaacttgagctatatgctgtccacataaactgtctttgaaaggacttttaaaagttgctccaaactatgtaactttagatcttttttgtatcaaaagaagtactttagaatggctatgcccaaactgtatactaaaaataggcacacaggactggctgctgaaactgatgagggcgtgtacgtgtgtgcttagttgctcagtcatgtctgactctttgcaacgccacagactgtagcccaccaggctcctctgtccatgagatttcccaggcaagagtgggttgccattcccctctccaggggatcttcccaacccaggaatcgaacctgtgtctcctgcactggcaggattctttaccacgcagccacctgggaagcccaaaactgatgaggagtggctgtcaaatggaatagtgcttcttcttgaaacattaacgaacggttgatactcttacctgcattgtttcatctctaaaacgatccactcattgtgtttttcatatgcataaagatgaaagaatttgataaggagtctactacaaggac

SEQ ID NO: 47460 - DNA, 1558 bp, Bovine  19866880508940
tcactctagagctcctgcaccccggccccacagcgaccgaccttggactctcgggtggctgagccccagcggtgagtccaccggccttctgccgcccctgcccctggcagccctcccagtctctggcgcccactgcagaggctgccggctcacagacgcccggtacctgtgctcaccctgggtctcaatgctgccagcagctaaccccaggcaccccgctgtcgaaaagtacctctgcgtcacaggccactctgggctgcttgagctgcacgatgagcaagctgctctgctcgcggtcctgtgtgcagtcgatctccgtgactgggaaggcctgctgctgggtgtcctcgctgacgctcaccacgaagagcacgtctgacgtcagcagcaggcagccctcgtgctcctggcctgagcccctcaccagaacaacctccagggccatgtgcacttccggtctgcccagagactggagcatcttcctgcatcagaggagaaaggtgaggccacagccagcttgggagagatgctcacctctcagggctcacagtttgaaccaatgcaagggccctcaccaatctgatgattcatttcatcttgaaatgtgtaattgtcactttaattctgattctggtcagtcgaacccagctcctcctgaagacaaagataccccttggtttggtgagtcctcttccccccattagaaatgtcacccctaattaggatacagatgacctcaggccctctcgcgggccccggcatccctgccaatggacatcctgccctgagtgggaccttctgctgccagcccagagctgtggaccagcagcctctcctgaaaacagctgctccttttgggctcccctggaagggtagcccgttagctgagaggaagccaggccctgttaacatacagtgcacatgtacagcttaaccagcgtccagataatcttaccagacatatttgacgtggctgtttggagcctggtcagagtgcagatcacttggctgatagcgctgtttgggaagctgagaaagtccagctccgtgtaaaatacctgtagtaagagaagtaagggggttttactagttgttttctggaaaacagcttcatgctacagtgatgtcatctgctcagaggcatctgtaaaatgctacagatccaaaatgatgtcacatctctggaagtaagtgtatagataatcattaaacattgcaatgctcttaacccaggtgatcttctattagctgcaagctgaaatatgaatgagctacagtccaagtacaggcgggcaattagaggaagcataatgctcctgggaatagtcaggcctgagcaatagcttacacatcatttacagttgatgtgacacaaaagactgttagttgacttccttgcttaatattacaatatgtctatctgcggtgtggctggtcaaataaaaaacacaacacagatgcacacaaaggcgtgtggttgcctagatacagtatttaaatgacttggtccagctgttagacatgaatccatatatatttatgagcgctcgcggggcct

SEQ ID NO: 47461 - DNA, 1196 bp, Bovine  19866880629077
tatctttagcttttgtgttcacaatcccaagaggctatagaattcagtgacaagatggtatcgtaaagggagtaaataattatagaattactaatgatattcatgtacagaaaggagtgatgaaatgtatcatgatgttcaggactctgttgatcactgcagcatttactttctaaaaactccactttcctgctgaaaagttggcttagagcctaatgggatggttcatttttctccagggcattaggtaaagtccattcccagcaacaagatgttggacttgatctgatgtggcaagtcctaccttcttggaagtaacgtatgcctctggaactaatggaaaaacttggcatgaaaatttgagcaacaattcttatctctataaatatcacaattaatcacttaatgtagagtatcctcatagaaagcatttgtccaggataccactctgctttttaaatgttacttttcttgctctcacataaaagagagattgtatcatttaaaagttactcaagatttattcttagatctgcagctttgtttaagagcttttccagaggtaaaatggtatttcctttctctaaaagaagggaaaggaggggtggagaggagtcccccttgatgaactgaatatttggaatacttgcataaaacagccgagtgtgtggcagatctactggtataagttttaaaagaaaacatgtatttcttatttaaaaagacctaatggattctttattaatacaatcaattggttagggaaacataaagtataaagtgacttttaactgtatttaagtgtatgtttttttaaaagaaagacttctcgttggtagtaaaaaaacattgatgataagcatgtgccaagctaaactataccaagatgtctggagacaataagttggaggaaacatgctgtatattaaagatagaatagttaatccattattatggtgaattagagttaaaattggtacatttgtataaaattgtaatctgagacatactttgttttttatacagatgacaatttttggagttctgtttaaattttggcctcagttctgtgagtttaggaagaacttaactgatgaaaaaattatgagtgttttggagagaagacaagaatgtagtaagcagaaaaagaaaaggcagtcatagaagataaaaattgtaaaggtagacaagaatca

SEQ ID NO: 47462 - DNA, 832 bp, Bovine  19866880648949
tcaagtgatgtgtatagtacattttggaagcatttccatggaaaatcatgaaagtaaaaataacggaaggtatttaatgtgtattcagatattttagaaaccttggatggtttaaaaaagaggaaaaaaaaaaaaaaacaacctcatttttcattgaaataagaattagtcccacaaagttaagaacaaaagcttcggaaagttttctaatcctggctctgccatttcccagctagcaaattctttagtaattcagttcctcaattgcctcatctctaaaatgagggtaataaaagtatctgtcttgtagaattgtgagattaaacaaaataatccaaataaaacctttagtgtgtgtacctggtggatagttggtgttcaaaatgaattaattactgctgctgttgtcttgttactatcacataaataaaggaagtatatattgatacattagtaggatttttacaatggttgagatttttctctttgtacatatgtattctatttggcatttcgttctagctctgtcacacgaattatgtattgtatttccacacgaaacaaactgcttcaattgacttactatactctataacaacagtgtttttttttttttggaaggtgggtggttctgagcttattttaaccctattgctggtctgctatccagactagcactcttagcttatcttggtgcctagacggaaaggcaacccaggcaaggcacccttaagagcaggctccagtcagacagctgacaatttgaaagtaaacaccttgaaaaacaacaaaggctagcgctgatgccaaaggatttatccaaagtcagtct

SEQ ID NO: 47463 - DNA, 1898 bp, Bovine  19866880672743
aaaaaagccaaagctaaaaactgatggaacagatttgcaaaagcaggcagctgagtcttccagaaaattccgcatcctcaagcactaatgttcaattacagtgatcatatcatcctactaacttctggctcaattttttctgttttactattttgtgtcacattttctatttgttattgtaaaaaaaaaaaagctcacttttaagtactttatcaattttataggttttcctgggctggtttgtatccctaaacaccacagagaacatgatttcaacggaaaactaatgcatcaacttgcaaccatttgaggacacatttgaaaaaaggggacttgttactgcacctaagactgaacaatgaggtaaataatctctcctctataaattatttgtaggtatgtacagtacaacagtctctcttccccttctacttcaaagtatctgaatagttttgtttttagcaaaaccttgctttggacaactctataaaaaaattaaaatctgttattatgtttgggactttaacaattaagtttagttacttaaaaccttctgaaataaacatttggtctgtaaatatctctgtctggcctcagtttcaagctaattaaaaaataacatgtactattatttctaactataaatgttgaacattaaaaaaaaaaaaaatctggttgttctatgaaagaggatcagccttgtcttgagttttgttccaaaagtcagaactagaatcaaatgaaacaatttaaaggaaaatggattctgactcaacgtaagaattttcagtacagctccctgacagcacgatggggctgttggtgttttccccactacagaggtgcccaaatggctagcttgaaatttatcagggatcttacataaagaatttgggcatctgggtttaaatcctaggtctgcttcttcctgtgtaacttaagataaattacataaatttttcaaaacttcaatattctaacatacattgaggtcaaaatgagtcaaagtatataaaacatctaccacacagttaaaactcaacaaatgttagttccctttttaaaaattcctgtactttgttctgcttggtgcagggttgggattagataatttctgaagttagttctcaattctgagattctactaatttagggagcagaagacttcttaaccacttcatacattatccttttaacctttcaataaaaaatcatttgcttagctaatgaagtataattcattactcaggacagtggcaaatactgggcattcagactttcacaaaatgattgtaatctacaaaactacgtatttagtaatagcaataagaaaaaaaactttgaagttagaaataactcaggaatggattattcttttgccttgaaggcacagattatttatctattaacttcatagacctgagtgtacaaggacacacggatgagaaaaatgtcagatgagtagactttaaaattttatgtgaagtttataatgcaaatgtgctgaagtgttcagattcagataattttcaagtaagtctactttcatgcagacatacaagcttgtcaaacactgaaaatgtattatcttatgaaaaaatagtaattatttgatatttaagatgctaaaaatgacctttcaaaacaaacaaaaaacaaaacaaacacaaagcaaaaccattaatcttaaatctaaagattaaaaatgagataatgaattaacaaggagtcaaacactttaccttccggcccacatacacaggaatgccaatgatcatggcagggatagcaatgccagctattaaggcaattcctaccggagcaccaacaagtgtgcccagctgccacaatattttcttctttcggctccaggggtttctttcccccaaaaagtacat

SEQ ID NO: 47464 - DNA, 874 bp, Bovine  19866880705415
gtgctgtgaccccaagtctagtccggttttccatgaacagtatcagtaaggcaaatgtgtctgaatgggatcctgagaatgtatccaaggattaacatcccaaaactgatgctgagctcgatgctctgaaacacatttgtgctcaggaaagatgtttgctaaggtttggtttttatttcccctggagctggtacacatcagtgaggcctgcagatagtgagtaacagcacaaacaataaattttaaaacaaacaaagtaaaaactccgagaatgctaatgcagaccagtgctgggctatggcgtgtgtgttactaagtcagcaatgattggggaaaagattctattacctgctccttagaagcagtaggtggctgactgctgattgtatcagttcctaggttatacgattttccatatgtcacgtgcttgttgtcgtttagttgccaaatcaagtcccactcttttgcgaccccatggactgtagcctgcaaggttcctctgtcaacatgatttcccaggcaagaataccagaatgagttgccatttcttgctatagggggtcttccgggatcaaacccacttctcctgcattggcaggcagattctttaccactgagccaccagggaaccccccatgtcacatgctaacagcaacaaatggggtgagagcaggaaggtgaaggagggtggacttaggaggaggaatggggactgtggcaggggctgtgggcttccctctcttccatctctctctctcctcactgggtgagaagttaggcagtatttcccagccccttctggcaggtgggggtacccataacactgacttccagtcatagcagcatgagatgcctctgagagagcagcatgcat

SEQ ID NO: 47465 - DNA, 1030 bp, Bovine  19866880718760
tactgttacactgcgcaaagccttgttttaaaaacacttttgttgataacgtcacaaagaaattcgtcccatgctcttgggtgtgtgaggacagaattcagtagcgtaaatttctgttgtggaagaagccatgttgcaacagcagtgatgaaagttctgtctcttcactggcctgctccatgtgtacttcccattccttgcgtttctggatagaatcttaacccaggttagctagaaggacagcaaaggagtatattaggaagaacatctttttttgtggttatagttgggaggtttgttacatttggtgcttttattttttcacttaagaccctatttctgttttatagtgtgtcctttttattagagattctgaaattagcagtgactattacagaatcacctatcaggcttaattaacctgaacttcataaagtagaacctaattttatagttcttacatattttattagatttgttggaagatttaagtctcgtaaagaacgagaagcagaacttggagctagggcaaaagagttcaccaatgtttacatcaagaattttggagaagacatggatgatgagcgccttaaggatctctttggcaagtttggtaatgtgtctgaattaaatttttatattcacattgttaattttggataatattttatactaaaaataaatgagacttatcatggtacttaaattttgtagttaatttggattaagctactgatagtccattatactagcatatcagtaaaattctatccagtttaaaggtcaatagccttgcgttagcacagtaagttgtgattgtaattggaacagactttaaaaggttttgccatgttacgaaattgtgctggatttatgcactaacagatcccatctcaacagaggcattgcatgtgacacagccaacttaggttggaatgtagtctttaattatgggttaggaaagctggccagctttaggatatttggccagtctcagcatcatgtttagcaattcaaaataaacttcaac

SEQ ID NO: 47466 - DNA, 2062 bp, Bovine  19866880805417
tgggttagatttcttcatatgtacttatactccccaacaatctccaattgtggagggcaaatttatacctggtaacagttaaacactaatgcatttaattactaaaaaataatcttgacaatatggaggagaagatccaatttatcattgctttgtacaaatattatagattctaaataataaaaaaattggaatgaacaatgaaagccttacttcccatgtgacagtgggcatgctcttcaattttccattttcctttgtacacatgacaataataattctaattacatttcaggtgaaagagtgtaaggcaaacaagtcatcataaatccaaaagaatttctgctaaatctactttggaagtatttgaaaacattttcttattcaaatgaacatcatgtctctaaaaagacaagtttcaccaaagtgccaagtcacaaagaaacactcaaacttttacctcgcccagagaaatgtagaacttcttcataattataacatcatcttcttcaacaggaggaggtggtggactgggtggttttttcaggacccagggtgaaaactctgtacctaatatgatattcatgcctgattcactccatcttacttgtgaaatcaatttggctaacctgtatttcagaaatcatacaaattgaaataaatttcaaatatggtagaattcagaataaaaactaaaattgtatgtattcaaatcaatcttccctcctagctttgcaggatgagtctcttaggagctgctaaaattaatggcatattcataggatcactaattaattaataattattctgttttattgtattttagaaaatagttgttctaagaaagggtcaaattttagtaaaatttcagactgtttaggaacttaaactttaaaagtcagggaacataaaagaaaaacttggccctgtgctagaacattcttttttatcccatttgtattcattttttatcaccctgaacacaaacacctttacagaagtagaaaaaaatttaaatataatgatcaaagaagcagaattgaagtacatttattaggtactgtttctatgaaatctctttgggaaatgttaagcaatttttaccaatgctctatattatactacatagtaaccaaaacgcaaactccaatggggttaaagtacacaattttattaagaaagtaaataaaaatgatttttggtgaaaaaaatcatttaaaatatatgtatattgatgaacccccccccctgtattcaaagtaacaatcactttccagaaaagttggaagtctttcttttttgacccagtgaataccttgttcacgattgagacactgttagaagacaagtgaaaaagaaagcatcacagaaaatcacctgttaggacaatgatggtctaatcactagagcaatgttacctctagctcttatagggagcctgtctctaccttctgtttggacaggacaaagaaccccgagtctcaagtttgaagccactttgtctgctggtacacttcattaattctctcaacaaacctacatcagctatcatttatatgttacagactaccaaactgaatccagaaaacttaagtaacttactgaaagaggaaaaatgaccaaaaaaaaattaatcagtgtcattattttcacagatataaaacaggttaaaaataatcacaaacaggggacttccctggtggtctaatggctatgaccctgagctcccaatagaggatgagatggttggacggcatcatcagctcaatggacatgagtctgagcaaactctgggagatagtgaagaacagggaagcctggcatgctctagaccatggggtggcaaagaatcagacatgacttagcaactgaacaagtgccagaagttcaggactctgtaggaggccccataggcatgaaaaccaaggtttccacagaacatgattgagatggggatggcgtcaagatggcagaatagaaggatgtggagttcacctctccccacaagtacatcaagaatacatctacaaatggagcaattctcagagtgcctgctgtacac

SEQ ID NO: 47467 - DNA, 1179 bp, Bovine  19866880851852
tttcctccgaaacagagagcctattgaaattcttctttttttgggtgcctttttgactgaaggcaagctcacagatgaagcagaagactgaagatctcgatctgaacccatctgccgatgtaaactcatgtctaaaatgctcattagaattgagtcagggtctgtgtttacacacagcccttcattatatttaaagataaaatctatttcttgttcttgcattcagattaagtcatgatgttagaaaatcctacttggttccttcagagaattcttgaaagagttcaatttatagaagacttatcacggatgttctgaaaaacagaagaaaacaaaacagcaagattatttaattgtattcaccatgtgcatgtctttttaataaacttacaaactctctatgaaatgtcaaacaagtatgtactttaatcaacggtttttggttttgatttttttaaataaggccagtttatggtagtgctagtggtaaagaatctgcctgccaatgcaggagagataatgatatgcgtgttcaaaccctaggtcgggaagatcccctggagagagcatggcaacccacgccagtatttttgcctagagaatcctatggacagaggagcctggcgggccacaggccatagggtcgcaaagagtcagacttagcacatagcacgttagcagtgatcagtctacaagagatataaaaccaatgctgatataacaaagatattatttaatcttaagaatctaatttgagttgaccttattattaaaatcttgtataaaacttctgatttttatcatactcaaacctcaatgattcccactgcctttaggagttttttaaaaactgactataaaatgtacatgcaaatatgaagggctaagaagagcttatacaactttgaagaacagtgtgtatgtggagagggagcagattctcttacactggcagaaataatgactcattataaagttacagtgatgaagaagacagtgtggtacaacacaaagacggatataaagaccgatggggaacaaaacacaggccaggaaaaaagtcccactgatacccacgaatccctgacttactgtcaaagggtgaccctgctgagcattgagaatgggcttgtcaaaaacaaaacaaaaacaacatagtactgttttactggttaccat

SEQ ID NO: 47468 - DNA, 1975 bp, Bovine  19866880897230
tggtgatgctccagtactcgcttgaatccttgctaaaccctctgctgtttaagattgagcacagaattttcttattagaattaatatttaccaagggtatagtagatgttgagtactgaaaaaggcactttgcagacactatctctgttatttacaacaactgtgcaaaggtgacattattgttcccgtttttctgataaggaagctgcagttccaaaattcacttgcccaagataactcagcttcaatgggatggacctaggattcaaatcgatctctttcaccctccatctctatcacactctttctgctgaattctgattccttactttattctactaccgcagtttttctgtttccttaacagttacttttctgccacttttatgcatctcaagcaagatttttccaattctttaaggattgtgctaaaagcagtcagaggctggtaaaaatgctacatctgtatcccataacaaagaccatgttgtcaagattcaggtcttattgcctgtcatctgttatactttgaaacaaatttgcaagaaaactcagccaggtctgaggctattattattttaatctctgcagaagatatacaactgcccaaactgattaaattaaaatgtaatttagattcagaaagttgcatgtctgaaggaatagaatgtacaatttccatatatgagttcttaagattctagctgttcaaggtacattagagtgtctgcagctatatgcgaccgaatgtctttgttccccaaaacagggaagatttattcatttcggcattaactaatctcgaccaaatattcattgcccactcaaatttgtgtaacttttccaaagaattgagttacaaatgccttttgtttagccatggaggacatcgaactgagtctaatgttaatagtttcctcacgcagttacatttaacaagatacacagtccattaggctcttgttttaggccttgagcataaaacgaaaaattttcagcaattagtttggcaaaatttttggctcttgagatccctgaggcaaccaattaagaatcagtaatgactgatgaggtcattttcattgtgttcgttctaaactcaccgcgccaagcctctccttcagcagttttcagctatttcaatcttctttttaggttgcacagtgctttccaaagaatgatcaggaggaagttagtccccagaagggttctgcaataagaaagtttcaccatcaaataagctggggacatactgcattatatagatttttggggggatagttacaatatgtataagcaaaatgaaggctctgagaggttctataaacaaatgtttttatttgctttaatctaatttttctgagggcttcgcacatagctcagtagtaaagaattggcctgccaatgaaggagacaagggttcagtccctggggcaggaagatatctaggagaaggaaatggcaacccactccagtactgttgcctggaaaatcccttagatggaggagcctggcgggctatacagttcatggagttgcacaagagtcagattcgacttagtgactaaacaacaatttttctgatatttgttgaaccaaagactaccccttttgccctcccctctgcaacacccatttaatctcacagtgaattagtcatcttttgtaaaacacagacattggttattgcaaggtcaaggggacagatgactcctttaacctttcctgtgatgagacaattggaaagtttggaggatgcaaattcaggcttcaagtgagacgcatggcagagtgcctgactcggagtcattttctaaatgttcactgaatgaataattccttctttgggaaaatggaccttacttttcagatcaggtttagatttacagaaaagttgtgaagccggcacacagagcccccatagactctgcacaggtttcttctgtattagcagcttctggtactgggatagatt

SEQ ID NO: 47469 - DNA, 1023 bp, Bovine  19866880898573
tactgagcgcctaattaactacccaacactgaacctgccttaagataggagcaatagtatctgcttcattaacttgctatcaagattaaaaagcctatttttgtaacatcatggtgaaagcatcctaactgatacatttttctatgtcattaggagcactttgtaaccaccattaaaaaaaaaaactattacttatacaaattaatatattaacaattatttatgaactattatttatcccagacaaatctgctagattgacagaccaaaaattaaagtcattgttacttcaacttgcattacttgagtagtgaggtttagcaatttcttgaacatttattttccaacagtctatttctcagaatcttctttagaaggaacacatctgcaaaaaccaggctatgctcaactgttatattccccctagatactctggccattataatcttttaaaacaatattttcaaaataacaaaacacacacaagtcaactgaactatgagtcctaaatcagcacacaagattttctttagcacatataggggttacgagacacttatgataagccttatgatgccatagcattgcctaattttgaataaacatttggaagtgctgaggcagtatttaactctgttcctcttctggatgtgtccaggcctggcaatgtgtgttcagtgctcttgcttcagaacctttgggccccatgagatttaggagagaatttggctgtctctcacagaaaccacagaatctttgcaaccatctgggactcactttgtttaaagacaaagatcctcttggtgggtttttatagtttcattttcaaccaaaaagcctgttaaataggcttcaaatttgataaaaagaaaatccttaaaagtggccagggaggaaaggctactaagatgaaaggaaatccaaaatggctgcgccttggaactctgctctacgtggctgctcccttgcagggttcagtggcagccatgcctgcgttccttcaaagtggcaacacttacagtg

SEQ ID NO: 47470 - DNA, 1112 bp, Bovine  19866880919458
cgaagggaccttggcttttttggcacagggcagagaaggtgggtgtgtgactgagcagtcacagcggacccagcagccagaatgtcactggaggagtcacaaccttcacacccatttctccttaggtgactttttaagagaccaagaccatctagtaaacgatttccatgaaactctaagaaggcaaatcaaaatatcacttattaaatgtttaatgttcactattgtgcttttatggccagaatatagttttcagctcatttcacgtcctgctttgatccatgcataatcatgttcaatgtacttttacccctgttacatgagttggaatgtaatttaccattttaaatgttccctgaggcttagcaccactgtttccttgctattacaatgccttgttagttacgtccggtttgtttgccaatgcatcacctaattctagtattgtttctgtgggatgatttccagggatacagggtaacaagaattaagaactactagcatcatacttagcagcagcagcagaatcttatgatgtttatcaatcttcattaaggagttgtaaaccagagagaaactgatggtgtttcctcctcttatggcttgggaaaagatggtttcttgaaaagcacactgaatggtagtttcaaaaatgccttctgtccctgctctgtcagtggccctctcctctgggtgaccttggactggtcacttcttccttctggaactggaactacaatgtctccctgtgaagtgaagagactgaactaacagtctctaagtgttcttccagctttaacagactggtattcaaaccttagctctttgcctggcaaagttttcaagaaactatatagctgatgtcataacaacctctgcctttatcatttctcaaatttgagtgaagctcctgagaaatggaaagggggcccaaggccagcaggagggagggaaccacaactgctgcctcctttgggaagtcctctctgcccccttggcattttgttctgccctccatcgtggcactcccacccagtgttgtgaatgcaggttcacatctgcgtctctctaattagactctgaatggccaagggcacagactgtgtcctggg

SEQ ID NO: 47471 - DNA, 1079 bp, Bovine  19866880949090
ctgggcttctactgttctcaagtgaagagttaagtggccaatcctcagttgaagtgagagaaaaggagatttttccaagactggtcaaggagagaagcttgttttataaacaggatcagtgactagcttggtggttaagaatgaggctgtgactctgactccctagacccaaatcctggcgcaagcacaggacagctgtgtgaccttgggaaaactccttaacctccctgtgccttggcggccttgtgctgaggataaaaccacgactcctgaggattgtgagaattaacgatctcctacaagtgagcccttagcatacagtaagcccttgagacagacttactgtaatagaaataattattactatatcaataattagtcttactatgtaattcttaatatattaatattatgttatactaaacgactgctcttattcttactaaaagagcgaacaagaaagaggctcgcccttttcaggtttttcatccccagattcagtgaaaatatattctgctcactctcctaaggaattgttcctgctttgctctaaaccgtgttgcttgatttctggagaaaggtgtgtgggtgcacttggaaatagtctggcatgtttattaaattctaaactgaacttcatagatcctggctgtgttgggtcaaacctagtcagaacatcatgttttgatgaagatactgcaataataaatgtctaaaatagcctcagtgtacttatataaatggtaaatgagtgcatggtagagcgctttataatgagggtggggtttcattttcaatccaaacaaaactgttgcagattgaaagctttccctttctcaggatttcatgcctccgtccttacccaggctttcattatttttcaggtgcaattgctggtatagttgatcagccaatgcagaacttccagaaaacatcggaggctcaagcttcagcaggacacaaggccaagggtgttatctctggcgtggggaaaggaatcatgggggggtgttcacgaagcccatcggaggggctgctgagctggtgtcacagactggctatgggtgagtcctggagaa

SEQ ID NO: 47472 - DNA, 1032 bp, Bovine  19866880964468
ttgtaatgtttgaagggattgtaacatattagccctgtggttccagtgtaaaatgtgtaattgagtaatcaattgtggactttagattttaagttaaaatataatagaatttatccaaatatgttaacaatagtctagtgttcaagataactagcaaattcttttcatcagtcatctagttcgttagatttatctatgattgtttaagtactagatgattatccttgttaatctagcatttgagatgcttttaaaaatgtgaaatgtataaacacagcttaagatgtttacagaacttgaactaagtttcagaagaggcttgtgtttactttagaaatagtaatttactttgattcctttctctcacatcccattctgatcagcaaagcctgtttgcacttcttttaaaaaatatccagagtcctcctccctacttagcttcactcctacacccaccgtgatatagccaccgttgtctctctcctgagctaaaaaaaaaaaatacaggctccaaagtggtcccttacttctacccccatcctctattagccaggtcatgacacttttccaacttttggcacttccttttgcactcaggatgctaactcccacccactgctccgactttcctgactcatctcctaccgctctctcctttgcttacttcaggttcatggctgagacaagcatcccagctctggggcctttgcatgtctttgtttcttctgccagaaatgctcttttccatggtggcaacatgggtcatcccttgccttcttgcgctcagatgtcaccttctcagagatgtcttccttgaccatccctgtgcaaaatcctccatgccctctgctcaccccttcaccctctgtctcccttgtcctacttcattatctgtcttcacagctctaaccaccaccatctggcagattatatgctggatattacggtgattttttttttttaattttgcacacaaaagtttgccttcaaggataccaaaaaaacaaaaaacaaaacaaaacaaccctcatg

SEQ ID NO: 47473 - DNA, 881 bp, Bovine  19866881009958
cagcccgggcgctcagcccacagctctcgcaggcggcagacaggtgctgcccgcgcaggtgaggcagcacgcccgggccttggtgcatcccgtgaagctgcagaagctggtgatacagcccgtgaacctcctcgtcagcatccacgcgtccctcaagctgtacatcgcctctgaccacactccgctctccttctcagtgtttgaaagaggccccatcttcaccacggccaggcagctcgtccacgccctggccatgcactacgccgcaggggccctcttcagagcaggtgaggacacagcagagggagcctgagcgagaaagaaaggcttcagggtggtcctgactccaagacacagggaagcggcatgggagggtgaggggcagttggacagcagtgactggaatgcagaccctgccactgcgggctgtgaggcgggggcaagttactgaacctcccacatctcagtttcctcacccgtaaaatgggttttaagatttctgacaagaaaacaatggaagtgtgtgaagtaccctgaatttagagtggcgcttaatgaacccttaagcagtagcagcctttaaatttgctgttatgtaacagaattttgattcccatttagcaagtgccttttcggctccttaaagacacaaggctctatatcagggagctagtgcagccaggaaaaccagcccaggccctctcagcccctgggcctaaaagaaatgtagttctgggctgttaactttcttcattacggcccatgaatagctctaggtgagaaattcagaggatttgtgtgctcgtcagatgcataaagagccttctacctacccagtacagccttgcctgtctagacagatggcaaagagaaggctgtag

SEQ ID NO: 47474 - DNA, 1631 bp, Bovine  19866881036825
taaggacaggcatgtttctctcttttgaatgacatctcccaagaatgggcttcctatgtggcactagtagtaaagaacccacctgccaatgcaggagacttaagagatgtgagtttgatcctagaatcaggtaggtcccctggagaagggcatggtaacccactccagtactcttgcccagagaatcccatggacaggggagcctggcaggctacagtctataggattgcaaagagttggacatgactgaagtgacttcatatgcacatcccaagaatagggcttgacctgtaggaggtacagggtgaatacacggtaatgaaggaatactctgaagagtgtactctgttattgctcagggattttgcagtgattctttgggtacaaagcaatcaaattctggcctgcatgaataagcaagaaactataacatattaagagaggaactgtagggccctgtgattcttggatttcagtgtgtttaagaaccataaagggttctggttaacaatgggattcttggttcctatccccagagattcagactcagtggttctggaagcgatccaagacaatgcacttaaaaaatatataaccgttgattttgttgtaggtgatctgaggcacgtactttgagaaacactgatggagtctgaaacagtggctcagatagttataaatagcttcccagaccacccagccgatgagccacagagctagggttagacctggctcttctcactctcagtgccacgtgttttccactcacaggctctcttaatatatgtttataagctttgcacgtaccttggttaccatgggaacgcaaaagcctgatgaaatcctacaactatagctggttttgaggcttcggttgacagctatctttagaaaaactcagctccacaatttactgtggcctgtgttgccctgagttcctgtagagtcttctaaaattgtaaatgtgcttttgtgatgtgctgatgccataatcctttgacaggagggagcacaatgaaagccaggaaccagggccctggctcaaactggtttgggggtggactaaaaagacacagggaggccgagtggagaaactggaatgaagctatactatttaatgtgtggtgaagggcttcgaggtggccattaactgatttagggaatgaaagaatgagggttggtttaaagatatttcgatgaagaatatttcattcattataaaccctctggttgagagcattgatcagccttagaaggactgtgtttgaggtagaggttagatcctaaagggacaacagtggttgataagccacctcccaagagcaaatccctgaagccaaaactgtattaccagctgtggcgcttaccatgtgccagggtctaagatttatatactatctcacttgatcctcataatattgctttatgtggataatattatcctcattttacagatgagaaaacaaatagactacctaaactcacacatttacaaaatatctgagctgggacttgacccgggcaatctgggtccagacctacccttttaaccaaccacttctgtccagtggatctgaaacagaacaacaggcagaactcctgtctttaggagcattgccgtaagggttgat

SEQ ID NO: 47475 - DNA, 811 bp, Bovine  19866881047051
ccaaggagctttaaggagaacccccccgggctgcggacacctgctgccccaggggccgccttgacttggagggggcgggagcgtcatccccctgcacacgggtcccttttagcaggaatacgggaggcagggaagtcatattaaagctatttgtgaggctgccaaaaggatcactttgatttataaagtatgaaagtttgccatttatgaattcacagtgaatgagttatttcccatattttgctccagaggagcttattacattctcaatcctagtgtgaaaaatgaattgcagggaaaatgggtcacttttcccaaatgttgaaagtactgcatttaaggtttcagtcaccccttctctctggtctccctcacaggctgggtggttggatccctggaaatccttggcagcccggcgagtctggtgcgaagcatcgggaacggcatcgccgacttcttcaggcttccgtacgaggggctgacccgaggcccgggagccttcgtgagcggggtttccagagggactacatcgtttgtgaagcacatttccaaaggtagctcttcaggttcctggtaatgaggcctgattttcattacttccctgtctttttagagaacgtcttaaacgttctccatgaattaacattgcctctagctttgtttggcttgttagctggcagtgagatgttggatttgtaacaaagcccatatataatgtcttatgttttaaacagatcactgcttgcctgtagctgtgtgaaaatgtttcagaaacttcagaatttgaaacctccctttgggaaaacaagga

SEQ ID NO: 47476 - DNA, 1785 bp, Bovine  19866881062317
tagcgaggctggtacggtgtgtggctgggccctctgcacggcttggggtctgaaccaggtgagtatgtgccggccaggagtaaactacatctccccatcgcaatccctccctccggagggcggggtgaaagatagactcggaggtggggagggagtgcgggatgaactgccttcttagttgggaaaagaaactggggccctttgtttctcggggctgaaggtggcgggtgttggggcaaggtctctggtagcagccactagttcttgtgaacaacgccggggactagagagaaattgttcataagagtcctgaagtgccccctgaccgttggggttggctgtagaagctccgggatcgcggtcaggccctgagcccgctgtcctctccggtcgcgctgtacatagaaaccgttgctacgggctggaggatgccgtttcctttccgtctccggctgcaggtggcgcccagccttgtggatgctgggaagaacgtgcgaaggtggaagtcaaaacagtttttcccgttactagcgcattgcagtttgcgctggagatattactgacaaactgatgagtaaatgtgggaaatggatgtgagttaggatggtggagaagttaaccccaactaggaccacaattttcctaatcagagacaagttgcaagcagatgtggaagaattctaacgagcaaataaagtataacttgtgttttggagtttgagagttaacattaattgatcttgagaatgtgtatcctccccaccgcagtcctccaaaaaagttctcaaaaaagattctcagaaactttaaaacagggtttacgttgaaattctcttaattaggtaagagatgtctttatcatttctaacgtttttcactatgttttattcaaatcataaaacctcaggggtttcaagattcctttaattgaaggtaatctattttaatcccgttagatgcttaaatcctcccatcaaatatcctccagctcttgggaaaaaattctcctacagacaactcattctattctgggcagcaccaataattttaaagttcttcacttggtttcatgtaacttccaccattaaggctacccttgtgataggaggccatcctactgggccctgctagtatggtaggccatattctcacttcttcgctggacctcattcaaaagctgacaaactgtcatctatattctgtacccaagtcaaagccagcaggaatatggagacgctgacagtgcatcctttttctgcagacgtatgatgtatgaccagactcagaaggcaggcatgctgaagggaatattccttatggattagacttattgctacttgttttaaaatttatcacccagtgtgttttagtgcagtgtttaaaaaaaaaaaaaaaacaactttgacaatataactcataatatatacattttactttgcaacatttatatacacatttgtgtgtgcatttatatatacctgtatttatcatttgtttatataggcatgaaataaaagtttctgtaaaacagtatgtaatggtttgtgtcaggtagtctgattttactcctgttctaccacataaaagaatgctgattgcagctgactaagttgatttcatgagttgtatgacagttaagtatgtgggctctgtagtggcctgaggttcaactcttcagttcactacttattagttatatgaccatatgcaatttatatacttgaaatatcaccttcctcatctgtaaaaaggaagtaatatctttcatgaaagtggtcttgagga

SEQ ID NO: 47477 - DNA, 1910 bp, Bovine  19866881066756
tcctatccctccacccctgccaagtagaaaggtttaagcatttcaagtaactggagacctttagctgaaaaatagagatggaaagttaagacttgagttaaataaggaatcataaaaggagatagaactgtcttctgaaccatggtttgggtactgtttaagctagagatcttttagttggttaactaatattattcagttatttctatgaactgtggagcgtgttattttcacaaataatacctaatgcactagagcattggaaattttctttaaagcaaatactttaccatttgcttccattataatttgagagttattttctagtggaaaaaaagcgtggctcccacacaatgaaaatcatcttcaggagtcctatcattctgctttcaaaatatgtgaatgcttggtacatttaattccttgatatattatacaataaaatgataaaatgtgcttaagttactattaggattgaatatgtatgaagatggaacacttacatagtaaacactaattattagcatacgaaaaagtttctagacaaaataccctaacttttatggttatcagaattcacagtcattaaaatatttggttagtattattaaaggtaatcccgtttttctttgtaatttgtttagattgaatgggacttaaatgtttagctatgcactaggaatatcttagcttttctatttaaaagaatactgcagagtatcatgaaacaagtttgatgtactttcattctaacatttgagtacatatgatgtgctgtgactattcctttcttttcctcccccccacctctctcttctctctttcttaccctccctccctccacacacacgttgttttatataaataccgtaactctttcttgttattatgtcctaatttttgaaatacatcaaaacctgcgttttcacaaaagtcaagtggccagatgtttaatcaatgctcgtctcatcaaagtgtaataaagggatgaacttctggaatacaagaataaatataaaattctaagaaataatttttttaaattagcaatcagatattaaatgtttgacatcataatgctaggactgattattactctaacatgtcagctgttagttttctcctgataattactgcatatttttaaatgttctaaatagataagcactatctatgagcagtcattttcaacaaacttaagtctctagactcaaaactataagaaattttcatcttaaaggaatttataaagctgtttggaaatttgattattgagaagaaactatgtttttgagtcctcactttccttggtatagcatgtttttatggatattttgctagattttggaacttgtgaaattttgaaatggcaaaattgacattctgcttttaattctcctcatcatgatgtgaagaattcccaaaaaaggctttttcttgaaaggctatctctagatagcctacatcactagttagaaattgtcagttcttaaaagttctgcttagtgatatactggtatactgaatggcctctacaaaggttagaattatgatttagcccaatttctgctaaactgcttcatatgttttatatgtttgctcagaaagaatattttcttcctaaatttatctagttaaagcaatcttgacattcatatttcctataaatctgttccctgtttaataatttgaaagctcttaagtttgtatctaaatttggctttcacaatcatcactaaatattttacattttcttcttgccgcatagtgtacatttatatacttaagttgtccagtaaaatttcatcatttaaagcaattagatttctactggggttgtcttagaaaggctttcagcatttatttaaaaatgaatattcacatattaatgtttaaatgacatacattat

SEQ ID NO: 47478 - DNA, 857 bp, Bovine  19866881078773
atggatgtgagagttggactgtgaagaaagctgagcgctgaagaattgatgcttttgaactgtggttttggagaagactcttgagagtcccttggactgcaaggagatccaactagtccattctaaaggagatcagtcctgggtgttcattggaaagactgatgctgaagctggaactcttaatactttggctacctcatgtgaagagttgactcattggaaaagaccctgatgctgggagggattgaggacaggaggagaaggggatgacagaggatgagatggctggatggcatcactgactcaatggacgtgagtttgagtgaactccaggagttggtgatggacagggaggcctggcgtgctgcgattcatggggtcacaaagagtcggacatgactgaacaactgaactgaactgaatgaggttcaaacaaacaagttctctggagaattttacattttatttcctaagattaaaaacaggttaattgaatgatgttgaggcacccacagagagatgctacacatataaagacatgatcctgtcccacagcttgcaatctaaaattagatatacacaggcaagctggaaaaacatagcatgctttttttttaagaccaaaaagaaatgatgggagagaaaaatgagagtggtaaatcaaaaaatcaaagggaactgacacatattctatcttctgccttttatttgtagccttaattatctttgtcagaaatgatcacactgttgaagtcaaagagggaagctgtctgatagcctctaaagggtgacaggacactaatgggattgctatgcacagtgtcctctgctttggaggtccccgaactccttttatc

SEQ ID NO: 47479 - DNA, 902 bp, Bovine  19866881086303
cccctcccctccccagttaccataaccatatatatttctctctccacttctctttcatttggggcgagatcagacagtgtaaaaggccattgggggctttgaagtgtgttcctgttatgtgatgagaaggggaaacaccaaggccagtgctatctgatgtcccaggatcggcagcctctgcatagcttgtccagttcagaaaacagaaaaaggtactgacattacagccgtcacaagaatggtccgagcatagcaggaggacagtttcagagagccagaggggaaggaatgaaggattatgctatcaacagaaatctctctgttgagagagagagtgcaggaatcctgcattatgaaaaaaaggattaactccccccccaactttatcaccctgatatataaaatataaaaagcctactgaaataagtcaaggaaccaaactatatcagaaattgctgaacaattctaatgtgttttatttttacatagggagaaggaggggaaggagactaggagagagaaaaattccaagaagtttcccccaacttctgtatttcactgcacaagactacttacagactatcatgtaatgctgtaaaatgataaaataacaaaacacaaggcctcggaacattactttctcatttatcaagacctaatagtgattttttaaaactatcgagataggctgcaaatatatggacatctctactgagaatactgacccaaaggaagtcctatgtatccttcaaagcgatatattttacagaaaaattaagttaatcatagttaaaaattaatcctcttgtgcagtaccgtgttatttatcccacttattttgtaatgtcctgctttatataggggacagatctcagaataacaagcaacttagttattcaccc

SEQ ID NO: 47480 - DNA, 1227 bp, Bovine  19866881125174
tgtttgtaaggctgtttctaagtacctgtggggatttgtgagagcgccagctgtactggtgactgcagagactggccagcaggatattttcatcagtatccacctggccaaaccgcagtgtctcctgtgtgtcattacagatcacaaaatggctgaagaccaactcctctacctcagggcatttgttctgaaagaaaaagaagacgaaagccaacatgcatcagattaattgcaagatgtttggcagctgtctgcccagtggcgattgttacaacacagaaatactaaaagatctgttgtcattagctctggtatacaaagtattctgtacttccaggataagcaccaaaaaataccttaaagagaccttaaatgttccaagaatatgttttgatttatattcctgcaaaataaatcatatatacagaagaggaaaaagaacaatgagatccctcaaacgtttaatgttttaaaatgaattaacatgctacaaagaatgctgtactgggtagtgcacgtttttgagcatagtaccagaggctagaattaccatgttcccggccttctaaacttgacaatcaagaccaattaccaaagccacagtttgtaccctacagaaagcaaggatcatttaggtaatacttccccagttcccttaagggggagggtggcgtgtgtctgtgtgtctgtctgtctgtgtgtgtgtccgtgtaaatctgctcaggcagagatgtaaataaaaccataactttccctctattgttaacaggctgaacacacacaacagatcaacttcagagtctgtgtaagccaagctgcagttttcaagagaaaatgttagttgaaaaccagttgctgatgtctatttcagctaataatcaatcagcaaatgtctttcattaatctactgaggctcagcaaattagtaatatgctcctaatgtgtggatacctccttctccactggttgctgttacatcaaagcactggctgagtcatagagcatttctgtgtttactctttttatcacgctgactaggttatggcttaaaaacaatcaacatacctttggtaaacagaatagctaaataaatggctaacttgagaatgcaagaaaaaaatctttattagccaatgatttttcagataatgggaggtaacatgtcactgatagggcttccctgtggctcagatgtaaagaatcctcctgcaatgcaggagacctggg

SEQ ID NO: 47481 - DNA, 889 bp, Bovine  19866881153347
gctagcccagttccaagaaagcatataaatctgtaagagaatagggtacatggaattcctaaataaaatgtttttctgatatggaacaatttgagagtccttttcttttagctccagtttataaacatctttattcaattgcatttttttcttttttttttttttaaataatcatatgatgttaccttatggaattggaatgttgacctgcatgtacctaatattgcatattattcttttatcaaacaaaatgaaaccttcagtttctaagcctttggtatttatagggtagtcccagtttgggttgatgttttttccctccttccataaatacaaattccactgtgattcaaagaaggcattgggaagtgaaataaaatgtatgttgccattaccaaaaaaaagtaaaaaggacgtcgttgcctaggtagacctataatagaaaaaattcctatgaattgaggtaaaaatatcaaagttaagaaaactattttataattgaggaattatttttccaggaagcttttcaaattggaatatactgggcaaatacaaacactgtgcacaagtcggcggctgttaagctggtccataacctgacgtctccaaagtggaaagagggaggtaacggtgaagttgtatctttggacgaagaagggtttgttcatgctgaaataagactcggtgctttcccaggacatcagaaggtagggtcaaagtctctcaaagtctgcttggctcttggctgggacagggagtagtggggggtcggggtggagctggggatagcatgccatcccctcaacttgtttaaaatgagccttcccttttcttttctaatccctttttagtattatatgttccaaacagtttataatagtgcaacaca

SEQ ID NO: 47482 - DNA, 809 bp, Bovine  19866881177615
cctctgggtgcttcacagttgaaacaatccccagttgtgcccttttgtgaaggcttgtacaaaactctagaaatcagtcctgggactggataaagtgtcttatcacaaactgtctttgctactttcttgtgtaagacttcacaagtcttaacaaggtcacaatgcaaccatttctacatagtgactgaaatatacaggaaaaagaaaaaaaaaactcgactccaaacttcttcctctcatttaaatagagtaaatgtatttaccaacagaaaatgaagaaattccaaacatctctatccactagatatttaatgaccaaaactgccagggtcccgtttactggtgacttcaacaaggcactataaccttcctcagagaatataagtttcttggaacctctcaggaaaccgaaaatatttgacgagagaaaggtgaagagacagagtctataagtcttactattttgctgtttcaatgactgcttagaactaaaataaaaaagcagttgatggtgactggatagtaggtcccgggtactcaaatggagttagtgtttacagaatattttggattgaaatccttgccagatggtcctaagaactgtttacctcactgttgattttagctatcttaatgtcagcaacaataaaagaagcttgttactgccactggggagcaaaggcacacagtccttccatcccaaacggaactgctcgttgtggacagctgtgcgctacgcaacagtaagggcgataatgtagtttccgggaatctatttccagattagagaaagagaaaatataaggcaa

SEQ ID NO: 47483 - DNA, 663 bp, Bovine  19866881208832
gcagcagaagaaatcaaccccaaagtttttttggttgtttttggccacacttgtggcaggtgggatcttaagtttcccaaccagggatagaacccgtgccccctgcaatggaagcttggagtcttaaccactggatggtcagggaagtccccgacagctatcctgatcttggatttttagcctcaaaaattttttctactgtggaagccacccactttgtggtattttgttatggcagcccaaccaaagtaagcttcatttaaagatggaagacaaggcatctggagaataagaaatactgtccccatcacactgaagtggtagagaaaggtaagagcaagggagcaccctacagagggaatttctttaaaagactctatgagctatctacgaaaatgaaatatattttcaaattgaaaacatttttcgaccgcgagcacaaagtaaaaataaaacatacataccttatagaaagttgcaaaccccagagagaccatgaatgcgccaacaatatgaaatcgcagacgtctggccagaaggccacgcatctgaggttttgccaaagcagtggacatggcagtttttcttctcgacggctagaatgagagagagctcttagaactcttatgcacaatacattttagtacctagagacacaagcag

SEQ ID NO: 47484 - DNA, 1357 bp, Bovine  19866881210421
catgattcaagtcaagtacaggtcctggaaccctaaccccaaggacaggtttccaagcactgttgatttcacaggcaataaataatgagaccaggctgttctttctggtttgtgagcagaatatatgtctattttttattacaaaataatattaggtgatttctcaagagttatgtttcactgatcatatctgaaacttaagaaattgttatttttaataaaatatacttaataatagagtaacccttctctatattttttcctataaattatttcttaagattctcataagcctgtgaggtgaatagagaagttattatctgttccattaaaatagtgatcactaatctattgcatataagagtgttaaacatgtaagatttttggcaattctttggaaacttacatggacattgatgaaacagtaatattctctggaaaggtaagacagtaactcagattttctccatcaatttcctggaatttaattgtaaatcttggatgattttagagtctaataacttatattaaatggatccatagcttagaaattgctgctgtcacaaataatctattacttcacttactccaagaatatgaggtaagtgactttttaaattcatagagcaaagtagaaatagacatgccaagttcatagattagatataaaatgatatagcagcatccctttgaaatacaaagctattaagagctctgtagaccgtctctcctatatggaaatgaacatgctgctcagtcacaaattagaattccacttaacagaatacatggtgcagaatgaataatcttcattcaagcagtcgacaattatactctcaatcctctctcgctgttcattatattattacagacttgactttcaaggggaatgcttgacaatggttaaaactaataccttaaaaatgtgagtttgggtacagatagagatccatggaatagacattaatatataataactggatcttctgtcttgtattctagctaagtgtttatttgctggtgatcttatctgacaagtccagagaaacagaatggtatcaactcatcactaaatgcaattcttgtgatgcttttttattcctgagagcaaatgaggtaagcaagctttttttactgaacagattgatggaataacattttggaaaaattatagggagtaaacagatgggaaatgggggaaaagtcacatgggtaagaaaagccatgagttttcactacaaaactataagacataaaggacagttctttggggaactccataggtcacttgattcaacaacagtgatgcattttcgttccagcaaaagttccaaacttcaggagtagagggagtttt

SEQ ID NO: 47485 - DNA, 1191 bp, Bovine  19866881256760
acaacaactctatcagatatgaaacaacagtattgccaatgaggaaaccaaggcttaaagaagtcatataaccttgattcaaacacaggtagtgcaagatcaaaggataaaatctttgatctgggaattaagggaaataatacttggaataaaaagaggaaagagcattgtaaggtggaggaaataacatcaggaacgtcatggaggtcggaataagcaagacgtgctgagggtatgagaaaatcttatggttgaaacatggcacacaaattgcagtaaaggcaagcgaaagagtgaaagagaggggcataaagagaagaatagattagggcttaaatattggaaactagattggggctttattcctaggaaaataaactggggcatgggatctagtcctgtgatctgtggattatcagtaattctggtgacagtgtagaagtattggtttgaaagaggagaaacaaagggagaccaattaagatattcttggaatggcctcactttgctcttccaggaagtgaagtcaaagaaaacaagttcttactgcctaatgaaaagaagcacacaagtttttttcaggaatacaaattttttcctgtaataaatcttgttgttgttcagctgctaacttgtgtctgactctttgcaaccccctgacttccctgtccttcactatctcctgaagtttgctcaaactcatgtccattgagttggtgatgccatctaaccatctcatcctctgtcacccccttctccttctgtccccaatctttcccagcattagggtcttttccaatgagtcagctctttgcatcatggccaaagtattggagcttcagcttcagcaccagtccagtccttccaatgaatattcagggttgatttccttaggattgactggtttgatctccttggtgtccaagggactctcttaaaaaatcattattatgtatctttatataaaggacactgaattatagaattcatccctttgtttactacaaaccaaatattcatttaggcctacggtgtatgcttgtttaaggctctgcataaagcttaccaactctatagaaactgatggttttgtagctgttaggcaacatatctcaaatatgcatgggctctttaaaaaaggtagatgaagtcactttcaaacgaggtttcgggaagactaaaggagaacta

SEQ ID NO: 47486 - DNA, 811 bp, Bovine  19866881279613
attatttattgttttaaaaaatttgtgtcattttctctttttacaattacaagcaatgctgtacgcatatccccttttccaaaatagttgtaccaactgcacgcccaccaacagaatatgagagtacttattactacaaattcatgataacatttgatagtgtgagattcttaaatttttggctatgtatttggtatgtcattggcgtgtggtgtttttaatttgcatttccctgattattgttgatgttgataacttttcaatatttagtggtcatttggatttcagctttcataagttccctgtgtatcttctttgcccacttttcttttgagagatacatagatagatggatagatatagatagataacacacatgtacacacacataacactggggggagaggatagggagcaggaaaagaagaagaaattattagaaaagggatgtggcaagactgataattgtgaacacatattatatgttctgatttttgaggcttattgcctagattaatcttaaatctgtgttccctctaactagggcaccaagattctgtgttactcacacatcctcaacaaaacatgctagtgccgagctgaaattctggcaccttcgtcaggagcagccgaggaaggatgttgaccctttcccacaaatggcaaccctcttgccgttaagacccaaatcttgcattccacagctacctgagatgcaggtaggttgtccagcgatactttgatctcttaagtttgtactaaaatgtcgatgcttgggttttgtacactagcccgaagttttatcataagc

SEQ ID NO: 47487 - DNA, 767 bp, Bovine  19866881297163
ctctggcgccatcacccagtgctactgagacatgggtgcccggcaccgagcccgggcccagtccatccagatcctgaatgtggaggagaccgcagccagcaagtgccactgaccagcggtcaagcagttccatgaccccaagatcgagttcctgctgccccaccgggtcctccgtggccagcacaagccacgcttcaccaccaagaggcccaacaccttcttttaggtgcaggccctctgtccacaggtctgcccaaataaaacttagtgggaaaacctaaaaaaaaaagaagcgagggccccttatcactgaatcctcaatgcttactatggtctctgggtcagctgttgtcactgaccttctcaccagcttccagaagtgaggaggactctatggacaaatacttcttctccacttccccagttaactgcttatacccagggcccaccctcagcctcaagttaggggtcaaagagcctcagggagatcagaaggactcagaagcaggaggaggagccctgatgtctatcagcatttgccaagaaactactgttttctccacaattctaagagcttctgatggactgtctccaggaatcctcagaatgcctaaagactattatgatttccctttaacagaaagttacataacctgcctaaggcacacacgagtagttggtggaggggcacccaacacaggatcaaggagagaaacagggagacaaggaggggattccttctttggtatgaagaaaactgagagcag

SEQ ID NO: 47488 - DNA, 1198 bp, Bovine  19866881343780
tgctccttggaagaaaagctatgatcacctagacagcatactagagggcagagacattgtcaacaaaggtccatccagtcaaagctatggctttttcagtagtcctgtatgaagtgagagctggaatataaagaaagctgagcgccaaagaattgatgttttttaaactgtggtgttgaagaagactcttgagagtcccttggactgcaaggagatccaaccagtccatcatgaagatcagtcctgggtgttcattggaaggactgacgatgaagctgaaactccagcactttggccacctgatgcaaagagctgactcatttgaaaagaccctgatgctgggaaagattgagggcgggaggagaaggagacaacagaggatgagatggttggatggcatcaccaactggatggacatgagtttaagtaagctccaggagttggtgatggacagggaagcctggtgtgctgcagttcatgggttgcaaagagtcgacataactgagcaactgaaatgaactgcaagtccctcaaacaccaacattatctaaaggataggtactttaaagaaggccgaagataatataataatcttgtcatttaaaattcccataagtcgtatatccttaagacaaaaagtataacctgtaactagcttaataaatgtgaaagcaaataactttgattctcattatttttcttaccaataaagaagtaagggctttaaaacctcagtctgaattttttttaagtgttcttcattccactgagatccatctagtagtttaaattttgataagacttctgcagaaaggtagtaatctccactgctcactagaaagcattttttcatcttctcaatatgtctgaaataaaacacacacaaataggcacacacatgcctggtgacacaatactcaactagccaaatattttcccttccaaaatgtttcaggcaagtaatgaactctcttagaaacaaaagtggggtcacaaagagcaggatcacgactgagcaactgaacaaagaaccgaaagtgagttacaggagtaccaatgtgaaggtcagaataattcgcacaggtatgggaatggcagggatagctgtggtcagctggacaatggccttgctaagatgtccacaccctcatctccagaacctcagaatggatcttacagacagaagggactctgcaga

SEQ ID NO: 47489 - DNA, 2454 bp, Bovine  19866881366814
ttagcgaccccatggactgcaggcccaccaggctcctctgtccctggggttttccaggcaagagtactggagtcgggtgccattgccttctccgattactctaggaggtggatcaaaaaagatcttgctgtaatttatttcagagcattctgcctctcttttcctttaagagttctgtagtgtcgggtcttacatttaggtctttaattcattttgaggttattttcgtgtgtggtgacagagaatgctctaacgtgtatttttaaacaacattagaatggtctgtggcgggtgtggggatggagaccgcaagagtaagggatggtgtacttgagctaagagtggtaaagtgggttcgcacagcagttctgcccttcacacctgagggaccacagtcactgagtccttcctcgtcttttaccctccctagatgacttctaatggcacactgtctctaaaattcttagtatttattaaagtttatttttcaggcttcattcaaatgattcatgaaaatgctagaatagaactaggacactggacttccagggtttagactacttactacctgcttattcagcggaactcaaatactttttggaacagagacatgtaaagaaggtaaacacaatgcagcaatgccaaaaaccataattgcattctgaataggaggcaacaaactattcttccaattgcaaaaggtcaatacatttaatgccattagtttccggaaaatgacaggtaattttgtggtagttctatcaatccaaactaataactgcctaattaacaaccatcccctattatgatccaaaagtgacggagggcttaaataatacagaatagcataaattcaaagtgaacatttagaataggaaataaaactaaagatgaggctataaaatgaatcaggaatgtggtcctaataaatcaccataatgactaatattagaatcatttctgatggaactcccatctggcattaaacttgacagcgtccaatgtggaagaggaattctacttgatcaactacataattcatagagaacataagatggaagcaaagttcggcagaaatgcagttttttgtggctgtaaaaagcactcacagatcatcatacagcagaactgtaccaacagcatcctcaataactttctttagaatagatgcagtggttaatacagtgctagtcctagagacaattcaaaccccaagatgatggcaccatgattgaggagagggcggcatgacggcacaatggttagaagagaccccagtcctatactgtctgacttcaaaccccagctctgccagttaatagctgtgggacctgggacattgttccaacctgcctcaggtgactcagctgccctaactgtgaggtgcagctacaagagcaatctgccgagaattgagttaagcagcactgcattgtgttactatttgttaacaaggagctcagtaaaagcagttgtggtggaaactgccttcattccattccatagctagttctatccaacccaaagagccctagggagatttgagagtactgctgtccaagagaagtttctgcaaacactgccatccaaggacttccctgtggctagtgactttccaaggtccagtggctaggactctgcactcccagtgcaggctgcccaggtcaagccctggtcagggaactagagcccacaggcaaaactaaagatctcatgtgccatagctgagacctggcacagcggaaaaaaagtgctgtccataacagcctcttgtagctaatgagcactagaaatgtggctagttttgtttttaaacgtacagtgcatttgagtttcaggctcggataactgtgctaatgaaggactggatttctactttaatttaaatgaatttgagcagccacaatgatgagtggctacgacactagacacatacacagaaaatctccattgtggcagaaagtttggacagtgccaatctaaaacagcttccaagcaacactgtgaatatggttatcagctaagttttctgatgactgttagacaacaaggaactccagactgtattccctgacatctaactagaacatgaccaaacctctgttgcccagtgagtggagacccctaatgcctgacgtggagctgtctgttcatgatgtaaagtgaagagaacaaacgcatgaaggactggacaaaatgccagctaccagcactttgaaggacgccaaggaagtatccacagcaaggctgagatcctccctagaaaactgttttgaatcaacttcagagcccagaggaatgggcttgatcccaaagttccacttcatctagcacagctgggattgtctcagtttgaacaattttaaagggtgctttagccagtgctggcctcttttcttctccccagtgttccattaactttgagaaatgctacttcctggtataccctccaaa

SEQ ID NO: 47490 - DNA, 673 bp, Bovine  19866881413488
aacccattgctgaatcccattacatttgtacacttattaataagttgtgattaaggccttatgattttggctcaacaaaatggaaaatctatgttcctggtcaacagaaatagttttggaggacaattcaatggcaaacaggatttttcaaagattgattatgttttgagcaatatcagttaagagaagaacagaaaagaggtagagatgaggcttaacagctaatagtggccgtttttctacccactgaaagatgcaaggactttgttcaccttgtttgccatttgtcctggcacctaggacagtgtctggcattccacaggcacccatatttgctgaatgaatgggtgagtagatgaatgatagttaattttattcaataaatcaccttaataaataacaaagttttaataatatataatactttagttttaaagtatctcccacattgcagacatttgtagattattatgaatacctaaaaaaagatatcagaagtatctaactgataagtcataaaagcaaaagaaaaaagatgactttcaggttgttagcaaaaagaaataaattactagttttcatacttaaaatgtagaaaatacgcttccatgttaatacctggtcctgttgatacacagaagctggactgttgggcccaaagaaatacttttta

SEQ ID NO: 47491 - DNA, 744 bp, Bovine  19866881517051
aaatcgttcttattttattggaacacagatgagtgtcaagctgcagctcatcaaatggcccctacttatggaaaagatgctttcccaaagactgtgctcacctttggcacagtgagagtactttgctgggtgcttctacagcatgataattggaatctaaccccagagctgtcatcgtttagtctttggtacaaaaagaaatccaaatagcacagatagttttggaagttgtttcatttttttttttttacactgtaaaaaacaagaataaactcaataaaccccaaattctccttcctcaagtatgttcatctagactttatgatgcagtaagaaagcatcaatatgttccagggtccatgagaatcaataaaatattggaataccaagcctggaatgcattgtgatatatttaaaaggagattggggtctactttcatccaagaatatgctcataacacgcttgattttgaaaactattaagtggcaattctgaaatcttgcacagaaaatatcttagcattggaaaaaatataaattgcaacgggaaatgtcatattttaatttgagccatctcctatgtagtgcagtacagctgttgtgttcaggatattagctctaagtaatgaagcatctgcgatttccttgaagaggcaaacaaacatttttatatttttccctataattccaaaaagctaatgtgtattcagagtaaatctgtttgtcatctcactatcctttaaa

SEQ ID NO: 47492 - DNA, 1530 bp, Bovine  19866880566040
aatctgaaaaagatttctggtgtttcatttgtgaactgattaggcttgcaggtcagttgccagcatgcccttttttcttatctccaacttgtctgtttcccaggaagcatcattattcttgagtggcaatctcccttttggtccagaagtgtcacattgtggaaccagtaggtaaggaggagcttgtggtacatatacagggcagacattactggaactcttttgttatcaggaagacatggctgccttaattaatgatatgaaaaagaaacgcaatggggtctcatattttcccttaattaaatctactttgattactgggcttgttcttttaagaattaaaaaaagataaaaaaaaaaaaaaagaacaaaactgtgttgtggaatcaaaagccattagtctaagctcttctagttgacggtatttacagtacttagctgcacaccatggctcaccctcttgcgattactttatccttctgcagtgaataaattcctgtcgtcggtgaaggtcatgaataagattatgagtcttgactctgcagtaacatttttaatggaggctaaggtgggactctgtaaagggcatcttgcagtgagcataacttgaaatgaaatatttccgtcagttggcttcttaagataaaatctgtgaatccaatttaagccattattttgtaatgagtgccctctcattccttaattcatccatttccttcataacacttacattcgatatgcacctcaggtcctcttcctgtgcttccctgaagtgtgtgttttgagtttctggctttctcctcggctgaggaaaattgtcaagtgcagcttgatgccacagcctcatgagtttaggagagaagaatgaactcatcactaaatccatttttttttaatttttatactggagtatagttgattaacaatgttatgttggtttcagatgtacagtaaagtgattcaattatacatatacatgtaacctttttcaaatcttttgccatttaggttgttatataatattgagcagggttccctgtgctatacagtaggtccttgttgattatccattttaaatatagcagtgtgtacatgtcagtcccaaactccttaactctccctccctccaccaccctgcccctttggtaaggataagtttgttctctaagtctgtgagtctgtttctattttgtaaataagttcatttgtatcgcattttttttttaagattctgcatgtaagtgatatatgatacttgactttttctgcctgacttacttcactcagtatgacaatctccaggtccatccatattcctgaaaatggcattatttcattcttttcaatggctgagtaatattttccacatcttctttattcattcatcaatgggcatttaggctgcttccatgccttggttattgcaaacagtgctgcaatcaacactggggtgcatgcatccttttggaccatgtttttctccaaatatatgcccaggagtaggattacaggatcatatcactaaatttg

SEQ ID NO: 47493 - DNA, 820 bp, Bovine  19866880632356
cggatgtgggtgcatctgcgtgaatcataagatgtgaaaaggaaagaagctcagcttaaaaagtgtttggcaaaataactagaaaagtcaattagcccagtgcttcctttttgagtcttcctattacagttttccctctagacaggagaggaccagtcagccacctcggctccgtttccttcttctgtttcctggtctataattgggctgcggaccaacatccctccagcatctcagtttggctacctgggagacctcggcccagctgctgacttaggacagacagaagccttcttctccagcccggagctcctctggatttctcttcaaacatctccccagggacagactgggctgggaggttggccacgctggctggtccgttacccttgcagccagggctgttaaccagatttgaatgctctcctggttcgtttagaattatttcttagagcagaattcctttacaagcccagaagaactgccccagagacaatttttcctgatttcagaatatcttggtgtgcttcatgcccccaggaaatgccccaacttcacttagaatctagccagaccccttggaaggagaggcagagtggcctcttgtaattcaacatcattagggaaagaacagctctttaccctttatatgctgtgagaagaaagctgttattatctctttactctggaggtacaaattataggcttgtctatgccttaatcatactgatgtttaccagtttttccaaagattactatcatagttggttattagtggtactgctgcctttaaaaccccagggaagaaagcagaagggat

SEQ ID NO: 47494 - DNA, 1259 bp, Bovine  19866880352318
gatggggaacatgtgtatacctgtggtggattcatgttgatatatggcaaaaccaatacaatattgtaaagttaaaaaaataaaataaaaaaatattttgattcatgcaaagaagatagtgaggtacacacatgtacattataatataaacatacacatatatacatgtgtttgtatgtggtatgttattatatcttaatttaactctgtggcctctcctcacagtggtttgaactacatgtgatgtaggatgagaagaaaagaaaaaccggtagttcagttaaatacaattcagagcaaataattcatcattattatagcaattactctttaatttttttctatccctctaagcaggaacacaaatcagttcattttgagagtggaacaacctgattatctcatattagatcctttcttttgttattaaaaaaataaactacataggctccttccacctctctccccatttataaagcagattttatattctccttctgctcttcatctctcccaaaattttgatgccagaccaagagatccatagcagtggatggtccaaagtggttgtacatccattttctaaaatgtatagattgttttgatagtagttcacaaataatttttccccggctcagttaatacatggacaagtcatttatgttcaacacatttatcataatcttaaacaatcagtatgtttaaaatcgataaccaagggcctactgtgtagcacagggaacttcttcctaatactctgtaataacctgaatgggaaaagaattaggaaaaaagtagatacatgttacgtatggctgagttgctttgctatgtacctgaaactaacatggcaatgtaaaataaaaatatttttattatccttcaattaaaaacaaataaagtggaaaattttttaggtttttaaatggaaaagaaaacaattacttgagactcataaaatacttatttgaaataaaaatataaattttaaacaattacattattgaatttttataatatataagtacatatcaaagtattgcaaggctgcaacgtatttgccttatggttcatgccttctaggggctcacatttctaatagctgacagtacataaagatgtaagacaagttaaataacataaattttatttcagcatttagcaaccattacatagcatgcatgggtattttaaaatgaaatgagaaacaaaaatctgagtgagagtttacatcttaaaatggatttttctttactttt

SEQ ID NO: 47495 - DNA, 927 bp, Bovine  19866880386731
ccttttgaaaatacatgtccttatctgttctggcatattcatcccctgtaggagagttgtgtgattcaaagaacattaaatagtaaaaaaaaaaaaaaaaagcagttgagaaaacacagcacttcaaaaggcttaaatctggaagcatttcaaatatgaggtttaggattgccagtacagtttgttaatctcctaattatttgagaatgagggcacttttatgtatctctctgtttggaatcactggaaatatcaattaaacataataaattaagagaatatcccttgggaagtgaaatcatcttatacacatcatggccttctgctagtggttagtgattctttaatcaatccagaggggtttcctaaacccaagaaatttggtaaaaatgatttagggctcacttagagatgctactatcattagaactacatttatctttggaaaaagagatgatttctatatataagccatgttcttcatagtaataccaacaagatctctcaacttatatagagaacatccaattttattccacttctgttctcgctaccctttcatagtccttctgtgcataaaacattgagaaggcatctcaccagagtcacagcagccatatgcaaaccacttatcaccagataccactgttgccattgggtgtcatggcaaccagagacatgtactacagcctctgttgggtaatagtgaggctatgatcctcaagtaaagccacagatgttctgggtacatgcagggtaaattttgttttctccttttctctaatatgttgctagagagatatcaaaaactattgctgaaattcaatgaatatggttttattaccttttattaagagtccaatctctttcaagaactgggatatatgttttgagggagataaactatagaaatattcaactgacaga

SEQ ID NO: 47496 - DNA, 2988 bp, Bovine  19866880389513
ggagggattgggggcaggaggagaaggggatgccagaggatgagatggctggatggcatcaccaacttgatggacgtgagtttgagtgaactccgggagttggtgatggacagggaggtctggcgtgctgtgattcatggggtcataaagagttggacatgactgagcaactgaactgatgtacccatcatgcagataaagacatagccctccatattccctgtactaattcctttcaaaagtggactgttcgtagcctcttttaacctatagactaacttgactgcattgcattttatataagtttgataatatagtatgtattcttttgtgtctggttcttttttgttttttttgctaatatgtgtatttaagaaagtcttactgttgggtgaagtgaagatgattcttattcattgctgtttgttatcttcttgtttgtgtatatcacaatctattaatccattctactactcatgggcacttgggtagttttcactttgggtttattagaaataatcatactcagtgagtcccacattttcccaaaggagcacacaaatgaaaaaaccaaagggcacggtgtctcatgcttgctgtcttcccctatattccagtccttcacatttcactggacttattcttaaaggaaagaaaacaaccagaggacacttggcatccatcttctatctggttttacactgtgtgttttagcatttttattacttggatactctgtatagatttacctttttgaatatgctaaatgtaggaagtctaattttaatttattttttatataaaatacacaaaaattaataaacatttcaaagttgaaaatatcaacttagtatagagaaaagatcatcggactttgaattctggaaaagtagatttaatttctatctcagggactttgtttcaaaaaaccatcttcaagactaaaatttgcaatatgtatgatggagttatattcctgctgcaaaaactttttattgtgtagatattacatttgtgaaggcctttggtaatcctaagggcagtacacaaatattggtcattattagggataaacttgcaaagcaagtgggtgctaagtctgagtgttaataatagctaaaacaaatctagggtctaatctattgagattttcttcatttaattttctttcctctatctgtgtgtgtatgtgtgaatgtacttttaggtctacttttattttcttagacaacgagagagtgaaagtaaaagagagaagggaaagctatccaggaaaaattaagcttaaaattcttgccaagaactagacatgctccccacagagtgaggtgttatggttaggttatggatatccattgcccctgtctctggggactcataaactggctagatgtcctccaattcctatcctggacatttaacagctcgggtgcattgtcagcatgtgattataccctccccaagggatctgcagtttcaagcacccacttctaatctccctgctacaacagaagtgcactgcaatcaaagacaaatttgtaggtcaatgagttgaaaattggttgtctttaactttctgatttttaaattcattttgtacaaattggttccaagaaaaaataggatgggatggtgaaaaataagagctgccaccttgcattaatattcacaatattgtctacttacttttggtttctggattaatgtagctctgacttggctcctgtctctgtcaataataaaaagataataaaatggataaatggaaaccagagaatttgcaagctgcatgataagtgtgattttttcaggttaaaaaaaaatgttcatctgggaacaaactaacttaaagattttaaaagccaatttcagcttagcggcgggggttttttgaaatcttaaccactgactgaggtgtgaaacttacatttgatacagtaaatcttgtcgactgttattttaaaggactgaaatgtgcttttattgcaaaattgtctcaaataaaaaatacatttttacaatctcactctgtcataaactttcatgtcaggttttggctccacaatgcatgcgggggaagcattatacagaaataagaaggaggcatgcataataacttgttttattttccattgtaagaaacagagatggtcttatgccattgttgttatcaaaatactaaatattacatacttgatcagaaatgatcagtaagcatatctcaggtcataagactattgcttattgttgcagaattgttttcttggtttgatatactataatgccatatatataagaagttctgtgaaatgtgtttataatttctttcacttaacatatttcctgaaataattattaaaaactccaggccagaattctacagagaggggagcctgatttatatgattctcacactaacatttcaaaaattgagttttctcagaaaaggttttaaatgaattgtactgtaattaattaaattgtagatttctcactattataagtactatgatttcaagtttaaaagtagttaaaaagattccatttgtatgaataatgtgtctactcatgtctgtgtttgagaatataaggatacaaatttgaaatgacattgatagcataaccattggcatattatgttaagtgtcaatagatatgatagaaaacaaactagccagcagtttttgtctcagggccatttctttttagaatatattgtttgtttactgactttagaaatctgggcacacattaaatctattaaaaataaaataatgatgatgggaaaaataattacaaggcattgctcacatgcttcagaaataccaaaatgacataattctcaaagagaagtcctctgcccttagacttaggctttttgggcttcagtgtatttgtatgtaggtacacctcagagattcttaacggtcagttctagaccactgcagtaaagcaaatatgataaagtgaatcacagaattttttggt

SEQ ID NO: 47497 - DNA, 1501 bp, Bovine  19866880449276
tcggacacgactgaacgactgaactgaactgaaaactaaacagggcgcactgggttctcaagaactctacaatgatactgacattttactcccacccaacaatgatgatccaagcaggaagctgccatcagaataattactgcggaacaatcataaactagaaattagtgatgtaatacagtcttcacacattccccaaattgaagacttcttcatttttcctggaaaggaacttttttttttttttaaatgaaccacatttctccttctgtgtcactcctctactggatttccctaccactttattcttaaacatggcctgagctttaattctccaatcctctgaatatttgacctacagtcctattttgcagcacttggtttgatatggcatccttcttgacttccttctcttcatagccctattttttcattttcccaacagttttttcaggaaatacttcctaataaatcattttcacaggaatccttacctcagcatctgcttttgaggaaccccaactgagataagtatacaaaaacgtgaatacatctgctcatcacaataacctaatttgaccatatgaagcacctactttattttatttttttgtcactgtcaagaggcattattacatggttaatagcttatgttctctgtgttaaatgttttgtggggttgatttctctggggtatctctcctttggtttttcaaatttagcttgtaagattacaatcttatacaatttagtgcctcaaagaccttttcagactatctgacttacctcagcctttcatagacactttgagagaaattaaacagtttagccataattgtacaaccagctagaggcaaaagctggagtgaaaagcttcttcagtgctttttctagccagtacacagtgatgtcttcgtgccacactatgaacattttattccctttatctgcctttagtagagacacaaaacagctggtcaccatccttcctattcggatagaaagtgcaagaatgaactattaaagaaatcacctccttctctccagtctagtgggtgatgactccacttagaggaaggagcaagagaggggaaacatacaatgctgctggcctgtttccatacagtctgtggataatagagctctttgatgtctggtacattcataaccaccaaactcggctttccagtcaacagaaaggctattttacactacttttgatgtgatgaaataacttaactagacatggttaatcacatagctggtgattatgccatgcaaggaaaattcattaaaataagccaagtgcctctaaaaagaacaaaggaaaactccttagcaggcatacacatagctgactcaagtgctctggcatgactcagtttttcaccattcacattcactttattttcataacatgaaacataagcataagcgctttgacacgaattctgcgttacctgcctaacttgcttattgcttattctgtgaggcagtcata

SEQ ID NO: 47498 - DNA, 2140 bp, Bovine  19866880489188
agtttggtaattagtatagtgaaacagcttttttatttgaaaaaaaaaaaaaatatgtcaatctttgtaaaatgtgttattcatgttcctgccatagaaaatggtgtactttgaaaacagaaacctttcttttttatgaggtcaagatgtaatgcacatcagtgtagtattgtgttgtagatcaacaaagacttcagaggtaactgcggtattgagagaaaagtagtgcttcatggactagtcagaagaggtatgctatttctctgacatgccatcgctgtgtgaccttaataccaggaggatgtttaagtgtgccctttcattacatatacccaaactgtagttctgcttttattaatacattttcttttcttttccccagtggcatttctgggctttactgtcattttatatggctatcagtggttccaagtcttgccacttcaattgtttttatttttgcttgtactgaaactgtcaacaattacttatctacaaagtgtctaggttcactttttttttttttggtctttgattgcctttaaagcttttcttagccttcaaaaatttaggaattaaaattcacaacgctggttcaggataatgccttttaacagtccaagcacaagttaacctttttcatattttggttgtcatgtttttatgggcataagacaaaatcaggattatagtatacaactatcattgctatatactatatatacaaccattcaaccaaccttgaagtaatataaccttcaaaagttcaatatggaaacaccttaattctgccatcttctccactggcactgcttatttaatagaagagaaaaaggaaataactcacttctttcctattttcccagcctgtacttccgctctcctccctagcttgccaagagaagtttcttatctttagggtcatggaaaaagatgtaaggagcagtaagaaacaataaaaattcttgatttttactcttcgagctactgcaggcttctcttaacccaggcttgtttaaagtttatttgtcctttcttgatacttcagtgggttcctaggctaccttccttcacgggtatagtagcaagaagaagagcctcccaaagatgtccatgtcctaatccctagaacttgtggacatgctacctaacgtggcaaagtgaaagtcgtcagtcgagtctgactctttgcgaccccatggactagacagtctacgaattctctgggccagaatactggagtgggtagcctttcccttccccagggaacatggcaaaaggactttgaaaaagtgattaattaaggatctcaagaggagagattatcctgtagtatctggctgggtctaatgtcaatcataagggtccttctaagaggaagagtcagtacagtccaaggcatggaaggtgaagtgatgatggaagaaaaggtacagagagaaggatttgaggattctaagtcattggctttggaaacagaggaagaagccacagacaaggaacgcaggtggcttttaggagatagaaaaggccaagaaacagattattccctaaaaggctccaggaggaatgcagcttgacctcacttggacttcagacttttgacctctagaactgtaagagaataaatctgcattcttttaagccactaaatttgtggtgatttgtttcagcagcaataggaagataatacaaccaacactctgatgaagatgaatgaagcttttacagaaaattgcttaggattcctgcctcagtccttgagtagccattaatataccaacaggctatgtcggctgaggcctcctcacctctctagttagaccttttgggcaagatttaggaccatcccagcatacacacccgaaacatatattttgacccaatgtagtgacttcttaactgcaattttccactttatttgtacagcttggttcagacaccttctggccctttacctttttccagtggcagtaactcactgtgtcccccaagctctatggaactcttatcaaaacaactctaacagatctacagtaaagatttagcaattctctcccctccctaacaacttccactagagaaaattctctcttgagactgtaacttctcttttagtctcttcaatctcagcttaaaa

SEQ ID NO: 47499 - DNA, 2143 bp, Bovine  19866880495064
gagcctggtaggctgcaatcctggcgtcgctaagagtcggacatgactgagcgacttcactttcactttaggaaactataaagatacctctactctggatgttgttatctttcttttgaaaagatctctttttgctcatagcagacagttacgatggggactggtaaccttagtccattctcagtttgagctcattcaaaggggttctcagtcttggtaaggttggtctatttctggcttgtccttcctccatgggtgctgccctttgaaattaccatgtgaacattcccaagtacttgtactggtcaggctttatatgcaatggttccctcagccctgttgagacttagcttgtcattctcttagttgttgctttttgcttgagttttgccacttggcttctctgcttgcagtcttttgaactccttggcttctcagcccctagactgtaagatttgaatcagcaaatgccccaaggagaaaagctgggccaaatgttattcctgtgtctatttcccttctctctagaacttggcccacacgtctttgtgtctctaacattctgatgccttcaaacagatacttttctactttatccaggttttctaacatttcttcagacttcatctgatcttattttattactgaactatcaccacaattatccctagaaagaaaattttatgttttaagttactttgttttcgatatttactcagtttcatatatataccttttacctgatccttccaccttattcctgtattaccagtaagatggaggtaaggtggaggctaagaatattgggaggaaatcactgatgaattatttgtcttgttcttttatttctcctctccttgtctactcgggcagcctatattggcctttcttgatttgacccagttgcccaaataaggaacccagtctggcaaagaaagatctgatttcactctcagagatgtctgcatgttaggattagctagatggtgaacaccatgccagatttctttgggtgagacattggcagaattgtgcaagctctttaatgtgccttctgccaacattgctcagactattcagattttctaaggtgctagaggtctaacctttctacttgcatatcagatgagcccttctctctttcctgagcttatttgtaggaggtcagcccttggtttttctctttgcccatccaatcatatttgttcatgaatttcaaaaagtcttcaagatctctctcttccctccctttctctcttttctctttttttaaccaatgctgttaaatattaactatatatttgcatatctcttaattacaaaggaatattagaaggctaaatcattaaatatgaaccccaccaatctatgactcgcacagcactctcccccaggcctaaggttgtgatatccattggctttattatagtatcttatatgtttctaaatttgtaatgatttagttaattcctgagttatgtgacaataagaaatcaatcaaattagcattatagtactgtggcttagacccaaggaccagaaccaagggctacaaaaacctgtaaaccagtaagttccatgtatgctttatgcttaatgagtgctgagcgtgaatgggaagtgggggaaatggatgttaacttcatatcacagacccttgtacgaaaatgaaaaagaaaatgccatagctcctagttaaagtcattaaaacctttttatataaagaagaataacacataagaaaaacaacataccctatatgatggggtcaatggataattaattaccaggtcagggaggacaaattagacttgctatgggatttcatttaaagaagggtttcaaaaagcactgccttcttctgtgaggaccccttagatgaggtaggattgagtcttgaataagtttataagaaggacagcaaagagccttcagggaagggacaatacacaacatcaggagtgagcacagagggcttatggaatagggaacaaacctggctgaacatacgagtaccacatgttgggggacctgagggaaaggctgggatgaggttaaatgaaatacaattagattgaagagaaatagagggaaagacagatgggagactgtgaaaagctcctgaaatgtaggtccacctagt

SEQ ID NO: 47500 - DNA, 2423 bp, Bovine  19866880529008
aaccgcttccccatccccccaaaagaaagaaaaacagaaacaactccctttgagaatggtcacatccacctatgcaaagtcttcaaagtcgcctcagaaactcgttcttttattggattttaaaaataaaaggatcatgctgttttatttttttgagtgttgtaggggtgtgatgtctatgagggagcagggagattagtatggtggtactgaacctgaatgaaagctgataaatggaagtcagacttcacccagcatcccttaggtcagagcgaaacagagcaggaccctgtggccctggcgccgccgtgccctctgcctgccttttgtctgtggaaatatcttagccaaagagtaagtttcatcagagaggtgaggacatgcaggaacaaaggaaaagaggagatcaaataataataattaggtaaagtcagggacttttagttcctccccaaggtctacagataatattctgagccatatcctgtgtgctgtcttgtaaagactggaacccccaacaggtggaagaggttaactacatgttgaccggcgatgacaccccactccagcactcttgcctggaaaatcccatagatggaggagcctggtgggctacagtccatggggtcgctaagagtcggacacgacttgaagtgacttctctttcacttttcactttcatgcattgggagaaggaaatggcaacccactccagtgttcttgcctggagaatcccagggacgggggagcctggtgggcctgccgtctatggggtcacacagagtcggacacgactgaagcgacttagcagcagtagcagcactaattaaagagtttctgaagcctttttgagtgacctgagaggtttgggcttatttgtttctaggtttgtattttgataaaatcgtatttcctggagattttgtttatttcaaatagcttttgtttatattcaaatagaataagggaactataatatgactcattccttttggttgtacataagacaagctttgaaaacaaagatttcaatagcaccaagttccaacctacaatctcttacatgaataatgagactttctttccacacatagaatattaccaactttccaaacagaattaaatataagtctctggggtcattgttcactctccaaccaatggctataagacacttttatataagattctcatctaaaacaaagaatgagacaaaatctgtccaacaatagcctatgactcaacagtgcttcaaccattcatttttagagtcgggcaataatttttttaaagctctgtcaaagcttaatacacacataattgaaacagtaaaggggcaaagagaatttaattttctgattctcaacatgttttgctgcagtgaggaaaaattacaactattgttcagttatttagtgtgttattgcaacattatataacacagaacatttattgttatagaaagtgcttttcacttgaaagtcccaagtcataaaaagttgtgcaccggttattatcatttaccttttctttaggtacattacttttcatatgctttcattagtgctttgctccctagtgtgctagtaacttaaagtctacttgccaaaactcagctgaggagggaaaaataaagttattcttgcttcaattctttaagttggaacaaagcattttgcaagagacggtagttgtaaaaggtccagatggaagagcctataaactgtggccagtgagaatagcattgctctcctagatctgcaagatttaataggcttcagacaattaatagaggctattagagttttacgtgatcttaattttgcatagtgccctaacgatgactactctaaaatgcttggttaatcttttttctccccacccccatcaaagcttgatatttggttttagtacataatggttttttgttaccatttttcttgggacaagggaaaacaatttgaggtaactatcttgagtgatttgcctaaaattagaagactgagcaaatttatttatctttttctgctgccatttcagataatctaatgactgttacttcattacaggaaatgagttaaggtcaggaataagcagaaacaatcaatatgctttcaaaatacgagatttggggatgaagcactaaagtttggattttactatctgtgttattttattttagtatttagaaaaccgtagtataaaaagacaagacaatagaaaacctgaataataacatccaggtaactcaatgattttcctgggtcttttttcaaagtttatgaagacagcaaatggatgattctgaaagacaataaaaacactgaaaatgacttaacacagaaagaaataggaaaaggagacccagaaaattccctggcagtccaggggttaagattttaccttccaatgcaggggatgtg

SEQ ID NO: 47501 - DNA, 2246 bp, Bovine  19866880537510
tcacacactagcaaagtaatgctcaaaattctccaagcgaggcttcaacagtacatgaaccatgaacttctagagttcaagctggatataacaaaagcagaggaaccagagatcaaattgccaatatcagttggatcatcaaaaaagcaagggagctccagaaaaaacatctatttctgttttgttgactatgccaaagcctttgactgtgtggattgcaacaaactgtggaaaattctgaaagaggtgggaataccagaccacttgacctgccttctgagaaatctgtatgcaggtcaagaagcaacagttagaactggacatggaacaacagattgattccagtttggtaaaggattacatcaaggctgtatattgtcaccttgcttatttaacttatatgcagagtacatcatgagaaatgctggactggatgaagcacaagctgaatcaagtttgctggaagaaatatcaataacctcagacatgcagatgacaccacccttatggcagaaagtgaagaagaactaaagagcctcttgatgaaggtgaaagaggagggtgaaaaagttggcttaaaactcaacattcagaaaaataagatcatggcatctggtctcatcacttcatggcaaatagatggggaaacaattgaaacaatgagagactgtagttttttgggctccaaaatcacatcagatgatgactgctgccatgaaattaaaagatgtttgcttcttggaagaaaagctatgaccaacctagatagcatattaaaaagcaaagacattactttgccaacaaaagtctgtctagtccaagctatggtttttccagtagttatgtatggatgtgagagttggactataaagaaagctgagcactgaaatatggatgcttttgaaccatgatgctttcttctctcaagagaagattcttgagagtcgcttggactgcagggagatccaatcaatccatcctaaaggaaatcagtcctaaatatccattggaaggactgatggtgaagctgaaactccaatcctttggccacctgataagagaaactgactcatctgaaaagaccctgatgctggggaagattgaaggcgggaggagaaggggacgacaaaggatgagatagttgaatggcatcaccggctcaacggacatgagtttgagtaggccccagtagttggtgatggacagggaagcctggtgtgatgcagtccgtggcattgctaagagtcggacatgactgagtgactgaagtgaactgataccagatggaaatgatacctcttccctcttttcaaggtattatgaagctcagtagagataaggaatgtaaaagtaccttggaaattgtgaaattcattgcaaatgtgtattgttcgtggaattatactccaaatttcaagctctttaagaacaaagactatttctctgtccattccaagaatatccttacattgcaactgtttaaaaatattttctttatttggaaaccaacccaagatcacttttacataagttggaaaaaagtacaacacatttccctcacacctcaaatatcacagatggaaaactgtcattttgcctcactgttttctatgctaaaatgatttttaaaatgtagcaaatgactaatatatgcctaaaaaaatttaagattttaactatttctgtttgtgactatttttcaatgaattaataactatttcttaatgaattgaatgtgccaatgtcaatagagaacccattttttttctttcagttttattgagatacaattgacatacagtactatataaccttaaggggtaaacatagtgatttgacatacatgattcatgaaatgattaccacaataatttttgtgactgtccatcatctcaaatgaacagaaaaaatacagaaatagaaaaatttttttccttgtgatgagaactcttgggatttactctcttaataactctaatgtatagcatagttagttcagtcacccagttgtgtctgaatctgtgaccccatggactgcagcaccaggcttccctgtccttcatcaactcctggagcttgctcaaactcaggtccattgaatcggtcatgccatccaaccatttcagcctctgtcgtccccttctcctcctgccttcaatctttcccagcatcagggtcttttccaatgagttagttcttcacattaggtagccaaaaacagagaagtgttaattatatttatcatg

SEQ ID NO: 47502 - DNA, 1298 bp, Bovine  19866880603121
ttgcacagagaaaatgccatatggaaagggagccccggagcctagattctaggtttagctactcttctgcttcagtttataatcttgggcaattcgtggaccctccccagggcttctgtttcatgggaacagtgatagtgataggaaaaccttttaactcaattgctggctggggatcctctaagaagtaatgagatagtgtctatagagcatattgaagcccttagacaaaatgagacagataactaagaaatactttaaggtattttaaaattggactccaggatttttaggattttaggattagactccaatttggatttttaggattagactccagtttggatttttttttaaggtaggctgctcaaggctgatttatttctcagtccaaaggtaacaaagtcatcaagctgagttgcactacagattttaaaataatacagttatctttatcaattatgagattgattctggcaaacaaaactaatttctatttataatgaggaaatatgaaggaaattatgttacacagaaatggacagaatgtaatttatttcccagacacaaatttatttttcagttcacttttggtttaaagatgtctatgttaagtgttcacgcttcaaaaattcagtcagcaattttttagcctcattttattgttttgtcatgaactgcctttgagtttacacagaattcaatatttgtgaaatatttctaaaatatttaacacacaccaacttattttaatagtagtaataaagaatacccatctcattgtggttggttatttaacaactcgagtcttctaaaacagtatatttaaacacttattgcattttagatcagggggggagccatttaaaaactgatttagatatctaactaatggacataaatatgctaatgatatatgaataaaagcagcttgcaaatcaatatatgtagtataatcctctatttttgaatatcactaggaaaagtttttaagtctatacctggagatatttacattggttatctgcataatgagatgtctagaatttctagtgtaaaatagtttttctgtatgttcagaaattccacacaatagtaaaataagctaattttattttaaaatataaggtactttatacagaaaagtggattaaagattcattgaacatgccccggcccatcagaacaaaacccagtttcatcctaagtcagtctctcccatcaggaagcttcaataagcttcttatctacatccatcagagggccaacagaatgaaaagaacaatcacagaaaacta

SEQ ID NO: 47503 - DNA, 1014 bp, Bovine  19866880829889
ttaaggtgtgatgagcaaaaaaccttcagcctgtgaccaaagtcattttttaaataaaatattgactataattctttactaaaataagtaaaaatgcatttgaagagaaaagaaaccaagctttgtccagcttaagccatccggttcccccaagtatattctccccacaaagaagtgtttatcacaggcttgcacacagtttggaaacatattaagaattctatttgtttctcctctattatcctattccttttacatatacttttttttttagttatacacttttagagtctataattagtgaactgtttctcaaaaacacaaagccaattctaagtaaacttaatttgttatagtttcaaagtttccaacaatataaaaacaaaccaataacataaagtaaaacactatagggaagattacctaaaaaatcaaatggttcaggtaaatcaggctactgtgagtttaggtgggcagacatccatcacacacccatacacacatacatgcatgcatatgtcatatgtgtatgcacatatgtaggtatcttttcttaatgtcatgtttatcttttcttaatgtcatatcatctgcacacacatacatatacatgcacatgtgtcatatatgtatatgactatatataaagatattttgcatatatattttttaatgtcatatcatctattgcactatgttttaagatggcaataaattcaagttggaggaagaagttttccatagatgtccctgaggacagctgattataggtctgaccttttgagattctgtgtatttcccacttaatcagtgctggaatgagcttctgctaagtgggacctataggattcctatgggaaaagtgaagccatttaaaaaataatgagcctctcttccaccccctctgcctttccattttgagctctattaggccatgatgacagtcttcatctgggctacacaaaagcatagcataagcatatactgttttgcagtatacaggggaacagtggg

SEQ ID NO: 47504 - DNA, 915 bp, Bovine  19866880867518
ttgttcaattttttttgtacttttaatccagtcttctggtatttgaattcaacttatttatatttactgaagttaactttatattaggatttatcttggctatttaactttctattttctatttcttatactttcatttctttctgcttttccgtctcctcttatatgatctttcattgtatagattgttttatttggaagttatatagtgcattatagttttttcttctagcagttaaatgtaattcacaaagacccacacttaaagtcatttcttactatgaatattctaaacatcaataaacatcaatatttttcagataagaaaaatgagctaaaatgatctttcctttctctgggcttcccttgctgctgctgctgctgctgctaagtcgcttcactcgtgtccgactctgtgcgaccccatagacggcagcccaccaggctcctcagtccctgggattctccaggcaagaacactggagtgggttgccatttccttctccaatgcatgaaagcgaaaagtgaaagtgaagtcgctcagttgtgtccgactcttcatgaccccatggactgcaacctaccaggctccaccgaccgtaggattttccaggcaagagtactggagtggggtgccattgccttctccttacctattcatatacccactcctcactgaaaattttatagcatggtattgaattaattagttagacatagttttgtaagaagtgttttcaaagaaggtttttatatggtaacccttatgatgctttgtctgtctgatatcttcattgtgatttcatctttaaatgataatttagcaggataaaaaattctaggatcatatttattttccttcaaaggttgaaattattactccgttatcttcggccgcattggatcaagaaacct

SEQ ID NO: 47505 - DNA, 1048 bp, Bovine  19866881041294
ctcaatgttatgtggcaacctggatgggtggggagtttaggggagaatggatacatgtatgtatgtatttatggctgagtcccctcgctgtttacctgtaactatcacaacattgttaatcaactataccctaaaacaaaacaaaacaaaaaagttaaaaaaaaaagagaatattagtagttagtgggaaaaatatatgatcttttccctcttattccaatgtgaaaatacatgattcactaatcttacatagatgtaagacctgtgttttaatcgccactgtatatctagaacttagcaccaagaatctggatcaaataggtgatcagtgaatattagacaaaatagatgtcaatgggtttttaagagacagctaagaaaagtcaggaacctttgctacaaaattattgaatttttaagcaaactagatacatacattttgaactatcaaagtcttggaaagtgttctaccctaaatccttcactttacataagaggaaactgaagctgaggtaaagagaaaactaacacaaggacacattggtacctaatagaagcccttgaattaaaatccagatctctggctactcacttgtgtcttttgcctggattcttcatgccaatagcttgcttttctcagaaattaaatggcatggtatttaaacagaaaacctcagcctggctgtttaagtctcttgtgttcttttctcttatttgctctcccttatctgcctactctctttcttatctaagcagtctcactctccttatcagaggattggggcacagttacttgacatgtaatttacatccactgaaagcctagagttacatggtatcccatcttacagataagaactaccaatcaggataaggctttagttcttagcttgtactattaaagtttacatctgattactaacttcaaatatgttactacatttgcatatttgccgctgcagataaaatgctttggtgaggtatctcagggcatcagcgttcctaagtctgtattgagacttaattaggaatttttacttctcctaga

SEQ ID NO: 47506 - DNA, 4156 bp, Bovine  19866881068897
atgtatttggagtgaaatggtgtggacccagtaaagcagtaagcaacaccctgaacagacctttgtagaaatgactgaaggccagggtgtatgaagaacagattaagttggaatacttattcgataacactcctgtggactttagcctgattcagatttgcaatttgtgtgtgtgtgtgtgtgtgtgtgtgtatgtatgtataatgtttagcagttaatgtatcatgataggcatgacactgaatttaagggactgagatataattcaggtctggttttagaaaatgacttcattttctagcataaaatgttttcagggtaggtaatctcccatctctaaacttcagtttccttttcttgcatatgttgtccagtcacttgagttgtgtccgaatctttgtgaccccatggactacagcacgcaaggcatccctgtccttccctatctcctggaatttgctcaaacttacagtcatcctgttacttgatctttacgtagtaaattctattttttatgaaaggttttctgttttaagtggactaaattaaactttctatatacatcacagagcctctttatacgtgagctttctttcccctgtccaaacttttgcaattcctggtaacctccaaggtttgtggcctctggagaattcaaagaactacatttaggaatttggtttgttgctctttcttccctcctacaactcaatttttttgctcatacacacccagtgtcacaaatagaattggtgtctacaattggaaatgcaaaagaccttgggatataaattgagttgaatatgtagtgattgggtattttctgttgatgaattagtctttataattttgggggtcaagatgtgcttgagttctcagtcttagggttcacaacagttttatagattggaattctactactactctattgtttccaatacatttcacaggagcaaaatatcttcagaccactaaacaacatctacttgcaagtgaagagggaacaaaagctcataaaactgcaataaaatatttatttgtcttcagcaataggattaattttatcactgtagatttatgacccaagaaattcgttggtggatatttaatatatcaaaatagcagaacaaggagcttgtattaagaaatgtgttgtgaaacttgtgatttaccagagagaacagatttttttccatagaacttaataaaacagcaacaaaattgaattagcttggcataaagtttaattgcctgacgaaagatttgatactgctgttgcattactgtttattatatataacatatcttggacttgtggatcatcatcccccatccccacccccagactgactgggaaagctgatgatggcagtaggattgtagtgttagtgtctaggaatcttctttttgatttcctcttcctaacataaaggaggaagagttcactgcaatgatctttccaaaaaggaaaacagaactgtatagcttgttgcctccctcagtgcaattcctttattgaaagcctctctcttcaaaaattccatagctcttcagtgctatagtaccttgtgagagtgtgccttagtgacatccagcttatgcatctgggtttttgtttttgtttttgatagaaatagcctgatagcggaaagtcataaaagaatatagtaaatctacaaccttccaattttctctattttgagttgtggctataagtatgaattactgtctttctgttcatattgtgtctgactctttgtgacgccatggactgtctgtggaattctccaggccagaatactggagtgggtagcctttctcttctccaggggatcttcccaacccagggatcaaacccaggtctcctgcattgcaggcggattctttaccaggtaagccacaagggaagcacatatatatatttcttatcttttgaggtcctatacgaattaggtacacacttaggaaaaaaacacagtctcttgagattgtaatatgggagctagacatctttatgttcagaaacgttagaggtatatggtctgacagaggcagaacaacttcagtccccataattcagctactacagaatttgagaatagagccactaaattgatgatatggccatagcgtttacaaccagagaccgtctaagttcttatccatgaaattcgtaacagctaaccttcttgaggactgctttgtgaattttcaatcagaaggacagtccccaaagggtggctgagtctggatcattgttatggaaagtgattgagtaagtaaaaatatgtgtcatgagaagaagcagccagtagcttccttttagttttattcgaatgagggtaaaaagaggatttctttttttgtttgtttgtttaatcctagtgtctcctggggtcttgacaatttgtgtttttaaagtatgtcatcaagaaagcattcactttctgtcacagatctgattaactctctcagccatttgcatgttcttgatagtagaagcatatgtacatttgatggagtctacaggagtccagaacattgaagcttttgggcttagtcatatccagtgcttttaggccaccttcagccctgttactgattatctacctagagaagatgctaaaaataacacaaaatataaatttgactcaacaattagccattcagactaaaaattctgttcagacattaaaaaattaagtccataaaacctgagtgattttatggcataaaagagattatcaattaacttcaaagtaacgtggttatatgaatgctagtgtctctctctctctccctctcagatcctgattagaataaccaaatatatttaataatagggaaaaactcacatccgtgcttcttactaaaagaaaagattatatgactacaccatagaaaagaaaaagtatacactgttgcaaaaaagtattcacagaagttgaaagcaaagaatgaacaaagagatacaaactcatttaaataaaggagtcattatattaatgccaaataggtagaaataaatgcccaacatattaaatgtaccaatactactgcattattgatgaaggacacaatcttccaagaaaatataaataccattattccttgcattaaaataaccaacataaaaatacataaaataatcaaaatacataatctgtataaatctaaaagaagttgaaagagcttccttggtggctcagatggtaaagaaatctgtctgcagaagacccagtttcaatccctgggtcaggaagattccctggagaagggaatggctaccaactccagtattcttgcctggagaatcccatggacagggaagcccagtgggctataggccatggggttgtaaagcatcagatactattgagtgactaagcgtgcacacacacacacacatacacacacacaagaaaagtgaaaagaacacaatactaatagatgagtatttttacaggcctggggatatcagtaatctacaaataagctagtaagtaagccaatacccttcagagtaggattcttaccctcatctcttataaaacactagaaaaatttggttttattttgagctataatggaagcatcaatatactacaaaatgcagccatttaagagaaaatattgtctgaccataatacagagggaaataataaaacaaaatgaataatactcaataacttgaccatctcccaagttttgcaggactgtgttgtgactttctttctgtagaagtatatatatatatatatatatatatatatatatatatatatttcttttttgtatttgttttcagagaatttcttatctaaagacattctatggccatcacagtgacatcatttagtgcttttctcttgtggttcataatctatgtactgtaattctttcctaatagctctagttctggtaacacaagacaatgggttaaaatctgagcctttcacacttgcattgaatacagtgtgccattgtcagcactaaaatgccacttaattttgttcctttattcttatacatatccctattttcaaagcccttttcattttttgacgggtaaaaattaaactgataatcttcctaactggttcttagaccaaaaggaaatataaatgtaagttatataatatataaaaaggtcagt

SEQ ID NO: 47507 - DNA, 2526 bp, Bovine  19866881078260
ttttaaaagatatatcaatcaatatgaactataagaaatctaatatgagtgatttaaaactagaaaaaatataattcatgataaaattcatcctaaaacttaaagaggttatgctgctgctgctgctgctaagtcacttcagtcgtgtgcaattccgtgcgaccccatggacggcagcccaccaggctcccccgtccctgggattctccaggcaagaacactgaagtgggttgccatttccttctccaatgcaagaaagtgaaaagtgaaagtgatgtcgctcagtcctgtccgactcccagcgaccgcatggactgcagcctaccaggctcctccgtccatgggattttccaggcaagagtactggagtggggtgccattgagtaaaagaaacaatagatcaagaatatataacaattctgaacatataggtacctaaaatagactgtaacatatgtgataaaacagctgctagaaacataaggtaaaattgaagacaaaaaatttaaaatacaagattactattttactgcaagtttcttaaaaccatataggtcaagcagaaaaaatcaaggagagataaaagtttaagtaatgctattaataagttcatactaaatgatttaggaagaacttcatataaaacaaaaacaacaacacattttttcaagtcgagaatttcacaaaaattttcagaaagaataaacacattattttaaagaaacaataacatcatataagatagagtctcctatgataatgtgatatgcataaaatcaacagcaaaattttgtttatatgattattaaaaacaaatttaagaattatatacaatcacccttgaattaacgaggaaatcaggagaaatgtaaaaatgcttaaaaccaaaatgaaatgacaaaacactattgctttaagttagagtgggtatttttgcaacgctccctttcagttcagttcatttcagtcactcagtcatgtccagctctttgcgaccccattaatcacagcacgccaggcctccctgtccatcaccaactcccggagttcactcagactcacgtccgtcgagtcagtgatgccatccagccatctcatcctctggcgtccccttcttctcctgcccccaatccctcccagcatcagagtcttttccaatgagtcaactctccgcatgaggtgaaagttattaaaccaaaaagctattgtttggataattgaaggtgtatgtgtgggtatataatttttttttttttttttactttgctattatgggacatttcaatggtggcaaattagagtactcagaggatgaccttaaaagaaggaggctaaaattgggagacaaaaagagttacatgttgtttagaatgagttatatttaatgagcttaggtaaggttatatctacaaagccatataaaggcacacctcagagatattgtgattttggtcccagaccaccaaaataaaaacagtatcccaagaaaatgagttaacacagtttttctgctttccatatgagttatgtttacactatattgtagtctattaaatgtgcatagcattatatctaaaaagcaatctgataccttaatttaaaaataccttgttgctaaaaaccatcatctgagtcttccgcaagttgaaattttttttttaatactaacaccaaatatcactgatcacagatcaccatggcaaaaataataatgaaaaagtttgaactgttgaagagaattaccagattgtgacatagaaatgaagtgagcaaatgctgttggaaaaataatgtggataaacttgcttgacacagggtggccacaaatctttaatctgtaacaaacacaatgctgtgaagtgcagtaaagcaaagtacagtaaaatgagatatgtctttaaatgtatgtgtatgtatatgtgtatgtgtatgtatgtgtgtgtatcaggctaaaggttagttataaaatgtcaacagttagtttcaggggcttttacactttctttctgtttaccctaaaaccgtctgtatgtcagaatcacctgtggaagcaaaaaaataaatgaaatccggatacccaagacctacctctgaagattctcattcactggggactggatttcctttatgtttaaaagtctctacaagtgattctgatacaatcatagacacagtgtaaagcttttgctttatatgaaataatacctgattattttatagttgtattaacatgttctatttttgatgggtaagtctgctgtcaaaatgcactccccactctgaaaaaagaaggaactagtactctctactgccacttggtggcagcatacatatattgcaagggcagttatactgtaggagtccaatttaatggaacctttagaattggaatattataaacagatcatgtagtcaagcttccaacttttatagctgcgaaaactaaggcccatataaatgaaataattgatctctaaagagtgttaggaaagagtataaataaaaaatatctagaacttttaattt

SEQ ID NO: 47508 - DNA, 1314 bp, Bovine  19866881164044
tgagattctccaggcaagaataatggagtgggttgccttgcccttttccagttcttcccaacccagggatcaaacccaggtctcccacattgcaggcaaattctttactgtctgagacaccagggaagccctcaacccagggtaggtcatctgaaaaaaaaaaaaataaataaataattagcataaattcaagttttccctgattttttccttttattttgttagatttttatttagaagtataataaaaacatcttaaatagtgatagatttactatccccctgtttttcagaggccatgtcagcattgcatatagcattacattctagacctttccagagaacaatttggaattaaaatacttgatatcctcatttgattggtaaatataaatttgtgtcattgttaggttttttttctagctttctagaagcttaaagtttcatagatgtggtatataaatttaagaaaataaacttctggaccctttaaggaatcaaataatcttaataggctatcactgcctcattagttaatagaacaggaactccagaattcatccctctactttacatgtcactatactgttaaaggactaatcttgattatgtgaaggaaaacaatgttctttcttcttagatgtttcagagaagacttttaatcagggcagcatttttatctaacttcctgtacacagactgtgtgatgccttctagcacatcagatgccaagcttacattaatatatatttcatcataatactgagttacccatttaaaaactacttatgtagagaggacacctattatagaatcctggttcccacatttaccagctgggtggctttgccaaagacacataacctctctgaatattagttttctcatccataaaatgaggggggttaaaatggagtaactctgaaggggcttcttgctccgaaattcaaggactcaatttcgaatcattttaggtttcctactttgccagcttaattgactgtctagttatagagtgcattttaattctctaaatttatcattctcttcagtttcatttagaagactgcatcattatttcttaaagagcatagtgctttcactctgtcaggttccaatgtgaaagaatgtggatccgtcctttgaccttaaggagcaagtatcagatactagatcttaatttcaagctccacatacttaaaaaaaaaaaaaaaaaaaaaccttatagataggatactgatgccaaaatcttggctctctgtgcaccagtgctgaacaagagtacagggacagacttacggaggggaaagaaag

SEQ ID NO: 47509 - DNA, 1422 bp, Bovine  19866881408459
aacaatggtaaatactactgtttcttccccagaacatgtagttgagagagcaaatacccttggggaggctgaatttagtttctttaataccagtttggcacattaaaagtgttacccatgaaacactgaataagacacttcctcatgatagtatttctttacatccctcataactttctatttcccagagatctggaaacagcaacaacaaaaatgttggcaattcaacttctatttattttttagacttttcaaaatggaactcttcactaactagccttagggtgcaactgaaataagtaaagaatacaataaattaaaattctcaaaaaatagcttaaagcaatattaaaacagcatgacaagaatcattaaaatagtgaatatccattatatcttgctgcatcgctgcatgtggcaatctgcgaaaattcttttgcatgattttatataaggtcaacatatggagaatttatcaatttctagtaggcactcagtaagtgcatatttgggttagtgaataaatatgtaaataaatgcttaagcattcagggacaataatggaaaggaaaaagttttatagactgattagatgtcttatggaacctgaaaacctagttttcaaagagactgaagtattgatttgtatcaatggatatttaatttccattaaattttataaattagaaatacatgctaatcttgttactgattggaacatataaatttttttaagtatacttgatttacaatgttgttttattttaaatttttagctatactctgcagcatgtgggatctttgttccacaaccagggattgaacccgcacccctggcattggaaggtaaagtcctaaccactggacaaccagggaaggcccttgattggaacattttatgagatatgttttctttaagggaaaaataatagcagaagcaatgatctgtttgtagcattttatagtcttaatcactcttgtcttagatataagtaataaaaaccagtattattaaaaaaggcataaaatgttttgattaaattcagaaaaaatcagatatatcatgaaagagaaagaatgaaaagcaaaatattaatgttgtataagctaattctaactaaacaacccatttaacacgcccatatttaagatgatgtatgttatgtatctttcttttttttttaatcatgctgaatttattgacatagggtcactaaccagagattcaggattcaaggctttagctgaagcagttaagaagagctctaaaatgctggttgggtggccaagtggctggactcaaaatgtggcctacattaaatggagctgaatttatcatatattgtagaggaaagtatttgaaggcttgaggagattgcaatgttaagagtatatttatcctgtaattccagctctccaacc

SEQ ID NO: 47510 - DNA, 2648 bp, Bovine  19866881531278
tttctttcttaattacaaataaggtcacgaaaaccacttcaaataatcctcacaactttgcagatattgctgatgaccaaagctgtcaccaggtaagataacataaagaagagagatcattttcctactggctttctttataaggggcttccctggaagctcaatcactaaagaatctgccagcagtgcagaagacccagattcgatccctgggttggaatcccctggagaaagaaatggcaaccctcttcagcatttcttgcctgaaaaaccctattgacaaaggagcatggtgggttatagtctatggggtcacaagagttggacatgacttagcaactaaaccacataagggcagaattttatagatatttgagagggaatgtgtttttgctgtggctccagtaattgcttctaagctggagggggcctaactgacaagaatagtttgttctagaactgtaattttgggtttggggagtcatactttcagtatcctatgctataggccctattgctatgtctgtaaagcataaattatgagagcagatatatatttataagttcatattgtcctatctctttattttatagttgaggaaattgaagccgagtaatataatatgtcacactcttggacacatagctcatttctagctctatccaaattaagtctagattaaactcagttaggtgctttggcaggctgaatcacagtcccctaagaatatccatgtcctattccccagaacctgggaatattttacttatgtagtaaaatgaatattgtagaagtgattatgttaaagatcttgagatggagagctttcctggattttcaaggcaaatctgataaaatcacaagagttctcatgagaggaaggtagggggataagaatcagtaataggagacatagagatgaaagtgagattgacacaaggcaggggccctgggccagagtgcaggcaagttctaccaggtgaaggcaaggaaacagattctccccaaaagcctccagagggatcgcacccctgacaacaccttaattttcaacatctgaccttcagatctgtgctaacaacacatctgcactattttaagccactaatttctggtaacaaaatttatccaggggctctctctacagcatcccattcctatcatcttgcatccatgctgtatatttttaaatgtcttactgtctatattcccagatatctagatatccttaaagacaggcatagtatgttattaatctctgaatatcttgctctttcaaagttgaatagatattgaataaattatcaaatactcctaatgctgacatttactaaaatacatctaaactccactcatgagatggatctgccaactactcaacaaatcttttgctgagagctttttatgtataaacttccctggtggctcagacggtaaagtatctgtctacaatgcgggagacctgggttcaatccctgggttgggaagatcccctgcagaaggaaatgacaacccactccagtactcttgcttggaaaatgccatggacagaggagctttgtaggctgtattccatggggtcgcgaagagtcagacatggctgagagacttcacttcttcttcttttatgtgtaaggtgctgtgaattatatatatatatatatgtatatatatatatatatacacacacacacacacacacacacacacacacacacacatactatatgaaaacttgggcagccccatctttttgtgaaaattttaatcactaaaattttgttacaagatgacaagacaacccaaactgattaactttgaactatacaatgattttaaattcgaaggggatctgatgcaatgcaagtgggactgattctcaaagaaaatccatttcataccttggctgcccagatcctatgaatcctttttcctttgtatacagttttaagaatgtttcagccacacttgatacaactattccaaataaaacttaaaatgttttccttctcagaaggaaatgacccaaatcatgtccatttttccacccaggcctatattcattatctctgggaaatgtggttaggcctgaatgtgatttcatgaccccaaacctggactacagtgaaaaatttaaccgtccctgcaagcataaaataacaacccactcccagcactcttgtgtggaaaatcccatggccagaggaggcttggaggtggcagtctatggggtcacaaagaattacacatgattgaatgactaagcacgcacacataatacaaaggtgaagcaaaaaggggaagttcacggttaaattcctaccactgggtaaagggaagaaggttaaaaaacaaacaaaaaagcacattactggggaaggatgctcgtcatggcatagatttcccaccagcttgactacatagggttcctctgattgagaaaaattgtcatccttgagacaagtataggggagaaatttttttctggggtctgccctgctgtactaacctacacattttggcaattggtggcctaaggtttgtcattcaattttaaaatcacaggtccctgcttgttactcattttaagagtgagctaatttgtttgatttcacgggattatatgctagaaattttgttgatccat

SEQ ID NO: 47511 - DNA, 874 bp, Bovine  19866881544103
actgtaaataagcaggggaaatttgattcctgagcatcatcccattggtaaaactgggtctaataggtggaataacgctatgaagtatgactttgtttgatagtaatgttggatgacatgcttggctgaccaagtcaaatgttaaatgtaagaaagaattgtttaagaacgtttccctacttcactttggtggaataccatcgcacagaacagattcagaattaagaggcttgtgtgtatttagcttaattaaatatttaatcaaatgtcatctacctgttatttccactctacaattttccatgacacccagaagaattagctatttttttaacatttctgttgactttcttgaaatagaacactattggtttatgtttctatccatctcttaattatcccccaaagttctccctccttcatcatctttagtttcactgggaaaaccaagtgggattagtgatcactcacagtatttaaaagttcagctgaccttaatgaaaagcccaggacccatccaggttgaaaaatgaaattgctgtgccttgtgatttttcacgtttccacttcactccctgtagccacatcttattcttaatcagaagggaaatgtgaacagatccattccataaaacagtggaacagggactaggaaccaggtagaggccatttaattaaaaggtataagagaaatagactgtaaaattcagctagtcctatataaaaagtcagcttaggagaattgaatgataagctaaactaacacatgtcaatttccagaagagaaaaatacagttttgaaatcttagcagcttttttttacttttagtgtgctttaggttcaagatcacaagctgagcgcaatgttttaaaa

SEQ ID NO: 47512 - DNA, 1306 bp, Bovine  19866881589724
tggatgttttgttcttcttgatgttccataacttctgcattttaaatttatcatgtttttgattatgtttcaaaaactggaacagtgtcaagaaatgggcagttgtatggttttgggtatattccccttttctttcctcttattaatacagtgccttatatctccatgaaattttcagtgttaatggatgcaacctttcaaaaaacattaatagaaatagccatgaaacatctacacttatgaaaacaaggttatggtttccatgtttccctattttctgcttaatggtaagttgtctcaggttggtcctataagaggcaaattttgccaaccaaattgtatttgctcccaagtatgtatctttcccgtgtatctactgcctgtctccatatggagtgcaatacgaaggaacgagagaggatggtaaaaataagatcgggtgttatcatggccagatggaaaggggcagagacctggcctagtggcaagtacacgcgtcttcgctttgtcactgtggttcagcacttccatgtggcagcgcgaaggcagggtcatctccattcactgttaattaaatgttttggctggaaaccatttctccatatggcagcatgcaccagcttgaagtagtgcttcaaatttggccacagaacccagctgcccacaaacatatgtagtgactcacaagtagtctcaaagaagttcatctcaatgcagaagatctttggcttttctgaagcatgtcaataactccaaatgcacaaatctgcccaaactatagcagatgtgttattcaaagggaaaatgaaaatgcatccagtgtaggtcatggcatgtatttggttcaagttcagaagtataatgatgccaaggcaatacattcagagccctggattataaattattgtctcacaagccagaatttgagtttcatgtgctgttgtcaaaaccatggttgaaaacagtaattttcaagagatactacttaaagttgtaaaaatatattaagttttgggaagctagatgatgcatgaatcatatatcatacctattctactcaactttttctgggggcagagattaagacttttttcaacaccaaggtgttgcttccccatggcttagatggtaaagcatctgcctgcaatgtgggagacctgggtttgatccttgggttgggaagatcccctggagaaggaaatggcaacccactccagtgtttttgcctggaaaattccatgggcagagaagcctggtaggttagagtccatggggttgcaaagagtcagacacaactagcacttca

SEQ ID NO: 47513 - DNA, 2238 bp, Bovine  19866880214983
tggatgtgagagttgggctataaagaaagctgagcaccaaagaattgatgcttttgaactgtggtgttggagaagactcttgagagtcccttggactgcaaggagatccaaccagtccatcctaaaggagatcagtcctgggtgttcattggaaggactgatgttgaagctgaaactccagtagtttggccaccagatgcgaagagctgactcatttgaaaagaccctgatgctgggaaagattgagggcaggaggagaaggggacaacagaggatgagatggctggatggcatcaccaactcgatggacatgggtttgggtggactccgggagttggtgatggacagggaggcatgatgtgctgtggttcatggggtcacgaagagtcggacacgactgagtgactgaactgaactgaactgaactgaataaaaataaatgatgaaagtagtaaaacagaagacaaagaaacttagagaagatcagcaaaagacacatatgacagggatttgatttgaaattttaaaaatagatatttgaagaagtggactgtagagggcagtccttgacactagctctgatcagtgggatgagagggtgctgggtatggccgtgcactttggatgctcacttggatgactgtaaggcataatctcttggaactagttctccacagtggcaatactaaggcctgtctcaaaaaagattccctggagaaagaaatggcaacccactccaatattcttgcctggagaatcccatggacagaggagcctggtgggctacagtccacggggtcgcaaagagtcagacacgactgagcgaattcactttcactttcaaagagttactgggaaaggtgaccctgcaaagctcttagcacagtacctgataatgtagacgttcattggccattttccttgcctccaggggaaggaatggggagatacccttatttctaaggaacgtacccagagtggaaggcaaatttgatcagtctggaatatgaaactagatgaaagcttagcacgtgaaattatgtttgtgatgtcctagagagccaagaaaattaagaaatgaaccaagtaactcatcatatttattagatgtaagaatgaaggtgcagtattatcatttccttgtgatagtcgtatctaatagttctgaaaccaattcacagtattcatgtcagacttattttatgagacatttaaccattgctaaattaaattttctaagagaatgtgccactataacttctctggagtttcagagatagaaatctgacccatcatttctattttcatggaaaaccatttagcagaactttgttccagtagaagtgtttattgagttgtaagcctaacacagttcattggctgcatgcatttccacactgacatttttctcagtgcagatttgcatcagttcattagtactgacagcagatggtagcactttcacacaaatttaccttctgaattgatctaagaaatgtcactaaaaagatcctgacagttttgatgttcttccatttctgaaaatggtatgttaaacaaataaggtgtaggattttagattttcttgaactccaacacataattcctaaaccaactaaagatgctttcatctctgattctggctgtctgaaggagaaagtagaaaatgcagataatctttcctgatagcataagccttaaaaaatcactattgcagaaaaatggcttttgaagaatattatccagattgtctgcactgatcaaatgcctcaaattatttgtaaattctctaccttactttgtctgaattcaaaattgcttggctagcaggatcagctcattgactgttactgaaaaatagtgttagcttaagtcacaaggctaactttaaattctttcacttctgccacagtaagatatccagaagattaactacatttaaaaattatagattttttgccttttagttagggttaaatcattatataaattatcagacaagaagacttaatgtttgctaagtgaatgaatgaaggaatatataaattctaatcacattgaggaaactattttctatattatatacctattattatatccttaataactcaaagccttgtagtgttcagtagtattatgtatataaacaaggatttattttgagtattttaaaaattattttccttctgcatttgaaaagtaattagtgatttggttaatttaccagaagagaagctg

SEQ ID NO: 47514 - DNA, 755 bp, Bovine  19866880360154
taaaaatctgttcgtagaaaagagtattctatatagtttggacataagtaattttaaatagacttcatgtttgcaggtaagtaaccaagcaaatatgaagcatgacatttcatttctaaagaaagtaaatatataaatatatatatatatatgtaataatctgccacttgtatcagagaccaagcccataggccggtttctataacaaatgttatcactgcttgtgaatttgacaagactgctgcttaatcagtagaaacttccctagcatatcaaggcatcagaaggataagaacaatgttaacttttttttttttttaacctaatggtatgtttaggtaaattaaagtgtctatctccaacactgtcatctggaacaagtttagatggaagcatgaatataaaatagggaaaatgctggggaagagggaaatacttttgcatccttcaatgaaaaattaagagtaattttaaaaacttattgttttggcttcttttttgagtcagcctaatactttaccctgaattataaatcttacatatttattttcatacccatggtgattttttaaaactatataatgcgggttaatctgtccttgtgacttgagtcagtgatagtaggcagcacagagccaaattcagcttacataggactccagctacttgtcccacagacaccaaaaaaaagtgtctttgtgtatttatgaatataaattgatctaaaacagtttattaacgtttttatagattgt

SEQ ID NO: 47515 - DNA, 1542 bp, Bovine  19866880531721
tcttgttagcaggtatatacatattttaagacaatattgacatagatactgacagataattcatcttataaactagatgatgtaaacttatggtattgataaatatagtactgtactgtaattgtattttcttataattttcttaataacatttccttttctctatattactttatcgtaaggatacagtatataatacatataatacatttataaaatatgtgttaattgtttatgttatcagtaaggtctctggttaacagtaggctgttaagttttagggaatcaaaagttatacatgggttttcaattgtgcagtggtttggtgcccctaactcccacattttcaagggtcaactgtgtattacatgttgattaggaactcttagatataagtcacatttacctgggtaaatgtggttagagtcttaaaaatctgttttgggcacacaacaaaatacttaacatttttaaagtatatacatgaaataagctcctaaaaccatcatttatatagactgttcttggagagaataagaaaagtaaatgatccttttaaccagtggtatgatgcactgacctctgacctatgagggagaaatgtacaactctgaattctggattcgcttctttgaaatataacattacaaaattaaattctacctcaggcagttttcccaagagagacaaagagaggttttagctaaaataagtgacagcctggagcagcatactaaaaaaatgtcatcaacagctgaataggttcaatcttggtgtatcctcctgggaaactgatagagaagtaggctaataacatctagtgtatactgttgtattacactttttcagcgagacccattttaatgtttgtttctaaatggttttctattgtttccatactcgaaatatggtactatatcatggtcagtggcattaaagacttaaaatatattttatgccacttattctgtttaattcaattagattttaaattatcttagttctcctttataataattactataattattcatatttcctcaatataaaaacagttatcttttttagtaataattactataatggatttctacccaatgtattttctagaatgtaccaagggcaaatgtggcttgatgttacatctatttggacatgtcatagacaacatatcctcaagagcttaaaaactatgtcatattaagtcttttatatatatatatatatatataatagaaaccagcagataatacagtttatttgtgtaagatgaaggcagaaactcagcctctggcttcctgcactttttacctgtggtcctaagggcaccattcctcttggaggagtcattctctgcattggcccacccatatttggatgacctaaaaagagaaaaaagtgtgacaatattagcaatgtaatgagcatgagtgctaaatcagaagctacagcctcctttctgcctggtgctacaccttatttactaaaggactaaattattgacatcacctctacttggcttccacagccattcttctacct

SEQ ID NO: 47516 - DNA, 1527 bp, Bovine  19866880540166
atataatgtctggggtagagaaaaagggagcaggtttctttctgtggttaacattaaacagggatggtcatagatacatcaagggtgtaagaaagtgccaacagaaatatttttaacacagatagttagaaaagacattaaaagaaactgcacatacagtcaagttataggaagataactagaattaaattgcctaaacatttgcttactggtggcgtccttatctggaggctctctaaaggcaaaagtactgatagacacccatgtttacatggtgatatggaaattggcctccaagacagttgtaaggctccccagagaattttttggaacccgcatctctgggtgcagtgtgatgtcactttttagagtttctaggcattgtgccaaaactcagtttcaggaaaataattgcaaaaatgtttaaataatttgcatgaggtttgtgaaagctaaggaaaagctgcctgttccattcccaaaggagatttcaagacacaatcaatgttaggccgcaaaaacactgtttagacagaataattatcagccctttcccttctctttcattattaaactgaggcttattccctctgagggtttcacctggcatatggaaagactgttgttgctaagtcccctttatggatgttcaaacaggctaagcaaattcagagtttactaaattcattcatggacatgatttgacatgaagttgcttctgtgtcatgattagcttttttgtttctattcatgttataatcaagtatgatggaattatatagaatggttccaaactacatggagaattcttgaaaatatatcccaatgctgagttaatttcagtcattgttggcaccttaaaactgagctcaaagaacccgaagtgacaggatcatcaaaacaacacacagaaggatgcagtgggtggaatagtattaagacaaaaaaagtgaagtcatgtttaaattgtgttacagctatcagtgcccaagttacagtacagttatttctttagggaactactcaaagtattgtttgagtggaatcaaagttattttcacagagactcttaaaatgacatcttgtgatttaaagagacctggtactcttcatattgtagtttattgattttgacagttcaggaatgacattgagtaactggcacaacttcactcttgcccctccccttatactgcctgttcaaaccactctgtgcaactagtttttcctctgcctggtctgtggaaggcactattatgtaaataggtaggtatataactgcatatacatgcttagctagcaaaaggtctttggacacttacaatctaaacagacttatgctgctaattaatgcctagttctgtgtaatagttaaagatttaaaacattaatttggggggtttctctggttgctcagtggtaaagaatctacctgccaatgcaggagacgtgggttcgatctctggtcaggaagatcccacctgctgcagagcaacaaacctgtgtgccacaactattgagcctgcg

SEQ ID NO: 47517 - DNA, 1370 bp, Bovine  19866880570548
cttatgaattgtaaaaattgcattatgtacaatctttttagcaataaaaattattttaaccatcaataactgagggttgttattttaggagaatgaagtcaatacatttgttttcctgaggcaggcaggggcagtattgtgctattcatgaacttcattaatattcattaattttaaaagcagtttggctagctttggcaatttctatcagatattatgcctttaaataaaaataattacaagaacttcattgtttaaaaatgtaattagcatgaagtttaaaacctacattttcactagaggatgttattcattggatggtgtacattttctggaagggtctgttttaattgaattcctggggtaaaattctaaaaatcatagtgactaaaataacctaaatgtaaccaaaagaaaactgagaatacttttttttcaaatgttcgaattaatttccactttaaagagtaccatagttgacccaattagctctgtaaacgaattctgttgtttgacattctttagcatttcacagtagactgttttcacccgtccaccaccttagatccccaaagatctcagcgcacatttagtgatatttaccttatgaagtaactaaatccagaagagcattgagctcacatcactgtaaaaagaaattgtttcctcatgcttgccgctcccattcagggactagaagctgaaaactctgaaattatccttgtgcaactaggaaattgtggacagaaatgcaaaatagttttatttgtatataagcccagccatagaaaccatacaaaaccttgctctgcaaaaaagtccttcagcctttgtaaatcaggctttttacaccatgacagattaacaaccagggcaaaaaattcatgcacgtggagctggaaatggaatcttccacacgtccttcttgattcatgtccacactgaggtacaacaatgttgagtagtactttgtggattataagaaaataaataaataaaaattaaagtaccacccaaagaaagtaagtctgaatagttcagggagacttttgaggcatggccaacagggaaaattcactgtagtgaatagctaaacttttaagaaaacacacttctttgtgtgtggcttttattttttaatattttttaggactggctgctctagaaatgtatttgaatcagtttgatttatgtttgtcaaaagtaacttccagtgccagagaaacacctcagttctttaggttttatttttagctttttgtttttgttttgtgtttaaggtaagctagcccttagggactagcacaattttcctgtttagggtagtctaaaaataggagagatcgtctgcttctgttatcaaacatagg

SEQ ID NO: 47518 - DNA, 635 bp, Bovine  19866880604068
aatgagtagggacttttattccatcctttttttcacgtttacattttaattattaaaagttgctcctgcccctccctgaactattttgtgctgtgtatatcactgctttatataagttattttttaaggtgaactcagatgttatggttttgtaaatgtctgcaatcatggataggaataaaatcgcttatttgagagctttcattaaatcgcgtgtgatgcaagttatcctgtgaatgacaacgtgtactaagaaaagaagtgtgtcttcatctttatgtcaaatcgaacaatttctcagtaaccttcagtgagtatttttgtactttttatgtaggaaaaaaacttcaaatcaacagaagcttagctggggcctaacacagtatatttctgcagtaactgctctaggtggaattcttgatttggcttagatgatacagaaaatcagtaattagtcgcagttgcttaaaccgtagcaataaagtgccaggggtcatcatatttttagcaacacattttctctgtaacacgataaagcccagacgtagtaactatttgcttgaattagtcacttgtcaccaggaatgctagagctcagttttttaataagatactaatgtgaaatggtgcctcat

SEQ ID NO: 47519 - DNA, 1764 bp, Bovine  19866880700613
tttctctagtatgaagataaaagcagcctaaaaaaataaaggtgcctgacagctgctggctttgataatgctttcctacagttgtaggagtttttccggcctcaactcttagaacaaattaaaacttctcagcatgagtaacttaagtttaaaaaaaattttagtctcaaactaaagaccctacattttgactatgatggacaacaggcaaagaggggagtaccaggggctcagagtctttacttgggtttttcagttagaacagaatgaaatactttcttgttagaaaccttacttttttgtttatttaccaaaatgagttatttatgaaaaagttaacctggctatcctagaccaatgtcttactactgaaaattattcccagaatatgtccatttttattataggtccctgggaaacaaaaaatgtatagcaaatatctaaagacagtttataacagaatcttagtgttttgtttaatgtttgttatagaaacaaaaacaaaaatggttagcattctttggggaattaaagataaagaaatgaattattaaatataaagtgaaagtctctcagtcatgtccaactctttgcaaccccatggaattctctaggccagaatactagagtgggtagcctttcccttctcaggggatcatcccaacccagggattgaacctaggtttcccacattgcaggttggtctttaccagctgagccacaagggaagcccatcaaatataaatcaaatattaaatatattgcaagttccctatataggtgggatagatttggcctaagtatacattagaataccttcagctttttgaaaaaatagcatatcggacttccctggcagtccagtggttaagactccatgcttccactgtagggggcacggattccattccagatagggaactaacatgctgaactgtgtggcaaaaaaaaaaaaaatcaccctaaaaaagctaaaacaacttatcactaggtgatattgttctgaaataatttgtcttctgtctatatcagaagtcaacaaacattttctataaaatgccaaatagtaaatatttaaggatttgaaggctctcaagtgacactactcaactctgttgtagtgtaaaggcagtcatagacactgtgtagactgaagactgtggctgtagtgaaggacaggaagcctggtgtgctgccgtccgtgggtagcaaagagtcgtccgtgacttagtgactgaacaacaaccgttgcaatcaaaccttacttacaaaaacaagtagtggttatgaatatgatcatcatgacagcctgtaagaaatctaaagggttaggactaagaacagtgtttctctaagcatgttctgtgtaacattggcaaagagtcctgggggtcacctgcctcctagtatatcagaattcttggtggtggggccatggtgctggaaatcctttggtttttgttgttgttgttttttcttttttaaacaagtgagtcttacaagctaagatttgagaacaagtggctaagatagctgatgacattcagcatcaaatactgactgcccccaccccccttacccatgctcgagttactgcagtaataagctaaatagaagcccttgctcacactcaacttagagtccactatgggaggcagtcagcaaacaagatgaatgtttaaaaatataagacatgttagattgtgatagtgataaagactagagagaaaaagaatcagaaaagaactgacaatgtagaggaag

SEQ ID NO: 47520 - DNA, 1866 bp, Bovine  19866880757132
ggaaatccaatttacttattatacattgattactagtcacactgaaggttattcttgtgtttacttaggatatcaattaaaatgatactaatttcctaagcatataggactcacatgacttatctgaattctgaattaagagtctgagacagaaattatgtttgtataacttagttctaacttcaacatcatcactttggctctaacagtatccattttctaagcagaaaatatttgatcacatatctgtgcactgaactcatagcttttcaattatttatactttaggtatccttgagtaatgggaatgtggaggctctcaaaagcctggcagccaaaagtggatgggaggttaccagtgctgtggaaaaggtaggaggcattcaggtatacatacaactcacttcccatcatgaatgaaagttgtcatggtagaggttgttctgctacttctaatgctgctttcaagaaggtaaaagatggagatcaagatggcagagtacaaggacaccgagtcaccctatgaacacatcaaaaatgcatctatatgtggagcaattcacaacactgaaaacaaactggagagtggcaggaagactcttatacaacaactatggctataaagaaagatccacacagagtcaggtaggaagagaaaaaacgccatcaggtcaggacctgcgtccctaggagaggacaccccagccctgagttctcaccccgagagaaggagtacccttagctggttttaaaaccagtgggactaacagaagggctgtataagaaacctaaactctactcttaaaggaatcaatgcttccttattcctgggaacaaggcaaaggatgcagactgaaacctcccacggctctgctccactgcagttctcaactaaggcaaataaaaattcaggactggaatagggaattctatcaaacatacaacaaagaggtaatacctagcattctcaaaataaattgaagggaacactcccaaattcattctataaggctattgttactctgacaccaaaatcagaccgagacactcaaaaaagagaaaattacaggccagtatttctgatgaatataaatgtaaaaatcctcaacaaaatattagcaagctgaatccaaaaatatataaaaaagggatcatacatcaggattaaatgggatttattctagggatacaaaaatggtttaatatttacaaatgagtcaatgtgatataccacattaacaacaggaaagataaaaataatatgatcatctcaataaatggataaaaagcatctgacaaaattcaacatccattcatgacaataactctcatccaaattggtatgaaaggaacatacttcaatataatacagatcatatatgataaaattaaagctaacatcatactcaataataaaaaggtaaaagcttttcctctaaagtcaggaataagacaccatttatttaacctactattggaaattctagccacagcaactagacaagaaaaagaaataaaagacattcaaattggaagggaagaagtaaaactatctcttgtttcagacatgatactacataaagaaaaccctaaggtctccaacaaagtaactattggaactaacaaatgaattcaggaaaagttgcagtatacaagactaatatacagattacattaatacagatataagactaatactaataatctttgctgtactcaaataatgaactatcagaatgaaaaatcaagaaaacaacccattaaagtcacataacaaagaataaaaaacctagaaataaacttaattaaacaggtgaaaaacatagtctctgaaaactataaaacactgaaaaatttgatataaag

SEQ ID NO: 47521 - DNA, 1469 bp, Bovine  19866880786396
gactgagctaccagggaaaccctttagcaatgctgactaaatactacaagtgaatctttcttaattcctcatttccaaggccgaattttttacttgaatccataaactttatcagtacatgtgaatacattatcatgagatcctggtaattttctactaattaggttcattctttcagctaattaagtttttgtttttttgttttgccaccctgcatggcttacgagagtgagaagtcctaatcattgaaccaccagggaattccctaagtcaaataactatctttcaacaaattttcaaagtaagaattgcttaccaaaaaaagtttcaattttctttctagttcataaactttgacaaaactcttcactggacatttactggcctttatttagtaataaacagtggaaagtcgtattccaatcccatttcttcacatgaagccaaaaatagatgtgagtgaagcagcttcagctacattagattctcccttttgatacatcacactatgtgaagctcatatacaggcaaacttttacacaaagactttctctttgaatcatattctttgaatctcagtgttttcatgactcttgatgtgcaaccattatagcttcctgtcgctgcagtcattctaccagtaatacaaattcaagcatgtttccataataccttatttgtttcatatcttaaagtatgaatttaccacctgcaatatttcatcctcagtaatttgttttggtacttctttacagagaaccaatattctccctagcatttctctttaggaattctaactgggctggaatttggcagttgctaacgtgtagattcattaatctgcaataaaagctcatttgacttaataattatctgggttagttttgtctttatgccatatgacatatcatcaatacatttacaaatactatcatctgacagtgctacctctacctcttttgctttatttgcaaaagtttccagcctggctggtcaaatgagggcttccatcctagtgcaaggcagcttggcttcaacttttaatgatgtgaccactcaactgtcttgttttgatttttaccttgacctaaatacattgaaatagttcattgttagaaacaatctcaaaatagctttgatttttgcattgcttttgcaaaattttaaaaagttcgtctttccctgaacaggatgagtttcaaagatgaagtgtcagtgcagtttgcttgatatcttgtcttcatctgataacttttctttccagaaaggcatttaggctaaggggaaaaaagttacagagcacacacatcaaaggtggagataattctcatttcattacctaattagtgacttcacggagaaggcaatggcaccccactccagtactcttgcctggaaaatcccatggacagcggagccggtaggctgcagtccatggggtcgctagaatcggacacagctagaacttc

SEQ ID NO: 47522 - DNA, 919 bp, Bovine  19866880928637
tcagcttattgtattgtttaactgtgattttaagaattgaagatgttttcttactacatgtatttaaatgttacttacaatgtcttcctggaaaaacaattatttgtaaggtttttataaatgcacaattaatgtataaatatagttggaatctgggatgactcttcgtaatctactatttttcattccaccatggccaccagctacctgatacattttgtaaatttagcatcttcctgtgtgcacacatgtgcattattacattttcaaatggatttatctctgtttgtgtaaaaatatctgagctattcatgtagtgggaaaggttgccataaagatgtacataaatatccattaatttcacacattttcacatttaatgttaaaaatgcactatttcatttacagtttctaccttttcattgctagactaactttattacttattgaaaaagtaaaggaaattgttcatataaaactagcagaaatgctttctgaatgataagaattgtaactaatgtggacatctgtgtctctaattgaattagacgttctgctttatgtaaaaccagcagtcttgtatcagagaatttatttatatgcatttaaataggttatgataagtgtctagctttttatagtcagataactaaactttgactaccacaaagtaagtaatattattagcaaaattaatggataaaagttcagtattttattccaagtaggattatacataatgcagaaatctgaagttattatgcacataattcatgtaacattatgcttcttctcaagtacattcatctttctaatgaattacacagattgtcacctcagttcaccatgagcatttatttacccacataaaaattctgaagtaggttctgtgcacagctctatagataagaatatagaa

SEQ ID NO: 47523 - DNA, 1473 bp, Bovine  19866880945358
atattgcacattaacatatatttagaatctagaaaaatggtatagatcttatttgcaaagtagaaatagagacaaaaacatagagaacaaacatgtacacgaagaggggaaaggagatagatggagtaggaagaatcaggagactgggactgacacatatacactattgataccacgcaaaaaacagaaaagtgatgagaaaacaccgaacagaacaggaaactctactcagtgctctgtagtgacctgaatgggaaggatattaaaaaaaaaagtgatacatgtatacacagagctgattcactttgctatacagcaggaacattgtaaatcaactatataccaataaaaataaaagaagattcatttatagcataagtaactagttaaaccggagttccgtttagtaagaaagagaaaatataagaaactaggaataggtgaaaactgagctcctctggttaacacagaggaagccaaggaccttctggcaggattctctcactcatgctcctaggcacctgcaatggtccttccactgcaccccgaagtccagggaactcagcatgaaaccactgcaaaagatgactgagagttttaaaatgctaccatctgttagcgaagcattgatcttgagtttgatttttctactctggtcaaacaggtcttcttaccattccttaaacatccctagcattatttcaacatcagccagtttttcaaaaatctccaaaataaatttatgagtttcaaatctctaatagaaagtttgatatgcatgctacttttgaaagagtatcatatttctgtcatttatgttatgatgctattggcaacataatcacaggcagtgcaacatctgcctcaaaaacagttaattaaggcctttccatcttcatttttccatattcaccagaaattagactttaataaaatcagtgggaggaaaagggcctaagatgaatccatgaaacaacatactttgatgaaacaatacattatttttcacagtgaaacaaactacgaagtcagatctgctctgctgttttacctcttttccatattaacttcttcacttatctttttttgaaatttatgtctatatggtggtttagtcgctaagtcatctctgactcttgtgaccctatgaactatagcctgccaggctcctctgtccataggatgtcccaggcaagaatactggagtgagctgtcatttccttctctataggatctccccgacccaggaatcaaacctgggtctcttgcattgcaggcagattctttaccaactgagccaccagcaccctgtatctctatataacgcagtaaataattctaagagattaggtaaagtagaattcttccccaatgcgtttatagtttccctgattgtcttctgttatgcatatttaccactgaagactaagtaacatatgccctacaggaaatctcaggatcaaaagaacaggg

SEQ ID NO: 47524 - DNA, 1701 bp, Bovine  19866880972749
atgagttgagggaagagttgttccctcttcagttgttcaactgaaggaaggttgttttagacagagggagcagcatgtgcacagacttttgtccttggtaaaactcctctcctgaggcaggcgttctcggacttcatttcccccatgtccctgcccgcttttcctttgcccctctccctctccctcctccctacctcgctgcccgcccccatccgcccctcctttctcttcctctctccccctatggaatcagtagactgtgaccactgcctgttgtttctaagcacacagctgtgagggtctctctggcttctcccagaagttagataacaaaatatgtaatagcttcaaagtccctgtgcaggccttttggtttagaaaaatgtgcttgtttttgttagagtttttttttttttttttttttaagaataaggtaaaaaatagaagcttgtccttttcagtcctaaagaaagtaaaaatgatgtgattggactcaccactgaacttttacctaatgatgtaggggacctgtggttgcctagcatcattagcctacaacttcaggcctgggaaagaaagagatgtggcgttcttcatttttcccctccctccagagaattgtcctactggcagaggctaaatttcaggtatcaggtttcaggtagtctctttattatacattcccaaatgccaaccctgctgtaaggttctgaactttttttaagactgttactttcctcagaagagcatgttactgcttagtatcacatatgtctgaagaataaaggcagagcccgatttctttacatttttggtgggacaggggtaatgattttagttattaagaatcaaggtagggtttggcccagaagggagcctctcaaattttgataaatcataaaccaatacagaagtaaaactaagtatgcaatcttaagagatttcttgtagcttgatatggctggaacaaaaggtatgagggggaatgctgaggaatgagactggattggtagaaagggaccagatcagagagaattttgaagacttaagttatgattttctctgagggcacattgcagctgatgggaatttttactttacagagggaagaacattgatcagatttgtgttttttaaaaaagtccactcaggtatcaatatggaggaaacaaaggtcaaggtagggaaatgtatgtagctctctattctacttcctgtgtctgtgtaactaaatcatccccccaaataatggtgtaaagcaaagttacaggtccttggttgaagaatttagaaagggcgtatagtaggcataacttgtctgtgctccataacatttgatgcttctgtcaaaattactgccccattgtcttgtatatgctaagttatgatgagatgtttattgtaattccaatcgttgttcctctgtatgtaatatgtctttttctttctggatgccttcaagattttctcgttatcttgggatttaaatgtgatgtgtctatgtaggatttttatcctcttgatattttctgggcaggttggatctatgttttgttgtcttttatcagttttgaaaaattctcatttactgtattttcaagtatttttttccgtccttgccctttctcttcttgtagataagttaaatggatattgtcccatagctcctaaatcatctgttcccttttttatttctttttt

SEQ ID NO: 47525 - DNA, 3204 bp, Bovine  19866881027532
attcctttggaacatgacgagagcctagccagtcagaattcttccttgggaattcgttaagtttactactgaagaaagtaattcattcatttttggtcacaaagctgtaagaatgtgtccgagagctgctgtcagccatgcccacccccaccatgtagaacatgcaagagaatgaagaagacaaaagccaaaaagaaggaggagagaaccatggcagcaacaagcctctgcctctagacactaaggactcagagctatgtgggttctgcaacaatttcttcagttctgcggtctctatcagtatctttctaacttccatgcttctctcatttctccactcacccctgcttgcttgcttcaagtaattttagttgtgtttctgtcacttgcaaagaatcctgactaatataatcaaaccaccacagacagaggtagaagaaagaagccttggaagggcattggtcgtgggatgctcacatgtgctgtcaggctcttgtagctacaagaaacagcctcactcagatctccctgagtacaaggacacatatgtgcagatgggaagtggaaagccaccagaacaaggagacaggccagggccagctactctctaggggtttctctcttggactcccctccatgtcaactctgcttctcagagtgtctgttccattctccacttgctcctctctgatcaatactctcccacttttcagtgtaaatcccaggagaccagctgctgacatggctgttcctactgggctgagccccttattcgaggccgctggtgggtgaggcaccatctctggtcccatcagggtgtcctctgaacaacgataaccaaacctggggaattcaggacgaagcagacatccgttgtgccccgttgtaggagaagtgtttcagaacaccaagaatgaggagtcatgatatgaaaaatcaaacactaaatcaacatttgcatgatatatgtacacatatagctggttcacttcgttgtacagcagaaactaatgcaacattgcaaagcaattatacttcaattaaaaaaaaacttaaaaaacgaattgtaccaggaaaccaaaagtataccagagaggtgggtatgacacggagcaaggactcgatgaggtgatctgcgccagagccaggtgcattaggtcccagaaaaagcagcgagcccagggtgagcgctttccagatcagaagtgtgaggcctctcacagccccagcaaagccacggcctctgcttggcttgcatcccactaccgactgggggaaactagggatggtcccacattgcccactatgtccatcatctctcagagaccgctcacacactgcgagcgcactcagacctaggatggggttctcgtaagggactgtgggctagtctcttagcttccgaagcctccgtttcctcatctaaagatggcattatctgctttcataggattactgtgaacagcaaattagacaatgcctgtgaaacacttagcccagctccaggcacaaagcgttcattgagcaccagctatcattgctacatcatcatcatcattatcctcattttcattaggatactttgaaggtgagtgagtgcaatgtgactcccgggatacatctgtgaacaaagctcatctcttgacctgtttgctgatcctagtcatttctctaacaaacattccccacttccagatgaaattaaaatcagaatatattttaattggacagctatgtgtgaaaagtgaacactatactatttagaaggtctttatttttaaaaaagaaagagaggacggaagagagcaagcaagcagggaggaaaaggagaagggaagaaaattgcttgtcaaagtcctccttcacttgtaagattttatacttcattataaagagacgccaactgctacctgaggtttcaatgcagcaccaactaccaaaaaaaaaaaaaaaaaagccagaagagttacctcaaatcatttcactctgtaatacagaatatccgggtgtatttacctagtgtaaaatcattcatttggtctgacatgcccctaggattactaacagtttacttgaaaaagatatgaaaaggttgggagggtgtggtttaaatataatctgcaattttaaaatttaactttacatattgccattctgttccattatatatgcaggaaagggaagagcagtattcttcaggcttgaaaaaaattaatccatgtttcttggcatgaaaaaccaatgttatctttaaaatatacatgtataatgtgagacatattatctaataaaaatcatgcaatctagcttgttcactttgtaacacataataacagggagttgatcaaagaaaactacttccatttttattactacattgttcctatttttatgaacaaaatttaaaatgcatgataaaaatccaatatacagtaattgaaacatacagtctgacctcacattgctctgataaatctgttcatttctggccattttcagtgttgctatagtgaacagtgttgacaagtggatgaaaaaaagcttacaaatggaattctgatcatagataagactgaacataaactatctccccacatttctgcatgttgggaggcccggtgtgtgccacagatggccatctcccaataatacataaaacatttcttgctggagctcagctcacattgttgaattcacaggtcatttgaacagaacaataattcaattcacttaataatgacctcactgggaacaaacagacacgggatgatgctgttagaagaacaaaatcgtactagagttttaaaaatgaaattcttaaaaagccgccatgctctcttgtcaaaatagcacttaaatgtattcagtgtttggcggccaggcaggctcactgggttaattttagtctctggaattttgctgcagcgactctgtgccatgttttgtctatgttcaggctggtagctttcctgggaaggtcagtggtgaccactgaaccccctattggcttattggctgagctcattgatgaagaagccttgagtacatcatttttttccttctcaaatggctgagatggcagtcaatgaagaatgactgcagaaagtttcagaagggcacgtgggaatcgtttaaccaaaccaataaaatcagctatttatgtaagtaacagttattataaccttaaccatccaggccatattt

SEQ ID NO: 47526 - DNA, 1290 bp, Bovine  19866881031454
ggaagaacattaaaaacactgaaaacaatgtaccttttgcatgtgctagacttaaatgaaaataaatatggcctaaaatatttatgtgccctttatttacaatttctttgatatctacaactaagtaaaaattacttaaaataccaaaaccacagagaaagagctcccctgaatctaagagccacagaaaaaggaagagcaatagcagatctaagagctgcacctactgataaaaacgaccaaaaaaactgaagtctgacagaagcaaaaagccaaagtattcagtgaattgttatcaaccatctacagtacaaggataggttagattcatgaggaagggagtaaaagagagatgggtgcaagaaacggaattaattctataatgaaaaacttaaaatcttcattttgttagcccactaatccaatatggacagacctctaacgtggtttcttgtgtcactttatagacataataggaaacatataaaatataagggtgtcgataagtggggaacctcaattacattcagcagttaagcatttatagtctagatctagataccataaaaacagcttatgtaaaatgaaaaactgacttttaaaacattatgttacaagacatcagtcttaagccccaggaaaaagcacaatagtgcttaactgcaaatgaaccgttattccaaatacaggaaaatctctgaaccaaaggcccgcacctgttcctgccatccgtattggagactaacaagggaaacccacaatcataactgaccaagtgcggttccattcaccacgggacttctagtaaagcacgttttcaggagagagattacaaagatgatggcattaagtaacagaccaggaaaccacatccacggcactggaaaagaacttttatttttgttttttccttttaagtatgatgctgagagatgagtgtattaacatactgaacaggaaatgctcctaaatgaagaaactttaaaaaaaaagaaaaaccttagcttgtccatttgagtacctagactaatgctgctgcagaaaagtcacaaacctgggtgtattggtgctgcaataaaatttgcaagttctgatatcaactagcctttaatactgactgatcatttctgtgtacattcctaggcagttctatctctgaatctatctagaactatttcaaacttttttagactattctgaaaattcaccaccaccaccaccaccaccttcagaatcttcaggcttagatgaagtcacaagggtggggccctcatgatgcaattagtgccc

SEQ ID NO: 47527 - DNA, 800 bp, Bovine  19866881057807
agtggaagcagggacagattttatttccctgggcaacaaaatgactacagatagtgattgcagtcatgaaattaaaagacacttgctccttggaaagaaaactatgacaaacctagaccacattaaaaagcagacacatcactttgccgacaaaggtccaaatagtcaaagctgtggtttttccagtagtcatatatggatgtaagagttggactgtaaagaaggctgagcaccaaagaattgatgctttcgaactgtggtgttggagaagactcttgagagttctttggacaacaaagagattgaataagtcaatcataaaggaaatcaactctgaatattcatatgaaggactgatgctgagttgaatctccaatattttggccacttgatgcgaagaactgactcactggaaaagaccctgatgctgggaaagattgagggaaaaagaagtgggcaagagagggtgagatgcttggatggcatcactgactcaatggacatgagtttcaacaaactccaggagatagtggaagacagaggagcctggtgtgctgcagtccatggggttgcaaagagtcagaaatgacttagcaattaaacaagaagaacactaagagcaaaaatgactgaaatagacatctgttgaaattttaaacccaaatcacctgataaaatagaaaaatcttagaaaccgatgtgtgagtgcacctgctcttcacacagcagtgcataaaaatatttcaaacccagacagactgtagaactgaggcttcatgagcttttatttgactataaaa

SEQ ID NO: 47528 - DNA, 1307 bp, Bovine  19866881062363
acatattccctaattatagctttctgtgtgaatatacaaatcagtttgtgattgatttcctagttctaaagtagttaggattcatgatcagtgactgaagttaagagctccccagtaatatagaagtatatttttcactcataaatatcttggctgtaatgacgggcccataaatatcagagaattaggcttctcttttcttgttgctatgccaccttcaacacgcagtttccattgagtggtccagttctactcaaacccagtcagctaaaaagaggaaagaagggaaagaagagagcacacccctcactttgaaaagaatgacctcaaagttgtgcatgtcacttatgctcaagtcatgttgatcggaacttacttgtatgccatatgaagcttcaaaaggctggcaaatatgatctttagctacatgaatatgtatccaattgaaaattttctatagttttgtaagaaaaaagatttttttggcaggggcagggtggggtggggaggagactaaaaatccaagaaacaagaattacctttttaatggaaaatacaattgcctttataatgactgtacaaaaaaaaattacagaaaaatatgctggcatttattaatagtttttctttctttattcttatggtaatattagttatgttgttcagaaattagaaacttataattaaactatctggaaaggcctagtgttcatgcaagttttctatgcttacacgatagaaggatataaatacataataaagctttgcttacttatatctggttaaggatataaattgctgtggagaatcaggtttttaaaaattaaaatagattttaggtaatatttggtaaaattctccatttctctgtgttaagaaaaacatgtagaaatatgaaatgtcttgccaaggttagacatctagcttgtggtagaggcaaccataagcccagaggcttctcttggttgataaagagcacagactctggagcctaggttccaatcttctctctttattatctttgtgatcttgatacttgaactctctgtgtttcactttctctgttaataaaaaagtgataattatggtacttatctctaattctggttatgaggattgaacaagttaaaaggcataagatactttagaatagtgcctgacatacagttagtgccgtatgtgttatatactggttaatattttagcaagttaagctcagatatttcacttgagtataaaattagtccagagtaaataatgcatttgaatttttaagctttaaggagacaaagtccatgcgactggca

SEQ ID NO: 47529 - DNA, 2541 bp, Bovine  19866881069105
aataatcttttaaaaatgcatatgcctataaattaactctgtaaatgacagaaaaaggtccagacgtctatacaacaaattatacatactgatttatttgggggaaagaaatgaaacaggcatgaagatgataaggaatttttatttttctactctttatatttctgtattgttttagggtttttgtttttttaatgtaagtgagcctgtaattatgtgttccttgtagaacctaaaataaaacatttttcaaagagacttagggatatgattagatatttaattatatagagttaacaaaaatgattcaaaatattcaataggggacttcagtggggactggtaagcatcagagaaagagaaagaaattcagagacagaaaaagactatattttgatgtagtgcctcctccatcaggtgccttagcaattctcttttcaaataatttctgtctggtggttaaacttgaagtattgaacataaaatgtcttatattctctggcgaattggaaaggccagtagcttttttgagtagactaatattaaaataaaccttgaatcccatatagaagccggatcttagtttgtcaatacttagtgagccactcagctcaattggttaaacatggggtcagcgaaagcgagcttcacgttgtcaaccttttagtcttcaaggcgggtgggggtgggggtgttgtatgcatgaatatatgcacatgttggtgagagtactttttggtgagttgagctaagaaagaaagaatagaaagggacccaaccaagatcattttcccacatgttccacaaagtaataatttcttaacctgacaaattcctttaaggacaagagtcatcaatatcataacacaaactaatttagttaggcaaatgtcttctttttttttctttacaacaaaaacttaaggagtcaaaaaattagagaaaaggaaagaagttttttgtagtatggggcactaaatttgggtagagagaaaggcccccacagcggtttggtggaaaaggcagccttgatgtgaatctgggctttgtaatttgctagtattgcttcctagggcaaatttcttaacttcttcaatgccaaatttcctctaccataaaatagagattgtataaaaagcaagatcattgtaagacatctatgtgtgtgtgtgtgtgtgtgtgtatacatatatatatgaacatgggacctgggatagagcctggtacatagagattatgcaataaatggcagctacaatttggacagaaagaagggatagtcaaaaagtctggcaggaaactctctgaattaatacatttaaataagcttcaactctataaaaaacaaacatttttatttaagcacctactagttagactgtcattcagacatcaaaagttggaaccagccactttctgaaaatggggtacctggacataccagaagctgcaaggtacagaaagggctgtagaaagaagctgaaggaaaatactattctggggtgacagaagaaactacaatgcctgtttctcaactgtatgcctagggacaagaggatacaggagagtgtgggtgatggctcactaccattctcctgtaactcagaaaacaactccagtggccagcctgggagggttggtccccagggccagctttctggaacaagaacatggtgttaatgtctacctgcttcactcataaatagcaacgatggtaccgataacaaattagatgagggaagccagttcccttcaggaactctcaattcaaacagagggcatttatgctgagaagaatggaagatatgaaaggcagaggccaacagacaacagggacagagattagctcctgtcatcagtcacgaccgacactgggcatttctgaggttgttgatggttaaggaaagaaccttagaggagaaaatgaatctcttagaagatgtgaggttgcttaatctggaagacagaagagaagtttgaagaagacgactggagtgatgggagagaaagattactcggggagaattttgaactgactgaatcagagaggaaagaagatgagtttgcagtagttgaaagtaccatgacatcggggaaggtggtgtggtgatggcaacgacaatgatttcagagagtataagagtgcaacacaaaactaccctcagagataccaaattactttcatattcatcttttcatttttcccccataatgccctgggggtacatagagacatacaagtcagaattcatccaaaaagctgtcaagatcagaatttggggagaagggatgtaaaagtaccaagtttttacatacagatttctcctctttgtgaaagtacagcattcctaagaaacctttcctaagctggaatgacgtgaagcaaagaagcaattacctttttaaataaaagtgaaaattctcttttggttcatgaaaacaggtactaaactaggtctttcatgaaagagaagtgatgtaaatcaaactttcaaaacaaaaacaagggaagactgtctttcagattcatcacaactttaa

SEQ ID NO: 47530 - DNA, 1521 bp, Bovine  19866881081061
gcagctttggaatagggaaggaaacatttcttccttcgcaactgaatgtctgttctttctcaggatccgttttattattggtctagggaataagagtagagaattaaaaatgtaaccctgatatttcatatagaaaatttacctacttgttatatgcctaaactatgttcaaatagtcaaagaataattcactcttaaaagcagcgtaaccaaaccaagataaaggccagctcaaaagaataaagaaaagattggaattagagcagtgtttacatcatcagggaggaggaagaagaggtttgtccctggtgcggagcgagagggagtctttggactgtgtagaagaaaatgacaggaaaacaggaaagatgagggttggaggaagctggagaataaaaataaaatatccatagccctgatccaacaattttcaaggaaacgctacagactggcttttctgaagaggctgggaaaagtactagggaaagggaggtgggtgagtgtcgagctgtagggctggaaggcatggcctgtttggggaatagtgagaagctggtttgaggaaaatctctacttcaaagtgttcaagatggttggaaagatatgttaagtcacattatggaagagatgatggaatgggtttggaggctatgagaaagaaatgaagtgagaagtgaaatgagaagtgaaagagattgagcaaaagtgaatgagatcaagggagggatttttctagaacagaaactatgactgagtaaaacagaaagagaattaatgaaggttgagaagaaattacgaagaatgaaattttgggaaaaggaattttgactttttagtgttgttgttgcaaatttttttaaagaaaaatttaaatcatctcttagagaaaatgaactggaaagaacatattttcaggaaaaaaaattacccttccagtagagtgagaattaaggctgcttgttaaacagaaaagataggtagattagagaaattaaggcaaaagtgattccagttaatcaccatcatgaaaatagaaaatgacttggcagatttagagtcttatttgaatatagagaatttttaagaatgttcataattatgcaatggaacatgacttttagtgcattaaaaagagattctaggggtaatgtgaagagcaaacaatgaaagttatttttcttaattacaaataaaaattaattatttaactaatataaatatattcaaactttttgaaaagtttaaatgacagagggaatttaatgaggattgtttgttgaaccaggtgaatgtttgaaacattatggggatttaaggtataaacaggatgctggggtaaaacacatgatggggatagaatcccactgaaaaatcaggtctgattttaaaccatgttaaagaaaggggaaacaaaactagagggacacctaatttgctaaaaggtttattctaacctatgttagtgcaaagcatcatgtatacaaagtaacagattttatgtggattcagaggccaggaaga

SEQ ID NO: 47531 - DNA, 1168 bp, Bovine  19866881145924
acaggaatggcccagagcaattttagctgaatctttggggtaaacagtgccatttcctgagtgcaaagtgattggacttcaaaatgaaccatcaaacccacaggtaagcttagtacagcaagcaggcctggtttccaggctaggagttaagcttttctcctctgattcaaatatcagaaataagcctttcccatttatatgtgatactagaataaatagaggtccctcacaaaggaagccctttgattcagcacagctcgacagatggtgatgggaacgtattgtggcattctgaaaagagagcgggcttcaggcccaccagagctggattcaaatcctagccttagttataccgcctgagagaatggtttatctgcttcaaggctctttctttgcctggaaactaaagatattaatatctccatgggcagggtgttttaaggactagaaataatacacatgtgatctgaccccccatgttcctatcttggagaagaaatagcagctaggagcagttagaagcaaatgacatccttcacttgggtttgtcagagcgcaatgaaggaggtcctatttgtcatctacaatggcattccctaaaacaaattccccactctcctccccaaagtctagccttcataggactatcctttctttctctccctcttcctcccacctccttagttctgtttctctggctcccagtctgttaattcagtatcacaaatgtcctggaatcaggcaaaagtctttgattcctctcagagtgcagagactacaagctgtgggcaaaagccagcattctctttagagagcagcagggttgtagctggggttgtgaacatacactatgaagaggtttgctctgtctcacacgtgtagtgctcacttcagtgcctgaaacctagtaggtgctcaataaaaagattctccattaaggattatctacaatgtgccggatacttatctcatgaatatgaggtttggagtaagacaagatccctgcttcaaggagtgcagagtatcaaagtcattattgaattttggtgactggtttcagtggctacatcatcactaaaccaatgaacatgcactagattatttccatcaaatatcctaagctagtaaaacatctccatggtataaatgactaattaatatattgggt

SEQ ID NO: 47532 - DNA, 1258 bp, Bovine  19866881173817
aattatattttaaaataggaatcagtctatatcttaatttaataatttaaaatttatattttaataatttgaaatttaaaataaacttgtatcttaaaggagtagacctgagtgtgggttttaactttttcaaagtaattcacgccagcaatcctgggccaactctgattcttccaggagcatccaatacttggacaacccttttttgtacttcatccctgcaagacgagtgaattcatgactcctgtgttaaagaattctcaaaaaatcaataggtaagaaatatcatcaagatacattggcttcagtcttattttaaaagtgtaaatctttttatgtgattctaaaagctaaactaaaaaagaaatattctttgtcataataataatggctaacatttattgaatttttttactgtgttctaggcattgttctaagtatttcagatatattaacacactggatttctataacacccctgtgagctaagtactattattttacctggtttacagaggaggaggctaacgtacagagggcctaaataaccaaggtcacatatcttgttgagtggtggaacctggggtgggaacccaggcactcttgcctccgagccatactcttcaccactgtactctgctaccttagctaatgctgtcagctgggtcaaactggaatcattgaggaaagtcaagagcatcagtgccttgaccccccctcccttaagctgctttagtgggggctcctcagcctctttggcccccaagtccctgtcaagcaacagattggcattgggaaatgctgagattccaagtgaccagcacacttctttgaagaaagcctcatttctcggattgttagtaaatgattttctaccactcaaacaagcacaatggaaacagagttttctgtgtttcacttacttcccaggaatgtcaactacatcacgtcgtggctgagcatggtagggccagctgttgggctgaatcttcctctgagttacgccacagcagcctctcaggatgaaggcaacgtcgagtggacaaggtaaaaagagaagcctgcgctccacgtttcctgttgcaaagatcctggagcctcttttgcatttggctatgtcgcccctgctggccccagcatttattaagtcggctttcatctccgacagactggacgctgactttggtttgtcctagttttccaaccaaccagcgtccactcatttaggaagctcttgactttcctatagtaacactca

SEQ ID NO: 47533 - DNA, 746 bp, Bovine  19866881176403
aactttggggactctcagaaactctgctactggcctagctggcttactctcctgggattacattcaatttggggaccctgggctttttcttttctctttgaaagggctgttgggatggtagccaacctgcagaagccacagggtggactaaaaagaaaaatatgacaagaccagtgtcttttgagaaagattaatctagcagttaggtatgggatgaaattaaacagtgggcactaggcggcaggaaaactaattaggagacagttgtaaaagtacaggcgtaataaaaatgtaacaggatactggatgggacctttcctgttgtctcagagtttccgccaaagcaccctggccaaggacaatgggcagtgggaggccacacattgtaaagacagttgctaaactcatccagcctagacttgctaactggttctttgagtgtccattcaattatgctcctctcctacataagagaagttagtgaatcattatgagaagaatctggggtagaagcggaaaggcctacgattcatctctcttctcaaattgcatatttgtttggagtttggggaaaagagaggctgacgcctgcttcttacctagaggtggacaggggcagagagaatagccctgggatagcctcgcttctaaaatgtgatgggaaaagggggggtaaatttcccataagctaaatagcatggggaggtagctgggggtccatggcagcatactgagcccaagcatca

SEQ ID NO: 47534 - DNA, 1138 bp, Bovine  19866881197827
ttccccttctgctaaacattattgtaaaatacttgaaaatctaaatgaaaatagttgctgcaaaagcagactaaaggattaaaaaaaagatggcaaggacaactgctatcaaaagcacggtagagccagcaaataatacatttaactccacatgaattctctgaatgaatttaacacaatttctcccattctaactcaaaaattaatttctgtatattgtccttgagatttggattgggaatgaaaaggagaaaaccattgaaagtgtgaagattttatgtgaattaatcaaccaagggctcagacactggggagtgaagattaaactttatagtttagaaacccaaggacaatactcttctcatgagtgtacctcacatcaaaaaaaatctctactgatatctatgtctcatttacaacattcaagtgaagaggtaatttttatgacatcccaatgagaagatgcaaagaggttaaacattttatagaaaagtcaagggagagtcaaaattagaacaaaatgtccctggctctggcactgtcttgcattccagatgaaaagataatttcgtccctctgtccattcacattaaagcctaagcagataagacagttcagcctcaaagaatcagagtaagaaagttgtccatggggtactggtattcagaaagaagctgctatattatttcagaagtaatagtggtttcccacccattgaccacctctgtccactgctgacagcctgttaaaaccgtcagttactgcttgaaagaattcagtttgcaagataagatacagatacaaggcttgtatataggttcctccttggttttccccaggtctattcagaagtactctatgggactaaggtatgggtgagcctacacgcctcactgtgtggcaaagagcttacttttaaaagttgccgattccagatatcatagactatttagccttttctaggaaaaaatctgaaaagaaatatgtgagcaaatgaacctataggatctgccagctttcatctccctcaagcaccagtaaacttacaagagtccagaataccatatgctaaaacgaggagttaggttctatatcccacagagtgagcaaccttttcatttctgtcatatgcaatcaa

SEQ ID NO: 47535 - DNA, 2188 bp, Bovine  19866881213428
tagtaagtattgtgcatggcacacaatggggatttaattaattgaaactttatctcttgtcctgatctccaatgaattcttaaccactacttctaaatatctgttgattggttttaactcagtgtctactagagcttttgaatacaatatcagacattccccaaacctgtcccctgctttctaaactccctatatatgaattagtagcaccatcatccacccagtcagcatgttggaaaccttggaatttccttaacttctcacccagtttgtccccaagccctgcagagtacatttgcaaagtctgtcaaattctcttatccctatttatcttaatcagcattgcctagaactctttttatcatctcttgcctagactttttgcaatattctcctaacttgtattcatgctccacgatgcctgtagagttatcttactaaaatacgtaaatttgaacatgtctctcaaaacctgctgtttccaacagcatagatttagcctgaccatgtagcctcatcacttaccacaatcgcctgtaagtcccacactgcaacaactgtaaaactacataccgtttccctaatgaactgtgagtactttcacatttgtttattaaatgccgatccttctctttgtccttgtaatggacccccactctctctcctattcccagtttcccagctcagatacatcttctgtacccacagagtactgcttctgtcattgctgtatttggtttctcagactaggctgacagacactgctgttatttatgagagttcagattccgtaaagtgctagggataagagcccaaatgctcctcttctctgaatgagggcaaggactacgaggtagaaaacagtgaatacaagagcttgacagggcaaaaatggaaataaactgaactggagggggtaacaaactttttaaagtagttttaaatgtttattatatttaatggtgtttgaagaaaccatgaagagggagaagttggtacttgtgagaatgagatgttcaagaggggctaactttggaaataaagacttcttttccccctacctgagatgaatggacgaaattttaaatctataaataatgaagtgtttagttgaagatgaaggcatagcaataatttcatggctttgatgtatgaccaaaggacaaagtactaactcaggatagtcgaaccaccagtaaagggccagttcacaaaagtcaattgttaaaaattcaggaactttgtcagctgattgttaaaatcattggtagcttgaaatctgccttataggaatatttacacagcataaattggcacatactacagatttggagtttttcccccaagtttacagcacacctctagaatacttcggagcttccataacagctgagccaaaatgcttccagctgttcgtgaaaactaggttaaagctggagaacatgatcacgtgttggatcttgtcaaccttgttttgttttccttgccaggcactctctactataaaacagaaaagttggctagaggatgatcaaaaaagagttgggaattaacaaagtagacttcaggataatgaatttaagatatgagagagagaaagaaaatgctggaattgtgatgggataagattctggttggaatatagagtgttgtttgtgagtgtcatgaagaacaagaaagatgtcagtcaggaaagttgtttagatcttagatctctgtgcaaaacttttaggatgtagtcatgctcatatatggaaaaaaactgggcttgggggaggggcacggggagggtatttctgtaaagtaaaggcagtgagtgtgttcctaacatctaaagagtggtttttttgatcgctaagtcatgtctgactcttttgtgactccatggactgtagcccaccagtctcccgtggacaaatggaattctcaaggcaagagtattggaattgttagatcatatcttgaagttgcttaaggatgatagtaggcaatagagacagaaagaacatgagcctggtggtttaagttataaggagatgaaaactggagccggcagataagttggtgatttggagacagcagggacacgtatttaaaataaatagcagaggatggatgattgatcatgaactgcaaaagacccaagagagcaaagctgtattcattcacccagtcaagtaaatgtaca

SEQ ID NO: 47536 - DNA, 1269 bp, Bovine  19866881230088
gaaaacttagaatgccagtgtattaatttataaatatgtgttgtaattgccatgtgaatgggaaagctagtgtcagctaataagcattgaagaggattattggaagccaccttataataagaataatatctaatgagcctggaacctcagcaaaggagagttagatgattttaaaggtaacatctagcctcggtgtggccaattgcaccatgcatatttctgccagctatactggtcactttgtcatctggtctaataggatgtaggattcatgagaatagagtctgtatctttcattctcaccattaaatccaatatctaacccatagatggatatgcccagaatttcctattctggttggtgctatatgagcactgccaaactctgctctctgttttccatttacccctgatccttgctaattctatgtcttctgttgatacagtctttctggatcattcagatgagagttgtgctttctccactttgggctttagatactgtcttttaaggtatgtgtgcctgctcagtcacgtctgactgttttttaccccatggactgtagccctccaggctcctctgtccatgagattaacctagcaagaatacttgagtgggttgctatttccttctcctggggatcttcccaactcaggaatcgaacccatgtctcctgcagctcctgtattgacaggcatattctttaccactgagccacctgggaagccctgttttttaaggtaacttttgtacaaatttaattccaaacatttaggattgattttatgagtttaattatgagtttctgcctcactgtcacctaaactacacattggcctaattgtgcatcagaagctggaagcataagatatctgttcatatccatggatttccacctagtaatctttgaacactgcttcataatccacagatatttaaaatatgaatgccttatgatatttctaaaaatgtaactaatcttcaagaatactgatttaccaccaaaaagaatgtgccacaaaatctgaaggcattgagaatatagttgacttttttgataggtaaaactagaacaacaaaaaaaggtatgataatgagctaaatgtatgatattttgtaagcttgataaagataattttgtagaagcagatgaagactactaatttacagaagatttgcagttgcattgttgttgcaacaattataattgggttccaattataattattatgattagactaatagatacattttttaatataaaaaaa

SEQ ID NO: 47537 - DNA, 1586 bp, Bovine  19866881244024
tccatcgagtcagtgatgccatccaaccatctctttacactacctgatcttgagcaaattacttaggcgggtcaaaaaataagttttctatagctctgtattttttaagattgacaaccattaatgggtcatgaaatcaatttataggtccaacaaatatgtttttaaaacagtaatagaacagagtataagtattttccatgaagcttgttttatatgtgtgtgatgtgtatgtgatgggggtgtatgcgtatgtacatgtggggagtggagtatacactcctgtgtttactggttgcaatgttagatgcattgcttattgtatgtggtgatcaaagaagtttgaaaaatcctgacaacttcttttctaactcctattcccactcagaagtaggaaaaaaggtggaaactgtacattcaacactactcagcatttttcagtttccagtttgaagaggttttatgtccattctcccctccccttctacttccttcttctctcactcacgttccactgcgcttccttaggctgtgagtctccatctcagtgcatggtttcgatggagtcagagcttcagagagagacaaactgcccaacaataaaccccgaacttaccaagatggggaaagacagcagaaagtgcttttaatataacattccccactacatgtaggattaattcaaggctcagttcctttatctattaagtgtggtgaagatcagataggtttaccatttaaatgcctatcacactttaggtactggataaacatgaaggtcttccctcttcgggcgcttatttgctgagagggtttctctaagccagccctagtcctctgggaacttaggctgcgatatggatgctatggtgcatagagacagcaaaacgaaaacaaatcaatacatcaatggagcggaaggtatttatatcatactcaggtcaagtgcattttatggcccatggccaaaggtctaagatacctcaactgatgaatcccccaggaaactagttccagcatgcctagctttaaagataaacaaatactgactacaactgcatggacacagacaaccctaagcaaacacgagagtggtgaaatgtctggatctgagccctctgtctgcctgccctcctccctcattcagagcctggtctcctcactgaacatgtggttgcccatatgctcccttcacaacccgatcctcaaccaccctcagaagattctgatagcatgtaacataattgacactccaacctattctcactgaaatgtttctgtggaaatatatacacaaacacacactaacacatatttttcccctaaagaaatttccaatagaatcaagggacctgaaggaaccttaatttagcccctgagtgtggcacagcaggtaaggaacagagaggggaacagggcctatagtctggcctgcccatagagaatgccatcctcagctaaagaccctctgacctggccctgaagcaaatgaggtagagaaagatgcctccaccttccatggatggaagcttactcacttgttcagtcactatgtctgactctgtgaccccaaaaactgcatcgta

SEQ ID NO: 47538 - DNA, 918 bp, Bovine  19866881257884
caaattctctgccccaaacaagggtgcatttcgatgtctaccaggatttagtagcattaccaatttctaccttgtattccacttagaagtgattttattatagacaggaattattagtaacctatttttatttctccatgtctcaaacactaaattgatattgtattttggcttagtgactatgtcataaaacattttgtaaaagaaagccaaccattccaaaatcagtgacaccacacttattaaattgtttaaatgaatccaggacagtttcataaatgaaattaggtgatcaggaaagtagcagaggaagtgtgactattgagatgagcttctagttgacagtatagttaactaattaatccaatttagagcagcacttcagaattggtagtcaactttgatcaaatgtgtaaaaactaaacgttttttaaatgtttaaactggaaaatccatttaagttttgccagctgaagttgacactattacctgaataacccactgtttctgtctatttaaaatgatctcctaagactacgttaacatgagaacacagtgagcaaaaagccaaattcctgaattctgaagttctcattgatgtgtccgagtctccaaaagagaaagtctataccacataaatttgttataattttatttttcagatgctgcttgtaaaataaccctagaaaatatgtgtagccatgaactgcaggtctaatttctaaaaatatttgtagaaagtattattaaaatggaatttagaattatgtgaattactatagaattgggttgtacaagtcttcagtgaattcattcttaatattttaattaatattcagcccctcagagttgataatttgcttacattacatgtaatcaattatatatatataaatatatataatcaaacaatattta

SEQ ID NO: 47539 - DNA, 1023 bp, Bovine  19866881262902
ttcgcagcttgtctagctggagcccctccctttcacttttggcacaccctacatcattactcaaacttaattttggttcttcccttccactgcatctcttctccttcctcaccatccttctgagaaagaagtaatcagggtgtacattggtctatacaggcagtagattaaactggaaaacggggctcagtgtcccattagacaatgtaagtcacatccatgtgagcatcttggactgattcctcccgcatagttaagcatttaccaccacaccactgcttacatggtaagttgtgaagattcatttaaatgaattgtgcctggcacataataggtgttcaacaatatgttaattcgtttccttgtttacataaagaagcttcagttcagaatggtttagtgacttgcttcaggttgcacagctggttactggcagagcaggacctgtgacctgtgacctatgactcacagcaagggtagttctctgaaacaagtgattctcaaagtgtggtctgagtagtcccgggcaagtcttccctttttcagttacatattcatataagcctaggttttcttcatatattttaattaaaacagcatagcacaggttaaatgcagacaggtatgagaatcctaccatattctattaagccaggcattaaagagaaatgcagagatgtaaatgaatgatacatttctcaccaattattttattttgaaaaacaactactttttaatgaaaaatatattatgctaacatttgtttgccttattattttgaatgaaactcataaatatatatttaactatctcatctttatttctaatatgatgcatatgtttctctaaagcatagtatctaaagatattaccaacataaacaaaacctcttttacattcttaatttttaagagtataaaaagatcctgaaacaaaaaatctgagaactgtatgtatatatgaaagcatcttgccctctaatactttacaatggtttctgggtgtcaaataggggagaaggaa

SEQ ID NO: 47540 - DNA, 728 bp, Bovine  19866881628521
atttttttcctctagaattctttaaaaatatgatagaaaaactgaatatagatcagaaactccattgcattaaaaccaggaagaattaatagggaagagtttcctttcttaatcaaaaagctttcagtcctgttagaagcacttgaaaacccttaccatcaagaagggcatgaaatctcaagtgttcctggaggatattttagcactccaaaggagaaagtaagtctgactacatttttatgttccctctgtccttaagtctccaggggcttgaggatggctgctgatgaaccagcttcactgcttacccttggatcaatcatgtttgcttaaagccaaggcaccaaagaaagccgaggaagattgtactcaagtcatctgtttttaattacatttcgctctattccagcctctccagcatctgctttccctggaatatgccagaaacattcccatctcaaagactttgcatgggccagtcattctataggaaacatgctacatccagaaatcctcatggggtcagtccctctctgcctccagatcttcactcaaatgtcccgcagtagagcctactctgaccaccctatttttttttaatttttatttttttcttaatgttttctttattattcctaaataatctatcaggccatcaataaccaaagcccaaatcctggatgtgtatatttctgtattcattatatagaatattaactatctttcaa

SEQ ID NO: 47541 - DNA, 1154 bp, Bovine  19866881672360
tgagatggtattcagtcctatagccccaggagctggttgctagttcagagaggttaacacatgcttttagtcaatgtttctgaaaatgtattctcacagagtcaagaacaggaacagcaaaggaaatggaaacaagatgtctttacatagtatttgagattacagaatatagacagaaataaaaatacacatgcaattattttcccctttccctttcattctaaatctaggctagagtttaatttaggattaaaagtctctgtatggattctcttctaacttctcctccagttatcccatccacattccagttctggttttgggcagaactgcaattgtcctttgtagggaattgcaggaactcctgtgctggttttctaatgtgggaaaatgtctactggggaggcaaagaccaccaaactagtttcattatgacccaaggaacactaaatccagcccttcggtggtgggcgaccagcctaacacactcttcctctacagagctcattaaaatgttacttacattttacagtatgatctcaatccaaaagttggaattttatctcggcaaatagaaaaagaatactcttgtgctatctgggtctgaaaagttttaatttcttctgtggacctgctggtgactagtgaaataaggtctgtattacttgagagtgagcatttcagttcagagaagttggcaaggaagtaaacaacagattaaaaaaacccaacccaaggacacaaaatcagacttatcagccaaatagattttaacttttaccttcctcgtaaaagtgaatttattgtttgccaaaagtacaaaatcaacaactctgaagaaggcatgtttcctactttggtctccaacctacagcaaaggtgatgactcttcataactacaccaccttagaactctcattcatgtgaccaaaattattccggatcaaaaataatatcataaatcccagacacttttaggtgaaccaaactgtctggatgctaacttcaaccaaccaaattaaattaacattttaacgatttgtttccggcattgttcatgcttcataaagagtcactcactttattttgactcaaggcaacaaggctaaacaagtgattctaaaaaatggatcacttccaggtctggaaattaa

SEQ ID NO: 47542 - DNA, 1109 bp, Bovine  19866881740980
tttaatttggagtctgtacactattaagcccaagttcttgcaagtgtctgggttagtggtgatagctgatttccatattggtgttaataattgtgattttcatgtgccttaagatcctgaaataccttctgaaattctggcacagtgggaagcaaattcaggaaaataatggtggcatcttctctcagattattcagtcagcaaattataatatagaatgagtatttgtaaagcttggataaagaataacatgaaaatgattaaaatcctatatattatcttaatattttaaaagggaaaatattgctttgtcatatgtgtagggaaagtattattaaggagtgtttaatatctattttattcattttagataagatgggaaaagaacatcactttgcgggagccatcaggattcttacattcttggtggtgtgtattttggggtctctactgtgcagctccagaaagacgggaaacgtggacattcaagtgaagcaaaagccttccatgattacagtgctgcagcagctcccagtccagtgctaggaaacattcccccaggagatagcatggcagtaggccctgtaccaccagggttctttcagccttttatgtcacctcagtaccctggaggtccaaggcccccattgaggatacctaaccaggcacttggaggtgtcccaggaagtcagccattagttcccagtggaatggacccaactcgacaacaaggtcatccaaatatgggtaggccaatgcagagaatgactcctccaaaaggaatgttttgggtggccccggaatgcctggaatgaacatgggcccaggtggtggtagaccttggccaaacccaacaaatgccaattcaagaccatactcctcagcatctcctgggaattatgtaggtcctcctggaggtggagggccaccaggaacacccttcatgcctagtccagcagattcaaccaactctagagacaatatgtatactttaatgaatgcaatacctccaggacctaacaggcctaattttccaatgggccctggatcagatggtcctatggggtggattaggaggcatggagtcacatcacatgaatggctcttta

SEQ ID NO: 47543 - DNA, 786 bp, Bovine  19866881999585
atgatgctgtgttcgatgtttccctttcaccaggtccctgcagtgcactttgttttagatgttcctggccaaactgtggacttggatggaagccaagcagctgagagtgcatctaggtaggatggaagctgatgctgctcaggagaaaacagttggctaatggtattcaacttatcttggctcttctacctgggtaattttccatttctatcaaattgcaatatttgatatctcaatatctgggattgtttttgaggttttgaatgatagctcaaaaaatcaagaatacaacaccatgataaaaaaaattatattagaagcatcatatgcatgattttggggcttccctggtggctcggatggtaaagaatctgcctgcaatgcaggagacccaggcttgaggttggaaagatcccctggagaagagaatggctatccactccagttttcttgcctggtcagacacaactgagtgactaacactttcagttttcatgtatgattttatgtttgtgagaaaattggtgtatatgtgtatatgcaaacaactgtatatatatcaaggtcactcaagcataaaaaagacaacatggatttaaaaaaaaagttccttaccaggaccactaaaatgaacaaaaggtgatggcggttctcattatgcagataaactgaaaagattagggctcttcatcccacaaggggctaggactgcagcctacaaatcaagaagcagtgcgaaggctagtgaagatatctctttgtccctcagatctcgcagtgctgcta

SEQ ID NO: 47544 - DNA, 1873 bp, Bovine  19866880530822
gttaggaagatcccctggagaaggaaatggcaacccactccaatattcttgcctaggaaatcccatggacagaggagcctggcaggctacagttcatggtgtcccaaagagtgggatatgactgagcgattaacacacacacatgtctaactcctgccacccctactctgggagtgtgcattccctgggcaggtgctgactggtgagggccctgaggcccagcttcagctgctccttgtggggagggctgtggggagccctgcatgtgggttgcaggctgccccaggggcatggagctgtgcagggctggcaccactgtcccaggactgctcatgacaggtcctgctgtctgaacaccacccccaaactgggcctgacccagaccttcctaatccctccccttccctgaggttctagattttttccatcctcactcagattccaaaaaggttgtgattctcagcttctaaaagctcttgcctccccatcacttttctctctctctttttctctctctgctcctccctcattccctttcagtcccagcattctaagtgtctctgccgcttgaggtgaccgtggttgactttaatggcaatctagaaacatgctggcactgcccctttttccaagagctggtgctgccggccaaagggaggtgtgatggggctgccgttaccccaggttcccccaggacctctggcctggaagtgtcaaagatggtgatgagttgccctggggaacatcacagcctaaatggctcctgtagcccatctcctgctagttaatggcctttgggacagctcagaggggaggagaggggaggcagctggagggggaatgctgacagctttcttatctgtgtggtgtcaagatttctgagcgctcctcttttcatattggtaacaggtgttctgcaaaaaaaaagctcgcaccatcacactgggctgggaaactaagctcaaccaagctctgtggattttctttctgcagcacttatcagagcctttgatatgttaattcatatgatcaagtaggacctgcagtatttctctagcttgggaactagtgcttcttagggaggaacttccctgtagctcatacagtaaaaaaatctgcttgcagtacaggagacctgggttcgatccctgggtcaggaagatcctctggagaaaggaatggcaacccactccagtgtttttgcctggagaatcccacggacagaggagcctgatgggctacagtccatgggcttggaaagagtcggacatgactaagtgactaagcacacacagcttcttaggaagtgcttggctaagttacctcatagtaaagtcagggagatagttccagagaagggaaggaaggggctctggtgaccgtaatggctgaaatcacgggctttgatgtttggtagactaaagtctgaatcctggcttggctacttacttgcctgagtatcacttagcctgtttggatttccatttcctttttacattggggcaataatagtatttgctttatagagttaaggtgaggattgaacaattatttgtgaaaagtaccttgcacagttttgggcaccaagtgagtgcttgctcaatgggaactgtcatcccccgctccccttcttggattccagctcctttttgctgtgccagctagacctctgtttattgccgtctgctattctgccaggcactgcaaggctggagtgcagggcagtcgggggaggatgtggaggccgaaggccagtgtatggtctgggatcccactggggtctggtgggggcacctccttcgtttgttgggtacatggcatttctaagttagacctttacagatttggcacaaggttggcatccagtggggag

SEQ ID NO: 47545 - DNA, 2473 bp, Bovine  19866880550749
cctgatgctgaatgggcagggtcggaaaagctcaggactggaaagagccgtgaagatccccacatggtatctgaggtccccctacaacttccctgtcagacttaaataccagcaggtgcggggaactcactacctcagttgggaacatcatctgcggggccacaggcaaagatccaggttcggagtcaggagactatctctgaccggccaggggaccttggcctgcttcctcatctgtgaaatgtacagattcaaaactccgagggcagctgcaccacgactgaatgaaggtctttgtaggcagtggagctgtacgcaccagggctggggggttggttaggagtcgcccagggcggttgacacacactgaactggtgacaaagcagaggagcagtgggcagagggtgccaggccaagcatgactcagctgccccctggggtcacccctcacatttgtcaccattaaggcaggtgggtttgggcagttgtgcccctgccatagggtcagaaaccaggatgccagccacagagccacacccctgagggccagactcagccagggacccccaccctcactgcccaggggtcaaggggactcagctaccccaggagaccagcccagctcaaacccaggtctcccctgcaggtttgggacagtggtcaagccaggcaggccttgggtctccaggggcaggagggaccctcattctgggactgttcctcaggccagcagatcaagaggccattggatgagggtgtccagggggcctctctggggcttgggtcctttcccagtgatgtcatgggaagacagggctaatgcttgtgataagctcactgcggctccctcagagaagggctcggtgatggcccagaagagtggcgatgacatcgctaatggtgtgccaggccctatacccagtggttgagatttcttggctcacttaaccctctcaaggtgccattgctgttatttattattgttgaatcattaagtggtgtccgactcttttgcaaccctatggactcctccatccatgggatttcccaggcaggaatactgcagtgggttgccatgcccttctccaggggatctttccaacccagggatcaaacctgcacctcctgcattggcaggtggattctttaccactgagtcaccagggaagccccaaggtgccattattatcctcaatttgaagataacaaaaataggcacagagaggctaatacacctgtccaagttcacacagctgggccagaatggggcaacccagagccacccatcttgtgctgcctcccccagggggacagctgagctgggcaatgggaaagcaaaggtccagaacagctgggaatgggggggggggggtctactgttcaagggcccctacagcccggggctgactcagatgattcccacagggtctcacttagggattcaggtatccttctgcccgtttgacagcctaaggaatgctgctgctgctgctgctaagtcacttcagtcgtgtccgactctgtgcgaccccatagacggcagcccaccaggctcccccgtccctgggattctccaggtaagaacactggagtggattgccatttcctcctccaatgcatgaaagtgaaaagtcaaagtgaagtcgctcagtcgtgtccaactcctagcgaccccattgactgcaggccaccaggctcctccgtccatgggattttccaggcaagagtactggagtggggtgtcattgccttctccagcctaaggaatgaggcttagagaaattaagccacctgctcaaggtcacttttcaaggatgtaaactcagttctaactgaactaccgtgtgaccaaacctgaagcccaaacttccagcagaggtttagggaagacccatcaatgctgcacactgtgctgagtacatgctttgcagccatttcccccaaattccagcaataatcctggggtgggggggtcacctcgatgcacaggtgtgaacactgaggtctgggaggttgtgaccttaggcagcaggatacaagcccgaaagtcctctgctctcacccctgggcccagagagctaagggcagggcttctggaaggaggaaggcaaagacccgggactggagggaagtcagaggtggctctgatcgctcactgctgctcatcttggaggtagtgtgagtggccctgggagccaggctggagccattagctgtctaaccgccggcctttcaggggaccagagctgggctggctcccggacagagaggcccccacccttaggccatctctctctaatgcagaagcctgtctactggtgcccggaagccctgccagctcctccagggctcagcttttatctcagcctgcctgaactgccaagtgcgccacaagctgcctgagcctgagccagcgccagcccaagagcccaactcccaccaccctggcctccccgccaaaacacaagtcaag

SEQ ID NO: 47546 - DNA, 1196 bp, Bovine  19866880566944
gcccggctccctgacttccttcctcctggcaggacatcacggagaccggccagaggctccgaaacaggtaccacgagggaaagctggctcccatcgcaccgggcatcaacagggtcgactggccctgcttcacgcgcgccatcgaggactggtcccgattcgtgtcctccgcgggagagtttaagctgccctgcgcgagcaagaagggtcagtctaaccgcgcggaggatgccctagggcgggagagacaactgagccgctgggtccatagagctgggaccccgagcgctgaccaaagaagagcagggggcttcctgggtgaaatctgaaaaagacaggggactagcagcagccgcggcactcagagggtgctgcacgcggaccggttgaggtttacagaggcggggcttatattggggagggggcggtgccaggtccgagcagtgggagccagtggggcggaggtggagggcaggcggaacaaagtccggaggtgggactggttcctcgagcgggcgtgaggcgtgtcttgacctaggggcggggatcaggtaagagccggggcgccggcttgctcagggcgggtgtggggccggagaccagcggtcttttcgcagtcgagagcttcagcggctatgcggtgcggtacttgaagccggaggtgacccagagctggcgggtaggaagggctgctcgccgaccggtccctgaggacgccggggtggaggaggagctgctaacacgggggtcggggagggggagaagagacccggctaaggtctccgacagcccagaaggccaagatctccggcagtagcaatgtttggggcgtcggagaggggcgatgtccgtgtcccccccctcctcagtagacaccccccatccctctggcccgccccagttctgtcttaaccagaatcccagtctggaccgctatggacagaagcccctgcctttcgactccctgtaagtgaccccgcacagaccccgggggaccccatacctgggaaggaggctggggtcttggcagctttcaccagcacataccaagtggcccttgaaaatgtgagacctcgaaagcatcgattggctccaaaataccacaagaaaattgcaatttcaaaatgagtaaatgtttaattcctaccaaacggagcatcttgtcatccagtccctagcaactccaccctttcaga

SEQ ID NO: 47547 - DNA, 1414 bp, Bovine  19866880573840
tgaaataaaaagaattagcaagtcagagggctttcccggtggctcagtggtaaagaatccaccggcaatgcaggagatgcaggtcggatccctgggtcaggaagatcccctggaggaggtaatggcaacccactccagtgttcttgcctggagaatcccatggacagaggagcctcgtgggctatgggtccatggggtcgcaaagagtctgacatggctgcagctactgagcacacactcacagcaattcagaaacaaaagatactttctaatttagatgaaggaagtaaaataaaacctactttcaccacgagcaataaatgccgcctcttgcgttttatcttcttttcacagcgaggcctgcctagtggcctctgaactggaaggaggtaaggaaaggaagttgatactttctgaggccacctatcttattatccatgtttgtcagaagctggactgaggagggggttgcttcctggaagaccttgacaggctaaggcagtgacaggcagattgccagggaggttgggaggccttgccccaaattgaccacgtctctttctcctttgatcctagtttgagagcctagagaaaggttttgggaggtttcctactctttaactgctcatatctctggttaattgcacccatccccactccactcttttcttccagtgaatttgtatctatagtgcttaaaacttaatgaagaagaaaaatcataattcactaagaaattaattcaatttgtttttaaagctctggcagcttgtgatatgaccgtacttgcttttcttctttgaggattgaactttgctcttgggcatagctctatttagactcttctcaccactgggcaggttaaaactctagagaaactggtgggtattccttcaaaaaaaactgccttttctcctctgggtttttgagtttttatgggctgcattaactaattttgtaagaattaagtttgtgagtgtggatgttgatgtgaaagaaatttctcttaagaagctctgacagtccagctttaacttgcctctgggccagaagtctgtaagaatacacaaagtctgttttggcttttagtctgttggcttctgcttgcagtataaggcattgttttcttctgtaaagacctgagtggtcacatttactggagtgaagtcgtatgctgtaaactttgagatgggcagaaggcaagtttcctaacatttccctccctgtgtaatctggcagaattttctgaagttgagggaagcttcctgtccactgtgatctgagagaccatccaggatgtaagatctgaggtcacgctgcttcttttttcttttaatttggctgtgccaggtcttgtttgcaacaccagggacctttcattgtggcattcgaactcttggttgggagttcacat

SEQ ID NO: 47548 - DNA, 1415 bp, Bovine  19866880713821
aaatcatcagtggtttgatttcactgggcgcgggtgtcccagttgtagagctcagcggcagggacaggctgccgtaaggatggcgtgtctcatgtgatgctgagggcagcaggggcccgcccgtacctccttgggcttcatggtgagtgggcacacctcccgagttaggtccatgtggcacaggtcctgggagccgtagccgttgacacagtaggcatcgtagccggcgccgatgagcatggagcagagcagtgtgctgaagtcgaagcagttccccttctggtacttgagcacagtggtcgaggagtacaggtacaagggctgggcacagcaggctggtcagtacagctgccccctgcccctcgccagtctccccagggctgggcgccagggccagtgtgcaggctcaaccccaatggggctcctcccctttcctggtttagggagtctgctaagaatggggtgaaaaccacagcccccatgtccagaaagtgcaatccacatttgcctgtaattccaaagggccatggacttcttcctggtgggaaagaccgtctggatgttgaggcttctggcctgaggatctttgattggatgttttatggttttattccaaattacccttaccttctacctctgtctctctcttctctttctccactgtgtacatattcccttttctctccctcctttcaccctccattcttaaagagattaagctggtcagaaccccaaaaatgtggccttgaaacgtgggtagcaggtccccctctttccttttccacctcctaaagtcctgaaaagaagactctgaaagccgaaggaggcaaaggagtcaaagaggtgggagtccagagatcaggcatgctgtgtgacctcaggcaagtggctgtctctttctgggcctattcccatcctccctcccagccagggggtcggtgaggggttcagccccgacagactcatagactgtggcccgaggctggccaagcctccttctcccgacctgcctggtttcccatctctggcttcgtggcctaaggacgcagccccaggtggtacttacaggtttgagggggtcaggcaagggcaccatggacaggaagtcggagatgaactgggcacaggtgtcccagttgtagagctcagggtagggcatcagtgtgggccggatggttgtgctcacgaacttctgcaaagggagagaccacaggccctggggcgatgtgccacttgggaggaaaccacggtgctccaaggaagctggagacctcaggatggggttgggggccgctctctaggcttctctgggccgcaggttcctactcagggccttgggagttggaggaagggattccctcaaggcccttcttgcccagatctagcataatcctgtgctagtgatgtgatcacta

SEQ ID NO: 47549 - DNA, 1349 bp, Bovine  19866880765950
tggccagacactgagcttgacttgcactcatgactgggctcctgcacgacacttcataggcaacatcccaagcgtctggggaaactgagccttggctccccaggtcacacagctatcaggtctggctccacagcctgtgctcttagccacagacactcagcacatatctaacagtacatgttctgcaaataagggctcaggtggcagacggccagggaagcaatctgacctgaccacccaccacctgtgtggtagtgaaaggccttaaccctcttgtgccttagtttccttgtttgccggccccctggggggagaaaaaaattttccttcctgtctctcctaggagcgtggttcttaaagcacaatgttgttgatcaatcgctaagtcgtttccgactctttgcgaccccatgggctgcagcacgccagttttccttgtccttcactctctcctggagtttgctcaaactcatgtccattgagttggtgatgctatccaaccatggcacaatatctgaccctgatactaaagctccgctactatttagcatttatcatgggcctggtccttttataagcacaaatcagcttatttaattcccacaatcaagaagtaataaaaactgttatcaatctcattttacagatgaggaaactctgggaaaaaaaaaaaaaaagaggttaagtaagtggcccaaaataacacagctacttagtgcagagccagagttcccaccacccaggcagtcttggcagcagagactgggtgctgtcgattccatgaaataagaggatggaagtaagggcctggcctggcacaggaaatcagtctcaggtggaagcttgtgaaatggggtggggcctggactagatgttctctgacataccccagctctaaggggagtctgggggagagagccactcttggggtgttgggatggggtgggaggcagagcatgctgggtgggccccccagacctcctggtcctccctcactgaggcagatgggtcctgtctgcagctgaggggtccgggctgccatcagggctgggatcccacagaccccagctggtccagagtcaccccagcctgaggaccttgtaggctgcttgtccttctcatcagagactgcccagatccacccgccctccctgctgccccgcgttgggcctgacttctttggctgctccctctatatccgctgactgcaggacacaactcccaggctcccagctggtcttacttcctgcactcccttccctggtttccgagccctggcccttcctgcttggaggggacaggattctggccccaggacgtccggatctcttccttccctgtcttcccct

SEQ ID NO: 47550 - DNA, 812 bp, Bovine  19866880798857
tccccaccccagcccggacctggcccgttagatcctaccaagcctgggctgccaatggaagatgtggccacagtgacacggaatggggctagtaattctaggaaacagccccaggcatgtggccctgagcccagctggggttcatgctctgggcagggaccactttctggaaatgccccagctgggtgtgggggcagggatgagggagcccttgccgggcctctatgtcctcctctcactcccagcagggtcctggccttgcccggactccacatcgggtgcagctttcaggggcttccagacttagcaggaagatggtgtgggttgtgtctgggcagggccgctgctcaggtccagagactccgaggaggcacctggtgagggatgacaagtcgatgccagaaaggccacagactagcagtttctgtgttgctttgctgtttttttttttttttttcagaaaggcatagtgtgtgtacggggggaggagtattgaatgagggttgtccaataaagcacaagatgctcgatctgggggacagatacaaaaaaagttcactgtttatctgaaattcaaatttcaccctgtagatctccatctgcttattttttctttagttcttttgctaagcctggcaacatgctttttttttaaatataatttttggctgttctgggtctccgctatgtgcacactagttgtggagcactagtactagttgtgcacgcgcttctcgctgtggtgacttgctgcggagcacagactctagagctcttgggcttcagtagttgtagcacgggggctcagcagt

SEQ ID NO: 47551 - DNA, 3054 bp, Bovine  19866880865692
ttcttgctcggttacctacacataaaattatggatttagatatagatatagcaatgtgtgtgcttagtcactcagttgtgcctttgcagccccatggactgcagaccccacaagtctctgtccatggaattttccaagtaagaatcctgaagcgggttgccatttcctactccaggggatcaaatagatatacttaattatgttttatgaccctgttagtaaaaagacaaatataatctaggcatgattgtattctttttctattgttttaaaccaattccaacatttccatgagcccctggacctcttgtggaccccaggcacttcacctgctctgcctcatggggagtcaggcctgagttggccacaggtggaccccatattgctgtgagtagagccccaaaaggagacaccccagtgtttagccctcaccttggtccttaccccagcagtaggggttgcatgggagaagttttgacagctctgaagggaactgttcaggactcaaagtgattgcatacatttcttaggatgaaaaattgcattccctttcaaatgcctatattttgtatttttaaattttcaattagtttggtgggataaataataggtgcacacaggttaagagtatgttgaatgcccccagcgatttgcaaaagaatataaggctctcttctactcctgcaccaccacccccttcccatcgctggtgtgagtccttccaagcagactgcattttcaagatgagtgcacagtttaccacacagactgttccactcttggcttttttcccctcttaagtctacattcttatgcatacattcatcttgtctgtattgaatagctctttagtatgccactgaatgaatataccatagttagaatgtgtgggtatttccaatatttctctctctctttttttttttttttctgatttcttcatgtagcttgcaggatcttagttcactgaccaaggattgaatccgggcccccagcagtggaaatgaggcgccctgaccactggactgccagggaatccctccagtatttttctttttcttaaaacataattttatttatttatgtattggctgtcctgggtctttgttcctgtgcaggcttttctctagttgcctcaagcaggggcttctctctttagctgcagtgcgtaggcttctcattggggtggcttctctcgttgcggagcacgggctctagagcagagtcgatgtctgtggtgcacgggcttagttgctctgtagcgtgtgggatcttcccggagcagagatcaaacccatgtctcctgaattggcaggtggattctctatcactgagccaccagggaagccccctccaatatttgtctattacagccctagaacagagaatatgtctgtacagactggctatgcctgaatattaggcaacttttttcccctccaaaaaatctctctcagaaaagaggaagtccctttactgtatatacaagttctgataaaggctcccattacctgaggatttctgattcctttatttcaaacaaggaagtactacttgtggaagacacaacagcctgaaatgacctcagtgaattctaatttgagatatttatggcggacactcaacagaattggctgtgggggagagaggaggcagaggcatttaacacacatgctgtaatttttcctggggatatgacttcacagttgcaagtgttaaaataacactgtaaacaaatcttcttcaagattactttagaaagcaatgcttcaaaattaagaatgtccctcaccagacaccattaagaaaatgaagaggaagtcgcagagcaggagaagatacctgcaatctgtatatctaacaaaagatctgtatccaaaatgtataaagaacatctgtaaagcaagaagggggaaaagatgatccagaagaaaaatgggcagaagactaggtcagcacttaatttaaaaaaagatatcctgataaccaataaacatacgaacacatgcataacttcattagccatcggggcaatgcaaataaaatcaacaatgcaatcctgccatctactcaccagaacggctagaaggaaaacagaagataatgccaagtgttgacaaggatgcggagcaaaccagaactctcattccctgttgacaggaatacaaattatacaactttggaaaactgtttagcatcatatgggaaagctggacataggtacactctctgagccagcagccttgctccatatgcagcaaaaatgctcacatatattcatgaaaaggcatgtttaagaaaattcaaagcagtactatgatattgtgattgataataaaaagtatacgtttggtcttcctctgggttcctggcacaaggcttctaaatctcttggaatttcctaagtgatgagagtgataaaggtatcttgttacgctattgaagtgacttttggaaagcccccaggtaagctaagattggggcaggttgtcaagggaaccagccacaggattggaggattggagctttcagtcctaccccagtttctggtgaaggaggaggagtcagtgattaaggtcagtcaccaatggccaatgatttgctctatcaagccaacgtaatgaagcctccacaaaacccccaaagggtggggtttgcagtgcttccaggctggtgaacacatacagatgtgggcagagtggtgctcagagaggacacagacgttctgagtcccttcccatatacttgccctatgcatcaagtccacccagctattcctgaattgttattgagtcactcagtcatgtctgactctttcgcgactccatgaactgtagctcaccaggctcctttgtccgtgggattttccaggcaagaatactgacatggattgccactcccttctccagggaatcttcctgacccagggatcaaacctgggtctcctgcattggcaggtgggttctttaccatctgagtcaccagggaagcccaaaacaagtctagtaaaatgtaaattgcaaagcttacatagtgggtcaatggatggtcatt

SEQ ID NO: 47552 - DNA, 1922 bp, Bovine  19866880873903
cggcggggtgggcgggaccgcgtcctgctgggccgggagaccctcctccctcatcccgccgccgaagtgctggggaaggggagaggaagtgaggatttaggcgactcttggtcgtgggaggccagaaagggaatttctggaaggagttgggacaggtggagcgacggcttagtgtcatgagaagggagtgggcctccgttgtcccactattacgattgtgagaactggtgatatcctgcaagcctccttccccaccggggcttcagtttctctgtcttaagtgtggattatatagggctgttggggaggtaggattacttcgtgtcggcacagattctgcccactgtttagacaaagcttttaggtatcttgttagtgcctctctccatcttacaagtaagaaaacagcatcagagagggcgtggccttgcaggtatcaaacagcatcacagaggtacaattggggctcctgagaagtccgctgtactagagtgtatagttcaaggagttgctcagagccccggggctggggtccaccccatgaaaacctcccatcctctcccagctgtgcttggcctgactgaggaccccatagtgtaggtagtcccaggggcaccttgcccctcaggtaatcatgacccaggaggggaggcatccaatcccagcaatccagcgaccccacccccccacctgccaacacacacccaggtttgctgctgatccttgatgtggaccaatagctgtacctctggatctcaggtggcccatttgtaaaaaaggagttctgattagtggtccaggatatctttggcttctctgtctgagatggagttacctgggaacagattaggggtgcctacccaccagggctcaggttcagcctgcaggctaagcttgcctccctgtcctctcctggaggtccagtgatgggagcacgggtgacaggtcagagggacaagcgcccacagtttgtgggctgaccagccttgggccctgcacttatccaatcaggctgtcctctgtggtttcctgctgggctctgctccctgcccacagccaggcctgtggccacaggccagccccacagccccacctgaaaggttctgggaagttatagagggtttctgagctggagggaggagttgggccatcccatcccaccccagccccctaagctgggccccatctaggcctcagcactgcttactcttcttactaggtatgagccatcaaaacacggtaaggacaaaataaacttgtccccctgcgagtcagttagactccttcaggtaagaggcctgatccttgacctggccatgagatgacctctgactttgaccttggctacaggctttgacacctacctgtctcagagcctgaccctaaagtgactcctgatccttagaatggtgcaaccctccccgattacagagaacccctagctgtccatcttctacccatcagcctgggaagcattagtgcagcatttgctgtatgctgggccctgtgctgacagccagtgagtccaggatgcccttgtggtttctcagtgtggccactgctgaagaacaaggaggtgccatattgggagcactaacatactctttgtatgaggttggagaaggctacccaggggatcattacccagaggtaggtcctaaaggatgtgtaggaggtactgctagagaaaggagaaagaacattccaaacaggtccactagaagcaagagccaccggtcactttgtctagacgaggctgatgaaggccttgcctgaggcaaacatccagtcaaaacattcttctgtcctggccagcagctgcctggagcagtgaggatgactgtggggcttggggttcaggagctcttgagtcccatgtggacctgtgcatgcttgctaagtcacttcagtagtgtcctact

SEQ ID NO: 47553 - DNA, 827 bp, Bovine  19866880886685
tgctggatgaggtgacgtttgaatcggggccttgaagttgagtaagaattgttgagctgaacagtgcctgtttcatgtaatgtatcttgttattgttcagtcgctaagtcatgtgcaactctttgcgacgtcatggactgcagcacgccaggcttccctgttcttcacagtttgcacaaacttgtgtccattgagtcaatcttgcctgatttaattgctgaggacctgagacatcagaggtgcaacacaagcaagggccctggggcaggaaaaagcactcagtcacttatatctgactctatggactgcagcctgccaggctcctctgtccatgggattctccaggcaagaatactggagagggttaccattcccttctacaggagatcttctcaactcagctcaaacccgggtctcctgccttgcaggtgaatattttaccttctgagctaccagggaaacccgggaaaaggcagggcatgttcagagcagggagtggacctgtggtggagggaagggaagtaggagatgagaagttaggacagccgtcacccagccccgcacagcgttcgtggctgatggagcacctgctgagcccagatggagcctcagagtcctcacgctatgtctggcaggctctgtcaacctactggattagcacgtgaggtgacccattcagtgtccctgccccagagaaaaggcaggctgggcccacaatgggatctgtggagaaggcccaagtacagtaggggcctcccctgggaagcggccattgtggcccataaataggttaggcgggcaggaaacaggaaatcctgacaatacaa

SEQ ID NO: 47554 - DNA, 1618 bp, Bovine  19866880913911
gagaaagcccttatgcctgtaatgtatgtggaaaatcttttataactctggctgacatttgttatcatcagaaagttcacagcagggaagtgccatataagggcagtgactatgggacctcctttaatcaaatgcacctcctcagttctggtaggaaaatccacactggagaaaagtcttataagtgcagtgaatgtgggaaatcttttactgctaactctggcctttggaatcatcagagaattcacagtggagaaaggctttatgagtgcagtgaacgtgggaaatcttttattgctaggatgagccttctcaatcatcagagagttcacactgaagaaaggccttataagtgcagtgactgtagaaaatgttttattagcagtttgagccttctttgtcatcagagaagtcacagcggagaaaggcctcacgagtgcagtgaacgtgggaaatcttctcctgctagctgtggccttcggtatcatcagagagttcatttgtctagactaggccttatttgccagatggggaaactaggctcagagagaaagaaaaacaataagggcaaccaggcagtgtcccaaacccttatgtgcatttatcagtcaatcctcccaagcagttagaaaactgagactcagagccgttaagggactttacctgagctggtattggatggagactccagaagcccctcttttaaccaaaggcctgtggctttgtctcctgcctctgcgggaagtgggtggggggggtcatatgggacagggcgtggctgtcctcgccaggtaccaggtgggtagaggggtagagctgctcctcctcctcccctctgtctcaggtcacaccaggtcagatctccagcaccgctgggggagctgacaagccaccttggggggcttggccctggggggtgagagagtagctccgacctgcctgtaagtcagccctgatcagaaggcccagtcctgatcagaactacccaccccacccccacctctcccaacagggcaaggaggatgaggataagagcttcgacatgccgccctcgtgggtggagcagattgagatctcccccgaaggtacagtgtctctggacctttgggggcatctgtggcggcgggatgcctgcagaggctgcctcggcccctcatttccaaaccccggccccatgtttcctgctgcaccctcttcatctcttccttcccaccatacacgctcagctctgcggccgggggcctgatcctagtctggcacacaggacagggctcagttaccagacccagagtgatggagtgtggcaggtgctggaggactggggaccgggacacagctgttcccctccctcagcccactctgccaggaggagactacacacagtacccagggcaggcagggaaagcaggggggcagggcatgcttgtgccccatgccaacctctgctgattgctgagatttccatctgggagtggctggacccatggggaggacctaggctgtcccatcagggcgggaagggctggagagggtgtcatgggaaccccgggggttggaggctggggagtgggtgggcagaaagggcttctgggaggaaggctatctaagctaagtttta

SEQ ID NO: 47555 - DNA, 1063 bp, Bovine  19866880939798
tgcaacagaactgttggtaaaaaacgtacataattgaaagctatcattgattattttgcccaaccgctccccagaaaagttgtgccaatttgctgtcctaccaggaatgaaggggagtctcttgcttacacgtggtagggccattttttcatttttgccaactgaagggttgtaggttggtcccttattgattttctttctttctttccccttcccttccctcccctcccctccccttcctgtctcaaccaagtgagattggtcctgtttttagatgtatattgcgcctatgtttttcttttgtgaattcttggattgggttgttaattctctcccaggatatgtccttccctgcttcccagtctcctgggcttgccaccacatgctcactgccacacttctgccccctgcattgcccttgtgggggtgcttgttggttttcttgtaggcatcctaacccctgtgaacgtggcccgaatgggtacctgatcccaaccacagcatgggctgcagccctgctttacctttcctggagaacacttgtcacatttccttagattttctgtgcttcctctgacctcccacacatctgctttgcttggggaggcaggggctatttcggtagcttgccacccaagaaccctggcaataaggatgctggttcctcccaccacgcatcagctgccgtggaggctgctctaaggagcacatgaggcccccaccctgggctcccaccctggcctagtcacggggtccacgcaccgcgcagtgcctgggggtggcccggcttgaagtagtcgacattcaagcccgtgatcttgtttatgtgctttagctccaacatgtcctccctgttctggtaccactccttcatctccaaagtcttggtacctgtggggcccgatcggtgtctgaagcagccaggccagatcccccagctgctgtcccaccactcccagcacacagagcacaccagcagggcccacactcacacggataggggtggtgacatgaccaaggtcacataacatgtcggggatccagctcttctgccccctccccc

SEQ ID NO: 47556 - DNA, 699 bp, Bovine  19866880950124
ccgccccctgggcctgcctgctcttctctgtggcgggggaggtgggttctcctctctgatgctctctgtgacttggccccctctcagggcttcagtttccccacctgccctgtgaagtggggctggcgctttctttccgcaagcttttgctgtattgagcccctactgtttgccaggttccatgctggcctcggggaacaccttgatgaacaaggtcccccaggtgctggggcgttgagaggttaagggttagaggtccttcctggcatcggagagctccctcccagaccaggggagagtttatcagaccccagacggcgggaccccagagtcctcctggcttgcctgcctgccgccggcactctccagtcctctgtccttttgttttcagcccacttaggagctagggccccagctcagaccctaggacatgtgccagctcccagtaggaaggcagcctcagcagatgggaggagaggaagccctttgaaccctaacaggccgggtccagcctcccaggcaggtccccatatgcggagccagcccagtccccccaccacaagccgctcacccagagccagggagctgctcgctcggttccttggcaacatcctgaggaatccagttgctgcacacgctcccttcctctcccctcccaccgcctgcctgctgcctgcgggggcctggaggcggaggcgg

SEQ ID NO: 47557 - DNA, 1750 bp, Bovine  19866880959886
agcccattgtagtcattggtcagggtccgcagtgctggctgcagcgtcagcaggttggtccggacgcctatggggacacaaaggggtgagaggcagatggggtgaagggccgtggtgtggggagcaggctagcgctcagccggccggcttacctgccaggttctcgtgtaccgccttcatctccacctgggctctggcgaaggcctcctcgatggcccggttcttgtcctcctccagggactgcatctcttccagcatctgcccgtgggccctctccagctccgactcgtacatggcgatctgaagccagggtcaggagctcagtgcaatgccccatgggaaggtgagatgccccacccccccacacacacacacatgcacgagggagagataggatggccgtctctctccccaaaagggctgccagctccgtgcagctacttcccagcatcagcccagcaccatccaaggtcccataggccctgggaagcaggggagaggatctctcatcagttatgatacggaccagggtacccttccaagagcgttgtgtgccaggccctgagtcaatcttgcaatgaggtcaagcctcaccgggagctgggttctgcgatcagaccattttacagatgaacagaaacttgcccttggtcacgacggccagcagggagagggggactggaacacgggtctgtgggaccccaagtgctcagcctctgcactgtgccagagtgcgaccccagcgtcatgccgccccgacagccacgcgatgacccacacacctgcgcccggagctgtgcggtcagctggtgcgagctctgcagctgctgctccatctccttcagcacctgcctctgcatggccacctgctcctgcaggtgctggttccgggcctgtgactcgctgagggcctgcttggtcttggacgactctacctccactgtcttgatgacatactgcgaggaaggggcggaggggcaggcacacagaggtgtgtgggtgccttgccctcaccctgggaccctgaggggaccctcaggagcatcccactaacatcccgcagaaaaaaactagaggagccctgaggtcttggctttccagaatgctgcaggggcctcctggaatcttctcattttcacgaacccaagaggagcctggctgtggcccaagactgggcacagaacagacaaggagggcaaagacgagagcagaacatagtgaagcatcacatccatgcctggctcatagcaggcaccccaagcctcggttgctggacgcctacatggcctgaccctggacagcaggaaggggaaggggccaggctgagtgcagacctggaaggattccttcaaccccttgcacctacttattcaccaagacaagcctgctctacgtctggcccgtcctgggctccagagaccagtgccgaggcacagcccaggtgcatacagcaggcagccacccagccccggctcaccttgatggggcggtgactgggcgcgcaggctggcgatggtctcgttggctgtctcgcaggcgccggctgagcctctcctcctcctgcgccttctcagccaggcagtccttgagccgcagctccacctcggccagccggtcggtcttctgctgcacctccaggttcagctctgacagcaggcctttgttctccgccacctccagctgtagctgggacagtctgtcgcggagctgggcgctctcctgcagacggacagccacagaggcatgggag

SEQ ID NO: 47558 - DNA, 712 bp, Bovine  19866880962477
attatttttatctgcttgctgacactatatcatgtctttatcttcctttactgaaaaccaagaagactgatatatatctctctcttataattccacagtcttatttgggtaaccaataacaaaactgagtagaaaaaggacgtttcaaactctttgatcgtgaattctactttactaaagtagaaccaaaagcctggaaagattaagcaactttcctaaagtcacacagccaaagatcaccatgttacattccacttctgtattgctaaatagcaagatgctcattagaaataattctagttctttcccctggggacaaaagatcccttgaaggtaagagagaggcatctcttcccacaggtgccctgctctggaatcctcctaggttcagaggtaccagctcttccagccaatttggtaaggttgatgagatcctgcgtgtgtctggcagctgaagtttgcggtcatttggggaaaggcattctggccctagatctcttctttaatcccagtacacaggagcagcagggcatgtgtacacacacacttcatggctcccaggcgcttactattcagcttcacactggaaattcccaaccattcatttgtgtttttctgcctggcctcacccttttggggaatgtacagaggacacaggagaggcaaaggggaataacagcaaagggcagagggtgagagggcttgccggtag

SEQ ID NO: 47559 - DNA, 1523 bp, Bovine  19866880965467
cgggcttctctccagcgaacagcccaaattctcagcccctgcagaaagccactggccccagctctccagataccccagagactgacatttcaaacgagaagaaccttcagtgaggaagcgggacctacgcctccatcaccaccccttcacctcacaggtcccagagctccaggctcctgactctctgcccagtgctctttcctgggcttggtctgcaaggaaggggcacagatggtgatgttcctggcagcggcgggagggagaggggccctgcaggcaggtgggtcgggacagactagtggcccagctacctgtccgatcatcacggagaaagcgaagacgcccgtgaaatagtttagaccctggaagacaatttcaaagagcgtcctggggtcgggcaggccgccgatggtgatgagggtcttcacagcccagtagtaacagcgaatgtaactggggagagaagaggaaggggacctcagtcatcagaactcagcctgtggatcctaggcaatctggcttgaatataaagctttatagctcatgagtgcaaaaaaaaaaaaaaaaggaaaaaaatccttctcccaactgcagcatcctctgcagcgtacagagcatgtctgcaggtgctgcgtggtttggtcatgactctgccctgacgctgtagagacatgctgtcatccccatttacagatgtggaaactgaggcttccggagattgcttggaatacttggcaagagaataaaccagggttttccggctcctgatgcctgggatccttcagtttccctccgtatgttttcaatgtccacagtctctgctttgctctcccatcatgaggttcaagaacaagcttaaaactggaagatatctcgagggtcaccttttctgaccctcccctctcctgtccactaaccagacagtgaaactgagggccacaaagggaaagggaacacccatggtcaccagctggcaagttccagggctgggactggaaaacaggtgtcaccttctctctaagctgttacccaccgtcagtaaccccttgacacaggcgcatgagccatcaggaagggaggtggccaatggggtcctgctgtgtggtacaaggcataggaaatgcccaagcttgtgtaatcacacaaagtagcaagagtccctccctcactattttgagttttaaaggtttgcatgtttattaataattacaagtttgcattattccaacagagcagcctcactgttctaattcctagccattaagtcctacaaaaataaacttaagcttttacaataacttaatcgatacagaagtaaaacctttatagctatttaaacggatttaattaccaaggtgcttatgttcagaccttcagactgtgccctccaaggggtcagcaaggttgaggtcagcagggcctaaactcagggcattctcagcaggctttcccgtactttctgtcatcctaccagggcataggaactgcccagagcctgccctgtccccagtgtcctgatacat

SEQ ID NO: 47560 - DNA, 1828 bp, Bovine  19866880982814
cttacctactaccaataggggaccactgctcaggagctgcctaaaatgaggtgtttctgggaaagttgggtgttcagttgcatgtctgcttgtgtgtcaatgcttgtttggacaccctggttctctctggaggtggggggacattggtacccagaactcccacccccaggaatcaggaaaacattgccctatgtttttcagcacaggaatcttcgtctctaaaacaagacactgaatgggatcacagcctccctctgcatctgtggagatgtttgttggtgaactagagattggctctcaaaggttcaatatggctatgtttctagctttaggattatgaagtcaggctctgctaggttcattgtcggtactttgagttcgaagacacaagcctcctttggaaaaacctagaaaacctccctggcaagagagcgtggttcttatttcctcctggtactctgaaagaagaaaacttccacataaatattgtaaccaaggcctttgaaaacgaagactgtgtggttccagagtgggttatggataccatctgagtgttagaccgtgacatacgccccagggtggaccacctacctgcctgcaagcaggaaaggggcagaaggtcaaccagggaacttgccctctgggagacagagctaagtacaactggatcatcagccagaactctgaccttctttccacccctggacacgtagctaaaactgtatacaaaggatctcgaattccagagagtggagatctgcgcttctctcaagcacccccaccattttcttggggttaccctccctatgagttgaaagagggctccaggggccccaccacaccctgggtccagtggaccatcaccagctctggactcacagggcttggggctctcctcatcggaggtgacgtcagggtcgatgagcttctccttcaccttctccgtccgctccttgaagagcttcaccagctcctggagccggtcattgatgatggcactgttctggctggctgtcgaggttgcacggtcctggtcactgtggaaacagcacccagagctgagcggactgtgtggggagggacccctgcgcccccaggcaagggcagaatctgtatcccacctggctggagggggtcaatcctgccccagtctccctctggacatcaaaacatcaaacccaccttaatatctcctgggaggaaattcagcctgggaattgcaccgggatacccagctttttaggaaatgtaccatgcaggctctgattcagatgggcaattctgaaaaactctggattccacttgtaatttagggggcaactcttggaactcagttcagggccgttagactcagtttggggttcacatgacatacaggactgatcagagaggggacagcggctactttttgaggtttaggaaatagctgattttaaaaacagtgcaggaaattccctggcagtcctgaggttaggactctgagctctcattgccaaggtcatgggtttgatccctggtcagggaactaagatcccacaagccatgcagcatgggcaaaataaattaattaattagtttaattcaattaaaattttaaaaaacattacagatacattacaaatccttttaatttataggaatttaaaatgtatgaacttgcatcaagagagacagacatagacagacagaatgaatgagagtctgcctgacagtcccctcagcctgggtccagagctctgggtgagttgagatgggtggctgtgtgaatcagcctagttccctgttctttgctgagtggcctgtgatcctctcgctgagctgaggatga

SEQ ID NO: 47561 - DNA, 1678 bp, Bovine  19866881023787
tgtgatcaaaactgcctgcagggggcgctaaggggcacgtcaggctctaccagcatcatcaggtgaggcgtgtctcagtctttggagggctggggtggaaacgatttttggactgcaatgtcccatagtttgtgaggcaagagggcttcgggagaagctgtgggcccctgtgaggtgtgggctcggcagtggtgagcaagggtgatgcagcgttggagaggcccagatggaaagatggacctagcccagcccagaaatgtttctactaagcctgagtcaggggcaggcaaaggcccacacagtaaataaaggtttacagcaggcaccaggcggctcttgggaaccactgcccaaagtccagggttggaatcagggaccctggggctgtgagtggaaggctagagaggtcctagaagaggaagggaggagcaggaaggggaaggctggggaggctgacaaagggggagggccctgggctcagaggtagggaagctgtgctcctccaggggtctgtctcaaagctctgcctcgacccattttccctgcatgccatccttaggttaaaatgaatggggctacagagtaccctcgtggtgatcaccagagacagagcagccatggcacatttctgtcctgggcgagagcacaggaccaagggtaccgccagcctccaaggtttaagtcctgcagactcccaacccccagctccaagggccggtccagtggtggtgcattaagaccagccttcagtcccactcctgggtcccctgagatggacccaagaggcaagtagtcagaagacccagcctgggaattcctggctgccatggcaacagccccatccctccaaggtccttgggccttctcaagtcttcagctggcccacccagggttgggcctggctgcaggggctgcaggtagcagtgaagagagacaggtgactctgcttcttcacaccggcggggggcgctggcggcctagatgcggctggacgaggtgctgcccgagctgatggggagcctggcactgtccgagttgctcttcagaggggagggcccaccctgggcctgcaggcgcatggaccagtaccagaggaaaatgaggaagcctgtgggcagcaagggggtacagggctcagaggctgggagcagcccccccgacaccactcccgtccactttgacccatgtctgcccacacccccatcacaggctccccacaacgactcgatcccaggagtaccgactctgcgccaggcactgggcaacgctctgtgcatcatgtcactttagtctctccagctcccttgagaccatgcctcgttattaccattctgtttcacaaacagggagactgaggcccagggagataaggggcttggctgagccaggggtccagcagcagtgggtgggctctggagccacctgcttaagtaccaggtgatagtatttctccccaaataatactactgtgatttagcaatagctcagtaaatgcgtgaattgatcagcatccttacagagttcccttcacttcacagatgggaaaacaaaggctcacctccgtcacaccccactccatcgcatggggactccatggagaccttgctttccctgttttcctgcccaagctgtcctccctacccaacatggtgaaaaacaaaggtgtgtgtgtgtgtgt

SEQ ID NO: 47562 - DNA, 1896 bp, Bovine  19866881069232
aggaggtgacaagatccctgtccccccgtctgtcttctccatagaccagagccccaggttgcttctagggaagggaagagcttacctcctggttgacagcgaacggggaggaaaacagtgctggccatcccatcctcctgcccagcctgtcttctctctcaaaccacagactgacctcagctgtctggctgcagtttcccttctgcatctgtgttccaaaagtggctaaggccaggcatacaaggtcagcccagttacctccctgttcattttttgggggctgtgtttcagttccttggggccttggcagaatgcctgcctttggagcataggaccccttagcattcccaaggtcagctgccagccctccctttcctttctcctcctccgggtcccagatccctggctgaggggcaaacccgacacatagccaggcatcctccccaacaggggctgggggccagggtgagcctgaggttcccgctccctccagggatggtcggtggaggcacagactaggatcccaccccagctcactgagcacacagcgccgcctcacctggtcctccgctactgtttgcatacccccatgggcggggtgctcaccacctccagccacacagctagcactaaaggaagctctctgaagatgcaagactcgattctaagctctccacccaaaggagcacatttaatcctcccccaaatctgagacaaataccattctgtccatttaacaaataaggaaacaggccctgaagatcaggttggctgctggagatcacgcggcttgaggtgcagcattggggcctggctccagagcacaggctctcgattttgcagtccatttctgcttgacattacctgttagaaagggcttctctttaaaatttccagtaaaagatgcttccagaaatgtgtttgcttggtattagttgaatcccttcctctgaagaagccctggtcctgggagctgtcaggaccccctcccagcaacactcttgctctctgtccgccgcaggctctggacacccactcccagcaccagcagaggcttgtcttcgatgacgggggtacagcccataaactgaaattgaatttttgctggagtgtggctgagggaaggaatgtggggtatgaggcccttacccccagccacttcctcgtcactctgggctgctgtctgtttcactgaccaattcccctcggagtcgcatctgagcccctggtgtcacagacacccagccccaccctccccatcagctaagctttcagtttagggagaaagggcggttgtggggatgggagggagaggcagagggagcagaaggtgatacgggggagagggatggcagggaaggtggacaaggaaaaggggagagatgagaagtgggggtggggtttggggagcgggaagtcagaaggatggagagagagggcaagaatcatacctggattcctccttcgtgccgtcaagcggattatcaatacataaagcgcgtgaatgagtaggctaagggctcgccttgtttgcaggctgcagcctgctgaggcggtgggtcagcttcttcccagtccaagaggccagaggggcaccttgaagctgaactaccccagctccggctcccgcctcctcaccagagcctcaaacaaagcagcgggaagatgggctgcaagccccagcccacagcccaggaaaaggggcgcaggtgacagcaacccctggcaaccgttgccctggcaaccattggcagctgcagtgactactacgtcaccacccaactccaacccagcacagcgcagttcccctaattgtcctgtgcccatatccccttactcagatgccggccaggaatggagcggcaggaagaagggcagagtttagtacattaagtt

SEQ ID NO: 47563 - DNA, 1002 bp, Bovine  19866881145124
agcgctggagaaccgcctattttttctacttatatccttatgtttctccccttatttaaaacttccccatgtctccctgtagaatgttgagtaaatgccaggtacctgagctaatgccagaaatccataattaattacccagaggcaggctgagctcacttctgaacccacttgctgctgttgcttcctgctcattattgcagaatagacacaaatagcatctcttttagacaattccctgaaagccccagccccagcctccctccacacaccccctcctgtacggacctctgccagagcccttagcacatgctctgtgagtgtgtgtgtatctgtgtgtgtctgtgtgtttctgagtgtccctgaccccaccacagctcctggctcacagtaggtgctcaatacctgttggatgacaagtcagcactggccaagtttgtgttcccacacagaagggtgtctgcttcaggtgtctccaccacccagccatggcccgcatcatcgacctggtgccctgggaggatggctccacccacatgtatgcatccccagccatcctactccccatgcccccggcggcgcaaccagctggccagcgtgaaacagcagctctaccacccggccctgcccagcctgcgccgcatggacatggactctgtcaaggcctgcctttccgacgagcactgccagtccaccacctactgccgcaaaggttgggccacctgggcgctgcggtggcccctcggggccttaggggaaggtgtggatggtttggaggagaaagatctcagagggagaagccaggagtggcagatgaaaggcttagagggactagtcccagctctgctcctccttgcctgagaatcctctgggtctgagcctctgttttcctatcagtaaaatgggaagtctaacagggtggcctctcagggctattgggagattgttgttgttcagtcgataagtcaggaagactttttacaaccctgtaggggtcctcca

SEQ ID NO: 47564 - DNA, 1072 bp, Bovine  19866881201161
agctgagagttcgggtccttcagcaactttctgggctgtggctatcctggccaatcactcttcagagcactagcttggctgcttcctgttttacctccctgatttctgggctttctaatttcattttccaaccatctctgttggtggtatattcccgtatgagggaagtttattaaagcactttgttagaactgtggtggaagcatctctctgccttccatcctggatcccaccaagtaccatcgcatattaatttcttttatgaaggtgtagatatatacatgtgtatatacatttttaattttctaccagaaatacgatagtattaataagtcagattctttccggctgcctgtttagaggcttattgatctctgagcaaagcaggccaagatgggctgtagggagggagtttctttttaaagcaatgtcttaaaaaaaaaagtcttagaggatgtctctacgggcatccttttttttaaaaaatcagtctcataaaagacatacatggaggaagtctgccacagaatctaaattttaggagactgaggggaaaatggttataaaacggtagcccagtcagccctctgatgccgtgtgtcacactctggggggaaggagcactgatgtgtggatatagcactggtccctgaatgaagaggacctagaggctactgtggcttgttgagggaccctcctcatacgttaaactctccttcctaagatgggaatgactctggagtcctcctgaagggatgtgtgatcaaagaaatttcacaaacttctggagaaaatgcttaacccagccatccccacccgctgcgggcctgaggagagcactcacgtcagtggactggtccccagcgtaatgccacatgtcatccaccatgctggtcagcaggttcaggctgggtgggatgttgtgagggagcatgaggatgctgagggcctggggagagacgacacaggaaggggtacttgcacaccggtaatgacagcgcctcactgttcggtagaggtagtaaggggcccgcccagccctccttctgagacgcaccatctccacccacag

SEQ ID NO: 47565 - DNA, 419 bp, Bovine  19866881382217
ccagggctattgtctcactggcggcgcagagctgtgtcctattcaggcactatttttggcgcccagaggaagaggaaaagaaagcaaagaaaggagttgctgttctcggtggaaccttcgcccggaaaggattccagggcctgctgggccagagaaggcagtcgctgtggatcaaaagatcctaggcttgaaaggacctggcggggggctgtggttcaggggagccagagagggggccacagatggggcacccctggccttgtacacacacttggtactcactaactgcagccacatgcagagaaagagaggcccaggacccctggtcccacccatagtcactaagcacttataataacaatttttttttgtttttttttgtttttttctaattttattttatttttaaactttacata

SEQ ID NO: 47566 - DNA, 1511 bp, Bovine  19866881421455
ggatgttggcattcgatctctggttcctctgccttttctaaaacctagatcgccgttttaccccaatccaagatggaaggtccgcggcttcacgctgctcttgatgtccccttcctgttggctatcctgaaattggttttccaataatacggttgctgattggtcaattttggacggttgctaaagcgattggtgcaaccgcccttggagggcgtttcgaaaaaaaattaagtgcaaactagttttcgtgagagacggaaaggggaggaaagggaaagcttgaggcggaggcggaaccaagaaaacggcagctcgcattggttcactagaggcctaggggcggctcttgaactctccttcctcgtgattagtccaattcaggaaaagagggcggggacttaggagaggcggcagaagcgcctgcttctattggtcatacccgaagggcggtggagtgctcgcggcggctgattggtgctgggggtgaggaaggaggggctctgagccggaggttttgttgtgagggtcggttgtcaagcagcggccaatcaggccaggggatggaggcaagtgggggtcgcgcctggagcggagcctcggcctgccgaaccgcagctgcaggtggagtgggcgagggggcgaaggggcgaggcggcgaggggaggttgagccctgggctgggccgagccaggcggggccacgccgggatgcgacggagaaggccctgggcagaggggggccggagccagtactgagaggagtgggagggttaggcaaggccgagggaccatttccagcttcgggaggggcgggaccggtgtggaggcccaaggggaaaatcctgagaggccggaaggagagcggggggtctgcaggaggaggggggatgaatggggactcttgaagcaggagagtgaatgaatggggatactgatagcagagagaaagggggggacttaagagggtctggcgaggcaggggccaagttagggagccctggagaccggatgtgcacacataggcggcagggagaaggagagaatggagaactagagaggcagacctggggaatccaggagaaaggcttgggggagcggataggagactccatgaggtcgccttttaatgctgaagagtcataccgactcatgtccagtctggaggcctagttcccagcgctgtccttgggaatggcagggacctggagtagttcccttgatacatactggactcccagggccctcttcaagactctccctagagaaaacttaagtctctctctctctctctctgtctctctctctgtctctctctgtctctctctctctctctgtctctcgggtgcctctcgtggccccctaaacttagtctctgactccgcccccttcccatacgtcagacaaaactgactctctgagatctatcagaactgcagacatgtggtctttcttccccgccccactgcagcatttcagctgcatttcaggcagccagcctccggaacagaacct

SEQ ID NO: 47567 - DNA, 1562 bp, Bovine  19866881461609
aggagccccccttggagaaaggcagaggcagggaccaatggaagtgggtctgggcaggtccccaaagatcccacattcaagcctgtgacatcactgctggcccatccctggctgccagggcacttcaccccacttcctgtccatctctggagaccgggacactttccccagcccatgttcctcctggagcagccaggacaggagggaggagactgcggggacggaaagctcagatgcgggccagggctggagctacactggacctttagacacaaagagccgtgatcaaacaaggctgcttccgtaaactgaagggggatgagaagctatttgacctgcctcacctgtgtcacgggacagagaggggagacttgacgggacaaggtagaaggcagtgatgggagagaggtccaatcagtttattcctgcagcccacccactgcacactggtcagtaaactggttacatacgtcccgtgaccagccaagggttgaattcagccctcaaatgtgatttctttgaccggcgaatattttggattagctaaggtttttttttcatatttattatttttatttaattatgtggctgcaccaagtcttagttgctgcacgcaggttttgatctttgatcaacgatctttgatcgttgtggcaagtggcatcttcagtagcagcatgcgggatttttttagttgaggcacgtggggtctagttccctgaccagggatcaaacccaggggtcctgcactgggagagcggagccttagccactggacccccagggaagtccctagtcaagtttcttaaatcaggggattttacaccagcacaatctggattcctcctcataaaaggcaggtgtggtttggctacacgggccctcattcctgcaaggtggtgattggctcgagctgagtagcagctgcaccctcagcgtgaggctcgtagccttccactgaccccaccgtttgccactgcctccccagtcgccatttctcccactgctgacacccagtcaccatttctcctctccgttgccctgataacacttccagtaggtttctcttatacatggccgtcttctcttgctcatgtttctccattgtcccccccgccccacccccacagtgacccttactagaagcacagaacaaagttcaggaggaaacgcccccaaatgtttgcatttgttggttaggtgacaacaactgacttttattttcttctgtgcactcttctacagcttccaaattctctacgatgaacacatacttctttttaatatcaaaagacaaatggactggtaattacaaaggaaatcctccccatttttgagtctgagagccaggtcaaatgttgctgtcctgcaggaagtcttcctggaatcccagctaggagtgatggctcccccaaccctgtgcctgcagctctaagagttcttgtgtttgtgcatggttcccacactagactgagaactcacagaggggaacgaccatttgttccaacagaattaactgggactggctgcggtgtgatcaaaactgcctgcagggggcgcta

SEQ ID NO: 47568 - DNA, 1687 bp, Bovine  19866881478981
aaccccatggaggtgaaggggggccctttcattttgctgagggccttgggggactctaaggcactgtgccagtggtccacaagcttttgagagccttcccaaatgatgcctaggctctgaaaacaaaactgtgtgcatgtgtgtacgtgtgctcagttgtacctgactctgtgaccctgtggactgtagcccaccaggatcctctgtccatgggattttacaggcaagaatactgtaaatgtaagtggaaagcatacagacagatgctttaataatagggccacctgggaagcacaaaaacaaaattactaactcgggtggtgttagtggtaaagaaattcccctgccaatgcagaagacacaaaagatgcaggttcaatccctgggtcaagaagatctcctggagaagggcatggcgacccactccagtatccttgcctggagaatcccactgacagaggagcctggagggctgtagtccataagttcacaaacagtccaacacaactgaagcaacttagcacaaagataaaaaggaaacagcgggggaaaaggtcaattaacatataattagcatgtcaaatttccttaaggattccattcagaatccgtaagaacttcactacatttggaaacaatttatgggtaagattctcccactttgcaagaattactgagcatacctcatcgctgacaagaaagctgaaccacagtgaatgaacatgtgttgttttagccaatttcagaagcaaagcatgacaaacaactataaaattattgtaataaactataatggaaaatgatctgaaaagaaattttttttaatttataaaatatatattgtatgtatagatgtatatgtatacatgcttctctgatgtatacaggcttctctgatggctcagtggtaaagaatctgcctgcaatgcaggagacctgggttcgaaccctgggtcagaaagatgccctgtagaaggaaatggtaacacactccagtattcttgcctgaaaaatcccacggatggaggaacctggcaggctacagtccatggggtcacaaaagagtcagacccgacttagcaacttcttgtatatggagagcaagaaaagtgagagagacagagacagacttcttcctttcctggttccaactgcacgtccaactttgaatgggcacctcccaaggcctccccaggcatctctcacttacatgttggggctgcagccccgagaggcccccaagctcagggccccaaggacagaggacaagggcggggcccaggagggcggggcccaggagggcggggcccaggagggcggggcccaggagggcggggcccaggagggcggggcccaggagggcggggcccaggagggcggggcccaggagggcggggcccaggagggcggggcccaggagggcggggcccaggagggcggggcccaggaggggcgtgtcttacccagcatgccttgggagtgccaggtgtattcgtaccaggtcttgacccggttctgcacggacctggggatcttgtagaagttcatatacttcacggtgctgtccatgcagctgcggtagtaggtctgtcccgcggtggcggcccccactacgtctctcatctgggggccaggggggtggtggtcaggacggccactgggtcagggtggggccgggcttcagggg

SEQ ID NO: 47569 - DNA, 1131 bp, Bovine  19866881500383
ccgcagcactgaccctcatcaaatcagcactttctcccagccaggccaggaggggagcaggaagagtgggactgacttgggctgtagctctgggtttgacattgttttcttatctccaaatgatacgcatttagaaaggttggtggtagaaggtatgaggggagggttccagaggtcctgagcacaaggcttctgccccaaagaggaccttggtgaatgactcgggctgtgtgagcctgagctctctgctgtgcaaaatggggcaggaggacagagctaacggttcctgcccgagcactggcctcagagggaagttgtgagtgtctgataagccctctgatcttggtgactttctgttgcatccctacaccccactctctccaccttcttgtgtataggcactcacacacaaaacactcactcacacacacatacacacatcagccagccagccgggctaattagttatacctccaaaacacaccctgaattttgaacttgaccaccctttgcaatctccacttccctggctcagtcaccatcatctctcatcctcctttccatgaccatctccctgggcttttgattctcctcttgcctctcacatccattctctgtagatcagccaaatggatcattttgaaaggccaactgaatcttgtcactcccctgctttgaacactccagtgactccaacacagacagaagaaaatccaaactccttttcctggcaccccagccctgtgtgatatggacttcagcctcctcccacgcttaaccttgtcccgttggccttgctgcctcttcaacagaccacaatccctctctgccccaggacctttgcacaggctatacccaccctgccccctgccctgggaacactgccattcctggctttgactgtgcttgtctctcccttcagaactcactgtcttctgagaggcgccctccctgaccacctatgagagcctcatagtcactcttgatcattggtaaaaagaggcttttttaaaggtaaaactatgattctcacctaaatataaaaagaacacaagtcaaagatttcatttaactcagcaatttgtaaaaaaaaaaaaacacacaaaaaaacaaaacagcaagatgttacaa

SEQ ID NO: 47570 - DNA, 1539 bp, Bovine  19866881586736
tgcctcactgagcctcagtttctcctctgtgaaatgggaagaaacagtctagatgaggctaacgaagcagaatttttcctccagctcctgacctctagctccgtctctccattctctctgctcccaccctgttcatctcctgtcttcctttacctggacctacgctgcagccgcaggatgggacttcacccctctgccctcacccctgtcttcccacaaacacaccttgcatcacactcttccactcctcagacaccttccctgagtccccactgcctgtgaacagagcccccccaactgcatgatatgacaggcagcccagaccgctttaagcgccccgcccccagcccccgtgcactttgcttttccagtttccaggccttgggctaatccctttctgctgcctggaagtcaccttactgtggaaggagaagatgaagctggctgcgctgggcagactcgtgttctgggggctccaccaggagctgactgaggtggcaaacagcgggggccccggggccagggtctcctcctgatgccggaagcacaggaggtcaagggcttggtcactcagcacgaagtctttcttgccgtagcgaagatgcaatttccctgcatggcggttccagtagaggcagaaatggtagaggcccctgggaagagggaatggccaagaagccggctggactccagggaagggggcatggatggtgagggcctcctcagaattcctgatggagatgtggagctgggacgcctgcttataatggaggctgctgttctgcgtctggttccgctggccgcagaagcggaagtcttcccgggggcccccgccatgggcacctgagggggcagagactgcagatgagactctgggctggaggcaggccctaggcccagaacacaggagcccagtgcctgggacccacacacattccaaggacctacttcaaagggtttcaaaaaatataaatctaccctgttccaagatggttggcttaaaaataggaaaagaacaaactcaaaatcagtttaaaaaaaaaaaaagaaagaaaagaaaaaaatttcaaaggcaaaataatattttaaatagcaataaaatatttcatgaggccatgcctgccacagacagcagcgcaggctgtgcactgcacaggggtgctctggctgcaggggcgggtggggcccaaacccaccccaagctgtgtactggggccgggggctgcatttgacaggatgaaggggagactctatcttttttccaaggtaccgtctacttgctaagctgtatttgcaggcctgtgcctgcccaaaggggttagtggatgtgctggttcttaacacaaggatggcattttaacagaagtcccaaggcacctccaggaaaacttacctggaaccaggaagagacccagcaggaacagtggcatctgcagcagcacttgggcagtcatcttcctcccccaaggcacccgagacatcactgcctgaaagaggccaggagtgttagccgaggtccgatccccagggggatgccag

SEQ ID NO: 47571 - DNA, 1402 bp, Bovine  19866881779054
acgaagatccctagagtgggtcctgcaggcattccgggtcagctcggccgggaactgcatggcgtgctggggccgggcctgcagagggccagagacaggctgggccccatgtccacagtcctccggacccacagcaccttcactgttccccactcaccagggagccctcccggccttgccctcaggcacttcctatcttggagcctccacccacagaaccctctcctgccaggctgcacctccacccaaacttgcgagatcctaggccttcccttcaggctgttctggtcttgagctggggtcttttctcccactcaagtggggccctgaggatggaacatcagcacccaacacccaggcattctgcaggaatcacaccagggccctcaaagggggctacctcaccccaggaacctgcaaaagcaggaaatcaaccctgaatattcattggaaggactgatgctgaagctgaagctccagtactttgggcacttggtgtgaagaactgattcattggaaaagaccctgatgctgggaaagattgaaggcaggaggagaaggggatgagaggacaagatggttggatggcatcactgactcaagggacatgagtttgagcaaactccgggagacagtgaaggacagggaagccctggtgtgctgcagcccatggggtcacaaagagttggacacgaatgggcgactgaacaacaactcacagctattaaggcagagtccaaagcccggactggtgggaaggcaggtgatagaccctggggaaagtccagaccttcaacccctggagcatttgtggggttgaggctctgggtaccctcaatccctgggcatctctgacctgggggaccttctccagagcggcactgctcagagagaggccagagaagttgcagttcagcttgaaggccagtgcctggatgatttgcgtctgcaaggtgaggttgtggcccccgaagctggcattgagcagcctcaactctaggccatgaatgagcctgagggttagagagacagccagagccctggagtaaggatggaagcaagagggaccctcccacagccttcccccatcccacacccctgtcactcccaactccaaacatctgcacacacagtgttcctggcacacccttacctcttcaccagctcccccatctccttcttccattaactcttgcttgggtcccattttattgccacctcctccaagaagccttccctggctgttccccactggctgaaatgccccacagtccctacacttccctgttaagtcatcagcattagcctgtcaccctgagcacctagggttttgagtcagagaccttggagagcctagtccattcttggagcccctttccagaaaaatgcacagagacccacg

SEQ ID NO: 47572 - DNA, 901 bp, Bovine  19866881955309
cttttttgaagggatgtttgtttttaaagatccggaatgtcccgtttcccccaattgtgaggagggcacattcaggctgacgtgtgtggctcccctgcacatccagggagctgggcctcgatttggtttcagctcaggaaactgacccccaaacactcaaacatgggtggtgggctgtagggacacagtgggccatcttgcagatgcccaggcttggaatacaggacaagccaggccacgctgggggacagggctcctcttgatatctctcaggggcagcgcttctctgcatgcatgtcctttctttgccccccgcccccaccccacgcattccctcctcagcttctccacttccccagaattgtctgcacatgtagctctgtgccaattctgggacccagtcttgacaactttctgttggagcatcaccattcctagccagcaaagtctcagcagagcagccagtaggccctgtagtatagccaccggttcccatgggccaagtgtctgttgcaccaggcagctgggcagggccttgcggctctgatacggggatctctgagggtgctggggagggtgaggactagcttcttccctgcagtccccacccctgggctgagatataattgccacctttttgactgctgcgttcgtgccttccttcttctgcagggttatcaggaccacagcctacctgctctacagcttacatctgaactcatgtctctattactgggcatcggcctatgagggcctcggctccactcactgggtttatgatggcgtgggaaacaggtgagccgcagtcttcctcctgtgtcttaataattcaaagcaccaagactcctagagaggagtcccgctgccgccatgttgccgggtcgcctcgttcccaaggaat

SEQ ID NO: 47573 - DNA, 1592 bp, Bovine  19866880475297
acaactactttataattggatacttccactctattccaatgcctcacttttgattaattacagattatacacttaagcaataagtactaattattggggcttcttttgtagctcagctggtaaagaatctgactacaacacgcgagacctgggttcaatccctgggttgggaagatcccctgaagaagggaaaggctttagtgttctggcctggagaattccatggacagtccatggggtcgcaaagtgtcggacatgactgagcgactttcacacactaattattagcaacaagtactaatttaatttttatgagtgaatgtcaaagaaaaagacagacaagatgaaactgatgcttaccactatgcaaagatcaaatgatattataggaagggatatttcaagtaatttgaatacaggaaagtggtggaccaatatgagtttccatctgagacttggcaaatttaaaagaatctatacggtagctggcaataatctaaatgcctctcacctaggagacatttaatttcagtaaaataatttaatgctaatttgaattttattggacaatagaagctatggaataatgaaatagaggtctgataaggaaattagggagtttgccttgcacagtcagatataaatttcatcttttctaatgttgcttgctaatgcttttggtacaagtagattgtctaagagagtaataaaaggtgctgaggttgtgtaaagatcaaagaggataaaaataaagaccattatgagggataactggaaatatagtttacacttaacgaatgcttatcaaatatgcagaacaatcaggcttccactgggcaggcaggggttagagggtggtgttgggtgggtcggtgtccctgactgggcaaacatttgtaagaagtaaacatctttcaatggtaaagctgcttgtcagctgtgagtccttccagggaaccggatgtggctccccaccctctgtgccagcaactggcaaaggtgaaggcaaggctaacgtttctctcaaaataaaatattaaaaagtacacagaatttgagaccaagatatagttatcattcatcatagtgaagacaaatccaatagtgaaacaatttggggtcaagaggttaaagtcctacaataaaccactgctgataaattggaaaaatgtgtgtctatatattcatatatataggggtaaggaaagatgcttccataaccagcattttccaaagagagaactcaaagggagatgtacagcaatggggtcatttaagaattctgttttcatcttggtccttcaccttctggaaggggccctgagtgattcactcattcagctgaataataatggctatgaaggcattgtcattgcaattgaccctaatgtaccagaagatgaaacactcatccaacatataaaggtaagtctgaaatggtaactattcatgctgttttgaaaaattaagcataatatgttgatagagcaaacatgagttctctaattccagctgtgtgacactggaaagtttttttttaatatctgtgcttgcatttcttcagctataaaaggaaataataacacaacaat

SEQ ID NO: 47574 - DNA, 1365 bp, Bovine  19866880561490
acaagactctagctctttcacaggtgttgccttgaaaagtccttggcctgaattcttacatttctaaaaataaatgttaattattataaaaataattcatgcttattgcaaaaaacaatgtagaaatatggaaaatgaaaacattacctttcattattcctcagtggtgtgtacatagacacacacacacaccagtacacatgtagtacttttatagtgatcattacatatatatatagacatatatatatatatatattcacacatttatgaaagtgaaagccactcaatcgtgtctgactgtctgccaccccatggactatacagtccatggaattctcctgtccagaatactagtgggtagccgttcccttctccaggggatcttcccgacccaggtctcccacattgcaggtggattttttaccagctgagccacgaaggaagcccatacacttataggattatattaaatctattgttccaaaatcagctttaaagaaattaaccagatagatactcaacttctaagaacaagtctccagacaacttctaagagcaattcttgagacaatgtattatctttcttcctaaaaacaatgttgtatataaaactgtgttctctagatggttattggaatagatatttatttttgtttccaacttaaaataatgtgttttataaatagtaattgaaatggtcagggtacaatatgaaatataacttcagcagaaaaattgttttgttgatctgattggttatgggaataaaaggaaaagggatcaacctacagaaagttgttcacaaaaggctataccatttcacagtacagctctaaatgatatgtaaatgctcttaaaatttctttgaatatttaaattacattttacagtgtacctaatgtcagaattttaccgttttgacttctgagaaaattttaatctggaaaatgggtacgtcaaatgacagtaatgaagttccatggaaatctgttaagtttttaaaatgtacacatttttgaaagtgacagatattggtgttgacatttaattgtgaattcattctaaactccatctaaaggcatatgtttttaaaaatctgtttttaaattgggatataaaccacacaggaaaaatgcacatatcttaaatgtacagttcaatgtgttttaacaaatgtagatattagtatcaccaatatcacagccaagatacatggtatcacaaggcatttcttttaatttaggcaaatgtcatagtaactgactggtatggggcacatggtgatgatccgtacaccttgcaatacagaggatgggaaaagagggaaaatatattcattttacatctaaatttctactaaat

SEQ ID NO: 47575 - DNA, 4160 bp, Bovine  19866880659414
tgggcaaggaaaattaaaactcactcacagtgctctgaaagaaagatggccaacagaacagaaacaggagatgcctactgcagtagaaccaatggaagaaacaagagaattttaatgaaaatagaatggaattacagtgcaaaatacaaaaaaaacatccaaaatttttaggaactaaaactcaagacttcttattttttttttttttttggttttcttcttccaattttattttatttttaaactttacaattcagtatccaacagcaaaagagaatgactgcccctgagaaccatataagcggttagaaacatcagatggaagaaatgcctcacaacagtcctgtaacagataccctgagggaaaaggcaagtggtgtggaggtcagatccagcagacaaaataaggaagaggggaggaatatgtagagaggtaataatcacacaaataatggaaggaaacatttagaatttaagagtcatgagatcctgaatatcaaggataaacagaaaatcctgccagcctattagtactgtgggaacaagggctttctttccccatctgggatgatgagaagctggaagcagacaccacttggggattcccagggactgactgtgagcccccctgacactgagtttggttcacatgccagaaaaatccaatgtctgtgcttaatgtttcacatggaaacgttaagcagggagattgctgaagttctagttctggtaaatttcctttgttattctgtgccagtacatccaagtaccaaccttagggtcttttccttccatagtctagccaaaatatggcggggaccaacttttaaataccatatgcacaaatttctttgataaaattaaaaatgtttaaaagagaaagtattcacagatgaagtaatgcatgattgttacaagaaaccattacctttacttatgaaatatacatgaagatagtatggtcatagccaagagaagagattctggatacctgctacttactagctgtgtgaccttgagtgagttgcttttctgtgttttggtttcctgaaaagtaaatgtaattaatagcacctatctcattagataaagggaaaatgaattaatacaagtatcagagtcagaactttggcatagattagtgctcaataaattagcaaccccatggactgcagcctaccaggctcctccgtccatgggattttccaggcaagagtactggagtagggtgccattaccttctccgatagcaatgatgccactgggctaatgctgctgtcactgcttacaacaggaaaaaagtattgtacagagattctggagtcagaagactcgagttcaaataccaactttaaaactcaaagagttttataccacagccacaggagtaattcctcttatacttttcatatttaaaacaggaatatgaatatctccctcttttaatatccatctacctatccacaaacatcaactaagtgtctatataccaggtcttgtgttgtagctgaaagagaaataagaaaacgtcaataagatacagttctgttctttaagagttcaaagtctagtgaaaaatactcaaaaacctttcgttttctttcttgagagtattttttttttctttcatgagagtatttcttaaggctgcctttgcttaaggagatgaagaaagaatcacaagggtcaagcatgtaacacaagtactatgatttaaaattaaaaggcaacactaatattgttagcaattgttaggcaaaaaatgtggccagtttctgaaattagtgtatttttgaaaaatactatgaagcaatttgggtcactgggaagtaagcccctgcagatgataacagcagtcttaggagtgaggggatcagagaaaagcaggccctcatttctggttagagaaatagataaaacatcttggagagactgagctcagttcataggctggactgtgtagtacacaacttgctgctttgaatgatcatttgagacctgagtatcctttaaataaacacctctcaagtcattctctgagaggagtcactattacttgattctttgtcaattatatctgtccccttgtagagtatcctgacttgacacatagggtaggagattagagagaacatctttcttggtgtctcttctactccattccaataacaaagatctcacactaaagcttcttggtattaaaagtgtttattttgatcatcccatgtgagttggccatgggaaggggtaggaaaaatcactcctctttaatctctcagttaactcaggggtttcagaatgtctacactaataatatcaatcactaacataagatgaacaaaaagagactataaattcacaggagagactaaagacctattctttataaagaatgcatgccaccgtgttttcatctgtcactgtcagctggcatttaataaagccatgacttaaaattctatatttaaaacctgacagaaattataatggcattttagcatatatttgaaacaatattaagtacactgagacatttggcaactttagaaagtatgcaattatatcattattaaaaataatattcagagtattttccttttattatattaatatatacacatatagcactatataatgtaaaacaattacatacattatttaaaatcatgtatttggcttataattggccaaggtttattacaagttcatttgaatggtggctatagtcacaaagaatgattctagcttcttttctgtgtataaaatattctagaaaccaaaataaattaaatagatattaatccagagttaagtgaagactatccagcaaaaaaggaatactaacatgtatcttgttttaaaatttcaattggataataaattatgtttcaaaaatctttacataaaagcttaatagcaccactcataaatcataaagtatagcaacagataacatatttatttaatttttacctaattactttttactcatagtaaaaatctattgtttatagaaagtaaagccaaaaatttatccaaacattgttacataagaggttttaagaaactgtaaataattcttaatactctcattttgattctctgacttttcaagactatgttgtatttctttcaaacatacttcctgatgttgtgctttctaaataaaaaaaagaaataaaaatagttaataatgacattaatatcaaaggatagtcataatataaaaatttatatacacaataattgaatacatggtttttaattttttaaaagaaaaaactttagaactcacttttctttaaaatctagaatagagcacacacatggttgatctctgtgacagtttgttgtaatacacacccactttgccccaaattattatatattttatatgattaacttaaatagattttacttaaaactgtcacaatttctattacatttaacatggcatattttaatactagtttttgtcattttctttgcctaaaaggctgactacttttgctatcttaaaatagcaaaactatttttgctgtctataaactagacagaattctagttttgataatatgaacattttatttttggaatcttttaaaaacaaaatgaactcaatatcatatgtggtctttgaggaaaacatttaaaatgtaatgtatttttaaaatattcagttgtgtgtaaattcccaaatagatctgttcactgaaaatattttagatagacaggctacaaatatcacctaccttccaactaaaatgtaggaaccatgagaagaaaaatcttttatatccttcctaccaggtgttcaatgacaccagataccttctgaaactgagcaatgcccccaaggaaagtatagtgggtggtataaaacaactcgccaggctgaagtctacaaagtcatagaatgactataatggatctttgagaaacattgattttactcaacaccttggagggaaaaatattaatacaaatacacataaggtagaatgcaaaatgaacatagattttaaaatgtaagtatataatatattccaaagacatttcaggcttcttgatctagagtaggccgctgagggtcacccttgggtctgcgtatctattccctctctctccccctgaagcactgggcagaaaatctgtagagg

SEQ ID NO: 47576 - DNA, 1044 bp, Bovine  19866880687130
taagtcatatattctcttagcaccattaatatgcttagttatgtgcttgtgactattagagattaattaaaaattatataccaagatttttaacctgtgtagaactttccatatcttttgtttattagcatactgaggataccctaatttggaaccaacagcttctttaaaaatgttgaggtgaactcttaatgcatctagctgcatacagaaccaaagaagcagaaaaatatttaatgccattatatgcttggtgtctgattttcctgagtgccacagaatgggatatcatagtcattgtactcaagtaggattttccatacccctactcccacacaacttcatctgagcaaacatttcctacagtgggtggagagaaaataaaaagtcctgtttaaattcccctagcgctgtgattacagatcctttgatttaaaaatgaagctgtctcctcttttctgcacactattttctatgtccatttttatcctaatctctcccaggcctagttgacctaagatcacctgtaataatgctctgattatatttgtaggcaattagaaacgctcacttccaaatagatggatctgaaatagtgctgctgactgatggggaggatagcactgcaaagtcttgtattgagaaagtgaaacaaagtggagccatcattcattttattgctcttggaccagatgctgctcaagcagtcaaagagatgagcattgcaacaggtaaaatatgacatacatcctttgatagcaatatataaatgtagaggctgacaattcaacaagttctcttaagctcctactctgcaggtgctgtgccaggagctcgggatcagagttaaaccagaaatgatctcaaggtgccaacagtcccgagagacaaaaaacactgctaatcagaaaagcatagtcagataacactcctccataacaagagacatacataggtgccaaacaccatgtgagcagatggagtcattgattctctcagcttgaatagagtcagggaaacaaggcatagagatgaggagctaga

SEQ ID NO: 47577 - DNA, 715 bp, Bovine  19866880834706
taccctgacaagtggtactatggtacaactactaaattatagcaacaataagggttatgcagccagataatccagggtaatcttcccatctcaaaatccttaattatatttgggaagtctgtcttggccatgtaaggcaatattcacaggttctagggataagggcatgctgactttgaggggaagggatgttattcagcctaacataccccttgtctgaaaatttgctaaaactgaaatctatttactactatctctaaacagaccatcaaaggatggagattccaaagacctacttttgttatgactagcaactataaacctaggtttctaaagaagtttattttcaaaaagagctgtttgggggaacatctgagaacatacttcctgtttttagactaatagatatagtcttcaaaaatcctgaggttcagatttgaattaaattttatcatgttcgttttgtgtgttgttgaatttctaagttattgtgtgcttctgcgttcttttgaattaatttatttttggtggccctaggtctccattgctgcgagccagctttctctggttgcagtgagtgaggactactctctagtttcagcgcttctcatggctgtggcttctcttgtttgggagcacaggctccagggtgcacaggcttcagaagttgcgtgcttggcttcagcagttgtggtgcacaggcttagttgccaca

SEQ ID NO: 47578 - DNA, 4568 bp, Bovine  19866880967642
ttttattgtttctttatccggcttaaattttgacatcagataaataaaatggttccagggaataaatataaaagcctattgagcatattgagcataagacagcaggatctgtttttcaggccagcccaagtgtatttttggagtatatacaaagtgaaaggtgtggccagagataagcatcagagtctgaaaagttgtttggatccattccagtaggcagaacaagagaatttctctagtattgtctgaggtggacttgaactaaaatcctttaaaagaacttttgcttcataaatatcatgcaagattgctatgtcaagatactaatgagttgtcaaacatgaggctcttaaaaaaaatttaccttggaaacaacgaagagaaggaatatgattttactggtagatcaaacattgggtctgccaacataaactttgaggtctattgtaattctgagaatttagattaggaaaagaacagaacaggaaagataaaacaataaaggagtttgtttttaaaagttaacacaagttagtcagaagaagcccagctgctgctctttgcccagcttgatgctgtgctatgaggtatgatgatgaaattcttaactctatgcagaatgagtgctttgaggcagagtttggttttatttgctttgtttttccagtgatggaaaaatctctatcctgattccactaggcttactggcctggtcttcttgtgatcaaataacacatgtaaaacgcactggctattttctctcatcaactgagctagttaactaaagaatagtctatgacatctcatgactcacaagttcaagcatctccctttttgggttttcatttactacttaattgtctaatccaattatttcagtgcatagtaaaactggtgaatctgagaggaatgtgggcatgcctattcccaagtgactttactgaatgtgctcagtgtcacaggacaaggggaagccaagacctgaatggtgggagactttctccctcagtgctgctcacacacagccactctcaggagcctcaagaggactttcttttcccaagttcactttttgcttttgctgtgcagatggaaacctgtagctacttggtatgtcaatgactatgacaatttgagaatctcataaggttaggggataaaaaatataaatttagagaattaaaaaaataacttcatattgatattgcagcatcagaacagctattaagaatgtgaaaaatgacatggaattccttgttacctgctccatcatcaaaaagtttcaacatcactggatctgcagtctctggttcaattgtagcaattacagtggcattgagaatgggataaaacccctttctcacaattgcataaatcatcaaaggatggggaaaatgggtgctgtctctttccacaaaggcttccacagtggcagggggcatggctgagcgggaggcgcgagaggtcactgtcactttcaaggcttgaggagagtggtgggtattgttcagtgtgtaagtccatagcccaggctgcaaaacaaagactttgtttgtcaagaagaaaatcaacccttattttaaagtgcaagcctaacctccaagggtttattgttcttgttttgttgatactgcattttctaaaatgatacaaaagaatgtcaggaagagtaatattggttacgagataaccaaattcagtatttacatgactttcactgtacaacccactttctctttagggaattacaccctgaatttgtttgtggggaaggacacaacttgattcacatttttagagaataataataagtgtcagcttcaaagtacttggcaaacattaatctgagctccttcacccgaaaggaggttcaatgtttttattccttttacataatggaaaaaattatagcaaatcaagtggacaattatggtttatgtggataacctggactaaaaggcaatagtaccttccttccctctacttccttcaaaattcccagacccagaaatctcaagcaacaaaatccacatgcactataagggatcaagaaaaggagtactattttttaatagatcaggatttcataatggtctatgttgaattatagaaatattgctagatgccattctctttatctgcctgggctgcctgagggaaacctgcaaaagaatatctagaagaaaaaacttaaactacaatgtagcagaaatttgttcttttgataaaattgtccataagtattcccttttttccccattcctgcctttgctccttcttaaaccctggaagtagcaggaggaacacagtggagcaggaggaagaggagagaacaatgggctaaggtttgactataatattaagatgcctgaatgccctacccagccttcttcattgggaaacaatgctttaccattttacagtgaagtcacaattcaaacaacaatattatctatctctttttttctgtttttaatttttttttggcttttgtactcataacattagtaacaggcacatggtggaaactccacatggaaaacttctctgtgggcataataagtgttttaatacagggcacctaatccagacaaaggggtcaggcaaaagcagcaagaagtaggtaaagtgttctggtccttgtgtacaggtgtgaaaagaacatgatgagtgtggagaaaagtaggggcggagcataaggtatttgggagaaaggttaggagataagcttggggtcagggagtgggaggtacaaatagtatataagagaggctcagtgatatattgtgcaacctggggaatatagccaatctcttgtaataactgtaaatggaaagtagcctttaaaattatattaaaaattttaaattaaaaaataattttaaaaaagagataagcttaggcagaagccagaaagtaaaaggcttgtgtattttattctgagaccatcaaaaagttttgagtaggacacagatttgataagatttgtgcttcagaatgatcactctaataaaggtgcttgaaaggaaggatgctggtgcagaggctggaagacctagcagaggctatcaacagtgacatgaaggggaggtgaaggccaacagacctgaagagggactgcatgcaggcaatgcaagagtggatctaacgaacttaccaccctgcttacaacctttagtggttccctttaactgttcctctcattgactcctgtatatccatctaaccccatcacaccctcctcttcttcccctaaatctccactttctatgctattctgtatttcatccacatcaaactagtacttatagttctatgaaaagccatattctttttctataagcctttctatgtgctgtttcctctgccgagaatgtcatttacacctctcgctcctcaagtcctccatatttccatctggatgtcttcactttcaggaagcattctccttcccctactgcctgcacatgccttcttgggttctgagtaccctgttcttattcctattatggcattttattgtaaagcacctagaacaagacctggcacataggaggtgttccaaaacatatgtactgcatgtgtttatattataaattctaagtagagggttttttttttttctaagtgtacagataagtattctatatagactttgtaaagaaggaagtaagcaaaaacttatttgcactgcataagtactaattttcactgttgaagtgagagaaggctttgatatccattttaaagttttgaacataccttagtcgttccttttaaattttgaacattcacaaaattccctcataaatttaaagtagaattttggtatatcagaattgatttcctttacacaatgcatttagctctgtgattcagtcgaaagtcatgtgcttgtaacgttgtcattatgaacaagcttacaacacttaccttagctgttcctggaatccagaggtgagcagtccgaaaaggtagattgatgataaaatcatccatgttgtattttcttccattaggatcaaataatataatctcagggggaccactggtctgccacataactagaaaggtagtgtcattgcccacacggtcatccacagtaacagtgtttttcagctgatgctgaggtttaacattttcacctgtactttcaagctgttcaaaagaatatataagtgacagtttccagcatatgcataatcattccatattttctttgtttttatgacaaaactgagttggcagaaataaaaaccatttgattctaacatgtcctaagtatataaattatttttcatataaaaatatttgcttcagcaaagtattataaaatactttgtatataaaatatacagtagatataaaatatttttgtagctagtacacgtgtcacttcattaatttttatcaagagattttaggtgttctcatatttgcctcttatccatatcaacattagcttcagagtagcagttaaaacaagcttctttttacttttgtttgggactacgttctaattaatttgtatataatttgtccagataccattatgtattttgataaga

SEQ ID NO: 47579 - DNA, 993 bp, Bovine  19866881060113
acccattcttggagccacgtgactgctttcttgaatcgaaatttggagaaacagaagttttggaacttttggataatggtgcaggtaaatcacaggtttctctgaacaagtctaaatgttcataactcaggatatgttatgagtccctgaggaagtgtggggcagagggacaggcatcagaaaattgatgcagattatggatgaacaactggaccagggtgaaattctatccaggtaacaactccaaagtgatttgcaagtgtcttacacgtggtagagcactcaatgaactttatttactgtcattactgttctttctttcatttagacaaccaatgtcttccaataaataggaaagtatcattgctgagattgaggacagcatcaagaattctgaataagtgtttcttagaggtatataaccaagaaagtctggccagagacagtgaaacacaagtagtagtatggaatgaagcagtacaatttgggtccctggcagggaggggatgccagccgtgagaaattcccaacagctggataaaaagttcacatataatcttagggactgagaccaaaggaagctggatctgccatcagagagaaggggacattactgggtcatcatcagataccagatctgactgggaggtatcaaaatagagtgttgactgctctctatctccttggtctgtatgggtgagtggtactgtactttaaaaccttttcccaactctgaattgttctgggaactaacacttctttagagaggtcatttagtaaagaaattactatctcagtaaacgtctaagttgtcagaattttcaattagcttcttttcaatgtagttaaatcagccagcttatcacctatcatcaactagagttggccctgtaagaagtttagaaggcaaaagtctttggtttatcaatgcctttatctaacatgacaatattttcttaaattatcccggactctctttctcccaaccccttc

SEQ ID NO: 47580 - DNA, 1595 bp, Bovine  19866881205469
actacttttaatgaaaaaattgaagaaaatatacaaaaagtgaaacattcaaaagcaaatatatagttctttattaacttattaataataaataacaaaatataaaacatacatatttttactcagattttctttgttatgcatttaagacaacttaaggatcaataatttgtgaataaaaatgcattttaatgggtaataatttttaattgtatttttagagtaagaaaagtttataaattataaatagcaaacatagcaaatcagacaatagctttaccatacgtaattcataggaaccatatataaactactcaaagaggaaagaactgaaaacatttcttataaaatagtaaaaagactcttttttttcttactttttcattgtttcgatctgaacttccaactcagttttctctattactattttctcataatgacttttccaggcattggaagctgaaactgtttcagacaacttggcttcctaaaaaatacataaagtactcatcttgtaatttaataacactagttttgttctaaaaacaaatacattattaacaaggaaacactcatcctataagttatggaacttttgttacagaaaatttcagtgtacaaatctgaatgcaggaaaactttaaagtaaattttaataatgactttataacactattactttatatgcatataataacagttctaacaacattttaaggatgttaacacacctattttaaaaaaatgtttcataattactgaagataattccctttatatttactgaattcttgtctttctctgacttctttcacttagaacatccttcaagtccagccatgttgttgcaaatggcaaaagttcatttttatggctgaggaatattcctgtgtgtgtatacactacatcttctctatacagtcatctgttaatggatacttagttgttttcactggagaaggcaatggcaccccactccagtattcctgcctggaaaatcccattgatggaggagcctggtaggctgcagtccatggggtcactaagagtcggacacgactgagagatttcactttaacttttcactttcacgcactggagaaggaaatggcaacccactccagtgttcttgcctggagaatcccagggacgtgggagcctggtgggctgccgtctatggggtcgcacagagtcggacacgactgaagcgacttagcagcagcagcagcagttgttttcatatcttggttatcataaataatgttgttatgaactttaggctacatatctttttaaattagctttttgggttttggggcctttttggataaatatacaggaatgaaacttctgggtcatatgatagttctatgtcaagctattctgtatagatcactctactgactctcaacaaataactgtcaaatgaatctactctttacaaattcacctaaagagctgtagccattgtacccctctctaaagaaagacaaattcactagaatgacaagggtgccaataattactaatcagaagacttagaagtagtgatatgagcagtttacatttattgggtgcttccttctttcctacca

SEQ ID NO: 47581 - DNA, 1409 bp, Bovine  19866881238814
tggtctacattcttgggaatgaaaaaatagttatctggagtctggctcctggaaaaaacaaaagtattattatttcctatgtcactgtttagtagataattttcaactaagtcaatcacaactcgtgctagttttcatagtatattacaccaaccatttcatgaatagttaggagaaaacattagaagactaactaaacatagccaatttggtattttcattttatgactgagtagacccaagcatccacctcataagcagatataactaaaacatctaaatcatcaacttataacttcctaaaatataatattcattatttaatactatcaaaatctatcatagtgtttatcttaaaaatgaaaaattcataatagaaagaaaacaagtaaatgatatttgtaactttcattaagcatctgtcatgtaaaaataatatgcagagaaagggcctgatgagactttgggagaaatgtaatagaagctaccaaggatacaggataataattccttggccaaatgctgacatttttatttttatgatttatattatttgttacttttagtactattagtaaagtaatagccttgattcccttcactttgtatgttaactgtttaactaaaactccatgctaagaatgttaaatgctcacttatttttaatgaaaatacattaagccatactaatacttacgctgttcattttgcaaacaagttgattttgttcttcatttttctttctaagctcattttccagatctactattttgacttgtaaagccctttctctagatgacattttctctatttcttcagaaacctgtaattttaattgaaagaataaaagagctaaatgtgctttctttaagatataatttaaagccttgacataattatactgtatctcttctttccaaatagatattatttggatattagacaacttaactacaaagtgtttaagggtgttctatcttgagaaacacatatagcataagcatgcattctcctgtttggtatggaagtatctgaaaaagtagcttgaagtggaagacgtgtatatattaccacagatgtgacgtaggcaggttttccccaatactatatttccacaatctgctgagattaactgccatgtttttacagtatttatcatggcatccaaagtggtggtgggacatagaaagttcacaatcgatgctgattatagacttggatggagagaattgggggcagggtagatgatattcacaccacacacacacacacacacacacacacactagattggtttttcattcattcacttccaaaatggtctgaatttgagttttcgtatttctctgatggtttatttcagcagaaagtctagcttagccaatgttatccaagggattcagatacat

SEQ ID NO: 47582 - DNA, 810 bp, Bovine  19866881714695
tctggttctgaaatctactactaaccgatggggaagataatgaaatacactcatgcattgaggaggtaaaacaaagtggtgtgatcattcacaccattgccctgggaccttctgctgccaaagaactggagacactgtcagatatgacaggtaaacctttggaatagagtttaaatagaaaataccttttcagtttctctcattccagggactctttccccttaaactataaactgctcaaaattttcctgtcctaaaaaattcatctctacacatgtatacctgtggctgattcattttgatatttggcaaaactaatacaattatgtaaagtttaaaaataaaataaaattaaaaaataaaaattcatctctgtcctttccttctcttcatccttcaaattaatatctttcctcaccccatttcacttctctctgtttctacctatactagcttcttctaacattagtccatatgtgttgtcttcactcatttctcatcactttttaccaccaagatggacctttgctctcatggttactggacttactcaactgcagttccaaaattcttactcagtatcttacctgctcaatattacagtagagattcagctagcactattttattgaggagtaaatgtaaaatctagagaatacaaattatttacccaaggcaatatagtaagactgggcttccctggtagctcagctggtaaagaatccacaatccacctgcaatgcaggagacttgggtttgattcctgtttcaggaaaatccctggagaagggataggctacccactccact

SEQ ID NO: 47583 - DNA, 1475 bp, Bovine  19866882127987
ttttttttattttataatattaaccttttaggtcctgaattctgtaatgaaaaaagccataaccaagaagctccgactctacaaaacaaaatgtgcaattatagaagcacatgggaggtgatcagcaattctgaggattttaaaaacacaacggctatgttggcaccaccccctccacctgtcttctccttgctaaagttcagtgaaagaattgtgtgcttagttctcgataagtctggaagcatggcggtgagttcacgggcccatttttcctggaagtagggacagggcagtgattgaatgtctaagaagattctgactgctacctgcacctgggttcttctaaaatgcatggtggcctaagtactgtcacctcctgtgatcttgacctcaagaggggcaatgaacattataatgaaagaaggatggtaataagagttagaaggacctaatccaagaattttctttcccagaaaatggagagtttattgaggagaacttttaagtctttagtaaagcttttgtttcaggatcagaactggagattgaaatgtgtaattatttcctaatcttactccctttatctattgaaaatacttgacaggcatgaagaaagagtgaattcagagcttccaaactacattccaaatcaaggaacaagatcaaccaggaggattcttaacatgtgtctcttatttatactctctataggaatgacctccttatgctcaaatacatagacaaaaagcatcactatcaagaagagatggccagattcagtcattcattccttctaccacattaagagaatggtactaggcttgtactaggctttaggaatagagatccatatccttgaaaagttcatagatgaataaagaaagatttcactctcttccccatcatgaattaatacttaattatatttcaatatttggcgtaggtatccactttgtccaggacatgggctggttttccaggatggcctaagggcatttctgtagttctttcacagtgacctgggtgtgtgtttagtcactcagtcatgtccaactctttgtgaccccatgaactgtaggctcctctgtccatgggcttttccaggcaagaatactggagtgccattttctcctccaggggatcttcttgatccagggattgaacccatgtctcctgtgtctcatgcatttcaggcaaattctttacctgttgagtcatcagggttccccttattactatatattatattgaaattacacatttttctcccactattctatgaatacctctcggacttgaaaccatcttatctaggaaccaggtctcctaggacttggaagtagtctgtcctcatctttgtgtccttttgtctagaatatggtttatcacatgtaggcattcaataaataattgttgaaatgaatggactataaatgagcagatggaatggggtcaaaaggatggcacatctgagg

SEQ ID NO: 47584 - DNA, 928 bp, Bovine  19866881359871
cacctcacactgtaattctcccttctcaacacagactacacacacacacacacacacacacacacacgagtataaaagggctgcagtgtagtttgacgatgctctttgaagtcctgggccttaaatggcagcaacatcatatacacttctctttcaagtatggatgaacctatgagaaacaaagcatccagtacaatttatatatagaaatatgtttcctactatttacacaggtaggaaaacctcaggcaaggtagattgcattcatgtttcttacccatgtgtataccaactcttccacatggtaaaggctttttatgttgttcattctaactcaaaaagtcgttttgtaaggattgactccaaggaaaaacaaatacccaagaacatttttccatttgttttcctacaaaggtttctgagccctctgccacactctgggattcccaagtccagctgaactaaacacatctcccactacaagtcctggatggaacaatctgatctcatttgtaggacaaagtccggctagctaccagggtccctctttcctaggccagaggctacaagggaggagagtaaagtaaagtactttgcacctgggagcaaagtaaaacatagaggaaagtatacttgacaagtcttggggttcaggccatacctagaacctctactgaagggactatatctgaacctgtgggctgctacaccaatatagctgactggaccactgatgaacacctaatgctagaaagagagacttttcctgagctggaccaagctaatcataagccatcaggaggttaaaattagacatatggatgaaaggtccaagttagtctggacatccagagtgaccaatgcttcagatgactaagaagaggtagccaattaaggggagtataggtatgaagggggaaagagcaga

SEQ ID NO: 47585 - DNA, 778 bp, Bovine  19866880181412
ctttcacttttcactttcatgcattggaaaaggaaatggcaacccactccagtgttcttgcctggagaatcccaggcatgggggagcctggtgggctgccgtctctggggtggcacagagtcggacacgactgaagcgacgcagcagcagcagcagcagcagcagataaatgtatagataaatatctatatgaccacatgagtttatacagaaaacaaaatcaaagggactgagaaagtttaggtagtgagagttttaggcccagtaaatgagtgacagaagcagttttattgaataaaaaacctattaggttccatatggcaggtcttgttttaattattctaagtgtgagatgaatatgaggcttttattaaagatttttaacaagaaaattgagataatttcaacataaaccccaagcctgtttgtggcaaatgtttcctgggttaacttaatttgtagaaagcttgtttaatttctcatattctgacccacatctgtcaatcaaagtaaatactctttaacaccaggcactgaaaagtgagacaaagtcttatttattgggtgtagttgtgaagatagatcagtggcactattgattcattaatttaataaccaattattgattttctgccatgtgcaggatgctgtgataggaaactattattcagaagtgaagcagcacatacattttagagagggaagcatgcaatcaataagtacacaaggaaataagtttataaataacatgcacagtactatgaaggaaataaacaca

SEQ ID NO: 47586 - DNA, 1319 bp, Bovine  19866881048745
attttcttgagatttcatctttcagtagagaaagacccagtcaaaaaaagtagtttaaaggagtatgtgtgtgtgtgtgtgtgtgtgtgtgtaaatggagggagagggcgaaggatagtagtagtacaaatctatttgtacgtttgaggtcatgcttagtcaagtacatgattacacctttgtggcaccccagataaaatccatctggtatctatcaagctatcttgttcttagagataaaataaccctgctgtctctataaagtaagcatcctgagaatcaatttgatgtctttttctctattatgtaatacaatgtccgtcatataataggtgctcaataaatatttgttgaatgagcagctacttgaaggcagtagctcttgctgcttaataatttaggttctggatttatagaaacgtgcgttcaaactccagtttcctcatttgctatctctgtaattttaggcaacttttagatgtttatctgtgcctcagaatcctatgtttaatataaatattgtatagtagtatagtagctctacctcactggtgttttctggaattatgtgacatagcgtgttaggatataagcacatgtcctgacttgttaggtaggtgctctaattatgtaaatagacgtcgattatcctattttgtaaacggatgctgcatttcagacttctcccataaagagcttatactctgtccagatactattgatttgagttaaatgtttaacctcatttttaaccattattaccttgaacgaggtatggtgaggccaaaacatcaatggagagaagccagaaggggctttatcatttgttgggctcacagttccttgggcaggacacggcacacagaactagggtcagtcaccaggcagaggcagagaggagacctgtgggcaagtgactttattgtggtttcagagggaaagaatgcatgaggcagggcaaacagacttagatttggctgatttgagcaatgtcagccgactcgggggcatgggggctgttactgactgcctggcacctgaccctggggcagctagagcaggtgtatattggccccagagtgtgagagctgataatggaggttaactgactgctcgagaagcagaagtggccagcctctagccagtgcttcaaaactgggtcaagaaagcatttaaaaaacctatatcacattgcatagagtcaagtgttagcaggaattgaggctgaggtttccactaggtaggagaaatcatcgtgtgctcattgtaaatactgagtactgcagatgccctcccccagttcaaagctctagcagcct

SEQ ID NO: 47587 - DNA, 669 bp, Bovine  19866881187140
tacacatagtttgtgtacaggatcagcacatatacacacctaaggctcttattgtctatctagaatttgcttaatgttattggcccttgtgagctctctgaacacatttcaatgcagctgagtaatttaatccatataaggaattgagaatggataacaactgacattttttaagaaacaggagaaaatgaattctgagagatgataaggcagctgtgcctaagatgtccaagtagctttcccatgtaacattggcagtaatgaatggtacataataccagttctagatgaaggactgctcagcacattcaaaagaacagaaaagtcagagaagcctggaaatgtttagcatcactacatgtcataaaagcaagatgatagaagaaagagcgtacagagtatatcaccattgcccattttatttatttgcttttatctttacttttaaacgacaatcttagtcctgaaaggcatctagtaaaatcatgttttctattattttgtcttaagataagatttcacctaaatataatctctttattttattcttgtatataaagagcaaaaaacattcacatgctttcattccttctgtctgtgtttaatatttgcatcttgtctagattatttttcagtggttttcatagtgggacaaggattcctgcgtat

SEQ ID NO: 47588 - DNA, 2028 bp, Bovine  19866881295675
acttcagtcgtgtctgactctctgcaacccccatggactgtatccctgccaggctcctctgtccatggcattctccaggcaagaatactgggagtgggttgtcatgcccttctccagggtgtcttccttgacctacagatcaaacctatgtctcttaggtctcctgcatttgtagtcaggttctttatcaatagtgtcccctgggcatataggaaaaatgggcattaggaaaaataacactatcatatttgtatacattagaacacagataagacaagttgagcatttcctaaaggttttatagctaattaatgataaaggctaaatattaatcagaaagccagagtttggtgaagtatttggtttttatttcatactttttctcaaataactgtttcaaaatgcttgctaacactaactatgcttctgtgcttctcaacttgcagtttttattaatgatttgtgcatacaaataagctgatattggcagtatcacagaaatccacagctttgcaactttctactgtatattacattttaccttaattttataattttatttttacttatccttataatacatgctctactgtatatttctggaaaaccaattctaggaaaacaaaataaaacctaatgcttgatatatttcttttaagctgaaattagttatgcaaaggagcatacttggatgggtttaatgtgagacatcagtgccattagatggcactctgggtaaagttgacaatgttatttcttatactagagcatcacaatttaagggcttaagtaaggtaaatggaatacaaaattagtgaacatttatgtcaaagaataataactattacaatgacaaaggacacttttgctctttaaataatttaaggtttccttttaaattgttacacactattactcatcaaataaaaattaagacattacacaatgagcttttcctctttgaaaatggattcatggttaaattttaaattttaaaattattgattttgctttatggagctaaaatcaatgttatcaatcactttatagcattcctaatataatgtaatggtaaggtctaaaatgaatcggtttttttaagcttatacatgttttaaaacaatttccatgtataaatatggattttacaagcactgaaaatgccgttcatattttaagttttctttattaaaataagtagtttagaaatatactcaatacataaatattctttctttctaatcagattacaaatgttttgttataagttattccacttgttcaatccttttcatctagtcactaataggttaaaaagcttaggagggaaagttaagaagtagaagttatggtaacagcccttcagaaatgtgccatcttattaatgaaaggtgtctacacaaaacaggcaataatagaagtaaatgcacgtaatgttcctctaaggaactgttagagacccgataacaccacgatggtctggcatttatttattattttattgttaccaaaaggtagataaatatccttgattactgactgtattgcagatgctgtcactactactaatataggtaatacctactatttattaatagtaggtacaattaagtacacaccaattaaaaaacagaggcaactacattgattcttttccaaagctacatacttcctgtcctttgtttctcgctctgactgcaagggttttaaattaatactaaacaagaattgattttgcaaaaacaatgggagcttaaaagataccagagcaagttggcagagaagtatgggagaaaagaaatagcaattggactaaaatgcgtctaaactttctttggtgtcttatccatgacactccatttcattttaacagacaataacaagatggaaacattttttacagtttaacttttggggcaacctgactgagactgttgttcattgtgttagaaaaaacaacacgaagcagttttcttcatggaaagctgatctaaatcagatttcatttttcttttatatagtttttaa

SEQ ID NO: 47589 - DNA, 1452 bp, Bovine  19866881414721
aattggagctctgtgattaattccccttcattttgaagaggagaaatcagcctgaatcaccacatgaaatacaaacactaaaaggcaatgcattcagaagctgcaagtgctcagcaaaagatggagttaattaacttgaccagatactcaacgaagatagctaatgtgactaattcaggctctcaaaggaatatcaatttcttcagctagaaaactcactagctttcccatgagtgttgtagttatgccagaacgtaagagtatgtctacctccttattcttctcctttgctgttactcactctcccatttgcttgccaacatttaaaactaatgtttataactgccttaattccccataaactaaaaatgcaataagatactgcaaaatatagttctttctttagtgatgtcttgggtggagcagggttagatattctcagtcagccgtttatagccaaaattatgcaagccctttttggcactggattgaaggcatgatgaatggggggcgatggacaagcaaaacagaaaagcacttgttcccatatgaaggctctgctgttttagtcataaatagcctaactaaaattatagcacatattagggaaatgaagagtgaataagtaaaaaagtttggtttccatatttcattttttcaccattattatcatttatttgtttgtgaagtgatgacaggtacttggctttatttgagctattagagaagacagagttcctgccctcacaacttcctattcaaagtgcacaaattcaggaagcaagatgtggtttgatttatatagagatgaggtatttttccccccaaagtgtgacactttttctgctgatttttctctacttaaaggaaggaataatgaatggaaaaagaaaaaacagaaagaaagaaaaacgaagaaaagaaaaaaaaagacttctgaggatgagtggagaatcattagcagacattcatttaatttgactattataaagcaataaaaaacgttgcaatatcaaacatgcctaaatttgatgaagtgaaattcatattttaaggtaagatgagaaaaatttaaccataaaaatgttctctgtttctctgggcctcctcttttcccctttgtgtgtattatgcacgtgtatggtacatcaaccagacctcctcaaaggtagaaatatctgctaaaccataaagatcaacttttcctcttctggcaccagctatgtaacccttcaaaagttaacattacctatctatgaccttattaatgttaccagtgtattatttgtattctatttgttctacaaaattattgtttcttgcttttccaaacatgtgactcggcctccgacaaaaatgatgattagatgacttggaactatcgaccgaatgtatacttttatacctagaggaggaaatgcaacccactctggcattcttgccaggagaaac

SEQ ID NO: 47590 - DNA, 1262 bp, Bovine  19866881423940
tttaaatactacttatccatgaaaagaagtgttatatttgattgttgttgtttagtcactaagtcatgtctgtctcttctgagactccacaaaccttagtctgccagcctcctctgtccctgggattttctaggcaagaatactggagtgggttgccatttccttctgaagagaatcttcccaacccagggatcaaacccatgtctcctgcattgtcaggcagattctttactgctgagccactggtgaagcccattacatttgataggtgagtgcaaattatccagacttccctaaaaaatgaataataaaagaaaggcgatgcttctcatccctaaagtaggccttgtgtttacacactttctgtatcaaaatgaagtatggatcccagcaaatccactatactttattctcagtgccactgggcatttctcacagctgcctaagctgccttcagtaaattgttttttcctacaacacacatttctctctttcatactacaaaatacattatttatgtgtatgcctaattctgttattggaaaaagtaagttaatttttagagttattgattttattttgtcaaacatatgttgctcttttcttcttgtgactaaaacaaaaagaactatgaaagaaacaaacaaaatcgatatttctctattaactacgttacttaaaaatcacatttggttcagagaaatgcaggatatgagatagaatcacatggaaaccaaatgttttaggcttcttctcccaaccaactttccctaaccaccctcacctgcttctattaactaccatgcctgtgtgtttcaagtatacattttattgcatgtacttaatttattataattattagtgtacatgctattaatatttctgccatattgctagcttattaagggcattaaattgcacagctaaagttaaaaatatgctgtcctgagcataaaagaaaagtaatattgctctttgtattggggtgaatttttacattaaggagtaaaggggtaaattgttctagattcttctttagaattgaatcacactgattttctgcatgaactgggttcctctctttaacctccgtgtggaaagctttggaaggaaaacagaggaaaaaaatatgtagaaaacacaacatactcagggtctgatctgtgccaaggaatacatcacaaaaggctaacagtaatattaatgatataacctccttgttattggggtgactacctttgacatgtgttataagttatatt

SEQ ID NO: 47591 - DNA, 1118 bp, Bovine  19866880364978
ctagatattagaatcgggtgaactgaaaaaaaaaattctgaagcctgtcccaagctaattgcctcagactctctggcactggagcccaggcatctggattttttaaggagttcctttggccaaccagagtgagaaccactatcataaagcaagaatatacccatgaaatgatgggctggctggattaacaggcgagatgggtcacagagggccttgggtttcatctgatgagcctctcaaggactgatgtggaggccttgggtttctcaaggccacaaccccaagatgtggcatcttgggtttctcagcatcgctgtagtgaatgattggagggcagggacaacactgggcacccaggtggctccagcagatcaggcagaaaagggcaagcgtctgaactgaggcagcttcctgggggatggacagaagtgggtgggcgcaagaagttaaggactaaccggagagtgactggctgtgtgagaaggggaaggaggagaccaggatggtcttgctttccaattcaggagaaggtggcgatttgctgaggagggtgagggtcaggaggaggagcaggttttcaagggtgtaggcaatggatatgtgggtgggatgggttgaagcatcaagctgagagcactcaggatatttagttcttaggtgtctcctgctgtggggcgagtctggggggcaggaggaccgtgggcatgcatgcacatactctcccatggtacgtactccttgcacccctcttcagtttcgtctgttttcttcctctggtcagttgcacaggtgcttccggctacacatagagagtttaaagaaactgggtaaacaggcccagggctgcaaaatggtgactttgtggctggcagccctgcagccctgtggccccgaacacatgactgagccagtcaccttctgggttcgggtcaagatggatgctgccagagccggagacaaggagctacagctgaagtgagttggtggggaagggggatgacccagtctcctggccacagctgcttttggcactcaaggtcacgttcattctcgtggctgagaaaggcactgttccctccgttcactgtgattgattgagtgccaagtgtgagcaggca

SEQ ID NO: 47592 - DNA, 1217 bp, Bovine  19866880448884
tgccctaaagcttgactgcgtttatggctcctaaggagccttcataaggcccttggctaattttcttccccctttagtcaagtgtcttcaagttaaggatcaggctggcactgcacatgtgtgctgcctcactgcctgaccttgagggaagttggagtccctgctggtcttccctgggtaggaagtctaatttatggagcgggtcttaatttcttagtccccgtgtctaagtaagtccttatttcattctcgtcagtgggaagttagtcctggggacctgagaggcatgggcagaaccttagtggagcagcagtgagctgcggaagggacgcgacaggaccgcccccacccgtacagccctcttgttggttttcggtctcactgagaaagcagagcaattgctagagctgaagcccctcctgtagtcaaggagaatgacacttaccttgtgactgcagccagctgtgtggccgctcaccccgctccttgccttccagacccatctgaaccagaacaaacatcatggagggtgtcacttactccttctgaaggaccatggcctttctatgggcctaagggaggacacattctgaaagcggctgggaatgggcttccctggtggctcagatggtaaagaatctgcttgcaatgcaggagacccgatttccatccctgggccaagaagatcccctggagaagggaatgactacccattccagtattcttgcctggaaacttccatggacagaggagcctggcaggttgtagtccgtggggttgtaaacagttggacacaactgagccactaacactttgacttctaagggaagacagtttctgaaaggggaagagtgatgccttgggactttcctaagtgaacacaggactcagtcctcccactcaccccaaggacacagctgttagagatgcaaggccatagaggaggggccagaaccacgtcttctggttcacagactttcagccacatcgtcttaaagcttgtttagagttgaaaagtctgagaaagcctcccactctattaggaaggactagaaggagtaggacctcctttgcttcatttttccctgttggttgtatgtcccaaatctggcttcctttggcctctgctctcctccttggccctgagccctagactctacactcttggggcagtaaggaggagatagcctaactaactgcattttgctgccttccca

SEQ ID NO: 47593 - DNA, 622 bp, Bovine  19866880467354
ctccctctccagccgcagcccatagagggctgccgtgggcagtgctagcttctcctcacaggcggggcacgagcacagcggaggcagccccgggtcttccaggatcaccacctcccggtagcctggggggcggtagccaaagtctccattggcgggtttccccagctcagacgggtaggggtacggcccctcggacagcgagcggcagaggcgtctcttctccacggagggctcagcataaccctgggggggcccctcataggctccgaaagccagccgccgcctctccagggtcccctctggcccggtagtagcctccattggggaccccgcagggttcccggtagccctggcggcaggagcagtggcggctgaggccaggcctgtgtcccgaatatattccgaggtgggggcctccgcctgcagcaggctggtcttcgtcatcaaggatggccgtctcgcgcccagctccccggcccccactagccactccacagcctcccagcaggcgctcgagctcctgccgctcggcagccgtcgggggtggccggccaggggactcggcagctggctctgtggtcagtgtggaggagtggccagagtcgctgctgacagaaagcag

SEQ ID NO: 47594 - DNA, 870 bp, Bovine  19866880469156
agaagaaactgaccccctcacaataccccttttctctgctccccaatctgccagtttggtttgacttccaaaccactgcagcccacagaccccagttactgggtgctggggaggggtggggcgggggcggggcaaggcaatccctaggggaggggccggcgcagggcgggtcttcctgggcttcgccccctgactgctgtcgttggctggggaccatagaggccagaagggcggagccacagtttccaagaccgatcgatggacaaacatccaccagagacaaagacacagacagacagacagacaaaccaagacaatgaggaaggcagagacagatggaattccagaccactccatctttccaggctatccaagagttttgtcccccacccccaccctccgccccgttagcttccctggccccatttgctgtcctggctgcctagtctcagtgctctagctctgggggaccagcccctgagcccctctaagaagggtaaggggaagagttgggaaagggctacccagcagggagagagttccgggggtgggtggcgcctgattctgtgtcaggatgcccggccaggggccagggagggagcggtgccctcgcccagttcatgaggacaggagactcattcactgtaaaccaagtacagatgtgctgggagggggagggggaatcagggccacattcacaaaccacagttgggccctccctcctcgccagcggccaccatcaccagggcaggaggggttaacttcgcagcctcctggcaggatccgtgccacacaggctgagtgccatcccaccccggcctggacgcctgggtccaacttcccaacacccgccccttccacactgctgag

SEQ ID NO: 47595 - DNA, 1364 bp, Bovine  19866880483706
tgggaagatcccatgaagcaggggaaaggctacccactccagtattctggcgtggagaattcggacacaactgagcgactttcaatcaatgtaattttttacattacattaaaggaaagtaacaatgtgatcatgtcaattgatgtagaaaagtcagttgaagaaattcaatagcttcttcaaaaagttactaaaaaaaaagaaattaaaagaaataaaactactattattatttatggcaaataagttttctttgccaaacattgacagcaaacatcattctaaatactaaagccattcccttgaaatcaaaataaaatagtattttggagagtctatcaaatacaccaggattttgtcattattattttttttgcctgctgggaaatgtttatttgccactaaatcacccaaagtgaaataaagcgaaagtgaaattgaagtcactcagtcgtgtccgactctttgcgaccccatgggctatagcctaccaggctcctctgtccatgggatttttcaggcaatagtactggagtggattgccatttccttctccaggtgatctccccaacccagggattgaacccaggtctcctgcattgtagacagacgctttaccgtctgagccagcattctacaattataagaaaggtacgggtcatttttcctttccataactcaatgttcacagcatctcctcaatcataagtattacaaaagaaagtaaaaaaaaaaaaatcacattttacagatcttagacttgtctttagtatttagctcaaatcttaccatcttcaaaaaacagttctgtcaaactcatcagctaaaagttctatccaagcagtgagaagatggcttttgttagcccgtggcaattcttttccgatttgtcctagctagttaatgctgaacagcagaatgaggcttagattgcaggggtggggggaaggggtagcaaagagttaatttcccccagtacaagatggcatctgaagcttgatgggagagctgaactggagagacttgagggaagggtccagggccctgtattcagtcagagtcactgctggaagaggaggaggaggaggaatgctgcaaggggaaaggggaaaggatacatcagatccaaatgacttttgttacttcatgggacattctttggtgccctatacctccaccccagtgccctctgctttctaagaaggtcaggagtcttcaactcgactgtcccttaaacagcaaaagcaaggatttccttcagcagtgagcatacaggaatggatgaaaccatcctaaatcattgcgcagaatttaacatactgcatttggagaaagtttccaattttctttacctgagccaatgc

SEQ ID NO: 47596 - DNA, 1355 bp, Bovine  19866880580757
ccccccccccaaccttggttctcctgcctgaaaggctggaggcctgtggcaaggcaaccctttaagtcctttctctctccctcctgtttaacagcagaatgtcaacgccaggctgcttgtctggctgtcttgggggttcagttgagaggccaggccatctgtctaagtcttgggctcccataatgagccctcgccactgtcttggactctgttttgcactcaggaaagggaggaagattccccatctctcttgagtgggggtgtaaggaatgtcttcccagggaaaggagccccaagacactcctgagagaataaaggactctaacccctcctggccaagggtcctggcgccagggttattctcagctggaaagaactgtagcttgtctgttgtgtcctcctgaggggggaatgctttcccctgagagccagggtaaaactggagatcacccctatctccaggcccccaggctcacacaggtccagcccctaaacctctagccagcaccactttcttccggtagagtgggtaccgaaagggctgggagggagcagtactacttaggaaaaaaggaaccagctttggatttggagagatcagaactagaaccttggttttgccacgaattagtttaaggaccataatccctctgagattcccacccctaccttatggggtagtgagggctaagtaagatgatgtagggaatgccatgagcacagtgccaggctcctggctttgtctttctggttggctggacaccaggtctttgtagattctggagtctggagaggccgtctcttctctctggtcagaagggagacttgggtctccaaccttctatttccccaggacacaacttgttttcaggtcccaggggaaccaggtcccaaaggcagtggtgtgctagaggccccccgtccttcctctgcaaatccttatgtcccacctcctctgaactgagggggaaggcctccttctctgcaccctgtcgtcaccccatggctctcgtggcccaggatcacccctcagccctaccgttaagatgtgaggggaaggggaggcaaacagcaaggtatggtggctcataggggtccctgctactcaggacttcaggtgagcctggaagaagttctgtgtatttttaacaaattgttcctgagccgggtgctattgaaaaagatatggaaggacagatagaaatgtataaccattgctaagtagatggaattgtgggtatttttattaagaaatttaaaaacctattttaagttgaaaaagaagaaatgaaaattacagaatgcctattattgatttctgtcacccagccttggacagtaagacagggagggaa

SEQ ID NO: 47597 - DNA, 2560 bp, Bovine  19866880600859
aggtagggatttcggaggccaaaatgcctctcttaacactactcagtatagtagcgtccctccttgaccccttgcaccggagcttctgagtcactactggagaggggtggcaggaatctacaataaaaaggactccctgggtggggatgtatgcacagagaggcttggcacctctgatgggctcagctcttgtaacaatttccaggcctctcaaatacctaagtgtttaacaagcacctgaggtgattcttatgcctggcacatcggtaaagaccagaaccaatgccttactaatttctcctctattccacattactgccttaatccaggcctcagtagctgtcacgtgacctaggacaactgccccttgaatggtctccaagttcttccaaagatccccccctccaccccattctccacccaccctttagaagggtctttctaaagcacaaattggccttttggagctccccttttcttcaaaccctctagtagcccctccttggtcctgtagcctcacctccatgctcttggcccctccccagcctcatcttccattgctgttcgtacccaggccctactgaactgagcctgttcccaaggttcatcaggtgtttgggccagggcacctaatgagaatggctcacacttatggaaagctgccgcccatattagcctctgttataggtccattagcttatttaatcctaaaatctcttaaattaggcgtctaagttactctcatttaacagaggtattagaggtcttaaataacctgtcctaagtacttcagctaggatgaggctccagctcagtgcccagtcgttttcagtctggaaggcgcttctcacataccatctgttgtcctccaagtttcacttcatcctggaagtgccccccctccccatgctctgagttaatgtccagtctgagctgtgcttcctgcatgatggctcccaccatcctggaggcacagtacagtcgggcgtcctttgagagcctgtactcctgagagtgacgacgccacacgggatcccagggcttccaacagcatccagagcgcatgaaggtgcccagttaggtgcaaccactgttctatgcatccgaggatcgtcctaaggaccacatgtactagctccctcactcctcagaactctccagggaaggaggtattattataggtctctttacactcttgagaaaaccgaggctcagaaagatgaaatcccagcctccggacccccaacatatcctgcgagataacggcggcttcaaggagtgagatgcacatagtaagacaaacgacaggccaagcaacgtgccaattcgctggagaacgtccgcgggaggacccgagggcttttgcctgtgcctcctcaagccggccgcccctttggggccgctgagaacgaaggctggggctcccggcactccgcccgggcgggtctgcggggagggctggcgggactggggcgctcagacagctagaagccagagtgagggcggttcgcagcggagaggaaggggttacggccccagcgccccctcccccttcccgacctccttcctggccgtcacgtggaaaggagctgggggcggggcgggggcccggccgtgagaggagggtgtccgggaggggacgcagcgggttgggggaagcgctgggcgctgcggcgtaaccatgacgactggacccgaggcggcgcgtgaagtcaccgggacaagattagcccggagtcacgtgagcggcgaccgcgggggtggggccgcgccagggccccgcccctgacctgggctggcccacgtgctggttgcgggctcgcaggcagggaccaccgaccagagccagccaccgcctctgcgtcccgtcttccccatgtccacccccgtccccgagtgcagcggagagagagctgtggtggtgaagagaggggacttgggtcggcattgggggtgcggtgccatagagaaagcaggaaatgggaaaacggggagactggacaggagaaagggcgaaaggcagaccagaaaaggagggcctgtctagctgagaaacagaagagcgtgaaacactgggagaggcagtcctaagaaggatgggctgaaaaactgatttgggaagcaaaggacacggaaaaaggagctgaatgaaaggggattgaaaaacaggagatctgtgccctccctgattcctttcgtatttagaagctgagttctgagtaggtacaacacctggctttgtaaaggaatttttcagctttcatctggtgtttggcaaccaggaggcttaggcatagagagggtgaccacgctccacgacacttgaagccgatcttccctccagctgcccaggcctccccaggggcccctcctgtatccagggccggcagctggggagagagagaagccatttcacctgtttgtcttttcgggcagtggaagaagctgaagaagtagtggatgggaccaaagaaaagggagagaacctagccaggctcaacccaccctttcctggttctcaggctaatgacagctcttccagattacctgaaggagtgag

SEQ ID NO: 47598 - DNA, 821 bp, Bovine  19866880631483
ccctaccccagccagagcacaatcgtagagctgggattgtttgctttggcaagagactccctgctgaaaggactaggcgttccagagactggtgaggcctctgttaggtttcccttatggagctgagaagaggacaaccccccagcctaaatcttttacctaaggaagtgagctgggaaacctggaggcttaaggcatctggcccattcttctccagctttgttcgcttctttccttcccaacattaccacagcataggatgttagttaacctcaaccttcctgcctttgaaggtgtttttggttcttgtactagtgttctgtccccaaagaagctacattttcacaaaatgcaagacaatcccaggactcctttctaaggagtccaacaggaaatagggattccgagatcattttctccaacctgttcctcttaggttgtattgcacatgactcttatagttgtagtcagtctttcccagaatgtccagaaatgtcccattttccttagatagcattgttgttgttcagtcgctcagtcatgtccaactctttgcaaccccaagaactgtagcccaccagacttctctgtccatgggttttcccaggtgatgatactggagtgggttgctatttctttctccaggggatcttccccatccagggataaaacttgtgtctccgtgtctcttgcactacaggcggattctttaccactgagccaccaaggatgcccaatgggtagcattgaaagaaatcttagctgctcagtcgtgtccaactctttgtgactctgggactgagcctgccaggcacctctgt

SEQ ID NO: 47599 - DNA, 2418 bp, Bovine  19866880638022
tgacacatgcctggggggtgggggagaccagaaatgctctctgcccctgggaaaggggggattgtgcacagaccccactttccgattctaagggctctccaccctctctctgccctcactgtccccgttccgaaatgctgactggtcctttctgtagaatttctgatccccaagttggctctggctccccatggagtgactcaggggtggctgaggctgggtgactgaacagggtgagggcaccaaccccagtcaggacaggcgggggtgctttcccacaccacacaccaggtttggggctaagagtaaaagacttgggatccccgtaatcccaggactgaatgccagggcttgtctccctcacccacaaagccccgggcaaacacaccctccgctctcctccacacccctgtcagctgcttattcctctttgacaagatggggaacggctgccagttgaggaagggtcacaaggacaggagtggaagctgtggaggtggggcagggaaccggattttagctgctgcttccaggtagagtcacctggtccagtttcctgcctctggcccagggctgcaggaggcaaccttccccttttcacggatggaaactcttctttgcctttctccctcgggggaaagggctctcttgtacactgagggcatgctgccttgagtttttcaggctacagtccaaggattttgtgaacttctggaaattttgactttataatgagccacagaatagggctctagtctagaactttctttctgtttcatgtgggtttattgtaggatttgtcatttagctaatttggacttagttggaggacacagaattggccccccatgacagggtcctatcttattggttacttgtaaggacagggctacatgatccgatcaacattccttggcaaaagcagggatagaacatttagcgtgctgccggaggccctgtggctgctctggtggaccacaagctacgggtcaaaattcctgtataattgtttttcctgcagattctgatataaaccattggggtgtagagatcaaagtcacaagctttgaagttagatggacaggactggccacctacctccaccacttcctagctgtgtgatcttagtcaaattatataagctctctcaaccttggttgtctgtagctctaaaccgcctggcgaccccctttagctgggttgttgtgaggaagggaattcttataagaaaagcactcagcgtccagcacatgatggcaattctgtgggagagtaactgttacctggaaagccaggcagccttcccctcatctttctgtctgagggatgacctctgcctcaacttagggtttgcatgatgagaagtacctccattgaggatccatggtttgggtgtcccacaggcacaaaataagattgattatatattatagattatttcccttaaagtcccttccacctctgttggctttctgttttatacacaccttaaggacgcaggattctcttgtattggggtgtcagagctatagactataagacacaatggacacatcacaagacaccgtggggctacatctctggggaggaaaaccctcctcctagcctacaaaggtcctcgtcaacccctagaggcagccaggaggatggagccatgagtgggaggtgaggcaggtgaggggtctgagccctgggttctgccccttaccaccctcagggcagaaaagcagacaatcagacctcagctcccctagagggtggctccagctgttccctgctccttcagctgcagcctcagtcatgcccactagggtggaaatcggtaaacccttgcatactcgcgccctcagagctggttcaaggtttgctcaggtgcccaaatctggattgaccgctgtacaaattagacaaactgactttacatcaggcaggatggtatgggtgagaggccagggagggcagagcctttgggaatagactgatgtcaattggggtcctagctccatcactgtgtgaccctgggggctacttcactgcccctgggtcttccaagtcatcatttgtaagcaccgttgtgatgctgactacagagagcttctaggaagattccatgatcacatgtatataaagcagtcagcacagagcctggcacaaagctggcacttcataaatactcattgagagaaggatgtccaaccctgaccttcacaggagatggtcttggctctagaatgctcccctactacaggtggatggaccatggctcgggctttctccagtggacctttgacggaaccccggtggaggggggtgtctcctgtcccactgccatagcccttccaagcactcatttacttagaggccatctggacaggtgcatagggagcccagcaaagacagaggtagatggggacagag

SEQ ID NO: 47600 - DNA, 747 bp, Bovine  19866880649799
acactaaattctgtttgaagacaaaggcatttcagtatggcagcaggactgaagggacacgaaaagagttgttacagtgatttggtgacagttcttcaaacaacagtgtcttaaggaaagatggagcaaggaacttgaacttttgagttgcattaagtgagaaatcagcatggctcaggtaaaaagctctagagtcctcctccttcaagatcactgggaagcgtgtttgcagtttcactcttgaatgctgccttagtcaacatattgaccaacccagtgagccaaactctgtattaaacaccagggggagatctagaggaaggaaaggagacaggccacagcccctgccttcagggagcttccagtcaaatgaaggaggcaagtctcctggcttgtgaaggcctagcaggtgtgagtttggttcccactgcagccagcaagaagatgatgctgagccagattgccagcaagcaggccgagaatggagagcaggcaggtagccctgatgtgctgaggtgctcgaatcagggccaccgaaaagacagtgataaatcccggagccgcaaagacgatgacagcttggctgaggcctctcattcaaaaaagactgttaaaaaggtggtggtagtggaacaaaatggttcttttcaagtaaagattcccaagaattttgtttgtgaacactgctttggagcctttaggagcagttatcacctcaagaggcacatccttattcataccggtgag

SEQ ID NO: 47601 - DNA, 1422 bp, Bovine  19866880649988
ccacagcaccacattcctactgagtgttccacctcacccttgaagcagccacctccagaattcttgactttctggagtaataattgagggagagaacctgtatttccatcctttccctttgtctcttggataagagtacaggctttattattattattattattcatggcataagacaggcaagagatgggaagagagggtgagagttcacaggcttcaggattggtcagccacattccagctccaaagactggcttgttactttcagagatggctgctgttttcaggtgtcataagtcatttctgggtacagctggactgagcaaggagacctgctcaggatgagggagggcccacacctcagttggaagttgaattcaagagccagaagatgtgagggatggggtgaggagatggaggctgaagaatttggaatatccaaggctattaagaaatgggaaagaagggactgacttcaggaagcagattctggggtactgaggcttggtcagtgaggctgtgaaaagggagcagaaattagatcttaattctaggaaaagcttatgactcagagggtgcagtgtgagacaagatgtgtaccgaccacaaaggccaggccaatgccctagaaacaaagatcgatacctttaaagagtcctgtaactcacaagggttggaaaccagatacaccttcatctctaggggcaagggctgtgggtgggtagggacagagttgtgggacagagaggtagaggggagagactttttaggatattaaatctttgtttcacaggagggcagatagctcgagaccagaatggaagagtcatcactaagccgggcaccatcccggggtggagtcaactttctgaatgtagcccggacctacattcccaacaccaaggtggaatgtcactacacactcccgccaggcaccgtgcccagtgccagtgactggattggcatcttcaaggtatccctagatccccttgggctcaggtttatgggtcctgggtggtttggaataaggggaatgacttggtttctggattcgcaacctcataatgatagggaagaagggagaaggatgtcagaaatggctaaggccatctgtgtaagcaaagcccaccttctccctatcttaaccttgctctctcctgacacactagcatccctccactttccctgtctctcagcatccttgccacagccacaccatcctgcccgcccccattcagtccctcagccctttgcactatccagagctgggaggtgcatcgccatacccctctcccactgtgggctctgacaggtggaggctgcctgtgtccgggattaccacacatttgtgtggtctttggtgcctgaaagtgttactgatggttctcccatccacgccagcgtccagttccaaggtacaag

SEQ ID NO: 47602 - DNA, 1418 bp, Bovine  19866880661707
gggtaggcccaatcccaagtggcccagcttgcagagcagggagctttagctatacagggctctctttctcttggaggagagcaaggaaggcccaggctgtctttaaggccacccagtagacaccacccccaaaacccagtgtgacccaatagctcactgctgccaccccctcttcccatgcccattttcttcctgtgcaccaacccccatccaaatgcttctcctgggacttccctggcagtccagtggctaagactgctcactcccagtgcccaggttccatctctggttggggaactgcatccctacatgccgtgattaaggcccagtacagccaaataaattaacaaaaataaacattaaaaaaaaaaatgcttctcatgccccactcttactgcagccctcttaacaacctcggcctagtctgctcgtcccttacctgccccagcactctgctccccccgtcttgggacattaccccaagactcagccctatccctttggtgcccaggaggctgaagatgagaagtcggtcctgatggcagctgtgcagagtgggggtgaggaggccaacctgctacttccagaactgggcagtgccttctacgacatggccaggtgagtgctcaagggggcagacagcagggaggatgcccgtggaaagggcacccaggtgaacagtcctcatgcgcttccaccacctccctcttcttggccccagctaagaaaaggagatgtagctgtgttgacgcagagaatgacccagcaccccagatcactggtgccttcaggcagccctccccaatcctatcaatgcatatgcgcactcgggccctgcctttaactggcttctgtgttgttctagcaccgtcctctgcagagcccaaattgccctgcatcccccctctcctgcccctatgccttccccagccaccaggtaagtgcctaggctctgtcaggggttgaagggaggtgaccaaggcccccagggacaggaacagagagaagactggggtccagcatccctctgatcaccccgcagatgctgtcgctcctctctgactcccctgggcaatcctttgggtggcggattcaggtatcagattgtgccccgcccgcaccccccccgccacccgccttcccttttccccctgcaggtcaagaggggaaggtagggaggcaagagaggttttatcgtccagcccccagcttctcctggatatgagatgggctcggggcaaggaggaggtgatgctgtcatccttccaggctggagcaggaagatgaaggacgatgtcagactcattttcagcctcattaggcagcagacggagatggagggaggagagcagggggttgggggaagggctgtgtactggagcaaccagcagggactaaagaaaagagggcacggggga

SEQ ID NO: 47603 - DNA, 1492 bp, Bovine  19866880675633
gggccagagaaggagtcagaacacccctgatctgaggcagatcaaactgtatatccctgagtcatggtgacctgtgaccactgaactcatgtccaccccacactgagcttcttggctggaacaggaagaagaattggagaagccaaaaggagacttcctctagaactcccaccgctgcacagtgtcctgataacatttttgtccttagaactcctccaaaaccaacagaacaggcaacacatggggttcttggggacttgacactcaagccagttttcccagttaaaaaatgacaggaagcaggaagggccaccccactaagaggaataacaaggacaatccactatttaatcatactataaggctgctgtgtaaccccgttaatgatgactgcaacaccatcaagctgggctgggccaaaaggcctcgtgagagcaactcaagagtcatcatcacttgcaaagaaagaccatccagccactcgggtccaagcatcccagaagggcttcaaaagtcacaccatccatccccgccccagtacacatgggttgcaacagcctccgcccaccctctctcagggtgcactccctgaccctttcctgcctccttccacctgggcccaccttgtcgatgaaggaggcaaacttgttattaagggtcttgatctgctcccgctcctccgtgcgcacccgctggatctccgggtcgatctccacgtggaggggggtcaacaggctttggttgacggtgacctgctggatgccgccaggaggacagacgggccccagcatcggcctgcaagcccccaggcccatgtaggccccaccgccaaggccgaagcctcccagcacccgccccgctgaggcccctccagccacgctgaccgagatgctcttgctgccccccaagttatagaggctccggctcccaaagccacccatgctggggccacagcggggccccccgcctctgccactgctccgggacacagtcaccgagctgaagctggtgcgggcctgggaaccacccccgccactggctgagctggagctgaaggcccctttggtggagtatgtctgccgagacacggaggatctcatcgctgcagcagggccagagcagacaggagagctgggagggagcacagtgagctgctgggccactgatgggctttttatcttttcccaactgggctggctcctggattccacagacactcctgccccatcgccccaggaagagagggaggggccctgaggaccgggggtgttcctttcccactgcgggagggaggggctgctccgagttatcacctgagctccagagctggggctgagccgactgtctggggccggatgccacctccttctcccccgctggggtgctcctgacttggaacaggatgatacgggctcccagggccacccccacccagtggcagactggtctcctcccacccagcccctggtagccgctctgagtcagtggggct

SEQ ID NO: 47604 - DNA, 973 bp, Bovine  19866880703698
tatatgctctgcttttagtttatatatacatacataatgttttcctttcttaattttgtcttttaatttgggatcagcttcttgcactctttccctgactcaaccctttctgtctccccttctctcgcctgatctcttcatattttgtttttggtagtggtccctggatgaggcacttctttcattttttaataaagtccttagtcccagcagcagaatggagaagccttgaagctcaggcgaatgcttgaggtagctgtgaagagagtgttcaaaatactactgacgcaggcacccttttggtgctggagagtcaaaagcacctctctcttcattggctgctctaagcatcaggaatcagaagtctttctatggaattgtacaagagaccctttgaaagttatagtctgggatcagtttgtccaaactgtgaaaagatggtcaaataataggtaggagctttcagtaggaaaatgatgtgctcagaagtggaagtgactcaagtagttcagttcaggagttggagtgtttggacctttgtgcaacttcttccaaggtagctctaagctttgatgtgtgggcttctgagttcacgttctgaaaggaaatacacttcctcttttgaacatctccagtagttgctttcccattatgttattacagagcatcagccagtgactctgttctggatttccattctgcagaactccagagcatggatcagtggcaaggcagtggttctttgatctttccccttaactcttcgtagggtggctcctgaggggaaaggaagtgctcatgatcatgggaatgatagcccagaacaaaaagaaatcttgtcttaccactgtggcttataggggagaccagggaaaaccatcctgcttttctccatggcctgattcctgaagagactgatccaaaaattacagcggcagggaactcttagtgcatttggcactgagatttaaat

SEQ ID NO: 47605 - DNA, 1289 bp, Bovine  19866880705783
gatgtgggtttgggtggactccagcagttggtgatggacagggaggcctggcgtgctacagtccatggggtcgcagagagctggacatgactgaacaactgaactgaactgatagaaactccccgcttaaccttttgaggaactccagagtgttctccacagcagacacagctctttacaccaccacctacgatggacagtttccattttctccacatcctctacaacacctggattatctacttttcaacaggatgagaagtgccatctcacaatggtttttacttgcgtttccttgatagataatgacattgagcaggtcttcgtgagattattagccagtttttttgagaaacgtccactcagatcctttgcctatttttatcatttaaattttttaatttgaaagcagcctctgtttattaactgaccagattacaaaaataatcacagtagataccttagttcatccttctaataagcctgttgatctggtcttcccgattgccagcatctctaccttctacaaaatgggtggtctcttccttcattccacctcgtggagaagacaacttgaagtgccacaggaagttgcacgcgtctttgaaacattttccaacggtacagatctcatgaatctgattctccatgcagatgatgccatctttgccaagagatcgagcaatcactgtgttatctgtcaggtcaattcacttcttgttggttttgccataagcacacttgtagatcaattcatttactgaccgcaggtctggggactctcatgcagtgtatggttccacagttctcagcgtggtaactgaagcgttgctgagcttcacacaggtgccactgaagatctgacagaggcgaacaagctgcaataactttccaacctttcggcaaatgccaccaatacttctgatccttatgacaagcgccagtttggattcagagggtacatagatgttgctggcttttcttgccatcctagccattcgaaacttttgcaggtaatggatatgattacctatattcctgtgataccatctgcctgtattcctgtcataatgcttagctttttcatagaactttttcatagatgagctttctctttgcttttcaaagcatctttagggcagacttctttctcaagctcttgatcttaagctctgcaaaaatcttttatttgatctaagggtttctggcatagcaaaaaccttctttttcttatcttctgaaccctccatggttccaaccaggaaagagctgctgctccccctcttttt

SEQ ID NO: 47606 - DNA, 2834 bp, Bovine  19866880737514
cgcctctgtccctgggattctccagccaagaatactggagtgggttgccgtttcctcccccagggcatctcaccaacccagggatagaatccacgtttcctgcatgggcagacagattctttaccactgagctacctgggaatcccagagagcaaaatagtttggggtaaactggggaagaagaggtgacctgctgagtgggaaaataatataaatgagaggtttcccccagagtcatgggaggaggttactctgcatctttcccatgtttttctgggctcctgagtctctaaatttcgctctattggtggagaaatgtgtttcttgttttcttcctagtggtaattttgagagcagagacctccagaccacagcctgagcaaaaggcctcatgtgtgtctcttgtcatctccaagcatttatcccacacaatggaatatcacttggccatgtaaaagaaacaaataatgccatttgtagtaacatggatggacctagagattgtcatactgatgaaagaaatcagatagagaaagacaaatatcatatgacaattggatatatatggaatctaaaaaatgctacaaatgaacttatttacaagacagaaatagagtcacagatgtagaaaacaaacttatggttaccaggggggaaagtgtggtattgggagggataaattgggagactggattgacatatacacattactatattatatgtaaaataaataactgatgaggacccactctatagcacagggaactcttcttgatactttgtaatgacctatatggaaaaagagtctaaaaaagagtggataaatgtatatgcataacatatgcactttgctgaacagcagtaactagcacagtattataaatcaactataataaattttttttttaaaaagcatttctttggcttccctggtggctcaatagtaagagtcctgtcaacacagaagattcaggttcagtccttggtccaggaagaccccacatgctgtggagcagctgaggccctgtaccacactactgagcctgtgctctagaggccgggagttgcactgctgaagcctgagtgccctagagcccgtgctttgaaacaagagagaccactgcaatgagaagcctgcacacagcaactagagagtagcccctgatccctccaacgagagaaaagccagcaaagcaaggaagacccagcacagccaaaaataagtaaataaattaaaaaaaatttttaaagcatttctcttttggagcagtgccctttgatttcaccacgtgtaataatctaatccttgggtgttatgcatgcctggatgtggtagggtgaggcactggggcctgatagtcaggaccatgaggcggggtgcaccacagatctttcagaatatcgatagtgcctatagatagtagatttccagcatctcatcattcagaataaataataacactccttgtttcttctctgtggggtggcacggggctggtcgtttcatctattaccagtgtgtgtgctaagtcacttcagttgtgtctgactctttgcgatgctctggaccgtagccatttcatgggattctccaggcaagaatactggagtgggttgccgcaccctcctccagagaatcttcccaaacaagggatcaaacctggtctcctatatctacctgcattggcaggcaggttcttcaccactagcaccgcctcggaagcccagtgcatctccctcttatattttacaccagctctgggagctcagaaccaccgctctgctccaactttgggttcagtatgtccgtatcctaaacacgcccattttcaccatcaaactgaagtttccctgccctcagggaacggcacctcctttctctggatctcatttcataccagtgtcagtatacagattggctgatgaagaggaaatttaaggaggtcccccccgcctttccacttcaaaaactatctaagattttggtttatgagagaagtaactcctcaacttctaggtcaggttatgttggttcagttgaggaaaacttctgatgcggctatagctttgagtctgtattctgtctcaggcttctttctggagacgattcaatgttttggggcacaggaagtaggggatattggtggtgactgggatgtggagaaacatgaaattttagccaggagaagctatctcagaaatctgtaatgagcatgtgtgttatttcttttccaacaggctgcataatttttatgaccaattattccatttgtaatgacgcggagataacagagatcccatctcatgctctgtggcaaacgccaggcactcgtgggagctagaagatgccattgcttatccgagaattggatggcaaagtctggggaccgagattcagttctagcaggggagaacaggagcgctaaggaaaactttgtaaacatgaacggggaacatggagaggactgtagttgtacaacaaaagagatttattgggtatagattaaaaaaagaaaaagaaaaaaaagcttgtcttccagcctgagaattttgtgatccaacacagtttctgatgatgttatatttacacataacaaatgaacagatgtctggttgtggagacagtgccatcccaaggcagaaggcgccagttttttttttcccccacaaagaatttcagggctcaattagagaggaggtttaggaaagactaggcccagcctaaggggaggatgctcttcttggggctagtggttctctattgagtctggacagagctgaggatctccttgacagatctggtaattggtccattgggcctgaaggcaggcagg

SEQ ID NO: 47607 - DNA, 1439 bp, Bovine  19866880749060
agggcctgggtggaatgcggccacccagacagagtaaccattggccatccctaaggagccggaaaggagggcagccggggggtgtgcaagccatcctgccccctcccttctatttctaagcctgcatgccagccatcatcaatagccaggatttactgagcacttactatgtgccagccactatactagctcactttatcttcataacaattctaatcctaattttacagaagaggaaactgaaacttaggtaggattaagctgcttgtctaagcccacataacaggtatgtgatagaggtaagattcaaatctagggctcaggcagcctccccagtctcctcctgctaggaaagtggcctaacacccatagtacaaagatccttttcattttttcataggttcctaatgtggggtccagagaagaacttcaggaagtccttgacacctcccagcactgcatgtaaaaatgtaaaattgtgtctacaggtgtttgtgtattttttcctgagtatacacatctcaaattctctgataattaggacttccccgatggtccagtggctaagattctgtgctcccaatgcagggagcccatgttcgatccctggccaaagaactatatccacgtgccacaactaagagttcacatgccgcagctaaagacttgggcagccaaataaaaataaatattaaaaaaattatctgataattactaataattatggctatcatttgagtattccatttatacacaccatcttccatgcattatgttattgaatgctaacaaggctgagttaatattattattactctcattttatcttatttttattttatttttttggctgtaccgtgttacatggaggatgttaattaattccatgaccagagatccaacccacattcccctgcaatggaagagtggaatcagccactggaccaccagggaagtcccattactctccttttagaaataaggaaatgagggcttcgaaggttaagcaacttgcctaaggccttgggtttagacttggggaagctggtgacagagtgtacactgggtgacatgagttcccggctgggacacaggccaaagaaggtgaaggagctgagtctctggtctgtgtcaacacactgtcccgttacctttgccaccagctgatagagggccgctaggatctgcagggaggctgctgtttgctggagacaccgtacagcgggcacctgccccttagtaagcacctccttccacagggccagggcttggtccaggcatttggactgtgctataaatcagaagaaagggaccagtcattctcacactctgggccgtctggggaaatgtggtcatctttcccataatagcctctgccttgtgcccacctcccactcatgggggagcctctcccacagctgggggacccatcctgttag

SEQ ID NO: 47608 - DNA, 1581 bp, Bovine  19866880808492
gagcagagtggggacaggtccaggcagagaaagggtgccaggaactcttgaggagaggtcaaggatgagagctggaacatcgccctggctcagccccaacttcagctctgtagatgttgtcagaatgatggtggaagggggaaagaaaggagagatgaagatcagggagtgggcatctgaggtctccgggctggtggccattgcagtccctggatcccagtgccagaagggggtgcagagtgtgagaagctgcaggaatgcacgcttcctaccattttccctgggttggacgcaccttgcactccagaagtggagagccttgctcataacctactcccacccaccactgcttctgttttgctatcaaaggctgagttaaaaacagtctggcttggggtgagaaggccagagggtggaggaaaaggttgagccgggagcgggagggcagcagagggacaattccacgtgggaggcctgagcagcccaccagaggtcagggccagacccctgactcagcagccatccacttccaagctagcatgaggcacagaggctaagtatgaagaatttccctcccttgaggtctatacacttccaaccaagtttaaaatctagacaggggactaacgcaggtatgatgagatgtatgaaaaggccagctttggagggtcaaggactctcactgaatcatcatccgcctctattctcatcctataaaatgtgggaaggccaaagagactgacatggatgcttactcaaaaaagcatctcgaagaacctctcccaacacgagtaggatttatgatgacacctaccccacatcacagcgaatgaaaagctgggccagctgggctgggttcaagccaaaagggaggtccaggcatccagcctctccaaaatcagccccgcctctcaaaggtagacagacgttcagggcagcagtgtgcgccaccctggggactgaaggaaccaaagaggcaaaggagagctactgctttccccaaggttgagtgatgagcctgagctctcaaacaaaagggaaggtgggaaaggaagaccaaggctaagggaacacagacctggacgcaaggaccgtgtcatggtgccaggcaccgctgctcaaactctcactttccaaaaccctacagaagacactgtcttcactgcctattccaagcaatcctaagagccgctggggccccaggagttccgcccggcgccctccacccactgccccttacttacggttccacagactcggacgtcgtgcagccggccccactcatcctcgtaactgtccaccatcatgacgctgtcatcctcgcggcccagctcggcgttgaggtgcagccgtacctcctcccccagcgagtgcatgcccactgccggaaacagcccgtccggggacatgggcatgatggtggagcccacctgagttgtcaggagagaaggaaggagggagctgccgcctggctcactttccccacggctcatctaattctcacaaggggacttttgagaatgatgcaaccagtcatcaccacacacatgacaggagagcaaaacagaggtacagagaagt

SEQ ID NO: 47609 - DNA, 1456 bp, Bovine  19866880843190
agcattcctacaaaactttttataagccagaatggtgtaaatcaaagaagcaattattttaggacacattttgctaacagataaaaagcttgctgtaaaaccaacactgaacactattttcacttttcatctttttttaaaagcagagtcctcttaggatttctttctggtggcagcagcatatatgggtctttttgtaaaagtaaagtggcataaaggtaactttgaagcaagtgatacttatatttagaacccaagtgtattaaatgtctgccagtttcaaatggtttgagcaagaaagacagcttatacacccacatataaagccaacatgataaaacttaaaaagtgatagttcttgaggggtcagcatgggtgcagggtagccattactgagctgggcatggtgtattttgttaaatctcttttatacagacacccaagctggcgaagtgaagaaactcaggaacgggaacgatcgaggacaggaagtgagtcatcacagactgggacctcagccacatctggcagaagtaagtcagaccagggtgggtatcttattattgccctttgccttaacctaacgtatccatagccaaattatgcatatgaaatttagtcgtggactctttatttgggttatcatggattggtctgactttcatatttgctctgagaaaatctgggtaatgggtaccagaagagacttagttaatcagtttaatgtcccactgaaaagtatacttggctgttggggtttgtcccctcctcttaggttcttgtatcactttgctgttgtcgttgggctgggtctccattgtggcaggtgggctttctctagttgtggagagcgggggctgctctccagtacgatgctctcatcgttgtggagcccaggctttagacgatgggctttggtagttgcggcacacaggcttagtttctccatggaatgtggaatcttccaagaccagaaatcaaatccgtgtcccctgcaataacagacattcttatccagtgtactacgagtgaggtccaaagtcttgtatcactttttgttacgagtgtttctacatgtgtatcaagtaccagcgttttaacaccgagaacatctgttgggagccagattcagctctgtattgaagaatgatgatggaaagcagtgtacttggatgtgggccgttttccactcttgaggttctaataggttgttatcaataagccctttttctgatgctttgaccttcccattttgacctcacagatgcaagaagaagagagagtgagaagtctttagaaaatgaaacccccaataaagaggaagactgtcagtctccaacttctaagcctcccaaacctgaacagcctctaaaggtaatgccagcccctccaccaaaggagaatgcttgggtgaagcgaagttcaaccctccgctcgatctcagagctcagacaca

SEQ ID NO: 47610 - DNA, 1128 bp, Bovine  19866880847707
tctggcttctgggacctttaaaggtggctgacagagaaggggttggggagaacagttccccttcagattgttgttgtcctgagagaagctgggggagctcgtgtctgcagagctcagctcaaggcagggtccagcttgcagtgctaagtcttaggtcttcaaagcttggctggttgctccatcactggccccttaaaatctggattcatgcatatacactagcctcaggatctttattctgtgtctcagtttctcctctttgtgggtttcatatttcctgtgtatatttgtgggggccttttatcgtggagagttgcttgaaggggttgatcgtaattgctcagaaggtgtctaaatggtcgaccccaaattgatggacagtcactagtatcttattttacttatcctttgcattctgctcatttagctctcaaaggcagacatcatcccagtccttccctctactggttcttctccaagcgacacctgaccaaaatatgtcccttctgctagatcttgcctgcctgcctctatttctctctctcctctgccccactagccctcgtactgattgtgtgagggtccattagctctgcagaatttctggccaagcttcaggactcttttgattgcagtatttagggggagaagtaggaaggagaggcagggcaggttttcacattcgggcaggggtctctgagatcccccaacttggcactgggagggagcccgggggcagctatagcagcggtttcacctgatcagctttctgggcacatccaccaccaagcagcacctgagaggggaaccggctcagcagtgagccgagtgagattgaagaggatcataaagaaaatatatatcctcctcctcggcctcgctccctcctcctgctctacacttgcctctgctctctctttgtctcactccctcccatctcctcaccgcatccctgttttctttgtttcttttttgcctccttcaccttcatctctgtcaggcagatctgactgactgactgtcagtctgtctgtctgtctctctcactccaggtatttttttggtccgagtctttctagaactctgccatcagctcctctctttccctctccccctcgtgccatcctg

SEQ ID NO: 47611 - DNA, 1556 bp, Bovine  19866880866965
gaagggttggaatttcaagcgtccaggtgtccctcactccccttcccggaaggcacgagggcggtgagtcatgcatttaggcccttctcccaccccctcactgctctcaggcaccctgcttccccctcctgcccctcctgcccctgggtctggagagaaattggggaggatggggtgagggctgggtctcgctatcaagctgggtgtggggtggagggcagagccttcctgtcctcccatctaggggcctggatcctggggcctgaatccaatccctggaatcagtgagaacaattacagcttctttcctccttatctgctggatccttagggcctggggtgaaagagaggagaggacagaaaaaacaaatgtgggggagaagaatagggatcagagcggagaaaatgattcacctggatagaattgactcttggaaccattcattcattcactcattctctcattctgtgaatcaaacaaattcctgtgctgggtgctgagggaaatagaaacttgcaagacagaaccctgttatttttttttttttttctgatgtggtccatttttaaagtctttattgattttgttacaatatttcttcttttttaatgttttggttttctggtcattaggcatgtggcatcttagctctctgaccaaggattgaaactgccccccatgcactggaaggcagagtcttaaccactggactgccagggaagtcccaccaccctgatttttgaggaagcgccttatagcgggtgtgaaggccctggattggaatctgggggccctggcttgagccccaaataccactggatgggcaaatcacttctctaagccttgggttcctcgtctgtgaatgaggataaccatactgagctcccaaggttactgtgcagatcagatgagatgaatatgggcgcctgcttcattcgcccttgtccactgcctgtcagatgcctgtggcttgggtttacaatcagggaggggtgctcagacaggtataacccagcccagggagtaacaaaggtcggttcttggggtctctgtgggaggggcacttcctactgtgctgactgtgggtggcggtgtgcggaggtgcctggtgtgtgattttcattcagtaaatgtttgcagagggcccggggtgtgctggagccggggcctgcaggaagggtaaggtttcagcaggtgcaggtgccaaggatggtggcaggagggacaggcagagccctggggctggggcaggagcagctagtgccaggtaggaaggactcagctccatccttcatgagccgcttgacctttactctgaaggcaaaggaagttctgagctggggagtgacaggatcaaagtggtgtttgtagaacagtctggctgggccctgggccttgggccctgggagaggacaacttggagcaaagcaaagccagctcagtgtggaggcggaggggggctgggccacagggaaaaagcctacgtgtctaggagcctcaggcgggcagtgaggtcacctctcccccaactctgcgaggaggaggagggcgttcg

SEQ ID NO: 47612 - DNA, 845 bp, Bovine  19866880870563
tcttcctcaagtgggaaggtcagcttggtgtcagatttgatatacaccaccatttttccctaagagagtttcctgattttctgcctttccatccagctggatatataattattttatttggagcttttaagtgatcctgaggagaacagaaacagcccaaggaaccaggagccaatgaacaagaaggcaggaggactggggcatgaagacagtactgagttctgaggctggagagtgacctcttcctggaaatacagcccctgctcagggaggggagagggctgctcccagctgatggccatggtccttccactgggtctgggttccacttcccaatacactcttcccctaaccccaatcctgtggttctccctgtttattattttttgccaccacttctccacagaaccacagaatagaattataagacatgtgaaagttttaattataagacatgtcatgcttgggatcagacctaatgttatcaaaatatgtcacattcactttaaatgatttttttaacaacaaatatgggctaattgtaaaagagtcaaaggcaaatacagatatatttaatgtaactatgtgaatgtaaatgcatgtccatgtgttaaaatacatttattgatatataaatatattacaaatatacatatagacatataaaatataaaaaattataggctcccttaagcccaccttcataccagtgtcaaatgtttgtagtctagggcatatatttaattttttttaaataaaaatgaatcacaccattcatgctgttctccaacttgttttttatttattaaagtataccttatttttctctttttaaaaacacttga

SEQ ID NO: 47613 - DNA, 1265 bp, Bovine  19866881036073
ataattattgagtgtgtgggcaaatatttatcaaaggcctcaaaggctccaggctggccagagggttgctcaggctagagagttgtcccggaggctgtgcccaggcaggcagcctggcaggagcctcaggaactctctgcttgtgcggcaggtgcggttcctggagcagcagaacaaggtcctggagaccaagtggcacttgctgcagcagcaggggttgagtgacagaccccagggcctggagtctttcttcgaggcctatctggtccggctcaggacacagctggaggagctgcagaagaaacgagggtctctggacgccgagctgaagtcctgccagggccaggaggaggagtataaagctaagtatgtgaaccacagcatccccatggggcctggtggcagctgggagggcttgaatcaggctgtctgctggaagctgtccttcctctgagctcccggaatcacaggataggcctctcctctgggccctctgcatccctactctctctgattctcagggggccccatctgctgcaggtaagaggccccccagcccctgatatccaggactggagagcctcgattctagcaggccctgactatgagggccacgtttctggtcaaggtggggaggggcttatttaaagaatgttcctgtgggtttttttcttgagaaattcctgttgagcaggctgtgggctaaagtgactcagatatcctctggtctcagagggagaagggaatgcacttagtgggaccacccctgggcctgtgcatgattcacggctggctgcagttctgggttccccacgaggtcacctggtggcacagggagagccctgaagccacagaaggctcaggtttggtgactgtgagcaaggaaagctgtgtggccttgagcaaagaatctcacctttcccagcttcagtttccatatctgtagacggggataatgcctttcttgtgttccagagccactgggaggttggctccagggcccaggggggagggtcctagaaagattggggccaggagacctggattttagatctgcatgggccacctaattatctataacctgggcacatcttataatctctctgataaaatccaaaatgcctgcttcagatgatgattgtgagtggtaagtgagaaagtgttttgaaagtgccttccagacatgaagctaagtgaccccgatgtcatagtgaacctgggccgagagagtgaagagggacataggacgtcacaaaccttcctga

SEQ ID NO: 47614 - DNA, 1041 bp, Bovine  19866881038770
agcctggtaggctgcagtccctggggtcacgaagagttggacaggactgagcaacttcactttcacttttcactttcatgcattgaagaaggaaatggcaacccactccagtgttcttgcctggagagtcccaggaacggcagagcctggtgggctgccatctatggggtcgcacaacgtcagacacaactgaagcaacttagcagcagcagcccaccacagaagggagctgcactaggggctgcaggagaagggaccattgtgagggcttctgaggaactgggatttaggtgcagggaaagaaaaaggctccagagggaccctaagtgaaacctaaggactcaggccggtggagacaaaaccttcccccaacttgcctccccacaatacccactctacggatgacaataagggccatgattgaaactcaggggtttgcctttccccagcacctgtgaatcctgaggcccaagcagagagagttctcctgtggaccacttcgtcccatcaccaagggtccagcaggacaggggagtggaggatggagaatccgaggcagagttgccctccctcagaaccttcctcacaggttcctttctctggccaccttcccctctgcagccctactagctgtgtggtggttctctccatttccagtgctatagaaaggactggagttagaccacagaagggtctttccagattaacctcttggttatggccacaacacaggccagggtagcaaaggttaagaaatctaggcttttctgaataggcccaatgaactgagcatgatgaaatcagggaatccagagaagatgggcaatctcctgggtatggtgggcttggaaagactatgcaactatcagaagcactgacatccaaatacacattgggatttattgggaagttcttctgaaggtcagacctgaaatcctccagctttagtttcagggtatttctcttttaaggctctttcagggaggcagaatttgaatagtaggtttgagacttgatgacagagtttccattatccctgtc

SEQ ID NO: 47615 - DNA, 1707 bp, Bovine  19866881051108
tcctcacccacccagcttacctctcctcgccatctggcgtctgtatggtggtctcagacagatctgccactatcgtagcggacttggcgcctccaacatacccctttccctcacctgtggatcagagcaggtgctcttaagtgtaggaaaagggcccctctcccccggttccccatctcctccccatcacaggcatcaatgcctctcaagtcttccgagcttctttacttccctttttccttcaaggcagcatattccagatggctctttcctccctctgactaccccagctattgtgcatccggaagtgttgcccctgactcaccacaacgttctgggaatgacaaggagtaaataagcggttcccccaacacggtgaacagcaggcggtttccactggggctccagcagccagtctggggtcagggagcaaagggcaggaaaagggtagtctatgagaattcaggaaggacgcacaggagcaagagaagtagaggaggtggggggcaagtacagccaacctcctcccccagctcctgcaccgcacactccctcctacctggcatcgccccgagagggtaggccaccgctcgcaagtccacatctgggcctcccagactctgtgccagagaagcaggccacagcttagagttgcaggtctcacagctcagacctccctgcctgtcagtcccaggttgaggggaatgggaatggggacagaaggctgtgcagctgaaagttccagaagcctagggcctttctccacatccttcctgcccacttccgctctccccacactcaccgaaagacagctgaaggagtggtagccaagactttgctgccatctggggaccagagcaggttcgtaaccccacctccccgaaaccagggaaggggaacacaggtctctgttgagacatcccatacctaggagacggggggacagtgagacagggagacagtatccccaacaccccacagacccccttccctgaggtacaaagaaccagagaggagaggaagtggagagggttgaaacaggaggaaacagcgagcagaattttacatgtgaggagcagggtgctcctgcaccttggataaatttaagactgaatggataactgttcctcgcctcccgcagtgtacttcccaccaccaggcaaaggcagctcttccctcaagtctgaggggtgtggctgaagtgaccccaagaggtatggggatcaactcaccaggatggcagcgtccacaggggaagctgagagcagccgccccccactaggggcccaagccaagctggtaacgggtgtgtgcccagggtgagagagcacctgggcacagccagaagagggtctgcagaagggagacggcgtggggttagaagacaagaagaaagcccctgtgactctgctcccttgcctccacctgctaacactgccccatccctgtgggccctctgaatgcaggagtaagaataatggaagttaaaggaaaacaagaaggaagcaagggcagtcgctaccaggaggcccagaaagggtgaaagcgggtaaacctgagagagacaagaactttattactcctgttactcatttatttattggctgtgctggatccttgtggccacatgggttttttctctagttgcatcagaggagcttcttgttgcaatggcttctctggttgcggagcatgggctttagggca

SEQ ID NO: 47616 - DNA, 1392 bp, Bovine  19866881061402
tatgaaaacttcgtggaggaagtagatgcggtggataatgggatttcccagtgggaggagggagagcctcggtacctgctgaccaccacgctgagcgccagggttgctcggcttaatcccacctggaaccagcccaaccaagacactgaggtaaggagggcctggggaaaagagactgaggtgtgtgaaaatcaggggaggaagtaagcgggcttggcctcttgagccctagcagagttagttcgggccagcaccatggttctcattcccaggctgggttcaagcgtgcaatggacctggttcgagaggagttcctgcagagactagatttctaccagaacagctggctgccagcgcggaccctggtggaagaggccctggccaagaggttccaggtatggacctgggaagaggcactgcggccctagagagttgcgtgctggcaggctgctggcctgttggggctcatgcttctaccctgagccgtctgtgccagctccacttcctttgcaggtggacccaagcggggagataatagaactggaaaagggtggctgcccctggaaggagcacctctatcagctggagttggggctgtcccctgcagggaccatcgcctttgttatctacacagaccaggctggacagtggcgggtgcagtgtgtgcctaaggagccccattcgttccagagcaggtgagggcctaggggtccaccctgcagcccttcaggcatgtttcagccccatcagaggaggcagccactaacctaggcctctgctccccctctcccagttcctcacgacctccatttgcccccaccaactcccttttctgctcactcgtaggttgcccctgctagagccatggaggggtcttcgggatgaggccctggaccagatcagtggaattcctggctgcatctttgtccatgccagcggcttcattggtgggcaccgtacccgagagggtgccctgagcatggcccgtgccaccttggcccagcgcccagcacctacacctgccccaaatcccatggtccaataaaactcccatctcatgctgaccaaataatgttctattactcccctgcactattctgggagcttgcttaaatttggggaaagtgtaacatctattatgtgccagagctggtgctacgtattttctcagttttgctttcaaatcatttgaaaactatccagttcttaagggtaaataatgaccagattcacaaggagtgactaaaaagtgaaagccaagatttaaaccctaagtccatgcctttttttttccttcagtgtaccccagtgcaactcactggaaaagacaaagtctcataattaagtggaaagcaagaaaggacacttttattactgaaagtgggagtgagg

SEQ ID NO: 47617 - DNA, 1041 bp, Bovine  19866881064622
tgtggcacgtcatgattattaatgatactaataaaattgcatctgaccagctctgccaaaaaagggttttgatgtggaaatgcaactaagcatgatctttcctggatttctcatgttttacttcttttcatatttctggtcagaaaagctgtaattgattttatttgatacttgcagatgattcttattgtaccgcagcctaaaaaactaaagattttcttctaaaatactggctattgttatttcttataaggtgttgtagtttaaagaatatgtttctttggaataaagtcagtccaaaacaaaccaatcaaccacacatatatacacacacaaattaagttttagaataaaaaaaatgaaactgtgataaaagctgtccctcgattaatgtgcagagaaggcaatggcaacccactccagtgctcttgcctgaaaatcccatagacaaaggagcctggtatgcttcagtccatggggtcgactcagcaacttcactttcacttttcactttcatgcattggagaaggaaatggcatcccactccagtgttcttgcctggagaatcccagggaccacggagcctggtaggctgctgtctatggggtcgcacagagtcagacacgactgatgtgacttagcagcagtagtagcagcagcagatttatgtgaacttatagactataggaagaattcaccatttctcccttttgtgcgtttttcactcagccattttttacagaataattttttgtcacaggtcttagtattggccagcagaaaacctatccctaaactaacagattacacacatacacacagctgtttcaacacttcttcacagtgaaaagctctctgacaagataccagaagataaagtgactgcaatgttttaacagctgggcattgagcacaattctggttgcatttagatctcagtagcacatcaccaagagctccctgttttctgcttatatttgtgcctcatattcaattagtgaaaagatcgtaacaagcaacttatttttctattttccttcc

SEQ ID NO: 47618 - DNA, 1254 bp, Bovine  19866881128512
taggagactgggaaaggtggaatttggaagtccgggaagggagggagcagtatgaggagcacaaatggaagggcctaagtataggaggagagcctctggttattccagggacccggaaggttttttcagagacacataacaccctccactcagcccacctcatcacttaacacctattcatggagcgacctctgtttacaatatacccagatttttgcaaattctgtggacaacgcccgcatcgttctgcagattgataatgcccgtcttgctgctgatgacttcagagtcaagtaaggctgggggtttaggaagctggggtcaaggggattttgttcagttgtgggtggagctgggtggatgagagtaaagcatcatcaatttattcttaatgtaactcagtgtgaagaactctgccccccaagtgccaggaatggtgttcagaggcttagtgcttgattcctgacttcaggtggctggtgtgcataaggctgcttttaggaggtggcatgggttgagaaggtttgggaccagaggcggggcccttctgatcacctccactccccgtaggtatgagacagagctggccatgcgccagtctgtggagagtgacatacacgggctccgcaaggtcatcgatgacaccaatgtcacccggctgcagctggagactgagatcgaggctctcaaggaggagctgctcttcatgaagaagaaccatgaggaggcaagcagtggcccctggccaccagggggtcaagacaagtcagggttggggagtagatggagcaagccacgtacaagaagacttacagggaagttgagaactaccagcctaagcacttcttaatcagactgttgccatgctcagtggttaaccggaattagagcatggtgaggtcaaaaagacatgggtgagaggatgagatgaggaccaaggtggaaacagctagcagtagaggtgagatgtgatagaggatggtgagggaggaaggtgcaaggaatagtctgtagatggagggacagggtgaagaaaggagagagaaaccaccacctgtgagcaacaggcatgtgtggttaacagtgggcattttacccatatggagtagaagcccagaattggcattgcccagagagcaaagtcaaaagattcctcagttctgttccccaactgatcctgtaggactcctggaagaggcagtcacagataaagaggcttcctagagctctgaccctgaaaccttcctcaacatt

SEQ ID NO: 47619 - DNA, 1046 bp, Bovine  19866881176850
actctctctggcagatgaggagctctcagcaagatgactgaactgcctccttactgctttcccaggctccggggttaaccccctctattctgatggcactggggaggcccaggaagcttagaggacattcccacccacacaatttcccagagagaagtattctgaaactgctagaaaggttatagaattgtcaagtgcatgaaatcaatgactaaaattatgactgtaacacagctttgtttactttgtgatactgtaaaaattttcaaacttttcagcagagtataaaaatcataaaaactacagaaataactctttcttgaggggaaaagaccacttctatcactagtcaccttgggccctgatgcttcaccaacatttgaagttcttcccagaggcttcttttcttccaggacaactcttatcaaatcttgaatgttgactcaaccccatgttgatggaaagtggaaatggcacgtggctaaatttgacccccagcccctttgcagtgaggtaaagtcatagaactggttatcaccaatggaatataagcagaagtgatgtgttacttctggactgaagaggttaatagtggttaccgtttctccgcatggtttctcttccccatctgctggcaggatgacacctcggcaacctgaggccacatagttaagatgacagagacacagcatgaacagatccagattcctgagttacttgaccacagacatccacactggattatgtgatactgaagtctttatcatgttaagatgctgagatcggggggttgtctgctacagctgttttatctaaagttacaaattaaggtaacaaggctgaaatagcaagaaaccaggcctaaggcaccatagaatttgcactgtaatggatgtagaaggtagaggagagcacttgggattcagaaattctttattttgggggcgtgctttacagcatgcagaatcttagttccctgaccaggggtcaaacctgtgatgcccaaagtggaagcgcagagccctaaccactggatcaccagggaa

SEQ ID NO: 47620 - DNA, 1600 bp, Bovine  19866881204625
gctccttgcattatgcccaccacaaggtgtgggggccaggatatcattgaaggagagggaaagatgaatctggacagttttttagatttctcagtgaaggagactgatctgtttttcttacagttatcgtctctgtggttaccttgcagatagttagcatttgcttacccttgtgttcattttatccactgctggtaatttcctggccttctgggtaggctcagtttagctggttggctcagctcttgccccaagatagatatttttttaactattgtggattagaaccttctaggaactgtgttgctgcttttagagaaaccaattctgtagatcttactggggagggtagttgaggggtggtgtttatacatatgttgtggaatgatatctatgcctaacagatttccatccccattgcacccctaaggcttttcaatccacttcttccactatctgaagcaaggacttttaagtttccaaaacatagctgcaaagggtaacaaacacctagcccataactcccttaacaacaggaggatagtcagtggggatttagctcaggtaaaatctgtacaatgcaaaaactcataaaattttcaaaaacagcttagcctatggacttgaccagattgaaagtcccacaatcctgggttcaagtcacttttggttaattcttcttgtgcttcaattccttcccttttgtgaaatgagaggcacattttcttgagatgtgcctcctagagatgacatagaaataaatgaaattagattttaaaattcttgctggaggaaatttccctggtggtccagtgggtataactctgcgtccccaatgcaggggacctgggtttgatccctgatcagggaactagatcccactttccaagactaggagtttacattgctgtaactaaagatcaaagatccttcgtaccacacctaaaacccaggacagccaaattaaaaaaaaaaaaaaaaaatcttgctggagacctagatcttgtaaattgtctttatctcttctgtttcttagttaccaatttaccaggagtaatttaacactaggactctctgccagggctaaaattagactccaccactctggggcttccttttctccttcttgcttttgttttgggagctggagggaaacatatgtgctgctggagttagtaaactaaagaccacagaaaacttttcctgctaaaaaaacattgttttcatcctacccaccttaatatccttttaaagaaagaacccaagtctgccctggattttgtctatttgattcactcctagatatggacctgggaaagcctaggaatccctggggagtgagagagagaggataaacagaattggaatggagacaagttaggctcttgattgctccagccagcctccctttcccagccagacaggctttctgccaccaaaactataaggttctctgtcacgtcaccaaagggtctggagttactcctgtggcctgacatcttttctgagggtggaaggcttcaggtatcggacacctttcttgtccaggggtctagggaaaaggatcaggcaaggagggagtcaatcttttccaactgta

SEQ ID NO: 47621 - DNA, 1148 bp, Bovine  19866881251910
cagaacctgcgggttctcctgggaagaggagctaagatcccacatgcctcatggccaaaacaccgaaacatagaagccatattgtaacagattcaataaagactttaaaaaaaaaaaaaaaagaagaagaagaaatacagaggaggggagaaaatcttcctacccggagaagagaaatttggtaatggaggaaatggggaacgtcctccccagaagggcaataaccaccctccagtaggtgtgcgataaaggtcagtaccatatccatcttccctcctcattatggccccagcgtaactttccttaagtcacaccaatccctctgctttttacattcgaagttttctcctggtaggaatgccttgcccagaatgaaggcaaggtgacatgaaatggagctcgggggaatataaagcacacggtaatggtataactctggagaatacaaaacatatggtaacaggtacacgcgttatggagaccagtctcaggctctgcacacgcaaacaggatttaataataagactcatttcataaggttgttgagtggattaaaaggacattcctacagagctcttagcatcacgtctgacacggaactggcgctgagggaatagtcacagtatttgtgggtacgcagcgaccttacccgcccgccccacacggggcgggagccgccccttgaccggccactcagcgcccggggcgcccagtgcggcgtctgggccgccacgtcgccgcctaccaccctctcgacacccgggtttaccagcccctacccggcgctaggtacccggttcaccgggccgcgcccggtccggcctgcgtccttcgattggctcctgaaggtgcctgtcgtcctcggccgctgcagattggccagagtgggtccaaaggggcgggtctcggggagcgtaggaagggcggggaccccggatgtgtgtggtggcggcggccgaagagctagtgtgcggagctgagaggcctatggatgaggaggacgcggcggccccggtaggcggggatcgggggcggggtcccggaggcctcgggtcggtctccaccgagcctgaggcgggaggcgggaggcgggggtcctgggcggaggcttcggagtcaggggcggggccttgcgctctggtctctgg

SEQ ID NO: 47622 - DNA, 904 bp, Bovine  19866881270791
aggctctgcctgatgctggggctcacaggcctgaaccccatccttccaactcccgccaccgcaggagagagatggacggcgatgcaggaggtgaccacgagagggcgtccagaggccggaaaccagcctctcaaccagtctccccactcggcaagcccgcgcccctccccaggctccgccctctcctccgcaggggcgccagcctggcccagccccggacccccgcgctcaccaccaccttcttgccctcgtgctcttgctctatctcctccccgtcatcttcctcttcctcctcttcctcttcttcctccccttcctggtgcagatacatgacattccggacattccgcacagctcgggcagtcggggacaggatcactgtgtcacagctgtcgtcgctgtcacctaagaggccaggacacctgagctcctgcggttctgcccgcagaacccaccctctgcccggccagccaggttggccacggacacccccactcaccctcactgtccagaatgtagtcccgggggaacatgattccacagcccattatgtcccctttgtaacagcgtggcccgaaagggtcccccacgccactgccatgaaagatcttcccgtcatctgttgggaggaggggagaccacacgcacctgcaggaggggctgataccctacacccccagagcccgccccgccagaagcccaagtgcccctccttccctctctggccccaaggaagggaggagagaaaatgagggccccagaagagagacacgtctgtcccctcaaagggctgagggggagctccctcaggagctgatcagagagcggagaagggcctggggggagggagaggtgggaccaggaactcaaggcttgtcctttctaaagaaagcccgcaaggaaa

SEQ ID NO: 47623 - DNA, 1027 bp, Bovine  19866881297463
tttccccactccccatcctcaggagcaggaatagccccaggaccactgacccagggtacaggcatgccagactgctcatgggatctgcattttgggaagggttcaaatctacccaggtttcctccttggttctgcaacaggatgggaggggtggttaaggccaccagtttgcgggatgtgtttggatgatttggggatgatattttgaccacagagaggaggttggatttccccaggccatcttggcttctctcacctcttctgctcatctgctctgggctcaggtcaggctgagggagtataaagtcagaagtggtctcccatctcccaccagaccaccccctccctgaatctacctacgtccccctcccctgtctgtgctgtgatgtatctcaataaatggaaattgcaactagctgtctggggcttgtctgtcctgcccagagagcagaaactgtcagctgattaactcagtgatggttaggcagcaacaaccacgtgctcacaatatctcaatcttgctaaaagcacattagttcagtaccatcaccaccgtaggctttggttcttactctcctcctggaggaagttggagggactatgtaagtagctcccagcaggacccagctcccagcagctgtctgttgctcagcccctcccctaatgctactgtgccccctgccagctctgtgggggcaggcagcacgtgttcagtggagaggtcttgggcttcacaataggtttaaatcctgactgtcacttactagctgaccttgggcaaattacttagcctctttgggcctcactttcctcctttgtaaggggacaacagagggtgagacagaggatggttggagggcatcaccgacttgatggacatgaatttgagcaagctctgggagttggtgatggacagggaagcctggcgtgttgcagtccatggggtctcagagtcggacatgactgagcaactgaacttcctcctttgttaaaacgggtgtgatggaaacatgtgtaaagcatttgg

SEQ ID NO: 47624 - DNA, 654 bp, Bovine  19866881318802
ctgtttcccaactataaaatgaagttatttacacctgcctcaccatggatgaacactgataaagattctgaaaggaggggaaaaaaacctttaaatgcctatgaagaccctgaaaggagaaaataaaaaaaagatgtcatttatccatcacattctatggttattttttaggaaagcacaacaatttctgaatccagtgcgttcctattctcaaccagctccactggctactagagagctgtgaacactttttctgccaatcagaatgactaggttacccaattatcaaaagcaaacaaaaaaaagttggctattaaagtactgtcaatgaaagaggaaatatcttttctggggaactctccatgcttgatggtgttctcacccccaaatctgatgctagatgctagaagctaggaagatagggttttggggtaacaaagaaaggaaaggctgatcatttgatcagtcaaagaaactagaacttgggactaggggcaggactggagaaaactagaagggaaagagtactcttctggcagtggtgcaatcacctcacagaactgggaagccataagtggctttgaagagaacaataaaccatctaagatgaccctgatactgcacaacagggaggctggcattgcagttcagttt

SEQ ID NO: 47625 - DNA, 1331 bp, Bovine  19866881364489
tctcttgtcccacttgtggccctggaggttacgatggttgctgagaaacaaggttttatttgagcaacagcttcccagaagatgtgtaggtctcccacttcctgagaaaccagattctgggcactcactgggaccctgctttgggatctggagtctaatgcttaattctgtttaggagaaactaggccacgtggactggaattcatgtgggacctggccagactcaagttgatgccaaacctgcagcctccagttgctcaagacaacaggaggttgacagggctgacccatcttgaaacccatttcagtggttgggcttctcagagtccatacattctgactgaggatggtgggcagaccagtgaacttaacctgttgggacataaaacgggcagttcccttctccctgctttttctgtgcacaagcaacgagaacctctttccagtcagcccttttcccatcttcatccttctttccatcagtttattcagacgtcagtattacagtgaagagggtggcttgaaatgaaggctttggaggatgtgactgaggcaggctatacaggcagcctgggcgggagcttttcctccctgcccacagggatcacagcacagcacacgccccttatccctcaacttggaagtcaacgcaccagccgtaaactacaggagctgttgctgctggaatttgcccaggaaagccacctgtttaactgtgctcccatctcccgccccacacttcctcttggctccaagtccccaaaattgtccactgtggtttctgtggcttttatgctccacccccttgtgaccttaaggattctctgccactgttctaacctctttcctgccttgaaacaatgaacagtctgtccctagctgtttggaaaattctcaccattggtgctttaaaagtggcctcagttgtaacctggaccaccctgtcaactcccctccgcctgcacagtgcagccaggagagcagacacagcacccgtccagactggagtgcaggtttgcagagacaaaacctcaaggacctgcagatgtagccctagagttcctgcttcatcttacgattaaaataaacagtacaggaaatgggatgcagatactctcaggtatggctcagaggttaaagcgtctgcccgcaacgagggagacctgggttcgatccctgggtcgggaagatcccctggagaaggaaatggcaacccactccagtattcttgcctggagaatcccatggatggaggagcctggaaggctacagttcacggggttgcagagtcagacacgactgagcaacttcattaaaaagttaacaccagg

SEQ ID NO: 47626 - DNA, 1477 bp, Bovine  19866881371105
ccacctgggggcaagagtcaggcgcatcatgaggctaccctatccctcttgccccttcttgcctccattctgccctggccctattttcaactgctggacaaagtaacttctctgatgctgtcatctcccacatccctcagagttgagagacccttggaggaaggaggcagggtgagcaagctgtctgcttggtcaaacctcacactctgaactgaccttagagggagactgcctgcccctctgccacaggacctcatgctcccccgaccctccccttaccaaggatgtttcacagagagcagagatcaactgccaaagtggtctctggatggagccagggtgactcactcaccagctgtgaggagagctcagggctgagccagagagggaagaaagaagagggctgccttattcccaaactgaatcagtttgggcgtttccccattacctgcctttttcttctttttttggccactctgcgtggcttgtgggatctcagttccctgaccaggggatgaacccaagcactcaacaatgaaagcgtggagtcctaatcattggactgccaaggaattccccattacctgcctttttaacagtcttttttgaatgagaggcctcagccaagctgtcatcgtctttgcggctccgggatttatcactgtcttttcggtggccctttaaatacaaatcaaatctaaatgcacagtcaatctgagaacacaagacaggaagccaaaaaggtgctttgagacaacttgtgaatcacctgccccagaggtttagagaaagtacgcatccatctcctctccaagtaccttggttttaacgagctgttgtacaggaaagaccttcctttcctgtaccctctaaaatacccatactcatggcccagctgtatcccctttcccacttccctaaacaaaagcactgaggactcagagctgggcacctcctggcagagagcttgggccacccgacccccaggtgccgcaatgggctcaagtgctgtacctgactcgagcacctcagcacatcagggctacctgcccgctctccattctcggcctgcttgctggcaatctggctcagcatcatcttcttgctggctgcagtgggaaccaaactcacacctgctaggccttcacaagccaggagacttgcctaagttgaaaggagatgaggtgtcaggtcacctggcagggcagggcaaaaacagactgccaatttccaaagaactaccttaaacacccagctactaacatgcggcttctctccaagggagcgttcctcctcaccacaaaaccctgcttccttcgagagtcctccctaactcatctcaccagggactagttattcattttgtcagctgtcagcattcagacacagactaagtgaataatcagatgctactgacgcttttgtcattagcactgtgctgggtaaaagggtctatctatacattactttgaagcta

SEQ ID NO: 47627 - DNA, 1612 bp, Bovine  19866881418551
tatggtttcagataaggcgcctatcaaccaaagggccccttctccccccgcctcggcccttgtcccctcactcttcgctcctcagctctgccccaatgacctggctccactttctcagggaaggtgccaggccgggttttgcagcctggggttgggagcgggttgttgctcccttaaggccccagggcccccagcgctggaggacgagttcctatatgctgactggctcctgggaggcattgtgggagcggaaggagggaaatcctggggcagattggcgcctttaagaataggagtcccctgggaaccgggcccgcccctgtttttggggaaagcttggtggttccttggccttagggacccttgacttgacttcttgactgcctttagctagctctggggtcttcccagtgagtagtttagcagaggcggaaggtccccagtgctctaccctttcctttgatggactaacttgctaaatctgatttcctcatctacaaaatgggctccctaatcccctaaatccaagaggttttgcctattcaggcatataatacatgtaagagcttagcagtgcttggcctacattaagcagtctaataagggtaaatgttacaatcacttattttttataattttgggacagaatgagctgaggaagaaagggatttacagagatggatttgctggatctgaaccaaaccctcaagacaaacttcttttccaagtcctcctaatttaaaagaagttccaactttgggttaattaaaaaaaaaaaaaaagcattcctctttttgggaccagtttgttattctttcttaaaaaattttctcttccaacatagtttaatttcatcctaaaatctggattcctccaacccaaggaacctaggacctttgtgttctggacacgaaaacaggattgtggattcagggtagagtagggtggggttggatgtcggagaacacaaagagagggctgtggggaggagggtcttcagtttgcagacagatttacctagtttcttgctcttagagatggggcttggatagggcttgcctgagatcttctaggccattgcagggttgaggagacctgggctcagagaagggaagcgactcaagatcagtagcagcattaggctaaaacctaggtcttctggccagtgccttccagactgtagggctgaagtttccctgtaatctatgagtctcccaaagccactccaaataataatcatgattgtttgatatgaaccatctgtatttctttcaatcatgaaaagtgttaatcaaaacttggctacttttactgatgtgtaatatacaatctcagtcaataatacctatttttttcctgaaagtataacttcaacataattcctagatatctacttccaaccatgtacccccttgtctccttgcagcccaacactaatgcagttctggagacccagctgcttggggagtggattaagggaaaacacagtgcttgctttgtgccagactttgagctctggccctgatgtgactgtggacttttctgccccatcatacaggtgcggcacctggagcagcagaacaaggttctggagaccaaatggaacctcctg

SEQ ID NO: 47628 - DNA, 920 bp, Bovine  19866881459570
agacccttagagagtgagacccagaaaccctctccctgggagacggacaaatcccaaaagacagacttgcagataagctcccctcagatcacacataccagaccatgcacacatacgcacaaaagaacgtactttgaagtcccttccggaaagacaaacccagagactctcagaggggacacaatgaccacatccctttcttccctcccctcttttctcttcccaccctccccaggcctggcctcctgccacacagaaccaggccgtacctgtttgtaccaggccctctctcagcccctttaaacaatgcttagttttccaaggagtgatttgaatgcaagctcccccctctccaacaaacacccacaccgagcagagctgagagactttgctttcctgagaccaaagggaggggtatgggcccggtgccaaaccaggcccagagaaggcggaaggagagagggagggactggtcagacaggtatggcagcccaggggagggacaacccagcagctccctgcttctcctcccccacactgtggtccacacagcggacctgggcacactcagaggggagagaccttacctaaagtcctcgcacagaactgcagcccagagccctcccctgaaatctcagctctcccacccccagccccagccacccggtcccctggttgcaggagtgccttttgtttaagatgaagacaaagcggcctacaaggactctgtggttttcaggctgtaagaaggcccagacctcacccaggggaagttcctctttgctggggcagcccagaacgatccagggtggaaagtgcttgcatctttcttgtcagctccctattgcccagagccctagccaacccctcccccatgcctgaaacccagacttggggtacaagagaagaggccagacctg

SEQ ID NO: 47629 - DNA, 1468 bp, Bovine  19866881468452
gagcagtactggaaaggcccttggggctgggatagggagaagggtgacccggaggaggaactcccctcccacagctaaacacctggaacacttcgaggctgagagctttacagacttggggtgagatgggcgagtgagtcaggggcccccaagatttacagtcagaagcctccaaaatccctccctatcccttcccctgcccaaacccaagtgcgcagaggggccaagtcactagttggaaggcagaatgttgccagagtgggtggggcccagcaggacactagtgaggggctggagatgtgcccatgggtggagtgaccaagagaaagggctgggatcctggtccagccccaggcactgccagccacgcagaggggagccctcaccttgtcgatgaaggaggcaaatttgttgttgagggtcttgatctgctccttctcctgggtgcggacggcctggatgttgggatccacctccagcttgagggggcttagcaggctctggttcacggtgacagctgtgatgccccccaaacctggggccccaccgtagcttccagccatgctcatgccggtgcccaggccgccgcgaaagctgctgctgctgcccactcgggaaaaggccgaggagctgatgcgggagccgggcccactggtgtaggagcggctgctgaaggacctgggggcagaggtagacaccttgtaggacttctgggtcaccctgatggacatggtggaggctggagaggaggcgaggaggccgaagctgagtaggagtcgaggagtcgaggattcgagaagctgcttctcagtggggtacagctccccgatggccttttataaaacagagcccagcccatgaggaggggattggccttgtagctgagtggctagtccctgagggggcagggcctaacctgacacctgccacctacaggctggactcaggttgggggcagcagagagctgctcccaccccggagcccacgcctgcaccaccctggaacccaggaaaaggcaactctgtgaatgtgaaagagcaaggactctgccagcctctacaagctccctgtaacaaagcttgcccagggctgcccagccactgcagccccaaagcctgggtcttatctccttccctcccgtgggaaataaatgcacgcactggggaacacggccagcaagggacccctggcatttgagtctcctctgagcagccgatagtccaaggacaccaccctgtgttctttctttcctccacttcgtgtgattacgaaggtctgcccaggctggacacttgggttccaaatcattgaacctgaggtcaaccatttgcctggtctttcctcagttactgctgtgccctcagcccctggtgcagtgccaggaggcactgggaaaatattcttggaatgaatgaatgaatgaacacacactgtcttaactatggggctgtatgtgaaagttaaagt

SEQ ID NO: 47630 - DNA, 678 bp, Bovine  19866881539394
ctttatctctctagcttagtggtaactgaaagctactaaatgagcactttagtaagagaataattcctacgtatgtttgtgttagttgctcagttgtgtccaactctttgcaaccccagagactgtagctcaccaggcttctcttttccatggattataacatttgagataatttaatatttaactggatgtattcaacattttgcttgcgaatactttaatccactttaattggaacagtctggctgcctggtcaccagcatgctcacagaaaccctgattgcttcctcaggtgcacctggaagaagcagagtcgagtctgaagcttctggatcgcaccacagacacatacctgctcctctccctgacctgtgacctcctacgaagtcgactctgctgcgctcgccagaaggtgcttctcactttcttgatctccgaaggtcctggggtttggaaggattttaggattctccagacatctgtctggctcctgaggtttctctggaactggggagaacgttcctggccctgagtagcagagccatctcctcacctcaccttctcccaaggatcattcaccagtacttctctaggagccattccaccattttcatccttttctagctctctcgaggacaaggggcaaagtctgtccggtgactagaaattgggatgacg

SEQ ID NO: 47631 - DNA, 695 bp, Bovine  19866881567636
ataaagctgttaatacagtgcctggcacataatgggtactcaaaaaaatgataactagtgttgttactgggtttccctagtggctcagtgataaagaatcacctgccagtggaggagatctgggttcaatccctgggtcgggaagatcccccggaggaggaaacggcaggccactccactactgttgcttgggatgtcccatggacagaggagcctggcgggctatggtccatggggtcgcaaaagagtcggacatgacttagcaattaaacaacaacaacagcattgttgttattgttgttgttattaaagagggtaggtttgggcaagagaggaaagagagggcgaggcagaaaggagggaaagagtatgccagggatcagaaatagcctgtgggagacgagaggagagaaaacagtctatagaacagggagcaaggggctggagccaaagacagtggctaataagatacaccaaggggaagagggtctgctgagcacctgagggcctggcatcatactggggtcctgggtctgtacttttccccacagccagctacctgcccaaacctggagcccagatctaccagtttcgctatgtgaaccgccagggccgggtgtgtgggcagagcccccctttccagttccgagagccacggcccatggatgaactggtgaccctggaggagactgatg

SEQ ID NO: 47632 - DNA, 1502 bp, Bovine  19866881570586
tttctggaagagctggtttataagcaccacctgtagctgggtgacccggggtatagccaaaggctgggatggggatggacggtggagagggaaccctccagagaaaccctgcagagaagaccagggaacaaaacccaccaggtccaccccacccccatggacactcagtagtttaataaagttcagaatgtccagggcttatgtgtaattaaagccaggagctgggtaattacatttcttctccgagttctacccttgacctgcttcctccccccacatacacacatcttttatgaaagacactgaactttagaaaatatctccactaaagagatgggcttcatttcagcaaaagaaattgagagtacactttgaaaagaatttcaaaggggaggtaagtgctagaacaaatgagaagtacaagcacacacgcacagaagtacatacccccaacaggaaaaggaaagcctgctcttgactgccatttcttttcatgtgtgattgacctccagatgatgtgtctcacatcatgcaccaaaatacagtctctctaaacaggacaataattcccccaacccctatctccaggaagccaatgattgttccccttggggtcatggctaccatgccagcagaagggttacacaggtcacaggcaagagccccaggtggaggcacctagcctggtgtcctatcccccaggccctccgtcttctgttttatctcaacctctttgtacctctcagcatccattctttgaactcaccctgtgaaccccgttctgggacagggaaagggtccaaagagaggagaagaagggctctggtctctggaatgtgagaagagagacacacaagacaggcgatccagacagaaaaaaagtgcatgtaagttaacagagtgtagccagatccttcaggtgccgatgggcctatggaaaggggagaggaaataaagagtgagactctaaagcaagatcagagaggagtaaatgccaggtttagaggctagaaggtgcaaagggcttgggaggcaggaggctgacgtgcccagtgggtatggagagaataagctgggaagacatcaaagatgcggatgaggagaatttaaatgccgagtacattcatagttataaatctttacaactgtacacagttgttttgcataaatttcattttattctcaataataggccacaggcaggtactggtatcgctattttatagacaatgaaattaaggcacagagaggctgagtaacttgctttgattcacagagctggtaagtggcagagcaagaaatcaaattgtgtgtatcaactcctgctggttctgcttcttgggcaagtagtaaaggagagactacctcccagagggcaaaagacctgcctcctggtgcccttctcagcatgttctgtgcaggagactctgggtaagttagtcaacttgtctaggcctcttgcgtaaacgaggaagtaatatcttacttctaagatagaaggt

SEQ ID NO: 47633 - DNA, 1494 bp, Bovine  19866881623692
cccccagacacctcactcctttctgtagtatctcctcccaccccagaggtgtcccaggaccctctcccacccccagcccagcccatacctggcctttgagaccctcgatctcagcctggagacggttgatgttccggttcatctcagaaatctccgtcttcgtgcgacgaaggtcatccccgtgcttcccagccagtgtctgcagctcctcatactgcagatgtgaaatgaggagtgagtttgagacgggactcctggtccctccaaggaaagagtaccctcagccaagtcaccagagcccaggtcatctcacgcccacctggctccacacctctgggcctggaacatccccatccctgtcccccggcacgacttggcagccccactcccagcaggcagagtttgaaatctcgcttctccctcaaggaaggactagcacccggaactacccaaaaggggagcaccaggttgagcccctgctctttaccttgatttggtacatggcctcggcctcagcccggctgcggttggcgatctcctcatactgggccttgacctcagcgatgatgccatccaggtccaggttgcggttgttgtccatggacaggaccacggacgtgtcagaaatctgagactgcatctcacggatctcctgtggcaggaaggggaggtggtaaggccctggccccgcacacaaggagtccccttctgtagaagggccttccacaagggacaagacagggcgggagagaaggcaaagttcctaaagaaggaagatgggtcgaagacctggaacttggcgggaagtaaagatgaaatgaggccaggctaaaaagaaatctggctttgggtgagagaccagaagggcagagcccttccacgctctcagctaccagtatggcggccccagagggctcccatatgacccaaaggatctatctaaaccctagggacagggcaggtctgaggtagccaggtcaccactctgcagtatgtatgatgaccttggacagtctctttcagttctctgagcccgttttctcatctgtgaaatggggtaataaaccctccctcattcagggagacagaacataaaggacatccatgccaggtgactaatggcagtcagaattattccgggttgggcccttgtctgttggtgcactggcggggctggaaggagcctctgatggggccagggaaccccagtctccggcaactaagaacgtacctcttcatacagttgcctgtagaagttgatctcatcagtcagcccttccaggcgggactccagctctaccttgttcatgtaagcttcatccacatcctgtggggtggggaaaggggagccagagctgagtgcccactcctgattccaagttggggcctatacttagaactttctaattgccttcccacctcagcgatccagtccggtctctgccccaccacacctgcattcccagcccctttacctcaccttcctgcacattc

SEQ ID NO: 47634 - DNA, 881 bp, Bovine  19866881682228
aggcttttaaaaagttctagtctagtaattgcctgtatgaagctacttcctacagcttctaagctttgaccatgtgttgcctaacttatgattcagcctaattctcactcccatctgttttcagtcatttgctacaaaactatttggtctatttaaactggctcctttctttgaaacctgtcgctgcatgtctgagcctgaaatccagaaattaattttaaccttctctttgatcagttcagggcactctactgtttatttctcaaactgtgggtctcaaactgcttttggtcttagtacccacccctctacactcttaaagaggactccaaagagcttttgcttattgtatctacttgtatttaccatattagaaattaaaatggagaaaattttaaaatatttcatatacttattttaaaataacagtataaatgtatctatagttttaaaaagttggggagaagaacatcaaatgtctggctgatagaaaacatccatattctcgtatctgtttctgcatttaatctgttaacaatatgttgtttggttgaagtatctgaagaaaacctgtgcttacacagatatgtaataggaaaagaaaagattcttttcagataactgttggtaatctttcttctttgataactacatcaaaatctgaaaagtgatagcttcttaaaagtaggctgttgtatagaatcctgataccacatctgtgaacttttaacacccagacttatgttgcctcttaacaggtcttttgcccatgtatgttctgaatacccatgaaccctctgggagggtctcaaggacctgtaaggatccctgaggccctctttgagaaccacacttaaaaatacagctgtttatcatgtagg

SEQ ID NO: 47635 - DNA, 1374 bp, Bovine  19866880692323
acatggtagggatgaggacagaaaccagctcacgtatctctgagacctactggccaggtagccgtgtcctccacatgcctcgcggcactcctggatcccccgctgggccgtccacgaggccaggggcttgccggcagacgacaaggcgtggatctcgcgtcccagctcggccttgggagggagagaagccaacaagatcaggggaagagaggctccgaccccggagggcaggggacagtccaagctcagcctcaaagacctacacccctccagtctgaccctaggtggctgacaactgcaatagcaggaacccagttttagcttaagaaacaggactcatctacacatgcataccctgcggtctagccacacagcttcctcgcactgaagataaaccaccgcggcggctcagtgggtgaaccctggtgggtaggctgatctgggaggaacacgcgtcatgactccgtttaaatgaagttcacagcgcgagcctgagcaacagctgtttaagctcccgtcgttcatggggagacgaggaggaaccccaagggatgggactgacacggcgccgacacgctgcccacacgctgcccccaggggagagggtggggggcagccccagagggctacaaagccctggccactcagggccccctgtgcaggcccggctcagggtccctagctttaacacacctagtaagcattctttctcttcaacatgatcctcagtaacaacagttacaatacaggcacgccggcacacacacctgttgcatagggtgatgtgcttttgcagcattttcagcttcacagaagcgctaccttgtaacccatgcctgggttgaactactttttctgagcttcaggaaaaaaaaaatagatcatggtgacacttgaaaacattgttaacaggacaattccattgtcagctggcaaaacttcagtgactcatgtttgagggaaaaaaaaaatgcattagctccacattcctgatgaaacggtccttggggtcacgtcagcctgactgtgcggctggctgtgcaccctgccagccccccaccccttcaccctccgcctcctgacgcctgggtgtctatgctggatattccaaaatgtgctaattcgatacaggcttttcagggcgtggttggtaagcccgccctctgtagcatttctgatgaattttcagatgcacttgcgctgtgacttttcgcaatgcccaggaggcagagtgaagcagaaaaaaaatcaacacgtgaggcgtccacacacagaaatgagcagaagaccctttctgtgcacaggggctgatctcagcaggtctgcacgctcgcatctggcacaaagccacgcctgtcagctcacatccagtca

SEQ ID NO: 47636 - DNA, 1332 bp, Bovine  19866880744032
ctctagtattaacacgccatggggatgctttgggaaaacgtctaaaaaatgctccttagaaggataacgaagacaaagtttcaaagaaactcaggtttaacctgtttccacccatcttccaggaatcagcccttcatcacctcctccaggaagccctcctgggttgcccgccatggctcagccctacgggcaccaccctggcgctgctgtgcccctggtggttccccccgctacccatggcctctgggctcatctgctccccgtgacgagcgctcagtgagccgcgtggaaggagcgccccacgcagctccggggcggggtctcacctcggtagagcagggcggtgtgctggctcagggaccacagggcgtagagggcgctgagacgccggagcacggcccgcagcgggggtggcacgcggggctggtgcgtgtgctcgtggaacctgcgcacgaccgtgagctccaggaacgccagggccaagggccggcagtggtacacctgcaacggcatggtgcgcgcgttcggggagggcacacgggggtgtgcgtgccggcagcgccccgggtgagagggcacagccagccgcggctgggcagcgcctctggggaaggccggcaggaacacaagcccgcctgcagcagctgctctggacctcgggcccagcgaccccgctcagctcagcgctacctgggacctgtgtgaccccacagctgacacagccaccaggggctcgcccgggtcgtcctggccctagggacgggggcgtcccctgggaggtgggctcccgagggcacaaggtcgcttctcttgcactgggaaccacagaggttttccacacgatccccagactcacctgaaagcaacggcagcccctcctggggcccggccccgccccgccccccaactttctcaaggaaacagcccctctctcccactcccatcacgtccggaacggagggaacggctccatggagggccagccgggttgcactcgcgtgtgagtcccgatgctggctcggtttgtggaagcaggaagtcaccacaggtcttctagcccccgctttttcttttttaaccaatagccaacacatctgctcatcattagctttgcttgccagcttttctttccccttctctagtttatcagtttactgggtttggttttttttaaattagaacaattacacatgcatttctaatttgttataatgagcatggttgcttttgaaattaaatcatccagcaaagaggtgacccgggattggggaggaaagagacccctattcaatgcctgtatgactttgccccagaattccttggtggctcata

SEQ ID NO: 47637 - DNA, 1945 bp, Bovine  19866880976977
ctggagctgccctggcctgggggcctagacccatggagaagctcccccgaggtccccttccctggtgcggtgctgtcccctcggttgactcgccatctgcctccaggacccgctggacgcggccgggtactaccagctggcgctggcggcggccatgggcctgggcagcaagcgggcccagatgaagctgtgcgcgcgcctggcctccatctaccaccactccctgctcgaccgcgagacgtccctgttcttctaccagaaggcgcggaccttcgccacggagctcagcgtccgccggggccgcctggcccccgggcccctgtcctgagcccagtgcttgcaggcacggcccccggctggcccagggtctcaggggctggcttcctgggaaagggacgcatgcggtcaaggggaaagcagcaataaatgtgtttttgtagagagccttctggagtccccaggctcccccgtcccgggactgcctcctggggagtgtgcggggatcaggccccgtccccggggggccgttccgctgctgcaccccatcctcgggtgtgggcgggtaggactgggggtccagccgtcccaggccagagtccccccagccggtcagctgcgggtcgtggggttccctgggcaccttctccctcccctataccctcaccgagtgtccagcgctggggcctctctgcttggaatgctcgaagcacacttcgaggtcaggactgtttgtctcctgatgaacggctgaagaaacggaggcacacagaggttaggtgcgttgcccgcagtcgcacagcaggtaggaaggggcagagagccagaggccagtgcactcacccctgcgccagcctgccagcctgcctcacatcatgtgccccgttaggacctgagggcagggacctaccccaaacatctctgcccctcgtctgtcacggagacaggagaagggattccaaatattcccccacctgggtgtcctccggcccagcctggccagtcccacctgcagcttctggtcagccgtcgggacacacggtggcagggcctccagcccaagtgacagccactgggtgctgagtgtagttgaaggcttatctggaccgcctaccccagccctgccccctctcccgtccctccccgtggcccgccgagggctgggaattcaggcagggctgaaaccggctcctgacccacagacagggtgctgaggctcggagcctgtgggcagccccacggcgcccttctgagattctcttttgatgacatgaaatgagcgtcgtgtgtgtgcccatgtgtgtgcttagtcgctcagtcatgcccgactttgcagtcccgtggacctctcgtagccctccaggctcttctgtccatgggattctccaggcaaaaacactggagtgggctccagggatcaaacccaggccttctgcactgaaggcagattcttcgctatctgagctgccagggaagcccacacatcacgtaaaacctaccattaaaagtgaataattcagtggtatatggtacacctgcaatgctgtgaaactaccactctggctagttccaacatctctgtgtccccaaagaagcctcctggaccaccgagcagtcatggcccctcccatctctctccccaggaccctcattaacagaaggaaacagagtcagaagacccctggtttgtttctgcacccaggaggcggagcctggaaggcccagagtcggggggaggtgggcaggggcgctccaccattctctggtcctggggtccagacccctgagccccaaagtcctctctctgcttagatatgcctgtatggctacccccgaccgcccaggcctctaccgccaggggacagcagagaactctccagaagcggcaggtcccagcagcagggccaacagacttccctgtaaccctgaccctgggctgccttctctg

SEQ ID NO: 47638 - DNA, 912 bp, Bovine  19866880981581
tgcccgggagacccagaaggctcccaggatcaaggaaggagcctctcctggagctcctggggagggggtggccctgccccccaccttggtctcagacgtctggcctccaactaggacagcaaacttctgttgttcaggccccggtttgtggggcttcgtcccacggccccaggaccccaggccatctcgcattccagttaccccttgaaccagcccggctcttcttctctcgtctccagcacaggggctggtatacaggaagtgctcaatcaatgccctgcccaatgcccggcatccgtgaatgagctggccctgccccctcactctctattttcctcacgtactcctaactcccctcgtctgctttccgctgcacaggcaccaaatttaattagagaaacagcttcttgatcactagccaaaaatccaaggcttgcccatggtgcgtccttccccgaatcaggccccgatgtcctacttcattacttgtaatgaaccctctcgtttaatttctctgtgatggcgaaacggtgccaagcctgcaaagcgctcggagttaactggggcgtccacacgacggagcagactcagccgtcacgcacgatgaatgcacgtggccttttctgtctcgcctggagagctcagggtgagtgacaggcatgggatgctgaggctggatctgaattcgcagaataatccaggtgtgtggacccgtgtttgaaggagtgaggctccaaggagtgagtcacaagttattttcactcctggtttcatatggcctggttttaaattattgagtggctggaaagctcccacaatgaaatcatatttcatttgtttctccatttggctgttaagtgaatcaatttctgggctggttggaggtaagaaaggacagagaagcccgcacag

SEQ ID NO: 47639 - DNA, 1750 bp, Bovine  19866880995736
gatggtcagaattgtctccagatgttgcccaaagcccggggaagcaaaatggccttggttgagactggcagagagtgtgcgtgtacccggggtcacctgctaggtgagggcccagggtggcttgatcagggatgggtatggctggagtggcagagcggagggccggccaggagcccaaagcaggctgggggccgtgggtgggaaagcaccagtcacctggggaccaaggcactgccaggggcctggttccaacctgggctgggacccggacccggagtgcaggaggaggtcagagtgtccggcgtccgagattcggcacagaagaagctcagaggctaggctggagggctttctggaaggggcgttatggcaggcgagcacttggaggtcaggcgtgggggcctctgacctctctatctctgcacctttcctaagggggcacggttagggttagagttcacccgcccatagaggagggcagaggggccaccagagctcctgccatcacggcaccctgcggcccagggaccctccctctcaggacagcccccagtgcgaggggcctctgtccgagtccacacatgcttgccgaggcctggaagcccatctctgggaggcggggcctccatcggttcatccaggtatccctggctcgcggtccggactgcatgcagtcagcgctcaatgcatgcaggaatgagcttcagggtttgttttccacatggtcacatcggctgttgtgtaatagcgtcctccttcaatgctggacgctcccctctgtcctgcccgctgtccctgccctcatggcatgggcctgacgtcccagtgctgcgggcacccgcagccccgcgcccctcgcccgggaggatgacgtctgtgctacgttctttccaggttgtgggggctgcggagcccgagatcaagaatggccagtccttggtggccttggacaaacactggcacctgggctgtttcaagtgcaagacctgcggcaaacagctgaacgcggagtacatcagcaagtgagtgggcggggccggcccacctgcggcgtggaaggggcggggctcctactgtgtccaaccggtgctcttggcctcagcctccaccccaagtctgcaaggcgagccccgccaggacaccaggacttggcctgtctgtcccaaaacacttgtcctgcccccccaccagcctggcttccctgacacagagacgctcatttctgttcaatgagccatggcgttagggctcccgcctttgacctaggggcaagcgccatccctgggtgtcgccctccctgtgggacctgccaccctcgctggtgcccggatccccgacgagcacaaagtggaggtcacccgaggctgctggccacagagccagggagggctgacaggctcaggggtcatgggtgcagctgtcctctgctgtagtgctgatgtggggtccctgacgggtgctcaggatacaggggtggctggtttggggtgcgtggggagggagcttgtacagatcagggtccgagcccctgctggttggccaggagggggctgcattagaatccccagagaccccagggacggcaagcctcccggcagcacaggggaaggaagggtcgtggagtgagctcacggagcagcttctctgagggcagagcggctgtctcctgccagtcaggggcgtttgggacaacttctatcaatggctgtgctggttcgtgatgctctggggaaacagaaccatcacagga

SEQ ID NO: 47640 - DNA, 1808 bp, Bovine  19866881055140
ctttctaacgctgctccttttcccctgcagtgtcggagccgcaggctgctcccagccccccggcagaagccgcccagcacggcgatcctgtgtaacacctgtgggaacgtgtgcaggggcgaggtgctgcgggtgcagaacaagtacttccacatccagtgcttcatctgcaaaggtgagcatcccggccgtccccaccgcggggccgggcacagcgctgccgtgcagtgagcccacgtccccagaaactcgttagatctgggctattggagaaactgatccccaaccttcctataccgacgtgatcttttcagcatggcctgcctgcatgccttctggggctgacaggagttcctgtctgagggggcagtgggtcagaggacgagctctggtcctgggtagcatcttcgatggctgtagccgtgtcagaggattcggatccactggccaaagtggccacctgggcccagagccacgcagtaagtggccattgctggaggcgtgagctcggcaccttggggtgcacggggccggagctggaccacgaacctcaggcacgccccatcctcaccggagtgagactgagaacgttaccacttgctccaggtgaaaatgactttttatctggctatacaaagtgacatgtatatgcactaaagtcaaatagataatttgatattcaaatatcagaaagataagagtaaaataaatcacatgaaatccccctgtttgaggctttctggagcatccttccagcctgcccttcctccctgcactgaagttagtgcatattctgtcgtgcccaaagggatttcgtgaatttacatttagtttcctgaaaacagggcttccctgatacctcagttgataaagaatctgcctgcaatgcaggagaccccggttggatgcctgggtcgggaagatccgctggagaagggataggcttacccactccagtatttttgaccttcccttctggctcagctggtaaagaatctgcctgcagtgcgggatacctgggttcgttcgattcctgggttgagaagatccctggagaagggaacggctgcccactccagcattctggcctggagaattccatgaactgtatagtccatggggtcacaaagagtcagacacgactgagccactttcactttcctgaaaagaaatgaaaagtagcatttgggggaagggatggacaaatcaaaccaatctgacacagcgtccagactcaaagaatttatacatgcgtgctaagctgctcggtcatgtcccactctttgcaaccctatggacagtaacccaccaggctcctatgtccgtgggattctccaggcaagaataatggagtgggttgccatggccttctctaggggatcttcccaatccaggaatcggacttccatctgttatgtctcctgaactggcaggcgggctctttatcgctgctactgctcagtcgcttcagtcgtgtccgactctgtgcgaccccatagtcggcagcccaccaggctcccctgtccctgggattctccaggcaagaacactggagtgggttgccatttccttctccaatgcatgaaagtgaaaagtgaaagtgaagtcgctcagtcgtgtccgaccctcagcgaccccatggactgcagccttccaggcttccgccgtccatgggattttccaggcaggagtactggagtgggtgccattgccttctcagtctttatcactagcgcccccgggaagtccatgtagttttaaagatttcttttagtgaccctgcaaccccaccttacctctgggcagca

SEQ ID NO: 47641 - DNA, 1261 bp, Bovine  19866881368218
cggtgggactcttatgctggaggggagacgcagtcctgtcaccagcggggagaaactggctgggccaggggctgtggggcagggatgggatgggaccggcatgacccatcccacctgggagtgtcactacccaatgtcacttctgttgagtgacaagaaggagatgcagcgtctcgatggcgaggagagagcagtggtgtgcgctcgagggagccagctggctgggtgacgcccacaagcaggtgggacctccctgggggcaggcctcagccctgcttccctctgctccctgctgcctccccaagccccgggctgtgtcctcaggggacctgtcccctcctgtctgttccttctttaattcctgtgcgcatccaccctgtgctcctggactcccggggagcttgttgggggacagacagggtgggcaaaggagccaaacttggcgaattggcagtgggtggggggatgtaggcaggcgtgaagccaaggaggggacccccgccccaatctgtgcttggggaaggctcgctgaatggtgaactcgactggggcgttggcagcttggagctttacgtgtgctttactattcgcatgttggtcatcgtcttccacagggaggctcttctttaagccataaggcccagcatatgcttttttttttaaaatggggttccccttgccacacggaaataaccttccatcagctcttacctatacctccaaggtttcgaacagagaagactgaacgtgtcaaagagatgaagactccagtgtgcggcagtctctaacgtccattttttccctcgtgcaggaattcatcatccattcccccgattttgaagctgccaaattctgggttggcaacatgggcaagaccgctacccacgcagtggtgtttgctcagctgtacacgccggggggccagtgccacgggctgcacccctttctcgtccaggtaggggcaggtttcacccctgggggtggggaggtctggccacgtccagagatgtttttatcacagctgggggcaggggcgcttctggcatttcggggtgcagacgcatggtgcatacaggtcaacaccctggagcgcacaggacacccggcccccccgcccccaggaagaacgatcagccccatatgtgaggtgctgcctatgagaaaccccaactccaagctcatctcggggagagcctccatcctgctggatggcaatgcccaggactactagcagcggtactgaggggctgcagaagttccg

SEQ ID NO: 47642 - DNA, 1299 bp, Bovine  19866881426710
cccgccggagtagtgagcaagctgggcaggcaggagggggagccgcgggctgttctgcaggaccagggccgcgctccggagcgcgctgcccagcgagccctgtgcccgcagcgaggccaccctgatgcagctcatcgccaggtgcggcaagcacctttggctgtagatgcttgccagcagcaggtagcagtccatgggccaggaggtgcccggggtccccgctgcctcggggagcagcagcagcagcctctccaggaagggcatggcctcctccggctgcttgaggcgggcgtggtgcttggccagcaagaaacaggcccgggcctcggcctgcgggctgcggctgctgatggccctccgcagggccagggtcaggaggctggaatcagcctcggagctgcccgacgtggccgggcgtccccaggagcagggccaaggccttgggcaccacctggaggtgcgcacttctccttgttcttctgccgcaggtggactgaggccaggctggtgtacacagccgccaccaggaccaggtccccaaagcggcccccgagcacccccagggcttcctcgaagtacacgcgggcctgggacagcttcagctgccgcacacacagccgtcccagcaggaagcagagcctggccagggccatgggcagcccagcttttttggccaccccacgggcctcagccagccacctgaccagctcctcctcgtcggtgaagccgccgaacacgctgctcagcgtgggcggggagaggtcgtacaggccctggaaaccagcctggaatcccggtgagtccaggaacagcagctgcgagcccagggcctctgggtcggcccagtcatctcctgtgtccaggcagaagaagggctcctcggtgtctggcaggcttgcaccactggacgccctgtggataccgggggaccctggttcctcggggcagccccggcaggacttgcattgttctagaacattcttcacagtctgcaggatctcctgtggctctgggttcaggcaaggtggggacatttctgcaaatgaccaaaatgcccggatgggtgagagtgggatctgagtccaggcagggcgggggcgtctctctcctggctgcagcgtccctgttgcctcccccataaggcttccctgggcatctgaggttgccgtgggctgctgggcacactgcagggctctaggggtgactttccgggaggacatggaggaggttagccaagcttctaccaactaacatgcctcaccgagtcctctcctctcggccacgtgccggaacccaaga

SEQ ID NO: 47643 - DNA, 1145 bp, Bovine  19866880659831
aagggaatctgaacttagatacacacgcagggaaagcactctgtgactataaaggcagaaatcccacttacaagccaacgaatgacaaaaacgccaaagatgtcagcgctccaccagaagttagaggagaggctgggaacggattctgaatcacagccctcacaagcctgctaccactttgatcttggactttcagcctttggaactatgagaaaatagatttctattgtttaaaccacttaatttgtagtattttgtaatggcatccacagaaagctaacatgatacccaaagaggtgttttgtgttttttttttttttaatagaaattcacattctaaaaaaatgcattaatctgttcaaattataaatatacactcagaaatatcctctaaataaaacatcctcagcatgacactacataaaataagtttaggagtttacgcacaggatagaatcactcttattacactgttttctcctctctaccgttttgaccaagaaataaacaccaactctagatagcagaacaattgtcatgaaaatgtctcatgcaccttcctatatcttacactgaagtgcctcccaaaaatctattgcaaacctcattagctgacgtttttccctctacatggggagggatgggtaaaaacaatttcagtccagtgttaaaaataatgatcctaatattcagaggtcatcatgaccataaccctgtcttagataaattcacctagaacttattctgagttttatcccagggaaagaaaggactgtgtaacacttagacctatctaatagtggatctttcctcctcaaaaagcacaggaaccgttacagcaaagggaggttgaacaggaactcaaacccaccaggggaactttgaattagctggcaactaactttcctctaagtctaaggtttatagttccataaagaaaatttaaatagtactgtgcttttttagggtggggggaagttaatcatgtttcttaaggacaaaagtttcctgtaaacgaatgccagttttcaaaaatctatttcgtttactgtgcaaaggccagttaattagtgtctactactgctaatggtaatgacattaacagcataatcaacaacacaagcttcagttgctacctagcctgt

SEQ ID NO: 47644 - DNA, 818 bp, Bovine  19866880886771
tgatgtaaattctgacgtttctacagatgactaaaattctttagtttattcagtgggagatgagtgggcgtaggaggaaaaagcaacatcaaataagaatcaatttctgtaatagagaaagtgaatatttgggtaaatgaataaaatgaaagagcaatctctgaataaaaaaggacactctttgcatttataaatgagattgagcttataaataaaaagatacatcacacagtaaaataaaaacagcttttctttttgcagctggtagctttacaattcaatacagtagttttcacgtttttttttatgaggactctttttagctgtccaagattttgtagatatctacaactactagttaattgtacttgtcaatgtttgtgaaatgactaaagctacttttaaattactgatgcttcaaaatgttaaaaaaaataaaaaataaaaaagaagtcacagtagtataagcacaaagagtggtacatatttaggaagctagattaaagagacatgccaggcagtcgatcagaatgccggcctacaaagggcactaaagcaagactgaaataaaactaggttgcctgttgactcagattaaatttgacttgttaaattctcattgaattgtaaattgtccctatttctctgcttgaagaagataataacagcttcaggtaggaattttgtaactctcttcaaggctccctagccccacttctacttaacagatgttgttgttgttcagtcgctctatcacgtctgactttttgtgagcccatggattgcagcacgccaggcctccctgtccatcactaact

SEQ ID NO: 47645 - DNA, 2400 bp, Bovine  19866881058230
tgtgtgtgtgtgtgtgtgtgtgtgtgtgtggctgctcctgctcgtgtgtgtatgtgtcatggtggtggggacgtgagggagagatatgaaaggttacgatacaaaagaaaaggattctctcccctttctcttagccaaacagtttaggtttaactgcccttgtttttgttggacttgaatagaaaaatgaggtattttaatcttctttttcaaaacatacagtcttatggaaatttaagtcaacagctgttcaactgtcaagtcacaggctaaattcaagtctgagaagagaaagaaatctgtttaaatgaaatcgtgtttgaatgaaggccataggtttccgcatttgtatctgaaaaaaaattaaattgttactaaagtaaagaatcttttcttgggatgacctttctttgttgaaaatgttagaaaatcaatattcaacataaaatcagaaactgaagtgtgtcaagtgtgggatcaccagaagtttgagggcattgaacaccataaactcatgaactcttcaaggtcagaggtttgacctaatacaatttccagtgtataggacgtgttctagaaaaaaatgtttgttggcctagggaacaaaaggaacagttaaagaaatcaagtggtcatttttcccccattttctaaaagtcttatataactgagttctactttagaaagattaatgatagttggcaggatatatagttgtgtgaaagataggcaattattatttgaatgttttttaacagttcagaaaattaagatataagctcttggtcaagagtgggaatagcctgtctcattatgatgctgattaatggattgattatttttctccatatatgataaaagcctgtgttcacgtgtgttttgcttgaaaaggtatgataagattatgtgagtttttcccagagtagactggctgcaagtctctgtatcctataaatgtaatgaccttgatgaaaatatactgatttaaacaccagacattagatttgcagatgcagaaaatcaatgatgttaatatactaaaacgtattatactcttgcaatgattcatactaaagagacttaaggagaactcgtatataaataacatggcaatgtataatttattatgctggtggtttctatggccaccttcattgtagatctatatcacatagacagagttggaatctgttaggactgtagtcattcctgttgagtcaaactctcagatcccttcagttaaatgacactctgctcaaaggtgttctccgtttatcactgctatcttttctgtttaaattggtcagtgcctcatgtgcaaggcttagtggtttttttaccctgtacagtactgttctccccagtgtttcctgaagccagatctctaccacactcttacctccaaaactttcccaccataatctctagaactgtctatctggcatcatgaaaaagccctatccttagcttgctcacttctttgccatacatgaaacttgaccctcagcagaagatagcactgtaacccgccctgttaaatgctatctgctcattttctcacacctgtagtcctgcatagtgaggtagtattaccatgctccatactctctacagtaggacttctagcaataagtactccaatcttttataaaactgatgttagagtgtgcacatacactctatgcacacacagtttcaactcacttaaaacttacatttcactgtacagttatcaccaccttatatcgacagcatcaacaaaaccatctggctcagtccctgttatttaccaaaacttttggtgactgtctcattaactttgtctccacccaaatcctgcttttccatgaaattaaaagacacttgctccttggaagaaaagttatgaccaacctagacagcatattaaaaagcagaaacattactttgccaacaaaggtccatccagtcaaagttatgttttttccagtagtcatgtatggatgtgagagttggactataaagaaagctgaaggccaaaagaattgatgcttttgaactgtggtgttggagaagactcttgagggtcccttggactgcaaggagatcaaaccagtccatcctaagggaaatcagtcctgaatattcattggaaggactgatgctgaagctggaactccaatacgttggccacctgatgcaaagagctgacttatttgaaaagatcctgaggctgagaaaaatttaatggaagaggagaaggggatgagagaggatgagatggttggatgacatcctgagtctgagtaagctccaggagttcgtgatggacaggaaagcctggcatgccgtccatgggctcacaaagagtcagacagactgagcaactaaagactactcagtaaatcctgcctttatcat

SEQ ID NO: 47646 - DNA, 658 bp, Bovine  19866881082712
cacagacattctgttactttttactcactgaaagctgaggttgattggaaaagaaaccattcaggatagagatgagttttaatattatacctatccctgaaaccaaaataagtcagatgaaaatattttccaacataaacccatactttgtaggtcaggatagaaacctggaagcaagaaaaagtgctttattctatttaaatgaaatgttttctgagtttaaaaattttcatcttttcctatccaaatctagttataccttctaaattttatgctgctctttctaacaaaatttctatgttgatgatcattctgctgctgctgctgctaagtcacttcagtcgtgtccaactctgtgcgaccccatagacggcagcccaccaggcttccccatccctgggattctccaggcaagaacactggagtgggttgccatttccttctccaatgcatgaaagtgaaaagtgaaagtgaagtcgctcagtcgtgtctgactctagggaccccatggactgcagcctaccaggctcctctgtccatggaattttccaggcaaaagtactggagtgggttgccatttctagcaatagcaattattctctgcttggtttgggttgtccctttgtactttgattttcccagataaaagaaccccgta

SEQ ID NO: 47647 - DNA, 1587 bp, Bovine  19866881116798
tcccaaccccacctagaagacttgatataatccacagattcatcgagtggtttatgctgaagcacaggtttgctcagtatgcactggcaaacacagatgattaaagtgagggaaaaaaaaaattttttttcaaatttaagataaaaaggatttatgttaaagttgcttatcctactcctcttttctttggaatcatttccagtcattgctgggtagagccatgagaagaattgattatttaaataggactttatcttcagaggttgcacttagggcaagatgaatattgaatatctcggtaatggaagctctccccatgggcattagagttttctttcaaagtgggttaagtgccatgataaatactctgagtacatactgcccactgtgtttttaaaagatgtgaacaacttgacatagaaaaccaataatacacatttgctacagattaatgcatttcaaccctttccaaggcctggatgcatcgcatgctgcttgaagagagtctcagtgatccacactgccccttttctcttttccttcctgtacaggttgttatctgggagaagatcacatacatttatgaagagaataacgtatcagaaatgggaaactactcagagaatccagtctcagctgttcacatatgtgctcagtttctgagtcattctgagtctcaggaaatgggcaaatatctttttcacagcaattttcagagccatttgggagcatctgagaggcaaaatgctattgtgagcatgcatgggaaggtcaccttgcagagagttagaaatggtaactttgaataaaactaaagaaggatataaaggaggaactggtttgtgttgtgtatggcatttatccctttccttagaccagcagataattttttttcaagtttggggaaatactatatttcaatattgtcaagtatatttatcaacatatttatatgcatctgagtaattcacaatgatttcccttcttccagacactggcaaatatagataatcaataatacccaatgactacgagcacttttctcaaaagactgtcctccattttcaacagacagcttgtcaaactaccaacaggaatgttcagtgttttagaaacagtgcttatgtgactattgcagattaacacgttgtaggtattagtgctattagaaagttgcaagggctgtagtattttttccctaaagagaaggcagtacaacagaccagggcccatccaagctgccatttgcatgcataaagacacttagcagctactttttctttatgcaaacccaggattctcagtattaagcagatatcttggggataacgggaataatttaaaatactgttaagtttctttaatacaaaacagaatggattttgagcagtaagaatatatatatgtataataaaataattcaaagatgattagaagagtcacgatttataaaagttaaaaaaaaaatgtataaaaggtcaacccctgaatattcactggaaggactgttgctgaacctgaagtttcaatgctttggccacctgatgcaaagactcagctcactggaaaagactgatgttgggaaag

SEQ ID NO: 47648 - DNA, 1867 bp, Bovine  19866881164998
gttgcttcctgtcctggctattataagcctccaattaaaataaataaatttaaattaaaaaaactgtatatatataatcatttattataacagaaatatctcaacaagaaatgagatacttgtgcatatacgtaatttattccagaaatttgttactcagcaatagctagcaattccagaaaacaagtcagaatggctattgaaggaatgtctcagggcaattcaaactccagttgaagaagtcggtattcataattgtttagatcctctgaacacttatattttatctttagttcatagataaacaatccaccagaataatatttatggcctgtcttcttaaatatcccattttctcatgtacctgtcatcactattgtgctctttaaaaaaaaaaatctaataatgttcttgaagctgtatcctttctgtgatatccacagtgaatcaggattcaggatcctatttctaatttgcagtcttaatcaccagaaaatgcacaattgcttaatggagaatactagattttgatatgaacatctgaatgtcatcatttcagttttccctcattgcctggttcccaacaaatgttacagattctctgatgtgtgtagtacccagtaaatcagtggtgtggcttactttatattggaaaggctacattctctctgaagtttcaagagttgagctaaatattcgatttttacatttgaccctccaaatccaaagcagtcttaaaataaatgtgaaatgaaacaaactaacaacaatacaaacaaaaactttctgggaaaaataatatagtggattaaaattactgagtgagagcacacattcctggcctcgtatatagcttctctttcctctactccagaacacacattcctttcagcataaatctgtctcctctggttgaggaaggatttagtctccagagcccagaggaaatcctgttgaattttagaacctgaagggttctgtaaattccaaacagaaatttacacccctcagccagccaatggtccatccggtagagcatcctgcttcctactgtgtctagtgatggatggtttaggagatggccaaaaatgcaccatgatgcacctaattgagaattattgcatcgccaaaaaaatttcttctttaactctggtggttggttagtttatttcacgatgcctgaggcctgataactatttatctctatactccagttatagagaaactcttattttcccttagaacaaacacactattaaatttctcaaaagcatctaatctttaattgaatcttattaaccctctttctgattaataactcactgtagagtgagcaagtaatcacattccaccttttagcttgacttaaaaacttccaagccaaattgtatacataaaatagctgtctctgtatattataggtttcttaatataatacttcttaaaaaaatagagcccgttggaagtcaacattaaaaatgtactcttgtaattaggcacagaatgtattattcggtaattaacatacaaggagaaaaagttcaatgcgtgacttgtgaacatttcagatgcagactgtattatttgcttagacctttcagaaaccccatatttctttactaggagaaaattgccactgagctaaactacattaatatgaaatatgtgtaacaatgtccttgcttggaaagtactaacaacgtgttaacagttttccagggcactgtggacagtggtttttttttttttttttgacaactaggctgcaaaccactttatgcaactctatatttcttccttaagctgctggtgggaaaactgttagtaaacaatctatgtcatcaaaggactcggcacactgtcatcg

SEQ ID NO: 47649 - DNA, 1370 bp, Bovine  19866881237151
tttcttactctaagaaactcattcatgaaacctgtatttgcagcttagccttgatttgatttttgatgtcaaaatgaggttccttccgttcaggagttcttcctgcaaattccatacaatgatatgtgaattttatgtttaacatggcacttacatatctgggatgtcagcttgccagcaaaaacccaatatgaaatcttgagtatatttaacttgaatcactcatggctgatgcagtgaagatctcgggctggtgtctttaatcaatggttatgaataacatgctgtatcatacttcagtgtaactcagttgaatgccgaagaaacccaacacagcacaatgcattgtgagttgctcagcaagctccaggaatgtgagagggtgatctgttttgtgcaacatgcggtccttgtgtgtgtgatatttcatgtgtttgttgttggtgtgcaaacctaaccacaggagaggtgcacactgggcccatgagaagccttcggatgagaagtgtctattgcagaatttcaagtcacaaaatacaactatctgtaggttaacatggtgaacaacacccaagtcagaagttcttgatttagatttccttggtaactagatcagaactaggatagatacaaattgcttttacagaatctcctcaaatttcacccattttccctctctgtattatttttccatttccttttgggaccaacccgcagcattatccccttataatttgatagagagaataaatcattctaagcaaaattaagtggtgtaattctatgtactgtaacaaagcacagttgttaagactcactctggacccgggttgacttggtttcttatcacttttgctgtgtgacttaatagagaacaaccctgactgcatattgaatctgtccctttagttctaacctctgtgctctgcttcctgtgcttagtcctgctggctctcaccttttgtaaaagaacgttgcctataacctgaaatatatatgacagcccactctcaagtctctaacctttaaaggtaaggaaagggaattggcaacccactctactattcttgcctagagaattccatggacagaggagcctggcagtctacagttcacagggtcacaaaaaattggatacgactgagcgagtatccacaacttttaaaggtatcacaattttccattcagatggagataaaaaaaattatagaacagagaatgatatttgtcttactgggtatttacaggaaaattgtgataagacctacatggacagctgcaagaacaaaggattcctgcacaaaaaagtttgcaacaaccagtcccaccccttccccttttagtgtaaaagaagcctgaattctaacttg

SEQ ID NO: 47650 - DNA, 1468 bp, Bovine  19866881323207
tggttttggggcttgagtatgtctcaggaagagacaggtttttttttttttaattgccccagaatatttctggtactcagattgaacgtatgcccctgtattgccaggccttgtttagaggagtagggacagggtggctttgtaacactggccttttcttctccatttctgctgtcgttggagtatattctttgcagacttatggcttcaacctgaagatatattgttcactagtatccaaactcttggtccacatgcgactcccctttctgttgcagttccaaaggatggggtgcttgcaggaactttgtaacatgggcttacttctcccgagccacttattttttattcctcttaattttagattccttttgaatgtccccccttgtttgcctgtactttcttcttgaaagcccctctgctaatagtgtcaagcaatgtcgtttccaatacatcatgccctttcattcctttgcaggagaactagggcgagaggtggttagcaactgttaggctccagccattggaactaaagaaagcaactgcgatgctgccatgaaggggctttcaccaggagcatgtgcgcggttgtgagcaactgtaagctttctttaactcttaattacccccacacaaaaggcagtgtttgctctcatgtgcatgggatttgcccgcctacttttcatgagtgttaatgggggtctctgtgtataaatcctcttccctgcccccagtatcaacggtggcctagatgccaaggggggtttctgcagttttgctcactgattggtttcagatggaacacaaaagcacatctctgagcgtgagcacgctcaccctccacgcactctgtgcttcaggccttattaacactcatgggattgcttgtctcatttgctgtccctggagtggccagaagcgcccctccgctgtgccccacttcattccctcccaagccattgaaaagcactgtgatttttttctcacatcagcttgacttactctattgtccttgataaatgtacatgaggataaggatcagaagcaaaaaaaaaaaaaaaaatcacaaatccctctcccttagattcccccaatactcagtgatttcccttcatgtcctccaggtccccagttccgcttagatgtcctaactctcctcgggctgttcactgagcagtgatgccatcttaacgtactcttctgtcgccaaatccacccttgtgctttccaggacactcatgcttataccctaattagttccagggttcctggaatcttcccatcctcacccaaatatttagctctcagtttgtcagactattattcattactcgctaggacctgaccagctttccattaaccatacacagaactctctccactgtcatttcttgaatctgacctcctacatgcaatgcttttttctttctttgattttggtggggggcttaaacctgagtaaacttat

SEQ ID NO: 47651 - DNA, 581 bp, Bovine  19866881436514
gtaatccgtacacttaaaaaaaaaaaaagatgaaattgggggaaatgtaccatggttttcaattgctttcaattaccattaaacctttcaaagaatgatttgcataatgtttcataaacatgtaggcagattaaccttttttagttaatttattcattagcagtaaaaattcaaagcaccacttatgagaaaataatgtcttgctgttaaattacatggaaacaaagcaattgggacatacatgcctaagttcacactgtgtcagagcacaaaaaaaaagtggagaggggataaaaaacccacaactttgcctgttagtagagtgttgattaaattgccggtttgtgaacaattagtagcattactagaagattaggtgaagtattaattagagtcaggccaaatggtttctgaggagtaaagatacttcctacgctgtgctggaggtaatggaaggcagtcctgacgtcctctcacctatggtctgtagtaactgccggaccctcttgctcagggctgagtcagggtgtacatgtgtgtgctgtttggaaagccgttttttaataccctctggctaatta

SEQ ID NO: 47652 - DNA, 1548 bp, Bovine  19866880195713
tatggatgtgagagttggactgtgaagaaagctgagtgccgaagaattgatgcctttgaactgtggtgttggagaacactgttgagagtcccttggactgcaaggagatccaaccagttcattctcaaggagatcagccctgggatttctttggaaggaatgatgctaaagctgaaactccagtactttggccacctcatgcgaagagttgactcattggaaaagactctgatgctgggagggattgggggcaggaggagaaggggacgacagaggatgagatggctggatggcatcactgactcgatggacatgagtctgagtgaactccgagagttagtgatggacagggaggcctggcgtgctgctattcatggggtcgcaaagagtcggacatgacatgaactgaactgaactctgtttttaactttaaaaatccatatagacaaaaaatacttattgttgaatttttgacacatttattgttttttggatgtggaatattttttttaaactattgaatttgttacaatattgcttctgtttgtggtttttgtggtgggcacaaggcatgtgggatcttagctccccaaccagggattgagcctctaccctctgcattggaaggtgaagtcttaaccactggaccaccagggaagtcccactggcactcttctagaataattatttgttgtctctcctgtggcttaaaaatagctaatcttccctggtagctcagaccataaagcatctgcctacaatgtgggagatctgggttcgatctctgggtcaggaagatcccctggagaaggcaatggcaccccactccagtactcttgcctggaaaatcccatggacacaggagtctggtagataacagtccatgaggtcacaaagagtcggacacaactgagtgacttcacttaagttttccttgctaccaaggcacctctccatccataatcagaaactcctaaacttctctattagttttgctgaaacacctataataagctcccaacaatgtctgcccaatttaaattgcaaacccatggagcaggcaccaggaataatgctccattgtctgtagcttaccttgagcagacttgcagaataccaagccttactccaccccctttatcctgcctgctttcgtgctctggtccccttgctcatctagcactttgcaccttactgggaaagtaaggctgtagccaaacaggtgaacatggagctttatttagagtttatctcttctgttttaactccttagagtctgatttctctttctacaaagcatgcaaacttaggtctgaatgtatgctctcctgaaaccagaaatgtgtgaaactcatcaagtcaaaccagtgctgtcactgatctccacctcaaacctcaggaaaccaagccaggcatgatatcttcagcttttatcttcctttccttgcctgacctgggaaagttgcagataggatgcatctaaaattggagtttaagaggaatattttttcaatgggcttttactgggcaggaaatgctatatcttaa

SEQ ID NO: 47653 - DNA, 2953 bp, Bovine  19866880423182
atacatgtagaaggagatcttctccctattgtctttggtattggaacatgaaagacgtatttgtccatctccctactttgtctgtaagagagtttaaagcctcagacttgaatctagatatgtagaacagcaggggagatgatgcctattagtgacactgtcgttgttaagtatagtctgaaccttcactttatttatgcacacactccactgtcatttactttgtgcctttacaaaagtaattgaaaaaaaatagttcttcaccagctattgtagccttttgtaaaagtacctttgttaggatatgtcacaaaccacagtgtgtagtactggaggccatgataggaatgtgtggaaatagcttgatccccaaaggctatctatagactctaagggaaaaagagagaatgttgtaagaagtcaccacaaaccttcctttaaatcagcgtttggggtagtgaaagcacatgaattttgaaacaaaaatgttatttccttactcaaagtttgccatcacctcctccatattagagaaaaggaaagggaaggagagagatggaagggagagagggggaaaaaggcaagaaaaggaaggaaagaaagttcaaagggaaaagagagagattatgcttctcctggcatgtaaaatacttctactaaaatctttagatgttttctgtttttttaaaaaatgttgttttttttcattatacaatcttgaaagtttaaaatggactgatttaccgtaagaagcattaagtaaatgcaatttctatttttaataaagatagctcaagtttcatgtgagatcacaccagccctccaatgtaattaagtgtatggctttctaatgcatgttaagtacccacgatgggtagttaatagaattttttaggtaagagtcaggacaccactacagtgagactacagtgggatgatgttggtcagtaaaatagtggccaccaagtaacggaaattacaacatattttggtataatttgtctaaaatggttcatgacagagaagtcaattttagctgaatgtccaaaatgaaaaagggctggtgtgtttgaatgaagaaaaagggtgtgaaggaaagattgtactttgtaggctgtagaaactctctgcactgcacaggtattcctagggggctcaaatgtatcattacaggagggagagtgtgcttgagattagactaggagttcctagagcaaatacgatgtcccatgatttcttttaacatcagaaaaaaaaaataaaaaacccacaagtagaaactgcaggtgcttcctttttattgcacgatgtaaagagaaaatgtaaaacggacaagctttcgacaatcatgttctcttcatcaagctgttattgttattttagtgagtccactaaaaagaattatctagagcttcttgtttttacttctttgtgtacttgatgaatatgattaccatttttacctcctgtatttaaacccctctgccataatcccatattctgcctaaaagccatgtctgtaggagctgtctccccttcactggaatagtttttagggatatgactgcatttaagcaggtgcagtaaatgcacttttggtgatttttcactgccgtgtgtaagtgcaaaacatctgacataattaaggtacgattaatcgagactattagtaaaataagcttgttttatgaatgaagacctcacactcattcagcatagcctttctttgacaaatgcactgcattcacttatgtagcacagctttgtatgcctgggaagtgaataaacatttgccaggctaccttccagagttttccattaactgtcttcaaattcccttcttgtgttgtgcagagggaacccggttttatttttaaatagaacaaagggactggcccagaaccacaagggccagtgattgtcagaatcatgagaaatctttagttacttttggccctgaattgttcttattcttgtgttttactcactttagaatttaaggcatcctattaaaaatggccaccatacaagagaggaggcagtgaaggaaaataataaagaacagtggcaagtgagttgatgctgtataaataagcgcatttgctgtgtctcttttctgcagtttttatgtctcactgatgagagaactggtttgagatgtaaattgcttccctttgattgaaccagggaggagatgtcatgtaactcatctcatcagcatagagcattgtgcgcctttggtgaattataggataacacagctaggaagaattccttaacctctctctgcagccctgttccagtctttaataaccaccaaagggaagtacttcccttctgttcacctgactaccttctgtggtttgagctcgtttcttctgatcctgtccttaaatattctgtaaaggatcactggaaagtgccacggttttaacttgccatgtatatcctgtaaattagaatataaagttctggggaggtttttgctttgaaacgtgagaacagggacaagaaatgaactgaagacagtatttcccacaatgtatctcacttgtctaggtttagggtaaatccagaggggcagctctacatgaaaccagcaatgaagtaggagcagaggtagaagtggggggtaggagctccctgtgatctgcatgagattgtatgctgtatgagcaaagaattagcaaatggatttaaaacaaaagaattgaaaataggcctgcaatccatctagcctggtatctcgaaaagcaggacttttttttttatataagaaattcagggcagatatcacagccgtatcatgacagcacggcctttgcttcctccccttctattaaatctacattttgaaggtggatggtgctgactcataaattaaattggagtaatacatacagcgtatatatattttctggcactttgtctcaaattaaacacgaaccttctt

SEQ ID NO: 47654 - DNA, 1322 bp, Bovine  19866880470408
agagctgtacagaaaacagcaaccagatctagtttctcgcatagtttcttccaccttgaacttcataccttacccctttggagcaaaaccaggatagaagaggaaatgaagaggactcttcttgaaaagggaagaggagttacaaaatagaattactgtttggaactgggccattgccctctagtgaaaactgtcaagggaacattaaaggccacagatggctcagacttcacttctgaacatcatctggaagatacagtgaatccaagaataagagtgtttaggaaagaatccaagaagtttggacactagtatactaagtatacttgagcaaaaaaaatcagtttttatcctcacttaagtgaaaagaaacttaattcttagcttaaaaaaaaagactatatctttcctgtaggctctataattcttctatgttctcattgtagtggcactagaaactgattgaatcatatatatatatataaactgaagtttgttttactaaatatgtcttatcaaaattgttatttttaccatacttgggtatattataaaaatccactcataaagggccaaaatcatgagaacaggaaagtcaatagaaaaattaaatttcccataatctaagatttccagatactaaaaacattattatttttctttatctttttgttattacctcagaaagtgtcttgttaagctaattatcttttccctagactagacccctgactcccgtactcttgcagtatctttttggagagacatcagacatatgagtcagttatcaaactcataatatggaagtaactgattactcttccttccctcataaaagccacactatcagttaccaaattctatttgcagtattttatacatctgtcttttccttcttctgccagcctttctcaaccagagtttcagaatagaaccaagccttaacaccccttaatgccctagagttcctaattgtacataatgaattaatctccttccgatacatctagcccatactagttacacaccatccttggcagaatggagaaacactcaaatcattttttatgtgctctgtggttcagatgagaaaccccaggtaagaaaagctggatggataatcaccaaaatttcttgcttttttggcatcacctttgcatactctctgatggttaatcttactttttactcccctttttctcaaaatttcagtgggtggtctttgtttagagcattaattttaatttatttatttatgattggttttcatggcttctcagaatctggggccaatcttctaatcttgccttacctcctattgg

SEQ ID NO: 47655 - DNA, 1090 bp, Bovine  19866880486463
tggtgattgcagccatgaaattaaaagacacttgctccttggaaggaaagttatgaccaacctagatagcatattaaaaagcagagacattactttgttaactaaggtctgtctagtcaaagctatggttttcccagtagtcatgtatgaatgtgagagttggactataaagaaagctgatcgccgaagaattgatgcttttgaactatggtgttggagaagactcttgagagtcccttggactgcaaggagatccaaccagtccatcctagaggagatcaattctgggtgttcattagaaagactgatgctgatgctgaaactccagtactttggccacctggtgtgaagagccaacttatttgaaaagaccctgatgctgggaaatattgagggcaggaggagaaggggacgacagaggatgagatggttggatggcatcatggactcaatggacatgggtttggatggactctgggagttggtgatggacagggaggcctggcatgctgtggttcatggggtcgcaaagagttgggcacaacggagtaactgaacaacaccaacaaataagtaacatttatatggtggatgatgataagtgccatggagaaaaacaaaaataatgaaagttatggggaatccaaggatagattgaggggtggggctgtcacagaactaattggtaatctgatacttgagcaaagccccaaaggcagtgaggagactaatatgaaaaggcaaatgtataggataaggtcctcctctactttcacagcacagcataagacaggatttttttggctgatgtttcagacatggattgttggattccagtatgtctgtttctccaaacagcggccacccccagagcagttgcagtctctacacattagtctctcctttttcttcctcctactttctcattcaaactctggctcctctcactcctctctgactcatcctgctcttttattcttggtcataattctgtgttctgactcattcagttctaatcactgaaaatttacttcctgtgtaaccagcactatgctaagtaagaggaaagattacaaaatagcccaagatc

SEQ ID NO: 47656 - DNA, 1287 bp, Bovine  19866880555125
ctttctctaggtcttctctagcctggatctgccatcattttgttagttgatttgtgtgtatttctcttggttttcctaagaacagttccatatgtgttaaaggtggtagagaatatttaaacacagaaatgctatggtgtttatcagtcttggtatgtggttggactgcttcatcttttcctatgtacttgtaagtattttactctcaaagaaagagttatgttcttttaattaactagcaaatattttttgtattgatccagaagacgtattttgtccactggtcttcatcctagcatcactggacctgtaacaccacatctttgttcatgtacctattccatgatatatggatagtgttgctaggaggcactcatggagttcgggcagtggtagataacagaacagacactgagaacttagagctgtgtgaagtcccctaatggagcatcccaccttaaattctgggctctcattctagtgctagcttactgtaatacttggtttccatttgcacatgtgtctcatctattacattttcttgtctgaaagacgcattttaaaatagtagaagcagagaaagttagaggcctaataattattcagaaagcagggttgatggtggcagggagccagcacaggatgagccttgtgagcacttctatttctccttgagtagcggaaagagttcaatcacattcatcaaagattaaagtgctttgagctgcccctccagagcatttggaaagagatgccttcttctgtctcatctagggaaccttaagtttttccatccatctattaattttctacatctggcacagtttttccaactttccaccagggcttcttcttaaacaaaactggtcattcgagacattcatttttcctcctttggaaaagctttgagatgcttgaagggcaggaagagagaaatatagggtcactctgcaaaaaatgtgaaagtacattttgtttttagaacccctgatcttctgttctttttgatgtatctattgaaatggtcctgaagattaaatagaaatgaattgtggccacaaacctgactcattcaacactggtcaaaagcatgagtctgaatcaggttcaactcaattcaacaagtattgattgactgcctacgatgtgctatcacaaggttagcaggctaaaaagcagaaaacctacagagaggagagtgattaagcccctttctccggctgtacttgatgcttttttgcctgaatcttgacttacacaacttaactcatgaattacagaaaattt

SEQ ID NO: 47657 - DNA, 1471 bp, Bovine  19866880605326
aagatctaacaggtgcctgtttcctgtctggatgatagcatctaatttctgggccaatagcttacttgataaagaatttgcctgcaatgcaggagaccccagttcaattcctgggtcgggaagatccactggagaagggataggctacccattccagtattcttgggcttcccttgtggctcagctggcaaagaatctgcctgcaatatgggagacctgggttcaatccctgggttgggaagatcccctgagaagggaaaggctacccactccaatattctggcctggagaattccatggactgtccagttcatggggtcgaaaagagtcggacaccactgagaaactttcactttcagggccaagatcaggatccaaggatgattctgtgcaggtgagagttgaaaaaggaaagcaacagaatgagtactctgttatggaaagaaggatgttccaagttggggaaatatcaaaaatagcagaaggaatttttttcctagtgttctgtctcatgtatatgctatgtaagcagaaattatctgaagaagtaacaatttctatcagtttacaaattctggcaggctaaattaaccctgaagatgaggacaaaattaccttcaagttcctatttataactttctatcccctaaaaggctatttatatagcttatatgtgcaactgacttgcatcctttccaaatcattctattcaattgtgaaatatttggaatcaaatatcattggttttcattttgttttaaggggcaaaaagaatgaactaacctataatcacaccaacggcaagaataagaatttaactccttcttttgaaatgaagagacaaataatttagccaagagcttccaagtttaatttacaaaccacaaaaatctataaacataaattatgtagtgaaaatttcacttattcttacttgaatataattataatctcttgaatatcagttttaacaaaatgaataagagtgcaatagagttcagatgaagcttatttcttgcacaaatccatatgaatgccaaataccttccaagcagattgtctagccacttagtataaatgaatcctcttgctttctatttgaaaaacattcctcatattgggcacttgcaactaagttacagtctccctcatcactgcttagcagtgaacagaactaagggagatcgactgaaccctttaggccacatgagtactaacagtggaccacatgtattatgcttctctagagacaagctacaacagtaagaaagattaggtgtattatgttttacctatgaatcctgatttacaagatggggaaaggaagattgggagaaagggaactaatatttaattgcaccctcttttgggctaggcacttagcagatattttacaacttaatctaatcacaatcagatgaggtattaataccatgcaatacaaaaagaagaccataaagaaggctgagca

SEQ ID NO: 47658 - DNA, 1277 bp, Bovine  19866880640284
acacacacaaaacatgcaggtatatatgatgctgctgctgctaagttgcttcagtcgtgtccgactctgtgcaaccccatagacggcagcccaccaggctcccccgtccctgggattctccaggcaagaattctggagtgggttgccatttcctcctccaatgcatgaaagtgaaaagtgaaagtgaagtcactcagtcgtgtttgacttgtagcgaccccatggatcgcagcccaccaggctcctccatccatgggattttccaggcaagagtactggagtggggtgccattgccttctccagcaggtatatatagttatacatataacatgtaaaatgtatatctacaatatcatgtgtttattttacttatataaatttctggtaattgttcctagtgatttggatgctaaaatataataaactaagttttttcttatgagatatacctatttaagcacccatatatctagacatccttgaggtgcttataagactctatttgactgtgtatggtcaagattgagtaccaatatagtgcattatcttataagcagtcatgtcccactctttgcaaccccatggactatagcccatcaggttcctgtgtccatgggattctccaggcaaaaatactgtactggtagcgatttccttctccacattatcttattacttattagaaaaaactttaatggtctaattaatgttttacataatataagaatgttttagtatatttaatttaaaaatatatgtatatagttatagttgattttggttattgagaaaatggaattgctggaacagcacttaaataaaatgaatagtactgacctacttagaaaaattaattatgaaagaaaaaataatggattagagtttcagataatggttttggggacgctgctggttgaaatccatcccgaggcttatttataattggcacaattagagttttcgagaattcagcagctctaatttatttacaaaaattcatataggatttgagttactgggggtgtgggggatggagatgggtaggagactcactatttacatttaagttctacagtatctcaaattcatgttttgggggagaattatctccaggcaaagggtaccaattctttaactgagagaatttattatattgggtacttatatcaataaatgtttgtattagatcagatagcaaaaattgaatatgtccttgcacttaagactattttattttctgtgttgtctacaaactgtctccacaatttgcatttga

SEQ ID NO: 47659 - DNA, 908 bp, Bovine  19866880649567
aatagataccaaaccaaacccagatattttcatccagggaaggctgcgaggtcaatgcaaatgccaaagtgtccacgagaaagggtagggttgtgatgagtgaggcgtacgcccatttgggagggtgattgcttaaaagttacttgggagaattcatcatttgcatactacctagattcaagtgcataaatttctttaacaaacgataaagatttcttcagagaagttgactttgtcatattaaggcaaagattttgtggctggtaggaaaggctcatcaactcctaaaactgtatactccattaaagtacatacgtgagacactggcaaggggtttctgtgtgtcctgaatacaaaagaactattaggtgaagtatctcctacactggtgcctcttaaactgtgttgtaaatagcacatagggatcttgttaaaatgaagatctccattcactttagagcctgagactgcatttttaagaagttccttggagatgtccatacctggatgttggtgcatggccacacttttagtattaaacatggacattttaaaaggggaaagaaacattcagttcagctcagttcagtcgctcagtcatgtctgactctttgcgacaccatggactgcagtacgccaggcctccctgtccatcaccagctcccggagtttacccaaactcatgtccactgagtcggtgatgccatccaaccatttcatcctctgttgtccccttcttcttccaccttctatcttttccagcatcagggtcttttccaatgagttagttctttgcatcaagtggcctaagtattggagtttcagcttcaacatcagaccttccaataaatattcaggactgatttcctttagaaggacggtggatttcctgcagtccaagggactct

SEQ ID NO: 47660 - DNA, 2500 bp, Bovine  19866880663764
tatttggaacatgattgtatgattttacagcatttggagaaacagttcatcacattttcctaataagcaagggagaagagaagctgactacagaagttgcaaaaacaggagggaaaagatttttctgatgtccctttatccttctactgtgtgctcagtcgcccccaactctgcagcccagtggactgtagcctgccaggctcctctgcccatggaattttccaggcaagaacctgtagtggtgtgccatttcctactccaagggatcttcccgacccagggatcaaacccatatctctggtgtctcctgcattggcaggtggattctttacaactagcaccacatggggagcccccttgtactagagttatatgcgttagtaagaaggcacgctgctttgcctccacacacatgacaggctagaaagggcccttacgtctgaccatggcattatgctatagctgcattcgggggtcctcacagtgctgctgttacattcctctttggctttatgggttaaactggagtgcaaagtagaaattggcccttagctaaatataactgcagatatcgcttgcccagttcttggctattctagtagggtttgttgctggatcacaaaagtataattaatgtgcctctctttccagctgacagaagttacctttaaagaactggtgaaacatgtttcttctgtaagttccaattcccccatcagaaaattatgaaattcattaaaaattttgcaatgatcataataggttacttgttatatgtgtgctttcaagatacagagaaagattcctgaaatcgcacaatggggaagaggggtggcaggatagatggagggggagaaaacactgtgaaaagttcttccttgtccttaaaaagatagaaaatatttctagggcatagtgttccatagaacatgctgaatggacagtcttgtgagacccagaggcaaattggagttttgcccccactggcctgccattatggataatacctcctctatcgatctccccatcccgactttccacccttcctctctcttctcgtagtatccctgtctgtttttgaacctgtgctaccatctacttcttggactctgcttgtttctctttttcttccttcctcctgtatcctctaacttaacttctatgcttcagtttatctctctttcattcatttatataatgcattgggaccacttcctctgtcttgcctgtgtgtatgagccccccaagccccccaacctgtcctcagtcattgactcacggcgttgacatcctttcctacacacctatgcccacacgcttcctgtacgacatagcttcaactgttcctttgttgggggtcctcctttgccagcactgactcagtgatgcttcctctgcaatcgtgtgttgatatctgtttggatcaatgcctttttagtttgacatgcagacaaagtaccactccaagttgttcctatggagcagagagcaaggataatgtcctggggaaagagagacaatgctacctgactctaaactcagtaacacgactcttgatcctcactgatctaatgaatccttacacgcacatgtaatctttttaatgagctctaggtcattccccacattaaatggttttgttcaggaatttttagtttgtgtttactatttatttataaaaatctaattttatttaatgatctattcatttacttttttaaaaaagatttttttttttaaagaacagttttaggttcacaacaaagttaagagaaaggtcctgaggtttcccatatacccctgctcccacacttgtatagattcctccattatcagcatactccatcaaatatctaactttttaagtttctgctgctgctgctgctaagtcacttcagtcgtgtccgactctgtgagaccccatagacggcagcccagcaggctcccccgtccctgggattctccaggcaagaacagtggagtgggttgccttttaggtttctagttgtatgtttttcccaatttgttatgtgatttatcttccaacctaaaaccttctccagaaggagctcgttccctttgtctctattctacagtagcaaccttcgccagtagcaatgtttccattgtgtcagttctcatgctgcattatagttatatgtttacatgcatcactttctcttgaggaagaatttttattttgtttcagtcagttccaagaaaattgtatagcaactacagaactgacctttctacacatgtggcagaattagtcatgcctgttctcaggaagcacctaaataaacagaaatggaaaaatcttaggttctacagtgcacagtcacataacaagaattgcataatctgaagggaggttcagaaatagaaggatcacacaagcaaaaatttaagtacccagaatgcttaaaatggagtctgtgcaatgtccctttgctaaggagcatacttttgctctatatggaagcataagttatatctg

SEQ ID NO: 47661 - DNA, 4668 bp, Bovine  19866880680556
accttgattttattgacagaacttaggtagccctgtcaacatgaatttacagtagaatcacgagccctgattaattcacatgaagataactgagagttgacacgaatatctgacaacaatcccctgactcctttcacgggaacaaaagtctaacttcctcctggtttatctcaagggggatagtttggccaatacttcacctaggaatcaatactttacccaccaattaagtgacttagactcagctgttacaggtgggccacaccaccaatttggacccattgtaacatgcacttctctctgttgaatccacttcttgttttgctcttcaaccgtttccttcttccttttgccgtttcctaagaagttcttattctctcctcattaaagttttctagccagaataattctgaatttattcatgctcttatttaaaagttcaaaagaagcttggaaatcttaacctctcttagaatttacattgagcttcaagtgaaatggctaaaaaccgtatagcatcaatttaaaggtaggagaatttttagtactgggactctttcctaatgccttttcctgttttcctagtctggatcggcctgcatcaggcagcctttcatggtgatccccgcacttaaactttgctgtgctatttagatttctatagccagcagggacttaaagatgaatatatataatttttgaaaatgcaagctcccactaaattttaatttgatggaaatatttctcttctatgagctttatgagaaaaaatatctttcaaagtaacaattacatgtgggggattaagtttaagtaattgacagtcttgtctttttaattaaaaggaataaagctgcctaagaagagctcaaagagatttgcagcagaaaatactggcttgctgccccaaagggtgacaagacccaggatcttgaatggacagaaaatgcttatacaggtccctttggtctttggagagcacccccaggggagctcaccctggtgtttgcatcaagtgtgacatttagcaggtgggtagcgatgtactggggacttccagtacatccctaccaaaaggtaccaaaaggtagctcagacagtaaagaatttgcctgcaatgtaggagacctgggttcagtccctcagctgaatgttaaatagccatgtactttgaggagagttgctgagtgtagccaagaagatggtcctttctttggaagttctgctctaggttcagagaaaagatcaagagtccttaaagatcaagtggcactatttaagagtcaaaaagatgtatgtatatgtgtaatggattcccttgtacaatataaactaacacaacattgcaaagcaactatgctacaataaaaatgaaaaaaaataggtagaaagtttcaaaggaaaaaaagtcaagaaagaacacatattcttccaagaattcaatcatcagtaaagtcttggctcctgacaaatttcataggatagccccgcaaaactataatctttcattttagtctgccccttggctccctctctttctttttcacctgaaattcttatttttgttatctgtatttcttgatcttctttttctctacattttccaccatattcaccttgcatttttttatacactctttctttgacatccttcaaacaaaaccaaagaaaaggttttgatggtgttagcattcaattcttgacactggataccacccagggaagcaccacaaagccattatcccatctatctggagaggctagatacaaatgaaccttcacaacaacctcccttttacagtcactctgtccccacaatggtctttaatcatcacaagtcatttgtaggcattaaattaaacaagcactgccataggggaaaaatcccccagcttaagaggtcccaccttacatctccccttgtacactgctgtgaagaacacacctgccaagtcaggacacagtgtggcataatgagcttggaattccaatttaaggtgttcatttgtacccagatatatgatgggagtaggcagaccactcactaggactccaccgagaatcggcagcttatatccactgcaaatcagtaggaggagagaccttacaagtcatttatcatgcttcctaattggaccctggggacctgagaactgccatagtttattgcactattttactcatcacactgctggttgtaaaagaaaacgcttcccacgtttctgtaacacatatgtacgttttaatagctggacattaccactaacagagtatctttgctataaatcacagctatcagtccactctactttatccgccccatactcacaatggagattcttctgttttaaccacttaccttccaaaccttgtagttccagtatgacttttcttttttaactacttaagagaatcttgtttggggcaaccgtagcatcctgtggtttaaaaaaaaaaacaaaaacaaaacagataactgtgccttgactgagtacccatcccatgcaccatcccatcctctgtagcccgcaggacactgagcatccccacccatgtgctatgttggaaagttgcttggccattctgaagtgctttctcaattgtacatgtgaatgtttggagggcagaaatgactaagggaaaaaaggaacgtaaaaaaagcagtagctttcacttctctttgttgaatcacaacttagagagtaacttgggagatgtgttctcgtccctgcagttcctgaacacaggtaagttcattgtggaaggttgtttacttcatgtcacagtgctgaaatagacggcatgctctcacccactggaggttggtcttcccatctgtcattaaacgaatgcatcactttctattctgcctttaaatgtactctccacttgccttcgctctgtaaagttccttttttttctgttcatgttttcttttcatctgattttcaaccattaggaacaccagaaagaaacctcattcttgatgggcagtgaaaactagtttctggcccagatgaagtttatttgacaatacacagtattttggttacactattcattccttcaaagaaaaagtaccatcctagtactttcttatagctctgagctaggtactagctctgagctaggtacttgggaagtgctgtgggaagaagccagacacgacctccacagtaatagaccttacagacctgcccgggcagtagttgttgatgagcagttacgagaaactttgctaagttgaggagacctgtgtggtctatggagaactcagcacaggggcatcttagctaacctggaccagtcagttctcttaccagtgaaagtgaagtttaaaattaaggcagaaagaagagaaggtagaaaggagcagaacatcccaggattgcagagaattagaatccagagacagctcaacagtagtgtctaaataattttttaaatatgggggaaaaacccacatttttttcctaatagtttcttacttttcctcatttgcatctagcctgtttaaaaacaaaagaaaggtgataaaccagtggagttaaaagagaagagatgggcattactacctgttacacatttaagataagaaagagcagctgtcaacttgactactgtgcggacatgtgtggatagggtatactatgtggtaggtggtgttacagaggtgagttttctggaggatgctgagagccattctctatcagagcttctagagaaagcttttagcctctcaacaaggaggcttgacagtaggcttttaagttagttgtcgggatggtcaggtcagttggagccatctgtgttttccaggagctgcttgctctagaacctggaggtatattatgtctcaagtcagtgacacagcaggaattacagatacatccctgaggggtcctggtgctcccagtagtaaaggcattgccaaggttccaaagcagaaccgccttcaccaaattctctgccctgcggcggtcagtgctatagacgcaggctctggggtaactctgagcataccactgttttttaatcccttatcttcttatttgtgagagccttaaaatcccaggaaatctcacaaattcacttatctccgcattcaaattccacagcgagtaccttgtttcatggtatttgaatgtttttggtttcaaacatatgaaatgaaaacacatattacacggattaaggccagtcttgaatcccttagaatttaaatctaaaatgtattctgaaacggatctgcaattcacaatttagagcatggaaacagagggagaaaaccagacaggaggcaaatctctagagacctacacaaacctgtacttttaaaatccttttttagcaagtcaaatacatgaaggcgcagaaggcttccaaatgtacatgaaattatgtcttttcaactgtaatctactttgccccaacaataagtagattcggggctaggaagtagctctttatgaaattggatgactgttctttcattccaatgaggaccaaatgccaggattttacccacaggtgcaatgggtgtgttataggcacaggagcataagcatttgtttcttctttaaggcaaagagttcgtgtctggctctaataacttacgattcaaaaaatttacttctggagtttttctatcttatatgtatttttagg

SEQ ID NO: 47662 - DNA, 1593 bp, Bovine  19866880746679
attccacctatctgattgatagttatattaaaggttgtagtcagttatataagtccctttgggttgcatatgataagagccttatgttttctttgaaatattatttcagtaaatattcggtatttataatttattgcttgtcctgctgtattttccaactgctgtccaccaaaggatcacaataggaatgttgtttggaaaatgttaattgttgaaaatgtgttttgaaaaataacacttaaggaaaatatattttaaaaaattgtatgcttcctgacctaaatattgacatttaaggtctgggattattgcagacctttcttgcattgatctttctctggtggctctagaaaaaaatcccttcgggcaatattatttaacataattggttttttagcatattgagagataaggaacaatgtaatctagtgttccaatttggaactggaatgtcatacagaccaaggccaaactgtgattttctctacaatagggactggtatatttttctgctgctgctactgctgctgctgctgccaagtcgcttcagtcgtgtcccactctgtgagaccccatagatggcagcccaccaggctcccccgtccctgggattctccaggctagaacaccggagtgggttgccatttccttcttcaatgcatgaaagtgaaagtgaagtcgctcagtcatgtccaactcttcgagaccccatggactgcagcctaccaggctcctccgtccgtgggattttccaggcaagagtactggagtggggtgctatcgccttctccaatatttttctaggttgaaatattcttaattgttttttttgtttgtttttgttttttgaatctcaatccatcatcagtattagaggtttctttctaaaagaaaataaaattctcctccaaaagtacgctgtgaagattgataataataatttctttttaaaaatttcatggatatatggcaaaaccaatacaatattgtaaagttaaaaaataaaataaaatttaaaaaacaccaaacaatggacaaaaaaaatattttctattgtcaatttccccttcttttcattataatcactgtgtatcaatagattgaaatgtatgaaataagttacctccactagttatctgaaagaaaaaaaatacaaaattatttcactaagacactatattcatctgcacatatatcaacttgtagccatctgtcttcctgttgtcatgcactaggctataagctcccatacattagagatgttcttagtacccagtgcagtggtccatgtacacaggattatgttctctgtaaagatccactaaaagatctatccactggagaaaaaatgcttcatccactactgaagaatgagacttatatataaggcttagtaaaatggggcacacttcttgactatattttatactgcaaagtaacccattctaagaagtaactgtgctactgtatctgtgctactgaccaatgcaaactggtcatcctcacagtgtcttcatagtttgattttgtatatatagttgggaatgttaatgcccatgaaagtttaagaaccactcagccactagtgcaaaa

SEQ ID NO: 47663 - DNA, 3824 bp, Bovine  19866880747157
gttacaatccatagggcccaaagtcagacacaactgaagcaacatagcacacacaaaataatgagattatagtcattgactatcggattgacaaagatatccattggggggaataataataagttataatagtattgaatcaacattttaagagaaaaacatttattaaagttttaaatatacataaactttgattcagcaattccacttcagggatttgtcaaaaataaccagacatttgcacaactgcttttttcacaattgcctctaatagtataaaattgaaagcaaatgtcagttggtagggaattgattaaataaattatgatacaataaataaaatattacagaaaattgtgtattggtaaccagacagtaatcaaattcaataatgtatgtcaaatgtacatattgtacatgctgtttattcaaataatatgtattttgtgtcccttctatgtgctcagccctctagaggcactatagacatattcatattgttttatatggggtgttagataatgagagaacttctatcttctctttatatggatttaacaatcatatattatgaaaaataacaaatgtagcatcaactttgagagaagagttgtcttaaattttaaaacaagtggatatttctgttttgaaatattaaattgatttctccttttgtggtttttcttttttttcttccccttcttccccgacatgtggatccatgagcctctatacaaagtgattcctaactgtaaccaaggcagtattcttaagtgttctggaaatgctatgccttggtatatattgaattaatgagttgtcaaaaagaaatatttgtttaaagcctttggaaaggtagaaaaaaagttaagccatgtaggtgtcaaaatgtcattccagtgtaaagcatggagagttaatgtgatgtgaacctgtgaagaggaatgctttactcggtcatggaagttgacactagtgtcagtggaaaagcaaacttgaaaatgtaatgtatagtacagtaattctcaaaccttcctgtgatcagactcaactaaggagctgttttcaaatgtaaattcctagacccaccccttgcgattctcatttggtagatctgagtggtgtcgtttaataagcttcccaggtgattcttatatccattctgagttttaatatctacatttcaaaaaaccatgctaatgagtaagtttaaatagctaatctactttttaaaatgacagatttttgttaatcttatctactaagtacatttccagaagaattctttgaacaaggttctttaagggatcatgaaatttatttaggggcattgtgaggtcataggcaagctacattccatttaagacctattgactttctggacctcaactttgagccaaaattttaatgagctgccagtgtttacttctgtcaaataaaattgccatgcctttttctcaaacaatggcattaatatttataggtttcctttcattcttattatatatagtgttcccaagaatattgttgtaaaagaatgacaaataaaatacagataatagaccactacaaatgcagaattctaatcagtgaaagcaagtatgtagtatagataaaagactactttagagtacttacacactatcagaatatcaaatctctgagtcttaaaagactgaattatatacaataagcatatgaattgctagaatattttgccttgaaaataactctgaacttcctaaaaggaaggatcttgagatgtactgcaagaagtttacaatgtttttacaacataccatcacctacctgtgtataaccaaagtgtacactaaacatacaatttaactattttgtgatcatttaataactataattctattttaagtaaagtttatttggataagaatccaaaaagccttcctcagtgaagctgataatgaaaacacctgatcaatacagactaccaaagagttttatggctggaaaaccattcagttcagtgtttctcaaagtttaatatgaataagaatcacttggggatgttgttaaaatgaaaattatgatgatggtctagggtgtgggacctgagattcacattccaaacaagctgttgttccagggaccatactttgaattccaagtatttatgtaaacccttttgtttaatagaaggaattggcatggaaggagcatggcattgcaggatgtgactatgactctggtggacttaaagtcattggagctgaatggtattatattaatggcagttcctcaaactcttatcactatggtctctggtggggcctgggctgctgcccttcctgagtggaggctttcaacttttcctttcattctgtgagagcactgaaattgctccttgcaatgaattttctttttgcttgagctatccagagagcgtttctgatgcctgcgatcaaaaaaatgtaatacaggctctgggttgggacttccactgcaaaaaaaaatatttacatcacaagggaatagattcttcttcctctagaacacagtagtaaatatattttcttaaatgtttacacaaatccactagtgactcccaaaggcctctttccatcatttttccaggctctgtccaacttcctatttgatatctgtatttgaatatctaataggcatctcagacttaacgtattcaaaattgaatctcccaaatttgatgtttatgtgacaaatggcacatcttttcgttcagttgctcaggtaaaaacctaggaatcatccccattttttttttccttctcacattccacctattagcaagtttgttggttctgccctaaaaatctagccagaaattaaccatcttaatggttacttttccatggcaattttccatcttaattgcctcattctattctaaaccatcactatctctaccttgggcaactacaatagcttcctaatccttctttttgcttccgctagaccccttcctcatggcaactagagtgacacttgctcaaaattggtcagttgcttcccataccactgaggaataaaatcgaaactctttaccatgatctgcaagaccttatgttatctgagcctttactaaatctcctacttcatcttgctccagtttattccttgcacatgctgcaccagcttactgctctcctgataactcttcaactagaatataagtcccaaggacagaaaagttgtctgttttactcactcttgtatcctagtaccttgtgaggccctgagcagagaatccaggtgagctactctgtgcccagatttctgacccactctgtgaggtaataaaatgggcagtcttttaagctgctaagtttgtggtggtttgttgtgatgccagtagaaagcatacacagtaggagaactggaagagtctaatatcacaaaagctagtgtagaaagaaaagatggagtcattaagaagtcattggcatttcagaaagtagttttttctcttaatgaataaggttcacttatgatcagggatcagtaaccaccatgaaatatacagcttagatttgaagcccagtatccagcagatttagcctgatgtgaatcatttctttattagcactttatttttccaatgtacttcacttcagttggggactgggtctttttccaatcaaaatggcctcagctgcagcaatattagctcttattatagcattttgctgtgcagctggggcccttaggtaggagtgggaactgaagccagtgatagaggaaataggaaactgtggggaggatagaagcaaatcttccttggaggtaaggatgggagcacaagaagggga

SEQ ID NO: 47664 - DNA, 1528 bp, Bovine  19866880785315
ttagctttaaagcctaacctgcttagttagaatcccagctccacatacattatccagaggtcctgtctgagcgtcaggcctctgcagagagaggaaataatacccatctcacatagttaaatgaggatgaaatgtagtaaaacagacattactaaatatgctactcaggaggtgctccttgatccttctccacttccaagggtttccaggatcctttgttggtagttagagtggttacctcccctaatactcagaagcccagtgctcctccctcccagctgctactggcctcatccttggctccaggttctcactaaccccagaagtagctgcagcagcaggagtaacatcaagattttagggaaatgaaaagcatcacctccttaaacagctgtgatctactgctccaaaaccatgagaaaacgaaagatgacttccagatccctgaaaaggtgaaatcaaaacaggattaagggaaatggaatttgcaaagggcttagcagactggctagcacacagtacatgcttagtaaatgttacccgttcccataaattgtttttggaatgaatgactaaacaggtcagcaaggtgtttcaacaccactaggtgttttattgaatagtattaagtgaactgataatgatggtgaccatgaacatgaaaccacttctggataaataaaagtttgccaagatgaaatttctgatgaaaattgaatgggaggatatcacacttctctcaagacaaagtagtaggttaagttaagttgaggtataggttgcagtaaagacattaataccactctcagctgaagtcagcacagaatgactcctcacttctttcactttggatttcagaaatattattctgggacataatcatctctaatgtgaacaggagtgagagatgaagttgttctgaacttttcatgatagccccaaactctgtcaattttaccatcaaaatagaaaaagaaatagatcaaaaagaaaatcttatattgctggtctgaaagctataaaatgaaagttgcttattccacccccaaatcctcccacttgggtctgaaggaatattggtgatgagtaaaatgtcttgctcagaataataacattttagaggtcaggcatatcataaagattatccagatcagagatttaacctggagtccatgggattaattgggggcaagggtggggatcttaaaaccctctgaaattatgtgccaaatgtgtatgtgtaggtgtgtgttttctgaaatgtgggaaagctggaggtggaaatcagggcattgactatgatttctccctaggtaaggacatggccaagctgatgacatgtaactcaagaattaaggacccgctccttataaaattttccctgactagaagctcacaggctgttagtgtaagttcatcaatggtgaagcaagccctcagcataaagcaaagtggcacagcaagcattctccttctggatcaggtaagagcctatttgcacaaagagcccccaactagggcctaggaa

SEQ ID NO: 47665 - DNA, 2779 bp, Bovine  19866880800626
attccaaagatatatacctactgttctgagagcaaaatagtttatctgatgccaagtcctgtgggttgaatggtggctccctaaaagatatgcccacatctcaatcctcagaagctgagaacgtggcccttatttggaagaagggtttttgcatatctaattagtttaagaatctctaaataggatcatcctggattatccaagtttgtaaccctgggtgcacactaagtcacttcagtcatgtttgattctttgtgaccctatggaacacagcctgccagattcctctgtccatgggcttttccaggcaagaatactggagtgggttgccatgccctcaggggatcttcttggtccagagaaatacaatgacatgcctctataagagacagaggaaaagacacagacacaaagggaaggccatgtaaagaaggaagcacagactgtagataaagagctgcaaaccaggaaatgcatggaagagcaagtaattctccccttgagccttcagagtgaatgtggcccttctgattcattgatttctgatttttgacctccagagctgtgaaagactacctctgttgtttgaggccatcaagttagtatgttatggcaaccccaggaaactgatatacttagaacaagaattgtttcacaaagaggtaatggaatggattagaaacaacatttatgcaagatagactcagattttaacctagattttctctgtacaaattgtgtgatataaaaaaggaagttacttaatatctctgatcgtcatgcttctcattagcaaagtgatggtaagttttcaatgtagggtcactgtgggatatggagatatgtaaaacacctcacttactgtaagcattacaacagcagaatattattctgatcaatattcaatactcgattaacctattaataattcaaaaatgtgccaaatatctataaaagttaaaaactgttgttttccttgagaataaacattttagcaaggtattaattagagcataagggattgattaatgtggaaactggttgtgcaataccaaatgtttcgaaaaacttttatttcaaacttactattcatgccattttaagccacctcctcagttgtcagtggaaccatattcagtcctgttcctttactgtctcatatttaacatcctccctagtttcttatagacaaataataaaaagtaatgccagagtattattggaaaatatttgcatctagcctgggcttaagtcagccagatacagaagcaaagactgtgttaatagaattctcctaaatgttagtctaagaaaattcacaatagcataataatctctaggacaaagttatcaaattcataccaatcgtgaacacctttggttattcttgacattaaggcagacaaaacaataaaggtaactctaacaataattttcctagagggacaatataggaatcacgcaatttgagcatttcatgttctggaataactccttaatatcagaaaattgagactctagtaaagctattgaaaacacatgcaacaaaagtgaaataaatttttaagaattgatgttttttgcttttctattgataaatatttataagaataaatactgtaaaaaataaaagtgaaaaatataacactagctataatactatgtatggctattaaaacacttatttattctttcactcactcattctctcaacaactatttatcaaatgtctcatcagtatcaggcattatgttaggtataagagataaatatcattgaatgagatataatatcatttcctatcttaaagaagatttaactaaaacaatcaattaaaataaggcttacattataggagcacaatgtaaggcaattaattggggaaagagagaagacatccaaagaaaatgcaccataaattgagacctgctaagttatttctgtaaggggaagaaggggaaaatgggagacgttttccatccatatggaggatatctgtaaagaccacaaaatgagagtgaggtgtgtgctgaaagtatgaaaaagaagttcagtatgattggagcatgggcttcccttgtggctcagctggtaaagaattcgcctgcaatgtgggagacctaggttcgatccctgggttgggaagatccccaagagaagggaaaggctacccactccagtattctggcctagaaattccatggactgtatagtccatggggtagcaaagagccggacatgaccaagcaactttcacacacacatgattggagcataggaagccagggaaaaagtgatttaagtcagactagaagaggagacaggggctagattttaagatttaatattaaggacatcaggagaatgctgcaatagcttgggtgagataagatggtactgtaaactagagtgttagctttggtatggagaggatacatatttaggagaaagatcaaaaatatttctaaacatactagcttgataccctatttaaatttactacctacctactcactgtatataagtcttcatctcttttgccctatatttaaaaacaaatttgttgaagcataattgtaggacgataattgcacagatttaaatttgataagttttgacacattgaccaatgaaatcactaccacaatcgagatagcaaaattatttatcaccttcaaaactttccttgtgcaagcattgatctaccttctgtcactatacattagcttatattttccagaattttatataaatggaatcttatagtatgcacttgtt

SEQ ID NO: 47666 - DNA, 2261 bp, Bovine  19866880819951
agtgctctatagtggtgccaggcctctagcagtaccaactgttaaataataaacaggcccagtttgttggcagcctcttcccctcccgccaacatggagtgcccattctctgggtttacctgcctgcatgtgttcagatgcttagaacagtctgcttggtgtgtgaggtggtggtggcactgaggcatcagtctacaatctaatctgcttagtttattattctcccaggaccttgggtgagctagcaaacatgcagggctctggcagcctgaacaatggccatgctatcattctagataacgttacaggctttgcagactgcagtggctaattgtttttcttacattcactttccctttgtattctcttcttcctttgaattggtttgcagggagaggggattaggaagggtgagagtgattctgcaagttcgcttttttacttccaggaagttagaaagtatttgtgttggttgttttattttaatagcagcatgtatgtggtttattcacactgaaagtgagtcagacataagtagcatattcttactgaagacccacagggtacatagaaccctagactaggtgctcaaatttaactcatactttatttactgtgttactctatgacaactgacctggtaaggacaaagttctccctcagattctaggcaccatgtactggaaaagcaggtcaataaagagccaagccagaaacacgtgcacacaaacttcagacgaaaatgattcctaaaagtcctctttgttgtggagaatttttattctctggtcccgggtttagggccttggtaatctcaattttgtattgctttatggccaaaggaatttggtatgccacacagattcagtggtcaaaaatagactctcttaaatcccataaaccctctccaacccccaaccctgagcaaagctcaggataagtagaccatgataccaaatccaggaggaggatttttgttaatcagtataagtgaggcacattcatagtagggtaaacaacagcatgtggtggtagagaaagggtagctaggaagcaaaaaggctgttttgggggggtttttttgtccagaaactaattctaaaggcaatggccccaactttcaagtaatgacagtatccctggagcaagtttctaccagggtgactgctatgaaaaatagcccttattagaggtctatgttaaaacacatctttaaaaaaaaaaaaatcagtcacattccattataatgatggctcttacatgatgaagctttcccttggttggaaaaccaaaaccatttgcttaactgaaatgaaatctctcctatctcaggtcactaaatatgctttcagctgaggggtaatcattcagtttcttgggctagcatatttttagatcaggagtacttatttgaattaagaactctggtgacagttcagggggtgttgcagaaagttaagatagtattccatattcagcctgtgtgcgtgctaagtcgcctaagtcatgcccgacccttttcgatcctatgggccatagccccccaggctcctctgtcaatggcattctccaggcaagaacactggaatgggttgctgtgccctcctccacgtgatcttcctggctcagggatcgaacccccatctcttacatctcatgccttggcaggcaaattctttaccactagtgccacctgtgctgtgcctagttgctcagtcatgtctgactctgtgaccccacggacagcagccccagattcagcctgtgtgctcagtcgcttcaggttctttgtgaccccatggaatgtatcctctgtccataggattctccaggcaagaatagtggagtgggttgccatttcctcctccagagggtcttcccaacccagggattgaactcacatctcctacactgaaggaggattcgttacccactgagcaccagggaagccccatattcagcctaatttttcctaaattcatacctcagtggtttataatggatacacttgtgatggttctattttgctctatgagaaatgcatgatctcatcttctcattatcttttaagaaagagttagctaatttgtagtgtcaaaagtgctttttaaaaaacatcaggcagtattagttcactcagattgtttacaaatacatagtggtaaagtttatagggaaacaataatttaaaaagcaacttgcattatataacaagataatgaatttctaggactgtcagtctcctattggatccatatcac

SEQ ID NO: 47667 - DNA, 1598 bp, Bovine  19866880822547
aaaatattcaattttataaagatggtaaatttcccaaatttacaccaaaatatgatgcaacatcttaaatataacctgatcaaatggttctaaagttgaaaaaagcaaatatgtgagaattataaatacacttaggcagcctttttttccccagatacagaaatttgtcataacgtttcagtgattttggcattagtcaagaacagatctgggtcagagacaggaattaaatgtctgataattaaggtgtttaaaagcagtagggatgtaataaattagaaaaaaccaaaagaatttttgcaacaaactgctaatgatgaataaatagctaatgctaatgtggagaaacagacattgttttacatgctggttggagcgcatggtgaggcaacctggcaatacctacaaaaatttgatgtaactgcaacttgactttgtaatcttattttttatattgttgccactagaaataatattttatagaaatacgtgttgcaagattttttattttttattacagcaaaagattgaaagtgatacacatatgatgggaaatgatttccaagaaacagctttaagtgcaacaaaggaagtagaaaatagtatatatactatacttccacttgtagaaaaatggggacaattgtgagcatttatgtacatgtgcatatacttgaatatgtgcatacaccaacatacatacaatatatatgtatacaatatgtgcatacatacatatgtatatatatttaacttatttcttgtggctttcaaattttcagtcatgtcgccataatgctataaataaatttaaagatttttaagattaaaataaatcagtataagctgaactttccataataggctttgggacagtctgagttggctaatcctttaatatttgagtgaaataaatccccagtatgaagcatcctctgacatagctgtcaggcagaactagtgtatctccttctctggcactttggacatcattctgttatagcatttatcacattgcattatagttagctttgtatatttctgtcttgtctactagaatatgaggacctctatggggcagggagagatagatatttatacattcatttattcattcactcattaactaaccactagaaaaggtgtttattcaaccttgtatcttttatgcctggcctggcaactgacatataattcaatgtactgcttttgaatgaaagcatgaataaatgaataaggtgaattcagcaattcatcacaggattcaggatgatagcttctttattgtcctttagtctaaggacttccaccttttcttgcctcaaaagttaaactgcaatcatgttgcatatatgttccaaatcttatatgaaagctcttaatccgtttgtagaatgattaaacatattcattcaggaacaaatgagattctatagtccttcaagtaccattttactacttttcttctggtatatttgcatgtttgcaaatatcataattgtatcaaacagaatagacaaatataagaatgtatttttagtgcaaaatgtttgataattacaaagcatcatgcatcactgggcaaaaattttcccaca

SEQ ID NO: 47668 - DNA, 1541 bp, Bovine  19866880925300
cccttttagcaccacccattcaaacaatccccagatcctgtcaatgttctttctactcccactgtactatctagaatcctaagtaatctaagtattttcatcctctaatctctgccatccatctttatgcttccagaattaccttccataaaaataaaggctcaaggaatttcccttacctccttaaaaaccttgggtggtttaccaaataaagtccaaactctagcataacattcagtctttcacagtatagcattaaactacaactcatggtaattatactgaatgtaaaagatattcagtaacagcttgctatgttccagactccatagcagcgggctggtagtaggaataaacatgaaccagacacagtccccattttcaaagaagccagtgcgatgaaaaggcagataagtgaactaaacattgtaatgcaatgaagtgagcacaacaaaggtacctaacaatagggagctaacaaaatagattatgcccaaactcaatgaggagaaaagtgaaagtaatatcttagtcctctgcttcagaaaatgatggaagcaacacaggagttaacctcctgcattaaacaactaaaaattggacaaaatactttatagacattggacaacaggcagcacatgacaaggtcagccccataatcactataacttactgtctagacagagttaccagatcacatctcagagcgggaagaaaccaaatagaccctgtgttgcccagggctacactgctaataaggagtaatttgggcttcagatagcagtctttctgattccaaagtccaagaagtttttacttttacttctctaccacctttaaatcattgcttagactgtccacctaggctagaaatcagctcactcctacccctccatattctctcgccctacagaaattatgtttcaaggtttcagtttaaacatcacttcatccaagaaaacttccctaattccattgccccaagccatagaaagaaaaaaatcagtattaccatcctttataatactgtattttttttgtccaagacttcatttttattgtttttcagcattaattttattctgctttatctaataattatattagttcaagccaatgtttatcagggcttccctgatagctcagttgataaagaatccacctgcaatgcaggagaccccagctggattcctggatcaggaagatccactggagaagggagaggctactcaccacagtattcttgggctttccttgtggctcagctggtaaagaatccgtttactgagagcttactgtattatattagtgctaaccaatgtttatcagggcttccctgatagctcagttgataaagaatctgcctacaacagagaagaccccgggtttgattcttgggttgggaagatccactggagaatggataggctaccgattccagtattcttggcttcccttgtggctcacctggtaaagaaacgtttactgagagcttactatattattgctctatacgatgtacatgaaccccatcacttaat

SEQ ID NO: 47669 - DNA, 1360 bp, Bovine  19866880926144
ttgaaacaatcgtaaatgcaaactgtacctgcggaatcgtggtctgtagccccgatacatattctgtctcactggtctaccttgttctcctgcaccctggttgtcagcaccctgaaaagggaacggaaaccaagccaaattttactcaatttacattagtgtaaaaacccaaccagacacaagtctgaacacagcagcagttaaaagtaaataaaaacacgtttacctccatcacttctccctgcacaggagggttggagtactgtggtcgacgcccatagggtctccgcatgtagtaaggtgggaacctccgcctgcggtagggccggcgctgttgggcctggccttcgggagcgctctccgatccctcattcttttccccactctcactattctggtagttctgctggtaattgcgtggaggacccctgcgacgtggatagcgtctgtaatggttacggtctgctgcgtatttactgccttgcactggaactccaccagggcctgtaacatttgctgcctccgcaccctacaaaagccatcatacagtgatcgtgacaacggaattaagtacatgcaacaaaacttacacaaaaaatacaaaaggatctctgtggccaggggtgcactgaaatgattaaacactagttcctcgctgttctgaagaggtagccctctatctgcagccagcacattagggttggtgcacctgtgttcaagtggtcacctgacccatccatgcaccttagagccaccatcctaatggatgagatctccaaaatatttccatacctgaagtcaaacctttacacaaaaagcatcctcaccttttctccttcaacaacatcaaactccacagtctctccatctcctacactgcgaaggtacttcctggggttattcttctttatggcagtctagtaatatcacattccaaaaatagattaacaggggagaataatgtgctttttcatttaaaatgtaccagagtcaatattattttaacttggatatacacataaaattagctttaaataagaccaaaccatcaataaatttaggaaaacaaggaccagtgctaacccccaacctcaaccaaaatactccaatcttacaaggccccagcattttatcactattttccaaactaaaacaagtaatttaacacgcaagacaaacacaactataaacatgtattttaaaacgctttttgcaaaagcattatatgtagctttgaacaaaatgaggatatccatctatccccaaagactgcacttaatagtagaagctagccccacatagggccagtttagatgacaggcgagtttagttttgcatgcgtcaaagttgaccaaaccaa

SEQ ID NO: 47670 - DNA, 1320 bp, Bovine  19866880950498
cggctcctgatgtgggatcagagacttgcaaaactactgtttttgacactattgttttatgttaaaacttttttgtgtcacttttgagtttattttctgtgctggctgctttaggtaaggagtagttgcagatgtacttcctgtctgctgcactgtctcaagtactagagtaatgggaaaaaaaaatgtttgcacctgtttgaaaacctcaactgtgtggtggtgtggtttctgggcaacaggcaggaattctcaaaagcttggttgcacctgcttaattgttgtttgcagctgtgtcatatgattgagtgcacagagaagcttgttagcagtttgcttgtgctgttacatattttgtgtcctccaagtttgaaagattcttgcttgatgtagtccttgagctattacactggtttattataaaactcattgattctagttcccaaatattttatccaaattctttgttctcagtctcaaatattttcttagcaactgttgactgccctagataatgtgtatgctaagttctccaaagaatacctggggagagtggatctctcaagataactgggttgataataatttttgtcctcatagagacattttctgtttggctcagtttcactatgttggcaaccccactatgtgaggctggatgtagttattgatccatttagctgaacagatttgaaagcatttggctattagtggacacatggggcatattcagaaaatttaagtgatattaagaaaattcaagatgatttcttgatttgtgcatgtgtctccattgcagctgagtggaagtgagagagaaaataaggaaaaattagataattatctttgaagaggaactaaaatccagatgtaaaatttaagactggaatatcatcctttagttttatcaaatcctgaaattgaaagtgaaagtcgctcagttgtgtccgactctttgcgtgtcggaccgcatggactatacagtccatggaattctccaggccagaatactggagtgggtagcctttctcttctccagggatcttcccaacccagggatcaaagccaggtctctcgcattgcaggcagattctttaccagctgagccacaaaagaaatcctttatcaaatcctagtcccttgatgttttttcctaagcatttctgttagtgatgtttcttttagataacagctctacaaggtttctgacaagtatctatatttttaacatagacaagctaatatgaactatatcctgtactagttagctaaagttctataaatataatataaaaagcggcaactcaatatacaaagcat

SEQ ID NO: 47671 - DNA, 1389 bp, Bovine  19866881026917
catgcaattaagaccacttaattaaacttacatgttgactttgagcagagagatttttagaaatagaaaagataatgtttcatggctttcaggaacccaatgacatcatttttattcatagaaaagtgcatttttaaaatgcactcagttaaaaatgtcagagtctgtcactagtgaatttggggtgcttgtccctttgcccccttgtggaatttactttgttgaaatagattgtcactctcttggaagacaattgctttgatattgacagcaggccttcatgagatctagaaatgaatcataaggcacatgagtagcacagccatattcagccatacaaaaattagctgagtgttacacatatcacagaatatggtgatttggggtagggaagtagtccaacttagattcacttttgtgaaaaagagcacttagtaattattgtatcaacttagtatttcatccaaacctggaatttgtgtttacccaaaggaccgctctgagattgagcaagatgattgaaaatgatctgggccaggtaggctagatagagagcgggatcagctgacatggcagaatagggttttgtgttatcacctcaaaagcaacattaaattcctttctatgaaattatagcatctttcattttccaggaaaatctaaaaagtttattctctgtcatggaaataatgcagttaaatggcttgaaatttcaacagatcattgtaaaagctcaggtaaaaagtcagtattttaatgatagccttcaaacataatcagtaatgaaatttaagcaggacctaagggaatatgacttaagaatcttagaatccttcaataaagctacttaagaaatagaatgttcctattcctgggtaatatatgatgtaggtaaagtgactagtctaagatccctaagttggggtgtgtggaagaactgggtctagaagcaggtgtctggtctccagtcaagtgctttttttcttgtagagcttgattcttttgtatctgcacaacagagtcaatctcatagaaagatacaggtcatacatttttctaggcagataaatgttcatccactcttacaacatcgataacaatggaaagcatttattgcatttacaacctgctaggcaggacccaaattatttaacttacagtctgtcttttaaatcttcataaaatgccttacaaagaatgtactattgctatgttcatttcatagtatggtagaggtactaaaacataggcaggagactaagtaaatccacaaggaaacagatgtactaagtgatgaagcttagttgtgaatgaactcaggcagtctgagttccagagcttgtgtccttatctcctgtgtagcctctctcaaacgttgttagttatgta

SEQ ID NO: 47672 - DNA, 1804 bp, Bovine  19866881052291
attttggaggaagacaaatctcacctgcatcctctactaactgggctaattcctgaccacttttgagcccacttcctcatctgtgaaacctactgattgttcaagaaagttcccctattcaaaagttgtttaaacttcctcttttaaacgcaaattcctttgaaattactaccagtttgttgctatttagttaccaagataatttttctcttcaatagaccttgaaataatgattgttatggtaaaaaaacaaaagcagaacacctaattgtgtggcctgctactaaatgacatgccctgatgaaagagagagaagaagaagggatgtgtgtgagggagagaggtaaacctggccaaatgaccccaaagctaacatcatcagtagcctgggaagagatatcctcttggactataacctgcgagtcaaggcctcctgagctctgctctggggaggtgaaggtgccgtttcttgcagtcctggatatgtgctttgttgcaggccccccactttgcttgtctttgcagggctgtcaccgggtgattcataactcagtattaactgcagacgagggaggagtgaataggggaatttttttcatgtgacataaagtaaccagcatcagggcttttccacagaagcattaattacccttgtcagtctaaccaagaacagattttaacttcaaccaaggaccatggtatttcattggcacccagcaaatgtgcaatgaaggctttgctcttcatccatgagtataataaggttaaagtctcttgtgatttatgatattccccctttctgtttaaacgagtatggtacctattaataataagcacacaattccagaatgtgagacaagacaggcggaaggttattggtgacgagaccaggttatcagtgtggaaatgaagttttttccgacttctctattcattggttttcttaccctttttcttattttattattccctttactgattgtggaaactaattgaatattagaattagaaagagcccaagagatcatctaatctagtttaaggaaaaattgtgaaagactaaaatttgatgagtgtcctgtttgattcttatctttgatgagaatattttacgactctaccaagataaaagttaatttataaaaaactgatagtagtgcaaataatagcgatttatagaaatgcatgtggtagagtccagttagttttcgctctatggatatagattagttttactagttttgcgtttgtaaattcagcattccttacctgactccaattatgtggcaccttgcattctgtttttaaccagttgtggtatcttcttggttccctcatcaaaatcttggcctgtgttgattttacatctgtacaacaaatatgattgtcttttttaaaatgatgccttaacattacagataatgaaaaaaagagagagaggaagtaaattacacaaattttttgtcattgttgaactcaaatccatatctcttgaccttgattccagaaactgaaactgacaccatgaactcttccccaatctaattgcctgtattctatacttcctcatgttttcttgaccctttgaaatcagaccacatctccagagcacaataattgatagcttcgatatctacttggtatgtttccttctgccccctccccctataagatatgtagcaattactttgcaaaaggtagggaaggtgttaactatggtgtatgctctgaggagctaccgagatcctctccgcttccttctccacactccttttccctgactgttcaaaacgcatcctctcat

SEQ ID NO: 47673 - DNA, 1692 bp, Bovine  19866881063649
gtgcacgacaactctttggaggagcccctctgcctcctcctaccgtgccgtgctgccacactgcttggtgctctgatgcaccaccaccttcccgctctcctgctgctcttgaggactcctactgggacacacgcagcacaatctggggcacgggagcagctgtccctgccaggagccctctgctcagagatggaagcataaccctgttaaattaacagttgtgaatggagcatgcagccaagatgttgttaatttattttactctatcttgaattttctgaatgaggcaccgtcttatgtgataggacatctgcacttgggccttgatgccaaatggttctttaatacaagtactggtacttgtgagagtaaacaagccaaatatttgagtaggcaagtgcataaaagaccgtttggtgactcaagaaaactgcatcaccctttactcttttaagaacacaaaagaaaagggataaactcttaaaactttggaaaatataaaaagaaggaagttaagtctgaatgataaaaagagatactttacaaggaagctgagtgtctgaatgatataaagaaggttactttataaggataaaggaagagcccctctaagttcttttcacctccatccccaatctgtttttctctctctatctcaatttatcaaatcgtctgtcactttaactttccaaatgatgaggacttaagcttctgtgcacagcctctgtgttgaaatggctatttagaaaggttcaaactagacgtgggtgcgaagattgtgggatcaggctcacctgaacaatccaggagtggaaggggcacaagataggaaggggtggtcaggaagggagagaatgtgaaaaaaaaaaacatggttagcagagaagtgagacaaccctacaagagctgggaacccaggaggtaaatacacccaaagaagtgcccaaagtacccccacagacatgcagcttctccaggaggcacttctgggccccttaatatcatcagagatttaggggagttggattttaggaattaagtgggaatagacaactaatacaaattgtacagatcgagggaaagagacagatatgagggaaccgaaagggaaaggaaagacaggggaaggaagaagaggaggggagtggggaggaaggaggggaaggagaaccagcctaagatgaggtcagcttaaatgactgtacagaggcatacagaaataaaaatattttaagtacaaaccaggtcttaagccagaaaatgccaaagtgtacataatttctttggtgcttgtaattaattccataaatatgacaaactccaggttattttctggtaaatttcctttcgcagtcctagaggtaatagcagtggtagtatattttgctgagaggggagacaaggagggaaggtttcccaagactggctgtgggggaagccacagagcatcagaccacatagaactttgcccagctggaaatagaagagcttgccccaaacaaggaacatgtgagcccaggaaaccagagatcactcagtacatttagcacaaccctttcagcttctaatggggaaagctgtgccctgaaaatttgcttcagtttatagcatgagtgaatcagtcagtggtctcgtttgtatttgaactcaggtcctctcctttcctacccaactccaagtccagttttattg

SEQ ID NO: 47674 - DNA, 2417 bp, Bovine  19866881084990
ttactattattttttgctatgtaatggagatagtgtaagagggagagaaaagatgtctgaactgtacatggattgccatggaaacagcagctgaccaatcaatggagagcactcagaacatatgccttctcttttcaacattcttgatgaactgatgttctgatgttgaatccttttggctcttatatcagttgcagtgagaggggttttttttttttgttgtttgtttgttttttgctatctaaatatatgacacacacctgttataaaaaattcagatgtatacatttttaatcttaagatttttaatctctatgtacatacacccacacatgcagttttttcttactccaaaacattccccaaatttctcatatattctcctttcccaatcatttaactcaacatttcctcacatccacttgtcatccacttgtctccaccctccccaccttaacatcctaaaacaccgtagtctagttgacatagagcaattttcacattatcaagaaatatcaatgtgtaaacatgaaactctttaaaactcttttcaatattagatgtaataaaaagagcaagtgaaaatatatttagaggaagagctacaaaagggtcacccaccagaaacatgaaaaaatcaatttcatatttctttactgaattaagaaaataaaaaatagatctgcttctcaggaaagcttggggaaaatgaatgaagaaaagttaagtccttgggggcatagtctattttataaaaatgagtaaactttattttgcaataatttgccagttctgagactagtttcattgattagaaagtgtttgtaaatttctcttcagtggtgaatgcttgatctgcagaaaagtttaggtttctgggtcttaaatgaatctcttatggagtagcatgttctctacaacagcttccatgagctggaaagatgataaagacaaaatcaggctctctggtctttgctgttgttgctgcataaagatttgaagagctgacttccactgagcagactgaactataaacaatggctgctgacatttaaacctgtctccagatcacacagtcaatctgtggtgagaattgagcacaagtcttaggaccccttactgtccaactcattcactgggagaacaatggttgatttgctaatatactaatgctcttaatgtttgggctcactaaagaattaaacatcttgaaaaacaattctttttgtatataaaccaggctttaaaagtgttcaatacttacctccttgaccatgtgcaggaatttttctaggatcttgggatacatcagtgaataaagaaggctttcctgatctcacagggcagacattctagcagagcaggcaaacaagaatgacatattaagcatattgtagataatatgctaaaaagtgaatgtttctgtgaaggtgatcagtagcctcttgattactaaaaacttgtcttttttgattccctcaaacatcatattgttgaacctattcttctccatctgttttttgaacgcctgggcattgtggtgggtgtcaacagagcacatggcactttttcttgttcccttctcctctagcacttatctcacttttttaagccactgatcacttcctctacctcttcagcaggccctttctcttctgtgtgctccataaagaccagaggtctacttctacaaggttttatccactgtcctctccttgagctacacgtttctttttttttttttttggtaatctcactgtgtaccttcaactatacatgcattgatctacatcctgctcagtaattcattgagcatttactattttccaaccaaccattacactaggagctgggaatttaagaatggataagaagcaccttggagaaggcaatggcaccccactccagcactcttgcctggaaaatcccatggacgcaggagcctggtgggtcgtagtccatggggtcgctaagagtcggacacgactgagcaacttcctttcacttttcactttcatgcattggagaaggaaatggcaacccactccagtgttcttgcctggagaatcccagggatgggggagcctggtgggctgccatctatggggttgcacggagtcggacacgactgaagcgacttagtagtagtagtggtaagaagcacctggtctctaccctcatggagattacaatctggtggagaaggcagacaaaaagtaagtaaagaagcaaatgaataaaaataaccatacacttgtgacagttttcatgaaagaaacaaacaagaagagaataagaatataggaaacctactatgagatgggatagtcagggtggactctgaggaagtgaaatttgagcagaaacagaatgatgataaagaagcagctttgtgagagtcttcagaggaactccat

SEQ ID NO: 47675 - DNA, 1419 bp, Bovine  19866881136034
ctatggttttttgagtagtctgtatggatgtgagaagtggactaaaaagaaagctgattgttgagaattgatgcttctgaactgtggtgttggagaaggctattgagagtcccttggactgcagagagatccaaccagtccatcctaaaaggaaatcaatcctgaatattcactggaaggactgatgttgaagctgaaactccaatactttggccacctgatgcgaaaaactgactcatttgaaaagaccttgaagctgggaaagattgaaagtcagagaagaaggggatgacagaagatgagatggttggatggcatcatcgactcaatgcacatgagtttgaataaactccaggagttggagatggacagagtggcctggcctgatgcagtccatgggctcgcaaagagttggacacaactgagagactgaactgaactgaattgaactgaatagaagcctatgaagtcatgaaaaagatggacagaaagaatgtgagaatcctaacactctgctatgtatgaatatagatccactcactaaaactcaaagtggttaactttaggacaaattagaagcaccgctttacacaatattgagtgaatttaaagtacttgttatctcattaaaatagtaaacatataagagttataagaaacacttaaataatttcatgagccctggatccttaatgattcagtggaggaactcagaagatttggggttgggggtgcaaaaagaaccccataatgctcagttcccacagcccttccctgatcctctgccagaggcagaattctgggtggactgaccttcaccttgccctagtttagcattttttatactcgcttgcttgcttctgggagaagtaatatgctgctgtggcaaaatttgtcctcacagggctctggagtcaatttccaaacactgaaaataatcccatttttttctcccttaaagacagaatggtgtggtgtaggggcaggagtggtccaagagaagctgagcccctccctgaactcccagagcagcttccctaaaagtctgaagcctcctacttgagttcaactcctagatttcttgagtacaaacctcttctctgtggtgccttctcttccctacactgtgcctgtggtgaagggggttgaatcattccttctcactctgtagttcaataaatttttttgttctctcttcatctcctgcccctcccctctagggctaagtctctcttgaagaaacagccatgcttcatttaatcctgctgcagccagactgctggcagatgtcatgcttctgatgagacattaaatcaaggtaagcactaatcccccaggctgaagcatctatgaagacaagaaaaatgtggcttcacctcacagaaacactgcagtcaattcagccctcgactctgcccc

SEQ ID NO: 47676 - DNA, 1670 bp, Bovine  19866881210214
aaatcccaattgtccatctgtagcccaaacctttctccctactccagacaaccaggtcactcaactggtgtatgtaatagataccttaaaccaaacattttggaaaagaaaaaaaaagaactcctgtcttttctcccagagtctgctccttctcaagtttccccatctccagaaatagcaagcccatcttttcctgaggctcaggccacatatcttggaattatccctgactattttgtcttttcctgtattaaatctgtcagcagatcttgttggctccactttcaaaatatatctaggatctgagcacaattttattttctcttgcttccatctcattccaacaaaagccaaggtcttaaaatggtctccaagccttgcatgattcacatcctgcaaaggtcaccactgggagttggtcttatctgttctctctctcctactcccttctagcatctctaatatctgtgctaaaaccccagtgaccacatgtgctcacagccacggcattgtgctactgatctctctgcctcaaaactctttagatgctcattgagttactctctatcttcagcttctgtccacatgtcaccttctcgaagagactttctgtctgatcttatcatgctgccttcatccctgttctccttcccaacattatgtttttcatagctttcaccaccacttgatgtgctatatatttcacctgcttatttatagaataatataagctccacaaatggtgttttttgtttttattattattaatattttatacactgctgtatccccagcagctagaacaggtacagaatgttcaatagatgtgtgagaaggtagatacctacttagtcaaacagcagttgaatcagtcctgatggtcaatgcataggcggcaaaactgatccaagatcactgtcacattcagttggtttactccttatcaccactgaaggaacttctcctctgccatctggacagacattcccccatcttcttgtgccctttcaagttccttggagactaactcctctaattcttacaggtaataccatccctcctagtgattgaaagctgttggcagtgaccctgattgggatgtcagtggcaccggaaggccagacctgtgtcctagtctcactgcattatagtcactccctagatggaacacaatcatagagaagagagtgctttcatctccccatgcaaggatacatctgtgaaagagagccattttattaatagcaattccaaaccactaggaattctgctctgaccaaaaatagatggtacagacacatttttgcttaggggagatctgcctttctctcaggttaagtcatcagatcaaagtcatggaagctttaaagtctaatgaagagtctctggtggattaaaatgttctacttttcacaaacgatagttatagctaactcagtatttacctgttagtagcccttttttgtgggaaaggaaatggcaacccactccagtgttcttgcctggagaatccaagggacagaggagcctgatgggcttccatatatggggtcgcacagagtcagacatgactgatgcgacttagcagcagcagcagcagcagcagcccttttttgtggagaaggcaacggcaccccactccagtactcttgcctggaaaatcccatgga

SEQ ID NO: 47677 - DNA, 818 bp, Bovine  19866881217196
atatccatatcagactgcactgatgtcctgaggataaaggagacccgttatctctgtataatcatacagctcctagaaaatacagaaacctgctaaaaacccccacccccatcaatgagtttggtaaaaacaattgaacattttaaatcttagctgcattggaaagtatttaaaatcttgaaagttaaagaatagcaccaaatttcagtccctctaaatgtgtaaccctatgaaatctaaggactctaaaatgaatttctaattcctgacttataaaccccgaagaaggaaatttataacaaaaccagataaagctcttccaactgtgcctatgacaccatagctatacaaatctgccccattttatagtacacaaagaagactggaattcagctgttatcagagataataataaacttctggtgagtcagtcgctcagcctcatatttacattcccactgtcagcaacagtttttaagttaaacattttttagaagtaaaaattcaataaacaatatttatattaccaacagaatgtgttttccttgctttggtgataaactatctgattattttagacgttgctctcttctctcttttgtccatctcttagctacctcactaaaagccatgccccctcttcacacttgttctctccctgaagcttcaaggaagaggactgcaaactgcctggatgcctggaccctcacgattctgagattaaacccagatccacccatggcatgggtcccattctttgtctgaagccagcatcagatgagtcagatataagtcattatcaaatgaacagcgagcct

SEQ ID NO: 47678 - DNA, 1105 bp, Bovine  19866881217767
ttatacaatatggatatagtacaaaagagaaaattaaaactctaacaatccaaatagaaaccacaggcatgtttttttcctatgtcaaaaggaaaaataataataattcttgtaagtagaagctgctaatccctaaagcctccaagtagagcggagaaaccattgagaaagaaattaacaactttcagagttgtggctttgaaaattgaattaataaaaatgtcccccttttaagccagtataataggaaaggttctattttttttttaaattggcaaaaaaaaagagcacaaaaacacataaattcccatggaggacacttacaaatgttatgcttcaggtcctcagcatcagtgaaggagcaagtggcacagggaatattcttaaatgtttattttattaaacttcttaatgattttaactctatccctctctcacttttcccagacaattggaagatagctcccctgttgaatttggaccttccctttctgctgaacatacatccttactcattctgatacaggaaacaaaaaaaaagtccagttagttaagtccgctaatatgttattttcaaaacccagggctcatcagaaagcttaaaaagagttgtgccatatgcaacagagaacatttccttgttccagtgactgtggcaggttgaaaagtgagccttatgttcaaataaataccctggaattagaacaactgtgcaaacaatacaaaccctccaactctatgtatcctacctgtgaactggaatgaatgcttataagcagaggattagaggtaagctgtcagagcactagaaatcaattcttctcctcatgggtttgttgtaccctcacctcctctcccagatagaattcaaagaaggagaaatgcggtaactcttcataaatatagatacagaaatttcctcaggtagtgagggagtcagacccaactgagcgacttcactttcacttttcactttcatgcacagggagaaggaaatgggcaacccactccagtgttcttgcctggagaatcccagggacgggggagcctggtgggttcttgtctatggggtcgcacagagtcagacacgactgaagcgacttag

SEQ ID NO: 47679 - DNA, 991 bp, Bovine  19866881220420
agtaaaagataaaagcttgacatctgacaaatttcgaatagtaataaaataatgactaattctattaatattcatatttttaaggtaagtgcaagtatgtctacagtgcattttaagtcaaaatttggggtgttattggctagacacagtcatttctttgccagagatactaggctgtgtaaaggctaaccatctgtcaagtgatagagagacaaagaaaggtttaatatatactagcctaaaatttccacaaacttgttttgaattgtattgtcattttgttttggccttcatattctgtgttgagtatgtactgggtcagtcaccccactttgttttatgaacaaactattcaaggtctagataaggttattgttgcagctgatctgatctcgaggcaggataaaatatgttttgattttgtttcagtgtaatggtcaaaagctcacaagtgggccacccattggcagttatacaagtgacttcaagcacacttattttcacccacccattctgaattttgggtgtcttaattcttttgctttatatattgaagcttcatatttcaaacccattcctgagctattgggggggatggggagagcaacaggaatccagattgcatgttttaggtgcaatatggtgagatgtgaaattgaaacagcagattggtgagaaactttagtttcaaacaaatataaactcgtttgtttagtgaagtcatacacaaaacagtagtctctattgacagggcaatttttttttttcccgtaacttccacatcatgaagtcaccattgttgtttgggccagcagtctgtttctgaggtatcatggaagaagaagaagccctaatattgctgattgtaatgatatacttagatataccaggctgaggaattatttatagcagtgctaattatatcaataaaaatagcagtattaatactgtgagtgtcaaaatccattcttgacagtatgaggtaaacaga

SEQ ID NO: 47680 - DNA, 1679 bp, Bovine  19866881269316
gtggtggaattgaattgattgtgggatacatagctggcacctggggaatggctgtttgcgtgggacacccccctccactgccacattggaattgggttcaggaccctaattttagaggctgacatttattgatcacttttgctaaggcactgagctaaaggttttgcgtggaaaatctcataacaaatgcatgaggtaggtattatgataattttaatgtatgagataagtgatattattttttacagaaatatacttggggaggttccatatttaataagtgtagtgctctgatttgattatttaggtaggtagaccagagctcatcctctctaccactctaaccctgtttcacatagtaaggccttaataaaagtctggtgaatgtgtgttatagtttggattaaattgtttctttcctgagaatagttgataataaggaagattgaaaaaactgacagagcaacttaaagagccacagcagaggacgtcaaaggcaggtaagcttcgtagaagggagacatgagaagtgggtgccactgaagctggactgctttattattatatgtttttttaccacactgcaaggcatgtaggatcttaatccccctaccagggatcaaacccagtatgccttgcattggaagtgcaaggtcttaaccactggaccgctggggaagtcctaagcttgcctaccttcaaagagtcctgccctgtcattgctcagctgtttgctcagctcagagggtgcacagaggcactcagacctgaatctgggtacaactgctagagaaatgcaaggtagaagcaatctggggaaatgcacagagagacctactgagccccagggttagggtcaggcctgtgagcttgcagcacgccagctgctctcccagaaggagagaaatgagctgcagctgggaggccacttgtgcgagagaaaaaagactgtttttttaaccatcagaattgagtctgttgcttatgtgtaagaggttttgtggaagcagcttagatggtgctaagtcactagacaaaagatcacaccctctagctcaagtccctgtctctagggactctttcttacagtctcaggtctgggtgaggacagagcagtgaaaggcatcttgatcagctgagggagcatagcgacctggtaacaggagaaacaagggctcctgaaatccccagggctgttctgccagtgagaaaggaaaggcaaggaggaaagatgctggctgctgttctgccgctgagtacatggagtgaccgtgtccacgcttccaagagctgggtcccccctcccgccgtcctccccccacgcagatctagtcatcaggatctgcattctcacgaatcctttgcacatcaccgtgtgaaatgtcctggcctatggtgctcagactaaacacacctgtcctggaagatccacagttccttttgaatatttcttcaaacgaaaagtgcaatttcagagatgcctctattatggaattcagagaaataagaagcagcagataaattagctaaagccatgaattggcaatcaggagaccagtgttgtaaatctgacatgtcccactccactgtaaccccatagaagtttctgtttctctggaccccggtttctgtgtctgtacactgagggggtgactatgagagtcaagactcaaacagtc

SEQ ID NO: 47681 - DNA, 1149 bp, Bovine  19866881329137
atttaatgtgttgtatgagagactatatatgacctaggatagtcccagtgagctcagagaaggtacttgttcactcaatgtcagaatggcctcattgttaattagacacataggatttgtactggatgttaaacatcagaatcataaaggtcttcatggctaatgtcacatcttgattgttattgctaatatgtagtttgtgtaatcattcatgctctttatcagcctagtatttccaagatgaaggatatcatgtgtgaaaaatgccagtgcagtaacatgtacactatagacacttgaaacaagccaggctcttctttctatttcctttgaactcactcactagctttctatttttgcctaagctcttcagcaataaataatatacataggcaccctggtggctccaacagtaaagaatccacctgcaatgcaggagacccaggtttgatccttgagttgggatgattccctggagaggggaatggcaacccactccagtcttcttgcctggagaatcccatggacagaggagcctggtgggtcagagtccatggggtcacaaatagtctgacatgactgagcaattaagcaggcacacacacacacacgcaggcaataaataacagacttcctgccatttccatttctttaaaggtggaaatctggaattggaccactttctttcaataggcttatcctgcattatctgtttaaagacagggcctctgaaggagctcacaaaacaaaaatgctacatcaaccttttatatggtctttgaaaatcattaaacctggaaaaatatcttggcctatcatatttatgtttgtctcacttatattttgccaggttacttcctttctcaggagttaagtttaattttctctgtttccttaatgtttccacattaagtgaaaaaaagcaatgtgtacataacattacccccatcatcatcaccacacccagacacacatttgcacgtctatctgtagatttacaaagattatttcatagttgacttcttttatacccctgctaaatcagcatgttaatttattttcaaggctacttataggactgaacatatgaaagcttgagaaaagttgtgatttatgtgtatgtgttggcagagagcagtgagactataa

SEQ ID NO: 47682 - DNA, 955 bp, Bovine  19866881332918
gcatgcctggtaatcttagtgctgagacacagtttggaagtgatgtgggggtggggacgaggatggggagaagcagccagtttagcaaatggagacgagaaatctaaatgtgaagaacaggctaaaacagaaaaagataaaaagaaaaatagaggataaaaagaaaaatgtcttttaaccaatccttggtgttgcatgacaatttgaacatctgcttatttaacttctctcactgaagttttcaaaggaaatgatagaaatatgctacgttcctatccacccgagggttttccaggtggcgccaatggtaaagaattgaccttccaatgcaggagacataagacatgtgggttctatccctgggttgggaagattcccctggagaagaccatggcaacccattccaatatttttgcctgcagaatcccatggacagaggagcctggagggctacagtccatagggtcccaaaaagttggacacaactgatgtgacttagcatgcaagcacatgctcccacccattagcatggtatgcttactctttagagaacaggagaggaggagtgaaaactgaaaatgtgtgtatattctatagagagcaagagtactcctttacatagaaccatgagtactttaggtttcaatatgtggaattcctcaattaataatactttgcacttgaaaaacacattgtttacaaaacacttttatttttatgactttatttgagcctcacaccaacttagtagaaaaggcaggtctggatttggagtattctttgtacttgcccacttatatagatggataaactgaggctcagaaagatgatgttacttacccaaggtcacaggacaagcaattggcagagccgggtctagaacccagggtagggtttattccactacaaagacatgaaacaggacattaaatacacaacatctaagaaaataaga

SEQ ID NO: 47683 - DNA, 1096 bp, Bovine  19866881393051
tgaggatttcatttattaatctagatataaaacaagcttaaagagtaagtgaggaaatgcccagcatgcttggcgtagtgcagggggtggtaaatacagaaataaaaagatccaacaattgttatcttcatggagcattcttgcagcttcaagtgacatctctgagaagcctcccatcaacttataatttatctcagaaccctaccatataacatttgatgaagtgatacataaaatgcaacaaaagtgagaaaaggagaaccaacatcatttctgaaagagaaaagcattttacaaggtagaaataaaagcagatttataggaaaggtcatcagtggggcatctgtgactaacataggatctgaaataataccagtaataattaaaagcacttctttctgaggtgtttcaaatgaagaaaaactcttctcttctcagcaaacttcacaatgttttgcttatgacaaactggtgtaataaagataaagacacattgaaatggaatttttacaattgtgagtcttaaacacttagctctgctgtgggaaaaaaaatacaatatacatttacacacccaagctatcttattttagcactgttttgcaaacgagagttttaacaatcagtccaggttaaaattaggtcaaaacttatactctgtaaatgaattatgttgaacatgctcagggaatataaggtgattttagttcttcattttgaaaccctaccactggtgtttttcgtcttgcttagcagctttttgcctatagcagggttgataattataatagatacttttagaatatatacatgtcttagagatgatggcaattttgaagctgaaacagtatgggagacagaaaagacaatgggcagtgtttcaagagtagatataatctctgctctgagagcttttggagtgggtaataaacatgaacacaactgaatccagttaggggtatcatggagtgagaacggaaaccatccacactgcttatttttagattaaactgactttgttcttcactgctgtcatcaatacaacattatcgtttccatgtagaggaggaaaaacttttcctctctcagttctacc

SEQ ID NO: 47684 - DNA, 1095 bp, Bovine  19866881403074
accaaggtgtatcatgctccctcctatgataaaggaaagaaagataaggcaatttgagcatcttggtaaaagtaagcaatagtgatccaataggagcttcacattttatttaggtaaaccaaatatttaagccgtgttttgcctacttttactggtgttcagaactgtgtacaggataggaggtgatcaagattccgggtagttctcatacagtagtgcttcctaaggctgggtccctgcctcagtttttggtatactggaggggggcagggtgggatggtatggttattaataaaaacagattctcaggccccactctacacctatggaaacataataataatctctgtgttacacgggatctgggtatctggtttttaataagctccacagtagatttttatgcacaatgtagtttaagaattattgctctgaactgtaagtcctctgaaacaggaatggaaatgcattcatcattgtagccttttcagtatattgaatagaataggtggccaaaataacatctgttgagtaaacgaagacatgaagaaagaaatgatttcatccttgatccttctagaagcatgttttcataatcagagaccttggcaggttgtatatagggtgagtaaggcaagctttaagctatacctcctgatgaggagggagctttatatacagaaaatgcccctttcaaaatgatccaggaagacttttaaggaaagcctccagggagctaattaaagagtcaaaagcagacaggctgctgaattaggtctttggtaagccgctgaactcaaggagggaaatcgtagatgggcaataaccttcgaaaacccggcagctggggagatacacactcaaagcaaaaggtcagaggacagaccacgggcagtaaactggtagctagaagggacgaggcagctgtacatccagcttctggaaagcattaagtctgtgtccagcgtaggggagaagattggaacgtgagacatatctgtgtctaactttagtgaaccttgggtggtgggggtgagtggacccatgggggatgttaatggagcagaagagctgtctgagcagtaaagcacagaa

SEQ ID NO: 47685 - DNA, 821 bp, Bovine  19866881576371
tgggaaaaagttaaaggaatgttgtcagtttgcttaggtaccaaattaaaactaagtaaaaaaaaaaaaaaaaactaaaactattactagcaggagactatgaatctcttaggtgatataatttttctgggagatagtatgcatgtatatgaacactgtatgattattaatataaacaaaatccccttatttagacaccaagacatttaaataatgagaagatgctcctctcttttagtgtttaaataggaactaggcaaatataaggggcttccctggtggctcagaagttaaagcgtctgcctgcaatgcgggagacctgggttcaatccctgggtggggaagatccccgggagaaggaaatggcaacccactccaatattcttgcctggagaatcccatggacagaggagcctggtgggctacagttcatggggtcccaaagagtcagacaggacttcactttcactttcactttcaggcaaatataggtaatctcagggacggctttatacggttggtttgttgttgtttttttttactgtttttgaatactggacacactaaaattctttttgacccaataaacgtactttgggtctgcgcatacgtaccatcatctccatcttctggattgttttcacttgtcaccccagctttatattgggcaaaaagagctgaagtcattcttactttttctagttgttcacatcaacaaaaagctttatcccttcacctcatctctagaggagagaagaatagagatgattaagaagcaaatgaagataagaatatgtataagtaaagctgaggggaaggga

SEQ ID NO: 47686 - DNA, 1342 bp, Bovine  19866881612862
ctatctatctatttaggagttcattttatacctaaatatatccgattttattctattatcaatggtattttatattttctcctctaaatcttaatgttaatcatttttaaaatgggagtaacaatgtagaatctacctcaaaaggattgtcaggagaatatatagaacagagtaatagtcaataaatgcgagctaatgttattacttgtaaagcttttccctatttctgtatatacacatactattcataattcaaaatccagttaaaatgcacttgataagaagtctttcctctacatccaagctaacagtgtgctttcttaaataagtcattaataaatatttccccaaaacaaataaacataatcaagcattactaagaaaaggttttcacaagttcatgaatcgacttaaacctactgccatcattgtgtgaaaacccttgcttacacaaagatacatacgcttgcaacattttcttatctaacaatctagtttattttatcaaaaagaaaaatgaggttagtatgacatgacttgctcttggcaaaataatgatatgggcgttaatagtcactttggtttctacatgatcacaataatctattcatgtttagaatagatttcagaattttgctggagataaaattaactctgtagattacagaattcatctttattttatttttaagactttatacatttgcttatatccagtattttatacttttcgactctctaaatgtgatcatatccagaagttatgaattttcattggaaaaaaaacactggttttccatcggaaaaaaactgcttaaggcttcacagagcaaaagttgttaggtttggattccaggtggtccatagatggaccactatgtagcttgaaaaatagtatttaatattagttaacacatctatgctgctgctggggctaagtcacttcagtcgtatctgactctgtgtgaccccatagaggcagcccaccagattcctccgtccctgggatactccaggcaagaatactggagtgggttgccatttccttctccaatgcatgcatgcatgctaagtcacttcagttgtgcccgactctgtgcaaccctatggacagcagccaccaggctcctctgtccacaggattctctaggtaagaatactggaatgggttgccatttccttcttcataactcatctatacatggagataatagcatcttcttgggcatagtgaatattaaatgagagtaagtattcaaaattctttagcttttctgtttcctcacctataaaatgggaatattcatccccccttactactcaagatcaccatcaggaccca

SEQ ID NO: 47687 - DNA, 743 bp, Bovine  19866881715057
ttatatagaaggaagctcaggtgaagatttgggaagctaaagacaggaaagactagacaaaatggcaccaggagtgtagagcacactacagaattattctggggtaagtcaaggaaaaagaaatggaaaggcatcttggcaaaaaggtcaagtctaggagatcagctgaatagacagttgattataggtcagtgaaacgaagggtactttcaagaacaagaagcatgaatcagaaaattaattgaggatctgagtttcactataaggagttgggacaataagacagtggatcatttgatgggaattactaacaatgaccctgggttctaagaaatgaaattaccattgccactaagaatcccacatatgttatgcccaggatcaggattgagccagactactgtaaagtcaacaaacagaatagaggaggaaatattttagaacagaatgggtagtgatgaaacagggtgctgtttataagaatgtctttcacagtcttcacataacagacgttcacaatccatataatttgaaatagaaataaagaactgattgaaataaagcatgatttcagaatttataaagacatttttggtacatatgcccagaggcatctaaaaatatggccatgttttgcaaaattaagaaaataaactgcatacatcaatgacagaggaggcatcgcactaaaatccaactaaaatccagtttaaaaatatatttgtaaattattttcaagaata

SEQ ID NO: 47688 - DNA, 1140 bp, Bovine  19866881765817
ctgcctgaactcttcctagaagatccagaatattattatatggcacttacataatcctttatcattgtgcaaacatcccataatcatttaatggaagtcctcaaaacactagaataggttgatcttgttattactgttgctgagaaaaggaaataaagatgaaatgatgaaaacttgtcagatatcacatctcctactaccaggaaaaacaggattagcactcagtctcttattctctgatctgctgatatccattgagctagagttatcttagcatcagaggaagaaataaatccattcatttctaagaattataatttggaaacgatctgttcagtgttaaagaggaggttctctttattttcaaaataaataaaatgcaaatcccggtgattcttgggacttgggggtgggaagggagacaagaaaattgcaatgtagggccagtgagcaggaaggaggtaaaagagatgggaaaaaaaaaaaaactgatggtgggtgaatcctcagtctatcatcacatgggagaaggagttaaaaagccaggccactgtcttttctcattggtttcctccagaacctgtgggagaggaagaaatactgctgtgccttcgtttggggagcagcagggcaaggcagtgtctctgcagccaaaaggatccctttctgacagatgtggggttaagtactagaaaattattccctaaaatcactattgttagtcagtcaaaacaaacaagcaaacaaaaaacagcttcaaagagaaaacaagatagattaaataacatacaaaatttgatgtaacaatctattgtttttgtgggtttagggtagagagtagaaaacaccctgagttgggatttagaagtcctggttttagttagagcagttacatagctagctgtgtgacttcaaacaagtggcttaaactctctgggcctctgatccttcatatttaaaatgagggggttggttactaagtaatgtctaagagtccttctagagatcgaaatttcccaatttataatagcaataattaacattttacagtgccttcccacctacaaaatggttttcacatacattatctactttgattcttgtgccaggtctgaggcagtattatgagtatgcccattt

SEQ ID NO: 47689 - DNA, 790 bp, Bovine  19866881874960
cttttagagtttgaaatagctcacctgggattctatcattcccactagctttgtttgtagtgatgcttcctaaggcccacttgactttgtggtccaggatgtctggctttaggtgagtgatcacaccattgtgcttgtctcaatcatgaagatcttttttgtacagttcttctgtgtattcttgccacctcttcttaatatcttctgcttctgttaggttaatactgtttctgtcctttattgtgcccatctttgcatgaaatgttcctttggtatctctaattttcttgaggagatttctagtctttcccattctatttttttctctatttctttgcattgttcacttaagtttttcttatctctccttgctattctttgtgactctgcattcagatgggtatgtctttccttttctcttttgcctttcacttctcttcttagtagaataaccagccaaaaattgctgaccttacatgtctgctactccactactgcccttctactagggatctcagttgtgagttctgaattccagtctccattactactgcttcagtgtagagaatgatgctgagtgtgtatgtttatgctgataactggatactcatatggcaatgattagagtggttaattaataacataaactgaaggggttctagggctcctccaggagagattaaatgaatctaaatcccaacaaacttagatatatgaggctatgtgccaaaagcaacagctaaaaataagttaaaacatacttctatagaggggaaatggaaggaggggg

SEQ ID NO: 47690 - DNA, 606 bp, Bovine  19866880460175
aaatttgatatttatcaatgtgaattttggcaaataaataatattagatatctatttttgaaagcagcacagccatttttattagtaaaatttacatttagcattttttcctgttgtaatttagtggagttctaacattcttacatatatttcacatctttccttctgtctcaacaaaggcaaagtgttatcctggtacattttctaacaatgtccttgtatatataatgagtctggaaaatctttgttggtgtgtgttcattttacaaatggagagtttttcattataacttctcttttgaaataaatgttaccagtgttttgaatgatcatgagaaacttggccccagggctgttgaggtcaacaatagcactgaatgaagtgtctggttggaaagagaaaccaatcctggctcactttgcatcagcatcctttgagaaggctttccaaccactaacatttgcatgataaatttatggactctggctctaccagcttgattgaacacattgcattttgctaagaacagcatgtcaactagcacagtcagcatccatatacatctgggaaaactgcaactgttagaattgtgccatgggactgaa

SEQ ID NO: 47691 - DNA, 1055 bp, Bovine  19866881052379
ataaaagatacttaacactatctgtaagtgctttagaaggagaaagacaaagtgatttagagcctattacattccccaaaatttatacatattatcacatttccttctcatcattggaaactgatgggccaaggtatcccttatttcttttcatttaacaaatatttattgaacaccaacttttgaaactattgtttccagagttaagatatatagtgcaaaactagaaattttaaaaaccacttgacttcttacaaaacacagcataataagaaaagcaaggttacaaataatgaattatatattttttaggaaattaaaatattttgtaagacaaagtttatagcagatactagtataaaagctgaaatgtaaatgtttattttccattgtaatgatcaaagattttttcctactctatcacatgattgaggtattaaaattaaattcctttctatgcaagaagttcctaaaatcttaaacactgccttaaatttcctaagtactcatggaagagagggccttgaataaaattcccttaggcatgtaactagaaaactttatatcaggccatggaatagtgagatgaaatatcaagaggtcttgtaagtagtgtgattatataacttatcatccagtgtagtatgtaagagtggaagcaagactattaataattacacctataaacaggacagaactacctggctgttccagataaatgataacaaagagtcacagtgttgatcttgaggctaagaccctgctgacctctaatcaaatctggaacaagctcttttcaatattgcaacttcaaagaactcacagtctttgtttcactttactaatatcatccatctgaaatcctctacctcttagaaaaattgtgatggacgaaggcttcctggcaagtgtaagcatgattcaccgacttatcctgtcctgagtgaaagataaacaagtgaacaatcttagaaacatatacctaactttgcatcagatatgtctgatagaggtcacagtggcatcaggtggattctagttcaaaatgcttgagt

SEQ ID NO: 47692 - DNA, 1018 bp, Bovine  19866881107197
aatgagctaatggttgaaaaacaaatgaagccataccaactctgtttgaaatcaagtatattctaatttactatcactcaaaaaaagacaacaagataagcacaggagggagaacaaacacaaaaaatcagttttatgaaagaggatcaatgtgatagcacactaacaaacctgctttcaccctggacaacacacacaccatgtatggtcggaagaataggctagataagaaagagagatgccagaaaagcttgatgctaaacaaaatccagaaaagatacagagtagcacagaaatattcaagattaacacaggcagaacataattttttacttaacattaaaaatttccctttattttctacataataaataatcttccagtctataaaaacagatgctactgctaaggctatgcttcacactatcattttcctctgtatgctagttcacacttttttccttcagaaatcttggatatataccatatggttctggtgatttattgggcttgaagtgctctacttgctctaactttctcattttagatgtcaatctttgtcaagggtaccatctgatgttctatgaaaactgtcttaggaatagaaaatttcccaaagttgtctcaatattctaatatgaaaaccattttctttcctctcctttctattaacaacttttaaaattctcatgaaggacttaaagctctcattattgatccttttttacttaatgtacatactttctaacttttctgagactttttttgtttcttattgctaattgctagatttggctaaccttttgctgaacttctatgattgtttgatttaaataaaatctgtacaatgctacatctaatccttaggaaatttgaaatataatacaaatgataaatcacttaagtaataataattagaataacagttcacattctctaagttgattgatttttatctaaggaaaattttctaaggtcctaaacagcttcaagtttatggttttcaaagctaggaaaa

SEQ ID NO: 47693 - DNA, 1230 bp, Bovine  19866881249652
gatagcttgcaagcaggataaaatctcactccctttataattctttataggtagtgagttaaaaaagacctgactgagcaaacttagtaaaatatcatcaactggggaatctgggtaaagactatgtgaaagtttcattacaacatttctgcaatcttgattccattttcaaattactctaaaatacaattatataaaaagttatatgggttttagaataaaataaaatgtatgtatttttaacaacataaaagtctttgaaattgtatttaaatgttaaattattatttaatctgcatataagcaggctttatctacgaagatagagccagatctgtcataaaggagtcaggcagttattctcacttggcctataatatatacgttacactcattttcagcctgccatttatattttcaaaactaattatcttactaccatttaaagtaaaatgaattttactttaccatttaaagtaaaataaattctgagaatttagttgcattttaatgttttcataaacaagcaacagtattaaacaaaaaaaagcaatacacaagcaaaacacagatgcaggtagagaataaggtgtcgtctataacactaatgtttcaatttttcccatttgtaatccatctaaagtgtacaaacacacgcacaaacacatgtttagatattctcataatgtcataacttttttaatcatgaaaaatactgccctcagaaaatatatcctccacattaaacatgaaatattaatattttaatttagcatttattaggagtgaaatatccaaggtgacagtaaagtaattataactgcagagtttgaaggcaaagtgtttggagttcgttcttgtgtgtattctataacatggttcatccttaattttctgacctgtaaaatgaggataatagcaacaccatagagaggagaaaatgtaaacgatctggcacacagtaagaatctactatatcttcttttgtttcacctgcctatgtttttcttttttcatgtacaaaattctagggaactatgaaaatatgtattccaatgggaataatactctattttctaataaggcctaatttccttagaaaatatttatttagcccagaaagaaatctttttctttccctgggtctcttgtccaaaatttatcatttgaatgagctctctgacacagatgaccaaagcagtccaaaagtacacaccaagctgaaggtaa

SEQ ID NO: 47694 - DNA, 1079 bp, Bovine  19866881500119
ttgaaattaaagaatgttccacattccttactggtcatttcttcatattaaacctctgtagaataatgaaatataaaagccctttctaaaatacccatatcagtatgtatttgtggttgtatttttaactgtgccacctactttgtgaggttctctgtatttctttttcctaaattctgctaccagcaccactccatactcttaacagacacacagacacaatatctacctacagctgattcagttattttgatagtgctcttttccttagtttgtgagcttttggagatcaggcaacatgtacacttttttgtgggtacccaggatttaattacttgcttgtcataaaaattgattctcaataagtgttttctgaattaatggatgtttataaactgtttttaagccaatacaatatgtttttccatagtctctttacgagttttaaattgagatatggatatatgcaggaagagggactgcacatttacaaattcatgccatacaggaaatgtttttcccatctgttaacctatgctattgtaatattgattaaatattatttttatatacagtaaaagtagacacttcatggtccttgtcaagtaataaaatgtgttttccagttccattttcattttgatgaatgtcaacataatgtacaaactattttgagactttccacccacaactccggtccagtataacggcattttactgaggaacatggttactccagagcatcttagttcaaaatgaagatcaattgcatatatatttgacaacgcagaatgaatttagattaatacaaaatcctaacattgtccattaagagaaaagcaaatatcatatattagcacatatatatggaatctagaaaaatggtattgatgaacctattagcagggaaggaatggagatgcagatgtagagaatggacttgtggacacagtgggaaggagagaatgggatgaatggagaaaacagcatcaatatatatatagtatcatgtgtgaagttgatagctggtgagaagttgctacatatatagggagccaagcctggcactctgtgatgaa

SEQ ID NO: 47695 - DNA, 947 bp, Bovine  19866881966463
ctccctatacccatttaaaattacttatccaatgctgcagtaagactatatccctgtttattcctagcaagataactgatccctttctggagtagattaaaaaaaaaaaggctttcctgatgttctcattttatttttctttaatttgtttttgtggtggtggtttagttgctaaatcatgtccaactcttgcgaccccatggactgtagccctgtcaggctcctctgtccatgggattctccaggcaagaatactggagtgagttgccatttccttctccaggggatcttcctgatccaggaatcgaacccggtcacctgtctttcaggcagattctttacccgctgaactatgaaggaagatccaaaatttatattcttatttctattcattgcgaccattgacctcagattttaaaaacctagtttcaatgcgatttataccatgcaaaattaaattgaaaggtcaaataggtactttaatcatttttaaaaattcttcttaaattatgcagataatataataaaattaactctcaagcagaatggtctgtagacaaacccctgcagtcttcagaactggttgacattatgcagctatttcagataatgcaagaaatgcattattacataatatcttgcctgctttttgcacgtgacagaggaactaatgatattttctaaagtgaatcattgccctgtagcattactctctgccaagcaacctccagctgctttctcagacccactttttgtgcttgtaattttcttttgttcctcatctcctgaagtattaggactaaggctgggtatttctcttgttcctgtgcctttacttgacctctctctttacctctggagctgtcagaatccaaagagtaatatatgaaacaccacattgaatattagcaacattttcatccatcaatagatagtgagcaaaatgt

SEQ ID NO: 47696 - DNA, 1240 bp, Bovine  19866880475739
gactgctgaccccacatgacttttgcataacatctcagtgtataatagtagaccatggaaaataaagaattgggatcagtttctcgaaatactggtctccccatgtctctctctctctcattctggctgagtctccatctggagcacggaacccaccaagcttactaattttgcctgggcttctaagatctgaccggggaggcctcagtgtctcctctccttcgggagaacggaaggacgcctgcggcctacgtaagtggtgcaagcttcttgtcttgaagttttattggtcccctgtgtaaaccaagctactcagcctcttttctccactgaattttcctactgagctatccttattctattactctttatatctttaattaatatctaattgaagctattgtatcctgaccctcgcggacgccgtccccgctttgaactccctggatcagccgaggctggacccccgcaggtattctttttgctttggctccatcccttcattctttctggagttatttctccactgatctccagtagcatattgggcacctactgacctggggagtttctctttcactatcctatcattttgccttttcatactattcatggggttctcaaggcaagaatactgaagtggtttgccattcccttctccagtggaccacattctgtcagatctctccaccatgactcacccatcttgggttgccccatgggtgtggcttagtttcattgagtataggctgctaaaatgacttctgagtttaacccttcccacgaattttcctcgaacacacaattatctctcatcagtcttgacagtgaattgtcttgttaaaaagcctgcaattctgttacagataagcttcaaatattgatttgaaccttttacttccttggtctgagatatcatggtaaggctaaaagtgttcaaatctattgctgcagaaaagcaaagaaatgtctccagagaaagacagatctcagagacatgcagaaaacagtttgctacatttctatttcactggacaccatgtaggcatggcctatgttggttcaaagaagaagggagtaccaaagggtgagcagtgaaggtagctctgggacacagtaagtgttcaataaatacacaagtcagggggttataaagtgaggtttctgctacacagcctctgagagccacatcatggcagtcagcaggaaagaagtgctgggagacaaaaactcaacaata

SEQ ID NO: 47697 - DNA, 920 bp, Bovine  19866880486727
ctttatgttttctgcatctgacatttacatcagacacattcaaaaaacagtgaaccaagtcttatgaaagagatagaaggatcattatttaaaatattgatgtcagaaaaacagaattgctttttgatttaggatatgtaaatattcactcttcttgaaagactgactttaaaacatgtctaatcctgctaaacaatagaaaaaacatagaagaaacttaaaaaaaaaaagaaagaaaatacaccacataaagcagatataacatcatggggaaagtaggtactttctatatcattgtcaaaaaccaaaaattgcttcttgatttaggacaccgtaaatgcatacagaggtttgagtggctggaagaaatcaatatcatccattgttccttggatggtggactttgctcatgctctaaactctgaacatttctaaaacagtctccctcaaagctggcaaatttggaaaaaataaattccttttatagatgaatcattttataggtgatgtatcttataatgaaccccttacgattttcatttaatattcaactaccctgacctgaatatttctatcttctcctctaagtcagtacttcaggaaaatatgatgagcagactgacagtgttgtcaggattgtgattgagacgaagctgcaattatgagcaatgtgaaatacaagtcctcctaggtcctgacccatcatgtatctggtttcacaacctctgcttcattcgtcagtcataagaagacctgagattcttagtctggtgacagaaacttccttttcttttggtctatcagaaagggtcggtttggtttagtggctaaagtcgtgtccgactcttgtgaccccgtggactgtagcccatgaggctcctctgtccatgggattctccatgcaatactggagtgagttg

SEQ ID NO: 47698 - DNA, 3790 bp, Bovine  19866880587311
tcaagtacacaaagcaccaaaaagcacatttctaaaatgtccctgagtgaagatgtgagaaaaccccttgaaacccattattatcatggagatattacagtggcctccttggttgctctcttagataagattgtgtctgcctaaatggcactgattccatttatataacaataacaaacgaaaaaaagaatatttggaaaaaagaaaaataaatagctgagagaagcactgtaaaaatctgtggttaacatagtactccaaatgtatatcatttgctgataacacatgattttgctaacagtgtcacaacaaagcatgccaatctatcagtcctgcttgtgcttataaccagcatgaatatcttaatgaaatcagtgggtttggggttaagggtcacccaagtggcctcctttggaaagttaaaacagtacttcattcccacatgtgtcatctatgcctttctgctgttccacttcaaattctctctctaattctagtcacgtactttttctgccctctgtgccatgcaaaaatgccaccaaatttgtcagaaaagatttgccctttgtgaaactagcctgattaagttttatcagctcatctctctctggatgtttggtaacctcattccttattactgtcttagagatcttgcctacagccaagggcaaatctgttcatttataatttcctgattctttttctgttcttttctcacagattggggtgaggtatttgtgttttcattttgcttctctctccctgtaactgaaacgtttttgctaagctttcctcattttggttgaaaatttacttagaaatagatctatatttttttccggtttatcataatgactgttccttataaatttaaaattattggttgataaaaacctctcatgcatttcctatactttccaaagtgatctttcttatcatgaagtgccccttagagcagatgaatatttattctctttatttttctcttgctacatcagtttaagcttcataaacaccataattacactagagcaaatttgaatatgaaataagaaaatgaaatagcatcccctgatccattaagctatattgtcttcctcccaatataaagattaaatgacagagatagtttatagaaatgacaaacatgagttcaatttattttttcaaactcataatcaacaaaagatttttattttccatttatgagtaggaaaactggctgattccctatgtgagagaaacatttgaaattttctgtttattctttcaaggtacaaccagttctgaagttctgaattttacctcttttttttttttttcccctccagtgtttgaacataaacagtttatcctgtgatgctatattgactttgtaaacctttcacaatgatgagaatgtatcaggcattttcttctcttcttttatattcatgttttcccctttctttatgttatttatcaacttgtttccatgttcttcaacacaggtgaaacgttagccaagagaaatacatcagatatctcattgacagggactggtatggatatgtaggaaaaaatttgatttgatttactcaacctgcattgtttaaagttttaattttatgccattatgtaaataattgatgatcattataatggggcttcccaggtgactcagtggtaaaagtctgcctgccaatgcaggagacataagagacatgggttcagtccctgggttagaaagatcccctggagaagggcctggcaacctactccaggtatccttgcctggaaaatcccatggacagagatgcatgcaggctgcagtccatagggtcacagtcagacatgactgaatcaacttatcaccatgcatgatttatcaagaatacccaagatattgaaaagaaagtctaattaaggaaatgaatggagtatcattaaaactttagttaaaaatttactaaaaaagcccactacatgcaataaattaaaaaaaaaaaaaaaagaggattttagtatgaaaatgcagtgtgaaaatgaaaaagaccaaaaacagttgaaaatttgttatgtgaaaaggatggcattctgaatcatgtggaaaatgttggcattccccaaaatgtgatttatagcaaaggtaaacaacattatttcatatggttctgttcagttcagtcgctcagtcgtgtctgactctgcgacccgtgaatcgcagcatgccaggcctccctgtccatcaccatctcccggagttcactcagactcacgtccatcgactcagtgatgccatccagccatctcatcctctgtcgtccccttttcctcctgcccccaatccctcccagcgtcagatggttcagaggagaccagtttaaaatgataaaactacttattttagctgatatataagaaatttataaaacaagtcacatatcacacctgttccctccaaaattatgaacatataatttagggcaagagtatattaagaagggagttaagacaaatttaaagaaaatattagacaaaataatattatcttagacaaaaatatattagacaaaaaataataatattgtgcagatggcatacagatacaataaagtgatgaaaatgtatgtaataatgatttttagaatacttgcattatttattaaaagatgctatgataaatagctattcatctggagaaatattgagttaggtaaataattcatagtctataaaaaataagttccagaagcaataaatttcaaaaaaatattaataatacactatattatcagctaacaaaaattttagaagactttattatagtcctgggaaaaggcattatttagaaacaaatctgaaactcataaaccatagagaaaaatattgccagaatttattccaaatcatttaagcacattatctgagtaaaaaaagtaaaaataaacaaagtacaataaaaaaatatataaaacatggatacaataattgccacaccacatgtaaacagaagaataattaactgctgcactatatgctatatgaagtgttctacaaatgaagaaatagataattaaaagaatggaaatatggacacaccctatgaagagggtgttttaccccaagaaatacaaatgacaataagcatacaaaagatattctgccacacaaatggtagaaaatgcaaaccaaaccaggaagatactacttttactaacaatattaggaaaccttacattcttaacaaaacacaatgtgaggaatggtgtggaaacaggcattctaatgcagtgtggataagatagattgtaacatgcaaagtaaaaataaatgtatgaaattgcatttggaagctggagtggatgtataaacacagagatttaactttttacttaatatattctgtttcaaggtagttttaaaagaatttgctttttgtaattaaaaatgttaaatctgacaaaagtttaggaaaaaatgtacatgaatagattagtaccaacagttaaacttggtaatgaatatgtgaaaaggggctaaatctcactgaagatcaattgaaagcaaattaatacaattgaatgtaactctcaaataccaatctcaaggacctatgaaatcaagaatatgaaatattgctatcttggaggaaagaaagtaatttcgttaaaataaaagagtaagctatgtcttgatttcaaaaaggcagttggcagtatagataaaaaggattatttttacgttgagttttagtccaaactggctcatatataagagtgctaggaaaataccaggatgtctagtgtag

SEQ ID NO: 47699 - DNA, 3582 bp, Bovine  19866880639882
caaatttggaaaactcagtagtggccacaggactggaaaaggtcagttttcattccaatcccaaagaaaggcaatgccaaagaatgttcaaactaccacacagttgcactcatctcacacactagcaaagtaatgctcaaaattctccaagccaagcttcaacagtacatgaaccgtgaacttccagatattcaagctggtcttagaaaaggcagaggaactaggaatcaaatttccaacatctgttggatcatcaaaatagcaagagagttacagaaaaacatctactcctgctttattgactactccaaatcctttgactgtgtggatcaccacaaactgtggaaaattattaaagagatgggaataccaggccaccttacctgcctcttgaaaaacctatatgcaggtcaagaagcaacagttagaactggacatggaacaacagactggttccaaacagggaaaggactacatcaaggctgtatattgtcaccttgcttatttaacttatatgcagagcacatcatgcaaaatgctgggctcggtaaagcacaagctggaatcaagatttcagggagaaatatcaataacctctgacatgcagattacatagcccttatggcagaaagtgaagaagaactaaagagcctcttgatgaaagtgaaagaggagagtggaaaaagttggcttaaaattcaacattcagaaaactaagatcatggcatctgttcccatcacttcatggcaaatagatgggaaaacagtggaaacagtgagagactttattttcttgggcttcaaaatcactgctgatggtgactacagccatgaaagtaaaagatgcttgcttcttggaaggaaagctatgatcagcttagacagaatgttataaaacagagacattactttgctgaaaaaggtccacctaatcaaagctatagtttttccagtagtcatgtatggatgtgagatctggactataaggaaagctgagcgccgaagaattgatggttttgaactgtggtgttgaagactcttgagagtcccttggactgcaaggagatccaaccagtccaacctaagggagatcagtcctgaatattcattggaagaactgatgctgaagctgaaactccgatactttggccacctgatgtgaagacctgactcattggaaaagaccctgatggtgtgaaagattgaagatgggaggagaagggaacgacagaggatgagatagttagatggcatcactgacttggtggatatgagtttgagtaaactccgggagttggtgatggatagagaggcctggtgtgctgcagtctatggggtcccaaacgttggacacgactgagcgactgatctgaactgaactgaaaggttaaaagaggttagggtagttaaatagggactgctacctgagaattaaatggcatgggaaaataataggcttctatacatagaaactgagataaaaatatcatcattgtgagtattatgctttgatactatttgcaaagtatttattcactatagcagtcaccttgtacttggaaaatccaggttctctgagaacctcaaattccattaagcatcacggggaaaaccacacttggtggttctgtgatgtggatagtgttctcccatcaattataataaatctgaactgaactagtcagaaagcaagctcactgtggatactacagtatagggggtttatttcagaatgaagatcttgtacagttgtgagggaaactggagtactaagggcccaaatgtaatgtcatcaacaagccctcagggcacttgggcaggtggtaagtcagacattgcaagtggatctggaaaggcagcagattcagctgccagagaggacatgaggagaacttcatgtccactatctctgaagctgacagcagacttaggatcactcttggtcagcagtgctagcagttaggtcaaaagctagatacgagaaaggagacagggaccctctctcagtttctcaaaatctctctctcaccacagttacttccatgtggctttcagagaaccttgtcatttcctcttcccaaatttcatccaattaaaaaagaaaatcaaccccagaattcagaaatccagaattctatagggaagggaaatttgggaacttagttttagctaagctaattttattgttctctcttatctctgaattaggatttcttctgattatcactcatttttctaatgaaaataatcagtagtgtaatcaagtagaatccaacaactatagattgtcttagtgtttaccttcttaacacatcagctgctaaatatgtgtttcagactgtctcttcacattaatagtttgtttggaatgtctgagcatctcactgagttaaccaattgaccacactgatggacaggcagactaatcaatgagttttgaaagttggaatttgtatataacagaaccttagccacagaatcgtagcattcaacaacttgacaacggcagtagagtttaaaaactgttacccatctgtgactaaactctatcagtgatgctcttgaaaataatttcaaaataacaatcagaaaacgtttgataaaagaatagcacagagaaattcattcataattacccgaggggatagcatgagatggataaatcaattcaaatatgagtcccaaggtgccttttagctaaaagaagcagtacggtcctcctatgttatgtgaaaaaaatagtaaaattgtgtaatgattttcatcttaaaatcattgaatatcaggactgtaaagggttatggctgtctactgttatagagatgataaatgctaatgttatcaagggccaaagcggaaataggctgagactctaatccccaggtgtagattattgttcctggtctcatttttcttcagtatcccttttctttcttttttttctacacctacatttggagtgatttcaatgttgtaaaactataggcaatggacaggtgcaagggtacggagaaacctggcagttgaatagaagatgtttttttggaaccagttccctgaacagcccatctgcatcatcagtcctcacatgctttggactctggaaatgtgttctcaaacacaaagcatgatccagcttctgcaaatattttatcacacaacagcaaatcatttggcaattctatttaagagagactctgagtctggataagtaaaataagtgtgtggccacgaacttagataaattaaattatacctttggccttggattcagtttggtgtgcacactcagtcatttagtcggtctgcctcttggtgaccccattgggactgtagcccgccaggcttctctgtccatggtaattctccaggcaagaatattggagtggtttgccatttcctcctctggggcatcttctccacccagggaacaaacctgcctgtctagcatcttctgcattggcaagcgggttttttaccattgagtcacctgggaagccattcagtttagcaatgctacataagaagtataaagtaaaaggacatttagcaattattaaaagatgctgtggccacccagta

SEQ ID NO: 47700 - DNA, 658 bp, Bovine  19866880843704
aatttaacatagaatcccaattctatttcagtaaaaagatatttatttacatgaagcttgtcttgttccctcaaagtttaaaagttgctcacaaaaatacacaaatgaatgcactaaaagtaagtgggaaaaggagacaaataagtttaggtcacctaaaacaaagccacaggtgagttcaaaatatttgtgatacagatttgtagggaagagacaatggatattagaccacattaaacagaatacctatctcataacaccataaggtaatgtttacaaagttcctatatagtgctcagctcatagtaggtactcaataaatcttaactctctctatgctaccattaactggacttaaaactcttgatatacagccccattaaaggttaatcgtttaaaaataataagagtgttcagaatttctatttggctatcacaaaatgagttttatgataatatatacactcagaactacatcatccttcacttccttaatggggaagctcttaaaacttgctagcacagacagatctcatttcctagcaatcaacatctggtgattcacattttgcagcacaggcaaattacaggcatgttggccgtgtgcagtaattataacagtaagccaggacattaagtgaacttatgctattcatgg

SEQ ID NO: 47701 - DNA, 1064 bp, Bovine  19866881053165
atctgatattttagatgtatccatatttataaaagtgtaaagcacaatggaattatgctggaagtctcaaataatatttttcctactttatattcatggaagagatgagctaaagagagaacaataatgagaaatggtggtgtgtttttctaagcacttaagacataattgccaactgaaaccctaaaaatgtttacatgtcattaaggtttgcttcttgtaacaattttaaattgattatgaagggattgggtttgtaatctgtggtagtatgtatcctagttgccatagtgacgtaagtagggttgtgccaaagcttactttgtttatatcttaaattgttggattacatcatcaaagcagataaaagatatgcagaactggtttacctgattttcttttggctagaattaatattcatagtagaaccttattaaaatgtatttgtattgtaggtggtgtttgtattcttatgaatatgtatggtttaaaaatattttcagtatacaagaaattcaactttcccaataaacgttcaacttcacgtactctaaaaatgtttgccttttttctatccacataaggagagtcagaatttacatatcaaccttaccttcagttgcctctgatcctgggatatctgtaaatgaagtataaattaaaggtataagtaaggtattttgagctgaatgataatttttacaaatagaccatttaatatcatctacaaactgtaatatgccaataaactctacagttacgataaatgtaaaattaagatgaacatatattcctctgattggttttagaacaatgtgtaagtgttcctttgcaaggaaacatccaataggctgcactttccaccaaggctagtgggtaatcggaacacctgatccggctcagcagaaaaatctactgaaaattgtgatttctaaaaagcattttctgtgtactaagcagtttacatacagtatatatacttttttattccctcactcctcttagaaacactttagaaaggtggggttgtagtttaaagttgacttattcatgggtagaaactt

SEQ ID NO: 47702 - DNA, 1004 bp, Bovine  19866881103808
ggttctaaggtaatttctctacacacaggttcatgtgacagaaagaagcaatgtaacacttattttactaattcatattggggaggggttagggttagggttagggccttgaggtgtatttcgaattgttttttgagagaggcttttgcaccttgagttctcacctgaagggtgagctttagttaaaagcctcagtcacttgtaacaaagactctgcacaagtcaaagcagagtttctgctaaatttttgaaatgaacataaaccccttgaagccaaagctattggataaatataaaaatcaacagtcaatagatcttaatgagtgcagtgaatgaacctggtctcacatgacattttgtttataaaggagaaagtgtagaaatgatacatggtgtctaaaataattaaatcaccttcacagtataatacatttcaccatatcaaaagtaaagtacattttccccatttactatcttgatataaaactctcaatggtgggctcataaaaatcataggtttaaattttgttttagaggtaatgttccattctctcttcagatacaactttcaggtttatagaacaattgaatttatccagtagtttggagcatctctctgtaatagaaagataactatttttgcttgagcctagcatctgtatttgcatcaagaagcgttgatgatttagcttaaaaatatatatatatatactataaaaatgtcagcaaaatgattgcagtggtggcaatagtgactacaggccaataaagtgtaggaatcttgtacttctgtgttatttgttttctaagtcttatatctcccccccgcctcagttagttccttcaatatgtttctttcatttttggctaatttttgtctagtgtaccattttgatttcatttaactgccttttctgtatagtttcaattattctccaaatgtctgctaccatgaaaaagtaaacattttaaatattaacacccttaatttataaaaatatagt

SEQ ID NO: 47703 - DNA, 948 bp, Bovine  19866881246173
aatcaaagagtttatagatttaatggtagcctgttttcaatctccagtatagaatggaatccattttatataagtacaatatatatattccatatattttatggaatacatttcatataagtccatcagccaccatgtatctatttatttatttaaaactttttattttgaattgggacatagccaattaacaaacaatgttgtaataaattcaggtgaacagggaagggactcagctatacatatacatatatccattgtcccccaagtcaccatctatttaaatactaccaattagataatttttactatcactttgtgaatatattttgatactggagaattataaactctaacaaatagccctgtaaaatgtttgtatttagtattccccaatgtttaaaattcctatattttcataatcacatgctggtaaggttttataagcaatttgttttcttcttatattttgaatatatcttttaatgtgctttcaatttgtgtatttaataagctaattctaaatatgatgctaccaaggactcatatttaggaagtttccatttgttcaaaagcaagattgctacagaatggcctattccatttttagtatatcttattttttgttataacttacaaatagtatattaaagaaaggaactctgttgtacttggttgcaagcagactgcacacatacatatgttggtgtattgattggggcatttttagttatatttaacaaagtccactagaaccaatttaaagataacaaagaaatactatattcattttatgtatcacataaacataaaatgacaggaatgcatcagcaatgaagaaatgaactggaaaaaagggtccaaattctgaaaaaacattcattctgtctttcatatctgttctttttctttaatctgctttattttccttccgagtcacatgccatt

SEQ ID NO: 47704 - DNA, 1818 bp, Bovine  19866881339583
taaataagcagtggagggagtggagtgggtcttggctgttattcttacagctcccatggaagagcactgatcctttctcctagcagcttttctctccagcccttcttaattaccctaacttcttttaaacctttctctgtcccccaaagctaaccttggccctatttcctcaagttccatgctttaaaatgagggcatgtggtatttcacacgcaggaagtaaggactgaaagagctttaaatcactctgcctctgagttgacttattattgatttgaccatgatttttagtgcttttacccaaagaaagaaaagtgcaaataggtgtggaaaggcatcaatctgtaataaggctacagagatgtcactttctaatagaaacatatacagtgctatgaagaatatagggtattttcacacatcttctttgcatgcatgttcagttactctgtcatgtcaaactctttgcaaccccatacactgtctagatgccaggctcctctgtccatggaattctctaggtaaggatactgaagtggaatgccattcttatctccaagggatcttcctgatccagggatcaaacccaaatctcctgcactgcaggccgattctttaccatctaagccaccagagaagccccatgcattgttactattcccatttcgtagataaggaaataaaaattgtagatcgtaaatgacttgctcaaggaaacatggcagataagtaacaagttgcattttagcatagattgaatttagaattcacactctcagctcactatattctgtccatgtccaactttaatcctcagtgcttatgtgatgatccagattttgactggatatttagctattcagggatgttgcagataatgatgagaattattcatatttctttagcatagaccatatttaaaagaggctaaaaataatatgaaagagctgtatggtcaagtttcagagttgagtttgaaaagtcattctgagcagtagaatttcagtgaattttatttctttattgtgctttctaaattttcaagtgggtttacattattttttaaataaatagatttttaggagtttttaaatagattttaagggttttactagttaaatagatgacttgacaagctgaggcattttcccctccaaactggtcagaaaattgacccaaaactttccactttatttgataaaccttgaccgttctaaatttccaaacatcaccaaagattttgatttgataaattatcaaatacttaactcttttgtgtattttcttagacctctcaagttatatatatggcataggttatagtcatcttaagttctattataaaagggtacttataatattcttattcacgtatattattcaaagttcttcaattttcagttcagttcagttgctcagtcatgtccgactctttgcgaccccatgaatcgcagcacgccaggcctccctgtccaccaccaactcccggagttcactcagactcacatccatcgaatcagtgatgccatccagccatctcatcctctgtcgtccccttctcctcctgcccccaatccctcccagcatcagagtcttttccagtgagtcaactcttcacatgaggtggccaaaggactggagtttcagcttcagcatcattccttccaaagaaatcccagggctgatctccttcagaatggactggttggatctccctgcagtccaagggactctcaagagtcatctccaacaccacagttcaaaagcatcaattctttggcgctcagccttctacacagtccaactctcacatccata

SEQ ID NO: 47705 - DNA, 802 bp, Bovine  19866881812761
catccctgaattagaaagattccctggaagaggacttggcaatccactccagtattcttgcctggagattcccatggacagagatgtctggcgggctacaatctgtagggtcgcaaagagtcagacacaactgaagcaacttagcatgcacacacatgtgggcattaagaacatggactccgggttccaactgcccgggtttgaatactgactctgtcacttattatatgtgtgatttgaggcaagctggttaattcttctatagcctcaatctggtcatccaaaaaagggattatagcaacttcagagtgttattgtgaggctcattatgcaaatgctaccaatttctttctttcctttttttcttgctctcaagttttcacctgtctgctctgtgaagacagggagtagctatttcttatctaccatttgatctttagtccctagcacagtgcttgatgcatataaataaggtgttttctggttgcttggctgatgaataaataaatggccattaatttattcaaccagtctagcatcagtcttgtaaaactaggagatttcagcaataatagaacaaactgatttaaaatggtatctgtgattaaatattaaatagaggaggaccaaaaagtctattcataagtaacttttatcccagtgtttctctattcattggtagaggtatatattatgagtctcaaaaaaaaaaaaaatacagctcagtgaaatcagaggtttctttcaaaatcctctaccttttctttactcaaggatgacattttaaacagcaatgacagat

SEQ ID NO: 47706 - DNA, 861 bp, Bovine  19866880237511
aattttgaacactgtcaaattgacatcatagctccacttaacaaatcactgatgttcaatggagtgaactggaaaacgtgtggaaatctcacacgattgtcattaggcaatcatgacgtaggattagttgaagaatagaaatgaaatattatatttgttaacccatcagctggtactcctataacattacacatctgctattatgcaggcttactctgcaattacctaattgtgtgatttctactctctcagtaatcttataagattttatcatttaccctgtctcagacttgaggtaattcctgtgtctcaatatacaggactgtgtaacagcagactcatcaacacctactcgcaccccatttttggaactgctttatagatatgtcctattctcttttctataaaaatatttatttttaatctcactaataaagggcttcattcattaactattttgtattttaggtcttagtcccagatcaccttctctccacagacaatttagattcccatcacttcatgggaaatagatggggaaacagtggaaacagtggcagactttatttttctgggctccaaaatcactacagatggtgactgcagccatgaaattaaaagacgcttactccttggaaggaaagttatgaccaacctagatagcatattcagaagcagagacattactttgccaacaaaggttcatctagtcaaggctatggtttttccagtggtcatgtatggatgtgagagttggactgtgaagaaggatgagcactgaagaatcgatgcttttgaactgtggtgttggagaagactcttgagagtcccttggactgcaaggagatccaaccagtccat

SEQ ID NO: 47707 - DNA, 1847 bp, Bovine  19866880347716
tcgctcagtctgtccgactctttgtgaccccatgaatcgcagcacaccaggcctccttgtccatcaccaacgcccggagttcacccagactcacatccatcgagtcagtgatgccatccagccatctcatcctctgtcgtccccttctcctcctgcccccaatccctcccagcatcagagtcttttccaatgagtcaattcttcgcatgatgtggccaaagtactggagtttcagctttagcatcactccttccaaagaacacctagggctgatttccttcagaatggactggttggatctccttgcagtccaagggactctcaagagtcttctccaacaccacagttcaaaagcaccaattcttcggcgctcagctttcttcacaatccaactctcacatctatacatgaccacaggaaaaaccacagccttgactagacggacctttgttggcaaagtaatgtctctacttttcaatatgctatctaggttggtccttacactgctatgtataaaatagatagcaaatgagaacctactgtacagcacagggagctactcagtgctctatggtgacaaagagaggatatatgtatacatatagctgattcacttttctgtacagaggaaacctacacaacactgcaaaagcaactagactccaattttaaaaaatcgtgactgacacccagatagtcagaaaagactgccctaagggtacatggtacttcccttcagaagacctgagcagaagtggctgtccagggagcctcgtcattatttcagttttgtagcccccagaagaaatcgttctgcgtgccgctgttcgtcttcacagcgtgttgctgtttctcctgtgttaagagaaaactctcaataggcaggttggttataggagggattttcaaccaaaaattaaatattagcacccaagcaccctgggcttccctgatagctcagttggtaaagaatccacctgcaatgcaggagaccctgatacgattcctgggtcggacgatctgctggagaagggacaggcttcccaccccctggtggctcagacagtaaagactctgtctgcaatgtgggaggccttggtctaatctctgggttgggaagatctcctggagaagggaaaagtcacccactccagtattctggccaggagaatactttgcaacttccacggggtcgcaaagagttgcacacgactgagtgactttcactttcacccaagcacccagagcatctatgtgacattccctggctttccccccaccccccatttaaaggtgatgcccatattattctgtctcggcactgtccgtcacagcacagataacagcccttaagtccttgatttgtttgtttacctgtttatcaccttttccactagactaggctccctgagggcaagggctgagtcagttctgtttactcctctctcagctctcagcaaaacaacacaaagcatatacgtttaataaacagctgttgagtgaaaaaatgcatgaacagaaagtctagtatgatccagttctaccaaatccaagatggggaaatggatttctggctggtttctgtgctgaacatcctttcaggagtgaacagggctattaatactactgctgtttttcaatagagtccaattataattactgttcatttacctgtgttctcctggaaggactacttaagccaattactaacattaaaacatagaaatgtgaaatttcactgttgagatggcaatctatttaaaatgtcctaattttactctcttgttagaaggttctcctgacaaacctctttataacagctgagtcctcccctaattgagcctaat

SEQ ID NO: 47708 - DNA, 1189 bp, Bovine  19866880454268
ttcaggacttatttcctttaggattgactggtttgatcttgcagtccaagggactctcaagagtcttctccaacaccccatttcaaaagcatcaatgctttggcactcagccttctttatggtccaactctctcatccagacatgactgctggaaaaaaccatagttttgactagacggacctttgtcactcaagtgtgacctcatcttaactaattaatatggaaataacctgatttccaaataaagccacacaccctgaggtcctggggagttaggacttcaacatatgaatttgggggaacacaattaaacccataacacagtcatgctccacatcgtccttcatgctctccttgttcaggaccttggctccttgctgccttcctcttccttgttttctacggtctgctgaaaactagtgtctcataagcccacacccaggagtcacctacaacactgctctgtatgctctgtattctttgctgacgttgcaccttataattcaggccttgtgctctgaagggaaggagatttgctatcttgggagccctccagattataaagaacaaacaggacaaattgtttgaaggaccttttgatgactcactcatcattcctaccctactattgtctttgcacgtttctccttactcactgacctttcttcttggcaaactgctccagacaaagtgctcaccttctctttcaactcagcccacccagcagagggatactgtgtgtgggccatgcattggaatgatcagcatgggcaccatggagcaaggttaacaaggaccagttttaattcttcacacccctcctctccatttatattttcaacatatggttggctttataatgttgctttaatgttttctcttgtatttaattatttaaagatttaataacaaactgctgagaatcaatcgcacacaagggacacattgctttgaattcttgctctttttttctgcttttacgtaagagtgaatttaagtcactggaaactaaaaacacaaagctaaagggggaagagaagagaatgacttaaatactttcagaaaagggtatctggaggtgaaatcaaactctcaacaatatctgatacctatctcttatcagcaatggacagtggtgataaccaaggagcatcaaaacaagcagctttgattccattttctttctaa

SEQ ID NO: 47709 - DNA, 2885 bp, Bovine  19866880498950
tgattcttgtgatagcaacagcatctcccagctcttcttttaactgttcatatgatttcccctgcctaggaagaagatatagaaaacaggatgagatgctgcttatagtggagggacgtctcaggtctggtctataacccttgagagaagcaaaacagccaggggacagaagacatttcagagataagcagaaaggaaaatcccctcttccaggtctatgcagggttggaaggtacttaaacatgatctgcactctttgctggtgactcctcaatattccatactaagagcagttgactaggagtcagaaaacctggcttcttcctactggttgtgactgtagacaagtaacttctctgagcttcctcatttgtaacacaggcaacaatgttcccctggctatcaggatgtaatgtgtgtggacagacttcacaaactttactacttctcacgttgcctgttcctgaggcacgctgtgaatttgctgactagacttaactgctgtgcagggtgcgaaagagaaggaaggtaaaaacgggagaggggagaagggagtgggggggtacagtcctgggttgactcggccctcgagtaccctgccatccttctgaggtgtcagtgctgagcaccctggcagtaagaacatctccctgcttctctgttcttacgctccaaacgtgagggtcccaggccaggaaccagcctgtgaagatgggaggctcgaatccctgtttaacgatcaggatcggtgtgccggtgtctcggccgctggggtgagtgtgcaggtactcctgggcggtagacagagcactcttcttctctgcagcgttggcctcagccccgatccacaggaacacctgttgttgtagagacctgttactgcgctcatgccagaggctagtgctagatagtacgcactgccccgtctttccccgtcagcagtttacagcctcagcagagtaaagtttttctcagatttgttttgatttgtgtatctcccacatctacatctccagtcctgaactctctgaacgtcagcttcctgaatccagcttcttgcaaaacatctcctctcggctgtctccaagcacctcaagtataacacccccaacatgtagctcttttctaaacttgtatctgtgtctccattcttggggaatggtgtccattcagtcacccaaggcagtaacctgggaatcattctgaatgcagtctgtatccccaggacttagctagtttacctctcatgcttttgtcaaatctgtcgccatccatccagctctactccactgcttctgtgggccagcagcagctctttctggactaggaccatgtgtgctgacgggcctcccaacgtacagtcttcttttttctcacaccccctccctcgtctcctacactcgctagagtgagtgatctaaagcacaatctgaccatgtcactcacctgcttaaatttcagtagctttccagggtaagttccaaacttcttgacttggttggtaaggtccatacctacttctttagcttcacctctagggcactctttaactctgtcttatactctgataatactctttgtagttccctatatactagactatttcctgccctgcttttcttttgcctggaatggcctctttacctgattaatacctgtttctccttggagtctgggagacatctcctccagagagtcttctctgagcccccaaactgtgttgaataccctaatttgtgctcctgaggcacttcatatgtacctccatcacagtaaaatgatgatcctccatctggtctcctccaccctccgtcagcctgtagactctgagagtggggtggggccctttgccttagcgacaccacgcccagcacagtgattagaaaggaagaggtgtttgctgagccaaattgaagaaaaccggatgtggcagaggggtggccttgaagatgtccccttttatccctttattcccccaaaggcccatatctccaggtgtgcagcctactgctcttggtcctgagagaatggagtgtgtgataggatggcatgatattcccagagcatagtggggaaattcccaggatggtgagttttaaacaacattctattctctccagccctggcaaaaaagcaggctcttccttcggtcaccactgacaattgtttgattgacttggggatggtccagggctaccctggcttacctggggtttgggggagagatactatacaaaaaaatagcctaaagcttgaggatgtctgtcatttgttccaagctctccggctgtgtcttacctggtcccaggtatccaggagcatcacgtcacctgggttcaggtcgtcctgggtaaagtctatgatctcagtgacagtgaaccggccagtcttattggaacattcaaagagacgagactggacatctaggatctcctgctgtagtctgcaatacagtccatgtagaggagctgagctgcttggaaatcacctgcagttcaccagtctgggaggcagggggagccaaacggaggggatgctgtggtcctgtaccttttgtcactggcatagggagttttccctcccagcaggtcccagaactcagctggctcctggccctcagccactgtgttctcagtaccgtcacagagaagtccggccagctccttagccatcgcccgctcatccccactagacccctgagaacggggtggggagaacacagatgtgagtcacacacaggcacgttgatgtgggaataaagtgcttagactaataactcagtgtagaaggaaatggcaacccactccagtgttcttgcctggagaatcccagggacgggaaagcctggtgggctgccgtctatggggtcacacagagtggacacg

SEQ ID NO: 47710 - DNA, 811 bp, Bovine  19866880525084
aaatactgtaggtccttctttgaagaaccaaaccaatgtgctcccagcaattttttttttttttttaaagaggacactggacttttgaacccatttcagttctgtaaaactctcaggtgcttcagtaatactgcacttagtatggtgcctgatacttgatatacactaagtagaatttattaataataattgtttcactgttaacactctttaagaggggtcaggttagaaaagcagtaaccagtacctaactttctcatccaacaatacttttacttacctgttttttgctttcagcatttgaaaaccttaatatctttttttttttttttgcttacgtcatgtaatttgctgtgcatttaaattctcagacgggacatctatgtgaaaagttgatgttagaggcacttgggttccttatattttcctgtaattttaacaggctcatagattctttagaagcggtggtggggggctccggagttgtctaggccttttcacccccatcactgaccagaaacctctgtgccatcaattgaccagagtgttttagagctctgttggaacaggttatctttgaagccctttgaggctaccaggcccttgtatcgactgctgtaattgttggaaaaaccttttctcatgccgagttgaaatgtgctccatgtaacttctgccctttggtccttgttctgctctctgaagaaatgttggcagaatctattcccacatgacaccccttcagatacttgaaattattgtggccttagttaaatcttttttttttttttaactttaatctttttatttt

SEQ ID NO: 47711 - DNA, 2311 bp, Bovine  19866880545346
aatgtttgtgagagttggacctaaagaaagctgagtgccaaagaattgatacttttgaactatggtgttggagaagactcctgagagtcccttggactgcaaggaaatcaaacaagtccaacctaaaggaaatcagtcctgaatattcattggaaggactgatgctgaagctgaagctccaatactttggccatctgatgcaaagaactgactcatttgaaaagaccctgatgctgggaaagattgaaggcaggaggagaggggaacaacagaagatgagatggttagatggcatcaccaactagatggacatgagtttgagcaagttctgggagctggtgatggacagggaagcctggcataatgcagtccatggggtcgcaaagagttggacatgtctgagtgactgaactgactgaccggcttttaattttatctgaactcggtgagcccttcagaggattttgctcctgcagtaatttgcctctttgtgagcatgtctgaaaggcagcatgtcttggcttctacttagataattttctcttagaatatgagacccaaccagaactaaaaatgtcttaaaaatctctcgatgaagtttgtttttaagaagcttcaaaaaaaaaaaaaaaaaagtttcaaagtgaattacaattgtataagcagcccttaagaacctcagtgagaacaagatgaaaatctttcccaaatgtgatcccaaaatgtaataggtgtagggccccaagtccattaagtaaccctattagtccttgcagagtcaagacataaaccatatagcatattcctctctaattacagacatcagctatccattcgtgggggtgtattttatgttggccaacacaggagccacaaggaggtcaaagtcaccttgttttctgaaatctgttaccatctggtgaatttccagcaaattttaggaacattctgtccctcctcaaggaggctgaaccacagtaaccattcataggatctcaaaaaggaaagcaaatctatgtccaagccagaaaaatgccggaactcaaatagcctactcctcccaaggcgagctcctcttatgcctgagaagaggttccaagttcattatctatttaaaagattcaaatgatttaccttcacaaaaaagtgaattgttacctaattaactgtcgtgtcagagttgctttccttgtcaaacaagcactcagtgctgctgatatgaatgacattacaaccgtattttagctaagaaaacacacagacctgttgagatatggttcatctctccaatcagaaagttggtacaaaggagacagcaagaagaaaaccaaagagctagagtccaatcaaattaatcacattttgcaaatggattttcctatgaatcagtgaccagaagaaaactcaaactgaatataactttcaatgactcatggccaaagaaatcgggagcacaactagctgagaagtggaaattttccctgcaagacccagagcccagagttagtgacattccatctctatatcaggaaagatcaccttaagatttctgtcattctggccacacaggtcggtggcggagtgtttactgggcccctccaccagcaccagttaggtacaatccacaaaggtcttgctggatttcattgcttcttctcagaagacagttttacattcctctgaatgccttaaatttacctctggtgggatatcatgattgattccttgacttttttctttttgcttataaataattctttatgtctcccccatgcaatggagggcagagcagggggttgtatccctgccctcatgcagggaatggaggtcaatgtatactgatcttattgccagctgccctgtggccttgcggtgggaaatggtggggggtggtctacagccccctttcttctaacattggtctctcttcaccacatcaccatagtggagctgaggggctggaggtgctaggagctgaggtaaggatgcttatctagggaaaaaaaaaatgtccccacctacctgcccactggttgccccaggaaagggctggaatgtatccagatgtctctgcccagtgggcagtagaggctagacaatgtctccagattgggctgcctacagaaatcctcactggaggggacagtgtgccccaaacatcttgtccaggtggtacctccagcagcgatgacagtcatgaaaacatgacggattactcgacttcgaacatttgtgtattgatttatactttttgaatttaagacaaggcaaattgctcaaaataaactattctcggaaagcattccaaaga

SEQ ID NO: 47712 - DNA, 1370 bp, Bovine  19866880559802
atgtgcctctgatgagaagggaaaaaactttctaaatcaagacacaaaatgaaaaagcagagtgtgatggcattgggaagcagtagagagaatataagggattagttaactggaagaatcaaatagcattattgttctgaatatgccaagatcatattaatctgaaatatgaaaatagtgctggcagtcatatcttgggtttatatcacactcttcaaggagatatttccaatacaaagtcattcaccttggctgtgaatgctggcagagataatattgccctaatccaaattatgaattgatcttcatgagtcatttgtcctgaaattttaagcagacactctaccttgttccctgttaaaattttctgtactggtgaagctacaggataaatgcaggaagtatcaactgctgtcatggattaaaattatttctaaattgttactagctgcctttcttgttgtgacactagggtagttacaatgagtccaacaaactaataccccctttaagtcctattagaaattcttgatactttcaacatgtgacactacatcttcaaaaaattttggaaagtaacttatttcctctaaatgtatcaaagtctttaaaaagtgataattatatatataactgaatataaccatgtataatctaatatatatatttatataacatatttatataactgatgatgggagtaaagtccgatgctgtaaagaacaatattgaataggaatctggaatattatgtccatgaatcaaggtaaattggaagtggtcaaacaggatatggcaagagtgagcatcaacattttaggaatcagtgaagtaaaatggactggaatggatgaatttaactcagatgaccattatatctactgatgcaggtaagaatcccatagaagaaatggagtagccatcatagtcaacaaaagagtccgaaatgcaggttttgggtgcaatctcaaaaatgacagaatgatctctcttcatttccaaggcaaaccattcaatatcacagtaatccaagtctatgcccccaatgaataatgctgaagaagctgaagctgaatagctctatgaagatctacaagaccttctggaagtaacgcccccaaaagatatccttttcatcataagggactggaatgcaaaagtgggatcaagagatacctggagtaacaggcaaatttggtcttggagtacaaaatgaagcagggcaaaggatagcagaattatctattgccaagagaatgcactggtcatagcaaacaccctcttccaacaacacaagagaagactctacacttggacatcaccagatggtcaatatcgaaatcagattgattatattctttgcagtgaaa

SEQ ID NO: 47713 - DNA, 1660 bp, Bovine  19866880569073
aaacttaagttgtgcctatgatctgccgtcaccgtttaggtgctaaaaagctgagaatgtgatggtgaacaatacagacaagctccctgcttttgaaggtgtcggggagtggggcggagagacagtgagtgaccaagtacaaaaggactgtaggcgctgagggaggcagggtcgggtggtcagggaaggccctcctggggaggtgaccctgcagctgtgacctaaacaatgaggcggacctggctttctgatgatctgggagagggatgttttttcaggcaggagcagtagccagcagaaaggctcatgtttgaggaacagaaaaacagcaactggctaaagggctgtcagtgaagacagtactggcctgtaagacgaaatcaggtgggcaggggccaggttgtatagggccttggaggccatcgcgaggactctggattttaagtgcagtgggaagccattcgaggtgtgttaaatagaagagtatcatctgctataaaaacccactggtggttatatggggatcagattgtagggacagaggtgaaaattcactgggggcctatggcagtggtccatgatggctggaccatactggcagcagagagatggagagcagtgggtggcagctagctgatgggttgatgtgggaggtgaggaaaaagaatcaagaaggagccctgggtttctggcttgagctcctgggtaggtcagttgtctgctgagtatttacactgttggccgtactccgagatggtgcttctgcagcgctccactcatgtcagtcactcacctcctttttggcagggttcacatcctctggcaactcctgactctgatttttcaacagaacttctagggggtaatattttggctcagaattcagggcaagggttgtgtctctcatatcctagggaagataagaatgtagacacaataaaagaccactcaggtctgtgcaattgaagttctatgtttataacattaaatttttttttttttaccacttcatgctttataatcatcttttagaacagtggtcccctatgctggctgcatgtcagagtcatctggaaatctaaaatagtttagtttgggggttcttgagaagctgattcagtgagtctaaggtaaatcctgtatagtcagttggcgtaaatgttttgcataaatctcacttaaatactgtgatcacatcccttctcttggtacttttacttgggctctacatttctggccttgagatggtttcaaattgaagtcatatttctcttaaatacattttaaagatgctacgttgccatgagttttgaaatcttgagtttgtagagcacaaacagcaaaacaccagatggtttggacagtggtgctgtgcactgtcctgatgctaaagagctgctgggttctcggccaggagctccacttctgggggccgttaaaacaggggtaatggcctgagtttctgtggatgccactgtcagaaactaatagtgtcacctgggttacaagcttattatttctgaaaaatactactagttaatttaatctctcctgagtgacagagttgaataattcgatttggtaacagcaaggtctgttctaaattctggaaggaagtaaaataaggaactcggctctgaagcctgctctttctaccgat

SEQ ID NO: 47714 - DNA, 1194 bp, Bovine  19866880658634
tggaggaattaagatcccacatgtcatgtggtgcagcccaaaggaaaaaccaaaaccaaaaaaacacgctgaacaaaatgcttagtgaaaattatttccagtttggaagcctattcttggtcaactattaattgtgagggtagaataaaggcattttagacacaccagaatttggaaaatgtacctcccacatgcccttttttagagaactaaagcaaaacgctggacactcgttgggtggtttcagagcttcgagtcttccctacttatccaagttgtcttcagtatccagccttacctcaggcagcttgctgtgtttaagggaaacttgaactcaccccccttatccacgggtgggcctgattagtataaagctaattcttcttcccttatattggttcccatactcaggcacgtaaagtcaaatcacagcactccccccagccacagggattggttcaggaatccatgtgtgagatgatctggccagggacatgcaagaagattgttgctaggtgttctctggaaaagaagtgtctctaccccaaaaacatgaccagaaaaaatgcccactctttcttcagaccagtggtgtggcaatggaagtctcaagctgcctcagacatttcataagagaagttgccctaaggataaagccaagcacgagggaaacccagacaagcttttcttaggacctgagcctctagatccttcccagcctaaagccagtcctatctctgggctcccagttcactgagttaagatactgtaaagtaaaaaaaagaaaatcatacaagcttattttcagatgcagacacatcttgattactcaaatgaaggagacacatagaatataccaaagaatggataattctcaagccatttataaagtaacacaatgatggataaaaatgataagacatgaactcttggttaattaaaatttttgcttaataaaaaataaaaaaaaaaacctgtttgtttttttttttttaaaaaagaaatactcttaagagttcaagcctcctcagcagtttccctgttacctgcagctgaaagctttatggagactgtggattcaatccaaagtgtgtacgtgggaacatgaaggaacagaatgaacactccacaggggttcagaggactgctggctcagactacagagaggccagggactcccaagaggggaactca

SEQ ID NO: 47715 - DNA, 1691 bp, Bovine  19866880667794
ttaattccctattatatggcaggcgactcgctggaactttctcaaatattttcttatcaaatcttctagcaatcctgtgactcagatcggatgcggaaaccagctcagggaggtagagtgatgttcccaaggtcacacagatcattaaaataaatagaagtgaccagagatttgcataatcaagatatctcacctgctcatggagtaatactaaggactatttaacatggtaaaccattcttagattctgccaatgactggcaatagtaacaaagccttcaaagacctggagcctaatgggcatttgaatgtttgttttatgagatggtaatgatctcaactaggtttctgctaacaaaaagttcaagtctcctgaaatggaacactgtattatagattaaataaccttagaaagataataagaaatattcttcaaatataagaagtataagcataatttacaaatttatcaccagaaacaactacatcaaaacctatgagtttgcaacaaaggatgtgggttagatggtggtgagaaaatgacactcaggagaaagaaatcaatttccattagtcaaatttcatggattaaatgaatgagcatgctagataaaaagtaaaagttaatggaattttgaagcaattcaataaatatttagagacactctagctacctagtggcaaaacaggcataaggttttgggggaaaataatcaaaaagcataattatattagaactgaagattgttgatgtcatggaattaagtatcaattaaacaatgaaaaatatttagtgagctctagttaaatgcccaatgccccagttctctttggcaaccaccccccttcaaaagaaatatcaagagacataagcatgcaatgccctggatgactggatgttggatgggacgaaggcagagagaagcggtccctgtccccatgctaggagttcacaattggttgtggtgacaggtacacatacttagatctttagcatcaagtagagcatagaaactgttttgagttttagtacttgtgcccttgtgccttgtaagcagagaagttaacattcactgggaccgttagttgcagtatttggaggaaagattagagtggaagatacgacccctgtcccagattaccgacagactggttgggacaaagctaacacactgggacattgattttgacttattctgcctatggggagactgcctcaaatctaaagcaagacttctccctgtgtcttaaagttctcccaacattacagtatctacttcaactttaaggacaaaaggctgagataatttgttggggatcaccatcatttggactcctctttaaagtcatggtggttgttgaatttacacgagatatttaaaatttccttggacaaaaccagctgtgactgatcagaagtagaagataatgtaagaatgcttacagaaaataagacaaaacaattcttccccaaactcacacagactcattggctaacagcatacagtacaatgcttctaacccttcaccagctaagctatgagtgagtggtttccctggttgtgatgctataatgggagccatctgcattctctttctttcctctgcatattcttagcagtaggcctagtccagatatgtgagctggcgaaaaatctggccagcaagttgcaagaacaagcatgaggcca

SEQ ID NO: 47716 - DNA, 927 bp, Bovine  19866880686598
cctgctatgtctgactcaaaggaacactggaaacaggggattccaaaaatccttccctcctgtgactcagtagaagtcatgtcataggctttctattctctttaagaaacaataatattcttcatgttatttgatggaaaattaactttgatattctaattttctttgacatcaggtattatcagcattatggtcagaatgccagtggctcctaagggcataatgaaattgttttgatggtttatagtccttgagagcgtgaaaaatatagctagacatcttgtcaaaggtattagattgatttttctctgttaccgtccttgttttatactaacagaaactctctttactgcatttccccccacaaatattcctaaatgcatcatttctatattttaccttttttcagatacaaggaatccataaagtaggcagacagtgttattttaatgaatttctacgtgctctaaaatattagtttatccagtaacttgaaacaagtacattaaatgattagcattgtatattcaggacagctttatcatctgagaactggtgttttttcaatcctaagggtatgtatcttaaagtaagtagaattttgctattttgcttgtatttgcacgtatggcagggaactttcttctttctaactttttactttcctaaaatatcttaagttagctccccctctagctttaacattatctatcttcctccctctcttccttttttttctaacagttttacaaaagtagccctaagatatccaaaactagatccaaaagataagttttattcctttttttttacataggaattatgtttagctggtaatgggccacaaaataatgtttaaaaatgaatacagtattcatttattcatcactccttctagagcaagctttatggaaagctatgaattca

SEQ ID NO: 47717 - DNA, 986 bp, Bovine  19866880697142
gtcagcgaacatcagaaactgcgtgtctgcgcaggggagcaagagaaaagtgcgcccaagaatttggaaaccagggaataaaagcacccactgcacctagtgggctaggataaagacatgaaagtcacttttgagaatgactttaaatgaagtcagcaagactggactgtaacctgattagctgtattaacatatctaaagagagaacttatcattcagaactgcagtctgccagcagaggaagaacagaaaatggaaagtcagagaggcagacattggcgacattgccctcctggaacttcccaggggaggaggaatctgaactaaggactttgaatatttcttgcccattggcaaaccatctgcatggtgggatgttatctcaggctgtctacccaatgtcactacacagtcaaagtgtagaactgacttactttgtgagcatctcatacttctcatgaaatgtgattataatttagctccccatagagttttcttggggcttccctggtggctcagatggtaaagaatctgcctggaatgcaggagacctgggttcaatccctgcgttgggatgatcccctggagaaggggatgactccagtatttttgcctggagaaaaagtaacacatgggactgaagatgctactaacctttctgaggcttacatttaccatggtaaaatcagaagctggttttctcgttgatgcttcagtcttttgtgaacttagtaagccagggtcagcttccctgagcctgatgatctctgggacttgagcttggaatgccccaggtccacaccaggaccacctcaggcagcaatgagcccagcaaggcaacgtgtgtcaccagtggtcaccctcgtgacctgggaccttgctgcacacctcccactcaccatggggaaagaggaaaatctaggaacaggaaccacacactgggtttgagtttcaagcgaacgggaggagttttgccctgattgaat

SEQ ID NO: 47718 - DNA, 4326 bp, Bovine  19866880703643
tccctgggcttggtattgaacgtggaccatacagacaggtggagaaactgtcctttccctctgatttctgcatagattattcagagtaggaaaaagtccaaggaactcttaccttgcggtctttaagtactggtctctgctcacaggtttgtctcctggacgcaggggccttgggcaaggtctccaatgcagcttcttccttcggaccaggatccccagtccctggaaatcttgctttttccaccagggccaggagctcaaaagtgatatccaggtttttaggctaatcgctggggaagcctgaacatgttctgaaagattgtaagtggtcataccagtgtcaggggatctgcctgatccagggaggggagacggctagactggaccgactggtgcctgatctcagcctctctgttgagccagagctgagtcaattgttccggggcggtgctgactgccacttgactgatggtcaacagccatttcctcatccttggtcccaggaacagagtttggttttccctcctctccaggggctcaggcagtccaggaactgggtgttaaacgtctcttccatcacttatataggagtggcctctgagcaggtgcagcatgccctctgaggactgagccgagggagcttggccttgctgggatggcggtttgggtaccaccttgcctcccctttcctttcttaaacccaacagcgcatggaaggttgtcctcattggtagcattctgtttgtcccctaccctcaccagagatggaggtatttccagtgcttattttcctgcattggagtttgccttaagccttaaagtggagtggggacccaggagagcaggcctgtggccgaggaccgttctggcagcggtggtgcagtgccacctcctggccacggtacacatcctgacttcctactgtggctccagttgctgaaacagttcatctaaaaataaaaggaacttgaaaaagattttccaaagtctggttctggttgatcctgtaacacctatagctttttgtatcagcttgacctttctggggctgctttaccaagcctccaattaagatggctttgtatttccaaagcccaaattgtcaaggcaggacttagcagttacagcctagaagcagggacatcaacccagaacccagcgctggatgtatgtgtcccaagagagtgaccttcttgtggtcttggaggagagggagtggtaaggaaagtggctggaatgtgggaagggcacggggtgtgaacaaagcatgtaagttcttcttgagactgaagctgttctgctttctagtctgggcttagtgctgccaactgatcgggcattgaaggaagctgatccaggacaggacaggagttctgctaacttgaaggggtctagctcactcccttctctagaattggtagtcttctgggaactggtgatagggaggatttggggttttgtgaattcatcttgagggatcccttagtgtgctgttaccaaagtggattctgtacctggccccatctttcagtgccccttcccccactgtgcaattaagagcaagttttatgcagctcatttcccaaaccagggactggggattcctgtgtttctactttacagagatgatggaataaacatgtacatttcactgttgaccgtatttggttgttcaccttgcccgtgccatgtgccccagtggagcttacagactagagggaatacagcatgggaagtgggcttctgtggatgtcctgtagctaatgtctcttatcgctccctcctttctaggcctggtgtccaagtcctctcctaagaagccgcgtggccgtaacatcttcaaggcccttttctgctgttttcgtgcccagcatgttggccagtcaacctcctccactgagctctccccctacaaggaggaagccaacaccattgctaaggtagctggatccaaggtggtgtggtgccagcaaggatgtgactgccatgggcgagaaagggtcaatgtaaccatagcaggagggcaagccagccttgcctgcgtcagatctctgacccagaggaggcccttcctctgtcctttccatcgtgggccatcttcttcctgttgattcccatttgtggtgtgggccaccttggatgtccttgtggtttctgagggcccctgtaatccagatccttccaagttcctggaactgtccaaggcactttgcatatgttgtctcatatgacccatagcagccttgcaaatagactcaaggatttcagctcacagacatgaaaactgaaacccagagggtatatgtagccctgaagagttattggttggtaaatagtagtatcaaggtttgaactcagatctctctggctgtaagtcctgtgacttgtttttatttttaactaagcaaagataacctccaagttatctttcagggaactttcagggaaccaaggaattgaaagtctgtcatatttcttgataaccccttgcagcactctgacctgtacctgttagagacatttggaaatatgtagggtgtctttgattctcataattaccagaaaatacatctggcatctcagaggtggggacagaaattattctttccccctaggccattggtatttctttctgaaccaccaagttttagctgtccttcctctctttcaaagccaggctatagacatgaacttcactatccaaaacagggaatgggttcagtgaagtacaaggtgacagtattaactgaactgttaacttttaccaagagttcacaacaatgtggaagtgttgagttgcaacattaagtcaaaaagcagaaaggaaaattatgtatcataagggggaaagactgctaaaacaagcttgaaggaaatgcagtaaaatgccaacattgtttctctaagtgctcggattttcatttttcttcagggtttccattaagatcacttatttgctacaaccataacatttttattattagccaaaggcaggaaaacggttctgatctctctgcactctatctcccttcacattttaggaccacagtatgggttcacatcggcttacttgtgttctgtaggggctcagcgtgttcacacacacacacacccgccatctatgcccccagcggagaacatagggaaaagacaggttctcaaagaaaagcctggtttctggactaagcaagaggctaagcctctgtaataaggggttctggtttggattctggctctgtgcacctgcatcagctgcgtcagttccctgttcctctgagaggcaatggtagccgagctcagggacgctgccttctccatccttcatcaggcctagtacggaagggagacttcggcccctttcctgcccagctctgaaggaaagtcacttctgttatgtcagggttttccaaggggctgggatcttagggagaagattgccctgcagggctgagtgggctttagacggccaggaaaggcattagtggctggcactgaccacctccttttctcccgtagtcggatctgctccagtgtctccagtaccagttttaccaggtatgtgactctgacagggcaggtgctcagaagccctgagacccagtgagccctgctaacctcatgtggtgacatcctgagtccttgtatcttgcgggctagctccccacctgggaagctgtttgtcccagacatttgctgacggcccactatgtgcaaggcattagatcgttgaggggacagctggcctccaccctgtggagctgatcaccagccctggctccctctccagtatctggatcacatcacagtccctggggaaggctgaagcagggagttagtctctactttttctcctcttggtcttctagtgtcacctctcttgggttgaagtggggggcatctttcgtctcctcaacgggcctagctcttcccagagttctgttgagggaaagtaatctttcttggtggcagattcagcaccttggctctggttttagattccagggacctgcttgctcccagaggtgacagaggaagatcaaggaagaatctgcgtggtcattgacttggatgaaacccttgtgcatagctcctttaaggtaacgtggcctctggagcccttcctcacccatctggggctgtcctgggaacctgactcaggtgccatgaattggcctaaagttgatgctggaagagtgattagagacaggagggccggcctctgggatttggccacactggcatcgcagatacctggaggccactccagagaatgttgagcgggagctcctgctctctctggtcactgccaacaggctgcagctgccc

SEQ ID NO: 47719 - DNA, 657 bp, Bovine  19866880725094
ttccttagtggtggggccttgtggatagagagaagctactcctgccagggccccaccacaggattgaaggctggggtgggcaggaggatgtggcggatggtgttgccatggcagcacttcctccctgtgttgtcatcattgctttaatggcactaaggaggtagagcggaaggtgtgtgtgtgtgggggagacaggaacaggagcacggggaggaaaggggaccgaggagagtcctggggacttctctgcactttcagctgtgcagagcatgctgtgtgagtgttatgtgtgtctgggagcctgagatactccgagtggtgtatttctggtatgcgtgcatgtgtgtgttctctctacagctggaaaacaagaggtcactgatccttcgtgggtcctgggaatgaccatattatccggtcctggaacctcctgtcccaaactgcttcctgccccagactcccccagcagggtccaagtctaccacgggtctgtcacggcctgtcttcctcatgctcacccacttctccattgccaaggtcagctcagcagtgatctgtattttgatcccctgggaggatgagcagagttggggaaagaagaagaatgacacctcctctgtctttttacatcctttccagatgtattctttccccaag

SEQ ID NO: 47720 - DNA, 2232 bp, Bovine  19866880726906
aatatcccctggaggaggacatggaaatccattccagtattcttgcctagagaatgccatggacggagaagcctcgtgggctacagtccatagggttgcacagagttggacacgactgaagcaagtaagcagcagcagtctaaacctcgtattttataaatgggactgctgaagcctagatgtgacacattgaggccagagaggtaattaatagtcaacgttggacaaggtcccagttttccaaccattcagtgttctttccaacatcaccctgtacctctgtcaacaactctgctttatcgactaagaaagagttcatcaagtcaaatcccaggaaaataattcctactgtgcagtctattaagttaagtcagcctttctacttaagttgcattttaagtgatttccattttcagtgcaacgggttggagatcccacttacagtcagaatagttaatcaatggctggattgtgtggtagccatagaggtgccccaatacacatctccctttaagagaactttctatgaaggacatagctccctaaaaacctccaactctcacacttttgtgtccacccaggggcaacatttgcaccaagaccacattttcctagggctgttctcagaaactgaacttggtggggcaattcctatccaacatggaattattctaaagcaaagttaagttaaaaagtttaagtattttttttttctctaaagtgataataaatattttagattttatattttttcagcccttcattctctgttgcaactactcaactctgccattttatcatgaaaaacagccaagggtgatatgtaaatgaaagggtgtgactatattccaataaagttttctttacaaaaccaggctagatctgttccatgggccatggtttaccaactcctactctaaaggatttagtcagggattccccactgactgattggaagtttctcagaactatgctgtggtctgaagctcttcctacttaatcttgccaaggctacaggcatcagacctgcttattcctgctttccttgcctacacctcctccctcctcctttattcttcacagagggaaaaagtgtgatgtgatggaaattacaatctggcctcagaagatccaaaatgagctcttgctttgctattttctggccctatggacttcaaactcccacagctcatctcaggaatgtgttaatcctgctttgtgtacctgaaaggattgttgagagaacatgtgaaaaaacaaatcactatcattcaagacactacccatgtttgacaccacgtttgaaatcactacacttctttttatccttaggcatgtccatagcatttcgttgagaagttaaggtgttgttttagaggaaatagaagattattccatgtaaagggataacaaagcttatgcatagttcaaataagctgttctgactaaagcaagagggtgatgcagccaacattgcaaacctgatcccctcactgaccaattaattttgaactgacaacaaataaggcatctctcacctatatcaacagccctgcctccaaagggaacagacacaccatcaccattacagcagtaaatactcaaaattcatatcctgtttactaataagcaggagtgtcatcttgtaattctgagcacagccccgccactgcctggctaaagccatggatttctcattggccactcttgtctgaaatggattggtattcattcttcagatacgaaaggaggcaagagaaataactgaaaatctcttccagtttgcattttattagagcagggaggcacagaaggcaacagccagagcagtcctgaaccagtgtgagtttcaaaagtcaaccttggtgtattggagcaggttacataaaataactcttttgtcaagataacggactgagcgtaacaagctcaagaactcaatgtgcaaaaagatcacgtgaaaggaggaaggcaagaggctggggaaaggcttttaaggacgcttattgaaacttatggttactaaagaaaaaaagggaaggtgaagggatagattttgagtttgggattaatatatacacatatttttatgtattaatataaaataaacaaaaaggagctactgtatagcacaggagaagtatgctcaatattttataagactgatgttaaagctgaaactctaatactttggccaccttatgcgaagagttgactcattgggaaaagacc

SEQ ID NO: 47721 - DNA, 1547 bp, Bovine  19866880780027
tagtaaagccagcacacaaaagcagacacaccgggtggtatgacctgaccccagatgtggtgctcggctgagacagttcctgtagatggcagtgtagcacttcagcagtggatcttgctgggtgttcctgggatgtggatgagatgcaaaggataaaagctgctgcgagagcaggctttgccctccagccagcaatttaactaagttgctggtttgctactcgatttcatagttgccctctaaatgaatcttttctgaactcagcaaaagtacaaattgttccttcatacaccccaaattgtccttttggtgaagtgggtttttatttttttatgccttctattttttgaatttcagttattttgaaagggttataggacttcaacattccttttcttgaattgtaaatgcaattagcttagctgcggagcactctttgagaatgaaactctcctccattgagatgattataaactacatttcatacaatccaccagagcacaatccaaaatgaagatctttctatattaaccctatggccagatttccaggatgatttttcttttgttctgattattttccttccttcactttttctaaagcctttttaaaaaattgtcctcccctctgctcagagaacatggatgactgggaattgaaaaacaatctagaaattacagacttaggtaatttataataaaataaaagtatgatgtcaattattttcttaattgttttaacctttaaagccagatcagggtcatattctactgtggagtaagtgagtgatggcagtcatgaaagaatttgtggagttgtgctagtcattccaggttaagttttcctctcccgcctccccaaacattcctcattgcttcagcaagcagctgtgcagcagcagcattaatagcacacattcatgatgtatttgctcctctaatggagctatgttcccatgaactggaatatctgttgtaaccgagaagagttttcatcctctaacttttgccatttagccacaaaatgtatgtatattaagaagtggcaagtttagatatgaatgatgcattggaatctgttgttgatataattggcatggaaattttataggcaggatctggtatgtaacaggcaatcaatgccttctgttgaataaatgaattcttaaatggaagtaaaaatgatgagtatactaaggaatgaagagacattgactagctatctaaaagcccagaaaaacatcagaaaggcttaagagcaatgggaattcagagatgaggaagccaaagtaggggggaaaggaggtaaccaatggtgctggacttatgcccttagatataggaagagggctacagcggagatcaaagaatctggaaggatgaaggaaaggcatgtcaagatgcatcagaggagattaacaaaaaactgatgatacaacattgagtggtcaaagaaagattaaggaatctggaaatttggaaacaccatcaatgggaggcaattgtgcaggtgacaaatggggccgagaggagagaaaggccgaagga

SEQ ID NO: 47722 - DNA, 2327 bp, Bovine  19866880833913
ttcttttttcttttattgtcagaacaaggactggtggacatatgaattctgttatggacgccacatccagcagtaccatatggaaggtgagttccacctatgttttccctaagccctcagaaacctgtcatggaaggtgacctgcctccccagttcccttccctcccagtcctctgagaacagggtaaccatgcttcactgttctctttcttgcagattcagagatcaaaggtgaagtcctctatctcggctactaccaatcggccttcgactgggatgatgaaacagcaaaggtggcaggagtgtgggaccaggagagaaaggggtctgggctgcagactgagagccctgtcgagaaggggagggtcaggattaactggcgtgtttctctgggcttcgtcttaggagagagtgctcttttttttcctccttgctgtctttctcacacccctccctcatgcctgatgtcctccccaggcctccaagcagcatcgcctgaaacgctaccacagccagacctatggcaatgggtccaagtgcgacctcaaatgggaggccccgggaggctgaagttcgggtgagtcttgggagagggaagttgacactccgacagtggcaactcagagtctaagggaagagggcaggattgtgtggtatcgtcaacagtgtctctaccaggccctagaccctaagtttaagactcatatttccagctttgtgtcactgcctcaattttcacaggcacttctgtttttttttttaataggtgtataattgctttacaatgttgtattaggttctgctctacaacagcatgaatcagctatatgtgtacatacatgcccccactcttgaacctcctgtgtcccgccccacatcccactcctctagataatcacagccctgaactgagctccctgtgctatacaggagcttcctactagctacctgtttgacacatggaagtgtatacctgtcagtgctactcggttaactcatcccacctactgcttaccccactgtgcccggaagtgcactctctgtgtctgcatctctatttctgccttgcaaataggttcatcagtaccatttttctagattccatatatacacattaatatatgataattgtttttctctttctgacttcactctatataacagaatctaggttcatccacatcactacaaatgacccagttttgttcctctttatggctaatgttccatcgtgtatatgtaccgcatcttctttatctcttcttctgttgatgaacgtttaggttgcttccatgtcctggctgttgtaaatagtgctgcactgaacactggggtacatatgtctttttgaattgtggttttctcagggtgtatacccagtggtgggattgctgcatcatatggtagtttgagttttttaaggaagctctgtactgttctccgggcttcccaggtggcgctagtggtaaagaacctgtctgccgatgaaggagatgtaagagacttggattccatccctgggttgggaagatcccctggaggaggacatggcaacccagtccagtattcttgcctggagaattccatagatagaggagccagcgggctacagtccatgcggttgcaaagagttgaacataaccgagtgactaacactttcactttttcatatatatgtatatacatacatattggagatggggacgacagtccactccagtattcttccctggagaatcccatggactctagagaagcctggcgggttacagtccgtgggggtcgcaaagagtcggacacgactgagcgactaacatttcacttcatatacacacatacatacacacattcttcttcagattcttttcccttataggttattgcaagatattgagtagagttccctgtgctgtacaggagaacctttctgtttatccattttatatatagtatagcatgggtgctcagttatgtccaactcaacacaaccccatggactagggctcctctgtacaagaaagacaatagcgtgcatatgttaatctcaaatctcctagtttatccctcccccactctttccctttggtatccataaatttgttttctatgtctgtgggtctatttctgtttctgagaagcaatttaaaaagcaaatacagatgcctgtattcacccctagagattctgataagattgaccctgagtggcagtccctgggatactgttccaaaaaattcctcagtggggtgtaaagtgtgagggctagaaaacctagttggagattaaatttatctgaaagggtgaagcagagagagcatgtgtgctag

SEQ ID NO: 47723 - DNA, 956 bp, Bovine  19866880874955
acagagcacaaaattcctgaaaacatgtgataactgtttatttaaaatcacacaagcttattttcagatacagacacatcttgattactcaaaagaaggagacacatagaatataccaaagaatggataattctcaagccatttataaagtaatacaatgatggataaaaatgataagacatgaactcttggttaattaaaatgtttgcttaataaaaaaatttttaaaaacctgttttgtactttgacagtgtaaacaagattttcttgatttagcaagtagaatttcatgtctaatgttgaatcctttttttgaagactgaagatctggcaccactttggtgtcagtaatgtgaacataaatgttcagtgtaaaaatgaagaatggggggagctttgggctaaaggtgcaccagtctgagaatgtattccctgatgtattggtttaaaagctaaattctttttaaaaaattaaagaaacaattttgggggccagatggcatgtgggatcttagtttcccagtgagggatggaacccatgtcccctgtactgaatgtatggagtcttaaccattggaccatcaggaaagtccctaatgtctagattcttactatgagtgtacttactgcttttgtgcttaaagtcgttgccaaggggactgtggaatcaggaagtggtgaaaaattgaaaagtgagggatcatccagttaagttctagttcactgaaattttacacgctttgtctcactcccatcattattatgggggggtgagtatttggcttccaagaaaacaccagtgaagagttatcctgcagtcagcttgccttactgaatccagtgtagactgggtctacactctttatattggttttggaccactggctttctggtcttgtgtattactaacacatttcttgagtgaattcattggttctgacaggatccatattttt

SEQ ID NO: 47724 - DNA, 1316 bp, Bovine  19866880885839
tggaattccttttattttcctctcttggttatctgctagggatgaggcataagcccagtgctgtcacatggagaaaaacatgatgcaattaatgaagttgctaatgcgtcatcttgtggtgacctccgccatcgccagctcagcctggccaatttcagtccatcttctacatcccacagagccaactggaccctgagaggtcattctggcccacctcctatctcccctccccccacagatggagggcctttatgctgagatagtttccaggacagtgcctaatgctctgtcacacggacagtaagttccttcctgaaggagagagctcaagttaagcaaatagtctcgattattctttaaatccggaagaagaaaaatagaagttaacataggggttcaagggaatagcactccatgcattcggacagataccaacttcatgccgttatcagggagcatctcctgtgtgcctggccctgagctgagcaccagggggaccgtggagacaggacacacaggcccctgccctaaccttactttctgcttccccactctgtcaccccagacaggaaagactttcctctccccccagcacacaaatgtcccctccccagcccacacccagcttgtgttgcccccaagtccagctgcatgtgtctcacttgtctgccaagagctgcttctgtcagaaggcgacacctctctctggtgattgggtggtgggtataagaaataacccaaaggcctatccagaaagtgagatcaaagttggcagcctcctgggcccctcccaaaacttataattcaggccccacttcactccgtgcccctttctttctttgctcttttttctgagggacccggctgccccccatccagggctcctctttcctaagcttcatatgccaggggtctgcccatcctcagagcctccctaatgctctgagtaccatattctcaaggtagcctctctgcttccgcaggagcccaagcacccagccctgcacagatgccaagccaaggtctcttctgttgccttaaggcttcttgttgagggtactcagaccttcacccttaaccgcaggccctgtcaacctccacttttctaaccccaccccactccaagaccatacccaccccttattccactcttttcctgagttaggtttctggcttccctcagccattcatcagcatggcctgataacgtgcgaagggagatctggcgagaagcctgtggtgaacaaacattttaatgaacaaacagaaatgatggctccaaactgaaaacaccctggaagccacaaactcagtga

SEQ ID NO: 47725 - DNA, 1363 bp, Bovine  19866880893588
aaaaatataagggagtaaaacattttatttaaaaaaaataaaagagtatagaataaagttatactgaaccaaacctatcatttgtaacaataaatatgagtagattaaacttgtttaagacccaacttaaaactccaataaagttttcttcattgtgcttttctttagtttaaaaactgatttcaataaagatatgtcaattttataattataaaagtgatgactgttgctataaattaaaggaaaaaactaaacgtaagtaatggcgtctgttttgacatgcacatggtaaattcgctcattcttgtaatgtcacctagatgctgctggtaccacactgagcaaacctgagaatgccccttctgaggcactgctgccccacccacaatcactagcagagcaccccgctctgctgctgacacactgcctcctctccctcctcagcaccctggccagagctgattagacagattacccaaggtcaaccaatccatgggcttacttatggcttggtggggaaagctgagctagagtaattagattcccactctggggtgtattggaactggacacatgggagaaaaattcagtcctcagtgtgagtgaaagttgttctgctcctaacagctccctaggtagccctttgacaagttctccttcttccaggggcaactggagcagctctgtttcagcactcaaaagagccaaatcaaaatatgatgggaaagtggaagattccattaattaaataatctactccacatcaaatgtaaaaattgactaaattgactgaattgattcacttttaccacattgcaaggatatgatttttcactctacaccagagttactctttagagttctgcctagtaagatatgccaagaaactgtgttaaaatgtttagatagagtgactaaaacaattaacaagttgccaagtgtcttcacatttatctgagtgaacacccacatttgtctctccacactgtagagaaacaaatctacactgtcctctatattcaggcaaaccttttacagggctagttcagttcaagttcagttcagtcgctcagtcatgtccaactctgcaaccccacggactgcaacacactaggcttccctgtccatcaccaactcccagagcctactcaaattcaagtccatcacattgggtgatgccattcaaccatctcatcctctgtcaccctcttctccttccgccttcaatctttcccagcatcagggtcttttccaatgagtcagttcttcccatcaggtggccaaagtattggagtttccacttcagcatcagggcttgcaatgaatattcaggactgatttcctttaggatggactggttgga

SEQ ID NO: 47726 - DNA, 1258 bp, Bovine  19866880893671
atgaaagactcctggttcctaaagtcctgctagagtttcttgcacagttttgcttgggtaagggatgctgcacattgaaccacacagggtcagtgctgggaagttactggcttcataattgaaatgcttggttttgtccacttgaacagatccattcaatttcagagagagatgtaaagtctgaggaccgtcataaattgcagccacaaaattcatatacctatttatttttcttctcattgtatcctagaaaagattcagagtgtctttcaaagaggctaacaatagagcaagataaagtcaattaaaaaaataagaaagatgacacagagggaagaagaacagtgataggaaacagcagctataaacccacatgacacactggccttcttctccttcctcacccctgtcaggctgataaggtggaccctcttggtaggagtgagaaacttcaaagtgagataataccaactttgatttttttttccctctaatttgcctaaattcaatgaaaatttcaggctgttgcttcaaatagaaatgagctctaattatccttctgcttttcatatcattttcaataagtcagcattactgttccagttatccaccagaaagcagtgaaaaacctcacattttctggggcctctgcatccttttaaacgtgcacttctgaaatgtttaaaaacaagtctgcctttggagcatttgtgtggagaaaaaaaggagagagtctggaatggtttaacatgctgttgtttgtggtttatcaaatcaggcacgcacacttctattaaagcacagacaaagcagcctggcagttatcgtttcatctgatactgagccttttctgggtttttttggtcatcttcagctacgtatgaaaaatttatcctgctctgtctaagggagcaaccgtataaataaagaaggacatacctttgtaggaggctcaactctagaacaattctatattgttctctgtggggcttcccctgctgaacagaccccaaaccatcatctggggacccaggcttcatagactgccttgggttaagttgaactgcacagataggaacctcataatcatgttttaaatacctaatatacaaatgtgcttttttttttttttaagggcatcctatttacatgactctggatgtaaatgaactctatttggagaatattttaaaaggaaggtcaaggaaaatggtctactccggctcagtgcttgtgattatacagtcatacttgacag

SEQ ID NO: 47727 - DNA, 1133 bp, Bovine  19866880926837
gtttatatgcaaatgcatgctgctgctgctgctgctaagtcgcttctgtcgtgtccaactctgtgtgaccccatagatggaagcccaccaggctcccctgtccctgggattctccaggcaagaattctggagtgggttgccatttcctcctccaatgcatgaaagtgaaaagtgaaagtgaagtggctcagttgtgtccgactcttagcgaccccatggactgcagcctaccaggcccctccatccatgggattttccaggcaggagtactggagtgggggcaaatgcatgaattccatataaatctatatacctctgtctctgagatttaaaaaaccaaccataagagccacctccttttctctctctggctgccatcccaagggatctcccatcctttattacagctgagcagccccattaaaaggaaggattagggacatcaccccaattcagtttccccttgggaagtcttggtgtgttcataaaatctcagctatttcctgagaactaggtttagtaaactttcatctctactctcaaattcccaaaggacatcaagtatcacacagagaaatatttgtgaaagaggtagttgtcaacaaagtcttgctgaaaaattcctgaacaaaacatacttaacatattgggacttctaaaattaaaatttagttagcactgccctaaggaatgatgctgaagctggaactccagtactttggccacctcatgcgaagagttgactcattggaaaagactgatgctgggagggattgggggcaggaggagaaggggacgacagaggatgagatggctggatggcatcactgactcgatggacgtgagtctgagtgaactccgggagttggtgatgaacagggaggcctggcgtgctgggattcatggggtacaaagagtcggacatgactgagcgactgatctgatctgatccgaaaacactcactatttttttttttctgagaactgtaggagacttaggtggaagtgataatttgtccagataataaacacttaagaacaggagtggtaattgaagtttcttctcaaccacatctcagactaatggagcaggagtgttttctatttgggtattcttcactcctgcacacctg

SEQ ID NO: 47728 - DNA, 1257 bp, Bovine  19866880951273
ggctactacagcccctacagcgtcagcggctccggctccaccaccggctcgcgctccggctcgcgcaccggctcccgggctggctcccgtcgcggcagcttcgatgccacgggctcaggcttctccatgaccttctcctcctcgtcctactcctcctcaggctatggccgccgctacgcctcggggcccacgtcctccctggggggccctgagtccacggcagcctgacccctcctgctccctgcctcccgctctgcatgtggcctcccgcccaggacgctggggtctctttaacattgaaaggtgtcttcctcccaagcggtgcctaaagtttaaccaaaaagactagactaacatattaatatatacctgctgtccagacagcctgttcccggggacggggccagcccagccccactgaccactccaccccccgggtctccctgctcctctttacctgccactcaccacagccaggtgccttggagggtccagaggtgggcccccaactcagccctcccatctccccgaggggttccgtctgggcgagcttcccccagccctgtagaccagccccacccaacccccagcccgacctgcctgggcagcggacgcagcccctagcagcagggccgtcgggaccagcgcctctgtctccaggactgacccgctcgctctgcgcgggcggcagcgagtcctggtcccctcctctcctcggctgctcaggaagccccttccccatgggagggtgaggtccccgagcagacccagctggcccaggccaggccccccagaccccaggcctctggcttcagccttccagcctcagctccctagtaagtgccttctgtgtcccccttcgcaccccaggccccaaggacccagacctggggtgggagacagatcctcctggtgaaaggctcgccactgcccagctctcaggcgtgccagccaggtacaacgggtcccctgtaggtttctgcccgctgtgggcccagcgccccccaaggcctgtggggcacccctcccccgggtgctgactgcctgcctctcccagggagcctcagccccccgagtgggcccgggacgcggccgaggcggtccgtgccaaccaggccaccccgccggtgccacccgctcctgctccatcaccccgggccctggcggctccacccccacctccaccctctgactgagctttgcatgttccactaacccagggaggtggcgggtggaagcgctcggcttcggctgcct

SEQ ID NO: 47729 - DNA, 3447 bp, Bovine  19866881010408
ctgaaccttactgtgcctccattttcttatctgcaaaatgtagattataagaatacacacttcatagtagattgtcatgaagattagagctaacaacatacttagaaaaattcctggcacacactaaacactcggtggtacaacttattattactactactattattatctgaaagcagcctgttttttacacaaacaagtgataaactactcatagttctatctcaattcattccagcaggttaacttaaaatctcttgcaagcagtatcatgttgcctcattcacatttctaagcatctttgaaaataagaacactgcagtcctaaaaaaagaaaaacaaactttttatagtttacttttccccacttattttttattgatggtaattttctatgttgaaagcaaatccaagttatccagcccattgctgttgtttagtcactaagtcatgtctgactttctgcgaccccacagactgcagcatgccaggcttccctgttcttcgctatctcccagagtttgctcaaactcatgtctattgagtaagtgatgccatccaaccatttcatcctgttacccccttctcctcctgccctcaatctttcccagcatcagggtcttttccagtgagttggctcctcacttcaggtggccagcgtattggagctccagcactggagccaaaaaaataaaatctgccactgtttccacatttttcccttctgctcgccatgaaatgatgggactggatgtcatgatcttcattttttgaatgttgagttttaagccagctttttcactctcctctttcaccctcatcaagagactctttagttcctctttgctttctgccattagagtggtgtcatctgcatatctgaggttgttgatatttctcctggcaatcttgattctagtttgtgagtcatccaacctggcatttcacatgatgtactccgcatataagttaaataagcaaggtgacaatatacagccttgatgtactcctttcccaatttggaactagtccattgttctatgtctggttctgactattgcacttgacttgcatacagatttctcaggaggcaggtaaggtggtagtcccatctctttaagaattttcaaaaaaaaagaaaagaaatttccacagtttgttgcgatccacagagtcaaaggctttagcatagtcaatgaaccagaaatagatgattttatggaatttccttgctttttctatgatccagaggatgttggcaatttggcctctggttcctctgccttttctaaatccaacttgtacatctacaagttctcagttcacatactgctgaagcctagcttgaagaatcctgagcactgccttgctagcgtgttaaatgaatgcaattatatagtttaaatattttttggcattgcctttctttgggattagaatgaaaactgaccctttccagtcctgtggccattgctgagttttccaaatttgctggcatattgagtgcagcactttaacaccatcatcttttaggattttaaataactcagatggaataccacctccactagctttgtttggtgtccaatcaatacctggggcgttgttcctttgtttcctgtcaaatccttataggatcttggaaaatatcaccacctgtaacattccccactgtaagacacaagataaaattcctttgtttttggcatgggtcatttatgtatactggaaattatataatcatacatcttatttgctaaatactaaaaggaaaggagacattataccttacagtgtctcagaaagaggtaaaataaagagaatgcgaacaagtaacagtttcctagttcatttggattaaagagaattcctagttacacacgatgaggttttcacaagcagcaagttagagaacctatatttttgtgtcaatacaaaactgccaaatgatttttcccaaaatttaaatttttctatctaacaaaactgattttcttgagtccaaggagggtatgttattcatccagcagtatctagcaaatatagattgtacaatacttattgacctaagtaaatctgaatggcacagcactgggctcaagggagacactcaaatatttttcgaatgaaatgaatgaatcagacaaagactaacggaaactggttctgggtgatctgtcttgctggttgtaatagagattaagagagaaatataggagggtggaatggataccatcccaaagctacacacacacatacatatctaatacagaaagtcccctccatactaatgcattccattctgataccacgttccatttgttcagttgactgacaagtccaacaaaggaagcctaggtacccaactgacacaactgggtacatagtactgtactgtaataggttcataatacttttcacacaaataatacattaaaaaaaaaacacaaaaaaaataaaataggcttaatctttcagtacaataccttgaaaagcataataatagagtacaacagtagtacaggagttggcatcaagtgaacagacaagaagagttactgactagaggagggagaggaggtgggagatggtagagccaaaggatcatcagcagtaggagatggaaggcaagcttcaatttcactcatgcctgacattgatggcataggttctggttccatgctgaaaccagatgcacatttcccacctttgaaagtttgcagcttgaaggttcctaggtagcagagtttttatatatgcattcacatacacaacctgaagcaatatcagtaatctacattgagaattaataggagccagcacttctcttgctggtctaatggctaaagactccaaagctcccgatgccaggggactgagctcaatccctggtcaggaaactagatcctgctttctgcaactaaaagatcccacatgcagcaatgaagatggaagatcttgcaagtcacaactgttgtataaataatgacaatattaaacaaattgcttggatataatccaccatttacaataggcttgatctgttcttgagggagaaaatttccccaatttgtatcattttggcttttaaatctgaaaaaaaaggaaagaaactttctgaaatgtctactgagatagatcgaagctgctgcatccctgttcatcacattcaggtctagggtaaccacgtgtcatcatcattccccagcactggaactgagaactgagttcagtcctcccacatgacatcattattcctaagatctttcaagacatttgaaagcccttcaaactctcttattcttctcagtccctgtccagtccaaccaggaaggcagacagttgccagaacggttaggtcaaggattgaaacaagtggggaatatctctttctacaatgatgagtatattcatcctatgcaaaaagataagtagatagaggtaaat

SEQ ID NO: 47730 - DNA, 847 bp, Bovine  19866881040808
tcatactctgaccttgtggccgctctttgtgaaaaacccttttatgttttctcacttaagtagaattaacatttttccctctgtggcatgaactcatggtagacgaaagctttcatagatagcaagtagtttttcaatgtcacattcctatcacagtgttatggaacaaaactaattgtcatcaggattgaaggcaattctattcacagcaagataaattggatttctaaactgtgatttccattgtgttacctctgtgtatcatgaaagttatcctgatgtgcacagcagtcaggctacttacttatacagtgacgtccagctttatgctgaatctgtcatcttttgcttcccaagggaggacagaagcacaacagaagcataatcgtagaccaccattcaatggaaggggttaatgaggatacattgctttaaatatcagtgtgaacattcaaagactacaagaaaatagtccattcccttagaagagtaggcatccttgtgaattgtccatttcattactgtggagttttatgtgcatgtgaggttctctctctctctctacttttttaataatacttttttagatatatgcatacagtataactgggcttcccaggtggctcagtgataaagaatctgcctgccaatgcaggaggcacaagagacaagggttcgatccctgggttggggaagatcccctggaggaggaaatggcaatccaccccagtattcctgcctgggaaatcccatgaacagagaagcctggagggctacaggctgtcacaaagagtcagacacgactgagccactgagaacagcatacagtataactatttcaaaatgt

SEQ ID NO: 47731 - DNA, 1082 bp, Bovine  19866881053210
actggcagcccccactgcaccactctgaagggtgaggggaccattcacaccatcatctatgttgtgcaatgcagggcctttcaggctgcacacagcagcaccgctgggggagcaccagagtaaatcaaaccctctctctcctgcttgcccttcacctttaatgacaaaggaagaaagtgaaaagaaagttaaaggcagcttgagctaccaaaactaactgcatattgcaaaaggaaccatttcacttgactgaacagttcaaacaaatttcagctcctgagcattttaaacacggagagaaaacaatataaataatgtatgtgtgtgtgtgtgtatatgtgtgtgtacatacatatacatacatatatatctatatggctgttaatgaatcatttgcaagggacattttgaatgtaaaatggtgtgaatttctacactcccttctttctggctttccaggcacaagtcccatcaatctctaaaccctgacaccaggcagttcattgtttttcaaatttatgacatttttcagtccactgtttttaaactgtcgccctcagtgggtagctggcacaactcattgctactctcagctcccactgagctcatcgccctaggagtgatgtgctagcaaaatttccagttgactgatctccaggatggtaaacactctctgtgtgcttcctctgatgacatcattagttttgtcctccaaccttatccagaacagaaataattaagattgtgtttgtccatcccaaacacagataatgaaaatgaaggtaattgaaaatagaaccagtcattctactcaatctcttggtgggatggaagactaactctctcccagacatcccaatagttttatgtcatcattgcaaaaacgtctctaatattgcagggtctatctggtctattgagagactattctgtatctggttcttcactgaaacaggcttattttgacctgctgaattttctcatttattttatgaaatgcataacttacgcactcaattctcatctcagaaaacagtctgattttctcccagagttctcaaactaagtacaggaattcagtg

SEQ ID NO: 47732 - DNA, 949 bp, Bovine  19866881124436
tataataaggtatacaccatgatattaataggatttacaaatcaatttgtgattctgggtcttttttacctttttatgtttataatattttctacttttttactctattttttcaatttattttctattgaagtacagttgatgtataatactatatggtatataggtgtataatatagtgattgtattaatcattaattttctaatttttcactataccattctaatctgttttattttgaatagttcttatgcaaatatttttatataaaaagatttacagtgaagtcaattttggaagctaggaactctttaataaagtcttctgatcattcagttcagttcagtcactcagtcgtgtctgactctttgtgaccccatgaattgcagcatgccaggcctccctgtccatcaccaactcccagagttcactcagactcacgtccatcaagtcggtgatgccatccagctatctcatcctttgtcgtccccttctcctcctgcccccagtccctcccagcatcagagtcttttccaatgagtcaatgcttcacatgaggtggccagagtctgatcattagctgacatttattgaacagcctagatggattgagcaaaatcttgccgttaatgtctgtctcaaaccaccagcaatccacatggagtcattaagagtgaacaggtggtacctccacgaagctgatgtatcttccaggacaggaatcaatggtacccagagaagcaagagagaggagagggccatggctgtgttcaaaggcttaggaactcaattactttctccatcacatttcagttcatgtcccatcagagagaatttctctcattcttgggtaattatgagaactgggttaaaataaaaagccatttatttaagacaagtttttaaagcatggctttaagtttctctgtgagcttacatgctcctttg

SEQ ID NO: 47733 - DNA, 1322 bp, Bovine  19866881125931
ttggagcagtcttccagatcctctctatgcatataatgtttcaagctgtaattacattgtacatgctattttgtaatctaaaaagcttttgtaaacatatttcatttaaaaaccaacatggttgtatgttttcaattgtattttttgttaaaacagtttctatcctttaaaaatttttttaaatttgtttggcagtattaggtcttagttgaggctgtgttgggtcttagttgcggcatgcaagatctctggttgtggatgggctccagagtatgccagcttcagtagctgcagcgctcagactcagtggttgctccaaggcatgtaggatcttagttccctgaccagggatcaaacccaggtcccttgagcccacatcccctgcacttccaggtgacttctttccctctgggccaccagagaaatcccttctttctgttcttaattagtactgtaatggagaaatgaaaatccttatagctaaatctttgcctaagttctcatttctttgcggtaattatttttctctttttaacttagtaatttgtgtttgcacttcctctttttcaaatgccttcccattccactcatgtctttatagtataaatggatgaaattacacatagggcatccaaagcctactcaatttttaaaagtttatctttctgattataaaagtaatacatatttactgtagaacattaggaaaatgtggatgaatataataaaaatattctgatatgtagacaactactgatcatattttggtatacagttttctagttttctctctgttgccttcagcaatgagcatcagaaaaatgtttggtaatatagtggggtgaatgacaccttttaatttgtatttctttgcttattcatgtagctgaatagcatttcagaagttcacattttatagtccatttcaggccccatcttctctatctagccttccctgagaattccagactaattacactaacttataatggtctaggttctcacggcaagcatactgggtggtttgccattccctcctccagagtgaaaaagccagcttaaaattaaatattaaaaaaactaagatcatggcatctggccccattacttcaaggcaaatggaaggggaaaaggtggaagcggtgacagattttctcttcttgggctctataatcactgtggatggtgactgcagccatgaaatcagaagacgactgcttcttggcaggaaagttatgataaacctagacagtgtgttgaaaagtagagacatcacactgctgacaaagatccatatagtcaaagctatggtcttcccagtg

SEQ ID NO: 47734 - DNA, 843 bp, Bovine  19866881131249
cctctgtgattgtagggtcttctctggtctgagaatggctacctcccgatatgagccagtggctgagattggtgtcggtgcctatgggacagtgtacaaggcccgtgatccccacagtggccactttgtggccctcaagagtgtaagagtccccaatggaggaggtgctggagggggcctgcccatcagcaccgttcgggaggtggccttactgcggcgtctggaggcttttgagcatcccaatgttgtcaggtgagaagatggaagcatgggagtgggtcgtgaaaggaaaaagacagcctaacctatagatgtagagtggtggtcagaagaggagtgggaaccctgaggaaataggggaggccatgttgggtccaagaccattggtcagtgagtgaccacttgttctggccaggcttatggacgtctgtgcaacagcccgaactgaccgggagaccaaagtgaccctggtgtttgagcatgtggaccaagatctcaggacatatctggacaaggcacccccaccaggcttgccagtggagaccataaaagtaagtagggtgggcagacactgagaggtagcttgagaccattgtggtagtttctgttgtaatttcaggtgtggcacctggttcccagtttctctgtacttcccccttccaaaccaggatctgatgcgccaatttctaagaggcctggatttccttcatgccaactgcatcggttcaccgagacctgaagccagagaacattctggtacaagtggtgggacagtcaagctggctgcctttggcctggccagaatctacagctaccagatggcacttacacctgggtcagtag

SEQ ID NO: 47735 - DNA, 766 bp, Bovine  19866881132012
tatcaagagagtgaaaaccaggaagtacttaggaaaggacatgtcccagtcttatctcctgtgatgtataccccattcctgcttctgcttatactcagagactctggggcaaagctttggggattttacgagtctgccagtttccagaatcttagccattttctaccataggcagaaagagcttctcttagcaaagctctattttcttccttttctctttttgggtaggctagtttgaacataagtttacctttttatagtactttactaatagcaacaagaaggaaccaacccaatccaacactctgaatttctctactaagtaatgtgctgctataaccataacaggcacgtgagctgcattccaaggtacaacaggaaaccatataactagctggatcggattgctaatttctcaaaccaagatagaggggttattactgcccttcatctttcctctttggttgaatcactttggggctgaaccatttgtgtggcctcttactcatggcttctctggtagttcagatgataaaggatctgcctgtaatcagtgagacccttggatccctgggtcaggaagatccctggagaaggaaatggcaatccactccagtattcttgcctggagaattccatggacagaagagcctggcaggctacagtccatggggtcatagagtcacggctaagcaactaacacatattactcatggcactaattgctgtactagttaggacgctttaagttggaataaacaaaaat

SEQ ID NO: 47736 - DNA, 2991 bp, Bovine  19866881141798
cacacgcacaggaaaggcagagtcgtataggcacaggagcaaaaccattcgatacaaagaatgtctctaacagctgaaagaatgacaaataaaggaatgattgctattgaatttgggagcaggcaggctgttatcctgggcaagatttttgagcaagttaaattttgaatagagtctatagggaggtagcttctccgaaacttggtttcctagaatgaccttctttctgttcatctctctctttaagccacaattgttcattcactacaaaaataaaggacctgaaacctgtcttcagagaacacatcagaagagacagatcactcctgggcatatttctggaaaaaatgaaacactaattcagaaagataaatgcaccttaatgttcagagcagcacaatttacaaccgccaagatatggaagaaatctaagcgtccatcaacagatgagtggataaagaagatgtggtacaaaatataccaaataatataccaaaaaatatcactcagccacaaaaaagaatgaaatttagcagtaaagtagatggggctggatcatattatgtttagtgaaataaatcagacagagaaagacaaatactgtattatatcactcatatgtaaaatctaaaaaataatacaagtgaatgtacaaggcaaaacacaagaagactcacagacagagaacaaacaagcataggaacaaactacagtgagaagagatatgacagggggcacattagtgatattggattaagagatataaactactatgtataaaatagataagcaacaaggatatattgtagtgcacagggaattctagccattatcttgtaataactttaaatggagtataaacggtaaaaatactgaacgctgtaggcctgaaactaatataatattataactaaactacaatctaaaaaatgaatataatgagagtggtaacagtgtagtcaggttataaaagaaaaatagttctacctgacaagtgagagatgttttcaaaatgcagaaactaaatggagtgttgagagaggaacagaagtttccataaaaagaatggggtaagaaggccacaccaggaataacaatcatgcaaagtttgcagggctccattgaaggcaggaggaaaggggggcgacagaggatgagatgattggatggcatcaccaactcaatagacatgagtttgagcaagctccagaagatggtgaatggcagagaagcctggcatgctgcagtccatggggtcacaaagagtcagacacaactgagcaactgaacaacagcaattgaaaaagaccctgatgctgagaaactgagggcaggagtagaagggggtggcagaggacgagatggttggatggcatcaccgactcaatggacatgagtttgagcaaactctgggagatgaagaaagacaaggaagcctggcgtacttcagtccatagggttgcaaagagacacgacttagcaactgaaaaatggtagaaaagagcatggttttccagagcctgagagcaagaagtcagggactatggaccatctgatggaaagccgacctgggccagaatgtaaaggtctttcctcctcagcactaaacacatttcaagaacaataacaattttatttatttatttacattttttacccccagcatttttattcagtcggtctctggggagccaaaaaggaaagaactatcagattcttacaatttattgtttggtattgttctaaaattaatccttgtgactgcaaaagaagcatgaaagaaacaaatgtgttttgtgttagatgttgacttctagcactaatttcaattcttaaataggacaatttttattattcagaaaagactaaatgtataatatgggatagagattgcatttattagcaagcatttcgcttaatcagccagatagttaccactggccagacaagtgcttatgaattatggcattgcttttggcaaaactatttatctgcgtgacatgatatgtcacttttgaacttcaacttgacatccataaaactacattttcatcaaactgaaagatcaagctttccatgctgactcacttgggtcaacattttgcaaatgcctggatttaccacttgaaccataaacccttggagaataattctgtgcactgatgtttgatagcctagggcacagatcatcatttctgagcagaagaaggggtgttaaagcaaaatgcatttcctttctgcatgcccaatgacttcctccaaagagtattctcatcagatcattttgaaatcactgaataaacactaactttgtggatccctgaaagaaagtaaagaccatccatggtgcattttttacttcttaggattaggagagagcatcacctccactgccagaggatattcactaatgcaccaggcattgccacaatttggggtacatgcgtgctaagtcaatcgagtcgtatccaactctttgagaccctatggaccgtagtctgccaggctccttctgcccatgagattctccaggcaagaatattggaatgggttgccatgtgctcctccagaatatcttcccaaaccaaggatcaaacccacatctcttaacatctcctgcatgatagatgggttctttactactgagacaccaaagtccctggtggggcttcttaaagtttccttccttaggttagacttaattttaggttctttaaaaatacgcagtgaggagaaaacctcaaaactgatcaaaagacctagaaagagtcattattctgcccttaattctcttctcaaaacaaacaaacaaacataaagacatcccatgcaacattcaggtgttacttctcttttctgaaccctgtttatgaggtggattcttttttccctgtgaacacagatttggacctctcaccctggcaagtgaatgtagcagtttggccctcaggtgacttcttaaaagaggaaatgacccaatgcccctgtaat

SEQ ID NO: 47737 - DNA, 697 bp, Bovine  19866881250892
gcggcgcgcggcacacttggccccgacgtaaaccgcgggtgcaccccggggctccagcgggcccacggccggtggagggggtgacaaccacgcggaccggtggcgcagcgtggggctaggatggccgggccgtttgggaagagcggtggcagaggcagcggacagagacaagaacttcccaccgagaacttcggaaaggcagaggtttttgtcatgatctcgattagtctcccacgcctgcaaagtgccttgaccacagtaggcgcttaataagcagttttgaaagcgtgagctaatcccgccccctcccccgcctcagtttcctcctcggatgcagcaaacgatttgatctccgaggcccctagcaagtctgaaatcctaggatgctgaggctaaatcccatgtgtactgctgtggttttgcttttagtttttcagggacatttttagtgctaccctttatgatgtgccaggagtgaatttgacaccagatggcttttttttttttttttttttaaataagaaagaagacaaagggagggagaaaaatattttccaactggcagtgctgacagcattttggaagagaatccagggaggcaaagaggagctgtctcagcctgattcttcctcctcccgcacaccctgccaccctggcctccaccataaatgggggagatcagattggagctttttat

SEQ ID NO: 47738 - DNA, 1200 bp, Bovine  19866881309621
actttaatttttctgtgatgaatgaatcttaaactgggttatgtagtcaatttggttaaattctatggctttagttaaattttcaaagaggaaaagttaagcatgtgggtcacccaagaggctttgagtttgtgtatatatcagagtaggaatttatttctgcctgcttgtactgggggaagaatcatcaatttctcctggtttatatttgtgaaatcagagtgctggttactagccaaggtttcttttcaaaaactgcagagaagacttgtgatgaaagccaaaaccctttgaaaaggggcattggatatgcctctttctatgaataaaaataaaaggtgatttccctctaagcctgtgtgaccaaagataatgcatctcattccaatgataggatttctctctccttttctttctctttctcttgtttagatattgtagaaacaacaacaaaaaacagtttggaagagctgaactccaaatataattaacacctctagcaatttgatttcctgcatttcattaaggcagctaaatttaggcttttaaagaaaatgacctttaaagttatttcattcaatgactgtttattgaccacactggataatttatgcactgcttggtgattagtggggtcacacaggatgttcaaggtaaatagctcactcgagaagggaggattaatgtgactgttgttgttcagtcactaactcacatctgacaatttgcgaccccgtggactgcagcatgccaggcttccctgtcttaactatttccctgagtttgctcaaactcatgtccattgagtcagtgatgccatccaaccagctcatcctgtcgccccattcttctcttgccctcagtctttcccaacatcaaagtcttttccaatgaatcagctcttcacatcaggtggccaaagtattggagcttcaactttagcatcagtccttccaatgaatattcagggttgatttcctttgggattgactgatttcatatccttgctgtccaggggaccctcaagagtcttctccagcactacaatctgaaagcatcaattctttggtgctgttttatggtccaactctcacatctgtacatgactactggaaaaataccatagctttgactatatggacctttgttggcaaagtgatattgtctgttttttaatgcactatactaggtttgtcacag

SEQ ID NO: 47739 - DNA, 1333 bp, Bovine  19866881382889
ctgcctgcagttcctcacacagagcccctgaaacctttccccgactgatgggagtgataggtggatcctgcacagagctcctaaatcacttggaaattcctgggtgataggaacgtcttttgctctaatgaggtgactcctggtaggctccaggatggcttgaggatggggctggtcacctaagaccacgccatgactacaagtttggaactccaggtacacttctcattctctggggagagtgaaagggctggagattgagttaataactgattgtggctatgtgataaagcctctataaaaatcgccaaactatacagttcagagagcttccaggatgctgaaaatacccatgtgttgggaaagcggtacatcccaactccatggggacagaagttcctgcattcaggacccttccagatctggccccatggtactctcttcatctggctgtttatatattttgtaatcttgtttgtcataaataagtaaacataagtggctaatttctctgagttctgtgaacagttctagcaaattattgaacctgagaaggggttgtgggtacccctgatttgtagccaagtcacacagaagtgtgtaacctgggaacccagtacttgagattggcatctgaagagggggcagtcttatgggactgagccattaatctgtggggtctatggtaaatctgcattgttagtgtcagaatttaattacgttttaggactctcagttggtgcctgcagagaactggagaattgcttggtgtggaacacccacctacacattcgtgtctggtgttgtgagtagagaaacagttttccctgcaaaatgctagagcagttgatgtgccacttacagaccttcattaagaagcatctcttcacatacagacccatcgctcttgctgaactcttttgtttaaagtgcattcggagaaggaaatggcaacccactccagtattcttgcctggagaatcccagggacaaaggagcctggtgggcagccgtctatggggtcgcacagagtcggacacgactcagcagcagcagcagcagcagcagcagcagcagaatatacagtggaatttatatttggggtcctaagctctgggaacaagattgacatttgcttgcacaagaatcttctccatcaatttgcaatgcaaaagctgtcagctaacttaaatacagtattcaaaacaagaaatcagctttttgggtatggtggggatgggttgtaccacgtggtgaaatttgcttgacagcctctgtattttctctggagacaaaacaacctttttaccagcaagaattttcagaggggatg

SEQ ID NO: 47740 - DNA, 1377 bp, Bovine  19866881385255
agacagtaaaggacctggattagatatgcatagagttccaggataacaggagaaagcacagtttaaaaagttcatttgggattaggctatcaaaatagtactggcttgaagcgataaaggcctgaaccaaaatagcagcattgaaaaatggaaaggaaggaataaaatagaacattataaaagccaaatcagtaaacctagacattgatgtcattggcagtgtgtatggagagcactcagaaatgacccaagctttcaagtctcagtggctgcaagatggcaaaggtaaagaaatcagaaatagttggttagaaaaggaaagataaaaatatgaagagtgtgatttaggatatgtggaatctgaagccctgaacagacacagaaaccactagtaaggggttgaaaatgtggaactgagagagacgggaagggctgcagtcctggtttgttcctactgccctgacatcacatccagttaagcatctgtgccaggcaacagcgtcccaatttgggcaacaaattatatgaccacactatctctgagggagagagtaaaaagatgagcttaaaagctcacagcacagaacactgggaaatgcccacagataggtgagaagagaaggaataaaaaggagccatggaaacatgaaaacagaatcagagaaataggaaagtatcttcagagaagagaacaaggtgtatgactgggggaagatggtcggctttgatgtgattttcagaaaccccaggagggcagattccatcaagtggattatgaaacatccaaattttttttaattttgtcattcaagaaagtaacaagttagaggatggtttgttttttaatgctaagtatatttgctggctgaggggaaggaactagcagagatgaagtgatagaagtaaatgccaagataatgaaaagagtgaggtctcaaaggaggtgagcacagcaggaaaggagatggcaaagacaggaattaaaacatcatgtggggttgcggagggtgggccccgggttggtggcagccatttctcatctaaaacatcatgtgaaagtgaaagtcactcagtcatgtccgactctttgggaccccagggacccatggaattctctaggccagaatactggggtgggtagactttcccttctccaggggatcttcccaacccagggattgaacccaggtctcccacatttcaggtggattatttaccagctgagccacaagggaaacccaagaatactggattgggcagcctatcccttctccatcttcccgacctaggaatcaaaccaatgttttctacattgcaggcagattctttaccaactagctatcagagaagcccaaaacatcatgtaagggagctttt

SEQ ID NO: 47741 - DNA, 2191 bp, Bovine  19866881399975
ctgcattctaaatagagaagtggttagttttcctaaaagaatagttttcctaaaagaagctatttgactttttaagttgagaatagaattacagcaagacagttaagaagacagtgaatttcacttaaaaaatatatctcattataaagaataacaaaattcagagaggcagcaagacagctaatgtttctgagaatctaatctattaacctcttggtgtctctgcccattagtgtttttcccctcaacaactctggaatattgtttagaaattctgcagtaattagtggaccattttacaaagctttattttatgctttgtgactgtctttggaatgaaactttgaattaacttggcatgcttacagtgttcaccacgggcgggtgaataaaattcctaaagatatgagagcagcaaaaatcatagatccaggccatatttcaaagtaggtgctttctctggggcaattactctagaagatggtcctgatagttttttttaaaactctgcaaggtgggtgttattgtaccagttagagatgaagaaatggaagcttctagagattaaatgttctgcttaaagccacacacccagaaaataatggagtcagaatttaaaattgggtcagccccaaagagaaccaaagctctttccattatgatatatcttaccaggctattcattcataaaacatccaagcagaagaggacaacaacaactgcatgcttatctcagaaagaagaaataaaggcaaatactaagaggcaagaatttaaagtgaataaaatcaattaaatgtatgattatataccacagcgtgcatcagacttatatagggcattatttaacaggggtaacttttagtgctctaaatagatatttaggtaggtatcttctaagtgccaagttttcagaaaagatagactatactttatttttcagaacctggagtttcacacttacatggtttcacatttttttggttgagggggttcattgcattagaaagttgcaaccctttgaaaagtatagtagtgcagttcatcaacaggttatgctgcgaatattgcagccacataagaagagagggcgtgtcagttatcagtttattgcttttcagcttcaaatccatccattattgcctgctctatgaaaatggagtttgttgtttagttgctcagtcatgtccaactctttgcgattcaatggactgcagcacgccaggctcccgtgtcgttcactatctcccggagtttgcttaaactcacgtccatggtgttaatgatgccatccaaccatttcgttctccgtggcccccttctcctcctgccctcaatcgttcctggcatcagggtcttttccagtgagtcagttcttcacatcaggtggccaaagtattggagcttcagcttcagcatcagtccttccaatgaatattcgggactgtttccttaagattgactggtctgatctccttgcagtgcaagggactctcaagagtcttctctagcaccacagttcaaaagcatcaattcttcggcgttcagccttctttatggtccaactctcacatctatacatgactactggaaaaaccatagctatgactagacagacctttgttggcaaaggtaatgtctctgcttttgatgctgtcttggtttgtcatagcttttcttcgaaggagcaagtcttttaatttcatggctgaagtcaccatctacagagattttggagcccaagaaagtaaattctgtcactgttttcactgttttcctatctatttaccgtgaagtgatgggaccagatgccttgcaaaagtaggaagtcatgagatacctggaatgaaaaattcagttcagtcagttcagtcactcagttgtgtccaactctttgcgaccccatgaatcacagcacaccaggcctccctgtagatcaccaactcccggagttcactcaaactcatgtccatcgagtcggtgatgccatctagccatctcatcctctgtcatccccttcacctcctgcacccaatccctccaagcctcaaggtcttttccaatgagtcaactcttcgcatgaggtggtgaaagtattggagtttcagctttagtatcagtccttcaaatgaacacccaggacgatctttaggaggacggtggatctgcttgcagtccaagggactctcaa

SEQ ID NO: 47742 - DNA, 755 bp, Bovine  19866881471472
acccacactcatatgggcaactaacctatgacaaaggaagcaagaatatacattgaggaaaagacagtctctgcaataaatggtactgggaaaactgaacaactacatacaaaaaaaaaaaaaaaaatcaacctggactattttctcacacaaagcacaaaagtaaattcaaaatgaatttaaagacttaaagtaagacctgaaaccagaaaacttctagaagaaaacataggcagtaaactctttgtcatcacccttagtaatttttgttttgatatgtttcctcgggcaagcaaaagaacagcaaaaataaacagaagggacatcaaactaaaaagcctttgcatagcaaaggaaaccatcaacaacatgaaaaggtcacctactaaatgggagaagatatttgcaaataatatctgataaggggttactttaaaaatatacaaaaactcatacaactcaacatcaaaaaacaaaccacctgatttaaaaatggacggaggatctgaagacatttttccaaagaattcatacacatcacacaagggcatacttcacaggtttcataatcaagtattaaaataatcacatataataaaaacaaatcactatcataaaaacaaaacacaagtaataacaagtatattgtagaaaattttaaatgaacaatttatttgctttatttaccaactggtaaataaagatccaagccacaaagatacaatggttgcctttgcgtttaaggcaatttcatt

SEQ ID NO: 47743 - DNA, 899 bp, Bovine  19866881653690
ggaaaagtccaaaaccaatgtggagagaaattatgcggctagcagctggaattcatgaagtttcacattaagtgaaggattgatagcaagaaatccaaacaccctttccccaaagacagacgcatccatagcttaaggacaaaaaaagggcttctcaggattcttggcttctctttaaatataactgttaaaagcttatgtttacctttataagggatagctatggctataatggtcatcaatttggaattattgaattcaaaggtgatgcggtgagatgcatgaagcgccaaaaaatgaatcataaattgggttgcatgccgatttattcttgagtctttttttatgagatacgttaatattaaatgaaaataattatttatgaatgtttttcacctaagttatctttttcagtcctctccactacatactaactaagaaataagtattttataacctctctctgcttaagaggaaactgatgcttcaggggattaatttgcccaacatcccgtggtagcagacaaggtctttaacacaggtcttctgatcttagcagccacgggtgtatccactacactggggttcctaaacctggatgtctttccagacttgccctggggcttttatattttactgatccctagagtgggttcaggaatctatatgcttaagaatctctgaagtgtttctgatgatcaacctggtttggaactcactgtgttaagataaatggaacttcattctctcatcagttaaaaaaaaaaaaaaattcttctttcccctggggatgtaggtggagcaaatagatattttgaaggtcagcagagccacacctgggaaacattagaatctacccgaccatgcagcttgtaacaatttgggataactagttcagt

SEQ ID NO: 47744 - DNA, 995 bp, Bovine  19866881053244
tgtccccctgaatatatctgtgtcgtagaaaccagaagagatcattatcaccttttagagatgagaaactgaggcctggtttatttgtggagaaatgatagaatatgatagtttttcttgtttaagtcctgcccccatggttaagctccccaacctcccaacatatgcaagtccagtcttttgcaaggaaaggctttatcaagtaggggtggttattgcaatagggagccacttaaagaccaagccaaggaaagtgtataagtagagactgctggatacatggctgggaaagaggaacgggagtttctaaaacctgctagaagaatcttgaagcttaacaaattacatgaaatgttgcagtaacaggaaaatagaagcagggaatgtttgcacatggggcagaaatctgagcctgagatagatcaaagaagttcaagtgtgcgaagttcacataagtttagagactagatgtacttgtcacaacagcctaaagttatgtcaagcacaaaggttgattatccttgtcatttctcaactgaatgggatatccttttaagtaaaagttacaattttctatttaatcttctattttatatgaagacttactattatttctacttgtaaggacttacttgagtcataaatttagagaaggcaaagttatacatcagatgcttttcctttttccttttgttatataaagacagttttccagaagaaaaatctgttgtctgtcagcaagccaaattcttacctggcctttcctttaagaacatttttcaatataaaacaagacaagaggtagtaggagagaaatagttttcgtcaaaccatgtatttgagaaacttttcctgtagacctagacttaattagctggcagtcattatcatttttgataaaagttttcaggaaaagcaacttctacatataaaattatatgtgtttgtctattactctttatatcaattattctatggctatttacctgggagtt

SEQ ID NO: 47745 - DNA, 1337 bp, Bovine  19866880131509
ctatttgccataaagtgatgggatcagatgccatgatcttcgttttctgaatgttgagctttaagccaactttttcactctcctctttcactttcatcaagaggcttttgagttcctcttcactttctgccataagggtggtgtcatctgcatatctgaggttattgatatttctcccagcaatcttgattccagcttgtgcttcatccagcccagcatttctcatgatatactctgtatataagttaaataagcagggtgacagtatacagcattgacatactccttttcctatttggaactagtctgttgtcatgtccagttctaactgttgcttcctgacctgcatataggtttctcaagaggtaggtcaggtggtctggtattcccatctctttcagaattttccacagtttattgtgatccacacagccaaaggctttggcatagtcaataaagcagaaatagatgtttttctggaactctcttgctttttccatgatccagcagatgttggcaatttgatctctggttcctctgccttttctaaaaccagcttgaacatcgggaagttcacggttcatatattgctgcaggagaccaccaattattaatagtaatgaaccttcaggcctcgtgagctcttaactgtgtgcatattctattctatagtaaatatgctttcaaaaatagcactgctggtctgccaagagtcaactcaaaatgatcacttgggccctcattctggtgttcctcaaaacccattttaacttagcccagggcaggcagagctgtccctcattaactcttgctcactccatccctagaaaaactgcttaatttgtatatttaagataaacacttgcactattagggatcccagatggagtctgttatctgacttcaaagacagattattacatttttattaatccaaaattctttgtacacctgcttagccttctatcttaaataatctcttttgaaggcaattgggctgaattcttccctcagatctaaataaaggaagcataaactacaattcccactgagaaggatttatatggagatggctcttcactcagtcttttttgggggattataccacagaaatcttccagggtcaaatttaaaacacatttgttttagagtttgccaagtctggtattattttgcaattttagtgctatttgatttctatataaaagtgtttttctgtcttcactttgctcctcaaagcccatttacttctttctgtctctgatctctcttttcagtaaagagtgtggaaaaggatgggaaattttgaagtggctctgcttttgtttgaatcaagt

SEQ ID NO: 47746 - DNA, 3194 bp, Bovine  19866880451487
ataggaaaaagccacatttctgactacttgcaatgagtcaacagtaacttcatttagttgaaaccttaaggggtttagaggaaactggtgctcgtaaaaagcactcactttgtagaactgaatgactacacctcaggaatgtgagcttcacacagacttttgttatcagccagacaaagaggtgacaatagttcccttatttcttagatttattgcactaacttaagcacagctgttttttgcacccagagacggaaaggattcttcaagaaatgtgttttaatggtggaatgatctttagggttttcaaccaaccaagcaaaaaacccaaagcaattgtgaaagaaaaccaaagaaaataactcctctttatccttactttgggttgagctctttggaagcaagtcaccatattttgtctcaagtctgatcatgtcacacacttagcttcccagaatgggaaaagctaaggtttgcattctaaatgtccacatttgctttcctttatatgaccattgatccctgacctagaccataatctggtagtaaaggggctagaaattagccttgttcataatataggttgatactagagtagtaactgatacaagtatatttatttcaacttttctgaaatattgaagcttcctaaagaaaaactttttgatatgttactttaatttactaaattatcctagaacaaacataatgttaatgttactaaactatctagaaaaagtatctgcaaataaaaaagactcagattttccacagaggtgtttgtatttcttcatttggtagaagaaactcatttcaaagcctgcctagacagttctgtattaaccaggattactataaacctctgtgttccccactgattcaacactgagcagattggtgtgtacttatttattaaatgaatggatgaatgagtattttttaaattgaaagcaaatattttaaagtgttttttttttttttttcttcctttcaggttgcatttagtctggagtaagtctaacactgattgctaattttgttgacaaaattcaacacacattcatggcaaactcacagagaaataggattagaggaggacttcttcagcttgacaaaggtcttctacaaaaacctagagccaatattacacttaatggtgagagagtgaatgctttcacccaaagattgggggaaaagcaaggcttctgttctcatcaccctgaatcaacatacgataataacagctgtagccagtgcagggcaaaaagaagaaataaaaggcacaaagattaagaaggaagaagttttaaataaatagggaaagatactgtgttcttggattagaagactcaacataataaagatgccaattattcttaaattgatatttaagtttaataaaatttttataaaattcccagcaggatatttttgtagctatactgtttagaataggcaagattatgccaaaatttatttggaaagcaaaggaactaggattgttaactggataaatttccagaaaattatactgagaaaaaaattaaatcaaatataaaaatacctgaaatatatttgaaaaaaaaaaaaccggaaatcttcattgtaaaatataaaagatatatctaagtaaagaggtatgttttgttcctggaatgcaaaatttaatgtagttaatatgtacttcttcaacaaattaatctaaatatactaaataattccagtaggaattttaatatttttttagaaatttgaccaaatatttctaaaagaatcttctgctcattattagaactcagttattcatttattaattaactaaaatatttactgggtttcccagatggctcacatagtaaagaatccacttcccctatacaggagacatggacccagccctgcgttggaaggatcccctggaggaggaaatggcaacttactccagtaatcttgcctgaaaactcccatggatagtggagcctggcaggctacagtccatggggtcacaactgaatgactgagcacacaaaatatttattaagcctctaccatatgccaagaatgaagctaagcaaagagattactagtaaaaactacaaaatgtctattttgatcccatttttgtaaaatgtgtattcatatacaatggaagtaggtgtacttaattgttaggagtaataatctcagggtgctaggaattttggtggtaatttcctcagtttcacttatcctttattttcattttataagctgaaaaattacctgtgtaatttttcttagggaaaataattgcttaggaaagtaaagattcactattttttatgtgactgagataatttatttcaggaatgctagagataagaaggatacagaaaacaaactggtaaaatttcatttatatatttgcattgtccttgagttttaatacaaaacatttgtatcttaatttttttttatctcttgctataaagatattcttgaaaacggaaacagatactcatgctcacaaacataacaaatatttggattaagcattagttttcttcattcccagacttgtaattcacatacattataagcttaatacattttttaaatgtaattaactatactaatttgttttcaaatgtaattaatagctccctatcacaataatatatttttctgtctgagcttttctctctgctactttgtttcttttaggctaaatgttagtattgtttcttttttccagataagaaaataaaagctcagaaaaatcattcaactttcctaaaaccacgcaactagtaagttttataggtaagacttgaacccaagcattctgattccagaatccatttgtttaatcaccacttaatatttgtaagtctctgattattaagcactatgatatatatgtattgtgttatccagtaactgattactatttgctagctgcgttacacaaaagggaaaactgttgcccatatggtctatagtcatattcaggacgacccacaaacttaaataagcaattcaagtcaggaaaaaaagcgggaaggaagaaaggcatgaagtgagaaggtcaatcagatttatgctggaaagcttattcattggagggtaaagaacatagtttggagatataatgactcataatgtccatgatgtggagtaggaaatagaccaggagacaaactacagtttctgaa

SEQ ID NO: 47747 - DNA, 742 bp, Bovine  19866880568616
caagaacactggagtgggttgccatttccttctccaatgtatgaaagtgaaaagtgaaagtgaagtcgctcagtcgtgtcccactcttcgcgaccccatggactgcagcctaccaggctcctccgtccatgggattttccaggcaagagtactagagtgggttaccattgccttctccgtccctgaggacccactaatcctgtaaattttgaatttgggcaagttacttaactcttctggattttgttatcttcatctacaaagtaggaataagcacacccacctcacaggttgttggaagaagaaaggagctcgtctatgtaatgaaattagtacagtcttggctcacagaagaatctcaataaatgataactactagcacttttactgatattattgttatattttaatagccaggctctaatgtctctagtatcaaattgcagtgaattttcaggcacttaggatggtcaggtctgtatcagctctccacaaccaagtttcccttagttagctggggtacaaatggtcacattttgcttaagtgtgaatctgttttttgtttaaaatttttctggcctttcctgaaactgcctctccagtgctcttccttccccttcccaaacattggccccagtcccactccacagtttttctcttcacttttatccagagctgctggtctcagcatgaccttccaccatgttgacttcctcaatctctcatgcccaggcccccaccc

SEQ ID NO: 47748 - DNA, 1680 bp, Bovine  19866880574457
cttaaaaatgtcatgttaagttttctaacccagttagaaaaaaagaaataattgaggtatctggaactcaattttgaactaaaatgttggttatcataagcttgcaaggtaacataatgtaagttcttttcatgtaaattatgtgtgtgtgtatatagatagagagagagagttttggaatattcttcccaagagaagaatttgtggacctactaaacaaaagtgtaaccatctcttttgcacaataggtattatagtaatttgtacatacacagtgatagaatatagggatataaactaaagaagaaaaatttctgaagaaacagttagaagatgatgcaggatgccaagaagtatggaaataaaatgcacctcatatttttttttcctgccaagggactatctcagttaagtgacccctgcaatgaaggcaaagagttcaatagaaaatatttgtcaaatgagactagaaagaatagatttcatgactctttgtgattttgaagaaccaaagtaaaggtttatggacacaaaacataagaactactttttaaacgaggaaacaagcaactaaaacgagcagtttgttcctctctccaccctttctttcttatccacaaagtccctccacgtacacacatactcgtatctatttggggaatgattatttgtacctctttgcctcaaaatattatgcaatgtcaagtttgggtaaaaatatcaaaagttgttttctttttctttatcctagacttgcatttgattctttgtagtgtatcttaagaattcaaagaccttggtacaatttaaaataaagaatgatggttgcctaggaaatgtccatgaactagccaggtatctcatttcagctaatttgataacagagtaaatgatatggaatgtagacgtatgatttagtcagttttctttctctttcctttttgataatggctatcagttatgaatgtatgagaagcagcatttggtctttttttacctttaataggcaatgagatactaaagtaattctgaagatgtacaatccatgtgagtttttgaagttctctagatacataaccaaaatttgatctttctttatctggcataaggaataatactaggtcacatttgtcaatatttgaaggcaagtgtagtaacaaaacactttactttgccttctcagatgactacaactacaatttagaataaaatccttgaagaatatattaactttcttgtgcagggtcattctcactcaaattattaaccttcagtaacaacattgcaaatatctcttttatgctacagaatgtaatatctgcttgtttactgctttgagtattctaatctgaatttgagatcatccttcctggaccatattaatgcagctcttagtgtctggaaaagcataaacatcaagtccagtggtttattatgacagtgataatgtttctgaagctgtatatacctttctttctttactttctggtcacgactcagatatccagaatcctttgctcaaactattcacacttaagtgagaatggcatatgaattgtgaaaccatgttctactcaaatctgaaacttcttcaccttaatctatcaagagttgagtcttgggagggggatggccgggaaggttcaaaaaggaggagacaaatgtatacctatggctgat

SEQ ID NO: 47749 - DNA, 2570 bp, Bovine  19866880699899
tttttagtttagtattgtgtatgtgtgtgtgcatacaaactaagggaaagcatttttaagtatttggatcacaaatttaaaaaagaaaaattaaatattccaaaggtaacttttatgttctaaaatagattcattctatgatggtttgattttatttgtttaaaataaagttacaagatttaaagcagagcatattcagcagactttgaaaggttcataattgtttactgtagcagcaggtgattaagaaagggttcagaaactattttgcatggccctccaaattattcatcatttgaatcagtccaatgtgttcagttttcacaaaccagcttagtatcactgccaaattaaagctggcatcttgaaagcttattgaatctttttgaccaagtgctttgcagttgtttaaaattttgcaaagaaagaataattatcaaagatggaaaagcacttgcccatgaaaataagttttaacactgttcctgtaagaattgtattctatatggaaacatcatatttctcttgtatgccagtgaatatgcagctatgccttaacacttgtgttcctggaaacttccctcatcttactttggttcataatagttgatttccagtactacagaacagggtaatttaacccttgaagacactaacactgaaagttttatttctcatcatggttttttaagtttgactctatttttttattggttactttattttttcttacattatgtttttttaatttaatttttattttatattgggataatagttgatttacaatgttgtgttcatttcaagtgtgcagcaaaatgattcagttatacatatactgtatttatttttggaagagacttcagatcaaaaccacatgtgtctcttgctagggtggtgtgagagtcacacatatagagagacatagtgagaggccatatagaggccatattgggggacaattttctatgggtgtctcacatcttgtgagcagaagaaatgacttgccatgtttagaactatcttcccaaagtatttgcatagcaaacagccttggcagattgataatcttcctctagagcacagggcagattatttttcttctcccatataataaaggtaacatctccttaaggtaaagattggagaggtttattgtccattattaaaaaagcagtttccctaaacttgggatttatctcctttaaagtaacccattgcatggatagctaacactttggcccaccttgcaatgacctatggaagtggggctcaaggaactggcacaatgcagatacttccattacttccactgttttcaataataaactgtcctttgggtatgacccagtgtctcatgtcttctgttggtactgccatccatgaaactggctggtcaagttgttagtttgcaagttggataaaatctgagttctttcacagttcttgacagggagctggctaaccccagagtgaatgatccaacagacaaagacagaagctgaggtgatttttgaaatagctgagaaagccacatctcattatttccatagggttctactggccagccttgattctgtgtgagaagggactagacaaaggtgggaaataccaggaagtgagaaccattaagagttattctgacatatggttatcacagctcttctaaacattataaagattgcaaaaacttgagctcagaaataatgaattgattatctttgtgtttcctgcagaactcaaactagtgtctttcacatatatctactcaaaatattgtttattgaattgcagcttctctaaatatattacatatggtatagggaacaaaatttccatatgaaatatgatgagtaagtccataaaaaatataaaatatttatcagtgtaccttttattatctattaaacagaagaaatctcagcactgaatcagaaatggtttactaactagccttgtaaagatccaagataagagatataactggctaatttgattgcctagtattttctgctgcgtcaaaatcttctgaatgttatagaataacatcaagaaaataagatttgtagaatgtgtggccgaagctcaaacactccacccatacaaatttttcaagagtgaaataaggagaatggacaaaaaggacaaaagcactctaattcatttgagtaacttaagttggagaataatcagaaaattaaagactttcctttaaatcattttttaatttaaagtcattttaaaaattacagaattaatcatttaactggggaaaatgatttggattaatccttagattgcttccagttgtaattatagaattcaactgtatttttatggacatgtactaaaatccctaagagcaaataaatttggattaagttagagacatgcaatcatattccatttggggtacatttaaatttgtaaattcaactttgtaagttaaggaggggaaaagtggctttcataaaacaaggccactagctgtaaacaaatcacttcctctgatgcacaaagaaacagtaacctatccccactctaggaaacagatttactgcagggaactt

SEQ ID NO: 47750 - DNA, 3500 bp, Bovine  19866880704052
tgcaagaggaaagattatagtcatataatttaaaatatcagctaacttgcactaatggtagctttaatgagcaggtaaccagcaaaacatattgcgtgtttcatttttaaaaaaatactagcaaaatatcatcatgccacatagacatttttttataactttctattatgaaattttctattagaaaatattataaggagttctcatgtactcacccctcagcttcaaccactatctcagatattgtactgtttttttttttagtaaatatgttaatctgtaactccaaaatataaagatttttaaaaataacaaaaagcacttattgcactgaaaatttcaattcaagtggaaattcatgaagtctgttaacttttggtacctcgtttgtcacagagaaattatatctaaaatatagagaaaaacatgaacctgaaattatctttttctctcaattctttccagaaattcagctaagttgcccaaagaaacaaacaaattgctggtcctcccagaaatatactcactttgttttctgtcttttacaacgttccacgtatatgagtgcagaaactgatgagtcagaatggaagtgtttgtgcattatttggcttttctcagatcatgcatattgataattcacaattctcgggacaggtaaatgtctcacaggtctgaaaagtgaaaccaaggggactgtgggtcagtggagaaaggaagtcacctttggcagcaaactcttacaaagccttgaccatttcaaagcacattaccaatttcagtgatcattttagaaaaacagaaaagaatatggaatatgtttacatagtgagaaaatgtgtagacctacatgatcaatgaaaatgacaacattcatagaaaggaaaatctttacagtttcagagtacagacagggaggtgacccaataccactctctgacactagtgtcactccctttaggtaacaatgagaattttagtggttaattttaggtgtcagcatggcttgactttggcacccagatgtttgaacaaacatcggttttagatgtgactaacatttaaatcactagactttgagtaaagacaattatcttccataatgtaataggtctgacctcatccattgaagcccttaagagaaaaatactgagattccctgagaaagaagtgctctgactctaatttgccttcagagtcagtactgctacattagctcttccctgggtctcctgcctgccagcctgccctgaagatttgggacttgctggcctatgcgagccaattccttaaaataaatctgtttccatctcttgtatctatatctacacacacacacacacattttgtttctctggataacactaactcagggatgaaagaattcttttgtgttgtagagaaataactgtatttaaacaatgttgcatattttgactgagctctaagaaaatatgaatcataagatcttagaattggaaaagaacttagagctaatttagtaaaaaatttcacccatatattgttaaaattgtaataataaggattaaatgattcctatgtattatgtataatattcacaatactccaagttaatataagttttgtatatgagaagatgaggctcaaagaaataacttcttcatgaagacctgagtggcagtcactaagtcagtatctgaatatttgaattgaatactatttgaatctaaagtccattgtctttctattaggtttagtggctttttttccatgtgtctcccaaatgcttggacatttttggtgatgtagaattttgttttgcaaagccaattatatgactgttgtatataaaaatatctttgttagaaaagcctttcatattttgatcagatcttatgtgttttgccctttatgactacattttcacatgtcaactcttcaaatacttgaagctagccacctgatcccaaatatttcctttttaaattttaaaaaatgttttgtcataggaaacaatttcaagattccctccctcttgattgtttttactgatgttctttggctagctgctccttagtaagctccagcaactgtttccaaaagttggactctaggtattatctactcaaagaataatggaatgtcttttcctcttgttctagactccatgctatcttaatgcaatctaagatttacttgcttttttaaaaagttaagtatggtaatttacaaaattgtgttagtttcaagtataagatttactagatttacaatgtagtttcatgtctctttttacagatttctttacaagaactggtctctcatctttgtatctgtgggatcaatatttgcagaacttcaaatttatccacattaaaattcatgttattagtttcaacctaatggtcaagtctatcaaggtatgtaatattgtatattctaactttttcaatgtacaattttggttaacttgtataaaagtttaatttaggtatattgaatataaaatattacaacaatagggtggtagaaaagcttagtgaaaactttttcagaaatattgcagagaaatcatttagagaaataaaatctggagttttatttgccttgaagtcctagttgaaatcattaggtgtgaacacattgctgtgagaaagactcatatacaaatgagattatcaaagattgatctttgaaaaaacaattaacctttaaacatggaaaagcccacttcaggtagggaagacaaaaagcaaattcttgaaaatatttgagggtaggaatcagtcttgttctgaaacatggtaggggtgataaaaattttttagtagaatcagggcaaggggcaaagaaagatagatgagaaagcaatggggggaaaaaaagtgcagcattgagaaagagggcatttgatggtgtcaaaactgcagacagatcaaagaaaagtgaaaagagacttctagatttggcagttgtaaaaatggtcacttagagatagcagaggcccagttacagccaaatgtttgggacagaagtcagattgtgaggtgtgaaggggtggattcgagatgaggacgcagagactgtttgcagagatttcatgcttttagagagctacaggctggtggctgtattgagcaggtagaaccaagggtttttgtagttaaggaaggtgccttggcagagagaagagacattgatgatgctagagaggagggaagagacttccaaagcattccagtggttaagactctgtgcttccaaagcagggggctgttcagggaactaagattccacatgttacaacttgtgggccaaaagatagagagagaggataattaaaggtggaaatcttgggaaaaacttcctgggttggataaagagctgagctgaatttgtgagttttgttgaaaaggataagcacattgtccaaagactgagaccccaggatggcggggaggctgagctatgattctgtgtagcggaggtaggaattagcttttcaggctggcttccca

SEQ ID NO: 47751 - DNA, 1408 bp, Bovine  19866880705478
cattggagaaggaaatggcaacccactccagtgttcttgcctggagaatcccagggacgggggagcctggtgggctgcggtctatggggtcgcagagttggacacgactgaagcgacacagcagcagcagcatatgtatatatatattatatatatactcacacatactcatatatatataatatagatatacgatctttaagaaaaaagtaaaaatgaatataaatatgatatgactttaaatgattcacctggaagagaaagagaaataaaaaattttgaataaattatgttttgcctttaaaaatttttaaatacctattaacatctgaggctttgttatattatgtgagaactatttttcttggagaaactgagtcacaaaaggactgtttgaagtcacaccatgagtcagtgactttgcttggaatgaaaacccagatagctgactcaacagcattccaggtggtgagtgctcagccacagtcctcaactgccgcgctggctcagtcagtctgaggtcagctcctggtgcaaaggaagcacaacggtcttcaatcatggataatggaattctatagatattgacaagtgttctgtggtgtttctatttttcttggaagaaaagattataaataaaccacttgaagtgtactaaaacattggaaagagaaataatcttaaaagttttcatttacattatacagactgtataaaaaacctcaaagccctctaaaatgcatgagccatattttaccaaaaacaaaattctcagttcttccctgctaacaagaaacatcaacatttttctacttaaaaattacaaatcaagtgagtgagttattgaaatggcttatgtttttgtaaagcaaagtcagttgtttttattcattcgaccagttattcattcaatatacatttatttagtgtattaggcaacatgttaggtggcagacacaatccttgctctcagagcttaccttctattttcataaacagattaaaccatgcttgcccctgaaataagtatgaaactttagatctttttttttttttcctattaaacgatctcagctggtaaagaatctccctgcaatgcaggagaccccagttcgatccctgtgtgaggaagatccactggagaagggataggctactcactccagtattcttgggcttccttgttggctcagctggtaaagaatcctcctgcaatgagggagacttgggttcgatccctgggttgggaagatcccctgcagaaccactcctgtattctggtctggagaattccatggactgtatggatacttctgctgctgctaagtcacttcagtcgtgtccaactctgtgcgaccccatagaaggctgcccaccaggcttccccgtccctgggattctccaggca

SEQ ID NO: 47752 - DNA, 1998 bp, Bovine  19866880749827
agcaactaagcccctgagttacaactactgaagcttgcctgcttacagcctgtgctccactgcaatgagaagcctgtacactgcagtaaggagtagcctctgcttgacgcaactggagaaagcctgtatgcagtttaaaaaaaacaaaacaaaactgtaggaaaggaagaaagaaaggtgggagtagtgtagtgctatgtagacataattctggaacattgagagagtttctgtctaaggtcacccaattttctctattaggattcattgcagaaaatgaggtgagaagtgaagggaaaaaatggctagagtcagatgcttgaggggaattacttaggtttgatattaccataatgaaaagtagaaggacaaatttgcttaggaaatagaaaaaaaaaaaatgcctatcagtgttcatgggccagtagaagtgattactatgaatttaatgcatattggtcacccttgcatttttgttttaattttctgtagcagtgcttagatgctccgaaactaatgtgaagaatgtagattcattactgtctccaatgtaagccctaggtgtgaagaggtaagatcgggcttattccaacaagaccagttctaaacacattgtcaagcattactgatttattccaacaggataaattcactttgttgctttgaaagacctctcttaatttaatccaggtcaggtcatggaggtcaaaaagatagtcttagctacaaaattgagtgactggacaagacttgaatgaccaaactagatattactcccgtttttaggggagtggagatccaacagagtgtatactgagttcaacaccagttgttgtagaataagaggaaccagttcttagaactaatttggtcacaagaatgtttaatttgttgtacaaagtcagagaacaaaggactatgctaacttgataagatatttttggccaaattttttaaaattcctactacttaagagaaattggtctgagaagttgagttgaatttacagataggaattaaatggcctccaccgtgtggactgacgggttgcagaatcaggcagattacaaaacaaagctttgtaatcttagaagaactcactccccaccctcaattccctaatcatatactcagagcatttgtgtggtatcaccaaaatgatgggtgctgtagcaactccatgggaatgaagagaatatgctgtgatcatgagtaaatgtattataatgaaaagaaagaggaacacagaaaaatgacaacagaaccaaagtgaaagagaggtcagaagttcaaaaattcctaaggaaaatttcacatgggaataaaaacagagtaaaaagatatagaaatgctagtagcccttcttagtttccttcagatataatattggtttgtatggtataatgtagggatgtaggaaaaaggagcaaatacttgggatagatgaagaaaagaaaataagtgtagataataggagtcaagtgtactattcaacaagaagcaattagataagaaccaagcaaggatgcactgaaacagagcaacatgaccactggggaagccagtaggaagcttccagaggagtaggaacacaatatgagaaactggaatctagagctgtgctgtgcttagtcgctcagtcgtgtccaactccttgcgaccccagggactgcagccctccaggctcctctgtccacagggattctccaggcaagaatactggagtgggttgcccaagccctcctccaggggatctcctcaacccagggatcgaacccaggcctcctgcattgcaggcagattctttaccagctgagctaccaggtaagcctggaatctagagtattggttcttaaatactatatactgctattgctctcaaaatttttttaggaagttgctttaactaagatttgtcataattaccctaaagcataagagcaaaccatatgcaatttaagaataagaataatcacacaatttttaacactgctgttg

SEQ ID NO: 47753 - DNA, 2485 bp, Bovine  19866880768386
atgcataatattatgtgctaacacttcattggagaggcttcccagggtaagcaggaatgaatgtaggagaaaggagtgaggcagaggagagaacaaagcatacacgacctagctggccctgctgctgctgctgctgctgctgcgaagtcgcttcagtcgtgtccgactctgtgcggccctgcctgctgtcaaatagcactaatcgatcttgtagaattgccttcagagagaccatatgcacaaccatatcatggggtagtcccttcaggggaaagataaaagtgaattttttcaatctcacctctctctcattggccaaaggtcaatgaccccataagccaataactcccccgaactccaagttgcactgactctgcctgcagcactctgtcgtactgacagccacaggtaaacctgaagttgactggagtccacacagagttagtcaccgtaatactacctgggaagggaccagtggccaagggccccagtgaccgagaccaggagaatctcaagtggaattaaaaaggtatctgatactttggttaaagttgttggagttagtctatggagtagctaatgagcaagattccattaactgtccctgaggtttactgggacaaagttatctgaccatacttgagctaaacaaacctaatggagggagtggtagattaagcactggaaagtaaagaagggtttcaaaagtagatatatggaggtaaagctttaaagaataagtagacatttactaggacagagagaaaaggaataacattctagacagaagcaacagtaggaggaaaaggctcctgtctagtaaacatgattctagctgaacaagaaacactaatccctctaggatctttatttgcatacagtgctaggggcttagagtttgttttttcatccaaccctagaactggaatttgattttgagttggtgtaaggagaaaaattcagtctaaagaagcattagaatgaaagccagaaaaggtgctttggtccccaggtcttacccaataagagaaaccctcctttgttttttctgctctcagggatgaaggctctttcttagtctcatttcccaggagatctcagttgtttacatcattcagtgatgcaggatgggtggtgagcacaatgaaggcctggagagtttgagaaaattctgatggaggttaacaattctgatggacttcaccctctcccctcaactaattgagaatcacccttgtgctaaggtctttattcttcaatagttcttttaaagtatggtgatttagaaaaggggacttccctgataaataattcacctgagatgcagaagaacttggtttaactcctgagtcaggcagatctccagcagaaggcataggcgactcactccagtattcttgggcttccctggtggctcagatggtaaagaatctgcctgcaatgggggagacctgggttcaatccctaggttgggaaaatcccctggaggaggacatggcaacacacttcagtattcttgcctggagaatgccatggaagaggagcctggtgggccacagtccatggagtctctaacagtcagacaggactaagcaactaaatacagcgcagcaccttaaaaaaaaaatacaattttttaaaagacaatttttcttttcttttttgaaattagtaaaattcactgcctttttcttgtttttgagcattgatttgtatatccacatatttaagaacagtattaagtattaaattcttcttcttcaccagacaatttccctaattctctttagtagcttggtaaagagatggggaaagaagtcggggaaatttcacttgaggaaattcaacaaaaaattacaaatatatattttaaagtgcttacttatagttcctattttaaaatatccctacttagaaaaacttacaattgtatgatgaaaactaaatattatgcaatcccaaataaattcttttttggagaagtaggaactagaatcctaaaatgggtttcattttacttttaactgatttctgaacacccatgtagtgttctggggatatatacactataagagtaataattcattttttattaacttataaatgtcataatatttaagctgcacagctaaatttctgtgatgaatatcaactacctttggaaaaaattgtttgcctataataccaaatgtcaaaatttttagctcaagaaagaaacgcagcttttctcttagacttgaaccattttttgatgcataaacacatatttaacatgtgtcacaacgatttaattttaaatcttgtaatatctgcaagtttgtgtaatttaaaaaaaaaactagaatatctttttttttccactgatatacataggcactattacttccctttttattcagaatagcctcactcataatttgtgttttcgagcatattacaacagtgtgatccagggacattattggcaagctactagatcatttca

SEQ ID NO: 47754 - DNA, 1670 bp, Bovine  19866880813875
ttatacctgtgcatatgatttttttaagtgtgagaaagaggggaaaaattgcaaaatattcagcaccagcaaccctaaattttaaaataccatggactttgaggtttgattatttagctcaagttgtgggttggataagagacattctggtcagaggacttattattttagatgttttatctcctaagtaatactggtgatacagattccaggaatgtatggtcagggaaggtacagaaagcaatattttcatcagagttgcttgagaggttggaaaaagacatatagcaagagattaaataaactattccccaaacccctgtttgtcatttacattaatgacacttgcccagaaagcagggaaagaattgacccaaatagtctatttagtctaacgattcatcaatcaaacatttcctaggtcttccccatgccccaaacactgtgccaggtatgggatctggcaatgcctaccaaaacagccactagcaggaacaaatactcatttcaaagccactggcctaaaacagctcctttaaaaaaaatttttttttctcctttagtttttatccaatgatgatttcactaattccttatggttttgccacttagatatttggcttttgaactaaggccattgagggaaggctgctgctaagtcacttcagtcgtgtccaactctgtgcgatcccatagacggatcaccaggctccccagtccctgggattctccaggcaagaacgctggagtgggttgccatttccttctccaatgcatgaaagtgaaaagtgaaagtgaagtcgcacagtcgtgtctgatcctcagggaccccatggactgcagcctaccaggctcctctgtccatgggattttccaggcaagagtactggagtggggtgccattaccttctccaagggaaggctaagagaccattaagactgattaggataaaatactagcaaagtcctttaggcttttgtctactgagattgctctgtgaaatcctcctcagggatatctgcctaacaaatacaactatttacttctaattaaatttttaaaaatgtttggtgtgcatcactggggctgatggagcaaggaaaaagtgagttcaagtttttgccccgtttttagaattcattttttcccatttctctctttaatgagcatctaagctacatgccctttttgaccatagttttttttttttttttttttaactgatcaaaaagtttagatgtgggaaatgcaagaattaggcacatttctgtcaggttttacccttgagaaaattttacatatcctctccttatttctcccttactttaaccatccagtatacctgtgtttccaagaacagccctgtaacttgaaattcagtttctaaatttcaaggatgacttttcaacacatttgattattgattcatgattaaccttttagttctggaatagggttttagagcttagtttcattggcgtttatctagtcaattccattaatttatactaagtatatgaggatcttctctgaatcacacagtttctttcagtagaaaccaaatatgaacccaggtttccagactcctatccttttatgccacatctttttttttttttaatttttccttcacttattccttctttttttcacttatatttttaattga

SEQ ID NO: 47755 - DNA, 1075 bp, Bovine  19866880866260
ctatttataatatactgatgtttcttaccaagaatctttggtttaatccgcaaaactgaaatcgaccatctgagcccactgccagcgctaaagtaacactgttttattgctattattcaggcccagaaatattttctgcacacacattcatttcaaaattatgtaaaataaaatcctcccaaagctatcagattatagctcacaattacttttgtaccttaaaattctgtggacatattgctgaaggagtgcaggtactatttatgaaaatcattctttgctacaatttttcagtgagtttaaatagcataatttggaaatttattacatttgtttttccttcccttaatatgtcatcaacactggctgcacattctttgaattgcagtgaagaatttggctgtctagacacaacaatataaaaacacaaggcttacttaaagtaaatcaccaactcgtgttagccaataatgagcaggaagattttcctaacgcttttgttctgtgtcattgaaggactcgaagatataaagaccacatgtatttcatatttcctctctcatcttttccattctatgaataaagacttgcaaaagagaaactcaaaaaagtgcaggggttggcccaaattgtcttacattgatacattctcttcagagagtacaatatgtaatgtcaactttgcctaacagatctagaagcaagagatgttacctgtttccctgacctgcatttgggaagcttctgtccagactcttatttattacgataatatcacagcctacagaagggaaaaagagcctggaattttgtgcatggcctccttcttttacggacacagaaaccacaaatagatcaaaggcatttttcaaaatcactcaacaaatccatgctctctattcctcacataactttcttaaaaaaaaaaaaaaaaaaaagaatagacctaaaaacttctgtccctgacttgaaaaagtagcttaatttatggtaagttaattttacatagaaaaaaaattattactttaatgcatgtgtgtctaaatcatttgcccggtaaagactccttaaaaag

SEQ ID NO: 47756 - DNA, 1310 bp, Bovine  19866881054491
tttttttttttttttggccaagaaacagctttatttccaaagacataacaagtttcatagaccatttaacttttcactaatatagaagcaagaatttttttttcaatttaaaaattagtctgtttacagaaatgtttgtagatgctttacagacctttcagaagactattcaatgttagcttggcatgttaaaagatttctaatatttttgtctaatattgcccacaagagtgactagtaaacattctccaactctactgtgaagagaagagcatcattttttttttcaaacaagtctttgatttaaaagcataatacatttcaaagaatcttattcttgtttagagtttccagagtgcctgtttgctaggaaaaatgaaaactttgcatactgttttccataacttgatattaagtattcggagtatgcttaagtcttagcctgtaaaatatatctgcaactgaaatgttacctttttctgaatatcaaaaatctgtgtacaacttccaatctgatatggaatattgtacttcagatctcagtgagattatcttcaagtttactacttgttgaaatggtatttattgaaaattggacattctgtcacacacaatctaacttggtaacattagaagtgatgccaagtttcctacaagtcgtctctgtctccctgaaaaatttataaggggaatcctagcagagactggcagtgctaagatttaaatatttttcatgtacttaaactttaaaatttgtaaatttcactaatgaaagtaggtaagaaagtactgcatttagattaaaggacatgatgttaaaacttgccttacagtttttagtacatctcaagttggaataaatcaaaaaagataaaacttaatgagtctgctgttatttcttataagacacttgcttgtaaaaatttttctctgccttcatttatttttatgtttagtttaaaagctaaagccaagccaggaagaggaagacaagatgaggaaccccaaatcaaggtaaacattgttttagcaaagtacagcattgtgacataaaccagaaagaacattatcatgcatgtcatacgaggcatcccaacaaaacttgtttttcttttcttagggttattttctatgtaagatagatactattagagcaaatatttctgcatacttgtctttcaaaaatgtctttcatatggaatgtgttcctttttctaatttccagctaaaagaaatatgaaatatccaagtcttgcctggaggctaaacagtcttctgcaactgataccataaaaactaaagagaaaaat

SEQ ID NO: 47757 - DNA, 1514 bp, Bovine  19866881055082
aacatttttacgaggatatatatagatgataatatatctggtaatatatgtgaatctgcctgacaatatatattatcatatatattataaaaattttgttataaacatagtaatatgttaaacctattagtcttataatctgtgaaataaatatagttttaacatgtattatttaattaaatcttaaatgtcataagctataagtcacaccagtattttatgtaccactataaaagaaaaagacattatcaattaaactaggacacaaagatgcatcctaatttcagtgatattaacatctgaaaaaaaagttcatcttattttaatagagggaatgtggtaagttacattgtcaacctcacttaatttatatatgtgtcatttcagatttaactattgtgaaagtagcatggtttttaattctgcagtttccatattcaatttaaaaggtatgaatttaagagtagtacatgaacctagattctggcgtgacagactgagttagaatctactttctgcgatttaatcagttacatgatctttactaagtaactgttgctgttatcatcatcattattattgttttaaatattgtttatgatatgaaacaattggcaatcctcatagtgacttgtattggatagaggaaattaatcccgtccaagaattttcgaaatattttctactgatcacaaaagaactgagtgaaaaatctatttgattcaaggcaactacatctccatttctggagaaacagctcagagctctcaggctgctgacagtgggtcagaatctgatggctgaaatgttcattcatacatatgactacagtgtgctaataaatcatttcctccaaatggtgctcctgtcatcattgcatcagttaacagtacaacagttctcagaaaacatttggaacaaatgtgcactcttttaagaatatgttatattttatccaaacccaaaactgtcatgctcatttcaattttattcacaatgtgtaagaatatattctatttttgctagaagaaaaaatattcaattgaagtcaacatattttgtctatagtgagccataatgcaatatatagcttatatgtaaatcatttatcagtaagtccaagatgcaacaaatatacatttcatcctctttttctttttgaatgtgtggaaaagaccagtgtcttaactctgtcaacttgcatattatatgttgttgtttaatcactcagttgtgtctgactctttgtgatcccatggactgtggcccaccaggctcttttgtccatgggattccccaggaaggatactggagcgggttgccatttcctcctccaagggatcttcctgacccaggaatcgaacccacttctcctgcattggcatgtgggtttttaccactgagccatcaggaacacctcacatacttcatgggggtaggtaaattcctaaaacactctgggcttcaaactgatcacccagatatgtgttatggagataataagaattcaaaaa

SEQ ID NO: 47758 - DNA, 716 bp, Bovine  19866881063862
agtaagtttttaaaagaactttacctacccgtgtctttttctagcagtgaaacttttctaaagtttttaaatatgttaaatgtagctttcatatgacacaataaagggaatgatgaacttgaagatgtctgtagttttaaagttaaaattaaacttacggtatttactttttgactgctgaaaagtttttcttttaataatgcaacaggtaaataagattcacatctttctgatgaggataaagaactaatttactggatatttcgttttccattttagactgtaattttacttttgggggtgatcagtaacagtctaggtgctttgtaactttttggggggggggagggcgaggttaggggcctacgttgggggtttgactgacaatacaaaaatcaaagtgcaaatttgcttaacgtgcttgctatagaattctacgctttgttctttttcatatggaaatcttgactgatgttctatagccttgcaaagcaaacttcctaacaaagtgctttgttaagatcttgcggttacttgacttccacgtggttccttcctagaattttacccagtaaacaaaaggtataaaaatcagagttgtgatattgaggttcttaaagccacagtaaagggttactttatgttagcagcactatggaaaaatcttgagactcgcaagagagccaccattgactcgaccacgcggcaattcagga

SEQ ID NO: 47759 - DNA, 913 bp, Bovine  19866881084333
aagcgacttagcagcagcagcagcagggacaatataaaaaagaggaaattatcctgataacaaggtttataattccattaagtgctggaaagtattttcatgagactccacacatgcgaaaggtatttatgattttacatagggaaatagttatgcatacaaaaactattaacatgctgaccctacagtattagtagactaaagcaatctcttgaattaggattttgcttacactgcttaaaatatccctctagccttcttagcttattgacaactatggcttgaagagtcaaatacaaatatttaccaaactttttttttctatttctttcatcaaagaaaataattattttgtagtaataagttgtgctgttgaaaactcatatcatttattgcttattacttaagtgattaaaaattaataaaccttgtactacatttctaattggctttgttaaaatataatgttacaaaataggtacctcaaaaagtgattttttatgagtagtgaccacattattcctccaaatagaggagctttttggaagaatttaaattgttgtttttagtaataaaatggaagatttattgtgtagttttcaggaacacacatgtatatagtgaatttggctttttgtctctttatttcatcacagattaaaaggtttggcaatttctaataaattctgaaagactgacctttattttacgacaagcttgccagagaacgccacaaaactgattggacttctaaaacttatttattttcatatggtacaattcttttaaatggaaatatttacttttctagactggggctgaaaagcgctcctaaacggacccttttttttgtttttaagctgtttaatcaggtggagacaatctaaatcagatgtatgttaaagtacaaaat

SEQ ID NO: 47760 - DNA, 1628 bp, Bovine  19866881086772
caagacatgatgtcttgtgtaccagagataagctgtatttactaactaggtttttagtttcaacattctcttctattcctgatttttcaaaatgcttttctgtcctttaatgaaggtcttgatactgaacttgatttcatctcccgttcatagaattgcaagctgatttttgggctcatccactaactttgttgtgtttggaaaggtgttcttagaatcaggatgcagcgtcttacctgagagatagtaagtgaaaagagccttcatcactgtgcctcattcattcatctgtttgcttattcatttatccaggtattaaataatacatttatacattctgttaatgtgtccaacataaatttttagataagaactccagggtttagtaactgattggacattgggaaaagtaaagtggaactctttaccagttctgattttagtaaaaattttgccaagcaaatctttactaccagagagccagatcattaactttgtagccctctcccctttgacgccactgaacaaaacgtgccccaagtaagggaatcctctgtcttgggcctactgtcctctgtccttccctctcaattcttttacagccttgcttttcatgttgcctggggatgctgcttccatgatggaaaatttggccagttctttaaagagtgattgttttaaattatcaactaaacccacttaagatgtgcagacttctttttactacttagagtaaatgactatttaaactccatattccaaaaggtaccctttaaaagaagtaataattggataagcatagtaaaatatttaataagcaaatcgaatatggtatatatatcttatcctcaagggaacctcctttcttatgactattactattttgttattgaatcttagaaaagtaagacttaacttgtagaataatgacataaatgtaataaagaaattactatctttaaaaacgtgagctacttttaaaagttacaaagccaagaagatgaaggaagacagattattttcaatgcacatcttgtttttctctaagtatatcaaagcgaatacttcagatagaaaactaacagctttctatggaaggcatgtgattgattgccagacaagtgataaagactagcttgacttgatcttgtttctttctttttttcatacacatgcaaacttcatgttcgaactcattagtttaaaacccacctttgtcagctaacaaatggtaattagagtagacttaatcctaatgtacctcccagaggtatgttgacaaaaagaatactggcgattctattctgccttcacatgaaaatctgttctaaagacattattataaaaagtcctcctttatcctctaagtctttgaagaacttaggaatggtaaatatcatctttttgattataaacttgcaaacaagagctacatgaaaagtgggttattttcctggcctgattatgttcagacaagacataatcttttcatgctggtctgtacaaagtctgatttttattttttccctaagatgttgggaaatgaagtgaaaaactattttaatagtccctgttctgattttttctagatcttccatatttgttcctgaaaatattgaaggttagta

SEQ ID NO: 47761 - DNA, 731 bp, Bovine  19866881152519
acctgtgtttgaagaaccaaatggaaataattttatatctctagatttttccagtgattctataaaatttcatgagtgtaatagtatacattctggaaaaatagtattttttttaacaacccaacccaataagttattattaatatagttaaattaaaccagagacatagcccacaagggttatttcaatgaaaacaataagaaaggaaatgactacttctgaattgcagtgattactaaagtttaagttattctaactatctgtttcttttgtgtctgtgaaaaccccctaaatatgcctttccaaacttttggtagaaaattatttagactaatacttacttaatatttcatcataattcattccagtttttcaagtacagttttggaaaggccaagagctgtctggatgatggaatgtatctgtgatattactaaactccataagctttaatgaaagaaaaactccagtactgcatatagttgctactgtttgttccagacagatatttctatattatcactgtttacacagaaaaatctttatagcaaacatgtgattttatctttagaattaggttcaatctaatagcattccaaatagttctgatgaaagacctagatgctatctgggctggaatggtaaaaccgagaattccaattcatcaatacgataagtgagttccatatgctaacctgagatggtgccaagaaatattattaagtaaaaa

SEQ ID NO: 47762 - DNA, 862 bp, Bovine  19866881473906
attgccaaaacttcttaagtgcataacttaataaatgtcagaaaagcaatataaaatgaatataggcaaatattgaaacattttgagatgtttctctgattgaagagtttatttttacccagactgcaagctattggcaaatacatttgtttttacatgagattgggtgtatgattattcagtgacagatgcataaaactttttttaaatgatgcaaacaacctttaacagtatttgaattattgtggatttgggccttaatggcacctcaatttataattttctaagctagatttcttacagttaaatggctgctttgaagccagttcatgaatgtcatcttaggaaagttagtactttttatgagtcaaataatctaaatgttttcttacatctcattattttgagttttgggatgaagcactgctagccggcccataaaaacagtgctattcacactgctttggtgtgagccatcttcttctctgccatcagttgtcctcttttattgagttctgatcttagtctctatcctcacaaatgcaaactcaaccattgacctgatgataaactgtgtacaaaacggcaccacaccaatttgccacgtagctttgagcaagagactgaatctcttgccatgttatgtacgttgccaccccaaagagtacatttttaatatacttatttcatatcacactggaagtgttaccctagtcatagggtcttaaagtcaatacaacaacatagaaagaggctagcaggaatttctttaaattatgttttctaccctagaaaatttatttctacttaccgaaaggaaatatttacaattggctcaactatctttattatcaacccaaag

SEQ ID NO: 47763 - DNA, 728 bp, Bovine  19866881584290
tcggtttgtatttcatttaaaaagaaaacaacgttttgtcaaacccggaactcagtcaccccgcatctgtttacagttcatagaatgactgagtatgtgtgagaagacaatggcagaaactgggaggatttctgccgccctcaggagccgcccccctcctaaactcttctgaggctatctggtttcttcccgccttcattcctctcctcttcagttcctccttccccacaaacaactttattctttgtgtgcagaagtttgccatttggtctcaaggttagttttaatacctaaatgttttcaactgctggttcttcaatagcctccaggactccgtctgcacttttggtgactgtctaacaggcagggcgtaaatgataggattagttttcatctacacttggagccacagaattttttatttgctttagagcagtagctctcaaaatggaaacttttaaaatattttaacttatttggttaaaaccattgggtcatatcacaaaacacaactgaaggaaaatccatggcgaggacttgtagggaaaggaaggaccagagttctgatggaggaccaataaagggaataaaaaatatcatttaaatatcttatccatttccctttcttatttaaaggaaaatctcaacaagcaggctagcctgtaacatcattcttccaggcttctctgttcctgtttaacaacattaaaacctgtctgtaagccccc

SEQ ID NO: 47764 - DNA, 701 bp, Bovine  19866881714645
taaaaaatttcacatgacagggagcagatccacgcttgactctcacttggaaaaatccctctaacctagaaaaactaaacaaaacatcaggttagaattcagaggttagaaataatggcccaaaggagacatatgttgactgatacatttcactcgatacatttcactggaggcatctgactctgagtgtgtgtgtcttcaagaatttgaacaactttgaaacacacacaaacttaaccacttcccccacattctctactaccccattcatctggtatctagcccatgtcacagtcacagatttttatctttttgaaggctataggcaattaagttttcaaatattgtttaaatttgtaaaagtacatttttacagtttaccttctcaaagccttcatggttgagatttaagtgttcaatatctcatgaattcttgcatttatgagatgaaaaaaaaacagccttattttttttttttaatcaggaaaaaaacagttcatttctttggagatgttttgctccatggagtgaagcttagcaggataggcagataatcctgtgcgcaggccacagaatgtgccacagtctgtttttactcttttgctttgagttcagtgtctccacttaccatgtccacctaatcttagttgaaatcatgggagcatcgctcttaaagggaatatgtgtggatccttctcatg

SEQ ID NO: 47765 - DNA, 1626 bp, Bovine  19866880072763
accagaaagggaaagagacacgtgtaccccaatgttcatctcagcactgtttataatagccaggacatggaagcaacctagatgcccatcagcagatgaatggataagaaagctgtggtacatatacacaatggagtattactcagccattaaaaagaatacatttgaatcagttctaatgagatggatgaaactggaacctattatacagagtgaagtaagccagaaagaaaaacaccaatacagtatactaacgcatatatatggaatttagaaagatggtaacaataaccctgtgtacgagacagcaaaagagacactgatatatagatcagtcttatggactctgtgggagagggagagggtggggagattttggagaatggcattgaaacatgtataatatcatgtatgaaacaagtcgccagtccaggttcgatgcacgatactggatgcttggggctggtgcactgggatgacccaaagggagggtatggggagggaggagggaggagggttcaggatggggaatacaggtatacctgtggtggattcatttcgatatttggcaaaacaaatacaatattgtaaagtttaaaaataaaataaaatttaaataaataaaataaaatctttagagtcattgaattgtaggacacccagctggtattgaaaaattactggggcgaaaaatcctcatatttggtgtcataacttttgagaatgtagaagaagcagtttattgtttttttttttaaagaagcagaacaattttttaatgaaattccaattagaagcctaataggcatgacagacaaaagagagatcttgagctcaggctgtactagtagctggtcttgtactgtttaaaacccagctcactaccccttgctcctaattctgtcttacacacacacactcacacacacacacacacacagtcattcctgtagatagggctctgttgaacccagttgaaatcctcttgactccctgatctcttctgcctcttccagttgttggattctatgtacaattgtgtagacacatctagtagtaaaatcttaaaacatgctctcctctctacagtgttctcaagtggaaacaacacaagttagaaaagagggcaagtaagcatttcatcatttcatttgatttcctttagggctcaagcaaataaagaaatattaatttaaagcctcaccatatgctataaatttctctcagggaaacaggaatgagaaacgcagtttctaagcacttagaacttagcacagtgactggcatcttgtgcttgtgcttgatgaatgatcattttaactgaattgaatattatagcaaaatatatccaagactcacaacataaatggctccaacatcactgggcagaactctttgtgattaattccattagatacttgaaaatcaatttcattgaccttatttttcctcttacttcaatataagaacatatttagccactcagtgttgaacttcttcctcttttaactccaaacatagatttgagagctggatattcaggtagtctcttaagaacctcatccttcctctctacacagtggaacacatttgtctttaaataatttacttttcagtatcattatc

SEQ ID NO: 47766 - DNA, 1699 bp, Bovine  19866880762209
ctttgactgtgtggatccaataaactgtggaaaattctgaagtagctgggaataccagaccacctgaccttcctcctgagaaatttgtatgaaggtcaggaagcaacagttagaactggacatggaacaacagactggtttcaaataggaaaaggagtacgtcaaggctatatattgtcaccctgcttatttaacttatatgcagagtacatcatgagaaacgctggactggaagaagcacaagctggaatcaagattgctgggacaaatatcaataacctcagatatgcagatgataccacccttatggcagaaagtgaagaagaactaaagagcctcttgatgaaagtgaaagaggagagtgaaaaagttggcttaaagcacaacattcagaaaactaagatcatggcatctggtcccatcatatcatgccaaatagatgggggaacagtggctgactttattctggggggcttcacgatcactgcagatggtgactatagctgtgaaattaaaagacaccccttggaagtaaagttatggccaacctagacagtatattaaaaagcaaagacattactttgtcaacaaaggtatgcctagtcaggctatggtttttccagtagtcatgtatggatgtgagagttggactataaagaaagctgaacaacaaagaattgatccttttgaactgtggtgttggaaaagattcttgagagtcccttggactgcaaggagatccaaccagtccatcctaaaggagatcagttctgggtgttcattggaaggagtgatgttgaagctgaaactccaataccttggccacctgatgcgaagagctgactcattggaaaaggccctgatgctgggagggattgagggcaggaggagaaggggacgacagaggatgagagggttggatggcatcactgactcaatgcacatgagtttgggtgaactctgggaattgaggagggacagggaggcctggtgtgctgtggttcatggggtcacaaagagtcagacatgactgagcgactgaactgaactgggagcttaaattttagatatagagcacaggacttgaactctgtcagcaaaatgtatggtaatagcttcatacaaatattgcagactggcacaaactcagaaaggcataggctggtaaggagacatttgccccaaatttgattgctctttaataaaaaattatatctcagattaaataaagctcttacaactctgtaagatagaccagacatgaaaaaattccattaaagacaaaatttggtaaattagtctctcttgctaaggtaccttacctagaaatgtaaactgaattaagaggaatcttaacatattttttaaggtcctgggagaaatggactgtctttagatatcactttgagagacatattaccctaggccctcttatcaagaacaaaataaggattggagcatcaatggaaaaatgatactttctaagaaattgtacctcttcctttgtgaataggtttatgtgattacggaagtggatcagggcccatggtgatccaggcattgctgtactggtagcaccacatttttgtgcattcatacacaaactgacattctagtgcttgcttccttgggaaaagccagaatggtgcctgtctggaccaagatcccacagagaccttgtcctgcaaaccctcacaca

SEQ ID NO: 47767 - DNA, 744 bp, Bovine  19866881450608
tgctttttctgattcttgtcccgttgttgttttgaaacatttaataaaactgtataatagtgaagatgaaataatgccattctagtaacttttcttaatgcgtgtgaactgtttatttccaaagttttcagattagataaggcttctgaaacagagtctagaatgctgagatgatttggcaacctgagaacagagttgtaatcagaccagaaagactacagttatttcttaaatctacagtgaagcttccttccatgaaagtccttcaaattatgtaattaagtggttcaaagggcccaggctggtttgagtgtgttataacagcacatttatcacactgtacagggagtttccagtaaagcaggtttattcttctgtagcctgacaacagagaattacagaaaacaaagcagcatagataaaactggctgtaaggaaagttcttttacgcacttatgttaggaataatctggaaatcataaaaaccacataatagagcataagggaaaaataaaagttttattccctccccacaagttaattgttctgtattttcttatgtatcatcttcagtagatacatgtagtctgtaacccaaggcatttttgaaccaggaaataaagtactgaaggtttttaaatgtgtgtttaaaaatcctaccaatacaatattgtaaagtaattaacctccaattaaaataaataaatttatattaaaaaaaatcctactgcagtaaaataaaat

SEQ ID NO: 47768 - DNA, 1099 bp, Bovine  19866880601530
gaactctaataaatagcacagagttaagtcaggtaccccaattattaagcaaaagggatagattaaaaaagagagaaaagagtaaggaggaagtctactctatgaatgttaagtagtgaaccaacatatggcacctattaaaggtatatttatgcatataaatttatggtaaatgttagaatccatatggagaaagttgtacatctgccaataggtgtacttacctggaacagccagatgtctctacccaaactcagagagcaatttggacccatgaaaagccaactgacatggagtacacttgcaaagaaagctattacataaagagatttcaaattccttttgactttaacagactgagaaaagtgaaataatgacacaactgggtgtctcaaaaaacactaagttaatctgaaaccaaggtgtgtataagtgaatgagtgaacaccttataatactttcaatatttttatttttgaaaatttcaaaaatatacaaattaaaaaataacattacaacgaactttttcttaaccatgtccttgagtcaaaaattattcactctttgtcaatcttgctttatttttttcccacccacatccacattttttgagtttttttaaaatattggaattgtttactgtcttcagcccaaagagggctactgctaagtcgcttcagtcatgtccaattctgtgcgaccccatagacggcggcccaccaggctccgctgtccctgggattctccaggcaagaatactggagtgggttgccatttccttctccaatgcatgaaagtgaaaagtgaaagtgaagtcactcagtcgtgtccgactcttagcaaccccatggactgcagacttccaggctcctccatccatgggattttccaggcaagagtactggagtggggtgccattgccttctccaaaagaaggctaattttgacaaatattggatgatagcacatttggggaggtctgcaaatccagcaaataagtttcagcccatgattcaaacaagtaaaatccaagatcggacgtcctgatgggggtaagataaacatttacactatctgtgtcatccttcccttaaagaga

SEQ ID NO: 47769 - DNA, 1851 bp, Bovine  19866880728180
ggacagtaataagacagaaagtttggtttaaatgcacttctagtgcttcatccttcctcataagtcatggcaggaaagagttcaaaattggttgaaacagtgtgtgccatcaagaggcagattttcaaaaatggcacagctgtgagtttggacaaatgcttaataatgtcttctcttcaagaaaaggctaatagtatcacttctttggctacagagtaggaattattcctcaggatactgacatgatgaatgtcagtctcctgatgtatggtcttccttagcaataactctgctgtcctgtcaggctcaaggagggaaggagctctttatgtggccatactgtaactcaatgaggtctgctctttctgggaacttcgtatgaactcctcctgtagcaacgtctcttgaaatgagatgctttgtagatttctctggtgcatgatcagagatgccaaaaatagcatatgcaccgaagagccgaatctggtgtaaaactatttgcaccttgtagtgctatctgtcgacccacaggttgtgatcaatgaactctcagcccttagcatcgggctcaagctcctgaaagggggggaggacatccaccaccttggctgcctcacatagtcagtagccagcctttgagagcctaaggtgaggacgaaaaaaaacaaatcacagttgaagaaatcaaaatcttcaagataatggaaacaaattcaagatctcatggagagtgtgctatgacagaggtacacgtagagaaggccaggggagaaggagcagattgtgctgagaatgactgaggaagaattgaagctaatccacttctcaggctttgcaaatttttccagttgtctttctcctaaagtttgatgatgaagaaatttctatctagaaatcccctcttagtatctttacaatattaaagttcaagaaatgattgaagagaaagtatgctttatacaagacaacattatagtatcttaataagccccttatcctgagtgttttacttgcagggctcagaattactctacttaggacaatgctcattgattcaagaggaacactgagcatcatgcaacatgtacagctgttttcctgtggtagagggggtggggggaatctgggaaaatgaaaccataagaccaggataaaactcatccttcacatctctgtaaggaatgaaaaattcccctgaacccctggatctggagctgaccagatccaggacaccctcagatgcaatgagctcagtcattgttgccagaactttatcatagattataactccagtacctctgtgtcatcagtacatcatcccttacctacaatcaaattgactcaagatgctgggatgatgtattgtatttaaaatgaaagtcatatatttcactggcatcagaccaaatgaagaaatgattaccaacccacctacctatttaaggcatacaacacaaaatgagcatcagaggctactgctaatggcagaaccactgcaaatgggaaattttcatgtattcctatattcttatgtttgcaatttatttttaccaggttccatctttaagtctagattaatttatggatgtaactgaaatgcatacagatatatttatttaaataaatatttattttagaatagttttagatgcacagaaaaatgttagtttcctaacacctcacacccagcttccctttctattaacacttcacattaatacaacacatttgtcacaattagtgaaccaatcccgaggtataataatcaactaaagtacatactttattcagattttcttagtttttactcaatctcctttttctgtatcagaatctcattcatgatataaa

SEQ ID NO: 47770 - DNA, 1717 bp, Bovine  19866881054653
tagaaggcagatgaggatattcttagatcttgccacctgtcacactccccaggcatactctagaataaaagcaatgtgtcatgggaggcctttcacacgaggcacaggggagttacttgtttgatgagtagtgcatgtgacaggcgttgcagactgttgtcacagagagaaatcactaggctcttctttgggctttatcattattcatgttcctccaaggactgctccgggacacctgctgtctgcctgctgggagaccatggcctgtgggcctgtttgctcacctcccctggcaccaatgttcattgcctaggaagttggagttaaagctgggtccccaagtgggctgggtctgatgatcccccgggcaagactttgcataaataaagattcaggattgactcttgaggaaggtgtgaattaccctgtctcctttctttgtggctgggctgcactattggcagaacaaacaacatcgaagtcatgaatatggaagtttctgggagatactccttcctccattcaaggcactaggttaacaaatacccgcagcccaaccactgtttcctttagttcagggcatatttactgtgaccagaaactgcagtagtgacgaggacaatcacagtggtggtgggacagggacttgacgctggggttggtgtgtgggcctctgggttggatcctgtaccacctacctccacgtggttctgagtgtgcagggaaaggaaggaaggaccagtctcagccgagctcacagccataggagaactgattaacataaatcatttaaaaatgtgaccatttggacacaaatcttattttcttatcaaaatagaccctagtgaaaatgactgctttgttgatgaaaaccacatttctcccacttgcggagcaaatccggaaccaagggaattctggggcatgcgtctccctctccactcaaaccccttttgagccttcaccatacagtctcaaggacagagagtagtgtaataagggggacacttactttgcagaatgtgtgggcgcgcatgcgcgttcatgctctggagagctgctgagactgtctgctgggtgaggagtggaggttgctgagagctaagatgaactggactgcgaagggcaatgtaggaaaaagaagaggcaagatgacaaggctgggagggggaggaatttatgggaaagaatagaagtaagaaggggactttttctgtttctgtcatgtggtttgtggttatgtcctggatgtttgttcaatgtccagtgaaatcatcatttctcagtgagaaataagcagtgcatttggattatttttgttacatttgaaaatttttttgagtgtggcccactagtatccacgcggaatgtggtaagaacagagtgctatagacacaaaagagaggacgtataagagggagaaaacagaggaaaattctactgccacctctttcccctctacacgatggcagatcttcagggtccaccacccaccaccaacaggaacaagttccaatgggctggctctgcatccatgtcccccagccccaccctctccacgcacacacctatcccacctttccaccttcctcatgattggctataggaaatcctggggtttcaagcttttctcaagctggtcctggcttcctcatccaacccattgaggggcctggcacctgagctgggtcctggagcaagggaatgaatgggttgg

SEQ ID NO: 47771 - DNA, 1244 bp, Bovine  19866881098901
ctgtataatacacagttacaccaacacaaagaaagcaaacaccaccttacagatgcagatgattccctgaacaagataagattatctcactaaagacagtaaattacccaaaggttacagtttatgttcctatagtactttcagcagtgttgtatctagcccagtaactactttctttattaaattacctataatacctaactcttcaagtgttcttcaggctggctttgatgttttatttgttccctcattaactggtgagctgaataagctctttgatgtatgtttgttttatatttgcatcagtcatgatttgtaaccttaggaaaattatactttaacagtttaaacacacacaaaaaataagatatctccctgaaggagacaagagctttgtggccaagcaaatgtaggctcaaactgaagcctttctactcatgtcttgggacagaagttacttcactcttaaatctccagctttcacacttgtaaaataaggataatatctaccttgctaacgttatgaaaattaaatgagataatacatgcaggcatttaacacattacataatcccataaatggcatctattactactgtaaatattgataatattatgaataattcttggggtatctgcccatagtgtcaccttgtccttgcctataactgactagaacaaagatgaacacaccagggcccataaaaattccatctctctctctctctcaggaatttagaatagggattcaaagatattagttttcctttgttcattatttaaactaaagatatgtcagcttggacctgaggctacttctgtggggtaaccacattcagccacatgcctgaagttggtttttaaagagattaaatgcaaacagtgaaagcaataagcaccgaggcaaaagaaaaagagcaggaaagaaggaaaaaaaggaaggaaggaagagagaaagagaaaaaggggcccagctcagagagggtttcaactcaggcagccctaggccctgccttcagtagcacaaattgcccttgggtacttaacaataagcatctctttacgattgaagctgaagctatgatgaaattgtatcacacacagtcaggtgaactttgactaacactaatgttattgtaactactattattactactattactatcattattgttgtttagtcactaagtcgtgtccacatcctttttttttcttttttctttttcctttatttatttacttta

SEQ ID NO: 47772 - DNA, 1016 bp, Bovine  19866881294029
aacattctgagttatgtttttcttgctgtggatgctttctagggagatgagttactgacggtctctcctctgcagaaagtaaccatctaggagaacagcactcgaagatcaggtccagagggtgtctgatgcagtgcaaagattgtgggatatggaatcagtatcttacttgctggggacatcagcaagcaacttcaccactctctctgatcatgtcctttccactgatgattggaagcaattttcctctctcactggagtgaggaatataccagccatcaaaagggtgtcattggctttgccagtagagctgaatgaccccctgtgtacccactgcatcttatcagtctgcatgaaggccctttaggcacctgctatcctcttcccgaccctgtgcaggagcagttccaggtgaggtcccccacccagctggccccaacatggtgaatgatctggacctagagaggctcttgcctacacactcacccttgccggtccacaagaccaggcctgactcaaggcagtacctaaggaaacattgaaatggagacccaccagctcttgactgaatgctgccaattatttttatgaatacttcagaagtcaaaatctggcagaaaggaaaagcatacagagatatttaccccataaataaataaatcaacctttcttccttgtgaatagcataaaaatgtctttgctttagtggaaactttgtaagtgtgatcttggctttttgccatcagcagatgtctataataagctaaggtctcagacagagatgaattgatttttttttttttttttttttacctcaaagcctcacaaaagacagtgtgcctgagagttcactagaaaaacaggatttgttgttgtttctagttttattatttaatggcaaacagtttaaagcttcaagtaattggtttttttgtgtttcattgactgcctttgattaccatgctaattatattgtaaacagactcctagattctcagacagtagtgactttaatg

SEQ ID NO: 47773 - DNA, 909 bp, Bovine  19866880447202
actgcagcatgccaggttcctctgtcctccactatctcccagagttcactcaaattcatgtccattgagtcggtcatgccattcaaccatctcatcctctgccgcccgcttctcctcctattctcaatctttcccagcatcagggtcaggtaatagccaatgaatgcggctataccaaaatgacacgggaacttaacgcctggatctaacttgcaaatgtcacccggacaattttttgaacaccaccaagtgacaagggtagagcgacctcatctcctcatattctaatcaaataaatccaaggtctctcacaggctggtgcctacgcttcccttagtgcctttcctctggagtgtctcccagcttagggaagactgactccacagaactcaagtgattcatcagggactcacagagctggaggtgaggtggagtgttactcctctccgaacacagcacttacctaccctgtcaccagctcctggtgctgaaaggaccctgcccttacaaatggatggggcattgcccaggggccacacggaagacatccaggtttccacccaccctcactgagacaaacagtggagagattcgatagagaccttgcagaatccaaaaggttaaaaggaataataaaggaaactgccaattgtaaatgaattatatttggctctgaaagctgagacacaggctatattataaaagacatctctttgcgttgtttaccatcaccctgactaatgcagacctttttttttttttgttttaaataatcttatgcaaattagacaaacacacttccttccagttgattgctatctgcaaggagtaatctaactgcagagggactgagcaagggctgagcagagcagacaggagaaaagggtgtcgtcgtcctgtggcaggcag

SEQ ID NO: 47774 - DNA, 2433 bp, Bovine  19866880478809
actgccaagaccagctgcaggaatggggaggtgaccaaaggctcactcccatgacttaccccagtgcaacaagcgtttacatcttttactcttcatagaaagatgaaattggaatgtgagtgcattgagagaagaggaggaagagaagttgaacaaatctgttcttttaaccataaaatcttatttcagtccagtaaaagacaaaaagaatcaaagaaatcagaggaccaaacaccagattttatacacgtgaagcactcagtaagtattggcaaagaattgctatttttaaatgtaaaaattacagactacatgcttgtttccctttttcctaagctgccttaagtttgaggttccccttgggtgaggtctgtgtcttttgggttcactgggtctcgtttggttctggcatcacagtgggtgctcaatagacacttagtgactgaataattaaacaaatgcccgagataagtgattatggtgattactgggcaagttgtaattaaaaataaaaaaagctgagtgcattttttttttttacgaatgtctctcttgggagtccatgagtgggaggaggggagagaggggcttcttcccaaatgctaagcttggttctcaaatctcatccaagttgaccaacttgccaagcctttccacccccaaattccctcatccctttttgtaaagcacgtgttatttgtttctgactatatatatatatatatatatatatatatatatatataatgtatttattgtagaaaattcagaaagtacagataaacaggaagaaaaagttaattgtctgtaatcccaccacccatgaataattcactgctgatgtttcagtgtatttcccgccagtctagggtttttgtttgttttttgtttttgctttgttttgttttatacaatcagcacactgaacattccaggttttttttaagtctgctatgtgtatgtagggtttcccaggtggctcagtggtaaagaactcgcctgccaacgcaggagatgcaagaaactctggttcgattcctgggtcaggaagatcccctggagaagaaaatggcaacctgctccagtattcttgctagggtaacttcatggacagaggagcctgtagagctccagtacatggggtcacaaagagtcagacatgactgagcacataccaacacatgtgtatgtgacatgaacattttctcccatcattaaatgctattccacaacacgatgttgtgtagacccatagcagagcttgatcataatttacttaaccagtgccccactattggaaactttggacatcaaattcgttcccaattcatttcattactacaaataatgctaatgaatatccttgtccataaatgatagtgcacattccttcaagtggaattgttgagtcaaagagtgtgcacgcatttcagagctttgattcccagttgccagtgccccctccccattaggctgtatgaacttgccctccagccagcagcctgtgagcaagtcccatctctccaaatgctctccagcttttggtattctcactctttttttttttttttaaacccctgttaatttaatgggtgaaagagtctgtgattctagtaatgaatccttattagaaccgtgctggccacaagcaggggctgtttcaaggtttgagcggccttgttcagacccacagcttcgggcagagatgagaaaaacaaatgcttagtagtgggtagttggaggggagagcagagatctcttacaggttctgggggagcttctagactgtctacctgagcccaggcttcttgggcatgtgctcaactcttgggggcagaggggtggggtctgtcagtctcaacagaaatgagctcctgcttcctcctacctctccgcccacaccttgcagacacctctctcgacagagaagccttagggatttctatgccataaatactacctgtttttcaagctcagcatccacactttgtacctgctttcatttccccgcctgagctatcactcagccctagtcaacggacagactgttttgctctctgattcaactttttctttttctagttggttctaactaatttacttttttggtatttatgtttacccctacctggaaacaagaagaattgaaggtgactaattttttccttttaggaaatgtaccctaatcccagtctgatctctctgatccttttcagctttgatatcctctttttttttttttaatagctttaaatttctggggtaaaaagattaactcacattcaatactaacagttcagaaaaatacaaatataaacagaatgcagaaaatttcaaaacacccacagtctgagagccctgtattggggtgtgaactgggactttaaaaattaaaagaatgaatttaagtgaaatccaccagttatatctttt

SEQ ID NO: 47775 - DNA, 1070 bp, Bovine  19866880552675
ctctcttgcagctactcagctctgttagttgtaacacagaagcagtcatagacagtacgtaaatggatcagtttgactgtgatccaataaaactttatttatagatactgaaatttgaatttcatatgattttcatatgtcacaaactcgtgtattctttttttcaaccatttgaaaatgtaaaaaccattgttcagcagctgtacaaaatcaagttgcaaagtggatttgacccactggcagtagttttctaacccctggcatagcatattgtataagtagcaccctcccccagcttagaaataaatatattatgttccaaaaactttgtttggaaccgaggaagcattttcttataggatcattgtcatctgtgttggttacattcccagaccaatctacaagcctgttttaccttcagtgttctgaattccagcagtacaacttcatcctcaggaataacactgtctctgagggaatatggatttaatattccttcctggaccagaaggaacacagactttccccagcactatcagaatttccttcttcctgttctcttcatttcgagtaccctgctccttgggactttaatagggtggtgtggtcacaggaccaaaaaggtttgtgtgtatggttaggtgggagaaaggtggcagggaaagaagaatgaaagaaaagagaagataccaagatgaatcacacacagtcagagtagcattgctctgtgaaaccttagttatgtgtgtgtatatgaactgggtcacagtgaaagtgtatttatttcttactgtgattggtgatcagaatgtttgaaagcctgtgttctaagggtttgaggtacagatcccgagatttttttttatccttttattgtatgtgagagccaaatgaaaaatataaagtaagcctcttgaccacttaggacagtgtgtttctagtaaagttaccttatgaggtggttacctgttttacagatgagaaaacagggtcatgcagctaataagcatcacaattgagatttgaacccgtattcttaccttgcttaagaatatctgcttcatccaata

SEQ ID NO: 47776 - DNA, 1263 bp, Bovine  19866880623105
taataaaacactaatacagcgccttgtatccaggggaagagctaaaattaacatagagcgagcagtgtttgctattacattcaattacctttttacttgagatttacattctcatccccttaatctccatagtagtggcttcaaaatcattcctcccaggctctgcccttccggagcccccacagctggaagccaggcctcctgcccatatggcgctcaccccggcacggcgcctgcccctttcaccacagctgcctctcctcacagggtaccacttctcacccctgctcttaattttctcacatctcagcctctgagcactcaaagcaaagggctctgacatgaggcacattcagacatgcagttatcaataagcaggtgcacggggcatggggttgggggcatcacttcatgagcctctgaagactgcccctggcacaagaaaggggcaggcagagagttcctgggagccctgggaaaactggcatctctggtttgacaggttgtgggggacggtttgctgcatggcgcagctggggcctctggattgtggcaggaagctcagccgtccagaagtagaaagggacaaggaaaccacagggtccaggttcttactcaatccacagacagtagagctgagggcttaggaagtggctgcttgtgggtgacagaggtgagcctagaacaccctcatcctgtcttaccatccagcactttccctaacagatagtcaccccaaacacagccacaaagtgtctgaaccaccaggagggcccctttgtttcctgtaagcggacaaaagcaggactccttgtccttggggactggtcagccctgctgtgagtcatcaacagagatgaccatgtttccaagtggcacaaagtcctggttccaaatctatcactgactagctgtgtgatcttagacaaggtacctcccctccctgggcctcagttttttcatctggagaacaagcgcaaccatccctgtgctcccttcttgagaatggcccccgtgactgaaagatcaggaagtcacattcaagcccatggagcctcagaagtttgacagcaaatccgtttctgagatggtctctgcgaaggctggtaggagtcccaaaatgaggccaacagggctgggatgctcatcagggtctcagacctcagtatcttgagtttcaggccaggccacctcagacctccatgacttctttttttttgggggggggggggggcaggggcagtgcttcaaggcaggtgggat

SEQ ID NO: 47777 - DNA, 1936 bp, Bovine  19866880653707
gtgtgagcctcaccctgctaaataaagctttggtatttctgataaagcctcaaattccttatcacactgacacaaagtgcatttaaagagacagacaccctgtccctcccttcccaccagcccctgccccctccactcagttcagatttccagcagctcaggctcttgtggatcagacaccaaatacggctcctccgggaggatgtggggggtgggggaaaccaaggggcgggagggctgcccgctccaactcccacccacctgtgtcagagcggccagcaccctgaccagggactcaggtccacagggagtggcttgtgcttcccgtcccagctctggagccagagggagcaatcaatagacacgccctgcaacgggtgggtgggggcggtgagaggggggtgacttcatgacagtgtagtcctgtgctaggacaatacccagcagctgctagaagaacccccagtaaaccgccgggcccaccaggctgctcggccactgcgcacacatcaggtggcctgagccactacggtacccaagcagagtacaaggacagggccaagaggggtcaacgatacccatgaaacacagggctgaccatgttcctgtcaggcttgaccacgggttcagcaaagccctgattccttacacagccctgcaaggtggtggaactatcaccccatttgggtattactcgctcagttgtgcccgactctttgtgacaccacgcgctgtagcccgccacactcctctgtccatggagttctccttggcaagaatactggagtgagttgccattcccttctccagggaatcttcctgacccagggatagaacccgggtctcctgcattacaggcagattctttactatctgagccaccagggaagctggcagaactatcaccccatttgatagatgaggaaatcgaggctggcctgaggcctcagagccagcggcaagcccagctgcagctctagccgaggctggccaacagctctgccgaacgaaagactcttcacttaatcgatttgcagagttcacgcccacctccccatttacgatcccaccaagacaggccttcctgtgtcccagtgccccccttccacctccctggccctagcttgtcagcccaggccctgcgcccacacacagcctgttggttgaggaatcaaatttattatttttaattattttgatttatcaaagcagcagctacaatcatattaaaccaacttggcttcttggcattgaacagatacagctgccgccggactcccccacattctataaaatgcccaggctgtctgtgtgctccccaaggagggcacccaggggcccttctccaaggaccccgaatttgaagaccaccaggcctcccccgtgcccggctagaagcacacgcaaagatgctgagggccagagaatggaaaaggaacatgctggggctgagctgccaggtgctttgggaaatagtcacctccatccctcagcccggagacccttccagagtcttgacccactgggagtcacaaacccctcagctggcatttgcaggggctattatcactagtggtaagaatcctgccaatgcaggagatgcaagagatgtgggttcaatccctggatcagaaagatctcctggagaaggaaatggcaaccctctccattattcttggctgggaaatcccatggacagaggtgcctgctgacagtctaaggggttgcaaagagttggacgtgactgagcactgctatttgaatttttgaatataattatgtctcaggcctgcattggggcactcaacagagaggaaccagactgctcctcagcccctgcccacaggaggaatgatggcccactttttgcaagggaagaaactgatattcacagaagagaggtgatcttcccggggtgcatagctcatgaatacag

SEQ ID NO: 47778 - DNA, 1215 bp, Bovine  19866880681583
cccttccctccctgcccccctgctctccagccttcccttccacccctggcctgtggcagccccctccccaccatctctgactccctgcctgccctccctctgctccagcgcagcctgggcctctggtcccttccgtctcccaggccggcagtcccgcggcgagctcctgcaggcgctctgagccttgtctgtccaccccgcttgccctcgcctccttcccacctcactcttttaccctctcccctctcttctactcttcttgctctcttttataattaatgattagttttaattggtttgcttaggcagcctgacagcaaattaacagaagccagctcagggctgccaggcttgggcgagagaccactgcacttcccaactggtcaggggagggcaagggcgaggctgacctccagactctgcctgggcctgtgggctggccaggcgggctctcagcggatgagagaggccacacctggtctggcgcgggggccaatgggaagaaggcaagaggatcctcgcatacaatccaggctcacttttgtcatctttctctgtgggcttttgttctctttctcctcctcatgtccccttccatattctcattcatgttaggcatcgtccacatcttctgagattaaggtcaggtaaaaggagggcaggggccctgtctttagacggggacagggcttcattctgatccttccctgtagctttatggggttagaagcttgatgggtctgggccaagatcttgctctttcacatggacaggagggagcaggtaacaaggcttgttgtcattgttagctcagctgctggtctacagtcagctaccgcagcccagaaaccaaacagatccggttctgtttctgatttgccctgtacctacctctgcacagagctcaacctcttgatcctcagttttctggtcagaatacttaaacattagatgaatgcatggatgggtggatgggtggatggataggtggatgggtgaatgaatagcgggcagagaaagtggccagcatccctgagcatggtactcctcttgcttagcttagaagggttgcacttattcaaccttcctaagtgtgggggctcctcttccactgtgttttcctactctgtacctccccccggccttgcagaatcctgccttaactatagcagctttctgattctccaccaagcccagggtgtgcccagtcactca

SEQ ID NO: 47779 - DNA, 1298 bp, Bovine  19866880697739
ctcgatcctgactgtgatttagagtttttagaatgttaggccgcaggaaaccagagaggcatcctacctttcttccaaagagagtttaccccgcacttaaactggagtccgaggacttaatcacccacctccattatcgtctaaaatgctgcttcagtcagtaattatctatttccaagttgaatcccaatagagtaagttctggcaggaccttttctgggcagagaattccaaggtttgatgggcatctggggaagaagagccctctgtggatttaaacttcacttttcacatttcccgttctcagggtcaggtgtacacagatcacgttcacagagcttggtaccatctctgatggggtgagggaggaggggatcttataaaggagtgagcgtgtgccctgtccctaacattagttgagaaggaaagggggttggctctctggtcttgggggccgggagtgcgtctggaggggagggaccaaggtcctggcttcctccagtcctgtctcccacaggactcgctgcagtgcagggttggagcgctgggtttggggagctcacagctactgtagtcttggctttcctagcaaatgtcacttcagggaattgcagtggagccctgtcttgaattataatcttgactttctctttttttaataaacatctctttcccgaaaaggcaaatccaattttgtttttcttttaatattatttaatatttaatatagaaatcgaggtccctgtagtgcatgtcacttcagtggaaaatgagggttacctctaaaaacatcagctgagtttgttttattgtgaagctgcagccctgagtagggccctggtcccacctctgtaactgacaggttaacctgtgccctctgatttcagggctggggaggccgggggagctgatggcatagggtttgcaagggtcttttgtggttttgtttgtttgttttttgtttctttgagatctcttttggatgcttcagagtctgaacatggagtcattaatgagaaacatgaagttattagaatcatttatcattttctttgaagcttgtgctgccagtttgtgtaatttacaacatttctttcttttatcgggaatttctttggatgcaagagaaaagcagctgttcaccttcagagtattagaataaatgtttttgttttccgtccaaccacttgattctgcagatgacatcaattgcggagtcagccacacatgaagataattggactgtgtgtggggtttaagccctcatagaaggaacgggtctatatatagaagcagtt

SEQ ID NO: 47780 - DNA, 1185 bp, Bovine  19866880719430
ctcagaacctggagaggcacattaatcaacccattccaccagcactaacggtgggaaggcacggggccggccctggaccacgcgctggaggagacgtggatgccgggctaactctaatggtcaccattatgagcagcagcagcagcagaaggcagggctcctggccttggcctcctgggggagggtacagtagtctgagtgctgccctgacacaccaatgtcatgggtataaccagatcctcagagcagcaggcccctggccaagctctgatctcttatctccttccagggccaactgggtgtgaggctgcaaagggggaggggcaagaaggtaggcaggagggcctggctttagggagctgggtcgcctgggccaaaaagggcagaaaactatggttgcataatgggaagcaagagttctgctcttcaggttgggggaggggagaggtagaggagagtgaagagcacgaggcaagagaggcaagggactggcggaagtctggaaggcgtgggtgacgcaggaaacatcgtctgcccatctccatctgtccaaatacctcccatcctttatcaagttcaaaggccactccttcacaaaactccctgggctctcctctcgggcgctcctctgcctggtgggacaggtaaacacatccgtctccctccaccaggcagaccccagaaagctgggaaggaccaggtggccttcattgctgcagctcctacagtgggtgctccccagtgcttaccaagaactgcaggccccacaacctgcctggggtttcttccccttctgggggtcaccagtatgtcctcgtgagtcggggttatgaggatgctacactgtggtcagacagccagaggggtgagcgctggaccaccaagctgccccctgtcccaactcatccccaagaagcggccccttccccctccactccctggggccaccagccctcctccactgccatctcctcccccgaaccctggcccagctaccccggaacagctgctgcctgccgtggggacccacaggctgtaattactacagagcaacttccttccccccgaagatgaggaggaggagaaggacaaggaggagcaggaggaggtgtggcagcaccaggtggtcaaggtttgaaaaccagtgcggggagggcagtgtaaaggacacgccttgggggctgg

SEQ ID NO: 47781 - DNA, 1741 bp, Bovine  19866880728945
ccacggtgcttggtgcacacagcaaaggtgttcggtgtctgaaagagatgcaggagaacaagaaggttcctatggatactgaacaatggtggccacctgccacattcagagagcacacggcccttcacacagacggttcagagacaccaaacacaaaacagagattctgcaccaaatgacagggttcagaactcaaaagggcaggccatgaacggcaatgaacagtggagagggcaggactgaccttcaccatggcctgctggtcctcgctatactccacctgggctgtggacaggttaatgatgccccgctccacagggtctttgttcgctgttatagatgaagacgtaagggcgacggaccacgacgaaatgtttagcccagttgctggacaggggctccttgaaatgcagatatcctttcttggagaccactgagctgaaaggacaggtcagcagaggttagttcctcagaaaaataaagtgatcataagctgaagtccatcaaaacagactgaggccatgtccctaggttgaaggaaacaggcaatgatctattcggcaggccatgccaggtgagggggacggagatacacctggagcagaacccagtccccttcccatatcccaggttcatctacatgagacttgagcagaacagctggaagtgaattcccactaatctgtcttctaataccccaggatctctgttccatacagtactcaccctggtctaatttcttcaatatctggaacaagattgagaaattcatttttccctgctcgggccaaatagggtgtttccacaggtgggacaatctgaaactgttcaaattctgggcagggactagaggcccgggaattggcttctggggtccttgaaaagagacagaggttaggaagaaagggagtaccaagagcttccttgaggtcaatgcacaaaacaatgcttctccccaaacaccaaggaccctgccaacatcaggtcctcagagcctggctaagaagacagagctggcatccaaaaggtaattaatcccacgtccactgggtgtcatccttcggcagttattaacacaaaggaaattctcactgatgacgagcgagtctctcagtctcccctcttgtccggaaggcctctgaacaaaaggctgaggagtatgaacaccactccctggtgtgctcctgtctagtccccaggccacacctagggcaggggttctcaaggtgaggtcccccatcagcagtatcaacttcatttgaaaaagagtgttagagattccgattctccggctccagctcagacatgtggaatcagaaaccctggactgggctcaggcacctgggctctcacaagcctcccaggtggtgctgatgtctctaaagtctgagaaccactgcctgaaggaccagtgcagcacgaaacaaatgagaagaactgggttcccatgtgactgtctggagcaaagctgctgtgagagacagttcctgcgctctgcgttgttgtctttgtagagcagcttagtctaatcaattgtatctcactaactccaaaaagcccatttttctcacacttcactgctcctcgaactggggtgcatcttataattgacggcatgtcacactgcagtgacagtgctctggctttcttgcacactatgtgttaagtcacttcagtcatgtctgactctttgcgaccctatggaccactgccttccaggctcctctgtccaagggattct

SEQ ID NO: 47782 - DNA, 1863 bp, Bovine  19866880791000
gtgtgtgtgtgtgtgtgtgtgtgtgtgtgtgtgtgtgtgtgtgtgtgtaaaaaagtggccggactatattctaagaatgctgggccagggagaggaggctgcccgagccggggtgggtgcatcactaacctgccaggtctaggaagaggagtccaggctcagagcctctggagccccaccccatcccctgcccagggactcgagccaggggcagcagctttaatgaggagatgctgctgcgtgactcagccctccaaaggtgcctccatttattttatttttccatcataaaaaaacccaagctgcaactcggccagattccccggccatgggggatgggggaagaccggcccagagaggactgactaactagccccagtgccctccttagaggggagacttatgggttcgtctgggttgatcccaaagggaaaaagggcctgggatggggtcccccaagggctctttcagacctgccctcactgcctctgtctcctgttggaggagaatggctacgccaggcttttgatccagagtaatgctcatgatatcacataactagtgctggggttggttcaaggggccacttcgcaacccacagctgcctctctcaaatgctttcttacgaagagcaggtccactcaacccctccccagggtgtcccactgaaccctctcgggaaaattagtttgggagtcagagaaccagagaccttaaaggtcatctgatgcttgcgtccctccaaatgtcacagccagcctctgcttgaatggtaccaggaaaccctcaacttccgaggcggcccagtctgtgcttggctctgactgctccttcctgccaagatggcaccgaagcacctaccccttgcagcagactggcaaaaccggtgctcaacctgacagttggtagggaccggccccaacttagactggtcgagtgggtgtatctggccaagtaaaggctcgaggaaggaaaacagaggacaacctgctctgccccaagcccagcatggaatctcttccttcagaaacaccacaaaaaccttcccagtccccagtgtacactggggtgaaagtgtaaccacagccagcaaggttcctagaagcctctactcctggcaaggccctggccttcaaccagtggcttacaacagtcctgagagtctaggggtggtctgacactcagacccagcaggggctgggctggggaagctgaagtctttgttctctggggttagaagtctgcagcctttcctctccttccttgagactgtgaatcctcgaagcacatgaccactacgctattccactccaagaactaggctactaagccaatctgtcttagcctcccttgaccccatcactcctggcctcatccacaactgagcccatggccaggatacaacgcggggggtttgtatgccatgaaagggggtctgggtctagagtcccagctgagctgatcccagggaaaaagaagcaggcctggttcagtgagcaccactgatccctcccctgactcaccttgacgacacagcggcagccacagggctcagtgtgcagtgctggccctcgtggttcccgctggggtccctggtcatctctttgaacttgctctcttgcccattttgccctttacctggcagagtccaccttgggtcctctgatggacagctccagtcctggagagcccctccccatcttctcaggatctccctagggagctggggggcacttacaactagatcctcaagaatcaagggcataagttccttcttaaagcttaaccgctgtttcaaaatcattttcaccctggcctccaggttttctcagggcctgggaatcagcctagtggggcctaatc

SEQ ID NO: 47783 - DNA, 1741 bp, Bovine  19866880800296
ccttcccaccttccttaaccagaaggcccagttgccgtgttccctttaatcattcactgtatctctggttcaaatgtcacctcctcagaggtagctgcagtcgccctacctgtcccctctgtcactctctattaagtcccttgttttatcctcctctaaactcgttaattgtttactgaattatttgtcggccgccacctcccacccccatctcacccccacccccaccaaggctaaacctcatgaaggcagggatttgggtctgtctcattcacagctgtaaccctgggacaatgtctggcacactgtggagtttgggaactgtttgtggaatgagtgagtgggggaagagttggtagcaggacccttcagggctgagactgcccctggggtcagtggctggctggacacagtgcccccaggtgctgagccccagcctgctggaggagcaggggccaggaattggctggcaccttccagtctgatctgaggccctaaaagagagcgcagcagcccacttttattcttttggatggtaagttggagccaggctcaggatggctcgggaggacaggaggccagggtggcccgtgtgtaacttccagcccagaggaacaagggtccccttgtggtagcctcaggaacccaactctatagccaatggaactccttctcagacttccccgagatgtaaggcattggaggcgccccagaagtttcaggatgagcaaaagagagcctcagctttctatcaccacgtcacctttgctggagtcctcaggaaaccccaccaccctctgtgctgcacaacggggccagcccgtgaagtgaagtctggccgcgggggccctgcacctccctgctctcccgctccggtgggttgggctctctgaaaggcccctccaggctgacggctgccttgggctccacgcccagcccaaggagggagggcagaggagggtgagggggacgcccaggcttgcagcggggctgtgcctccaccgctaatgaaaatcggaaaccaattgagcaggacaaggtgcccagccagcaggttgtgggaacaaggggcctaatggatgtggctggggggtggagggggaggaggggagcggatgcctcattgatcgccccatggctatatttatccaccttgggtccgtggccccagcagctgggtggtgcagggataaataaatggccactaaaatattcatgagttgtacatgcacatccgtggtcagggggaccgccaagggccttctcttccttcctttgccccatctctctgcagaagcctttcaggaaattcctcccacctgggtcaggtgaagtgtggctcagccctactgggcatgcagccggcttggggaccctgagggagcgcctcctcccctgggctggctgacggggtacattcgtccctgccttccctttgtcctcaccttggctcccatgcccacatccctgtcccttagtgatggattggacatgtttggccttgctttttgcttgcccctctgtgtccccactaggctgtgtactccttgggaacaagtttatggttcactggtccctatttcccatgtggcctggcagggtgcctgacaaagccttgaggggggcattgcatgggatggggaacacctcagaggtagctttgaatctcagctctggtctgttttcaaaagtgatttaacctcactgggactcaatttcttcatctgcacaatggggctaa

SEQ ID NO: 47784 - DNA, 750 bp, Bovine  19866880802074
aattgaacagctgttgttttaaacaactcccccgttatcaagtcttttaaagacatttagtttagttttcacacttagttttgtttcacactaaacaaaaattcttattgctctcatgtttcagtggtttatctaatatttaattaaattagatcattgtaataacaaacaactgcatagacaggtttgggaccaaatactactgatacttgaaaagcacaaaactcagctctttggagcaaattgtctgggcctatgcatgcatactaagtcgcttcagtcatgtccaactcttggtgaccccatggactgtagtcttccaggctcctctgtccttgggatttctctaggcaagaatactggagtgggttgccatttccttctccactgggcctatgagctacctctttattttagaataacgctcaatgagaaatggatgtcagtctttacattctagggttgtgaagagcataagttcatgtggtaagtggctaaatggagtttggttaagagagcttttgttctttctgcctaaaggtttagtgtttaaagtttaacttacagagctccagttgggtgtattaagtatacgtgattagaaggtacttgtgatacattgatagcagagtgcagctgataagagccattgctccttttcttcctggtcctacatttctcttacctaattggtttggttttctcataactccacagcaacttcctaccatttccaatagtaagtcacct

SEQ ID NO: 47785 - DNA, 1273 bp, Bovine  19866880876056
tagaattttaatgaagagggatgggtccctgatgttctctgctttggagcataactgaatcccagcatttacttcaggaatgtttgtggggatcctgcactggtgtcagtggttatattccacatttatcaaactcataagtcctgccgaactaattttaaaagtttaattctcattgtgagtggattctttaccaactgagctatcagggaagcccaattttaaaagtagctaattataatgaaaaagaacaacaacttcaaatgcataggaatctctcttaaatgttccttgtttttcttttttcttcttcttttttttttaatgcctttggtctgttttggccttcaaagtgagccatcctctgaattctgttgtgagaaaactcctttcctacatatctccaaggaaggagagtattttccatgctgtgaatgggggaagatacggtattgttacagtatttaatggattgacggctgtgagcttcaagcatgagttctgtctgtctgctgggcagcactcaacatagaatgctgtgttttaacccacttggctcaatgtctgtttctgacacaaccgcttttcatgctgctggaaaacagaaaaccacaggctgttaactcaatactcttcccttctggggctagggcgggggcacaagggggttcaaatcaagttactccccactggagagacacatgccctccttccagctgacagttttgacaaggattctagagttcctggccacttgaattaaacatcagtgaggggtgccctgtggcccgcttatgacctgggcatttactccttggaccgggagcagcctgccaagtgtctcttgcaggctccctctggattccctacctatggatgtcttctcccttcccgggcagagcccttttgagaggagcagaaggatcatttagtgctcgtggcctgctcattccttggcttctctgctgagctatccagcaggggtgccaattcttccatttagctgactattatatagcccttaaaagggaagggtttattttagctggctgctatattgattgctatagggacgtttctattttcactggctgctatattgactgggaaaaggaaaggggccgtattgccgggagctgtcatattgactgttacagaaaagatctgtatttaagcagtaccagtgcactgggatctcccaggcaggatattaatgctaattcatccgctcaccccctgctggaatgtattgtttaaatctgtagattcccac

SEQ ID NO: 47786 - DNA, 1424 bp, Bovine  19866880920901
gcccaggagatgaggcaggcaggcagtcctgaggttggaagagccaagcaaatcataagcagatataattagaggggagaggttttggacggatatactgttgaccatggacaactgcacaatagaaagataaagtagaaatactagaggttagatacagtgcaggtagattacccagagtgcagatgaattatatggattgctggagggcggggggatgtctgcagataaattagaggcagcggctcataggtgtgtggacagaagggggaatcttcatgtatcattaacagagatgcgcctgctctctcctcccagtgactcagttacagatgaccctcgcctcagtccaggagctgctgattcagcagcagcagaaagtccaggagctggcccatgagctggctacagccaaggtacttgtccctgaccctccggcccctccaggctcttcttgctcatccttgtgccaattcattgcgcgtctgatgctcttttctgattctggttacactgctcttgtggagaaaggaggcggtcaccaggcaggcgatgcggcattcagtgacgagggctgtcctttctgtctctgaggcccacccccctgaccgtggcagcacacactacagttctggtggtagctggtgtagacacgggatggtctccacctacaagttaggtcacaggccccagcgttgccaagaacagttcagggaacagggtgggagagggtgcccaggccctgggctaaaatgtggctgttgccaagttctctaaaccctggtcttggggtccagtaactcctgaaagatgcagacccacctaggatgaccgaggcgggttcattgcctcaacttcccatatctggaacccccatggcaatatcagatcctgggatcacactgcccaggttaaagctctgtgccacgtgctggctgtgtgaccacagacaagtcacttgccatctctgattctcagttcccttgtctgtagaatggatctgtaaccctacctccctcatcgtgtacacctgctgggaacagtgcctggctcctgtcagctcccaggatcgcagcttttggtctgggctctgtgtgtgtgtgtcacggtcttcctgactcagcctggtccaggagacagtggtccacggcgtcagctgccctcccttcctccatccccacctcccatgtagctttctggctgcttccatgcaattctcaccccaaggagagagaagtggcttcctccggagagccccacctgagcataccgctcgaggtccctgtgctcttgcgaagagggtgcctgggaatcccctcgtggggtgcctcacccacggaggtgctgcctctgcacatgggcatggttaccagtggccactgccagccaccacgcaccctccccatgggcagcagtccataaag

SEQ ID NO: 47787 - DNA, 1324 bp, Bovine  19866880922599
cttgggcctggattgttttgacttgagtcagtgaagctgaaatattgagtcacagcgggccctaaacttcattaccagctctcaacacagattactaagggaaaaaagttgcttttaattgctttttccgattagcatttctggagaagaaactagtgattaattacacctttccctcccttcaaccacccgtgccgcagaggtcccgacaccaggctaccatctgaagactcaggatcagaaaagtctcatgcttatgaagggccaagaaaccaaaccaaactgggtggtgagctgaaagtggagaccatcctgggggctgatttaacagagcaagcagctgatggtgtggggaggcccgggtgggcccatccaagggtcctcttatggcttcagcatggtgtccactgggctgaaggacttccacaaggactaggactatacctgggtgcattctagaatcagagagtcccaggaagctgggagaagatgaaattggggagcctgaagatctgcaagagaagacgatgtgattgcagccattgggactccccttgggtgcaaaacccactgttgcttctccaatgccagtgtgttctcccagtggaggctccaaggtgacaggacagaggcagggtggaagtgtcctcctctcatccacaagacatcaaccccccaaaccatgggccactctctgtcccttttggagtgagcagatcactctgggtaggtcccggcagtccggccttgccggccctgcctgatccctttccctttgggtcagtgcctggtggaccccaggggcttccaaccctgctaggagggagaacttgggaaggaggcgcaagatgggggtgttggcaacaccaagcagaatcctagcacagattagaagccagaacactcagtaactcttcctaaaccatctccccatcacgtctctgcccagctccatggtgttgtgaccacggagtccactcatccaggctgccacctggggatgggggggacaggtggaggacataggcccccactcccctcagccagaacctccctctcccaatcccgcccctccacactcccaccccagctgcaggctctggagcggccggccccacatcagatcaaagccctggagaacggagttagaactgtccagtccagttatgagtgaaggccatggatctagtgcaggccacggaggcagaaagcagaagagcctcccacacatgcacagacacacacggctgcccacccagacgcacccgcccccagggctcagcccggtgttttgatgtcggcagacacacccggggaagactgg

SEQ ID NO: 47788 - DNA, 1132 bp, Bovine  19866880930253
tgtttcaaggaggtgagaaatgaagatgagtccaggttgacaccattttcttcctcctctgtccaatcctaactaaacttacacgtgcaggactaactagtggagtcacacacaaatccaggcttaatcaggctcgttacagaccctgcaaaatggcgcttaatagcctgtacttcataagggttgtaatgagcattaaacgagataataagcgtaatttgtcctcggcatgatggcacacactcagtaattgtaaagtaccgcttacccccagtccaccccacctttggactacaaacgccttcagaagccttatcatccactgcttcctaacaggagtgagcactttcaaggtccccgaactggagtgggattcggctgcacctatgactgaaaggctggagtctggctgagaaaaccaaactgggcagcaaggacagattaccagccattagctcggtggcgtctgttgtttacaatgagtccccttcctaccaacgcactgagagtccaagtatatttcccaccctccaacttagcaggggaagcgcaaaggtgactgaaaacgaagaggctggcagcagggtggcccgggaggctgaggctgcggggaagtgggaaccctgcgggagtcaggcccctcccgggacggaacggccgggaacgatccagcctctcacccctctcaagcaggagccctcgcagctcaaggctggggggatttcttaagggtcccgccaccgctcctgccaagcacaagtgggaccccaggggccggcaggcgagaaggggggggccgcgggcgcctccgagccccggctcgggaatgtgatcaaagaggggtcaccgtgggaggggccgggcggcgaggacctggagagggggcgggacccccggaggtggctagaggtcgcgggcgcctgtttccgaggctcaggatccccaccgggctcccagccacccgccaagccaccccccccaactccagcgggggtccccgccaccactactgggcaaccccactccccttacctggctcggctgctcagcctgctccgaggacgccatctttttgaggcctgactaatctatcgccgtggggcgaggcttctcccaagcgccctcgctctcg

SEQ ID NO: 47789 - DNA, 1523 bp, Bovine  19866880935781
tgggccagggaaagggacccatgtggtctgagcaaggggccaggacctctggccatggactaggtgttctgagtggctggagccagggtgctcccaggctgactcctttctcctgctctcgagggctgcctgtccattctgtctgaccgacttctgtccctacctcctgaccccgggtggaagagaagagaaataagagagggcccactcagatccctgcagcctggaattcaccaatctgtctccttgaacagcaactgccacataacatctaacattcaaagccaccatccttccagttacaatcccggatcacaccatctgtggctctggcttggctctctctgagcatgctttgctgggttgtttagactaggaattctcagtcctactgccccgtaattccttcccctgggggtgggagggcagagtcggccactcgagcaacacaagtcttcctaagaacacctggctgctctctacccctgaaagcatggtgtggttaacaccaggcaaggggctgggtcctctctcagacgacacctacacaaacaacccagtccccagatgagagccctcacgcaggggcaactgtctgcagagcagcaagtcaatcttgtacagttcccaaggtggccccgttacttccagaagagatgagggccagtgatgagctgagcggcaagggtttcccattcttccagcaaaatccacacttacacagaaacatatctgacaaacgtgcagccacacaactgcctcccaggagaacgcccgttcatttagattttctttctgaagagctcttcgacccatccgttcatttccaacagaaacaagtcagaatattttcaactccccttcaatccttcccagcaaataggtggcagcacccctttctcaggagattggcagtaatgaaagcttttagaggaggcttcctacaaaaagttcaaaatgcatttgcatcaacaattgcattttatcttgcaaaatggcaggcccagggatgtgtccatgggttacggtgaggatgtaggtggggcccggaggtgttggggatgtaggccaggcagcagagttaccatcctggccctggagggctgaaagaggactgtactccatgctgccattggaactgtccctagggaagcccccttcttcaagggcagccctactctgggtctgtctccctttgaaagtgttagtcgctcagttgtgtccaactctttgcgaccccatggactgaggctgccaggctcctctgcccatggaatactccaggtaagaatactggagtgggtagccattcccttctccaggggatcttcccaacccagggatcgaatccaggtctcctgcactgtaggaaaattctttaccatctgagccaccagggaagaccccatctctttgcacttggaaacaaatccctaagtgtctctgggcctcctgttgccccactggtgaaatgggacaactccctgtgtctctctccaagggagctgagaagaagtggatag

SEQ ID NO: 47790 - DNA, 916 bp, Bovine  19866880953257
ctgttaggttttgatcaagtcatggtaaaatgttggtcatcacatgcctatggtagtaattgattctggaataattgagcacttaattaacaataaaaatcagatgcctcggtgctttctaaagatagagctggagtatgaaaaatgattttgatggggtgcctttgaagttggaggtagcttgataggatcacaaaagtattcagagcagttttgtggaaatggcagtcttataatatgaagaagtttaaagctgttgcttgtgattgttacgcttataatttggaggctgctgtcattttaacattcatctaagtattctattatcatgtgatcacctttatattttttaggacagtggcagctaccaacatgaatgaaacaagtagccgttcccacgctgtgtttaccattgtcttcacccagaagaaacatgatactgagaccaacctttccactgagaaggtaggagaacatcagtgtctgggcttgagttgtgtggaatggaggtttctgtaagcctctcttgctacctttggattttgtggaagggaagaaagtgcccttttacttaatggagggtatcttatactttatgcttgtcatttatattccactctataccagttctgagtgtgggtttttaagtgaaattgcaaggtagaaaataagaaacaaaccaagacacttgagtctcaaaaactactccatgcaagagggttaagcaattctgaagggaagaaaatccttcctttgtttgttgattggaacctctcaattaccttactaacatctttagtatatgtattttacttttttgagctctgataatattactgtggaattaaactgtttaagcaaacaagatgtgtttaattttgggggataaaaataactacacagcatttttggtgtt

SEQ ID NO: 47791 - DNA, 1033 bp, Bovine  19866880960256
aaccctctgtgttgcttttgtccgttaattcccattttgccacaccaggggcccaggcagacgagttaccaaggaacacaaaattttaattagtgtattttaatcattcaggctttccgagctaatccacatgccctagagaattcccgagatgcagctctgccctgctttaccatttattgttgagtctattataattactgttagcaggtggggactgggagatgtttattatgagtttttcatctttagtataattaccgaaaaaaacaaaataaaaagatgtcgttgtattttgtttcctagaatttttttttttccaggggagggcatggccgtgggatttttttttttttttttcctgcttcttcccaggcaggtgacttggagtttctgggctggaagatagtcctgaagatcagcagagttgtgctcagtacccctcaggctcaggagaggtgggcagtgccatctctgcctatcacccgctggaccaggctccaggggtgtccctcctctgcttccttgtatatatggaaagggtcagatgttgaggctgagagggtcaggggtctatcagttctgctctgggctggcagctccccctggtatgggctggtctggggctctaaccagggtgggcccgtcaggagtgagaacagagctttgcatggttataaatacaacagttaactcaaccctgaatattcactggaaggactgatgctgaagctgaagctccaatactttgaccacctgaggaggagagccgactctttggaaaagactctgatggtgggaaagatggagggcaggaggagaagggggtgacggaggatgagatggtttgggtggcatcactgactcaatgaatatgaatttgagcaaactctgggagatagtgaaggacagggaagcctggtgtgctgcagttcatagggttgcaaagagttggacatgacttagcaactgcacaacaacttgtattgagttcttagtacatgctaagccctgtgtcatactcttttacctg

SEQ ID NO: 47792 - DNA, 1701 bp, Bovine  19866880971956
ctggagcatcagtcccttggccctgggggtggtggtgacacactctggggaattgtatgggtcctgccttgaaaggctaagaggctctttcttctctgtccttcctcaggatgaagtgacaaccccaccgcaagagaggagcctctaggacccacgacaaggtaaggcctgagcccttctggatccttacgtccttccccctgctggagaccatgcacctggtatatggtctgagctgggcccagtcctgctgagcacccagggtgggtctggaagatggagataaggaatcggaggcacactctccatttgaacctggcaggaaaagataaccctggtagaagtgtctcagattgataggctggaaatgggctggggacctgtggatcactgactgtgggcatgaaatctgttcaaggcaacatcaggctaaggtgtcaggtgcctggcaggaccatgcacagctctccatagtgctgccaccccctctggctgctgcctctctccctggaggctctgcttgcagcttgtgcttgggaaccacacggacttgaaagccctagaagtccagtcctgcctctcctgggagctgccgccccaccccctggcctcctcctccctccatgggacgctggcagggaagaggccccagactctgagcccagagcaggctgctgtccttccttcccctggcctggctgggccttcacagactgtcccagtcctccagtggctggaggaacctcgggggccactgggcctcggccccaggcagtgccgtgtcagaggtgaccggtggaacgccagtgttatgtaaatagcggggcctgcccggcgggcgagctagctggctgcagccatccatcatccgtgcgcggcggggcgggggacagacacagcaccgtgcgcctggctccaaacctgtttgttttccctttgtctcacgcgttttgggggcccggctgtgaccggctccgggttttgtcctgctggccccctcccccgggaggatggggggagggaagagattcgcgcggctcccaccgcggcatccctttcggacttcaaaggctcccccagcattgtctgtgccggcgggcagtggccctgaaaacgtgatcagaggcggccggtgtagggcaggcccggcccgcgccctgcgctctcgctggggcccgtggattcctccctttgccgccagcaccaccctggttacagctctgctccctgggcctctctcctcgtctttctctcccctggcatcccttctggccagcccaaccttgcggctgcccactcccatcctctcttagccatagcccaacacctctctcttggcatcaggtctcctggaatgttgagagctgcaactctctgccccttcatgccatctgaagcacagtggagggcttttgggatgctaggagctgggaaggactggtttctgaatatctgtttcccatgccagccctagttttcttcttttcctccaccctcttcgggtaaggagaccctgacttgccctccgcccaacctttctttgtacttcttggcaaggttcagattggctatttctgtcctgaaagtcagccccaggtgcttccattctctggagcatggcttggcaaaatatggccagagggttaactttggccccctgcctgtttttgtaaataaagttttattggaacatagccacac

SEQ ID NO: 47793 - DNA, 1327 bp, Bovine  19866880988712
aggcatatgtattgaaatctattatgtatataaatgttttattttcccattcctcaataatttcccacagaagtaagtggatgatggtgaaaggagggggagattcctttctcatttctctttctgtgatataacacagagcaactgtcgagcctcacatggaccaggatctgggtctgctcagatggaggtaggagtaaacacatgctcaggttcaaaccctaatcaaattttaatcctccccccattagccccggaatctttcccttgattacacacccttgtttacggctccttgaatcctagatgctaaagaaaacttcccaggcacgtggtttttttggatgttaaactttaaagcttagagattcctaccaggagttaaggaaagtttctgatggtcaggattagtatcaggaagactggcaaaggctggctggaaggcattgcaaggatgttttcttctctggacaccaggggaacagactccacaaagtatgactgctgacctttcctttctgtcttccacagagctgagctcatattcgtaattactagctgagtgaagtataatgtgatggaagagtcttaatagcatcctcattttcaaacacagcagttttcagggacctgtaagtgggtcagcgcactggtggaagatgcctgcctgaaaggccagctgaccttcaggatttaaggttcttctagaagaaaagaatgcttactgtctttcagttttgcttagagccatacgtatacattccttaggattggggattttaactttttgaaaaaataaacgttatctttggctgcactgggtccttgttgctgtgtgtgagcttactttagttgtggcgagtgagagctactcttcattgtggtgtcaggcttctcattgcagtggtgtcaccaagacagcactggtgcccaggctctagggtgggtgggcacaggagttgtggtgcatgggcttagctgccccatggcatgtggggtcttcccagaccaagggtcgaacctgtgtcccctgtactggcaggagggttcttaaccactggagcactggcaaagtccagagattttaacttttaactaagtaatatctgaaggaattgaggctacattaatggcacctccaggaaatccatcaagtttaagcccaccttagttcaggggccttagaaaaatgtaaactggcatcaactgcatgttagactagattaacatgctcatcattagtaaactagggtaatttcctaccatcaggtttttggtcgactttagtcctacctggtttaattcctgggttggaaagatccactgg

SEQ ID NO: 47794 - DNA, 1264 bp, Bovine  19866880998545
cgagactcagagaaagacgcgaagtgtctgcaaggtgcaaagtctaaaaaacaaaacaaaaaaaggcagggggggcggaaaaaggagggaggcactgcccctttaaacgttttagtgcatatggagtttgatttctgaaagagatcagtttaacatctccatagaaaccagcaacagattatcatcaacacaataaataactagtctaataaattaaacaggaggcataagatcgctggaaacctgattactgaagttcaacaatattccccataaactctcgttaaccgcctctaaggtggctaacaagatgggggtggtggtgtcaatctctccaattcgccggattccggggagagagacggtggccgctgcccggaagggaaaagtttcccaccttgccctggagagagtctcagagctccagtgaggtgaaagccagaatgccgaagtttgggaagtgggaaagaggctgggcgtcagcggaggcagtgcgaatcgccggagatggcgcgggacgcgacgcccgcccgggacgcacagcctcgccgccaccagggcgcaaacccagagctttgcgctcgggcgccgaatggcccagcgccccctctgggcacgtggagcgcagcccgggcgcagcccccggggaccaactacccccctcaccacgcccggcgcagctgctcctgctcagcccggacagctccctttaggacggcgacgtgtgtgtgtgtgtgtgtgtgtgtgtgtgtgtgtgtatgtgtatgtgtgtgtgtgtgtgtgtgtgtgtgcgcgcgcgcgcgcgccgtggggtgggcggcgggggggggggcgcacccaatttgcccagcgatccgttttccagtcccctcgcgcgctctcatcgcgcgtctgtaccagcttagaggcgccctaaatttaccaactttaccctacgactaccctggcctttcccccctcgccgtccctatgtctgagtgtacgggatgttggcgggacaaccacacactctaagggtcgtggcctcagactccgccggggcagcgacgcataacccggagtcaccccttggtccagccgggtctgggggagctccaggctcgttggaggggtgttgttgctgcttcgctggtggacaagtcatacacaccgtacatgcgcccgcaccctccccagcgtgactggaaggaggtcctggccgcacccagggcccacttcccaagctgaggcggtcaggaggaacttgtgggaagggtaagcggcc

SEQ ID NO: 47795 - DNA, 603 bp, Bovine  19866881004186
aattcctttaactttgatgacccctttcttaagtatctcatttggccctcacaacgatcccgtacaataatcacagacagttccaaaagacccaagctctatcctctgacccatggcagaatcaattcactacatttcactactgaatgaagccacagggaaaactgaacattttctagaggaatagtttttctccccacagaacaaaacgaacaccattcagtgaaaagaacccacataagtaatttccacaagaaacaacagatctcaatctgtactctgttatataaacatcttcaagaagaactgaacaaaagaaaaaactataaaagaaaaatacttacgggtccaattaccagagaccaaatttttggtcctgaccagtttcttccacataattaagtaatggttaagaatgctcacctccagctgtacaactaatgctttccataggaaaaggcaaaaaaatactctatcttatttcttgttttttgggaacatgtctgttgtctgtctctcacaccaccaccagaatgctctgaagatcttgtctgctagctctttcatcagataccttaaaatggtgtctgatgaaagagttta

SEQ ID NO: 47796 - DNA, 879 bp, Bovine  19866881054952
aggaagagataactccagatttttaagaatcagaaagcaattaactcagtggaaaccatttactgtaacttcttctccatcataatgcaagttataatcacattatggatctgtctacagaaagtcaaattccttaaagtaatgtcacttctgctgaatactacaggatcgatagagccaaacctcacacacagcaggaactcaataaatgtttcctggaggtaactgtgatggtggtacccggcatgataagcagaggatcgttaagataacatttatcccctgtcttttaactgatatagcctcttccctctgtttcaggagagggatctcttttgtgtttttcaaaagcatttccgagacaagtataaacagtgattacatttgccactgagtctaacacaacaactcagagtaagccaatgctgattattttgactggagccaaaagtccttaactgggggtgattctgcccccatgggatatctgacaatgtctattgccacaactggagggaagggctactggcactttatgggtagaggccagggacgcagttaaatacctgtaacatttaggacagcccccaaccacagggaatcatctgcccccaaacagtgcagaggttgagaaaccctggtctatggaaatattctgtcccctaagcccctgagatgtggatataagtctctggccccattgtgcacaatatgcttctgactctctttgcttgtttgctgataaaacccaatatgtaggttgtcttccctcgtaacaaagtgccaatctccatgctcctgctaacaagaagttaaatcactcagtaagtattgtttactgttacaaaacgggaaataaaagaagatgtcctatgaaag

SEQ ID NO: 47797 - DNA, 1188 bp, Bovine  19866881080341
aatatattcaaggaaaaaaatctatttgttttgcccctaatctttttaattataagaggttgggagatgtctccttttccctgacaagtgactggcagataagaagccccccaagttagatgaggcttctttcgcttgatttcccatgtctccatctctggtcttactcctggctgtccacaaattgctttttaagacagatcagattgagacattatattctggcctttcagactccttagaaagctttaaggagtaatctgatgatgaatggcttttctggaactcagctgctaatttcagagaaaaatccatttttaatggtcaactttatgtactctttcttggaagtttttcaaaatgaaaaaaaaagagaagtaaatcacctcataaagttacaacttctcacaatggaaaatgtaatgatgtcaattaatctaagccagtgggaacctgcgctgtatgtataaattaagattctacaagtaagtgtgactaacaccgcagtggcagcagcagtagaccaattgcactgcaatagaccagtgtgatggctttgtgtttcaaagactggcagatggagatcgctagcctgaagaagctccctttagtgtcagcgttttctaacaagtttcctaatgactgaagatggtgagtcaatggtccatgtggacatcacagcacagggcagctgaggggcacacggcaaagcccagccctgcagtctgtcctgtacacacactcagccacagagaagagggggatccacggggtggccagatttgccaagggaagggacagctcacaagagggtgagcacgcagccgagtcagactactcaccccgctctcgtggccggcgaggccaccctctggggagagggcagtggtggccccagagggcagcagcagcagcggcagcagcaagcagaggggcagcatcttgcaggctggctggtacttctctccagctctggagctgctcatcctgcttggcagcccctgaaaccagtgctttgtggacttgagtctcttctctgcagactgagggggatattttcagctcaacctgcagctgtgtgtgtgtttgttttttttttttgtatatatgcctatctaaagcctgtaccccctctcccctcacattcaagtggtgacgcatgagcctgagcaatcaggcccacaaaag

SEQ ID NO: 47798 - DNA, 971 bp, Bovine  19866881082236
gaataagctccttatttctatgaacctcaatcttccaatccgaaaaatggaggaagtaataaactcacatggcagagttgatgagaggaatgcctgagcttatgagtgtggcgtgctcattcctgggctggggcacgtgctgggggctcagcagagaagagggggtttgtgcagtggtgcagaggtggcctgagccaaggtgtggagggaccctgaggcccttactccttcaccctcttacccaccagttgcctcatttttagccttcacttttaagaaatcacacacacttgctcattgtggagaaatcagacaacacataaagattctaagaagcaaatgtaaatcctttgccatttgagccctgtgaattaactcctgagaacatcttctggttatggatttgaaaggcagagcccttctgttccccatgggtcttccactacagaaccaggaagctggacttggttcacggcagatggaatttagggccgattcgggaggcactgtcccagctgagggggtcagcatccctgagccaggtgatggaggagaacagacagggactggctgctgcggggccagatgctgcgggagtccctgcctggggtccttggaagtggcatccttggggggtgctgaaacttgagagtggaagaagggccagtagcattttggaggacagactcttacagaggggaggatgggggaggagaaaaggaagggggcagggagggaccgtttgcagccagaaacctgtgtctgtgaggggggctggtggaatgaaagatggtggtgggctctgaaaatgtgtgtgtcagcagtgggcagaccccgccaacacttatagctgccatgcagggaggcactttcagggcgagtggagaaagggccaaatagccgggtcgagcgataaatctcatcagaacctactcacacaccgagaaccccgtctcctccagccatcccag

SEQ ID NO: 47799 - DNA, 1032 bp, Bovine  19866881136412
tttacatggaaaagtggtgtcaaaaattcaaaggagaagttgtgcagaggaggctggcatctgtccagggtcattgtggctatttcccctgtgggccctcctccagatcactgtctttctctctgcagagtctcggggtcatcccaaagaacgcatgtcagtgagccgcccgactcggggttcctggctttgcaggcggtggggcctgatgtcacagcgcgtggggcggggcaggcaggtgaagcctgccttcagggttgattaagagtggggggccgggggatgggccaggcaggtgctcaggtgtccccttgacgctccacagcagctccaggttccaggcctgtggttggaagtggctgcctgtctcaaccccacggctcccgtgggtgtggagggcgtgggcggggtgggaggtgtgatctttgtagggaggacttaggtggaaggagtagttggtgtagagatggaatttatcttcttagtttggttttaatggaacgttttagacactcatggagtagcgggccactcagtgaacccacatgctctggccacacggtgcagccgctgcctcgggcctgtcctgcccgaggttattctgaagcacattccagacagcatatcatttcacactgcagacacttcagtttgtatctgtaaaagatgagggctctcttgttgttttattttttcataaccaggataccagttacacctgaatacatgtcatgtttccctaagatcgtcagctatccaaatagagttgcaaggatgtttgttttaagggagttgtcatttcagcagagatccaggcaagcagaccccagaatgggacgcagcaaaccttcccgagggggttgggtcctcctgccatctcagcgtctgagtttggaggggtgggagggaggtgccacactgatcctcaatcccctttgctgtgactttcaggccaccacgtctaccaactggatcctggagtcccagaacatcaatgaactcaagtcggaaattaactccttgaaggggctt

SEQ ID NO: 47800 - DNA, 1639 bp, Bovine  19866881150572
aatctcccctgcacctggatcgtttgtccgtgcctaatttccatctcccgaactttatgatttgtccctcgtttgatgagcgcttctcccatcaattgtgccgtaagtgcttgcagagaaagaccccctgcactgaccccatctcagatggacgggcttgggcttctcgtcctgcatgttgggtggagataccccccccgccccctcctcagttcgtccctcaaagggcagcttaaagacgatgctgtgcccgcaccctcccacagtgatgcgaggcagagctggtcccagggtgtggctgggacaatgtgaggaggagggaagtaggaagggcctgtggctggctgggatctgggggggaagagtcctgggatgggggtcaaggggcttgtgttttcatctctgccctcagctcgctgggtgacctcaagcctgttgtgttccctctctgagcctcactttcttcatatgacactcaaggaaagtgctgtccatcttttacagttatagggagggtggagatcattcattcactcacttgtgctttcacacattcgaacatccctgggaaccgttcatctactttggaagcactcatgggacacctgctctaagcgcagactgaatcagcaggagccttgcaagctggcgcagctggaaggaacctttttggttaaaagccagggcctttgtgtccaggagatgtgggttttaaatcctggctctaacgctgatgagctctgtgaccttgggcaggtccctggacctgtcttagtctcaattccttcatctataaaaagagggggagatgagtaattgtacggagagcacctaacacacagcacatgcttgacacacaacgtccactgccgtggctgttttgtcattgtgaggacacagagggaggcagtggctttcttaaggtgcataaggagtcgggaaatgtgagtaagaggatttggagaaatgtgaagaggggaacagaagcacagggccaaaggctttagcctgggagggactatttttccagcctggcctcactggccagctgacacatttagaaatatcagatgaaccccaggaaaggggcagagaggaggttacgtggaactcaaaaaatttttttcaagatattttattttttggtcaccccgtggcgtgcaggctcttagaaccagggatcggacttgtgccccttgcagtcttagccactgggccgccagggaagtccctggaactcaaatttttggaccttacaaaggaagggtgatttcagggactgttctcaggaggccttggggtcccaaggaagtgcctgttccccaggctggggcgaagacgtggagtttaggaaattgggaaacccagctggcaggtccttccccaggcagaattacagatctgaaaggcttcccggctgtgacgtgtgtacctgtgagctttgggacactgagttcaaccctgtccaagccacggcaggggcaggccccttggagaccaagctggggaaggggaacacctagtttaatgctcaggactgacccccacctggaagaaaatggagggttcagccagcacagtgatcgctgtgcctggcattcacaggatgtccttagctcccactgtggaggccagggag

SEQ ID NO: 47801 - DNA, 955 bp, Bovine  19866881285839
atattaaaaattgccaatcatatcattttttatagtaaattgctgcccttatgcagtagaatcagctttattgaatttcgccaaaaatgcgtttataattctgcccatacacacatgatattcatgtccttgctgcccatgtggaaatgtccctttttacgatgttaaacaaattaaatcggctttctcctgagccgcctgcctcacctttaagatccactctgaggagtcgaacctttgcggagcagcatgtgcctccctcagctctaatgtcagtgtgcagaacgctggagtctggcaccataggaagccttgcacaggtttggccttgagattattacagcttgtaccaggacagttaatatatatcttgtaggctgagcgcttacacggccttatcgtaattattctgttttgagggaatggtaggtatttgtttaaaaggatctcatggtgaaccaagagtacacaggtacagttagttctcagctgtttacttgtaaatatttatcatgaaagtttaaaccagttttcctttaattccctgtagctgtactccctctccaaccagtgtgggattggggatgtgaaacagtttcattgttagtctaacagaagcacaatcaggaagttataatgcatttttaaatgaaacagtttttaatctgctttttagaatcgtttgcttcaagttttatctctccttttcatatatctattatatatattattattattattatatatattatatatatatctacataggtaaacaaaaaattgttggttcccagacagtgttacatacaaaggcaatatgacacagtggaaaaatcatgcatccactgaccatttattaaatgtacattttctttgtgtctttcttttgtgctaagcactgaaattagaaaaataaggtttaacgttagcctagtgtgattccacagtatgcgaa

SEQ ID NO: 47802 - DNA, 858 bp, Bovine  19866881319211
tttgtccccagcagctcgggcagtggctgagccaggtgaccctcccgtcggggctgggcctggagcccttgtgtttctccctggaggcctggctggcaggttctccggtggctccacggagaggctgccctctccccctccctccctctcggaaatggcagctgaaaggaaagtcagccactgagcccagggccacgtgcctccctcccggggcctccgccctgggaggctcctgagcgtcccgccccacttgaggttgacgagtgagcagactgggtcagtgggactgaccggaggggagagggagaggctggccaggaagggggaggggggaacagcggtgcctgtgggtgctgagccacctgctctgcctggtctggctctgaggtctgctcggggcacgctggctagtgaggaccttatttctttctctctctcgtgcgctgatcctttgcaaactcacagaggtctgtgcttccagttattactttcaaagtagatttccaactggagagggagagagaaaaaggtctggggaatgggggaaaccctctggctgggaagtgtgtcttgggaacgggcggagatgagttaatattccgatcaaacaattaaaaatagaaaatgctcccgcggcaccagctgctgaggcttttcaacaactgtcaccagtgggttcatggggcaggtggtgctggagaggagcgtttccacacatagcaaatatcagacacggtggtgtaccccccacttccctcccaggacccaggccagttgtttgggggctcccagtcctccttgaactcccctccagggccgggagccaggagtctgtgcagcttcagggccgcgcttctc

SEQ ID NO: 47803 - DNA, 1113 bp, Bovine  19866881393067
attaaagttaaatatatgcttgttctgggccctagcaattccattactagataatagacccaaaggcatccccaaaggaatcagaattggcagtattcatattagacaggttagaaattccaggttagaaaatattaagaatgaaggttaatttataccattacaaagttcattccacctagaagacataatcttgaaactttatgcacttaaaatattttaagtaaaagcaaaagctattagaaagataagatttaaaatcatgtaattgaaaatagtagcacatttcagaattgaacaggaggcaaaaaataagaatatgaaataattagatgacaccattaataaacatttgatgtataaatacataaaatcgtaaataaaattgaatattcagtttttcagtactcatgatccacttataaaaagttatgtaaatcggccacaaagaagaatttcattgaggtccaaaaggcagaaatcatgtaactccctttctgtgatcatagggcaataaaacaaaaatttacagtgataagccctgcaagaaaaatttgtccacttggaaaatttaaaacactctactacagaattcctttcctctactctgtttcaattttcctgatgaccttcttctagcttcttgagatgagtacttaatttattttctttcttcctttttatttatataggaattagggagaaatggcaaatagtactgtctgatattccctcaaaatagattcctaaaatgaagtattaaatcagagagtatgatcttttttttaagactgtgagtacatagcaaagttttccaaatagttgtactaattcctttatcagggtctgcgagtacatgtctcaacatacaaaatgtgtttagtctctaaaaagcaacaaaatagcaacaagaccactttctcagattgttttaatttgcatttatttgattaataacacaattgagcctttaaaataagtatatttctccttagaaatatttatccaatcctttattttctactgggcgattagtgctctacttattgatttttaaatgccctttatatattaagaatattaattcctcgtcatgtttgtaaacatttcccc

SEQ ID NO: 47804 - DNA, 839 bp, Bovine  19866881542186
tttgtcttctagaactttctctgtcgttccgaatagcattttttcctcaaggttaaggagccaaagccccaaacacaatgcccttgggggtagtgaagtgggaaagattgaactcattttaaagacgagggaagtggggctgcccaggcaggacttctgggccccaaagctggtatctggagacctcaagggctgggcctctttcagggatcaagatcaatgaatgatgggaccaaggggaaactgagccatctgggaaagggtgaggacagtcagggtccggctggggaaacccccaacccccaaatcccagacaagcagagtcatagagttgatgctgaaagtgacttcatccccactgtggactgaatcctctcgtgggcagaaacacgtggtgagaagcaggggaaagactacttggaagtctagttgataccctagctagacgggggaggcatgggccctttctagtctgaagggggagggggcatgctgctaccaccagccacgccactctacctagttcaggaagaaataaccaactttcccctggacccagagctcagccgatcccggtgggctgcccagcatctcggggggccaggcccgcaataaaaatcccgcagtggtgactgcagtggtcagagtcaaagagaaagaaggagagagagagaaagagagagaggaggggggaaaaaacccctctagtgcctgacattctttttaggatgcccataaaagataatgtgacctgtaaaatctgcaagctgcttcccaaccagtggcgcccgggccccacgccccactcccacctccactctcctgccctcgggcccagt

SEQ ID NO: 47805 - DNA, 807 bp, Bovine  19866881657444
acacacacacacacacacacacacacacacaaacacacacatatacacacagagcagcagcagataaatttatttttagaaggcagagactcaaaaatgttaatttaacaatggattagttaatgaatgaatactatccaaagttaattaagaatcttcctaattatagtctaatcaacataaaatatttttcaggagacagccttaagttctaccttatgttaaatttcagaagtctccacttccaacattttccaacagacccacagatcccacagttcctctggtgaaaattccctcacctacccttagtagacaaacctcctttaaaatcatctcagaaaagctagcaatgtgatacagaacacatcagcatttatctctgggacaaactggaggtatatcactactgcttttcttaacaactaaaggcccaggttttctcaaaaacagttaactaaaaacgtatcctgccctcaaacatacacccagtctgctctgtgttgaatgaaatactttagatttacaaataaaccactgccacctgcttccagactggaaaggcaaactctcttttgcctgactcttttttattaacatggtttgaaacaaactgaatgtttccctcattttgtaggctgttatggaaatggcttgaaaaatagttattaaaccaagttattaaacgaagttattaaaccttcagtaagaaagaggcaaaccactttcttacccgagaagggaatggcaaaccacttcagcattcttgccttgagaaccccataactgtataaaaagcaaaaagat

SEQ ID NO: 47806 - DNA, 3093 bp, Bovine  19866881742547
ggaggaggtctgcaggcgcaagagaaggtaacgtgcagtgtcactatgcggccggagaggggatcgctgtacacacgtgtgtgccaattagagaccacaagacccctatcaggccttcccaggaggtgcagtgtaaagaatccgcttgccaatgcaggaaacgcaggcgactcgggttcaatccctgggtcaggaagatcccacgaaggaggaaatgtcaacccactccagtattcttgcctaggaaatcccatgcacagaggagcctggcgggctacagtccataggatctcaaaagagtcagacatgaatgagcctacttatcaactcaaaatcacaagccagctcttacggtccagagaggacagcaatgaaaaccaggtcctcctttcctagaaacagagcaaagcaatagcgcagacacctgaacacgcccacctaacaacgtcaccggtactatgctgactcctcagtacagcctctcttttaataaaggggaaaattacccaaagtgctcatctagttctgaagacaaagaacaagattatttgcctccagcatcccaagcttagccttattagtatagagaacaggcagcttccatttaggaattttgtggaaaatacgcactccacttggttaaaaacaaaaccaaaaataactgagcacggtgttcccttcaacactggactatcctattcctccagccctggcctcgagtttcacaaaaaccaccccttaagggaccccacccccaccccaccccaccagagaactcttccttctctgaataatgaaggctctcttatactcccagccaggcaattctgcaccaaaattatatacaatttttgtactgtttgctaaaattatatacaaccttgtgccatttgctaattgtcttgcatgtaacaaataaatgcattttcttccccaaataagatatataaattacttaggaagaaggcttagctttattcttcaattgtctgttcctcctgagcacccaggagacagctaacacatatagcctgaggaacctccctgcgggggtaggggtgagggtgtagataggcccttgggctgagtgctagggggctttctgtgtgtgggtgccccatcacctctctggcaccctgtgactctctctagcctgctgccagttcgcagcagctcatcctgtccccctgaccagccacaaaagccgctgctggccctcggcagcttctctgcctggcaccctcctgccgcctctcccaagaggcagaagtagctcacacaagagcatacaactcggctggtgccctcatttaatcaggctgctgcaaatggttggccaaaagcaataagggcatgactgagaaactgtgggagtttaatataaaaaaattaataaaaaaagaggggaaggaggaagggtctaccttttaatagggccctaattacccaactcataggatcaacccaaatgagatgggagtttatttcggggtttttttttaattattgtttttttatatatatataaattgctgctatgtgttttctttcctctgagcaattatgcagcaagtatgtaaagaggggaaaaaatattaattaaatataaggtaattgtggagttggcctggagagaatgagtctgaactctggacgatcgctggctactagggtttgaagactgctcagggcctcccagaaaagaaagaaataaaaacacaagcaaccaacatgcaatgccgaatgcagcaggaaacgaacagtggacagaaacattagcagagcgaaggggccacggggatccaagcacccagtagtcagcgatgccaccaactgctcagggctccgtgctagaaagaacgcccaaaagatggtccagctgctcttctggtgatcagtagttaaatgagtagataaaaatgtgaaaagagactgaggaataaaggactgaagaggactaggagtgttcaatttgaactttagtccaaagtcaaccacaacttcagtctgaggggcactgaggcaggccccatgggaaacaagctcccaacataagggattggccaagcaaagcctcctctggctttcacaccaccaagaccacaaggaagagcccacgcaataccaaaagagagaaatgaagccactaagggagtggtgggaagtaacccatacttgggaagagcaggtgacatgcagggcaacagtgactctctccaccagtccccgcagggctggcatcacccgagccttcctccagctcagccagatccaactcacctcctgccttggaaagtcttagcacaggccggaattcagacttgttcataccagataagggcctcacgtcacctcctcccactacctccagaaggagagggaaggaaaacgggtaaaactacaggccctgctgaaacaaaagcttggtggtatatccctaagcttgctatcactattcaataaaagaaaaagctctgcaaagttaaacgtaaagctggcccctctggaaaactcatctggagaacaagtctttttttttttttggctgtgacacacagcctgtggaatcttagttccccaatcagggactgaacccaggctccagcaatgagagtgcagagtcttaaccactggactgccagggaatttccagtacagaacagggcttaatattcagccaagaggatttgcagtaggccttgaaatgcaaaacagaaaatggggcaggcactcaggctaagaccaccaaggcaaatgcactgtgtaaagaaaattagcttcagcacttagtaggcctcttccctatcaattgtgtaagcagagaatgttggtagtgagcatcacaaacctaattacaggccaggcagaaacagaactctctctcttatctgttctccaaaggccacttgaagtgtcctcactctgaggaacagaatggctatttcagacaatcaagcagctcagctccttggtcaggtccagcaaccttgcttcagctcagccaccataggtttctggcatcccactgattaacaataaataaaacggtgcatcaccagaccaaggatgggtgctcctcattccagaaaagac

SEQ ID NO: 47807 - DNA, 800 bp, Bovine  19866881744173
accaggtgaatgtgcagttgaggcaggggtcacctagcatctcccccagtggtgagaagtcacgggaggtgtggcagggaaagatccaaatcccagaggataaagaggtggaagatcaggccaggtggggagaggacagagccctaatgagcagatttcataaaccacctggagtgaaaacaaaaacacagacgtgcacattgcccaacttcagggctgtatggaaaaggggaaaaaaaaacaataaaaaaatccacatcttaatacaaaaatcctacacgatgtgttgtggcacgaaaatgtttttcattgcatttttcatctgtgatctcacacagcctacgacgggtacgcccaacgcaggaggtatctgatggtacataaacagggcaaacatacatacaatgaaccaaaacaagggcagcaaagattcaggttggtccgagctgacatcgcatggtttcaggtggcctctggagatggctacactggctccaagcatgggccccccttagattcctgagggaggaataaatggggcaagaacaagctccagtggaaagaaacatgtggagttctgagcactccgaaccagcggaactgcgggccagctggctgtgtggctttctccactgagggtgctgtcccgccatcgacagaggccggagagggaacgcacaccccaaaggcccctcctgtgtgtcacttaccccacagttactatctgtctcctgtttgctccacccctccccccttttaattgttggatgagtttacagagctgtgtgccaaaaacaatc

SEQ ID NO: 47808 - DNA, 853 bp, Bovine  19866881907491
cattaatcctagggaaggtgatacaagaagtcaatggcaccccactccagtactcttgcctggaaaatcccatggacggaggagcctggtaggctgccgtctatggtgtcgcacagagtcggacacgactgaagcgacttagcagcagcaacagggaaggtaataaagtagaattaccatcatcatttataaaggaacattaggtgttgtgtgaggttattttggtagagggatgcagaaaaaggacagaaacaaaaacaaaacctatacctacaggtcagaggaagagaagatggcagaagactcacccattagaaataagttggtttcaaagagcaaaatgctgaaattctagtttagcccagatccataagcattatataaagtacataagcaactgtactgaacgctgaggaacttgtactgaaaagagtgagcagaccgtaaatgaaaccatattgacagctgcttcaaataccctcaacttgtatgactggaaggactctaaggagactacttaacccctgtttctgtatcaaagcaaggaaggaactctatgcagacaatcgtccggccattcttaaaggtttatcaaccaggcaggagcacttgatcctcgcagagcagtgtggggaccagcccagagcctctgcgacggcttgagcatgtgcccacataggtgatgagaaaacccaggtctgcaggaaatttacaggttttgagcacgtctgggagaagctagaggtcagtactctggagctttgtcctggaaggcaaagctcagtgaacaaagtgtaaagaaaaagtaatcagccattttaactcctgggcaaagagttctgtcattaacaat

SEQ ID NO: 47809 - DNA, 2045 bp, Bovine  19866880518970
ctattaaatgagcagaataatattgttgaaatcatttaataacataactatctttctacatgctttatctcttcattgttgggttcagagtaacatatctgcttttttaagtttctccacaaaaagagataaaatgtaaggtggatagaatatcagactatacagaatgaaaataaacagatacctagatgttgcccaatatacagatgcacaatattaaatatattcaattgaaatgttctctttaacggagttttgttttgaaatgggaaggtgggggtaaacacaagtattattgctgtactgattatttaaatcaaaagacaatgtatataacactataattacataaaacatatactgttcctcactgtttagtcagtataagcatagacacacatgtagtaagtttaagaatgtatgtatatacatgcatatgtccttgtactgaacagattttgccatggaaacattctttgtattatcaattacaattcattccctttccttagagactctaggtactgtactatgctggcctggtggataattcaagttctttggctgaacatctgcagtagtcacagggaaaaagcatatcccatttagagttcaagagcaggaaccaggatattattattttttaataaaaagataaatttttgtgaactctagaaaaacacataagtcatgtcctacattaggaacatgttaggaaagcagcgtcctatgtaactgcgttagtaatgaaagcaagttttattttgaaaatttacatacattaagctctctgctctgggctttaaatgtgttatgtcacttagctctcacagtaatcctacaatgtagattccaatactatccctatttgcagatgaagaaattgaggcttagaatggtttagaaaagcaaagcaatgtagttgtgctgatatgttggctttttcttttaaagaacatttttttttggtaacactgtaaaccaacatttcaggaaaagcaataaaatctgcatatattgctagaagaatgccctcaccactgtgctagcatccaacatttatgagcactcactatgtatttcttaagtttaaggacatgagtatgtagtttttgtgttacatatagcaatgcctatctaatcagtagcttagattctttttgctctacagcagtcaaaatagtcatttctttgctttatacatattaactcatttaattttctaaataacccattattactcagattttacaaatacggaaacttcaatattaagatggcaagggctctgtacaatgtcacagggctagaaatcatggagcaagtactgcaggtagacagtctcaggtatgactttccctcattaccattaccatgcttctctacaagtgtgttctgacttgaggaaaaaactattataccagcagagagatccctagcagagagattgactttcatatattaatttttttaattaaaagtatattgaaataatgtttattgatatgtgaaagcaaatacagtatcaagacagcaaaggtttttagctagttcttttcctttataattcaaagtttattaaataacacatatatgtcctagttttaaaattctttcactgaaaaaggtaatgattttcctatgctctgctttcaatatggatagctctacttttgtgtagaaaataaatcatccataatttaccttaatagctaaattattctgaagtacaaacaagaatcaggaagctactctgcatggatggttttgaaaaatgtagtaacataacattaactgacaatttgatatacgagcatgtgtggagctggagattttaaaaatcaccgtaaatacattggattttagtaaaacatatataagcaaataaaatgaaaatctagactgtgataagcccacacattgaatagaataattgcatgacaacatagtgtccaagtttcactaatccatatgcttaatttttaaactcatttcaggtggcttaagagaaatggaacacggtcttaatagaatattagtataat

SEQ ID NO: 47810 - DNA, 782 bp, Bovine  19866880530775
tagcaaaccaaaagcaaaaggaatatagagcaatactcactgacagtgtatatcaaaacatattttcaagtaggctgaaaaagtctttggaaatacacactcttgtcccccagagaagcttctaaatatcctgtcttctcagactatgaagtaaagatattgagagttgtagcatagataatatcaaacactcttataggaaatcgtgcagtttactgtaagctgtttattgtagtaagctgtttattatttatataaatctagtaactgcaccattattctatgtatgatatgttttcatttgttatttttgcgctaatatatttgtcaatgtttaatacatgctcaaaaatatttccaaaatatttatttaaaaataattgaaaatatttgatatattgtgtgcaccataacaaacaccaaatgaccaaattttcaattttacttttttagtttctgaagtattttatggtttgttgtgtttcagcagtttatgggcattattaatgtttccaaaaataaagcagggttaggtatactcattattatataacaaatgacatttttgcttgctaagaaaatttttcatggcctagaaataatttattaatagtgattcaaataaatttcagcatgccatattctgtcaggtttctatgccccattttattttctagtccttaaaaatcagttcagttcagttcagtcgctcagtcgtgtccgactctccaaccccatgaatcacagcacactaggcttcctgtccatcaccaactcccgga

SEQ ID NO: 47811 - DNA, 1368 bp, Bovine  19866880538077
actgaaactcaccagacataaataagcatgtttttaatctacaaaatcgtttatcaaatcttagctaaagtattcatttttatgattatattttaaccgatatcccaaacaaccccctgaacacagagaatgtgggtgtgacttataaaactgcttgcagagatacagttaaattgctgtgtgatcagggtctgattgggtctgattatgaaagctctctttaatgaatacaaatgctttgctagactgttcaaattccttcttatattattatgtattcactataaaatgctcctttgtgagacactgaaaaacttcatctattttcttttcaggctcaaatgcatgaattttcagtttaaaaaatgttaaaaataaatgatattaatggactttcatggtttcttttaaaaataattaactagtaggctgagacacaagtattcaaacaattggtcataattttatagtatcaagtatccttttatcaaatagcttacacagcttatctacacatatataggtcaaatcatactccacaaacaaaaggttggaacactaatgctgattaattttctttgcatttgaagaagaatatggactttagctaaacttatctttctagtccataaactatagatttatgacacagaatataaggtaataaatcaaataaagaaacatatgtgtctatggtcaacaggattgcaatcctagtgggtcaacttgatattgttcagataaagaagaatcacagttagactgtttttaaatattactaataaaagtgattcacatagacctttactatcagtgattttaaatttaccaatttaacgtactctcttttctgtaaactttacccatccctctaagatccccatctcgtttggactttggaggaaattactcctcaagttttatacccttctctagtgaattattgaggtgcattcacccctaccttcaaagggatgaatgcacctacattcttccaagtcttgattctaccacctagaatatatctagatttctcatctctgccctaatggttgtcctccacattggttatctccacataatggttaccctaaccactgctcaacaagaacttctttccgggaatgaatagtaataatatctagaatgtaagttgttcacaaaaaaaataggataatgtccatttagagcactcagctcagttactgacaagtaagaactcactgcactaccagtgtcttccttcctctgattttcctttcaagaccagactttacaaataaatgtctagagctatttcatcagctctagatcaattttttttcatcagcagttttaaatctgcttcactaccccagttctacaaaa

SEQ ID NO: 47812 - DNA, 1003 bp, Bovine  19866880553459
cctttccttggtggcagcactggagctgtatttcctatatgctgtctaggtcagtttatcagtaccacttactacatcatatttgtcttaaatcaactataactcaaaaaaatcagtttaattaaacactgacaccaaattacttttaaaaacaatgtatgatctaagtttaaggatcattttggaagttgcctcagagtttcacttaaaatgaacttcatcagaccaaaacgaaagcagcaagagtgcatatttttcttctatgtattttgcaataagcaatcttaaagaaccgagcctaaaagagtttttattagaatggcctttagttagaattctgtaatgcagaagacatggttcaatcccagatccggaagatgccctggagaagggaatggcaacccactccagtgtctggtctggagaatcccatgagcatgggtacagtccatggagtcacaaagagtcagacatgactgagtgactaacactttcactttagttagaattagcaaatgatttctgtctagctagtaatagaagtgttgtagttgtataaattttttttttttctgacactgcaagctaacatacagaccaaatagcaaaagaataattattagtaggatacagtaaacccagaggcaggaattcatataaagtggacatcaggataatagagtgagagttagctatgtagccaagaataattaatagagcaaatacagaagaatttaggaatgtaataagtaaacagaatttcagtgtttctgatttttcccatgagcttgaaataaaagactacataaactcccatttcctttctactgaagtccttttgttctcaatactactgaagtgcagttatcaagacaaacaaacaaacaaacaaaaaacacttctttttcctgattatcacattagagcaactaggagctgacatagtagggctggttatccatttggaagagtttgctcccagctgggttcttcacaatttaat

SEQ ID NO: 47813 - DNA, 1078 bp, Bovine  19866880648364
ttttgttatccatgaattcaaatactggcagatgtgtttttctatcattagtgtatgtatgtacgtatgtatctatctatatgtatatatatgtgtgtgtgtatatatatatatatatatatatatatatatatgcttttatactttaggagtcggacatgactgagcgacttcactttcacttttcactttcatgcattggagaaggcaatggcaacccactccagtgttcttgcctggagaatcccagggacgggggagcctggtgtgctgccgtctatggggtcgcacagagtcggacacgactgaagcaacttagcagcagcagcagcagcagcatgagttgacaccccctttgggctttcctggtggctcatatagtaaagaatctgcctgcaatgcaggtgacctgggtttgatccatgggttggaaagatcccctggaggagggcacggcaacccactccagtattctggcttgcagaatcctcatggacagaggagcctggtggctacaatccatggggtatcaaagagtcaaacatgactgagagactaagctcatgagttgatacagttttattcgcttcccaatctcagcaaaaatatgcacatatacatatgctaagtgaaaaaattaaaaattaaaagaaatgtattaatgaaagtggttctctccaatttccagttttgtattttgttttagctcactgaaatgctgccagcagagtgattttacttttatatggcaaatccaggtttcacttaccccaaataactccacaacttttatcccttacacttattttttgaacaacatgtttctacattactccttaaaagattagaaaccataggtggttataaattagaaatagcacctcctatccaatttttattggtttaatagtttatattgatggctatttcttcataaaactagagggggggaaaaaaaaaaaaaaactatttcatgagcaaaatgacaccattataaattagagtcccgaaaactgcaccgctttcttcaaactcaatgttcttttaaggcaatgatagctccctaaggaatgtccat

SEQ ID NO: 47814 - DNA, 1931 bp, Bovine  19866880900144
atattaatcacagggattgtgactttagtaagatgattcttatataggtggtttatgctttttgatactcaggcattgaaaaataaactaagccttaaagatgtcatgtttgctcacactacgtttttatgattcaacttttcattttggtttgttttgctgtctttccttaagggctaaccattgctttacccagcagggagaagagagctcacccaccaggttccctccaacttgcactgatgagctcttggggctgtttacattagccatgcaaatttgaaaaaccccaactgcctcctggtgtttaaatctcacaacccaatttgtttctgaggctggtgcacttagcagctgtgccacagagctttgcccatccctaagacaaaagctaagaaataaaaaataaaagactaggcaaaataccccaatgtcttagacagatcactgcatcgaaggaggtaattaatgaccctgaacagtcacagccaacctattttcagttataatcaagatgaaaacgtatgtgtcaggtattttccggaaccggaccatatgtataatagtcgctcacaagcacactttgaaaagttagtaatgacaaaatgtatgtgcctaagcaatttcctccctccccatcaacaatagctttttcttacagtttattttaaaacatctgtttctggcagatttaagaagatatgagtttggatttttaaaaatcccactgctgttaaaacaacaggaaaaagaaaaagtacatatttatgtatgttggctgaaaatgtccctcagttgagccgtttctgaggaaaagtgcctttaacacaagtctcagagactatgggggtgtaaataaaaactcaaaaaatgaacatctctgagctttaaatctggaagtgagttggaactgacactgctattacaaggaaataaccttggagtctagtattccattctgcatttagcacactatattagcatatgtataaaaaattccctgtaagaccctttgcaatttagccttaatctgcttctcccttcatcaaataaataaataaataaataacgtcaatacatttcacaatgtttttcaaaaacatagatacctttgcattgctatatgccatagatcattattcatgatgatgatcctgccttgacggcgtcctcattctttaccttttagtcttacttttatttatttttaaatttattatttttaatttgtattgaagtataattgatttacaatgccgtgttactttcaggtatacagcaaagttagttgtacagatacatatatccacttattttctcatatgctattgctaagtcacttcagtcgtgtccgactctgtgtgaccccatagacggcagcccaccaggcttccctgtccctgggattctccaggcaagaacactggagtggattgccatttccttctccaatgcattaaagtgaaaagtgaaaagtgaaagtgaagtcgctcagtcatgtccgaccctcagtgaccccatggactgcagccttccaggttcctcaatccatgggattttccaagcaagagtactggagtagggtgccattgccttctcatataggtcattgcaaagtatggagtagagttctctgtgctatactgtaggtccttattatctattttctgcatcagttcagtacagttcagtcgctcagtcatgtccaactctttgcaaccccacccaccgtctatggggtcgcacagagttggacatgactgaagcgacttagcagcagcagcagcagcagcaagcctccctgtccatcaccaactcccagagtttactcacactcatgtccatcgagtcggtgatgccatccagccatctcatcctctgtcatccccttctcctcctgccccaattcctcccagcgtcagggtcttttc

SEQ ID NO: 47815 - DNA, 2254 bp, Bovine  19866880926421
ttttgcttaatgtctggaaatttttatagcatgccaactgggtaactgaactttaaggagaaggtaggaaaaaagaatcaacatgagtcttcaacatcaggctcgctgctgctgctaagttgcttcagtcatgtccaattctgtgcaaccccatagatggcagcctaccaggctcccctgtccctgggattctccaggcaagaacactggagtgggttgccatttccttctccaatgcatgaaagtgaaaagtgaaagggaagtcactcagtcatgtccgactcttatcgaccccatggactgcagcctatcaggttcctatgtccatgggattttccaagcaagagtactggagtggggtgccgttgccttcttgtcaacatcaggcttactgcaacacaaatgactttaaataaatatatttagaaatagcttctggacaatgattccttccatacctaagaaaaatattacttcaagctacaacctagcttgaagaccattgcttggtttctttcttgtattttgtctgtgtattgcagaatctaactagttttattttccctcctgagatactcactcatccacacatacacacaccaacactcccacacgtgaaggctttttaaaaatttgctagtcattttctttcaaagtagaatagatcatagattattaaaggcaagtatcaggctatgccttcaaatatcatttgtatagacatgggatttattatatacctaatgcaaccaattgaactttgaccattaagaggtattttttgtgtaggccagaataccagcatttttatcctggtcctgctactttccttctgttatatataggaattgctacatgactttcagatcctctatctagtgactataaaataggcattataataacctttatctcaggtaatgtttgtgaatattaaataatttaatacttcaaaaagcacttacaacagtatcaataatggaatcagagctcaataagcattaaaattcttcttaagctctctgtcatctccagaataaatttttacctggaattagaacaagttctcctatcttctgtcattttgaatctttcttaacttccaaacccaaattaatactaacatctcttaagtcttgagttttcatggttctattcttccatatccagttcttcttgtaaaagaagagatttttggattgtacactccatcttcaaattactcatacttctccacacagttttctgatacataacgatggcaagtaggaactctctacaatctctctttgtacatcaaatagtatccaaggtaagaaataggcccttagctgaatttcattataaatcacaatagatttttctttaacaataatttagaaagatgttttttcataaatgtgtaaaaaattgttactgaactttagatcatagttatcagattgtgttcagggccagcaagtaccccagatcacatctttcatgaaatttgcaaaagaagaacaataaaattgttcaaaattaaataattaaattaaatatgcattgaatttggtgttttagaggagtaaatattcaattaaatcacaataataattatatttttaaaaaacctgttatatagcgttaatgtaaatgtggagagcttaatgacaaaaacaagtctaaacaaataaatcagattaaagaatgattgctacaaaaacatgtggtccactcctgatttccaccaactcacttgaaatgtcattcacctcaacatcttcagaaacttagcacaaatatctttgctctttaatttacagaaaaaagcttaaggcagccatttattatgaaatacatttcctagtattttaaatgattcatagcatacctcttttttgaaaagcaaaaatagcaagctaaacccagcagttccagcacataaatcatcatgatagcaataaaaaagggggtgtggaaatgttgactgtgttctgcagaacatactggtggagcgcagcttggtgtgcagagtttgaatggactaatcacatcatttttatattaccttaaatgatgcattctattaaaaaatgttattattgcccagaccatttcccttcataaaatcctgttcttctcatggtgctaccataaaatcttgattaaatgaaatttcagaggaatgattatttgattcaaaaaggtttaaggaaaagcatccctgttaaaaatattttaaaaatatataattagtgtcatttaaaaaatc

SEQ ID NO: 47816 - DNA, 718 bp, Bovine  19866881044645
cagtggtttataagcttttgtcccataggtaagaaagggcaaaggaacctggcactatcctgccttgtgcatagcactgtggcttctctgcctcaagtctgggcacaggaggttttctgtggtttcctgctgtgccctcaatccttcccatgtacatctgttgagattcgtgggggagagcctgctaattggtgataatttccactctatctgtggcttccggcagtattatcttcattgtagaccatacgctacttgacttccatcaacttacagaaaacctgatccgaattcttcctagtttttgtgacactctatctgccctaggtaaacaagtgcttatatcccatctgaccagcatgaccaaacttaggcaggttttctggtgactctaggtccctgaccttgcatttcttacagtgtttactttagaaaacttttaactataaactatttcatctctttgagatgcaaatcttttaaaaagcctcttgccagttttacaacccaggaatgtctttctcaaggaaattagagtgctccttctgaaatgtattcatcttgaaagatagtgtccctgttccccaatctctgtggaagagtaggagttagcctatcttcagtggatgttttgccccaagtcgcaaaattacttcctgtcataaaactacgtgaagtttatttttcctttgtgaaagtgaaagtgttattcactcag

SEQ ID NO: 47817 - DNA, 1887 bp, Bovine  19866881055382
ctgtggtcctagtgtgattagattgactagttttctgtgagtatggtttcagtgtttctgccctctgatgccctcttgcaacacctaccatcttacttggatttctcttaccttgggtgtggggaatctcttcacggctgctccagcaaagcgcagccattgctccttaccttggacaaggggtatctcctcatcgccgcccttcctgaccttcaacgcgggatagctcctctaggccctcctgtgcccgacccagacttcgtcataaattctgtttgggaagatattccaaatctaactgaaatactactgtatttccaagactcctttatcaatacaaaggaaatgagcttgatggaagcacctgaagaacagatgtggattctataaggggaaagggtactgatatataatgggcttggcaaagatatctatagagccatatttttgttgagttatctctcatttggccagctagactctagagaggttttgtgatgattttcccccagcacttatttatagaggccttggtgagctgccatactgaatcttcctgaaacagtacttgaatatatctggccacataaaatcagtttcagagggaaaaaaagaaaaggtttttttttctaagtgtcaagaaatatatttcttatttgagatattttatagtaatattatgatacattttatcacatcaggaggtaaggtgtctttcaaatataaaaaacctccttaaaatgaaccacgtgccatgtaatgtattttgatgctacatttgcaaagcctgtctaatagtgtcaagaaatctaatattactgaaacagaatgcttgtaggaattatgagcttggatattaagtgctaagaactcttcagtttaatgaataaaagaattatcttgtcactaagagaataaattcaagccaataagcaccatacactgtaggtctgagtgaaaataattatttcctttgagaaaatcaaaatagatcctttaaaactgtaacctgcattagattttttttttttctaaatcctgcatggatttttttaaacacctttccaaagtagtctataatttagtttttatacagttatagtacaggtcattaaattaaccatcatttctgccagcacatgcattcagtaaactgaactttttcctgcctatcctagacaaagtatgtggtcttctggaactttttaaaataagtgcttttttggaactgtttaaacaaatttattataggtttaattccttcagagataagaatttagagaaatggaaactatatcaaggagtcacaggagtctatgtttgtaagattatagctgtttccacttatgcaccatcttgcaggatatattatcaacaagatatgacaaatttaaatgcaactgctgaagcagatcggactagatacaaattggtggtactttaataactggatagttagatttagcaatgggtacctgtgtgagccaatctcccaagtgtgcaccaaagggtaaagggaactcaaggaaatgaaccaggggattctagaaaaaatactctcacctatactaatggaatgggttcccagatggctctagtggtaaacaacccacttgccaatgcagaagacacaggttcaattcctggatagggaagatcccctggaggagggcatagcaagccatttcatcattcttgcctggagaatttcatggacagaggagcctggtgggctacagtccatagggttacaaagagctcccaacagctgaagcaacttagcatacatgcatactaatagaatgttctggttttatattgctaggcaatctgaaatattttttgttgtattaaaagttggctcttgctggtgatatatatcttatt

SEQ ID NO: 47818 - DNA, 837 bp, Bovine  19866881149744
agtgcctgacactatattaatacaaatacaatgatactgccatttcattaatacatcgaacataataaaaatagagtaaatacagagtaaataaattgaaaatgtgagatattgcattattcaagaaaatggcaatactgtatgaagaagttttggggaacaacattaaattttcaagggaatgttcatttaattcttgcactgatcccaaaataacaacaaacaaacagacaggcagctgtcatgaagctataaagtatacttcctcctccaaatacttttatgtggccaatggaaactttggaataagatttaattctacttctgacaattcatttctctcttaatggtgagaatacacagaatttatcaaacctgctggactgattccacatctttaatctgaggccatgtctagaagaatgattgctaatgtaattcaagcagcaaaaacatatttagtcaagttagacatttgcataatacataaatttagacatagccaaaaaagagattccaagcctgacatcccaatatggatcaataccattatcatatttctaataaaaatttctcactgaggttatatgatccataagaatttaaataaattaacatcacaagtaatgataaattcaaaaaagaacatttagattgcaggcaaaagaaccttcatttatttatttgcactttaaataaccaataatacagctgacattatatatatctatttttcaatgataaaaggatatttaactaggtcacattacttttacttatgaagcaatttgagaaagaaaaagaagtatgttaatttaaaacggcaagtctattctg

SEQ ID NO: 47819 - DNA, 1354 bp, Bovine  19866881174967
taagcaacaatagtaagagaacagtgggataaaaaggaatgttcatagattagtgagatttataaaaaatagatgataatgatgataatcgatactatttattctgacaatatttgttgaatgtttaggttacttcatggttggcatagtgctaattactttatattcattagcttaattaatccttctaacaacctgaagaagtagctatgatcattcttcattttacacatgagaaagctgtgtctcaggttctgcttcttgtccagtgacactcagtggaaaattgcagagctcaaggtctaacccggatctcacttgctagaacgttgattgtgcaatataagacaacagacacaatgaaaaatgtcccctatccaagaactttgttcccagcacatatacaaggcttatctatacattaaatacattaataaattgacctttatttctatgtatcacacttgctgtaacagactattctttgtgtgctccaaaaatccttagtaaaggtaaacaccagttgatgaaaagcttcataatttaagtctaaaactttgtgtcattaggcctctcatctcttctccaaacacagtaaaattttagggaatattttaaaattagtaaatgttgcccagaaagaatgatataaaaatttgtggcatatgagaacaccacttgtgggttttcaaaagggcattacataatctgcaggaagtgagctccctgacttacgaatggatctgacagaggtcaaattacagtttacatgtctgcccctcttaagagaggattaactcttataacattaacttctctttatcatccacaaggatatgtcattccctaattgttaatagtggaacctttctcaactaagtcaaacactacttgagaataagaataaaacagtaattgcattagttttctatcattgccataacaaatcactagcaatttagcaacttggaaaacaaatttatctgacagggtctgtagctcagaagtccacatggactcagcaagtatcacaaggctgaaatcaagcagacagcaaggctttgtttgttactggagtcaaaagacagtgagtcactcaggttcttggtacaaatcatttcctcacaactataggaccaaggtctcaatttgcttttcttactgttgcccaagggtcattatcagcttctagaggccacctgcattttctcgtacctcgttcccttcaatgccatcagtgttaaggtgaatccttctcatggttcaaatttgcctcacctctctctcatctcccctttgcctctgttctcctctgaatttatctacctctattgtttccatctgtaaatgttca

SEQ ID NO: 47820 - DNA, 1673 bp, Bovine  19866881279880
actaagttcatacttgtcttactttccctatgtaagtgatgcttcccatataaagtgatacgactgaaccctttggaaacgttatcgtgatcatttgaaaagtaaccagccaatgatcttatgaccccagcataattgaagccgtcagctattctttgtccaggaacaaggccctggatggttagcagaaggggcgatgaggtggctcggcctcacattcaggctgtcaattagactgcattaaggaacacttttagcagggttaatgccactgctagagaaaggcaggcatctgaagatagccagtacttagaaatattctacattagaaaccaacttctccatggatggaagtcaatgtatttatctcttactctatggtaaggtcatggctccaattacaatgtaaaaacgcatgaattctgaatggttttcctttgctgaagaccacagatttttttttttttttcttttcctgactgcacactaaagatcaactttttaattgtctgggtcagatatgtgggaaatagctattatattcttcccttccacagtaaagaatgagatctttgaataaaatcccttctgaaaaaatggaaaaaaaaatgtggagctctgttgcactgcagcaaaatttgtttttcactaagtctctatattttgagaggaagggaaaaatccatcactgttaacactgataaatgggtagaattttaatattcatatttctgattcaattacagttactgtgacataaaaggagatggcaaactattatgttactttgggatatatgaaatccatacaaaacccataagggggaaaaatattcttagaattgttattttctttaaatactccaaaaatgttctagtgcattatgaaatataaaatgaacttattttaaattctcacttcatttgaagctaaaatttatctttgtcaatactgatctgttatagagatagtaggagatcaagaattcagggaaatgtattattataattgtgaagaaaaaatttaaaacaaatattcacttaccaatgttaaatttactgatatttggtgttggatgcaataaaagggctataaaattaaaacgctttgttaaaaaaataaattatattgttcaaattttcataaattaagagaaataatagtttcagaaaataaaactttaagaaagatatgtaaaacaagcacaagctttggccccaaattcttctcggaaatcaaattggaagctaccaatgccaaaattcaatgcatcagtgtatcagaagtctttctaataaccacaaggatatttgtcaaaagaatgagggacttggaattagacaacctggatttgaatcctaactttgttcttgctagcttttagaatttggacaaataatttaatctacttaagcctaggcatctcttgtcctaaaataataaaacatagcacctaaacaatcctatcatcaactgcttatttggctgatggcttagaattgaaatgtctggaaaacatgaccaagcattcattttatagattaactctagtttcttcagggatataactgtttatttttatggcccttcttcaaattccaattcagctgtagcactgttccaaattactgtcaatagtaggatttaaaacacaccccagattttcttagaat

SEQ ID NO: 47821 - DNA, 845 bp, Bovine  19866881613869
ttttagttgcttaacagttttactgacatgtgacaatttaaaaaaatcgtttccttataagataagttaatttatttgatgcctatatcgacacagatcatataacttcaccacaaaaatgggtaaaatgattaaagttaataacacactcaagcgtaaacatttgtcagtcactatatgtcacactcctgtatgaattattacctatttactcatagacacctgaagtagaattttcttgaattacagctcccaaactccaaaaattctaatgatttttgttatttaatcaacctaagcagtgataaggcagtcaaataataaaacaaaataccaagagctttccagaacattactgtcacatagaagttagacatctcttccaaatctaaaacctttacatttatgacagttgcataatcccattttattttacaaaaataaatctcttgcaccagttcaattttacttcttttatattgcacaaatgaacagtcttacattccactaaatttttgacatttaatgtaataattatcttctattggatatgtgattagtaattcacagttttcaaggttctgattgatattgaacatgcatcccattataatttactggaatcttttcaatagcagtgaatcatggtataaactagctttgtttatttcaagggcatttttctaatacagaacaaaatgaaattgaaaacaagccaaattttaaagagagtactattttggtttcgtgaactgcattccttgaatggtacaagtaaaatgactgtctagggtgtaacaaatacaatgaatcaggaaaggtgtcttagtcttcaggatttccta

SEQ ID NO: 47822 - DNA, 979 bp, Bovine  19866881723546
cagacataaaggcaaatgtgcaaaaggctgctcatatttatagcaatactgacacatgatcaatgttatactccacaaacatgatgacataaattatttagaagtaatgacataagcataataaatcatgctataaatcaccattttccacattgcatttgaaacgttgttactgtggaggaaaattcatgatgtatcttatctcatgattgatatctaatgaataaaggaattatttaaaatgcttaatcttaagagtctctaaaatcaacacttaatttactcataaaaagttaaatcttgtattatcagctaaaaacatcagaaagttccttaagtgtttacttagttaaaataatgaatctctaattccccatctgagaatatggtatgctatgctatgctatgattttttggataatcccacacactcttaacaaataaatctaatttaagggagatggacttacttaaattttcggaacacccacctcaacaagaaattactctatggccacaaaagtactggaaaacatcataggctgtctttcctgccttctttggactttactacagataaagttgtctcagtagtatctttaaaactatcaacctagacctgcccccaaaatgcttcttttaattaaatcttctatttttatatagcataattatctaagcagttgaacttgacatattcctactattaaatttattaacatctttgtgatgtttattattgttctttgcatatctttagggaaatttctaaaattctggtaggcagagtcaataaattccaagattttttacacaaggtgatttacaataaaggggagtttttagtcccttgcaataacaaaatagaatactgctgccacttctggaaatgaagaagccaaacaaccactagggtttctgtaacataaggaaaagaaaggaatagtagaaggatcacattaaactaagagacatatag

SEQ ID NO: 47823 - DNA, 2696 bp, Bovine  19866880159078
cgtgagtagttcttgactgactaggtggccaagtattggagtttaacttcgcatcagtccttccaatgaatattcagaactgatttcctttaggatggactggtttgatcttgcagttcaagggactctctagagccttatccaacaccacagttaaaaaccatcaattcttcagggctcagctttctttatagtccaactctcacatccatacatgactactggaaaaaccatagctttgactggacagacctttgttggcaaagtaatgtctctgctttttaatatgctgtctaggttgttcatagctttttaaaattttttatttaattagaggctaattactttataatattgaattggttttgccatacatcaacatgaatccaccatgggtgtacacgtgttgccaatcctgaacccccccctcccaactccctctcccataccatccctctgggtcatcccactgcaccagccccaagcatccagtatcctgcatcaaacctggactggcgattcatttcttatatgatattatacatgtttcaatgccattctcccaaatcattgccccctactccctctcccacagagtccaaaagactgttctatacatctgtgcctcttttgctgtctcgcatacagggttatcatttccatctttctaaattccatatatgtgcattagtatactgtattggtgtttttctttctggcttacttcactctgtataatcagctccagtttcaaccacctcattagaagagaagcaagagtcttttaatttcatggctgcagtcatatagataataatttaagtaatagaagcaagtaagattggcaaagaaaaacatagagaaagaaaacaagactaggcagaaatggaaaaatcaagaattttacccaaacctaagttatttccagagaaacatgaacaaaattgcctagatagtaatatggtcaaatccaggggacaaaaaatgcaagatgacagtattgtttaaaattgtcaactactactaagaagtaaaaagcttactgcagagaactgaaaagcaagcaatagaattggcaattaggagatttattagggaatataaaaacaatattaaacctgtacccatcttttcaaggcttataatctatttagaaactggtacattatgaaatatttcaattaattccattaatatctatttgaagacccactataagctggaaaatataaaaatataaggccaaagttaataatgcaggcaaaaattattagagtcctgcagagcaatcctaatatttgcttcagtagccaaaggaaacccaatatgatcagcacaggaattttgacctggtctgttttccaacctggatcagttcaccaccccctcccaactttagacaacaggtggttcccagctccccagaggtcatcatattactgctgaacttaatgccaacacctaatcacacctatagcccagaactcctaggttcaagcgttccttctgcctcagcctcctgagtagctccgtatacaggctgtaccattctgcctaacagtgaaagagaaaaccagataccagttattaacaagttcatggaatctagaaaaatggtatggatgaacttattagcagggcaggaatagatatgcagacatagagaaaaatgacttgtggacacaggggagaaaggaaagggtgggaccaactgagagagcagcactgacatatatgcactaccatgtgtgaaatagatagctagagggaacctgctgtatagcacagggagctcagctcagtgctctgtgatgatctagagggaagatagagtggggggagtaggggtgggaagggatatatgtatacatacagctgattcacattgttgtgcaatagaaatcaaaacaacattgtaaatcaacagtcctttaattaaaaaaaaaaaaaacatgaaagaagggagaactatgattaggaagacaggagtaggaaagacattctgtcaggtacaaattcataaacagaaacaataatggagcttttgcctatatttcaatgaaagaattccattgtatttcttcctttggaaacaaatatatagaaaagtaaaaagaaaaaaaaaaaagaaaagtggagagaagcagtatctaaagaaataaaattgaataagctttagtgatacattcataaataatccacttatcttatccaatgtgacaaaatcaggaatcattcaaagaacagtatggccattaatgcagttggaatagagtaatgcctactttaacttcatttttaaagtatattttggtttattggataaaaacatttgagtattatgcaatttattatccaaatataaatgattctattagtacaaacaaggtctccaaatgctcattttctgaaaagaagttcagcagtcctgtttatgtgagggtcaccttagtggtgaattatatgattttattgccttgttaaatgtaatctatataatcatgtaataaatcatagtgaatatatcttataaataatacagataatcctcaaagctataaaattaaaattttcttgtaattacatgatacattttttgatatatcactgaagccacactgtagttctctttggatactaaattctaaataaaatgcttttttccacccagagggaggtaggggagggaggaggga

SEQ ID NO: 47824 - DNA, 1556 bp, Bovine  19866880410101
ttttttaaatgtcaagggagaatacaactgtgcctcaaagcataaaaaaccagtgaaatattttgcaataatttctatggttaggatgagtacaaagagacttggagccctaaggaaggagtaatggattctggccaaggtggaggagtaggagttggtaataaaaagacctcagagagaagatataatttgagctatgccttgaaggataaatgaattccacagggttaaaagagaggaaataatatttcagagaataacatgagcaaaggcccagaggaactagagagcatggctaactcattacagtgttagaaatctttggggcctagaatatagggttcttggaagtggagttggagaaaagtttacaagaaacaagtctaaaagagaaattagagctatgagtattttcattaagaggttggaatttattatatacataagggggcaaagaatgatttaaataaagaaaaagtcaaatctatatttccacaaaaatgattcaataagcatcactgaggttgaattcaaagataaaactattacaatagtgtagctaataaaggaaaaatgatggtttggattaggggtaagtcatgtcaaggatatttttgaacagaagaatttaaggatcattgcctatggagggtgtgaaaacttagggacagccgaatagccaaagcatcattaaatgaacaggaaatacaatgaagctgcaagaaatgttcactttcaagagtagcacttgatttctctgtaaagcatcacagatagatatacttaatagatggctgggatatgggtcaggagaaatctgagaattggaaaaatataatataaaataattggagagtaatacaaggtactggggcttccctggtggctcagtggtaaagaatgtgcctgtcagtgcaggagacttgcagcagactcgggttcaacccatagattgagaagataccctggagaaggaaatggcaaaccattccagaattcttgcttttgaaatcccatgaacaaaggagactggcaggctatgggggttgcaaaaagaatcggacaacgcttagtgactaaactaccactatgaatacagggtactagttacacaccctgaatctagtctgcaacctgtatctgtaacctgactccaacacgaataactgcatcttcataacatgtgatttaatctctcattttcctactctgtgatatggaaacaatataggaatttatacttttgggtatggtaaaagaatacaaattaattttctagaaactcaaagcatttcaataaaagttactcattattatcttatcagtttagttcaatcactcagtcgtgtccgaatctctgcgatcccatggactgcagcacatcagccttccctgtccttcaccaactcccagagcttgctcaaacttctgtccactgagttggtgatgccatccaaccatctcatcctctgctgtccccttctcctcctgccttcaatctttcccagaatcagggtcttttccagtggagtcagttcttgactgactcaggtggc

SEQ ID NO: 47825 - DNA, 1501 bp, Bovine  19866880558566
cttaagggagatcaccctgaatactcacgggaaggactgatgatgaagctgaagccccaatattttggtcatctgatgcaaacagatgattcattggcaaagtccctgatgctgggaaagagggcagcaatgaacggaacattcattgcatcacagaagcaatgaacatgaactttggcagactccaggagatagcgagggacagggaggcctggcattctgcagtccatggggttacaaagagtcagacacaactgggtgactgcacaacagcaacaacatctaatcttgctacatttctttccacttaactctgcacatttcatgagaaaactaagattttgcttcagaacatagagtatgtttcctgtttgttgattttgctttgtagcattttgtcaaagtaaatcatacccagattttatgctgagtcctgaaagtccttctagaatcactgaacatatggtggtggtgggtacctctgacaattagataataataaaaataaaagactggataatctgcatagtcttgttggacagcaatgtatattttgttaataagccagattttctactgctcaaaaaatttccgggcttccctggtggctcagtggtagagaattcacctgccaatgcaggagacacagatacaatctctggtccaggaagatcccatgtggactggagcaactaaccagtgtaccgtaactattgagcctatgctctggagcccataagccacaactactgagctcacatgacctggagcccctgctccgcaacaagagaagccactgcagtgagaagcccatgtactgcatctagaaaatagcccctgcacactgcgactagagaaaagcccacgcaacaaggaaaacctagcacagccataaataaataaataaaattatataaaaaatctggctgtcaaccatgctaaatgtgacacatttaaaaataaagaagcaaaagtttccatgttacagaataaccttttggagaagatatcagcattcataagctttttatttaaagcgaacagcactttgggtaggttgcctctgtgggacaaactcataaattatgagaggaaaacgctctcccctgtgacctagggttctcaggccaacaaggcactcttccagactccagtttattcatctgagatgacaccactgggaagattcacatcatcattaaaaatgtgtttgtgtaaatcttaccaaggctgggtagggattaaatgaaagcctctgtatgaatctcaaaatagctgtgccaacttttaacttcacacatcaggatgctactttattacataagcacttggataaacacactctctcatccatatcaaacatgcctttcaagcacttctctttgaacatctcttctcttaactccaggtggcatgaagttcagtcaaaaacagttctgaagaagggaaagaacaaaatacatctcaaaatacatttcaaaaatatagcactgcagaaaca

SEQ ID NO: 47826 - DNA, 1642 bp, Bovine  19866880766120
ctagagaaaactggattaccttttttttttccttgaagagctgctttgtaagtggttacttcaaaatgtatatacctgtttttatcttgatattctttatccaaattcaatgaagttgtttaaatcttacttaataagtaatctatattattattttattttttttctatattattttttaaagttgtgccttttgatgaggttttaactctagcctttcaaaagtcttaatctatagaagtaaacaaatattttaatttcaggtaaaatgtggttaccaaattagtttgcagactaattactattcagtcttgcaactattaggctctggttcacaagaacaaaaagagcattcatacagagtaaagtaagtcaaaaaggaaaacaaacattatacattaacgcatatatgtggattctagaaaaatggtataggtgaatctattttcagggtggaatagagacatagacttacagaacagacatgtggacatggggagacgggatggtgatgggatgagttgtgagatttggacacacacgatcatgtgtaaaatagatagctagtggggagctgctgtacagcacagggagcccagctcagtgctctgtggtgacctgaaggggtgagatggggagggtgttggaaggcggctcaagaacaaagggataaatgtatgcatatagctgattcacttcattgtacagcagaaactaacaacattgtaaagcaattatattccaataaaaaaaggggaaaaaaagaacattcatagaaagaaaacctgggttgtcatccagccttcatttctaaagagctctgagatcttaaatacttcatttatctgttttcaattatctcatttttgttaaatggatttactattgttacaaggaaaaaaatttaaaaaccaatgttacactaaattagttgtcatttttatctttctcctggagacaactcagggtcctgtttgaatacctgggagccaggctgcctgagtttgccatttctgaaccatcagcttgggccaataacctaggttccctgtgcctgtgtcccctcctctgtaaaacaggggtaacagcaacagtatccatctcattgggctgtcacatggactatgtgagaagcacttagagcagcactagcacgcggtaattcctcttccctcttgtaacacctgcctattatctactgctataatggcacagatttactaagaagcagccagttcacaagttttgtattacagctggaaataacttgagagagaaaaggagaacttcaaagggagaggactcaatccatgcatactttcccccactgtcagaaatgcagtgtctgctgaggattaagtacatgatgtgggttctcggggaggcaggtttggtgctgtaatgaacaatcacacaatcaatacagacctgggagaggtaatcccgacctctgctttacccactcctgatacgctgagctctcatcccagttctcaaatattgcttcttttccccccacccattaaatcaataaaagcttcaaaaatcttttagagctatagatttaggctataaaagtttcaaaaaatttaaagcataattatagcatcaagaccatcttgcatccaggttttaaccatgt

SEQ ID NO: 47827 - DNA, 1435 bp, Bovine  19866880783462
ttgatgcttttgaactgtggtgttggagaagactcttgagagtcccttggactgcaaggagatccaaccagtccattctgaaggagatcagccctgggatttctttggagggaatgatgctaaaggtgaaactccagccctttggccacctcatgagaagagctgactcattggaaaagactctgatgctgggagggattaggggcaggaggagaaggggacgacagaggatgagatgactggatggcatcactgactcgatggacgtgagtctgggtgaactccgggagttggtgatggatagggaggcctggcatgctgcaattcatggtgttgcaaagagtcggacacgactgagcgactgaactgaactgaatctaataattgaaaatatacacagagagattaaaagtcacacaagaatcaggtttttaaaaatgcccaaaaaataggagttgatacgtaatatcacactacagaactaaacttagctaaagacacattattgattttcttaaactacaggtatttttaaaagtattgagaaattaacagtttataaaaataaggtaaaaatttcaggtgggagcagaaagttaaaaccatgttgtactttggcaaaatcttttaaaatgtcatgcccttaaaataacgtcttatgagattgttcttaggccgaatcatacacaagataactttcaagccatttcactttgttttcgtcctcatattggcttcaaagttgtccctgggggacaaaattaatctcagttaagaaccattgctggggcttcccgcctatcaaatcaggagacataagagatgctggtttgatccctgtctcaggaagatcccccgaaggaaggcatggcaacccactccagtattcttgcgtggagcatcccgtggacagaggagcctggtgggctaccatccaaaggctcacagacttggacacgactgcagcagcttagcacacattagcacacatgcacgagaaccattgtcacctacgtttgtgcgtgctcagttgctaagtcgtgtctgactctttgtatccctatggactgtaccccgccaggctcctctgttcatgggattttccaggcaagaatactggagtgggttgcccttttccttctccaaggtggtctgctcttttttgtatccagtggataccccaaagtttgctgcttaaaccaggtagtgtatatttttattaatttttcctaaaaaccctttgatgaacaaagccttcagataacacacacacacacaaaacacacacaaattctcaggatagaaaaatcagcacttttttttcttttagaaaattcaggtcagcctgtgtcctctggtcaaggagggagtcagccactattgccagaaaacgaaatgaccatgaattctctcatatacaatcgagatgcattca

SEQ ID NO: 47828 - DNA, 1117 bp, Bovine  19866881055581
aaaagaaagaaaatgttttccaaaagaactcaacccttatttaagtaggcaaagatttttaacatgacatattgaacaagataatctttcttagaaaatgaaaatcttttgtaaatattaaacaagacttacaatttccaactcctctcaaataagaacaatgtatttttgtcttaaggatttctattggtaaaagtaagtagatcaaaccaataaaagaaaaggattaaattcctctgactcaaggtaatgcaactgttttcaatagcaagtgaattgagtttaattttgcttttgcagggggaatgatggcttctcagggaatttcaaccttttacaaaacaagtatagcacattcaacaaaaagaatatatacttatatctccttatttgagatttctgtacatatcattaactccctagctgaaaatttttattttgtaatttcagaatcactgtacatagacgttaactctcatagcttttcagggctttattttcttatttttagagagcacataaaggaataaagatgaaatgaactaaagatatgtccagagttcgtatcatgctgctgagagttgtacatattacttcttataattcagattaaatgtaaaaaaaaaaaaacttcctcataatgatttctttgatgtaaaaatattgataaaaaaagaagtactggatttcttgctctgaagtcttctaaatataggatttttcttagcaactgtatataaatggccttgttgatgaacaaggaaattactggatcagtccctaaagaaataattcccttgatcacaaaatatgttattacattataatcccaagggattccagatgctctttcctgattctgttagagctaccatcccaccataaaaaagaaaattatagtttaattattacggatgtttgttttaaaagccacttattatgagatgttgcaacacagacagaaatggttgactggttcagtttttctttgttttcttctcacaattatatagatagcatgagatcaaatctaaatattgttatccccacttccctcaaataaaaataaaattgataagaagagtatttatctgttcaaagggaggataatcattct

SEQ ID NO: 47829 - DNA, 966 bp, Bovine  19866881093479
taggtattgttatattatttcctattacaagatgagaaactaaaacttggtaaaggttatgtgaagtgaagtgaagtgaagttgctcagtcgtgtccatctctttgtgatcccatggactgtagtctaccaggcttctctgtccatgggattttccaggcaagagtactggagtgggttgccatttccttctccaggggatcttcctgacccagggatcgaatccaggtctcctgcattgcaggtagacactttaccctctgagccaccagggaaagtttatgtaacttaaccaagatttattcagctattaagaaacccaaagtacatttcagtctacatttgaatctactctgattcaaagtaattcagacctaaactcaactgaacaaatatcaagcaaacaaacaaaaccagtcaaactccatctgttgatctggttctaattttctcatacaatttgttaacaatttgcccaacatttcttgagtataacaggttatgaatttagtatatttcctaaatttaaatctatatattacagaaaatggaaccttttggcttctcacattcatctatggagaaaccctacttactaatttgttacaaagagaagaggccagtttcccacagagacaacatatgtgattctaggcatcactttatgcagctgccactgtattagtggaagaagttaaaaagtgaccattactctgtttttttaattaagtcagcatacacagggtgattattgacttgcattttatagaaagttgcattacccatcattagaatttcaaatcaatgtaacgtatgtttaatatatatgatgaggtgcacacacttggcatttacttctcaaatgaaatttaagcaaacatgaaagaggtctgcagcgttattcaaaattaattaagaagctttctgactacagcgatccacagttctgtgctatcttcaggtgtac

SEQ ID NO: 47830 - DNA, 1419 bp, Bovine  19866881133258
tgataaacttgctccactctggaatatgaaacttgtggataggaggtcaaatttctcttgttagaaaaagaataataatagctcttggctgtttaggttgaaataatatgttttctctgataattaatctgataataaaaagctgtggctagttcttataagaggtaaattttgcagactaagaaaagctctgtttggtgttaacagttcaaggttgaaataactttatgctgatgtagcaagagctaattcattagatttcaactaaacaaattggtagtctgtgaatttgagatgaatttgatgtagctggtgattttacatttaaatatataataaggtgaaaaagaaattgctactatgtcttattttgctttggaaaaactgagtttgaacaagctggtctcaatttgagtcttgaatttcatgctgctttatctaatttcaagaaaaattactgacccaagttcattggaggaaattattttccacaccatgagctctttttcagactattgttcaaatgaactacaacaaggtaaatgtttttcaagagaacagaagtagagcactggagagaaaattagtaatttttctattgtctataagtgaaaatatatcttttaattatgaatttaactttaagaataacttgatcacatttataaatatgtccaacaaaagagttcaatttagtttcaaagagctgaatgatgaacattaaaaagccatttttgacaaatgtttggcataaacattcgcatgaaattcttgttattttttcggcttttggtctgattctgctggtaatctttgtcatgactaagcaagctacttgaataatctttctattacatgctctcatgtttaaaatcagcttatgccttataattaaaggagttttacatctgatagctatgggtttgaatttatataagtccattatttactagttgtgtcattttaaatttatttttaagagttaaccacttttatttcaggtacttttatgtagcagagtaatatgtttaactattttacagagatataaatgcaaacatgaaaaacattgacatatatggtaattctatacacatagtttttgttttttgtattctgctttttttgtataacaacatttgtaaatatgtctttcactagatatttttcactagatattcactagatatatttcattagatattcactagatatttcactagatatcttttttaattgctaaattaagttttaacactgtatggacataccataatttactagattgattccttgtttttggacacataggtaatttcttacttccccccgcccttcagctttattgagacataattgacatatcaatataaaattagtaagtttaaggtgtacattagttgttttgatatgtgtata

SEQ ID NO: 47831 - DNA, 2136 bp, Bovine  19866881159871
ctggatgtagaagcataaactagtacatttctaccttttcacaaaaatataaccaatatgtacaattattgtattaaaaatacaaaagggatacagactccaccaatgtctttctaaaagacatacaggtacaagtagtatcaaaagtatgaggaaatcaccagttaattgtacattctgcacttgacatcacagagcgaactgaggttacagtcctatgttctacggtgacttaatgcttagataacatttgtgcaacttgtgtagagcgagagttctgtctttctatatgcacatgaggtccatagcctagagaagaaaactggcaaataatgcatcttacatgtaaaattacaaatgcatcattgacaatgtaatacataagcaagtagacagatgccatgatacaggagagaatcattaaataaagcactgacattgctttgatacagtgaaaaaacactgcaattcgacttttaaaattggaagctatttacgtttatctactgatcaatatgatcagctgaatttaatggaaaaaaaatccaagaccagcagttcctcacatctgagtactactcggattggcagccttcacttttccggagtctgtgcaaaaacaacacaaaaatagagtggagggttcagtccttctggggttaatagcagctgtgagcaggtggttgctacactcaggccttctccatctcagcgtccgtaaagccacttacgggtcagtctttggccaccaacctgccttgcaaaggctggcggatcgcaccgggttttggacctttttgatctttttcatgttaaaggctcgtgtgttccctcgtgccgatcgatcgatacagggaggctgtcttgaaagagcagtatgaacggctggcgttagtgccaacaccccaagctgctttcactgcaatgctatccagttataaacgtttctctttaaaaacaaacaagagaagccctaaagctaaatgaacagaaatcaaagaaacataacttaaaaaacagggggtctgccgtcggtctcgatggagcagggcacgcccaagggtgacgctgccctgtgctccataaggctcagacacaggacgctagggtcccagtccctccccggccatgtgcaaacagtttgtacagtagagctccagcccctggggaaggaggggcgggagccctggaatctaggtaattggctaacatctcatgcttccaggatagggcacttctgggggcagccaggacacaggaagaggggctgtgccccgcctcctctcttcctggtgtggccacaccctgtccggcatatttggtttttgagaaacccaggctggcaaccctacttaaaggttcaaaataatactgtaatcattaaatggatataacatttactctctgaacacaatctttaaactcattaaaaaggaaaaaaaaaaaaaagaggacattgtaaacaagcggacgagcactgtactcaaaggatttcgtttttgttttccttggtgggttaaaggccccaagtagttccgtggctgacttttctcacgattccaatgaaaccaagtgctaggactggattgaaatctaaaagggagatttttaaaaaatccttcccggcgtgggtaagtgcagccaggttgaatcatcggtggcgatgaccttggaatctggaatgatgctgtgttacgtggcaggcagcgacggggagctcggagacggctgcactgtgcattcaagcaacgaagtcggaaaagtgccagggcggtttcttcacagtatttcacatgcaaaggggacaggaagaggggtcaggagccccatgctgcttttaaggcaggaaaggaggcaaactggtccaccatcctcagagtgtgagttccaaggctccgacgctagggggcgtcttcttgtgctctcctttgggcggtttactcgggtccagagaagcccgcacctcaaacagcagacacttgttcatcttctgctaaaacaaccgtcaaagaaagaaggaaatcaatgagtaagcaagtcattttcttgtgcttagagagaatacattcaccgatatgctaaataaaaacaccatagctgttttctaagtctaggtcactatactgcagctagtcg

SEQ ID NO: 47832 - DNA, 1858 bp, Bovine  19866881254887
ttaaagagcccaaatttaagcattaatttacttaatgcttaaatttgggcttcccagttggcgctagtgataaagaacctgcctgccaatgcaggagatataagagacacaggtttgatccctgggttgggaagatcccctgaaggaagacatggcaacccactccagtatttacatctagatagtccttcacaaggcttccctggtagctcagctagtaaagaatccacctgcaatgcaagagaccctggttcgattcctgggtctgaaagttcccctggagaaataataggctacccactccagtattcttgggcttcccaggtggctcagatggcaaagaatctgcctgcaaaatggaagacttgagttcgatccctgagttgggaagatcccctggaaaagggcatggcaatccactccagtattcttgcctagagaaacctcatggacagaggagcctggtgggctacagtccatgagattgcaaagagttagacacaactgagtgactaagcacacacacacattccttcacagagcaattgcctaaaaagtaaaataaaagacttggccatcattaaaaaccacttaaacaatctgtggatagttcaggaaagtccctgaataaatctctcccctaaccaaacccctgaaagaaaaaaagaaagagaaagtgagagaaggggaagggtagaaggaaggcagtgaaggagagaggaagagaggggggaaaaggaagaaagggagtctatgaaaatttctatttgaagcattctcatctgcaaccatttcatttatgcatattaaaagataaggaaacagagtgaagattaaagtacaaagagaaatatggattgattgatggatctatttatttataatgcttaatttagagtaggagacaaacatgaatgcaaaagatagtaaggtcttctcagtatttctcccactttgacaaaattgttgtgatggaagagaacaacaacaaaatattgtgtactaagagtgaatttcagctttatgaaataaagtctattaacttacagatgttatgtcagaaatagctgtgtagatatattcaagagaactgaactatgttcacataaaaagaaatagtgaatggtgtttttctaaatgtgaagccatgcaggaccctgcttttcaatactaggaaatctgcaaagggactgctgagatcaatgtaattatccagaaggcattactgaaatagattttaaatcctttgatgtaattgcttgctgagtttgccattacagcagctctatccttttgactgattgagggcctttaacagctcaggttttactgagactgccaacatactcatgttggaatcttaaagttagacagatgtttgatgtttaatttaactaatatggcacaccttgagtcaacaaaacacattttgtgttaatgtgaaaacaaaacaaaaggtgagggacagaaatgcatgcagaattaatcttcctgtttcagcagacaagcctttgcgctttgacttattaacatgaattttgatttgaaaaccctatggcatttttcctgccccttaagaggagcagtcttgattccattggagtatttagaaccagaactcaatgaataaattaaaagtgcataaaatccccaagcaaagtgtaaggaacattgaggtgaattgttttttcttatggacagtccctattttccatgactctttgaataattcttattccttatgacacttctctcttttttccacaacttcttacgacaaaccataaagtaccttattagcttgtctttagattcactctcctcctgaagaaagacagatttgaccaaagcattttat

SEQ ID NO: 47833 - DNA, 874 bp, Bovine  19866881262435
tttaatttactggtgcaggtaactcactgagaaggcatttaaccttaaagttaatgatatcagatctattccacagtgtatgtgcctccaattgctttctacagcactgcacaaactaatattacattctcattttagtagtatctgtgggcagaggggagacattatcctcaactataacctgtataacacgtttgccaacttcagctgccttcagtttcaagagctgtaggtgaggaaagcaggggcaggaccagatgacctcagagagtggattcaaggagaaacctctgagagccaagagggagggtctgcttcagttgtgtctatgccagagaagcttcattttgcctttccatatttatacaaatgccacctttaggatgtgcaggggggttttgctggtgtatggagatgtgtttctaaagggggatggggaagactacagaagtactagacatctttggagaatttaccatcatctcagagggggaagtcctttctaatcataattttaaaagtcctaagatttttaaatggataaatttagctacctacatagcaaataactgcatggcaagattcaactagcaaagtgaaaacatgaaaaactggaagaaaaatacaaccatgttataaaggtttatctctcatttaatatagagagtttccacaaatcagcttcaaaagtctaatagcaattagaaaaatggcaaaaaatatgagcgcatagttcactttcaaaaagtaaatatccctcttgaataaatgaaataatgcccaagctcattcatagtggaagtatgataccaagataccagtatttattatcagactagcagggacccagagatttaataacatgctgaggtga

SEQ ID NO: 47834 - DNA, 1421 bp, Bovine  19866881281647
tgttctgagagttaatgaatctctagtgtctagaacagggtctggcatttgataaattttagttgaattaataaattcactggggagaggctaattaatttcaaccaaggggcagtgaagaccttggatgacatccgggaaatgtgactttaagttaattagaagacattcaggtggcattgtcaacatggtgatatgctacccagatcctccctcgaggaaagaccagctccccagctgcaaggaaagctttcaacagagagtctgcagtcatgagctgcttcaggatctgcctccaacagccagaatcacactttccctcacatggcattgtacatctactgtacaaagtgggagtctaagaatatggtcattcagagcaactgcaggtctcttctgataggcagtaattgctctgaagcatcccattgagtcagctgagattttctcagcctgaaccatgatccaacatttctctctgcccaagcattcttcctctcccttcctctcataggtgtcaatgcttaatgataattttacacacttaactctgttctctgcatccacttctggagaatgcaacctatgacagcagggtcatgctccagagaaatggacatgtcaacttggacttgaggagagaggtcttggcatggatgccttttagggagtgatcgccatacatggacaccaaaaccctatgaatctgtacttttttaacagggagaagaactgtgggaaatgaaaatagaaaacagaaatagtaagaaagaatctgaagaaatgccagcacttaaggatgaaaggagagtccacagtgtaacacactgacccgggaagataggatggaaaagcatataccatattttcacttaggtgacattggtatccttgaagagaaggatatttcaattactgtattatgaattgtgtgaacaagaaaaggggatggttaaagatattctttacattcaagaactttggacaaaaggagagtattgctacaatggcaacacataggtaacaagagggacatagagaagagaagaaaaataccagcaaaaggcaggcatgtcagggaggagagatggcagccaagattaaaaactgccacaggaaaggaggtgacagtcactgccaggagtgatgtgtaagagaagagcataatgccggctgcaaggattcaggtaaaacaaaaaaggctaaaacacctatgtaaagttgacataagcagtagcaacctataggaagaacacatttagaaagcatgcactgtttcatcctatggaatatacctgagagatttttttttcctaaaaatgaaaaacccaaggagctattcaaacaggacattatcaagccatggaaagcttaacaggctactgtcctactgttgcagacaaaaaggtaatattttgagg

SEQ ID NO: 47835 - DNA, 737 bp, Bovine  19866881312126
tagaacctgttgcatgtaatcctctgcctagcagactgtcaataaatgtgttgagagcaaataatatgacaatgtaaatcacttatgtgacacatatataatgtacttctctgagctggttttgacactgtatacgttgggcattgatatttcattatttcagaatctttttctttgcacaataaagtgttaaattagttttaagagtcttgaagtcaaagaggtttgaggatgtttgaaagtatagtaccgtgtctggagtattaagtgtcagtagcaagagggattatcttggctcatggttgaactatttttagctgcaatattgggcagtgtcagagtataaagaatctccttaatcagagttgtcgtttcaataactacacagtaccatgaatttaggggcatcatttgactcactgtattttgactcaaattaaaatgaaaaaaaatcattgtatagttaagtagtttctgatgatttgtattttgtaaaaaaggcaaaacaaaacaatagttaaacactcaagctactatcttaaattaatgaggtagttctggctttaagaatttttggtctgggctctttccaaagagaatgaaaatataattgccaataaaattcaaggaattttgtggttggaaatatatggtaaacaccttctcttagctggtctggaggttaggtttctaagaaatagagtactaggtaattttttctcggcaagcattaaatt

SEQ ID NO: 47836 - DNA, 723 bp, Bovine  19866881366497
aaaaaatctgaaaaagaagagatacatatatatgtataactgaattactctgttctacaccagaaactaatgcaacattataaatcaactatactttaattaaaaaatatagaaccaaatttaacacatgcaggctaagtagaaaaacatttagccatttcccacttgcatttcacttttcactagtttgaggttgttggttggttgttgttgtttttttttttttttttttaattcttcttcttatcagaaagctcctatttttcttgaattcctgccttcctttgaccattccttccttgcctctaccatgctgaaatccactatgctcttactttcaggccattcatgcacatctaaggcacttctgttctgcctacaaacaggattttgctaacatgttctccttaggttccacccattattgcaattattgctcaatcttctttctgcctctacttcaatgtctttatagagttcactacccattcatttttctctcaactttttcttattccttgcttttaggagaagaataagggaagaagagttgctattgttggtttttttctttttttaacagaaaaatccatttttatggaggatttggagttgctatttgatgtacagccagatagagtgcccttttgaaactggatggttttctatataaaagagcacacaaaagtacactttctaatgaagagcatcaaaatctactaa

SEQ ID NO: 47837 - DNA, 905 bp, Bovine  19866881480320
taatccttgagtcaggaagatcccctggagaaggaaatggaaacccactccagtattcttgcctggagaatcctgtggacggggagcctggagggctatggtccgtggggtcacaaagagtcagacatgactgaaaagacttagcacggatttctattcagataagagtgatgcagaaaacaaagtcaagtgcaaaagtcacagagatacatagattttgtttgctgctgtccattgaagacccctctgaggagcattctggggtctccccatggacccacaggtcacacagcagagactgtcagggaagcgatggcttgccagacctcttagcggtgcgcaaacatcccagtgggtgcagcctctcgctttgccgctctgcctgggaggggaatgagtaatgtgatttgaattggcaaaaaccatgattttcactttaaaagggatcttttattcttgaaccaaagccaattgaaatgccccgagcctgggcctttttattcagacaagaacaataagatcaatttccaagagaaaatgaggaaaggggagagagagatggcagctgaggtaataggctgtaaaggacaaagtctgaaattaaatattatggcttaaatagtcctgcaattcaaaccaccctgtctctctcccacctccacacccccacaatcttgcattaaagaaataaaacaaaaaactcgtcacagcaaaagggaagacaatctttttttctaatagcagaaaattctctctgcgacatgaatttgagctatggcgatttgatttctatggagataaagaggcagagaaagttagcgctgtttggaacagaatggaaatctggggttgaggaggaacggagggggaaggaaagctcacgcgtgctgccttattaggatggg

SEQ ID NO: 47838 - DNA, 1104 bp, Bovine  19866881498355
atcgcagcacgccagggcctccctgtccatcaccaactctcagcattttattaatgaaaaattgggatcataagaatgaactactttgcttttataagtgtatgattattaaataccagatgtacaattgataataaaaaataatatatttgggataatgaaaacatgaaaaatttctgtttgaagatagtctgaatatattcaattcacttgtggcatatagaatattgtcctttttgtatgtattattataaatgttcacataagaatcagggtaacctcccggttgccttgccatgttctggtatctgtcttgtgtgtttttatatctacagtcaatgaaaaggaatgttagacatatgccacgttctgtgatactcatcctcatataataagaactgcaatattagttatatatgaaggaaaaatacccttttccatttctaaatatgaactctcagtgttaaaggtcaatgttttcttaattcatttttagaatgctttcataaacatttcccagcatgactactttcctgaaaggtgctgcctcctgaatttaggaaggacatgattcattgaaatggtaatttaccaaatgttcggttattgtatctgcttatcaatattccttttagaatgcctgcaggagatgcaatgtctcattttctagtcccaagggacatcaggcaatttatgcataataactatctgttacatttctctaacacagtcactttgcttgtaaataataactgtgttttacttataggaatgtttaccaggatattaacaatttgttaaagccctgacatggagaatgtaaaataatataattcaatttgaaaacctataatttcaagtgatgtagttttaacacttttcttagtcaaggtaggataaagcaactttcctgtcagagatgattggataatgtgatacattacctgattaccaaatgattctgggaaaacaacccatttctctatattaatctgacttgtttagtgttcttcctctctctgcattcagatgaggtgctcaacacccacctaattcttttttatgtgcattggctgtttttttacaacatcattttttcctaaa

SEQ ID NO: 47839 - DNA, 1029 bp, Bovine  19866881501243
tcaggcatcttgccgggaaaggttccatgggcagaggagcctggcgggctactgtcccatggggtcgcaaagtgtcaacatgtctgagcaactgagcatgcatgcaaacaccacattgttgtcattaaaaggttactgtgcttctgggccctgttactgttggggagtcactagagggaggagactgtgttgctctatcacagctgccttcaagtctaggtggaaatttctctccattctcaggagcctgtttgaacagggataggagacacatcaattcagttgtaaaggatctgtaaaacaagccaggtgaaaaacagcaggcgaattacagactatgccctggagaagatgtaaaatggcgtgttagttttatacaaacatccaaggggctggatgtctgcaccacagccccagacttacagaagcaggatggatgaatgttatccacaggaaagcagatttcgaaccaacgaaggatgaacacataacaacatatagttcaaatcataatggttttaagagattgtgagctcttatcactgaagtttccaatccttacatcatccatttatttattcagtcaacaagtaatgatttagtgccttctgaatgctctatgtaactgtttctatttaactccctagtgtcttccctcatcactcatcctttctattatcaaaccaagggcaccgtgacctttcattcatcatcagaaacatccattctctttccttcctagaatactctttgcctttcttaattcctagtcatctttcccaagatactttccctgatatcaaaacctgaataaaatcccacatccctccagctttattgaccataaactgacaaaccattaaattctcccattatgtgtgccagtcaatgagttttaataaatagatgtagttttacaaacaactctcccatttggctttgaaatgtttctgttatcccccaaagttgtagtatatccatctggaaggaatctccattactagaaccaggacaccattgatatgcttt

SEQ ID NO: 47840 - DNA, 1525 bp, Bovine  19866881742411
acagagattggagaaaagaaaatattgggaaggctgttattgcaatgaactcctaactggtctctctgcttccattcttgaatcttcaatcaattctcaatacaacagtcagcatgatcctgtaaaaacagaagtgaggtctcaccgctaatatgacccatccaaatagctttctctttcactcagagtaggagccgaagttaccacagtggcctaaggcctgatgttagctgccactcgttcttgctccattacttttctcttttcatcccctactgttgtttcccaaactcactccactccagctatactgttctcttagttttttatttaatttaccagacacactctctcttcactgcatttacacttgctggtctctgaaatgcttttcttcaagtgctcactcaatttctcatttaattgtatttatcacttaaaaaaaataaaataaacactttcttggagctgagaatgcaaaaatgaacaaaacattataaaatcactgtcttcatggagcttatatataatgaggtcggtaaaaaagaaagatatatattcatactttactactttactattactttactatttactagaaatgtaaataccaaggagaaaagataaagaaggaatagagagcagaaaatataggggatgagaagtacatggagaaatgtgaaacagagtgatcaacttctacaatgtgactcaagtgttaaaatttcaatgaaactttctctactctattatttaatattgcaaagctgctcgctgacaaaagcttttaatatctcttccctgaattattttttgctatagcaactctcagagaaggcaatggcaacccactccagtacttttgcctggaaaatcccatggacggaggagcctggtaggctgtagtccatggggttgcgaagagtcagacacgactgagcgacgtcactttcacttttcacttttatgcattggagaagggaatggcaacccactccagtgttcttgcctggagaatcccaaggatgggggagcctagtgggctgccgtctatggggtctcacagagtcggacacgactgaagtgacttagcagcagcagcatagcaactctaactatctaacatagtttacattttagctattaagaagggattttttactattttgtttgcctttgtatacccacaatctagaaaccatgcctagcacatggtaggactcagtaaatgcttgttgaatagatgaatgaccaaagtaaggaaatattatgatattaatttaaaagcagaatggaaacatcagaccacctaagccaacagagttgagggcagtaagtgaaaataattaatagggaaagttgacacacttgaaattaacacagtattattaaacaacatgctccaatgtaaaataaaaattaaattaattgaaaaaatgaaatatattcagaattctctgacaacaaaaatagttttcaattttagaaaaatacatatatggagatatgagggaaatcacacttg

SEQ ID NO: 47841 - DNA, 1025 bp, Bovine  19866881897716
atttaatctctctctggggcttcccaggtagatcagtggtaagggattcacctgccaatgcaggagatgtggatggaacccagggttccatcccctgggtcggaagatcccctggagaaggaaatggcaacccaccacagtattcttgcctgggaaatttcattagacagaggaacctgtgggctacaattcatgaggttaacaaaagaatcagacatgactgagcaaataaacaacatctttctaacctcattagaatgtcaggatgtgagttcataaagtattattattacataatttaagacatgatgttaaaacattttgagtaatgtagtaaagtgagtagccaacaaccctatggacacagtcattaaatttactgtacttttaagaaatataaaagattggtaggttgactatctcttatatacaatttgaagtatataacaaaaacaagccttttcagaagacctagttcagaccatttcttataaagtgtgcatatatatatatatatatatatatatatatatatgttaacatctaccatggattcagtaagacttgaaaacattactagccctaagtatagacatatcatgaaatacatataattataatgtaatctattttctttattatttaagcaaaatttcaagagttaacaatatgatttctaaatatttccatcaagttaacacttcatattattctctttggtgattgcctccttgtctttttctttgttgttatttttattagcaaactgaaaatttagtaaaataatgttggatgttcctatcttgctaggaaaattactatcaatctgagattgtcatcaatattgctgctgagatttcttattagaccttctggaatatgaatttcttcctccaaactccaaggctggagtcatccaacatatatgcttgtctggatgctaccaaaattttatctgagccagtttacttcatcaataatctcaaggctgtaagacatataatacaaccctagaaaagaggcaa

SEQ ID NO: 47842 - DNA, 1668 bp, Bovine  19866880417098
tgctctgttaagttgcttaatcgtgtctgactctgtgcaaccccagagacggcagcccaccaggctcccccgtccctgggattctccaggcaagaacactggagtgggttgccatttccttctccaatgcatgaaagtgaaaagtgaaagtgaagtcgctcagtcgtgtcatactcttagcagcctgcagcctaccaggctcctccatccatgggattttccaggcaagagtactggagtggggtgccattgccttttctgtaagtgctaaataagttctacttatcattcttactctcctattcttttgaaacaatttataaactgtttctacataattataaaataaatttttaatgaaatgaaatttaacattagaaattatgtaacataaacaaaatggcatgttttacaattgaatattaaaaaatacttaactaaatgaaaatgcatcctccataaagcactataatttctgcaagggcatagataaagttacattcaatcattatatttctatcacttagccagcgctaagtgggtgcttagtatttattgaattggacctatgcataataacctggtacaagggcttccttttttgctgtcatcattttgaaaatacaattaatgtaagctaaaaattaattttaattaataacaacattaccttacacatagtggccactcaccaagaatttgctgaattgcctatgaaatcaaatagaaaaacacacaaaggtcatggaaataagtaattaccttttgagaggtgaatagggcaagatgaattattcatcaccattcctgtactactaaataattgttaataaatgacttatcaaatgtcagcaagaaaacaccacttaaatatgtaagtaaacacaactcatggtgatctcaattagccagtaatttaaagattatgtaacaaacatacaaatatatttattttcttagtgtgattttttttcagggaaaaaaataaaaaacttgttaagtgccttttttttattgccaggcatttttactacatgataaagaaagaaaacacatgccaaaagcaagattttatttggagaagtgacagcctagtgacagagaccaatgcttaatcaaataattgtaatcctgagaaatggatgctgtatgatatgtccaagggatatggaagcacacggtgtggaatgactgtgtcagaaggatcggggtaaacaaaggagatttttcacttagtaggcaatgtttctcatgcagaaaaaaagagaagatacagaccaagaagtactgctgtgagttagtaaatgcacttggtaatacttaattgcaatttcatcaatgatgatgataaggctgaaagacagatgttattatctttatgtcaataaattatttaagaaaaattaaaatttatatatgttaaaagatgaagaattagattcagtatcttcagtctttaagggcaatttagatcccactatcttaggcaagaggatatataggaaggaataaaagtgtggaacagcactattgaatgtggctggcatacagactgtgtattgcaggcagtacctatggagagatggcaaccagtgagactataaataaaggtaaacatacatttgggcacaaagagcatctatacttctagtagaatttttttttttc

SEQ ID NO: 47843 - DNA, 1081 bp, Bovine  19866880503297
tctatggggtcgcacagagtcggacatgactgaagcgacttagcagcatcagcagcagcaacacctcactgcttttgtgtttttaataagcataggggtctggtccatacaagagggttagcaaatggtattaactggaatccagggattttgtaaggccttttttacttatcaaatatgtcggaagagtggtgacatttttccccactaaaatgtctgtgagaacttgggataactgtatgtgtccatcatgtccttcacatattagctctaggtcacaaaatattcatatttgtgcatctttatgcatttgcaagtagaaattcctccaggactttgtaatagcctggctcagtcctctaactgtgaggctgatcaggaaattgagaatttgaggaaactcagtgggaattacaatgtccaatttaagtccaactggacatagttttcattgggcacagatagaaccaaaatataccacctttaacttgattctccacaggctaatttagttttcctaccaacttttgaagtttgaaaagcatgttacagtaaaatctccttcatcaagtaaagaacaggatgcaaagtggaattccattgctgtgtttaaatagagtatcatatttttaaaataatgagaaattttcaaagaagaggactcatctatgtgtgctgaaaactaatctgtttgatttgcaaatatcattctttctaatgggaaagatttgaacaaggtaattttaggcaacaagactactttagctatttttgtctaaatttaaatttaaatgaaagctcagcaatcactcctttcaaactagtgtttttcattgttattaatttattttgtcaacagtgtattatagactaaatcagtggtgctttttaaaaatagtattgttaagtaaagggtttattttatttcttatctgattacataatgcaagccacttctgaaagcttaacagaaaattacaaaggcttctctgggccaagataggggaactaattcaattataataaaaaggatttaaacccaagccataagagttcttgcttttattgattatttttcaag

SEQ ID NO: 47844 - DNA, 1395 bp, Bovine  19866880522767
ttggctttattgtgcttcacaattactgtgttttttataaagtagagatttgtgacaaccctttctcaagcaagtctattggcatttttcaacagcatttgctcacttcatatctctgtcacagtttgataattctcacaatatttcaggctttttcattattattgtatttatcatggtgatctttgatatacatattgtaattgttttgatatttttttagcaatagaatatttttaaaatatatacattatttttaaggcataatgttactgtataatagattgtattatagtgtgtacgtagctgttcactaagaaaccaacaatccttgagtaacttattttatttttatattcattttattatattgtcctggagccgaacttgcagtatcattaacatatgtccgctttggcaaatgtttgtcttttgtcaaaaaatggcaaaatgaaaattgtagaaacaagttatttcttgggcaggttcctcttattaacaataagtaaatcaatataaggattgaatgatctcttatgaaattatcagtttacttttaaaaagtaagaccaatttttattttgtttttatttttgtgacaatgtatataaatgtgttttatttttactaaatgatagctgtgaaatcaactcaatagacttctttatacacttgtaaacttactagcagctttaataggagtaacagctgaaaaaacacccataaatgaaaggaacattttaagaaatatactaagctttatgttcaacggtttttaggataatgttcacaataaaattggaagaagagagtatggatttccctaaacatagagattgtgtcagtattcccataatgttaataatttttaaattcaattaatacaatgtgacatatagtgagtacaggagaaaccttaagaaatccattaaaattaaaaccagttttgtaaaaatgtgttctctcttaaagtttaaaatatctgtctcttaaagactattaaaactttttcttcttgctatttaagttatagagacacataaagttgttacttggctttctgctcagagtgataactgaatgcatttctatagatctcctcctttcaaaattatattgatatgataaaagtaatattcaaataaaatagctccctggcatctctgggacacagaaaattttcgtagactagaaacacttaggaaattgtgtaagatggaaaagatagattggaggggttgagaagtggaattccatacctccgtttcactgtgaaatttccatagttactctcttcgtcaacttagtggtaatttcttttgacttttcagttttgttcatgttccccttttggaaactgctggcatttactgtgtgtttttttctcctcttaca

SEQ ID NO: 47845 - DNA, 1180 bp, Bovine  19866880895641
ccaacttgttgcttttacttaacaaaggcccctgacataccttcattttcccttgtatgattacttattaaatccctatggtatgacatttctcattaaaggaataaatgaatgtattttcatacctttgccaatgtaaaatgatcaaatctctgcattaatgactcacatcaaagacattagtctaaatcacaagtcataaaatgagaagccatattaaaataaaaagtataactataatggttgaaaataagaacaaaaagatgtgtatgtaggaagagctactaatcaaaattactcactcagaatttcttacagagggaaatgcagaacagtttaaaatgaatgaacagctcaatgagcaggcaaatgagaatgattagaaaaacacattctcttactgaaaaatagaaatatgtaaaataaagtatatatgcattttacacacagtttgttggttttctttaatggattctggctttttagctattttttaaagttagtactttaaaattaaaattcttaggttgacttactgatccctcaatttccttttctcattttccttcccactgccaaaagaaaacaaaaatacaaagttttttgctctactctagagccatctctaagggaaattacaagggaaaccaagagaatgtgtatgcctgcttatatgcaagagtattaggcagggtttcctaagaaacagaaccaatacattctctctgccctcctcatatatgtattataggaaatggcgtacatgtttgtggaggaaaaaaagtctcacaatctgccttctgcaagttgcagaacctggtgcttttataccagtaaaaaagctgatggtacaaaatgatgagttttaaggcccaagaacctggagctctgatgtccaagggtgagctccgatgtccaagggcattctagctcaagaaaagagagaattcatccttcctttgccttttgttctatctgggtcctcaaaggattggatgaggctcattcatattggtcagggcagatctctttactcaatctactaaatcaaatgctaatttcttccagaaatgccctcaaagtcacacccagaaataatggtttatagctatccggcatcccacagtccagttaagtttaaacataagttaaacattcacaacagcacactttacatata

SEQ ID NO: 47846 - DNA, 792 bp, Bovine  19866881089383
aaaaatactccagttaacactgcaagaaaagagtaaggtttcaatataaaagtattaactccaaaacctatgctacttgattatattacaattctttttgttactttaaaatttaataaaaaggtgaaaaatacaaaattacatgtagaattatagtaaaagctggagttgtttatgggtcaggtgcaggataaaaggaagcatttcctggattgaagcagttcaacatggaaaaaaggtagcttaagcaaacagtttatggagtatttaaaacctaaacaaaaaggttttactccgtatcagtatcaatattttcttcaacactgaacaaatacttcagtgattctcagaccagtatatgagacaaaattactccaatgtgcaaaatcccattttcatgcatagcatttaaatcagatcactaaaaacatacagggtttgaaaactttgaaacagtaaggtaattccatccaagccaaagaccagaatgaaaaagcatagggacttaaaccactgtgcagtctttcagtttgtaaactctagtttttattagttcatttgagaatgacctaattttcaatgatctctcaagcacatttacctgtttcatccccatatgctcctaataacttatctaacccagctagtacaagtttgcattactcctggaaacattctgagaagtgatagcatttccagtgaattaggcatgccttttattctcgggggaccttctgtgtttaaatgaatactcacacgcttcattacagtatctctaaaatacatgcaaac

SEQ ID NO: 47847 - DNA, 1507 bp, Bovine  19866881162092
ttgatatccctatcctaaggcactgacagtctttaatgggcagcatgcctagtagatatggatttagtatgaatatatagatggaatatttctacttaaaccttatgccagtcaagttaaacttttgtagatatgttatgttattgtctctgaaatgtgtttggttgaaatccaaggaagtcaaatgagcgctagtcttagaaatggtttaatttggcagacactgccacttccataaactgttcaacaaagtcaattcttggaatcattataactttaagaataggaattaaagaactatgcggcagatgttatatgtagctgcagtaaacataatggaaacatttgcacatttcattataaatagtactatttctccaggtgcctttccatagtttcaaatgtataccatggcagattggcttatccattcttctctactcttgtctcaacatattctaaggtaacaatgcattgctattatcaggaaatctctaaaagcatcagttaaaatggatagtgtcaattggtttcattaacaatttaccaaaatatttcagaaaaaaatatgaccactccaaaatgtggtcataaagacatctctcgcattttaatcttgctagctagctttatctatctagatttaggtaaaaatatttcaagctacagagtagttactgctgttgttttcttacatctgagacttacagaattaatttgaaaacaaaataaaaaacagctaaaatagaagaaacagtgtcaagaaatttatcacagtgtactagggatagaatggaaattccttctgcattataggagtttggtatgtattttgcaatgtgtaaatggggccattggagacctgcaaattaaagatttaacatcactgccaactgaaagagacaaaagttgagtacacagactttttttattgttagttattttctttttctccaacaaagagaatgtactttttcccttttttttgtgatagagatttagaacaatgctgcactgtaaaactgtatacattgtaaaatgctcccatttatgaaatttaacttgctttcaattagtttcttatgagtaaacatttgctttgaaaagcaattctctaatttgaatcatccctgtttaaaggaaatattggtagtttcctgtacagtgtaattctatatttttttctatgtcacatgggatttttattattgttaagtaatgctatttggaaatttattggtttatcccaacataaaagaaaaccatgaaatttttaagtgctatgaaatgccattaaactgtgtatagaggatcaaagttgatgaatcataaataatttccagcatattatacatcatggaaatgataaaaattttaagaggtaagcccagataatcattgtagaagactgtgtaaaagggattggaaaagggaaaccaatgccgtagtccttgactccctctgtgaatccacttgccaggtcacctgacacataatccaatcattt

SEQ ID NO: 47848 - DNA, 1619 bp, Bovine  19866881056454
tcctgtaggttctgtgagctgctctagcaattaataaaaccctaagacgggcatcctcggaagctctgatttatagccggtgattttggaaaggaaataaggatgaggggatggttgttggtggagtcaaccatgtgattagaagattgaaactttcaatcccatcccgacctacagagagaggagaggggctggagcctgagttagaagcatagttgacaaccatgacccgctgttagcatctggagttggaagagcggaggggaagtcttgcgagactaaacccttaacttgaaagccaaggcagggggtctttggaccctccagtccaaagccagatggtcagaagctcaggtgacaacctgggcctgggactggtgtctgaactgggagaggggcagtttggtgggactgagccctcgatattgtaatctgataccatccctgggtagatagtgtcagaacggagttgaattatagaacagacagctggtgtatggagaatgtcttgatgatgtagggaatacccccaccctggccacagacattggaaactggtattcagaacctaaaatatggatgagttggatagaagtggagagagggagaggagccatggatgcctcccagggcttgggtctgagctcttgcattggatagaatggtgcattttgtgctacgcaggggatgttaaaatcacattcaagtctgacttgaaacatttacaaattgggctgcacaccctctaagcgagtttatcatattaatgaactccttcccaaaataacccccagcatgacaatgtcccagcgaggagagaaaccttatttgcagataattcacaacgctgactcactagggttcagagatggggattttaattattgttgttaccatatttttcacagggatgaacatgcaacagaacaagagggaccagcaccatgctgtttctgagagcagaaccccagtgccctctgggacccccaactgcgtacaactgggttccgtactttgagcttctccagtgatgtagaatcttcccagagcagcccaaatcatcagctcttgacagaaaggggtaaagaggagtttggaggccatgtccttgagaaatggtcaaagggactggggacattcagcccagataagagagggttcagggaaagtgtgagagctgctttccactatttcaccttgatacacaggactatgatcaggagatacagggagtatgatttcagtttggatttggaaagtacttttcattaagccctaatgaaatgggggaaattgtggagatcctggctcctaccacttacccttccagcaattctttagctgaccagcctataagccaagatgggatctagcttctaccatgtccatctcttcctgcttatccagcttgaattccagagtccatcattttaaacattcgtataccctccactccttgatccactcactcttctccttcattctgtgtttctgagataactccaatcctagttagatctcagtctatcttgcacatgtatacaaagttcatcttggctggaaaaaaaaatacattgaattatgttgcctggtctcacttgaaattcatgaccaaccaa

SEQ ID NO: 47849 - DNA, 1553 bp, Bovine  19866881121233
ggcgtttatcaggggtcagtcacagagtcacctccttgagacacgtacacaattcctgactcccggaaaagaagcacagaccacactgttggcacactctaagtcccaggagcccttcttctcactcctgggaatggtgtgttccctccccaaatccaagttccccaaggccaagcccaggactcacctagcaagcaagcctttcagaggctagaagtctcaggccagacatgttcactttttctgcacaggtggcagaaaatatccacctgccaatgcaggagacacaggagaccagagttcaacccctgggttgggaagatctccccctggagaaggaagtggcaacccactccggtattcttgcctggaaaaatcccattgacagaggagcctggtgggctatagtccatggggtcacaaagaattccgcacagattagcagctgaacacaccctgtctttggagaaggagatggcagcccactccagtattcttgcctggagaatcccagggatggaggagcctggtgggctgctgtccatggggtggcacagagtcaggcacgactgaagtgatttagcagcagcagcagcagcgccctgtcttggttctgctatttaggggacactaggtggcgccgctgagctgacataattttgtcttgtgtgggcttcccttccaagagcctggtctgtaaagacttctgtaatgttttcctcccggtgccggcgtgttcagtagtgtggggctgtctctgcaaatccctaaggagttaactagcatgaattgctctgtgatgcaacggtgtgtgtactctggcccatccacccatctatgtatgagcattgttacagccctcctgagaaaaatttgacatggattaatgacaacctctatgaatcaggcaggaacattaatatcgtaaaacaggctacaaggtaatttgcctcccattgtctggcaatttcctgtcgtcctttggagctcttctatggcagtccctgcggctgggcattgcacggttcagttagtcgccaaagcttggcccctgtgttgctggctggggagatagtggtaagttattcatggcttcgtagacctgagaagtaaacaagtctagaacccttctttcacaaggcagaaacaatgatgtcaaaaccccccacccccaccagtcaccccagcttctgtttgtgtgttgtttttttttttttttttggaattcttgtggatccagcactgtcctttatgttcatcttcacattttaaatcctcatggtaactctttagggaggaaaatgatttcatagatgaggggccaaaggcacagagaggttgagcgacttgctcaagatcacccagcagaaaagtggccaagctgagagctggatgaaatggattccagggcctttaaccactgagaacccggccctcagaggactgaacaatacaagtgagtccaaacccatgacttctcagctctttgttgagtctctgttcctttaaccctgtgacctctatttatttctttgcagtttgggctctagtta

SEQ ID NO: 47850 - DNA, 633 bp, Bovine  19866881311131
cgctgagaagagggcaagggggtctggttgagcaggaggatcgtgttgggtttctgccgtgacccctgcgggtaatctcagcctagggtgtccccgtggccgcggagttcaaaagccgccgcctcttttctccccagatgcgcaccggctccaccatgtgagcagcttggcctggctggatgagcacacgctggtcacgacctcgcacgacgcctctgtcaaagagtggacaatcgcctactgaggagcccccctcacaccaactcgacaccgaatcagggacgtggggtgaacgcagctccgcctctgtcactcctctctgccccgcccctgccccgcctcccaagggaggggcctcacctcggtcccaccccaccctgcctcctgggggaggggccgcacctcgtgcccaccctcggccccgccccctggagggagggggcccaccgcccacctgccagctcgctgggccatcctgtctgtcccaagttctgaaagctttagaccctgaccgtttgcacatgggaaattaagcgggcaccttcaaccacgtgtggcgcctgactcagacccaccgcttgctgcgcagaacattccagaggcagagcctccaaagcacacagaccctcccgt

SEQ ID NO: 47851 - DNA, 984 bp, Bovine  19866880687041
cctgtccatcaccaactcccggagttcactcagactcatgtccatcgagttagtgatgccatccagccatctcatcctctgttgtccccttctcctcctgcccccaatccttcccagcatcagagtcttttccaatgagtcaattcttcgcatgaggtggccaaagtactggagtttcagctttagcatcattccttaaatttcatactttagttaaatgaaatgaaaattgctttactacacagagttctattccccattaagatgttgcaaacaagatgttcttatgtagagaacaatgtgaaacactttttcagagtgtctggtcttcttgattttgctaaagcaagtatgatcatgtttactgaagggttaatgctgccccactgaattgttacattagagatgctctgagctactgcttttagctagagtgaataagataagaccttttctaaaggtgaactaagatgtttaaaagtctgcttattcaaggcaaacaaaactcagaggattcattaagtctggagaacaccagaacattacagaatcttatttctttataaaaaggcatatatgtatctctttttacaaggaatactcaatttcatctaaagagaaatttggtgatcaacttatatttacacagcctttagtctgaggtgtgttttagttttaagtcagcatgcaagtccatgtcctcccattatggagaagtaaagtcatcagttaaaaaaatgtaaagatcctaaaatgagtccatacttccggagacattcacgtgtaaacattaaaaggcgtacaacctaggtggccttttcagcagggacagggagagggctttgagaaagatgggcagaaatgatatttcagactgtgagctgcttgtggcacaaatactgtgtgcttgtttttaaggaactagggcttctctactggctcagtcggtaaagaatctgcttacaatgcaggagacctgggttt

SEQ ID NO: 47852 - DNA, 1593 bp, Bovine  19866880861345
cacccatcgatgcaatctgtccgcagagaaacaaagcagcactgctgccatccttgtagaccttccacaacgggaggggacggggtcagcactgcaaaagcgaggggaagaggactgagggaacgcagaccatcttaatgtacacatctatgccttcaagacaaaacaaaatacactcagagcctttcatgcaatgccaacaacatggatgtgacctcttgaaaaacttaagacatgggctctaatagacattaagcaggaaaaaataagctgatttcaggaacataaaggacactgaaagccaaattttttactaaagtattattgaaaattgaagttctaatttgtcatttgcaacttttcaaagaaataaagcaaaaaagcaaaaccaactgtgggaaaaaaagaaaaaaaatctcacaagtttctccccagagtcaaaggcagttctggttacatgcactttgggatgctcttccccagagcatggctaaacggaaatactgggcagcatgctaacttctccctcatgccccgcaccaactcctattcatgccatcgtctctgctcttctctgcgctccatttctctttttgcaagctcaagaatggcagctgacttatctctgcagcccgagtgctggcacagaaaatgaatggtacattcttgatgggtgagtagctgaacaaaaggatgaataaacagaaagccttctctcaaacagcaaaaatgtcctgtgagatatgacaatttaccacaacatagaggcctgtgagcacaaggaggaacatctcctggtggatctcactgcctaacgcagtgcaaaggaacagctctccctctctctgtacataaggcagacgagacaattctctgatagcctatgacagaaaggaaacaatcacactggctcaatgatgagttccccaaatttaaaaccaagggggaaaaacaccttcttaagcatatggtgttaaacactctatgcaaatgaagaatgaagatcactttcacacaatgattcaagtagactaaaggatgcagagagccttcctcttcctctccattcccaccccaccagctccttgtgccaatcatgtggcacttcctatacactgctctctctatatacctggatgccacaatgaggctggatgctcctcaaatgcagtgatatacttgttcctatgcctctgagtgtctagaaaaaagcagatgtactaaaaatgaggacgagatggttggatggcatcaccgactcaatggacatgagtttgagttcactgtccaagagacagtgaaggatagggaagcctggcgtgctgcggtccacaggatcacaaagagtcagacacgactgagtgactgaacaacaacaaattctctctatccatcctgtcctcttctcgacttgtaatgttcaaacagcaatctctcaatcctttaagacccagatcatatcattcataacatttttccaaatcccctcaactaaagtcaaaggtctttggctttggacttctctcatggcccttctcacattttgatgttatcccacagctttctgtggtcatgcactatgtgaagcttaag

SEQ ID NO: 47853 - DNA, 1524 bp, Bovine  19866881096791
ccagataagcagaggaaatgagggcctactgcagaagcacggaaaggcaggaaggaaaagatggtgccggctcaatacagaagatgctgttctgtttaacaagggatgaaggccttcaaggaagcggaaggaaagaaccagtgaggggggggcacgaatccctagagttctaaagcagaaatataatgtccaaattaaataattcaacatttattgagcacctactgtatgccaaacactctacttttctctagtggcacattggttaaataaaatagcccttactttttagaatcttttggttttagtaggggagacaaacaaaaaaataggtaatcatattatgaggcagatatgacaaactttattatgcagctatgaaaaaacttggtaaggattttaaagctaaacaatggactgggataaggttcctgaaaatggagattactgaaattagttttgaagaatgagtaggagatggcttcaggaagtagttatttcagaggaagaagcatcatgcagtcagtcgggaatgaaatgttaaagattcagtatgtcagtatttatacacatatatatgatctctggacatatcttaagacaatactaaatttatttatacatccccatttttgttcaataacagactgagcgaatgcctaaaactgagaaacaggctttaattgactgtaatagttgacatgaccacagtgcaagcaaagggccacttctcctttctaaaaccttctcctctgtctacttgtcagcacatttttctgatggaacttggagatgacaggaaaaaaatatcaccacaggaaacacattctacatgtgactttccatatttcacttttggaagagggtcattagcaaaatagtaatcttaaaatttctaatactggaatggcttcttctcatcttttagccatcatctgtaaagcacattttttttttcttttttggaaaaagactatttcagaccaatatatggcaagtagtataagaaatgctgtgctattcatcttatgctgcagttggtcactccagtgagcaggcttgacagtttgcagatgaaaatgtaaacactgagctcaactcagttattctgaggccaaccatttctgacagtctctacaatgtgataaacaccgtctgtctacagttcctctgtatttgaaagttacaacaaacattttgttgaaatgtaaacaactgacttcatgactggtgaagcagtggcctgcaaatttatctaaaatcaagaaaacaaagatcttgtttgacactggataaaccattagtggtcaccaagggagcagctttgggaggtcataagtgttgtcatcagtcttgaaaaaatatgcaccgaaggtattgtcacaacttacttgaggcaagaataagtaatatgagagacaaaagaactacaaaccagtagaaaaagggtaaattcttcttttactctaaaggacagttttaaccagtaaaaaaagggtgaagctctctctttaaaggatagtt

SEQ ID NO: 47854 - DNA, 1174 bp, Bovine  19866881372017
aagaaatggtctccctcttctttgaactctaaaacactttgtctgcacctctcttaggagaagtatcaatttttgccgtggtttgcattgacagcttcttgttcttttatctcctctcacgctagtcttttcaaggtctctaccgtggctctctctcttccacaaggtagatgagaagtctatacacacagcgcacacatgttacatgagcagtcactttgtgtatctgaattttgtggattttttttttttactgtagcaacaaagcattttataggagtatgttactgcatggtttcttgaaaagctatgaaaattttacaaatttgtaagtaaagcttctatttgaatatttgggccattaatataagaaaagtttgtgtaaagctaattatgttgatgttttgaaggaacttcaaaccatagttgtataagagtcttatttaagttgcgacagtcatttcagtcttatgagagtcaggaattgatggcatgtaggaggtggctaaggtaggaaaggttatttattttaccctgatcacacacaacagttgggatttttgatagttgatttatgcatgctttttttttaaactaagacactaaagtggcaagtatatcatcctctccataatatatgagaacatgctgtaaatgtgatttttcatgtataaagcatgtactttctttttaaaaaatgagtagcaatttctcttctgtgttctcaaaaccctctgattatacttctgttatagcattaactgtgggattatagtgatttgttttcctaacacagtgcacttcccacctcagtactgtcattgggtgcatacccctagattaataaggaaacacagccttaagtgacacgaaactgtttattgactgaatgaataagatgactaactgtagtttggtgtgttgttgttcaatcgcccagtagtttccgactctttctgaccgcacggactgcagcacgccaggcctccctgtccctcaccatctcccagagtttgcccaagttcatgttcatttcatcagtgatgccatcagccatctcatcctctgacacactcctctctttctgcccttgatcagaagtgtagtttaattcccatgaaatacagttgtgtatggttgcttatgtcttctgaagcacagagattcttaatct

SEQ ID NO: 47855 - DNA, 4151 bp, Bovine  19866880358608
tgaaagaagttaagcattgtaacaaaatacagatattataattttcattttaaaatgtatgcaaacattttaatgagtggtctttaagacatatatttgggagaaggctgttctggataaaggaagattaagcatgccttaaaataatgcaaatcttgaaaatgagtattttcccttttgtaatttctacactatttaatttttaactggcaatgcaacaattgactgtttgtaaaagagaaatatatatgcatgtgttaccatacatgtattactttgagatattgaatctgatcaagttagaaatgaaaacacacaagacagaaaaggtttgtactagtaataaagaaaacacatatagcaaaggttttcctcagttttctttattacaacaatggagacacagaagtacagaaaataaaatgacatttaatatactatgaaactcatgcataggattacacaaagtgctggatattatgtcacaggttttaaataagagatgatattgaggacaatacatatataacatacattttattttaagaaaataagctatgatgaaaacaaatgcaattaaaatgatcagaaataatcactttaaaacagaactgttatatataaaatcgatgttaagatgtgagataaaaaatattcttgaaagaagttcatgaattatggatgttctttaaaaacagtcattttcaatttcttactttttagggaaaaaaaggatttactagagatttatttcactgtgcccatttagtacatagataaatatggcataatttaaaagttatgttatctctgaatattatgcaatgttcccagtttataactacatttccattacttgaaaatggagtgataaagaataactaaattcaatttgaacatatacaaataaagaaagtttacaatgtatgtaggcttaagacaaccaacattagattagttcatacttaaaatttaattacacttgaatgagtatatctttaaaaagtagctggaataatagtctacaacaaagacaggaggacatcagttgcagttcaaatcacctcagattcactactagaacttttgaacatatgtgttttccctggctattttgtttttcaattttgctaactagtagctaaaaactgatgttctagaataatccactctttctgtaagatttacagacaggtattttaggcttccaattacttacttaataaccatgagggagggggaggatgactaccagagatctgtatctgattcataatcttaggtaagataaaaactaaggtgtttggaaaataaagcattgatattagattctcatctctgatttatttcagaacaatgaaattagattgaatccattctcctaccaaaatactgagatgctatttacttttataatcattatgtattatattaaatttttaagcaccatgtagtagaaagatatactacatacatcagcatgaatcatatggctgattcatgctgatgtatggcagaaaccaacaaaatattgttaaagcaattatctttcaactagaaataaataattaaaaaattaaagatgttaactctagaggattagtttagatggtggttgggcagaaaatatgttaattagatatttgaaactttttccttttagttaagacctaatatttactggtaatatcttctgcattctaagattatcaagcattaatagtgattaaatactacctcatttttaatgacataatcagctgatttaaatataggctttttaccaatttcaatttatattgaaatcattccagggcaacttgtagaatattcatatctccaatcatttgaaaataaatttaatctacccattcaatgcattaactttgtttaaggttttatgacatatatatatataccacaaattctgaaatttaaaaatttaacagcaattaacagaaaaggaacagaagaactgcatcttatttatccatggcccgaaattgagagggaaagagagagaggaggagcaaagggaggaagggagagagagagagaatagtataaagaaaaattaagaaggaagaaatgaaaggaaataaaaccaagtaagagaaagcttacttgatttgtacttattcaaaagtgggttaaaggatactacattatgtctcatagatttgaggaataataaaatacataaaatgacaaatttaggtatgaacttttcatctagtatctttattcggtgaatggaattctaatatataagtgctatgaaatatgtaaatgataatatttaatttaggtagtgcttccctggtagctcagacagtaaagcatctgcgtgcagtgcaggagacccaggttcgatttctgggtcaggaagatcccctggagaaggaaatggcaatccactccagcactcttgcctggaaaatcccatggacgaaggagcctgataggctacagtccatggggtcgcaaagagtcggacacgactgagcaacttcacttcacttcagtgtcctaagaagttatttatttaaaactcttagtgctactaataaaatagttggggcgttttagataattttatgactagagatgttgcttaactactataaactgaaaatacacataatattagttatttttgaaaggtagatacaaacatatttactctactgcattagtgatgcaaatattcatcttgaattgttaaaatcatttgtaatctagaaattttattattttattcatgtgtaggtgtataatgaataaaaagaatgcttttcatatatctgaaagtaaccacccagatctaaaagttcatggcctaattcctcctcaaatattttattttgttcaatataaataaaaaatcataaatctacctgtctggattaaaaaacagtatagaattttccttagttacattataatttaaattaaatataattaatgggaattattaaatagaaaatataagttgtataagcatctccaaattgtataactgatgaattactatgcatacttgtaattttaattattaatattaaaagaaatgctgaacgcccaaacagtcaaaattatgtgcaattatttttacataattgacatatatatataatatgttaatccaatctctagaatttatttatttaacattattaaacccttgagatactttaagctaattaaaaaaaatttaaggaaaatgaagtcattaagagtttcaatcattttcatgtctaccagcaaagaacgcaggataagtacataagtacatttgcataatagtttggaaaaaatatgggtatagggtttataaaatgtttttattctcaatggataacagtattagaacagaaaagacaaaaatgaaattaacttaaggttctcccatataagacaatatttttcataggaaaggttttattgctgcctcttaggcataatctgttaacatatctgaaatgtagtttgatcgaccttagagcaatctgataaataattagagcttgaattggggtcaagagatcagtagggataaatgataaatggataaaagaagataaacttggaaagggttggaagaagaaaaatgatttcaagtgtatataaaaacataatcagaatgctctatgtgcaaataatggtaactatgcataagcaaatcaacctaactttataactggtataatatggtctaagcaaactgttaaaatgatctaacatttgacgatacaatacatacaacaatgaacataggtacatatttctgattaaatataatgaataacataaaactcaccttacacacaagttcatatttatacatttaggcacaaaattttattgaaaaatccactggattaaaaaaaaatattggatgatgctaggagaatttttacatcttggttagcaataatcacatttccttagatctacagcagatttcaattagacaaaacatactgtcagacttgatggttgtacataacaaaagtaaaactcaagtaataaaaaatagaattcagcaacatttacatttattacaatgtaaaataacaatcagacaaggtaatttatgctctctaaggtttcactttttgaaatgcaaccgctgcattgcttatagtttt

SEQ ID NO: 47856 - DNA, 3206 bp, Bovine  19866880409858
cttgggaggcaaagggcacagagaataaaacattcataatactctcacccccactcttttacagatgaaacttcctctcctgaacttacagaagtggatcagcagggctggacggttccacagccatgagattcctgtgggtcgatgaggacagaaggcccatgaatagggtcctaaccctgcccatcctgtgctctccccacttccagcaaacaggctccaggtcttgtacactcacactgtcatttttgcgcttgcctttattaataattgtgatcaagagtggaaagggaatgcaagcatttttatttgtttaatgtcctcatagatatagaatattggagtgagttgcatgccctactccaggaaaatcttcccgacccagagatcgaactcatgtctcttaggtctcctgcatttgccagtgagttctttaccacgaaagcctcctgggaagcccattttaggtataggagtttatacgtgttaatctcaacctcctaatttatccctcccatctctttcccctttggtaaccttaagtcagttttctatgtctttgggcctgtttctgttttgtatgtaagttcatttgtttctctttttctttgttttgtttccacacgtaaatgacaacgtgtgacatttctctctgtctggtttacttcacatagtatgatcatctctaggtccgtccatgttggctttgctttgacttttgcttttaaacaaacacctccgattttcttttaaaagtaatagaagtttccttccatgcagttggaacaccaggtctgagaggtctacgcagagtaattgtgaatgaattccgtccctgtgcagttacagtcttgttatacatcgtattccacatttcacttgcaattcaccaaaacccatagatggcagaattaaagctggagataaggagctgtcccactctgtcagctgcaaaagtcaagttgatatcttacttctttaaatagagagattataaagtaggttaataaaaaataatcacctgtcggtaggaaaagatagaaaaccactgcgagcatcaatacacatgcctgctggaaaggctggcttgatattcttgttaaactcaagcaaggtcaggcaaaggagtatcattttcttaaatccgctgctcaaccgactaagaaatctgtgaaaagagtgtttgcgacgagatttatggaggttttcctcaggatattgatgtatgtattgtatccacagccagagtaaagatgatgtctttaattatgattcagacacaccaaagagagtgtggaggaacaaatgacttttgaaattaagattgatttctctttttttgacactctgtacagatacacacgcacacaatcttttccctctttatatgtattaacacagtgacattttactaatatgattataatttggattttcaaagtcatttcatcaagatgcaaagataaattcattaataaattagacactgaatgtaatatagatatgcttttttaaactagatatatttacatgtggtgttattctttaaaaattgctggtcttctcataacatagatggcagctaagtaacagaatatttgatcaacaagaacattctggcacagccgtaactgataaacaagactgctgaattgaaaagcacacttggaattcatgttgtgtaagcctagcgcctaagatcggagaaagtgatggcaccccactccagtactcttgcctagaaaatcccatggatggaggagcctggtgggctgcagtccatggggtcgctaagagtcgggaacgactgagcgacttcacttgcacttttcactttcaagcattggagaaggaaatggcaacccactccagtattcttgcctggagaatcccagggatggggtcgcacagagtcggactcaactgaagcgacttagcagcagcagcagcagataagatacattattaataatgtaaaacacccttctttcattagggaaaatattgtccttctgcacattaaaaagcaaatttatccaccttaaaaataaacaggtcctttggttatcacctgttataaatgatatacctttgactcgtggataacaattcatgtaagttagcatgttattaatattagtaaaaatggtagtatgtaaaatactaaggcagctagtatgccctatcttttttctttctcacatccatgtgttaaactcttttggaatcactgacactttagagaaaattggggatcctgtcacttagttactcaacatttttatctatgtttgcaatttttttttataataagcaacaatatatctgaaattaacagaaatttaggaagaagagaatttgttctatttctggaaggagtgtgattccctgagaaataagtcattttcagagttagcactgtctctgtaataatgcacaatatacatttgactagaagaccaaagtcatttcttctcatttcatataccaaagggcatctttctctctgtgctacaaaaatatattacacatttctgaaagaaaattcatttatatcttggctttgattcaccacctacggaagattcatttaagacattagatatttgactgagacaggttaattggtatattagccgttcatgtagtattttcagtttctatcactgcattaagatgactggagagcaaagtgtctgagtgtacattattctttaaatcttttacataaagacactctcagaaatttgacttgatatggtatcttttacctttctgaaggttaacttaagaactgcgtgcttgtatagtatttcagtatttttataaagtgattattcatagtgctgattgtcctttcattaatcttaatcaaatgtctatctgaaaactattatcttgagtttagtacaaaataaatattttgttgtaaattttatctgctgtacatttgaaattatacaacatatatcatggttactttgtggctttacttgactagatttcattgtcaaatttagaattcagttgcagcaaacaatacatctgagttggtcataattcctttccttcttcctcacatttatgcctttgaacgtttttagggtcattgacgcttttggccttttgtgaaatggtggttcacgtcagtcaggcactcaacacttttttgtatgtgtgcaatgttctacaagaaggtccaggca

SEQ ID NO: 47857 - DNA, 2218 bp, Bovine  19866880419035
tttttaatctcccaatatcccaattgccatagtaaagtttccagcattcagaactctttaagaatagtaaccagttaaatctttccccctagaacactacaagtagctcttgcaaggtaggattcatagatgaacacatagatccagagaggtgaattccttatccagatttactcaacctagtaagcaggagtcaaacccagttctgcctgaatccagagctgaggcccttgaccacatattgcagtcttcccagcaactctgtgggggtgtaaatacccatataagaaaggaggaaacaggagctcagagaggtaaaggtggcctaaggtcccatgggaaattaggtggggatcaagcctgaattcgaagttgaatttgtctgactgcagactgtgcccttaattgctgtgctgagatcccaatatccagtgatttccaagcctctgtatcctcaacaatcccagggcaccagggcctaaaaagataatgacagctagtgatttatggaggagaaggcaatggcgccccactccagtactcttgcctggaaaatcccatgggtggaggagcctggtaggctgcagtccatgaagttgctaagagtcggacacgactgaacgacttcactttcacttttcactttcatgcattgaagaaggaaatggcaacccactccagtattcttgcctggagaatcccagggacaggggagcctggtgggctgccgtctatggggtcgcacagagtcagacacgactgaagcgacttagcagcagcagtgatttatggcatttagtgagatgatgcgccagtgctttagccacaagaactcattaaacacctagtgaagtggacataattatctgccttttttcaaatgagaaaacagagacgacaatgatttgcccaagttcacgtggtgaatctggccagagcagaatttgaacttgagcccttctgatttcagagtcctaatctctgcccttgtgctgtgtccattcaagaggggacagagagagagttaagaaataaacaataaaagaacaagatatttggagaattgtaaagattcatgcaaggaaaccaaaccagtcaaacctaaaggaagtcaaccctgaatactcattggaaggactgatactgaagctgaagctccaatgctttggccacctgatgcaaagagctgactcactggaaaagaccctgatgctgataaagattgagggcagaaggagaaggagatgacagaggatgagatggttggatggcatcaccaactcaatggagatgggtgaacttcggcagttggtgatggacagggaggcctggcctgctgcggttcatgtgatcgaaaagggtcagacatgactgagcgactgaactgaactgaactgaagagaaacttagttttatatttagttgaagaaaatgtattttccaatgaactgatttcaagctgctttcaaattttatggaacaagggtctagataaaatgtagtccaggtacaagggcaagtagattgactataattacatatcaacagaattctgttcaattgatccaatttaacctgtaagaaggtctctattcttaaaaatgacttgcatagactgaaacatgacataggtgaaaatgcaaatgactgcctcacgggtatttgtgaattaaatcaatcttggaaagagagcaaaaatattggatttgacaagatctcagtaagttaaaaggatgagctcaaatggacaagatgaaatttaataggggtaagtacagagtcctaaactgagattaaaacaaatcagctgtgaagcatagtgcaggagacctcagcaggtctcctagtattagcttgtgtgaaaaaaggaggtaggaaaagacttgaaggaaaaaagtggcaaatcaagtgaaatttatgaattgtttaataaaatacaatgtccataataaataagattgttatcccagtatcagatactactgtgcattcatcatctatgatgtcctagaattagccagttttaaaaagagacctagctactctcagctgctgttattgttcagttgctaggtcatgtccaaatctttatgaccccaaggactgcagctcgccaggcttccctgtccttcactatttcctggagtttgctcaaatccatggccattgagtcagtgactctatttgctaccatttccacccttgccttcagtatttc

SEQ ID NO: 47858 - DNA, 1209 bp, Bovine  19866880425135
ctaatgattaactaatgatgaggggaagccaatgtggagaataagtcaagtacccgtccaacgatccagctgacatctcatcagtggctgagtcttcaacagtcaagaatttaaatatgaccattttggaccttgaaggaatcccagtgctccacttgacagtgaaaagaattcccaatcaaccaacagaattataaggaatactaactttcttttcttgttagctttaaagtttggtcttatttttacatgaatagatcactgaaacaacagaggaatggtccctctttaggagatttctgtgctgcttccaagaaccagagtcgcttccctggtagctcatgtggtaaagaacccacccccaatgcaggagaccctggttcaattcctgggtcaggaagataccctggagaagggataggccacccacgccagtatttttcggtttccctggtggctgagctggtaaagaatcctcctgcaatgcgggagacctggttttgatccctgggttgggaagatcccctggagaagggaaaggctaccccctccagtattctggcctggataatttcatggactacatagtccatgtgttgcaaagagtcagacacaactgagagacatttacatttcagtccatggggtcactaagagtcagacacaactgagcgacctcgctttcacttttcactttcgtacattggagaaggaaatggcaacccactccagtgttcttgcgtggaggatcccagggatggaggagcctgtttaatatgtaatattcaacatttgcataagcaaaaccgagtataaagcattacatacacctcatgaaaatgatacatacaaaaagagttatttatttctctatgaagtaaattcactttctggttttaataaaatagtccatatatatcatcataaggtgaaagcataaggatgattttttgacaaatgttacacataaaagaagatcacaactgttgggattcattaaagttaacatccatagcatgttgggagaatgccatttttgaactgactgaaatttctcattagtatttccatatcatatttttttttgtaaggcaaaggagctcatgaggggaagaaaacagaaatttacatgacaaattaagtctattttagatatatgtaattttctactgctttcaaattagtcttagaaatctatcaagcaaacta

SEQ ID NO: 47859 - DNA, 1460 bp, Bovine  19866880452833
atataaggcagacctgtccaccaccacagtggctaaggaagcaccctgaacttggtccaactcaggcttaaaacatccccatgtccatgtgactagcatggcctctggtggcttgattcagagcttccagtcaaatcttgttttaaactacgtatcttccctgtctctcatagctaactctcaaaagctttctagagcaaaaatagcaactcctgtttgtgtaattatcttgttccaggaaattgagagcacccatatgatgctccagtttcccataagctttaaggattactgttgtgttttcatttctctgtcatttccttatgtgcttagatggtggtgctaaaattaggagtaggggcaaaatgagaagtcacaatagtaacataaatgcttattcttagatcttacttgctatgctgctactgctgctaagtcacttcagtcgtgtccgactctgtgtgatcccagagacggcagcccaccaggctcccccgtccctgggattctccaggcaagaacactggagtgagttgccatttccttctccaatgcatgaaagtgaaaagtgaaagggaagttgctcagtcgtgtctgactcttaggcctactaggctcctccatccatgggattttccaggcaagagtactggagtgggatgccattgccttctctgtacttgctataaggaaagatcttatttccttcgtgtcaagaaaagctataattaatatgtgacattcttaataattattcttaggataaggtacaagttaggataaccgacaagtccaagtttaggagctgtacttgtttctggtcttccccagtgtacacttgatgttgtctggctgggcaatgcattggggagcatttatggcaggattgcagccatgactcccgctgtcatgatccattcgcctcacttacagccctccctgtggtctatcctttctttctcactgaagagacctaaatttcctatccctcacccaaatatacctatctcatacctattattttaggaatgagacaatagtgatatagttattatagttggagaagactcttgagagtcccttagactgcgtggagaccaaaccagtcaatcctaaaggaaatcaaccctgaatattctttggaagaactgatgctgaagttgaagctctaatatttgccctgatgtgaagaatcaactcattggaaaaaactctgtttctgggaaagattgaaagcaaaaagagaaggggatgacagaggatgagatgatttggtggcaccacagattcaatggacatgaacttgagcacactgcaggatatagtgaaggacagagctgcctggcctgcggcagtccatgatgtcacaaagcgctggacatgacttagcaactgaacaacaagattatagttagataggtaaatagtattggggaaccaggaaagtcaatcttttccca

SEQ ID NO: 47860 - DNA, 1152 bp, Bovine  19866880553502
aaacctaaaagcagcttgcctaggggtcagggtataataattatcctttatttgtacccctggcttttttttttttctgagcacccttgatgatgctagttcatgatcattgaatcaaattgaactgtaattttaaatgtcacactcaacctaatttaatgcagtaattaaaatgacatatagcttcatcatttttcactgttcaatttagataccctccctcattctcacttttactgaatgccttacacttgccactatgcttagcagacaggaggacactattgagaagttatcatgtgagattcttttcctcgggacatttacaatgttaatggggagagaagaaatgtatgcttaagatttttcaaaccactctcaaatttctgtacaagaataaagtctagagaattatatttttggtgtagatgagtttagtttagacagtgtcagttaaatgatatcagatgatggaaagccattcaaatggaaaagccctgcaggcagttgaaaatgtgggaatgatgctcagagaatgatgaaaatgagaggtggcgatgaaaacaatacaatacaatagctattgcatacaagtggatggattttaaaagaagctcaactatatagagaaacgaaaaatgagtagggatgaaaatgactgaacaaatttaagaactttgagtcaaaccatggatgagaccatgactctacactatttacatatgggctatggtacaaatcacttgccttcactgagagtctgtttcttctttaagtagtaaaatacagcaaatacactttgagagggtataaaatagctcaaagttgtcaagccataaaacaagtatcaactactgacaccatcaaaagagtgacagaatattctgttaatcaaataaacataagtttactggtgctactgcaatgagagagtctgtgcattgtctcagaagggtatattcaaggaaggatattcataggatttggaggtccaatataaagcagattatttcaggtctttcaaagagggacagtaatttcatttgggcaaagattgtggcataataatttaaaattaatggacacagtgagatgtggttcttgataagtacaaatgtttttcaataatcaagtgttggccaggttagcaac

SEQ ID NO: 47861 - DNA, 1399 bp, Bovine  19866880645118
ctattgaaaatatattcttagtcttgaaaatgtaatatatttatttacaaaataaagccagactttacagcctctacttattgtcatcacttgaaactggttatttttactggagtttgcagcatagaaatggacaacacttttattcttaaattttcccgttttacctttgaaactgataatgttattcaaccatgcatacagatttttatactatttggcatattcattctagagctataaaaatctgctctttgcataatgagacttcctttaatatccatttaaaagcccacagattttttagataggtgagtaactgaggataatttatagcttcaagaacgcccagtacacttacattggcctgtgtatatgtgtatgtgtgtataactgattttcagtctaatagtctgctattgttaagctgtctcaaatatcttcctgaatagatatttattgcagaggtctagttgtcaagaatttcccacagagctgtaagctaaactgtactcagtacctttattcaaatatttaaattgtgttaacatttaaaatatataaaaatcatgttgagaattttttctgtgtaaaataacattttataaaaagtaagaagaatattttttacataaattttaccctttatgcatataaagctcatcggatcctctggataaaaacaaaggactcaattttggtagaatttatattttaacatatttatagtgaaaatgtttctgttatcagaatatgtttaataaagcaaatttaaaacatagatattctttaaaactttatccgtataagacacttccttatctgttccccagtaacctttcactcttaaccttcttctttttttttttaatcctcattccaaaattctgagtatttagtgctgctcaacatgcaatgtccctttatgtctctgtgtactataatatactgattcctgtgacttgaatgctctgttttcaggtgatctttcctctccgataatacaacttttaatacctatgagatataatcttagtggtaccttttccagttgcctcggatacaacaattaggattcaaggatagagaagaaacattaaacactcaattttccaaggaaagggccatcaaatcatgcaaaaattagtcaaaaatatttctaaaaatgatcactctagatttgttactccaaaaccatcatccctattcccacttatttttcttagactgcagaaaagagtaaatgggaaatcaggttacttaagaatttctgcctaattcctttcttactctcaagcagaaacttgagattcatgctaaattgcttcagtcctgttcaaccctttataacaaacatcatggactgtagcccgccaggctcctctgtccatggagcctg

SEQ ID NO: 47862 - DNA, 1873 bp, Bovine  19866880813361
aattagggagatgatatctgcgtgaggggctgtgcccatgttgcctttttggagccttagttgagtttgggacttgcaggctaggccagccaatgtgattagattgcctcctgaggactaccaaatggatttctgggcaaacataactcattaatcattattaaatacttaatatttttctaagcttgtatccaactacttctctatatttacagtcacaaatcccaatggaatataaaagaaagagatgcaaatccatctgacagatagggggtgggtatagaatgccaaaaaatgcacattacaaaaaaaaaaaaaaaagataatgagataatttagaagaaaaaaaaactttgtctactaaggagaaaagaccctgtatgggactcagactgaacaggatcttcatggtagagtaggccagccatttggggtagaatgtaaagttgttcattaacctctcagtattatcattcggtgatcctggaaagatgacaacaataacagaactgaatcactgggggcacaaatagttctgctttgtaacctctttttacacagttctgacatgcccaagggaataagttttcctattttcctaagagagaagtaaaaaccacagaagcagtcagagatgacgatgaacttagaggagtgactgcaaagggaatgacttccctaaggtggtcagaggtcaataagactggtcaaggaaaacagcagttcacacagcagaccacagcaggtggattggtgcagaataggaggaacacagacaaaaaggcacagacatgttaagggaaaactaggtcagtgatgtataggccactaggcagtaatttagacttttgtgcgacactttactttggggattcctagggtcacagcagaataagagctaaaggcttttatttttgatgggtgatgtctcatgatccaaaaaattggagacaaaatgctaaaatccattttctatgattcttcaactaatacattttaggatacttttgtttacaccaagtaaaatatctgatcaatattgttaatatcaaacattggtctctttcctgacaattgtataactcattcaataaaagtgtgaaaatgatttcagagtactaatttttaataagatagaagattttatattgtatagagctatatttttacatgggaagcagaaatatattttggctgtttaatgtaacctctacttttttttttcccccccactaaaagccagagctctgttcaactaagcaaactaattaaatttccacaatgtttttgtaaagccctgtttgcttacagttagcccaaatgtgctaaaaacccaccaatgttctaccttcttttgttgcaagtaaacttgccctagaaagtgaatttagggattattatactttttccattacaagctgtttgtgtaaacctttccacattgtcaaaataaatacgttattgaaggcaagtgaaatagaaagagactaaaaaaaataaagttgatggattaggtcagcatttcccagaagaaattttttaattctcttatgtttggtagtttcttatcacagtggactatacctctactttttatcaattacctgaggggcacttttctgcaaatactttcaattctatagagtcctctggcagacctccctattacctttggctctttatctctggattctatcagacactttcaagagaactattctgcaaccaactctccaaacccgagcactagactgtttcagatctttttcctgtgaaatagctaaggatcccaagatacctatttgaaaagcaagcaccattttgtaaaggcaggaaactctcaattcactcagataagaagtctttctataaa

SEQ ID NO: 47863 - DNA, 2159 bp, Bovine  19866880861941
gactgcttaatttcgtgaactgttcagttttataccttagaagccatatgaaaacagcacagtgaatactaatatatcttttcaaaaaataaagtgcagaaaaaagagatatctcaaaagttaacattaggtcaggggtcaatagagaaagaaaaaaaaaataataataaaaaaaaaaaaaagttaacaaactcctttagttacatatcaatttctctttacttagtatctctcatattaagctgctatagagcaagcaaaaaatgagtgtgagcccagtccctcggtaatatccaactctatgcggccccatgaacagaatagccccaccagagtcctctgtccatgggatttcccaggcaggaatactggagtgggttgccatttcctcctccaggggatcttcctgacccagggatcgaatccgtgtctcctggattggcaggcagattcttcaccactgctccacctgcaaagccctcaagcaaaacataagtgaaaccaaatttccaggtcactgagtccttactgaaggatcagagatgtcttgtaatcttaaacacattccctgagctccattgcctctgtttgtgcatttcattggcagtcgctttttgttgcagaatttcagtaggcttgggctcaggaggtggacttcagttaaggaaaaaaggaagttcctgagaacagaaaaaagagaatattcattcgattacaattcataccagaaaatagcccctttaattttatataagctgtttgacaaagattaatatggatattctttttctttagcttagaagtattttattctgtttctaataaaaagtgattcaaatgcataatatccacactaaaataacattggcaacctccaaaaaatttataataaaactttaatgtcatatgtgacaattattaaagatttcctgataccagttttgttttttttttgctgtttcaagtggaaaagaaaataaggaggggaattaaaaggaaaaggattgcttttgattttctcctgaaaagatggtgaaaacaaaaattgatggtcatgtttcactgtaattaaacgagcagcagaaaccattatttatagctgtccctaaggctatactgtaagttaaccccattttcttgacattttctttatataattgttcttaatcattttgccattttgtggaaatcactaatccatgtgtcctaaatggaaaagtatcagctcaattacttcactaacattttaaatcttatctactgttccaaatcagagagttgaacacttgatgccttttctgaattaatgttataattttacattaaaaaaattaccagaggtatcaatttaattactgaacttcagtgagttttcattcttatattttgctatagagatgttttatctatagaaagtaaaaatattacgataaaaagaggtttctttctttacatagttcgttttaacatctttatggtttagcccaaatttggatgaattgctctcaaataagcaaaactcctctgaatgattgacaacttttgtagacacagctgtattatgtattatgatggcagaattgattatttaactttaactctaattttactcttattacaattataaatacatttggagaaaggtaattttcataaagataaaatcattatgcagtctttccttgatgtgattagcatttgttttatttgaaacaacaaaggtacacttatttcagccagcaaatatgtagctttaagcaaaaacactttgaattatgtatcttccagagccctttagcattaattcaattaagaaccactaaattactcaagacaccaaagaaccccagtttcgagggaaccccagggaattagaattccctctccagaaggctagagaagagagtgggtatctccacttttaacaaatgccctagttgatagttttgggaatttcatttaaaaaaaatagagattttgaaatcccatgaattgaaatgacttcatttttcaacacctgaaaaagtaattcttcaatcacttgaaaccaattgcagatttttccacgctaaataactattacatacagtttctgaatgattctaattgagagtgtttattactttgcacttccaaatacaaaaatgaatttcatagga

SEQ ID NO: 47864 - DNA, 2022 bp, Bovine  19866880880049
attttaaatgtttccttcccagtatcccagaatgcaccaaattgatctacagtttacctaattttacatgaacaattgcagttggatttcaaacagaagacatgttttcatagcagatggcatattcattttattaggcacccaagtttagactgctatgaatctgtaccatgtatctggagttaaaaatcaagttactttagattttgtcaaatatatttcaggactcctcttcagttccctggctgttgataaggttttatctttgttttgttgtaggtttctggttggctttcttacccaggttcatgaagtcttctctgtgtttactctataatgacctacagctgagcaatggcaaaaaaagaggaaaaaccatgttttcatatatcaacaaaaatatggactggagaaacaatggcatacagataaatctgtgcctctgaaactgggtttctttttattgttaagcagtcagaaaatagagagctcctgcgagttctttgttcaataaaaagacatcatgacccaaatcaaacaatgcttcatattttcaacaaagccatttggcttttgaaatgtgagcattaactacgtttattggtattgttcaataccaatatttttggctatgctatgcatgtggaattatgtgcacttaccagagaaaatattagaatgtattcttgaaaggatcaggcttctgaactatattgttcacacttatttcacagattgatgtaattggcctggcttgcttcccagttatggctaatatttcaaagcacctcagattcttctaagagtcagacacgactgagcgacttcactttcacttttcactttcatgcgttggagaaggaaatggcaacccattccagtgttcttgcttggagaatcccagggacggcggagcctggtgggctgccatctatggggtcgcacagagtcggacacgactgaagcgacttagcagcagcagcagcagtagattcttctagtgtggactcaagcttgagaactatgggactagagaagtgcttctgaaagcataattcacatgtaaatcagctggatatttttgtaaaacgtaggtgctgatcttgtagatattgggtgagttctgaaagtgcctatttctacaaaattcctagaggattccagagctaccattgcctatgctacattttgtgtaggcaggggccagaagatatgacagctaagactgcagactcagctaaatgccaaagttttagccataattataatgcccaaccttcttttgaaccatataaaaaataaacattacaatggactaattcctattgcaaaattttgggtgattgtttttccaatggaggtttaagatgctttgccaaatcaatacacattgtttatgtcacctgaactcatttttctaggatccaatggcgaataaatatgctctgagaataaaaatacttatctactaaattttggaaagtattactaaatcccaaactgcttatgctgtatggtaataacatagtagaaattgatacatccatatgaaaggactgtctgctgggaaactgttaaggaatacattccctgaataatcgttgcatataatctttacgttgaacatcaaaaactaaatattactaaccagaattttgtctattgttctcttttgaaaaatactttccaaaatatacaactagcactcatttttaactgaatttaaaattcggaagcattttaaacagttctatgaacaaatattggagaaggaaatgggcaacccactccagtgttcttgcctggagaatcccagggaagggggagcctggtgggctgccgtctatggggtcgcacagagtcggacacgactgaagtaacttagcagtagcagcagcagcatcatgaacaaatattgggcgtaaaattatttaaccgagaattttgtcttatattgatagctttactgtctgaattttcaaatacatcaaagtgttcgctttagtttcgtattgtgagagc

SEQ ID NO: 47865 - DNA, 832 bp, Bovine  19866880902998
acacacacacatacacacacacacacacacacacatatatatatatatgcctatggagaataaagaggcagcttgaaaaaagtgactatttttctgaaggcctgacccgtccttctcgttttttctcttacctgtttctattacaacttctatcgatagtgttgatttcctatatgaaataaaattgaaccataacaggcagctgggatgtaccttaaatacacctcaaagtgaattgaaatgtctcagttccttctcatacttcaaaggctgcaggcacttctctctggcagttattttgtgacactgattgccagatgatatgggtcctgagaaactccatttaagaaatgtatgaagagatagctgtatcagtctgtcaccatcaggccttatcacctgcaagcaagtggtcaagcttaaagaatagtgctgatcataaagaatgcccaaagcagattatgataggaggttggacataaagatggaacacgtcgccccggattcatctttatactctagagtcaataacaggtattaataaaatatatattttgagacctccttaagctatttacgcttagaactgacttcataggattataaagaatacaatgcattctgttgctttcctattcatgttcctgagcctagaacacattattttcctgcacatgactattcttccacaaaacttctttgctctgagttagtataagatattggagctttttggagaaggcactggcaccccactccagtactcttgcctggaaaatcccaggacggaggagccggtaggctgcagtccatggggtcgcacagagtcgga

SEQ ID NO: 47866 - DNA, 903 bp, Bovine  19866880908123
cctcctattgatgcttttgaactgtggtgctggagaagactcttgagtagtcccttggactgcaaggagatccaaacagtccattataaaggagattagccctgggatttctttggaaggaatgatgctaaagctgaaactccagtactttggccacctcatgtgaagtgttgactcattggaaaagactctgatgctgggagggattgggggcaggaggggaaggggacaacagaggatgagatggctggatggaatcactgactcgatggatgtgagtttgagtgaactctgggagttggtgttggataggggggcctggcgtgctgcaattcatggggtcacaaagagtcagacacgactgagcgactgaactgaactgatgacatatatagcatatagatgtgactttgcatattgtataactttgggaattaaaatgcatgtatgctaattaatttggctcagttcatcagggatgtgtgagggaattcaagctgtaacctagatttattcagcccatgttacaagtgctttaccccactgcagtagggcagatggtggctaggtctctaatgacaagctgtctggaaaatcttgccaatttcattcatgtgaagcatgtgccaggttgtaaaagggtttattccaggtaatttaaagaactgaagtaaagattctgttttagtttttcaaacataatctgtgttttggtagaaaaacttacataactgagagcatcatgttgatcagtatctgcttatggcctgttgatcaatataatttgatcaataaatttgtgatcaataaaatttggccctgaggttccaacactgacttcattacttggttagtgtctacattaattgatggtacaaataagaaaaaaatgttgctaattgt

SEQ ID NO: 47867 - DNA, 1392 bp, Bovine  19866881053918
gggaagcctggttggccgccgtctatggggttgcacagaggcggacacgactgaagtgacttagcagcagcagctttgatttagtattattgatagtgatactaacgagctcacctattaaatacaaattttagcatcaactcttaatgataagcaacccatttttacagagtttagagatttgaaaggcaaaaattcaaaggactattccaaaattacatttgtcttatcttatttctagcaaacagtctctggatataaaatgtctatcataagaatgcctgtttccttgttccaaattaacttaaaagtcatgctcacttcttatggaaggctatgtaaaaatgtaggctattgttgctattttatagaagtttttattataaaagttgatattttacaattgatttttttttttttttctgtctcttttagctactgcaaaagggactagacagacaccagagggagctcaagttaccgaaccttattctcaggagctaaggtgacatcagttagggaatatggaatctacatgtacagcttgctacatttaaaatagataaccaacacaggcctactgtattgctagggaattctgctcaatattatgtggcatactgggtgtgtggggagtttggggcagaatggatacttgtatatgtatggctcaggtgctttgctataaaactatgaaacctgagactatgacaacattgttaattccctctactccaatataaattgaaaagttaaaaatataaagtgatatcatttgccatcctatttagaagcagtcgagctaatattcagaatcaacccaacatacctaagaatagaagaaaaagcaaatagcttaacttactgaggtttacatagcaaatataaactgcaacatagacattcaccatttaatactaataattggtttaaatgactttatttctaattgaacgccaaacaacatgagcaattcttaaacaacttggaatctagagagagtgaagggtgaggtgcgagataatgtagaatcctgtaggatttgaagttcagtgtggttgggatgcaaggtctatcatggcctggttgtaagaacatacaaatatgttgtattcacagtctggcattctgctttattattttataggtgatgaaattgctctctaagctctttttctcttctgcctcctaacttctcagattttattttttccctacaaagagtgcatgtaaaagaaacaatacctagcactaaggcaattcacattttatcagggccttcagcaataacaaaatagagattgcaatatttcaccgtactcataatttagtggtacagaggcactttggaacaagcacacgaggcaaaagacaaggagcacctgtgtttgg

SEQ ID NO: 47868 - DNA, 2373 bp, Bovine  19866881057325
cacttgtactattttataataaaaaggacatatttgtcaactacatctattaaataaaagctgaaatctaaatgcattgtacaaaaaaagaggttaaaaaatgctaagtattttaccattgtgcatgctcagttgctaacttctgtcggactctgagaccccaaagactgtagccatcgaggggatggcctctgtccataggatttttcaggcaagaacactggggatactactccaggggatctccctaccccaaggagatgtctcttgtgactcctgcattgacaggaagatggattctttaccactagtgccacctgggaagccacatttcacccaaggtcatcctaattaaaagatgaactagaaataagaaatgaaatttagtaaacgtctgcctgactgggctcttaatattgcaaagtcttctaattggtattaatattacaacagagatgtcaattccagccttccatgctgcctagtacagattgcattttattagtctaaagacacaaatgatttgaagtgataattaaaatgtttctttagtcagtcctattttattccttgtcaactgattcaagatcacatgccattgtccagtgttacattccacactttaagcatttttctaatttattttatacctataaaatatttatggctgtttatattttcaatgtaccttgggaagttatagcaactaattgtaattaacttcaaattggcttatgatataacataacatttccattaatttagtaactcaagctcacaggcacaacaatttctaatgtaagcagagttatttcataattcagaggcatatttttgcttatttttcttggaaaaatgacagtcatatctttcttaaggaacacattaaatagcaaagctaacctgatatatcatggttttgggtttaattcttcttgacaaaggatatgaaaaagaagagatcagggacttccctggctaagactctgtgctccccatggaaggggcccaggttcaagccctatccagggaactagattccacaagtgtcagtcactcagttgtgtctgactctttgcatccccatgaactgtggcccaccaggttcctctgcccatgtagttctccaggcaagaatactggagtgggttgccatttccttttccaggggatcttcctgacccagggatcaaacctgggtctcccctactgcaggcagagtctttaccatctgagctacagggaagcccaaatgccacaactaaaagatcttgtatgcctcaatgaagacccaatgcagccaaataaaaaaataataaaatactaaaaagaagagacaaagagactacaagttgggtatctccttggtgacatgcagttttcttttaactgtaatacttttgcagtcaaccaatttcaacgcacataagttatctaattgtctattatttactacttgtattgataggtttagctttctaccattatgtggtctcaatttcatactgcctgaagcacttttatgctattcctgactttggaatgggtatctggaatgggtacctgaataagcctacttaatccatagctcaagtgcacactgctggttatagttatctgtggattcataacgaccttgtatcccgctcctacttttcagattcttattgagttgccctacttgacaatctagttcaaactgggctctggttttgctcccttgtactagaatcccagccttgataccccgcttatagcatgatggattcagtagaatggctttagttttcatcagccctgcagttccattcctgagccaccctcctagtgcccagtcatagcaaaattgagcaaacacaccgagatctgaaatagataacactctgcttcttcttgactgcccaaactcacatcttctccaataaatagggcaactgtgttttaacaaaatattgtgttttaacatattatcattcacttgtgaatattattcacatggagcaatatgctatgtgatgtatgcatgcaaaccaatatgactgtatgatccatatacgtgtttgttactatttccccaattttactttaaaaaaaaaattttacaggggaatttattttcattacaaagaaacatttacatgtcacttctgaggtccttaaccagtagggttctgatgttctataaaaacacgatttaatttatagaaagtcagtatgcacacagtttgattacgaagttcagtttgcactgtgccgacttttgctttcattggattcataatgactgcataataaaatccaaatcctcttaattagcacaaagggttcttctgttatttatatttctagaagactcacacaataaattgtttt

SEQ ID NO: 47869 - DNA, 1792 bp, Bovine  19866881327328
caggttacagcattggttttgtcaaatttctaacggttccaaagcattaacattaccattttatataacatctctcaatttaaaaatgctgacttgatatttgttaacctcaaatataatctaagaatatttggtaagggaaaaagttcacaataagaatcatcttctgcaatttataggataactagccagatagcatatttgaagttgtctttttttttttttaatattgaaagctaagcacagattttatcaaaatatcatgctcctttaatacttaactatatacattcacaaaaatgctatagtgttagatttaaaaataatatttagatatgaaataaatgtttttccacttgattgcattaactagaaacacttatttaaaaaaaaaattgttaatggacaattctggaaagctgcccaagatgtgtgtttagtataaacttatgccataaatggattgctgtcatccatttaaagattatttcaatgaccgagacatagatctctcacctgaatcttctccagaatggataaaatttagaataatgtgaggcaatattaaaaattcattgaaatgaaatccatttggaattattttgacttcaattatcagcatatctcttcacagataatagaaaatcactcaaaaatagagggaaaaaaaggttctgaagatcataacacaaactgacatatgtagaatactcactcaacaacagaatgtattttgtttgtaagtatatatataaagttcatcaaaaacaaccatgtggtgaattataacaaagcttcaacaaaatttaaaatatttaaataagttgaaatattaaaatatttgaagtaattcaaattattttatctaattatgggattaaaatggaaatcagtaataaaattatactagaaaaaggtgtactacctgaaaactaaataatacattcctaaacaactcataggtcaagaaatgaatcagcatagataacagaaaattactgaactgaattataataaaatataccagatcaaaacttgtgggatatagtttaagcaatgtttaaagaaaaaaaatatgacataggcatatataaaaagaagaatgggtgaattttttaaaaaaaactttttatttcaaggatgagtgtgaaaaaaagaaaggaatactaaaatgaaaacaaatgaaggacatttgaaaactactgtagaatagagaaaaagacaaaatcaaaaattagaattttgaaaagactgaaatttgttaatttgttaatccttaacgagattgatcaaggcaaaaaagataaaaaacaaaataacaaaaataaaaatggaaaagatggcataaatatagatctgtaatacaaataactaaagatcattatgaataactttgaagaagggaaacataatttagttagaatgaacaaatgtccatagattacaatttacttaagaagtgatatataaaatcttactagtgaagcatctgttaaagaaattaaatttgttattttaaaaatgttgccacaggaaactccagtaccagatgcttttaatagtaaatttttataactattttaaaaaagaaataactgtaatctcacacaaaatttctgaaaaaaaaaaattgaaggtgacctttacttttatgaggctgacagaacaataaatcctaaatcttgtcaagaagaatcatgatagaaaatatatatatatatatatatatatatatatatatatatatcaacacaagccatatagaagcactaactaaaattcaacacccttt

SEQ ID NO: 47870 - DNA, 784 bp, Bovine  19866881332309
atatcaaacatgtattgaattggcactttcataccatgaagagggaatgaccttatacaaggatggattaaaatgctttggaagttctaaggaaacctgctgattcacttaataaaatcaaatgttgggtatccaaggctagcaaaggaaagaaaattgtttttaccactctgactcttgtcctcaagactttcttctcaaggtctgttaataatagttactagtctaaggatattgaagcagaaaaagacatagtgttcttcagggttcctgcctgatgttgtaaaacttgcctgtgcttctcttatatattaatatgcaatgtatcccaaatctatagcacagtgctttgtatataacatacacttgatacataatttcttaatgaatgtaaatattagagaccagaatgaagcattaaaaattgtttttgcattatctcggggataaaacaaatgaatgcaaacatcaatagaaaattaatattctactaaccttgatcttagtgatcaagatggacttcattcgaaagatagacttaacaagctgtggatggttatttcatgacctcaatagagaacaagataataataaaataagattatctatacaggaaatgcacatatacataaagactgttttctgtaaaatagggtaaagtatatttactttatacttccagattgtttgtaaaaccttcatcatgcaaattttgtttcccttttatgggagttggtgatggacagggaggcctggcgtgctgcgattcatggggtcacaaaga

SEQ ID NO: 47871 - DNA, 1277 bp, Bovine  19866881364828
tactcagtatttggttctattttttttgaaatttcgaaatacactttgtaaaatcttttggtgggtgtcttgtgttgactgatatttccagtatgtttaatatttgtacatttagtgacactatcattgttattatccatgtgaaccactttagcttatctgcctaaagttagcaattctgtgattgaattctccaatcttttatcttccacactacaaacttgctgcagtatttgttaatgtcattcattaaacattaaacatgtgcaataaaattttattgaattgaaagatgtatgtcttgactcttatctgttggagtacaatagacacaaatttatttgagtttggggagttttattttaaggccacttagctagtatatgaccaataatggccaccacttttcattgttctaccactatatcagagttagaggaacttgttgcagacaagaagaaaattaaaaatgaatttttcaatttaaattaaaagttaaaatctgtttcattctggaacatctgcatttcactaactgtgcttttgatgaatgaaaatctatctaggtattcctaaaacaattactgtgaaagtgaaatataactaccctgtaatttatgataaattatttttttatcccctgagcaactctgcattaaatggaatgagtaactatgtaatcatattgtttatcataaccaatgcttgctctatgtagattcatactgccatgtaattataatattaaagtataaagtaggataaatgcaaattcattcttattcacaccttttttcttcgattgtccagttcaacttgattaactttgaggagaaatttgttctgctaatgcttattacttcacaaaagtatccccacctgccatctctctctctctttttttttaaatatgtgtttaaactgactttacagtcctcaaattgtggaaggaacaaatagagggatgacagatggaataatgaaaaggaaaaggcacctgtatgtgagagaaatcttttgttaatgcaattaaatagaaattatcatttgtcttgtgtgtatggagttccctggggtgaagaaaggcaatattattttcattttagagtgtaaatcctcaggaggtgagagtttaactgattttctggtccatatgctttgttcttccctgagatttgacattacctctcgtaaaacggcagtctttctttagactaaggagatgtgtaattataactgaaattagatctctaagtcactttgctctctttccattt

SEQ ID NO: 47872 - DNA, 897 bp, Bovine  19866881796957
tgaagttctcacgctgttgtgaaagttctaggctccacaaccaacgtcgcaacctggggatcctgaaaagggactgagtatccccagggaatctgactttgaaggtcagcaggatttgattatagaacttctacaaggactgggaaacaaagactcttgaaaggcacaatcaaaaccctgtgtgcaccagaacccaagagaaaggaacagtaatctcacaagagactgagccagacttgtctgtgtgtgtttaggagtctctggtggaggcctgggtctacagtgtcctgccatggggtcaggggcactgatacagcagttctggaaggcctggcatgcttggattaagtccttttgaaggagatcagcattactacctattacccctcccataggggaacacagccccacccatcagcataaaattggattaaagacttactgagcatggccatgcccaccagaaaaagacccagttttccccacagccagttcctcccaccaggaagctttaacaagccttttatcctcattcatcagagggcagacagaatgaaaaccatagtcacacaaaactaacccaactgatcacatggaccacaaccttgcctaactcagtgaaactatgagccatgccatgtagggccaccccagatagacaggtcatggtgggagagttctgacaaaacatagtccactggagaagtgaatgggaaaccaattcagcattcttgagaacaccatgaacagtatgaaaagtcaaagctagccaaccataatacagagaacagctttgaaaactcaacagtaaaataaatcttcattagttggttagctcaagcatgtctgtacttcttaaaaccccaaaagggtaatatagcaccaaacacatttcca

SEQ ID NO: 47873 - DNA, 1215 bp, Bovine  19866881929516
cacacacactacccttttaagataataaatataattatcttcaagtttatattattaaatagactcagtgctttcttatgataaagtctttgttgaatttatgtagaattatatggaattatgggccaatgtttgaatatatatctaaatataaaattcagatggtggaaactccctccagaagtgtatagaattggcatccgtcctataggtttaaagaggtcttgattccaccacaaaaatactgaactttattatccctagtctctatgccagtttaaaaagtaaacacaagttttacattagtttaaatcatattctctgacgctagtaattgtgtccgtgtatttatcatattctacatatctgttcgtgtacacatgtatgtatatatttatctatctatatatccatgagtcatctccactgcaagtcacatgatcaccacccctttccacttataagagacacagattcagtccctaggtcagaaagatcccctgaaggaggaaatgacaacccaccccaatatctacctgaagaatcccatgggcagaggagcctagtgggctacagtccatggggtcacaaagagttggatatcattgaagtgaggtagcatttgtcttttcactgttaattgaatttaactacttttttgtaaaaaagattaaagctttgtatgttataaatactgactatgttttcctagtttttgcttacttttcaattctgcctattcatcagtatttaatgcccagaatttaaaatttttgtgaggtccaatcagtcaatcttttcttttatggtttctgtgtttggtggtaaagagtgatttgaaacaagagttttctttttcaataaacttttattgagcacttgtcctggcttaggggcagagagagtcaattaagtgcttgtcccgcatgaaatttcaatctagttgtggagacagaaaaataaatgtacattcacacaacattaagaaatgttttaccaacagcaatctacaaataaatgcaaattgatacagtgtaaatggagaacatatgtgctaagaataaaggaatgggtaattgaatggaacttttcaagggagggaaattagagataaaacacacaaggcttttaaaattctcatgacaccatttttcattggttctatgcatctatggattattccactttccctatattggaacaagctgaacattg

SEQ ID NO: 47874 - DNA, 1989 bp, Bovine  19866880166883
tatataccaaagtacatgaagaagtcaggttgacagttatttcccattagttatttggtcatcagacatttttatggaagggcaatgcttaaaacagaatttgaattaagtcattcagattgtttttttttttttttttccatttgcttcattcttttactgctgaactcctagaagggatttcatgcagagaaatacagaataggatccaaatattccctctttttagataatcctatcccttgctaattatatggacatagctctgtgagacagaaacaactgtcttactgagattagattttatagttctcttgtctttttatacaaaataggcatcttgcttacttggtttccattgtgaagaaggctgtccttgcattttagctttctctccaaatcttgaataagagcttcttttgatccttgtatttcgtggtcaggagtttttggtgtgagcttagcatttgcattttgggatgacttaacatttatgggttggcctactgagggttgttgatagctttaaaaaaaataaaatatttttttttatttatttacttcacaatgctgtattggttttgccatacatcaacatgcatccgccacaggtgtcattgtgttccccatccctgaacccccctcccacctccctccccataccatccctctgggtcatcccagtgcaccagccccaagcttcctgtatcctgcatcaaacctgaactggcggttcatttcttatatgatattatacatgttttaatgccattctcccaaatcatcacccacctccctctcccacagagtccaaaagactgttctatacatctgtgtctcttttgctgtctcgcatacagggttgtcattaccatctttctaaattccatatatatgtgttagtatactgtattggtgtttttctttctggcttacttcactctgtataataggttccagtttcatccacctcattagaactgattcaaatgtattctttttaatggctgagtaatactccattgtgtatatttttaatatactgtctaggttgatcatagctttccttccaaggagcaagcgtcttttaatttcattgctgcagtcacctgcagcatcatctgcagtgattttggagcccccagaataaagtctatcactgtttccccatctatttgccatgaagtgatgggactggatgtgatgatcttagttttctgaatgttgagttttaaatcaattttttcactctcctctttcacttttatcaagaggctttttagttcttcttcactttccgccataagggtggtgtcatctgcctatctgaagttattgtatttctcctggcaatcttgattccagcttgtgcttcatctaccccagcattttgcatgatgtactctgcatagaagttaaacaagcagggtgacaatacacagccttaatgtactcttttctcaatttgaaatgtgtctgttgttccatgtccagttctaactgttgcttcttgacctgcatacagatttctcaggaggcaggtcaggaggtctggtattcccatctcttgaagaattttccacagtttgttgtgatccaaagacaaagtttagtattaatagaagttgaaagacttttcttagttttcatcactgtcacaatcaatataagccccttgaaaacaaacttttgaaccataagtagcagcacactgtaactatgtctagaattcttatgatatccattactttaataatctgaatcattatcttgatccttcagttcatgtgcaaaatgccaaattttgatgaggaatacatttttctattttatttttttgtgcatgcttggaggcagaattaacaaaaagatcaataagaactctcaatgagaataaacagaataagaaagcaaacccccttttctctaataagccaagaaaagagacaataccatacttacgttaatgcatacctaatgtgtacctaa

SEQ ID NO: 47875 - DNA, 1023 bp, Bovine  19866881432061
aacttgctatacagaccaaatcatgtttctccacttccccaccttcccagtgacacaacaccatcattctgctctcttgccttcgcctagacacactccttctcttgaagcaaactgcttgaatcccactctacccctccttccatttggcaagagaggaaaaaaagaggtcttcatatgaatagctatctaacagaaatcaatttgaagcccacccgtcagtggtcttatttctggagaagtcttagtagtcagaatgtcagtcttagaatactatttccctttcagcccttttttcaacaaggaatatcaaagcccccttcacaaaaagagaaaatgagttttctctacaccttttcccatttctcagttctttgctgtcccccctacatgtgcttactaaagctcctagtcaaagttcacatctaaaataaagaggcttgcaagagaagctcatgtaatcccactccttaaatatcactaagacatctgagatattgtttagatcatggactcttactttgacatgccagcataggtagatggacaggcaagcacatcagatgtcactgcttggcagctgataaaagtcagtggtgctataatactaagcacagagccactagattagtctgcgagggaaggggatgcctcttccttccctttagtagtaggtttaacccagctggcactctctggaactcgggtaagtcccttctttattcctgcttcagtttggggttttgtttttgttttttgtccaaatcagaacagtatgtaaaaggtgatcttcagataaaacgttcaaaagccacaagatcataatggcattacacaaagatttgaaaagaatgagacctgttcattccactgaaactataaggcattaaaaaaggtagaaggaaagatagttgtgtgtcattatttttcaatcatcagttttctttgaaaaaggacacctggcctaactgtaactgtgcaatgtcctatatttcaaaataccctcagttttctgtttaagtt

SEQ ID NO: 47876 - DNA, 1815 bp, Bovine  19866880255158
aagagttccagaaaaacatcacttttgctttactgagtacgccaaagctttgactgtgtggatcacatcaaactgtggaaaattctgcaagagatgggaataccagactacttgatctgcatcctgagaaatctgtatgcaggtcaagaagtaacagttagaactggacatgtaacaacagactggttccaaatcgggaaaggagtacgtcaaggctgtatactgttaccctgcttatttaacttatatgcagagtacatcatgtgaaatgctgggctagatgaagcacaagctggaatcaagattgctgggagaaatatcatcagtaacctcagatatgcagatgataccacactcatggcagaaagtgaagaactaaagatcctcttgatgaaagtgaaagaggagagtgaaaagttggcttaaagctcaacattcagaaaactaagatcatggcatctggtcccttcacttcatggcaaatagatggggaaataatggaaacagtgagactatttttgggggatccaaaatcactgcagatggtgactgcagccatgaaattaaaagatgcttactccttggaagaaaagctgtgaccaacctagacatattaaaaagcagacacattactttaccaacagagatccatttagtcaaagatatggtttttccagtagtcacgtatggatgtgagagttggactataaagaaagctgaacgccaaagaattgatgcttttgaacggtggtgttggagaagactcttgagagtcccttggactgcaaggagatccaaccagtcgattctgaaggattcagccctaggatttctttggaaggaatgatgctgaagctgaaactccagtactttggccacctcattggaagagttgactcattggaaaagactctgatgctgggagggattaggggcaggaggagaaggggacaacagaggatgagatggctggatggcatcactgactcagtggacatgagtctgagtgaactccgggagttggtgatggacagggaggtctggcatgctgcgattcatggggtggcaaagagtcagacatgactgagcgactaactgaactgaactgatggtttatggaactttaaagagtaagtataaaaatgactcaaatccccacatgaaaaagaatattgatttgagggagtgtgaaatgttaatgtgtctcacatcaaagaggctcagcttaaatataacaactagtaacacagcagagagcggaaattgtggctcttcttttctcccccaagagtctctgatctccccctacagcctcagagcacccttcacatgaatcgcaagagcctcactagggttttgatctgcatgtttctatgaatcccagagtgaccaagtttatcaaatcactcagaaataccttaaatatttatcacagggccatattgcctatcccaggctaactctggccattgtttgcctcattatgtgtgctctgttgctcagtcatgtccgatttctgcgacccccatggactgtagcccaccaggctgttctgtccctgggattacaggcaagaatactggggtggattgccatttcctcctccaggggacccaggggttgaactagcatctcttgagtctcctgcattgacaggtgggttctttaccactagtgccatctggaaatccctggcaattgtttgcctaattatagttagagcaaataaagaactctaggcattttagggagaaggcaatgacaccccactccagtactcttggctggaaaatcccatggatggaggagcctggt

SEQ ID NO: 47877 - DNA, 1773 bp, Bovine  19866880349527
atcataataacaactatctcatcatgtgaaggtgagaatgaagcaaattaattgtttgtaaaccacttataaacaatgtctgacaccttataaatgccatgtaagtgtttgttaattaaaataaataatggctaaacattagctattattgcttctttcacttttttggtattatttcttcttaaagctaccatccaatccctctattgcctttcatcactaaatttctcaaaaggatggcttacactgcagattctccactaattgcctccagttcctcaagccactataagactgaaaccaccgtcttccaagatgctaatggcgttcttgacctatgactccacaaagtctcttttcctttcatttgccttctagtatctgacttagaacctcttcctcccattggagaatcaaatccagcgccttgtcagccatcattgctccacgtactccatcccttgacacagccttcccaaaggttctccttgccttcttacgctcctccctctccctggtgatgccatccttactcctgtcttcagttattgcccacatgccattgactctcacacctacgaggcctgacgttttccccctgagcactagcccaaaagcctgactgtccagacagagaagatatcctaccaaatattcaattacaacatgtgaatctgctccctctcatgtgttgccacaagtctctgtttctggcatttagcctccaaagtttgaaatcttagtctttgttgttctgtacccgtatgtgcctttgcatttcacaagtaagtttcacctcccttagtgcagttgttccctatgacgaccttaagaacattatttggtgagtgatttagtaagtctcaatttagatgcgtcgtctttcctcagactgacaaaacgagtatatttgccaattattttaagaaaggctggtacaactgcttacaaaggaagaaaacaaggctcatgaaagttaggtagcttgtcaaggtgttggaagggtcaaatacaatagtaagtgcaatggaagcttcatgaaccataaaacatgatgaaaataccaggttttaataattactaataaaatattaaattattgttgaaacaacacatttggtaaatgtcaaaggagaagtactgtatgctcattcagtcatatctggttctttgcaaccccatggactgtagtctatgaggctcctctgttatgggatttcccaggcaaaaatactgttgagaattactcggtgcataaaatatggaggggagagaaagatttcagtttgatgaccttctaaatgaccagaggcaaagtctagcagttgccaacctggctgggcctggatgatgcattcggagactttatcttcacctccccatattccgggtgccacacagtcactgaggatatcccagcattatttgactaagtgcctgagacacaggcctctagaatgtaccagaggaagccaccaaaagctgtgtctcattacttcttgtgtttttaagttatttaagaaaaattaatcttgtttatttttattgtaataggttgacttacaaaattgtgtttgttggtggtgtaaagactcttgtccacttatactcatattatagctattcagctgtgctttttttttttcacatgtaagttattacggagtgtttagtacaccactcttgctaaagtaggtccatgttgattatatatttgcaatgctcctttccccagactggaaaaatggacatattgccaatgctgttaaagga

SEQ ID NO: 47878 - DNA, 750 bp, Bovine  19866880677908
agctcggcttagaaccaggtattagagcaggaatgtagcaggtcccacggtgtgattgctcctctccaggcaagttagtgcccacaccaggggagggtggggaggagaacagaacagaaacacaaggctcccagctgattctggagctagattccctccacagtggtgcctcagccaaactctgccacatcagtcctctggcctggagtttgacacccactgccattcattagagtcaggtgacaatgacacatgcgggccttggccagcaagcatcctgagatagataacaaagtccagccgccagcgctgtgctgcacctccccagaatgagatcagagctcaggagggcacgtggcagagctgcctggcctcagggagttgtgcccaggccctgcctgcctctctgcccggtaggaggggctggggctccatgcgggacgtcctggtctgaggtggggtgccttcactccagggcagctatgtcaggtgaggaggccaggctgactggtgtgaccatgtgtgctaccacctgcccacccttcctagcagacaactggaggtttctcactgtgagtcttccttcccgggcagactgggacggaggactgccttcgggttttctcccgcagacggaaattcaaagccaacaggcctctccccgagagactgcagacccaggccaaggttcccaggaaatggccagctcaccctgtctgacaagtgacctctcctgacaagtggccaatt

SEQ ID NO: 47879 - DNA, 5585 bp, Bovine  19866880679383
ataaattatctatagagctatcttgaagattaaaatggcccaatgtacatgtagaaggtaagcagagaggtatttgtgggtgtgttttaatatgaatgctgctgtagcatttacttttaaagaccagttagagataaaattgaagaattaacaagatgattccagcttgttgtggatgattccaatcaacaaggaattccagcttcacttatcccgcaggagtaaatacttcttttgtgtgtctatgtgagcatgcatagaggttgaaagtcagtggtgacttgtgtcctatttgattatgaattttcaccaggtggcagcagagtattatgagacatcacagaattcagtgtcctactcagaccacagagtagagaccagcaagcgatggtggcttgaatatctgtccactgatgtcggttgggtgttttaagtttcctgctattattgtattcctgtcagtttctccctttgtgtctatttctatttatgtatttgggtgcctgtatgttgatgagtgtaaaatcctcttcttgcattgatctttttttttttttaattaaaagtattgatttatttgtctgccctggatctaagttgcagcacgtgggatctttgttgaagtatgtagaatctttagttttggcatgtaaactcttagttgtggcatgtgggacctagttccttgaccagggatcaaacccctgggccccctgcattggaagcatggagtcttaaccactggaccacgagggaagtcccttgtgttgattttttcctcattatatagtgtccttctttacctttatgcgctttgttttaaagtctatttcatctgatatgaatgttgcaacagagttagcagatgcaaactatcacatatagaattgataaataataaagtcctactgtataacataaggaactatattaagtatcctttccatatgatggaaaagaaaatgaaaaagaatataaatatatatatatgtgtgtgtgtgtgtgtgtgtatgtgtgcacacacataattaagtcactttgatgtacagcagaaattaatacaacattataaatcaaccatacttgaataaaaaagagtaagtgagaaaagagaggggttggcttattcagggcagtcctcattctgaaagcagctcattagatctggcaagtcaagctccaatatgagttcaaaaataccatctccatataaaaactagcagagaaatgtcaggtggatgaggggagagatgcttggagaaatcaacatgggagtgacaagagagtacctcactgagtcagtgtgtgtggaagttcactagtgggtatgaaattcagggcctgatctgtatgttggaaggagaaccagttgtctgtctagtttgcctggtgaagtcctgaaggtgttctgttccacagtttagcccaggctcaccattatggctcatctgggtcagcttttgtctctggaagatcactgttataatgtaagtacaggacatccctccaacccctttgggacaaaagtttaagtcttattaactgagatcaattcttcgattagtttatgccactttgaaagagtgaattgtctcaaggaagggagtggaaaccaatagttttaagccagaagtggagggaaaggttaaagtcatactacaggatcagaatttagggtgaattcccactcctcattttggctgacagctaggagctggcctggccctatcaggtaggatattgctggagctggccctgtactcttggctaggctgtggtgttctccggttgaacagaaacaatttcactcaaccccaatatctgacaaggccagtctgcaaccacagtgggcaaggcaaaaaaaaaaaaaaaattgttactcaggtctgaacacagatacaaatgagagcactgtcaaaagtgagcaaaaaaatgaccaaacatgctaataatctgatgaatatgagtgagtgagttatatttctttgctgattaaagtttggccatgtttcactcctcataccttcttctctggtggctcagacagtaaaaatctgcctgcaatgcaggagacctctgttcgatccctggatcaggaagatcccctggggaaggaaatggcaacccactccagtattgttactgggaaaaatcgaatggacagaagagcttggcgggctacactcacggggtcgcaaagtgtcggatacaactgagtgactgacgcacagcacacactcctcacaccttctaggtaagaatgatcaggatacgcagtcatagaatcctggcagtatcctgcccagaccaaggccttgtttccttaaatcctccctccaaatcccctaacacaaggttcagtaagagagtgctggatgtttgggaagaggatagaattggagaagaacatgccccaggaaatggaaagaaggatgaggacaaaaacctctctgcttcacaatggggccttgggaaggccctcatttctctgtgttcagcgaccagaagccaaggaccctggctgcatgtgttgctgacattcatcctctgttccatatctgagcaaaggagcctgtggtcctgcagaagcctggcatctgggatggggagtgagttcattcagcccactgcctcttctccttcctaagcagctgactccttcttctgatgtggttttgtggttagacagtaagcagcacggctcatgtggacatggtgtgctttcagtttctgaaagtgagtcatgttgactttcctcttgggagtaagagtgacccttgctgagaaggactatatgactagaaagaagaaacaccaaggccaccagtgccagagtgtttaccactgcaggtagtcactagtttctgggagtggtatgtgtcatcgctgtaagcaaggtgaactaggaagaggaatttggttttgaatcttcaagtatttgccaatgtttgaagtttttattctcactcatccattggagtgatgccaatggcaaaagagctcaggatctatcagattagatcagatcagtcgcttagtcatgtccgactctttgcgaccccatgaatcgcagcacgccaggcctccctgtccgtcaccaactcccggagttcactgagactcacgtccatcgagtcagtgatgccatccagccatctcatcctctgtcgtccccttctccttctgcccccaatccctcccagcatcagagtcttttccaatgagtcaactcttcacatgaggtggccaaagtactggagtttcagcttcagcatcagtccttccaaagaaaacccagcactgatctccttcagaatggactggttggatctccttgcagtccaagggactctcaagagccttctccaacaccacagctcaaaagcatcaattcttcggtgctcagccttcttcacagtccaactctcacatccatacatgaccacaggaaaaaccatagccttgactagacgaacctttgttggcaaagtaatgtctctgcttttgaatatgctatctaggttggtcataaggatctatagatggactcaaataaatttatattcgatcagctggtatatgatggggagggtttccaagaggattatttgctattgttacatctttaatccttgtgtctactaacaagctcatgatactggaccactcataaaggtcctaagaaatcatggcatacctgttgagaattgaagttgaacttgtaaagagccaatagacaaaagaaggactttcttctttgtgggtccatttggttaatctttcatgaaagaatgtaaagccaggaggaagctatgaagcagtcatgtcactgcttctgggcccttgataagcattgttctttaattgtagcattctttcacactgagccaggatgtagcctcaagacatttcttatctctgtgctccagacagccactacaccagatcccagtgggcatctagaacatcccaacgtctgttctagattctcagtttaactttgctcttgagtatccaggttatgggagtgccacattgaggaggttgcatttctttcctcaataagtaaatcctttttagttgaagaaaagagcaaagggaattattcttgaattctgcatcactgatccatcaactattacctattgccttgttaagttatttgggtgagattaagagagttatgagaaaaggcctattgtggagaaagatgaggcattctaaacagtttgtgtctataagtatgcaaatacggcgggccacttcatggggctgaattttcaaggcaatatgacattcaattctttttaggtattaggcctgtcatttggtagttgctatgaggtagggggtagcatctattagggcagattagattcagtaaggagacttattaaactgttaacattttagaagatttagcatgtgatagctatttatgcatcttctataaaatgtacttttaaaatcataatatattattaaatacagtgccacctgagtcttggttgcacttaatagatataagctctagattatatcatcaggaaagggacttattggaaggcaactgcttcagagaagcagcaagaaggttagaaaacagacttccatcaaaagacatttgctacacttatgtcagactgacacaggagctctgtgcttgtctcacttctcttcatacctggagtccttactcttttgtaacatgaacccatttggctatcaaatgaagtctatgaaccacttctcagaatattttaaaatctgtcagataaagtatgcaggcttataaaagaaaccagttatactgaaatatggttatcaaaatattaaaaaatcccatgtgtgggatatatagcaacatatatgcttctttattaatgcattagataaacttaactggtgactctaatattgcagcttcaggaatgatgagcataagtgtatcttgggtatctgttagtagtttacaatatctgtaaggattataaagaagatgaaaatacttaatttcaataggagacaaggtcacaattactgctaatactactggggttagtttattgcctacattcttaattgaaggacatgaaaaattgtagttagaaattagaggaaataatagtgtatatattttttcaattcaatttcatggatttccctttattctgtttatagattccaggttaagaattcctattttagactgtgaactcctaattcagctttgtgtgtatgtgatccccttttgtgaaacatctgtatgtattcctctatgtatgtataaccctaaccctaaccctaaccgtctaggtggatagcttttttgtctgtaatgagtggaacattatttttccccccaagcactcatggaaataactgaaacatgaagcaacagatcccaaccacagtacagatcatcattcagtactggtggttcttggcttgcttctgtctggaagaactcccgctcagctcctctgctgtcgtggtactccttgttttcccagtcatatcagccaaacgctatggtgcagtctcctatggttccactgtgggagctggatgctattttgggttga

SEQ ID NO: 47880 - DNA, 1522 bp, Bovine  19866880688946
gtcacactctacttatttttctcaccaccagttcctagcacagggttttgtgcattaatgagtgtttgataaatttttattgaacaagatttaagatttcttgagcctcagagtccttgagggtgctctctgaagtctgctctagttcttagaaaattaaatatggttttagttggggccaacttcctggaagagagaagacttgagctgtgctgtgaagaattgggtggatggtgtttgaatgataatcagacggaacactaacattgtgtttctgacacagagtagggggagatgagtttgggttggtagaattggcttattagaaacttctgatgaggggcaggtggatttgggcttatctacacaggcagaagaagcacttgagattcttgaacagaggagtgatattttcagagccatcctgcaagaagaacaatccagcacaagatacaaaaccaactacgtgggaaacaggtgggaatcagtgaggccaaggagatatcaaggctgttcaacaggggccagatgctgagggcatggatcagagtggcagttgagtgaaaaaaaaaaaagagtttgagccattagaggaaaaataaacaaagactgattgcatgtcataacaacagaaagcaaagagtcatgacattttcagatacagcagcagaaagttagggatataatgaacaaaaaaggaatttggagaggaaggatggtttatgggttagcaggtgactttagtttcaaatcttttaatttgagatgatgaaacattgcaatacttcataggtactgctgctactgctgctgctaagttgcttcagtcgtgttcgactctgtgtgaccccatagacagcagctcactaggctcctctgtccctgggattctccaggcaagaatactggagtgggttgccatttccttctccagtgcataaaagtgaaaagtggaagcgaagtcgctcagtcatgttcgactcttagcgaccccatggactggagcctaccaggctcctccatccatgggattttccaggcaagagtactggagtggggtgcctttgccttctccgtcatagatactaggtatgcttaagagatgctgtatgcatttgagtgggtgaatgaatgaatggaatcttaatgaaagagttcatcaggcatatggaatctctgactgaaatctcttgtcggatagaccatgtctggaactgtgacttagatttataaattatcaacttagagttgtgagaactactggagtacatgaacttctggaggaatttttagagggggagagaaaggcagaggactcaggtgtgagcctggggtgctttctttctctgaagtaaacagaagatccattgaaagccaatgagtgtgttaggttagctagatacagatctgttgctctgagcctgaatagtctataatacagttacacagctctcaaatataacagagttgttggaatctatcagaaaacaaatttgcagtcataaagctacttttcaacata

SEQ ID NO: 47881 - DNA, 1308 bp, Bovine  19866880735573
ttctagttccttgaggtgctaagaagaggggttaagagctgtttttgctcttgcacctcaaattctacaagtataaaggaaagtttttttgcttcttagttttgtttgtttgtttttaaaaatagtgttgataacacaatgttcatcttttaaatgcttttaaatgttcctgttagctaccagaatcacaatagcatcgttgaccacaaaacatgctttcattctaatggggcctggagcctctgctctaagtctaggtggagacagacacagaattgcatgtaaacaaaagttcatgaagtgcgttgcagatgctctcctccagccaactcttcagagcaacttcctgttctcatgaggaacaaaccagaatgaattgctttatgtagacaggataggagaaagatagtgtcattttctcatctgagattatgacttgatactcatctacttagttcagatctttaacagaaaggggaagttctgataaaaagctagttatgagggaagatgatgcatttaattttagaaacattgaatttcagaatctagtgagtttttggaacacagaatccagttttgaagtgcgtatcattaggctttgaacacatggagtttaaggttcagcgagattttcctatggaggtgtccaactgtcagagctgacatagaagaggtatcagggccagagttacagatttggtcattacttgtatgtttgaagctttgtgaggtgatggggaaactcctggactgccaaagcagggattgaggattgagccttgggttatacccaatttggtacatggaaggagaaagtgaaaccaagaaaaaaaaagatgaatagatatggtagggagattgtgacaatatagccttgtgcatgcaaacaccgatagaattctgagaaggcatgtgtgcttatgtaactaagcaagggcttgtgtgcccacaaggcagaaagccaaactctggtaccaattatttgcagcaaagcaaggatttatttgcagggagtcaagcaaaggagtgggagacaggactcagagccattcaaccttggtctttcagttagggatattgttaaggggaagaacagaaaaactgggataaatcatcatcctgtgacatttcttaatcatgtttttaggagtcaagaagtgtccagtttatgattctctagccaggtggcccaaggcttaggggtctctgagctcatcttgtcctggaaaagcaactttagtttgtatattaatattgaaatataacaatagcaactttagaccatgacaatatttacggacaact

SEQ ID NO: 47882 - DNA, 1719 bp, Bovine  19866880785180
ggcatggttcctacaaactcgctgattgggcaggatgcctcaggagtaagggtgaagtaggggcagaatggtccttatacagcaaccaacccagattcagatcagatcaacacctgatattggatttcagtgacgccaggtttcaaatttctcaggaacctaacagaaacaaacctctcttgagaatgacgacactatcctagacctcaaacaggaaatttgtcaaagtctagcagataataaaaattaatcatacgtgtggggagacgagataacacaggtgagaaacaacagaaataatgcttctaaatatgcttctaaatatggttgccaaacacaactttagaataattctgcttgttattttcagggagacagaggatgagatggctggatggcatcactgactcgatggacgtgagtctgagtgaactccgggagttggtgatggacagggaggcctggtgtgctgcgatacatggggtcgcaaagagtcagacacgactaagcaactgaactgaactgaatagatactatcaaaaatttcagcagagactggggactatttttttaagtagcaaattttaaaaagagctatttaatttgagaacattaatgacaacccccaagtaaatctccctgatggtatcagacagctaacaagtagagaagaattataagactaagagatgcttatatggacattagattcataacaagtagggaaaagtattaatatattgttttcaataaatgatgttggagcaattaaacatctatatgaaaaatgtgaaatgatctttatttcacacaacatatttcattgattccatgtatattcatgacctgggggtgaagaaagaattattaaagaggttactgaaataactgctccagagagaaaaagcatagtagtagaaaaaagatgtagagaaggaaaagttgaagaaaaagagaaaaggaaagttgatggtataagtttccagaaaggataggaacagattatgaggagttgacacttgtaatttttcatacatcttaaaaaatgacctgattagtcccaatgcttcagtgaaagtgttagtcactcagttatgtccaattctttgcagacccccatggactgtagctctccaagctcctctgtaatgggagaggagaatcatgggattctccaggcaagaataagggagtgggtagccattcccttctccaggggatcttcccaacccaaggatggaacctgggtctcctgcattgcagaaagattctttactatctaagtcaccaaggaagcttcagtatatgaagagatttgtatagtacatagttttagctgagtcacatggttctttctctctcttgccacttacaaaaaaaaatcttttgactatgtttggtaatcaatatcctgaccctaatcatgaatatcctattatgattctttctattcttgtatcacctctgttgataagatggaaaagtattctatctctggttatatccggttgaatcctgaggtaaagaaaagcagtaaatacctgctcctgagaaggtatatttctgagaatgtattagagatacactggttgagatggaagaggttgtatgtaaactttcaactttcagatatttctggcctaaaattccaccattatcaattcaagcttttgtaataaactctgactagtctctcttcaggttacccacatcagaaag

SEQ ID NO: 47883 - DNA, 830 bp, Bovine  19866880791077
aattgcatctttgttcctacccagcgagctggacggttggtgctaggagagcactattgctgcaatcaccagggttcagttagagagtaactcacacttgtttccatactggcctgtgcacatgctctttgtttgtgtatatgtttgttatttatccaattgaaatgataagtcattcaaaggcagggtcctagtacctaaaccctttcatatcctcagagcccccaatattaggatctcacctcctgtttttttcattctgcttagcaattgagaaatgaacttttcttccttcttagtatcgctagaatgtgagtagttcccatggcgatatggtgggagcgtgagacattgttctcatcctcatgaagtgacacatttttctagagagacaagaattacaaatatgaaacaggggcagtgcttactaaggtgctaaattgaggtgggtttgagggggacatggctgaaacaggattgactgtcctcgttttctctagagattaagtttttctatttctagacattctaatttaatcttgattcttaagactgtagttcatagattgactaacagaaacaagtctgtgcttcctcctcttctgggaaattttctgtattctattgggcacggtcatcctcatcctcagactctcccaacctaggaactacacccatgcaggatactccaacagggcttccttagaggagacaaggccattctgccaaaccctgtttcacatctactctttggagttacagattcttgggcatttttaggaagatgggcagctccagtgtaatatcgcagggcccaggagccaacaggc

SEQ ID NO: 47884 - DNA, 1466 bp, Bovine  19866880861395
tgattgtctccgagtgaagtgggactaccctctgaaaaatgcctaacattttcctccaagctgtccagcggctgcaagagaaccaccctaatgtggatgactgcttgcccactctttaaaagcttaaatataacctattaaaatttaaatcagatctgactcttaagtaatctcttatagagtttaaataggagagcaaggatctttcccagcaacagctgtgtctgcctgcacctccccttttctcctgaggagctatagccgccgccctgtgcatgggaatcaggaggcctgaggaagggggcaggcctggagccagctccttgtgggggcaaaggtccagggttgtacatgtgtgtttctctttccaaattcaagcagaaattagttttgaatttttttgtgatacttaactaaactaattttgaacagttaaactcacttcatattttagggcagtttcaagaaccaaaatgacatgagattttggaattggttaggatttctcttccatagtctatatgtgcccaagaataagatggaattcaaggtactcctccaacatggttcggtgctgaggactgtttttagaaactcagtgtgcaagcataaaaaaactcacctatttgcttctccaaagatgatgctgtatgcctttggctggtggactggcaaaagagaaaagatatataataactatgaagctctttaagcaaaggaagaactgtcaaataaactaagcactggaaaggaaatctaagcacgcagaacctctcctaactcagactctggccaagcaattgtgcctgtccatgcctcagttttgcgatttgaaatagttctaatacttttaagcacttccagggaaatttagtttgtgcatttgaacaaattcacttctcagatgccaagttccttttctttgttgaatcaagtatgaggtaggtagtaaaggtcttcctttctcagatgatcagccaactgagaaaggaagaactcttaactgccagtcctaatttgatcctgatccctcccaagatagaaaatactccttccacccatatgagcccccatttctctgcaggtagaataggatggctagtgtgattcatttctaagacaggaagaaaggattgagaagtacgctgcaagccaagtgtggtccatgtggattcctgttgccctcctcccccacttcagcagggcagtttcaccccatcccccacccctgcaccttcagggtgtggcaatcccccaggcagcttacctctctgagttcagccaactccttctgtagatggaagagctgaaatatccccagccccaatccaaccagggccaccagaaccatgaaaaacatcacaaggagacacaggcctgtgtatgtggtccctcctcttcttcagaggtggtggcggtagtggaggcaggggtggcggtggcggtagtgttgggggtggcggtgg

SEQ ID NO: 47885 - DNA, 1549 bp, Bovine  19866881023072
aaatagggtctgcacaagactgcagcaacagtatatgggtgtgtcaaaaactgaacagatatgggtgtgtcaaatactatcgtattatttatattccagattccgttggtggagacagagatgtagagatgttgttgctcaattgctaagttatgtctgactctttgccactctatagactacagcatgccagactcctctgtcttccattatctcctggggtttgtgcaaattcatgtccactgagtcagtgatgctatctaaccgtcttatcctttgtttctcccttttccttttgccttcaatctttcccagcatcaaagtcttttccaatgaactggctcttcacatcaggtgactaaagtattaaagcttcagcttcagccacaatccttccaatgaatattcaggatgtaaggatacttaacttgaaaagtgtgagagacagaggcagagagaaagagagtgagacttgagaaatctttatagactattttatttagttctctcaggctcaataacagcaaaactagaaaggacacttgggcaaattctgagtcataaaaatacttgtggctgtacatttcatattactaaattagagcctattagaggttttatgactagttcttggcaaaaagatcagagaatgtcctttcatctgccagtgctaactgaaaaggcagtagatttttataagcaaaggcagcgggctgagcatgtaaatttcctgaagggtgcctttgacatttgcaagtaaaactctgttagaagcctagatgtgtccagtgaaaaacaatatgtgagtgtgaaactgcaaaacaatgttgtggatcatttggtcaaggtcatttcttgatccagtctccatcagtactgctataatatttacaagattactctattgggtgttttctttattttctcttctttggattgctcatgaattaagatttccataaaataaaacttttggtgataggaatgtagtcatcatggtttttatatttattacattttctacttaaaaaaataacttatgagggtaatgaatgcttgatgtagtagtcaagcaaatacaagtgaatagaccactgtctcctttgccagtcctctgccaaatttaacagtatctttccacgcctttctttatgtccataaaatgtattactttgtaaaactggtgtgacattcttctcatccctgtatacactcctttttgcagtatgactttgtggctcctctcattaagaagtcaagtccacttcttcacccttgaagctggacttgccaggagtgagttcccttgatcattggggcacgactgacaagacactgggagatcaaaggacagaaatcttttgcctttgggaattttctgagcaccacatgagttttgtcacatgtatagttatgcatagagctcctcaaaactatgaaacaagaacagtacatagagaaaggatttatgaaaaaaaaaaagaagaagaaaaaatggatttctgaagtctttgcttaacgaggtgggtgttttatcatgttgtgtgat

SEQ ID NO: 47886 - DNA, 1661 bp, Bovine  19866881057851
tgaacaagcttggggaatatcatcttaatgaaatgataaaactagaatcattagtaatgtgacaaatcagttacatgctctttgacaagatgcaatgagaagaatgcagcatcacttctatgctatgcctgagagaaataaaactggatactctccaaaaaaaaaacaaaaacaattctgtaatccctcaaagtaccaagatcctgaaagtcaagaaaagaagaccaaagatagaggcaaactaaagagacacaactaaacgcagtgtgtaattctgaactggatcctttccttataaagacatcactgggacactgactgaaacctcagtgaaaggataagataggatggtattaatagcatatgtcagtattagtttcctgattttgatggttgctgtggttatacaggggaatatcctcatttgttaagagtacaatctagctttaaagtatgataggggcatcctgtcaaaacttactctcaaatgtttcagaaaaaaattgatttgttgtaacttttatgtaagttcaagatagaatcaacattttaaacttcacactaccatatataaaatagattactaataaggacctactgtatagcacaggaggctctactcaatatcctgtaatgacctatacaatgaccaaagaatctagagaagagtgaatatatgtataactgactcactttgctatacagcagaaacaaagactatattgtaaactaactatagttcaattaaaatttttactaaaagaaggacatcaaagaattttaataataaatggtgaattggttataccacatgttctgggctggtaagggtccccctgaaaaaggcagatagtggagtctctcctgggtgatggaatagggaagggtacaggacatgagtgcagcaaaggtggagagcttgtcccagcacaccctacccaagccggagactgagggaatgatgcatctatgcatcctcatagcagagatgtcctgatgagtgtgcatggcagtgctttctagttctgagtcatcaggtaaagtcagcttcctctgctcttctcagtataaatggttttttaagaataagcccttcccctctagagtccattcccatgtagatgagcctctagaagttggtaggggaagggaaacaactctgggtttggaacgttaaaacctggtttgaccttgggcccttggggcatcctcctttcccacctcactgcttgctctgagcatcagatgagacagttatgaaaactccttagaaagggctgtggaaatgctagtatcaccatggctcctcactatctgagctcacatgaggaaaattaagaaggtgaggggttttttttgtttgttttttgcctctgttttccttttctttattacttgtcatcttttgaaactacctttgatccagcattctcagcagctcacttattaccctgttttgacccatttgcatgtatcttttctgtctttctatcaaaatactaattgctcagccaacacaggaaattgtggatctcaatcacacacatactatgtgctgagccagtaggagcaataaaaaagattacatgcacgctcagtttctaagttgagtccgactctttgagaccccatggatgtagcccaccaggcttttctgtcca

SEQ ID NO: 47887 - DNA, 1157 bp, Bovine  19866881106050
cacaccagggcctccctgtccatcaccaactcccagagttcactcaaactcatgtccatcaggtcggtgatggcatccaggccatctcatcctctgtcatccccttctcctcctgcccccaatccctcccagcatcagagtcttttccaacgagtcaactcttcgcatgaggtggccaaaggactggagtttcagctttagcatcattccttccaaagacttccaggagttttaagacagaaatcatattgtttcacaatcatgtgaattgttcttctctgaagagaattcattttgttcttaagagagaaataccatttttgaaaatcatctcacttcatccttatccatcaaatgtgtcactaaggttcaggaactaattacctttgtagtaccaagacaaagaaaaatgaaaaaaatgaacagtgatcacatatctccattagaaatacagtaaatttgagacaaatttcatacaccctttcccaagacacatagaaagaataaaactctaatataccctgttggagaattatcattggcttgttatgactttatgtggtttcataaaaggcaaggaagagtcattgtgctgcagtgtttgtaaaaacggggaagaaagaagaggaagcaacagaactcctggaaagctacgactcaagtggggagtgaaactcaaggggtgctgggatgctggggaaattcctgcaaggttggaaagcaaaaaactgagaggacatcagatttcaaatccatgggtgacagcgcactcaaatcagaagcttaagttagaagtagagaagagtgctggtataggaccaaaatatttgtgttcaagagtcctgtcctttacaagtcacttctttggacagttttccactaatggtagatgcttacttcctggttcacggtgatgttctcagctgtatgtatttacatgataaaaatggagagattgcaagtcaacattccattgagagttaaagctctgtggaaccatttgaatggagactgtcaatccctttgatagcttgaatccattctagcaggtcccagggagatgatcaattcctctctgaaaccaagaatccaactaagcaaaagatcaagagctccatcctaagattcacaatcctctgcatcattcctgtgaacag

SEQ ID NO: 47888 - DNA, 1033 bp, Bovine  19866881148138
tatttttgaaatatttttattccaatgttttgagaagacagaaagctaatacacaaattacaacttcatctttatttaaggtacctttttctgggattgtacatcttcattttctagtgcacaattgtcatcttgagagtaatacgatgaagctgaagaactctctttacaacacacatgccaactgggaagcctgtaaaacatccaccgacaccatcaaaaaaaaaaaaaagtaaggctgttaaaacaacatattccataccatgaactagaatttgaggcaatagaccaatagatggttcttatcctaatgttcttgacaatttgacaatttaatgatgaagacaaatgtacataagacaaaagtttttttatttaataccctaagaaaaatatagtgttatcagcactccaagttaggcatcattaatctcacaaaggtaaaacaggaaatacttcacaataataagagtatctgacaattatcacagaaagaacagagaaagctgacaaacagctaacctcctcaaaagctccagatgccactgatattctaaattctaccaaatatttaagaacagataatgctgaagctacctaaactatttcaaagtatagaagtaaagcttccaaattattttatagggaacgtaacaatgatatcaaaaattaatggaaacagtacatatatataaatactataggttaataatacatatggaatcaaacacaaaagttctgaagaaaataaaaaagaaaaaatctccattaacataccaaagatgtaacacaccactgttatggtcaagtagagtttagctctgatattccaaaatggtttaaaatacatttactttgctatgcaaaaataccaaggaaaagaaatctcaagattatcctcaccaaaggacatttgataaatttatgcaggcatcaagatgttgaaattaataaaatagtaataagtagatatttaacatggggaatacatagtacatgcataacacataagcctaagagtcactatcataat

SEQ ID NO: 47889 - DNA, 1052 bp, Bovine  19866881166704
ccttcttgaggttcattctccttcttactcaatttaaattccatggggcgatcattataatcatgcccatgtataattactattctcccttgcccttctctcagtctgattaatcaccatcctgggtaaattcaactccccatctgctctagtttgcactcatgtagctatacaaggtcagcaaaacacacacacacacacacccaacttcactttaaattcatgactaccagtctcaagtgagcccttccttactactgctgggcatttatactaagcatccctagttcatccactcccccagtgtcacaaactgtttcatatcccctcattccatcagttcccctcactctcacatcccagctgattctttgcctcctacttccctgagaaaagtgaagcaatcagaaaagaacatccacagattcccatcacctcatctgtccactagccatctacccacttacctgcatctgtatctatacgtcgcgccttcccacttgttcccagagaccaactcttcttctcttcctgaagccagtccctcccctgtgctcacttgctcaagaacatgacctcagcagttaattctcccctttctcacatcaactattactttctactgtttcatttccatcaatatacaaacattctcccatcttaaaaaaacaaaacaaaacattttctttgccctcacctcccctttcagtttctgtcctatttcctggttcccttttgatgcaaaacttccagagagttgcctgtacttgctgatccaatttctcttctcttgttctcttaaacttacttcaaataggtttctattctcaccactccacaaatatatatatattaagggacaccaatcacctcctccttgataaatccagtcatcagtgctcagtccttgctttcttgatttttcagattttgatctaatcacagttgaccatcccctcttcctgaatcatttgcacttggtttccaggattctaaactctggatcttcctcctgcctcagtcgttgtgctttccaaatctttttggttatt

SEQ ID NO: 47890 - DNA, 1222 bp, Bovine  19866881186454
cacagtcacggaaaccaaccagctactctgctttttgccaaaggctttcccaagatagccctccagatacagacctgttaaatgagctgcttttttcagttcctttttctcagagggtggactggggtgacctgtattatagagagatgaaagatacatgtaaaagtgacataactactattcttttttgtgggactctaaacagggcatttaaataaaagatatttttataagcataaatggcaacagtctaacatccactaatcattcaagtccaaactgcaggacttacagcagcctatatttcagaaacaggtaaaaaggagtcaaattaagatagacatgcataaattataaattacaaaacaatataaaggtcagtttataaagccctccatataagttactgcatttataactcccaacaatcctttgaggcggcaatccttacagatgccaaaatgagcttggaagttgggtgacttgtccaagaagacccgctaactcagtgtcagagtgggaccaacactcaggtctcctgagtccaaatcccgggctcttgcgtctctggctctgctgccctcaggactacaggacaaaggttgaagaagactgctaatgtccaggccactaggtcttccccagcggcattctacagttggccccagattaattcctctaaggtctcaaacaccgcgaatgactcctcattaaacaggtaattgcacacaggtgttccccaccacacgctctctgcccatctgtccagcctcctctggctcactcccctaccctggacactgccacacagcagttctgagcacacccagcctcctgcctctgtgcttttgtctgtgctactcttcctgcctggaatgccctcccaaactgatctctgtgtcaaattcctattgacactacaaacaccacctaaaatatctcttttcctggaaaaccttcccaagcctttctaatcaaatatgatttttccctccactgaaacctggaagcattctggcttcaccctattttgtccattctgactcacctttttttcaatggtaactggatgactggtcttactcctccaaataaatagcaaattccttactatatgtttcatctaccagagtaattagctcagtttctaacccagggcatgcaatcagtatatgtgcattaaattaaattgaaagattgaaaatagacaacagttctcaaa

SEQ ID NO: 47891 - DNA, 1078 bp, Bovine  19866881245328
ccagcagggtgggtcaccctgggaagagaactcttgttattgctgtagcatctctgcctcaccttctgcctggaacgaaggaatgttccagaggaagagtataattggagggagatgttccatggtaggaaatgggtggatcattttagagtacagggacagaagctccaagaaagcaggccaggcaggaaaggactgctcttgttaaatatcagtggcttgtgtgcagaccttgccaagaaggagctctggggtacatgtcacccattatctttctgcttttctcaacagtttttttctagctttgtttgtacaccgtccactgtctctgacaacctacaactggcattggttagttcaaaaagggtgaacttctctggtggtgcagtggtaagaatctgcctgccaatgcaggtgttccatccctggtctgggaagattccacatgccacagggccaactaaagtctatgtgtcacaactactgagctcacgtgctgcagctactgaaacccacgtgcctagagccttgctccagaacaagagaagccacctcaataagaagcccacacgccacaaggaggagtagcccccactcgccgcaactagagaaagctggcacaaaagcaacgaagatccagtgcagccaaaaataatttaaaaaatttttaacattaaaaaaaaaggaaaacctaaagggccagagaagccagagtgactaaagaggagaaatcttatggcagccccaaaatggccggggccctccaggttcagggtgaggagcaacaacttgggtgtcccccaggttttctctgaagtgcccaagggcctgacacctcacacggggcaccctcggttctaacttgctcttgttttgccttctcagatatcctcattcctctgccacttttctggttgcatccaagaaggatatgaatttgccaattttgttccaagttccagatatcttatcttaaggtacccaattattttttaatcgaaaagaaacccgaggctataaatagttccaggatgacagaatatgaatacaaagggtatcatatctccctaacacagcc

SEQ ID NO: 47892 - DNA, 1377 bp, Bovine  19866881285022
ctcccatacatagcacctcgttcagacttccccagggatgttactgccagcatttttgtgtagttcggtagcggatgacacattggttttacaggtataagggcttaatcatctttgaccagtttccaacagtgccagaccataatgagtgtatatgatattgcctgctaagccccgcccccttcctttgaaaactgtctctccccaccactttatctttttggacttatttcatcccattgcaatggtcataattgattgcttgatttgatagggtgcctttccaagttgggctaggtgccttcttttcgattttttagcttggaactacagtggccaaaaggctatatggcattaatcttagaagatacttcttatcagtcttcaggctttccaccatgtggaaataggcagtctgcagcagggaaaggaaaaagataactccagaaataagggaaaaggtagagagagaatccccaccaagttaggtccctgggtccagcagttcctggggtctgctatatccctgccttttttgtggcttagttgctctgggagaaaagccaggatccttcaagcacattttctttcttttttttaattgtatgaactgagtttctgtcacttgcagccaaaggattctggctcttatctggcacgtagaacgtatttgtaaatgtcagctgaacgacaaatgagtagtttctcagtgtccaaattaagaattatcatgaggatggaagatgtttggaaaggccacttggttttccctcattctgggggcaaatccacaggcatccagtcaaggagaaagtgctctttttttaaagccctcctggaagaagattttataacttccctaggttagttaacaaaggaaatgagaggaacatggacgaccatgacaacttgaatttctccttcttaaaagtctcctgccttcatgattttccatttcttagtctaaaaatgttattttaaatcttcaaatctttcatctctttcaattttcatatcacataaaatctatttgcattttccaattttttttattattaagattatatgttgctcgctgactacttttcttgaaaattacagcagcacatcattaaggagtatacgatacatgttcttttatccagcaaagatttactgagagccttgtacacggcaggcactaagaccagtgatacagaaacattacagctagttcctgagagaaaatgaaccatttaaaacctgctctaaacctgacacggaatttgatctgtctgaaatggaaataattacagctcctgtcattttcttcattgattcattcactgttcagtcattcaacaaatatttttaggtttctattttagaggtattgtt

SEQ ID NO: 47893 - DNA, 1277 bp, Bovine  19866881305137
ccgcgtgcagaacactcacctcgggacgctgggaggggccctagtgggccgagacggaacctgcggaggcgccccgaacgagtcactgctgttggggaaaggaggtaatgggcccggccggaatggcactggcggcgcccctgagtggggtcccggggaggggatggcgggtgcaggtccccggccggacgtcggtcgtgggagaggtgcgctcagcgtcggcctcctctgggtggtggggctttggagggggggacctggggacagagagagacatcagtttgctcatcctcctttccatcagaagtcatccttaaaaatttgttataattgactatgtttaaaaaagtattgtctgactaactcagatacacattagggatattataaaagggtaaaaggtgaaaggaagtttccttccccaccccttcctctgtggagacaaccagtatcttttcctgggtatcctttttatctatattctatattatcttctctctctcatatatatacatatatatatatatatatgcataaattgcttttttgcatacaacattctacaatttaaatttttttttaagcttcacattaactggactgtctttttacttcagtacttattctttttaatggctgtataacatgccattgtccaggtataatgtgcttgtttttgaaaggagctgagactatctgactctctctatccctcctgaacttaaataatccttttcctctttttgctttaggttcatattggacttccatggtggctcagacggtaaagcgtctgtctacaatgcaggagacctaggttcgatccctgggttgggaagattccctggagaaggaaagggcaacccatttcagtactcttgcctagaaaatcccatggacagaggagcctggtgtccatggggtcgcaaagagtcggacacgactgagtgacttcactttcactttcatcctccttcatttcattgaggctttcctagaataaccattttaaaattattattaaatttgtgccactatatttgtatgaactagaaattttattttgctatattttttagaggaattgtgctccttaggtatctaataatttttgtctgtggcagcatgtcatctggcggttttagcaaccttgtttgtgattgtgtatgaatttggattctctgttctatcttttttaaaaaatcaatttttattggagtatagttgcttacaatgttggtttcctctgtacagcaaaggattcagctaacataaat

SEQ ID NO: 47894 - DNA, 1029 bp, Bovine  19866881413174
aaaaagtggagaacagaaaagttaatgagaaacaaacaaatacagatgtggcactcagtactttgaactccgattcctcattttgtttttgttaagttcactgagtggcctttctctcttttatttagttatttcttagatgaagggaatacacttctctgccaacattctttcaggaaattctgtactggcctgtgtactggcctccacatgaagtcaaagtaaaaactcaaaaagagaaaagaaaatacaactattatacagggatgagccttgcctttaagaatcatattcgttaatataagctggtctagttgtattttgcacacaaataacaaagggtaaaatgtccctttaaaataattctagttgaagagcctaaatttaatcctgtattactgagttatagtttgaagatacttaaaacaatcaaaacttctataaagctctctttaaaaattgcttaaaaaaggactttatgcatctggtaccaaacagtctatggcggcagaaaaccatttataattaaatacaaccaaagagaggtcatacttgggacaactttatatatgaacattacactggcaatagtttcatgaagtaaccacttgctctctgggagcacacttcacctcagttccacatttatcactaactattgatcccttaactttatggcaaatacaattaacaaattacaagattagttaaaaacgaaaatgcattgtgtaacaaagtaggagacagtgcatgttatttacctacctcattttttaaattatttgaagaagcattcaatgcagattttggatcactaccaccctgatcacttgatgaaacttttgattcaaattctgattttgttatctttcctttgccgtgcgaagatgacacattttctatatgttggccgacaaggctatttgaaatcaaaaggcatattaaatcaacaaatttcagctgaataacaagtacacacaaatccaaactataaaaagtgtacagaatacaaagtaaaccaagaaagga

SEQ ID NO: 47895 - DNA, 987 bp, Bovine  19866881876158
ttgggcagatatttacattgatgtcagaactattttaaaaatacaaatggaaatctgccaaacagttacaataaggtccttcggtttgggtatttctgtcaggaacaattctgaataagaatcatgcagtaaggcttgcacaacacaagggcacagcaggattcacatcctgactctctcttccattaagaggcttcctctgaagacactaatggatcctctcacagaacatgtatagacatgagaaagaaattacaacaggaaagtgtgaattaacccaacagtctttccaattcatctttccacaaggagtctatgctaaatacaaagggaaagtaaatcaaaatttctcccctcccattcccttcttacaaagagtctttctctattctctggaaattcagctgggataaggacatgtgtaactactgaacactcttccattttcttactaccggggaaatgaaaagtggtaacttctcccatcaacacaccatgagtaaacaatggaggtcaactgttgagtcagaagctcaattactttctgtaagaaatgccttctgtagacctagattttcagaatcacttccttttcaatagctaagtgtcgcggtgcttcctggcaagtgtcactttgcacgctccagcagccgaaggtttgtgtccttctttaacttagtaaaacaatgacttcaagtcagtaaaaatgtttcccactctcctgcctttgatttgttcaacttgctccctttaaaaatctcattcttccccaaattaatgacactaatgtcaaatgctatcattctccatactggtaattctgggacaattggattaaaaagagttctaagtatttacaagtcagatcttaccgataagcaaagacatgactcaaatatatacaagaatgaggaagagggagtccttcaaatgttatcatttatttcaggttcagtagtacagcttcacattttcacaacaggtaca

SEQ ID NO: 47896 - DNA, 809 bp, Bovine  19866880369777
cctgggttcgatccctgggttgggaagatcccctggtgaagggaaaggctacccattccagtgttctggcctggagaattccatggactgtataatccatggggtcacaaagagtcggacacaactgagctactttcactttcacttagaaaagaatctaacggacttctctggaggcccagtggtttaagacttcacgttctaatatagggcgtataggttcgatccctggtcggggggcaagaatgccaaatgcctcgtggccaagaaactaaagcacaaaacagaagcaatattgtagcaaattcaatagagacttttaaaaaatggtccacatcaaaaaaatcattaaaaaaaatagaaaagaatttgaatttctaacacctttatttaaatccactccttcttgaatcacagacaacattgtacttgctcacgtgattctcagtcaaatagatttcccttaaacactgagatagttcaaaagtctttttgagcaaccagagatttatagccgccagtcagtcgtgtgagaattagccagctctaagacaatatctacaacaacccactaagtgctcgtggcctccagaaatgaaggaacaatgtcctctcttggcaaggagtcttgaggagctccgtggagccacaggtagaatgcaaatctggaaaattgtgctgccaacttgcttcagctggagaaaaatctgtcgttagatgcttatcagacatccttttattgtctccgtaacaatggagagcagttccacaagcagtcattttgcatgcccttctcagcagaacagagg

SEQ ID NO: 47897 - DNA, 1982 bp, Bovine  19866880610889
tggccacgtacctatcagctatagcatgaaataaaataccaccagtatttgaaaactacccccccttcacccagtatatctcagggatcatgtcttccctcatccccttgtcagagacgactgtgctcttcactttcttgttaattatttccagcttcgttttatagttttacacatgtgtatgcatccctaaacaaaatctcgcttgtttggtgtcagatggtactttcatgtcataaggaaagaaaacactgtcattcttcctagtatgggaacaaactgtactttttagggggaaaaactgaaatatgatgtgctttccaaatacttaaccaaggagaacgtcaaatacatgtggaagggaagacgttcagggagaaaccccagcacttgccttccccttcccaggctgcctttgtgttccatttccttctattttgtgattaaattccagccttccattattcagaatttacatgaacaactaatgtcaccagggaagtggtgactgttgtggaatttccaacctgtggcaattttgcaggcagaggcaggacttggagaaatcacccaccaagtgaagcatgtcgacaatggtgcccactaaatttctgtcctcttacccccaagacctccctgggaagctaatggcctctgtcggtctgtatcatctcatcataccaaaactttaaactcattatttgcattgattaactttaagacagggcttttaaccatttcctaccgtaatggtccagtggctaaaaataaggtatctggggagtctttggacatgaacaagctgaagtaagcatagatttacttacttttattgtgaatagtatctcatatacacagaagtgtctcaaatacatctgtatgatagaggatatcaataaagtgaatttctgcctacataccactcagctttaaaaatagagcataacctatagcttaaatctttctacagagacctcaaaaattgcttctgcaacattttatcctaaatctgctgcttctcttcacagttttgcctgcatatgtgcgtagtcgctaattgtgtctgactctttgcaaccccctagattatagcccaccaggctcctctgtccatgggatttcccaggcaagaatactagagtgggttgccatgtcctttaacagagaatcttcccaaccagggatcaaacctgtgtctcctgcattggcagatggattctttacccctgcgccattcctaagcaaaccatagtttgactttactttggggggagtttatataaataagctattatattttcctagaatttaatccttttgctcaaaactgtgttttaagaattcatcctcaataatgctgtgtctgtacctcatgatttttgctctttgtactgtttcattacatagatttatttactctgcttttgacagacaattgaatttatccattctgctttattcattcttattttgatccacacagttgtttattttttttcttttctagtttgggactactgcaaagagcactgatatgattatgggaacttgtcttctggtgtacatgtgtatgagtctctgaacttgaattccacctagaagtgaaattgcagagtcataagccatagtattcaaatttctaggcaattccgaagtgtttcccaaagtagtggttagggttaaatcccgaccggatgtggatgagagttctcattgctcaacatcctcttttaacatactatttcaccattttccccccaatctgatgcattgtgatcttatcttcttatttcagttattactgaagaaactgagcatcctctcatttattattataagctttatgtgtttccttttctttgtaatttctttttcggtctttcgtctatttttctattgggttggttctctttttcttattgattggagctcttaaatatcgaagttggtatagtgataagcaataattttagctattgata

SEQ ID NO: 47898 - DNA, 3332 bp, Bovine  19866880623118
agtatgagggattctggtctaagtcaaagcccctcaccactatttgtcatgtccatttccagtccctgagttggaaatcagcctggtgagcactggctgtcaaattgcaccatctattgagaaacattttccaaattccaaaagattgcttgcctcgggaaagtgcttggtataagatgaaggtctgcagttttcctcctgtgtctcacctgatgtctcagggacagctttgtagcaaaggggaatatactgttgaggaaaatctttcaaagctgagtctttcccttcctcattccagataaatgatattaatgcacagcctgttacctaatgggattgcggtttaacttccttttctcaagccttttatgggaaagctcaaaagatggggcagcccacagtgcacactgaactgttcgaagagcgattcctaccaccgcaccctgggtttccctgctttcctgagtttaaatttgtaccaggcatatgtgttgaagcaatttgcaaatgtggcttaagataaacctttgctggggaatgtaagagagtagaaatgaggattgagtcttcaaagaggtgttactcatgtaattgtctcctatggaatgattaagaaaagaaaggcctggtttccactctgaactgcatttcatttctgaagaaagaaaacagatgagcaattattttgatattccaccaaccatagcgctttgggcagtctcataagggaaaaatgcagagctatgactcttgcaaataatttctattatgtaagtaccgagcctgcatcccttccttttctggcccatctctcctcccaccatgactttctaagatgtctgctcaatatgtatatccatagtttttcagagtgaaaatgttttcctggaggaactgggatcaggttcaactgagagtgattgaaaagttagaataaaattggcttaaatgagaggaacatttgtataatctcttatgcgaatgtggctgatccaggactggaatgatgagaccattgtaatcagggaccccaatactttctaccctgatgttccattattctcatcaggactcagcaccagccatcatatctgtattccaggcagcaggaaatacagaaaaaaaaggaggcagaataaggctacagcctctcctttagtgacacttcctagatatacacactactatttatagcccttgattctttcctcaaggatgatggggaaaatggatattggaaggcaggaagacagtttttcttctaggtggtcatggctgctagcattcagaggttttgttattgaggaagaagagggacataaactttcaggaatgatcagcagttccatgtatatttttaaatgagtttaggcaagtgaacaatgattacagagactgtcacatgtatcacagcaagaaaagagcaagcattgaggtgtcattctgaacaagggatgttcttatgtaccttgccctattctgtgcccagaatttaacagcaatggttgattggggggttcttcagccaatgtgggtcttgctgtgcgtcagcctaactgatcctgaaagaagtttctaaaagttgaaattttataccaactactagaagatcaattgaggatgactcagcagacccaactgagatatacgcttcttcaaacaattggcctctgcactgtatacataaatcaagaaatgaaacagagtgttgttctcacataagttctaattcatcttcactgaggagttgggaaaccttgtcaggcagatctgaaggtaatgccttgttgcaacccttgctggcactgtttcattttcaatatcacttctgtgtgcacactattgcctcggatcaaagctgattgtaatcaaagagtctcagtatctcttcctaggaaagctacatgtccctgctttacccacggttggcatcaaccaggttctcagaggaggggccctctcctatgaggacactcagccgcctgaggattatattagtcaaccctggaaaaggtttgctcttcgtgtgtgttctttggtaactctctgacaaatgctgtccaccagcttcctcgtggctctgacggtctctaagtcgcgggcagctcttgttcaatggtgcaaaatattccctcctcctctgcagccacttagcaggcagggcgtgggctggaaggggcctcagcttcctctaggggaccaatgactcagggcttgggaagtgaccccgctgggatctgggctgttttcatcatggcgcaactgtgccttcaggccccagcgaaacttcttacatccccttaaacatgcagtcccctgaaaagacaaaatgccaggaaattgacatggacacactgctatatctaaaacggataaccaacaagtcctactgtacagcacaggggactctgctcaatgttatgtggcagcctggatgggaggggagtttgaggaagaaatggatgcttgtatatgtatggctgagtccctttgctgtctacctgaaactatcaaagcatggttagtttaggactttcctcatggtccagcggttaagaatccacctgccagtgcaagggacatgggttggatccctggtccgggaagattccacatgccagtgggggcaactaagcctgtatgtcacaactattgaagccctcacaccctagagcctgtgctgtgcatgaaaagagaagccaaggaggtgagaagccagagcaccaaaactagagagtcgccctcactggccacagccagagaaagtcaatgcgtagcaatgaagaccggcccagccaaaaataaatagatatattttaaaactttgaaataaataaatgtgaggataaaaaaaagaagcatgggctgcctttgtttgttttctgcagcactttggttctaaaattgatttccattcatttgtatttgagtacagctgcttgatctcaggtaatgtagtttgggggtctgaaatcactttctggagtgggaacgattttatgcaccaagggttaaaagtgtaggaagcgtctttcaaatagagctctggtctcctagggtaacagtgtctgcgtgttgtcatcataaagccatgcggtcccctcttgaaaactttgtcatggccgggataagcgaagacactgaggcaccgctgcttcacgcaggtgacagtcaaatctcttgcttgttcgctgccaccgcggattttgaaatacctcaacatgccttctcgtaagagcttctatgcatttatcaaaattgtttacaggatgtttttagtcttttcttccaacacaggagtcacttctcaggactgttacctatcagtaagc

SEQ ID NO: 47899 - DNA, 1566 bp, Bovine  19866880655977
tatcttagtggtggtggtggtggtggtttagtgctaacttgtgtccgactctttgcaactctgtgggctgtagcccgccaggctcctctgtccatggggttttccaggcaagaatactagagtgaggtgccatgtcctttcaaagggatctccccaccccagtgattgagccatgtctcctgcttcgcagatggattctttctgagccacctgggaagcctatcttggtggtagctttctacaactgtttcatggacatgagatcccaggtgccacaactaagttctgctgctgctaagtcgcttccgtcgtgtccgactctgtgtgaccccatcgacggcagcccgccgtccctgggattctccaggcaagaacactggagtgggctgccatctccttctccaatgcatgaaagtgaaaagtgaaagtgaagttgctcagtcgtgtccgactcttagcgacctcatggactgcagcctaccaggctcctccatccatgggattctccaggcaagagtactggagtggggtgccattgccttctctgacctggtgcagacaaataaataaatattaaaaaaagaaaaagaaaaagactagacttggagatatgccctgttatcatataggtttgcactttcccatggtcgtaggctaagtgacgctttgcaccctgggccaccaaagggcctcagcaggagaaagagtggctgacccgatccagcacaattgctgaaaacatccaggacattcaagctcacgttctggggatgggtgttgcccctttcgtgtgactgcaacactatgacaatttccagcaatcttcaggactctatcgttctgttctccagcgacagcgccgtgagccctctgctcgcattccatctctagccagtctccacccattaagtcgatttttaattttaaagcacgctgtccctgctgctccattcccgcttcggccactgtcatcgcccgcgtggagcttgtctgtgcttctcccaccccttctccctgcacactgctgccgaatgagccttatttgttcaaggactatttttatcccatccttctcctgctctaaaatctcccttggcttacccaatcaagtccaaaccctgccttctggaactagaagctgtcttaatctgctgtgagttcatctatgtagcccagatctcattatttccaaacagaaacatttgtcctcatcactttgcttttgctcacacttcaccttagcctaaaatgtcctctcccctgttttttttttcctctgtctaaacattaccaatcttttcaagatgagctctgattccttgactttccataaagcccatcattcacattctggtccgcaatgctcttctcttatctatatcatatgtggatataacacactttgaagttgaatcaaacactgttgtgaattgttctccatttgtttcactttacttccctggtggctcagacgttaaggagtctgcctgtaatgcgggagacctcagttcaatccctgggttgggaagatcctctggagaaggaaatggcaacccactctagtat

SEQ ID NO: 47900 - DNA, 1706 bp, Bovine  19866880713412
tattcattggaaggactgatgctgaagctgaagctccaatacttggccactggatgcgaagagccaacttgttggaaaagaaccagatgctgggaaagattgaaggcaagaagagaaggggacaacagaggataagatggtttgatggcctcactgactcgatggacatgagtttgagcaagctctgggagttggtgatgaacagggaagcctggcgtattgcagtccatggggtcgcaaagagttggacatgaccaagggactgaattgaactgaagcacactgaaaaattattgttactatatataattctcatactttgaacctacactaatcaaaaggtggatctgatctctgtaaatgtgaggcattgatccacacacactttgatcagtgtcttcctaattacctgccaggatgcacaacatgaaaaaaatctgcatttggtgcaacccaccagagcaatggatgcaaagagataacagacaacactgtgacctgaaaccaggcttcctgacattaaaaaggaataatatccaagcaaagcaacaggctttaacagcctttgcttttcagtccacagctcagacattctcataagtcatataaactctgtgtttcatctacttcacctaaaacacggcttcccctggtggctcagatagtaaagaatccatctgtaatgcaggatttgatccctgggttgggaagatcccctggagaagggaatggcaacccactccagtattcttgtctggaaaataacatggacagaggagcctggctggctacggtcgatggggtcacaaagagttggacacaactgagagacaaacactttaaaacatggctacagtaagtatcggagaaggccctggcaccccactccagtactcttgtctggaaactcccatggatggaggagcctggtgggctgcagtccgtggggtcgctaggagtcagacacgactgagcgacttccctttcacttttcactttcatgcattggaggaggaaatggcaacccactccagtgttcttgcctggagaatccccagggacggcggagcctggtgcgctgccgtctatggggtcacgcagagccggacacgactgagatgacttagcacagtaagtatgcgggagccacagttcatatgaaacattcagagctgattttttgcaaatatttactatgacttgactccaaaaatgaaacaagttgagcacaaatatttatttatttttccctctctatctcccagttgagtttccagctggctatacatctcataaaagaatagacactaagataattacaatgtctattgaataatttttcttttggatagctacatggcccctcatttcctatcatcagggtgccatccagaatcattattttctgttttcggatactctgcctgtctaattaatagtacttctctctgtaaattctactgctggccactctccagccttgtggaacattccctaaaggctacacacatctcctctcagttctagtaaattgttattactgcttttcctgtaattatcccacgtgcatcacagttcaagaaaagcaaaatatgctagatttacagactcaggtggaaaaaatttgtctgtcaatatttttaggaaaaaccttagccatatcctcaaatagatatcacaaatccatagcaaacactagaaacagt

SEQ ID NO: 47901 - DNA, 1229 bp, Bovine  19866880760504
tgttctctacctgctcttgagtcacctctgacccgggtttcttccacctgtgagatcattatttctcctccctgaagatgctgagttgtctgaaacccaactacatcagggattggtaaactgtggtctgtgagccctctgttttcacagcagagaaggaagggtttctttgtttctttacaattacaacaactgacagaaatcagaagaaaaagactattccatgatgtaagacacttacactaaattctgatgtcggtgtccataaataaaattttgttggagctcatccatgcgtgattgtgcatgtgctgtccacagtagcttttgttgcacagctgctgggttgaggagctgcagcagagatctgcagaccctgaaatatttgctctggcctttatcagaagaatgttgccgatgcctgatacatccccgttcctgtaattcggaagtactgcaattgaccatcttaacaacacgtctaatcttaggattgaaagggactcgatcacttgtctatatcattaccagaactgcagttttactctttttcaaaggctccgtgatgtcctggtgtaggcagagggacaggtttaaaatgaaaatcaacctaaaaagaaacaactcatccgaattgggtttgtggagtatctttgcgctccccacccccaccgtgacctttatgtgggcttcaggcaagcgcatgtgacaaaggggatgtatttctaatccccacctaagagcatgctgtcttgacgctgttattgtttcggtgtgaactttagaacaatcgcctctgctattttggcacatggagacttgcctccacggtaattattttgcaacccacaaaagtaattataaaatcaaataattagcttctaaacaagctgtaaccccagcgatgactcttgggaggggaatgaagctccgttcttcagttttcgtttttaggactgtcaccgtatacctcccttgcccctttatctcaggttttgtgttatgtcaagttcagtcttgactgctacgtcaagtacagtcttcagtgatgcaccagctgcccttgaggcggctttcttaaacagtagtattgctccaaggttatgagcagaaagaggaacaagcaagaaaagggaaaagtgaagcctggtttaatccttccagtgataggaaatccacttttaaaagggtgtcacagcctaccacactcaatacctggtttgggctgg

SEQ ID NO: 47902 - DNA, 1255 bp, Bovine  19866880846029
attctcatatatttcacaaatcccttctggagaagaaaatatcaaaactacattgtgtttccctggtttggaagttgtggggcccaagataatggagaagtccatgttctttagttgtttgggccttgaaagtgacattttttttttcaggttactgtaacctcctttggcagagtaaacatttggttgcatttttaaaagctggtagcagtgaacagcaagaatccagtcacattttttaacgtagctccagaggaactatggtttaaaatcgaaagtcttctattcctatggcaaccaccagaagtgttcagctaatgctacgtgctgtgtacattaagccacgtactgtgcacctcccccaccttctgctgcctcctccccctgcgaattcatcctgaacttcactaaactgtctaccttgaaaaaggctcttttccagactcagagctgctttccaacatgcaagcaatcaagcccatgaaatctaaaagggaagactcctcccagaggaaacctttacaaacccagaggggaaatgtaccccaaaatagagacaccgtctgcttgcctgatttgacaggtttgagagctccttgtttgaaagccagacgtgaatctgtgaagagattcccttgagttacaacccttttttgggagcagctaccatgaagataacatatgtggtgagacggagccaaaacgcacccactgggcagccgcgcagtgctgggagcgcttctaacacgttctcaggaagctggagcggttagtcacggggacggaggaagagccctctgtggcgcctgtctcatggagcagggggctgactgtcacccttactgcctgctctccaaggaggactccagggttctgctctcctgaagggcttgttcttctaaagagtgagaacccaaagctggggattcaagatgcaaaggtcaagtcaaggcaggctgaatcttggctgagtgtttttaaaatttgaagagaaaaaaaaaacatttttaggcggaaatggcctggggatgtcttgcatacagtcttagagtctaagatatggaccaaatacggacgagtcattcacttctattccttgggggaaggttcagagggacattctggatcagaatgaagcatgaggccccgattggcttccctctaaaggctatcgttgtccctctgccccccatgtttcctcaatcaggatgcttgcttagtggggagttgggttaaggctctgtgggacactcag

SEQ ID NO: 47903 - DNA, 1964 bp, Bovine  19866880920615
cccctggagaagggaatggctcccactcccgtgctcttgcctggagaatcccatggacagaggacccttgtgcgctacagtccatggggtcacaaagagtgggacatgactcagtgactaacacttaacacactaacccttgcatacacacatatagtgtgaaggtaagtcgatgaagcttcaagaagcttcagaaaatactgggagagacaacagttaagagttacgcctttgaaacttgcaagcaagcttgttcttccataccattcagtttcatccatacccatttgcatcacctccctttgaaaaccatgaagaggtttgagcgtccttgtccttcggctaattgtttagctcaacagtttgctgccacctagtgtccagtaaaaactgtcttctattcaatcatggttggtgaccaaagaacaaactggacactacttaccagagggcacacctcgcaaaaaccaacatgcatgggtcacatgataatgattcccacaggcatgctgagttgcttcagctgtgtctgaccctttgtgaacccatagactgtccccatagactgtctcccgccaggctcctcttccgtgggattttccaggcaagaatactggagtgggttgcaattttcctcctccagggatcttctcaacccgcagattgaacctgtgtctcttctatcttcgtcattggcagatggggtctttaccactagcgccatctgggatgacgcaataatgccatcatttaagattcaactctcattaatacatatctcataataggaattgaggggtggaggaggaagacagttccattttcaaattaacttagaaaaccaccttacacattttaaagcatccaaatttcaaagcgcttgaagttaattatgagaattctcatagcctcagccctaccacatgagtttaattaacagaactacaaaagatctggtagaattttggagggatttgcattttcgcatgaggtcttccatttttaaggatccttttgaatatgagttcccagaagaagggcaatttctctttcttttgtctacgaaattgtagacttcctccacttcaatcttccatttacatccagctacaattattccttcggaaagtctagttgttcctaggatatgacaaatcacatttaacatccactttctttctgagcctgagccacttatagctgttctgaagaatagatttcattttgggaagagaacacggtgctgttatgtaacatctgattgatgggagttaaagtgggcagaagttctcaaaatctgaagatgaagtgtctgaaggggaaggaatgtattatcagtaaaaaaaaaaaaaaaaaaggtgggaggacagaattgcctgctctgactaaggatgggttggaagcaccagcctctactgtagatcccatgagccaaggccagtgtccttgagaaccttggctgtgctgatgggcagtgctgactttctcagaatgcaggaaagccccttatcagaagtcctcttcagcaatccgtctagtcacaagtcaagacgtgtttgtcatacgccacactgtactgaaatatcacaatattagaactcacgaaacaagggcctcagcaactcagagccaagaacgagctaaggcaacaagaaagagaaagaaaaaattcagcctcactggtttggtcatactaacacctgtctcccttctcatctggccctttcgtctctcctgctgctgctgctgcttaatcatttcagtcatgtctgactctttgcaaccccatggacagtagcccaccaggctcctctgtccatgggattctccaggctagaatactggagtgggttgccatttccttctccaggggatcttcccacccagggatcgcaccctggccttctgcatggcaggtggattctttatcctgagccaccagggaagccccctctctcctgatt

SEQ ID NO: 47904 - DNA, 1403 bp, Bovine  19866880928168
ggtcacagagagtcagaaacattaaagaacagctcatcagaatactacccagagtgaaaagggtgtgtgttagtaaattatggatgctttaatattgtttacatagaaaatctgcagtgacatttcctctcctacccatttttaaggaaaacatcaaagcgttataatactgtgacaacataactaacaaggaactcgtttttacttacttagtatcaaaggttcagcgaccaagagccttcccttctgtactgtgggtctttcctttagtgtgaagccagtgctttgtgtaaaatgggccagttgattctgggatcatccattgcttcctaaagagctgcagcattcagacacgctcttagaaatacgtgggatgggaggaataggataattcaattcattcttcccttctgaactttatttctgagaacctgacttgccaacatctatgaaacatagaggaggcttagcaatcaatcacgaggggaggaggtgacagaagagggaggctggccaagcatccctaagcttcagtcattttgtatttcagcacaagagagcaggattgctgactgttagatttcctttgagaggcagtatgcaagcggcatattgagtattctgataaagccaagtataggtgtaaccctttaaggaaatagtcaatctggttaaaaagtgaaactccttgggtgaatattaggtaaaatttgacttacatgaaacttagaataagagcagaccttctagagcacctaattcaaacctctcatttgactcaagaagaaaccaagaccttgaaagttcacagattcatcgtcaggattactcagcctatggacccaagtattctgaaggactgaggctgcagctgcaatactgtggccacctgatgtgaagagccaactctggaaaagaccctgatgctggcaaagatgcgggcaggaagcgaactgggtgacagaggatgaaatggttggagcatcaccgactcgatggacatgagtttgagcaaactctgggaggtggtgatggacagggaagcctggcatgctgcagtccatggggtcacaaagaattggatacaacttcaggactgaaggacaacaaaattcggatactttgtccagtgttctttctactctaccacatgcctctctctctctcctcctcctcctccccacttctctctctcttatacgcacacacacacacgcacgaagttcattcaaacaacaaaacgcttaaattgaaaggacagctatctaggatttctttcttttaccttatccccacatttaatagcttcacacccacaccccaagaaagttataaagttgcccttggctttacggtgataaacctcaaacactgaaatctctagtcagataaggtctgcaagg

SEQ ID NO: 47905 - DNA, 3479 bp, Bovine  19866880959813
gggcttccctggtggtccgtgtttaagactcccacttccccacagtgggcacaggtttgacccctggttgaggaactaagaacctatatgtctatagggcaccctcccccacctccaaaaaaaaagctacagtaaatattggaactaggttggaaggattttgctgtttggtgaggggtgggtattttaaggaaggacattccaggcagagggagcagactttaaacaaagtcatggagatgatggtatagtcaagaatgtaaaatcaaagattgggtagccaggagatgggccagaaagttccccaaaggccagctgatgattgcctagtgtgtaaggccaaggagtatggattttattcaaaaggtaacaggttgctattaaaagctttaagttgagaagctccatgattaacgtctgctttcaacgcatgctcgtgctgaaggcaggagagaacatgaatgtaatgggtggagagtggaggcagggagaccaggcagaggtccccagactcgagaagaggtgacaggtaggcttgttatgactgagcggtctgttaggggtgctgagaggagagggcagaaaacgtgtagtcaagcacggttctgggtaatttgggcgaatgggaccaaccaagaaaggaatttttataaacctgagatttattttttttaatcttcatgatcctctggtggcatgaaagaagctgaatctttaatactacttcagtttcaagcttatttgatattttcttgctccacccaggagaacatcacttgaattatgccataaagctagagccaaatgaattcagttcatttttctaaaagttccaagtagggacagacaaatgtgtactcagagaacaaatttcaagccaaaatgaccacatatagtctgaagtttggccatctaatgtggttaccactgactctttgtggctattgaacatttgagatgtagatactaccctgaattgagatgtgatgtgagtgtaaaatacacacaattcatatcagagtgcagagacttagtctgaagtaaagaacataaatgctctgttaataattttataatattacatgctgaaataatattttgaatatattggatttgaagtaggaggtagaatgagcctctcagctggacagctggtgtttgtcaagctgataatattaccaaaatcagtttcactagttttttttctttttaaatgcaacaactagaaaattttaaattacatatgtagctcacattgttttcctgttggacaacactggtctaggaagttggagttttgtggtgtcagtgttgagggactgtacagagaccaagtatttattttgcattattgcttcttcctcaccacctgatgttttctaatattttactatgtagccttattctcattaataaacaagtagttaccatagcaacggccacaccactctgtatttaccacacctggagggagagatataaacagacatcaatctgtcattcatgtttatacggttctgttttttaatgtatatctgggtcttcctttgcaaaacagagctctgagtgtaggaaaattgacttctaatttccatctatgtcactgggtttctttgggtctggaaaagaagaataattaccccatgcccacttcagagggatatgtgggtagttacaaagaattttgcaaactattcttagggcaggagcatgctcggtcgtgtccagctctttacgaccccgggaactgtagcccaccaggctcctttgtccatgggattttccaggcaggaatactggagtgagtgggttgccatttccttctccagggtatcttcccaactcaggggtcaaacctgcatctcctctgtctcctgcattggcaggtggattcttttaccactgagccacctgggaaagtcccattcttagcgcagagtatcagtctaatgtcacatagtttagtatagccgtggtatcaactattaatacactgttgcaggcaggcaagaagggcaggggaggttcctttggccgataggagtgaggaaatgcaaaagggaaaaaagaggtcagaccaagaaaagccaaaaggaggttagcgtttgttagcgtttgttccctagcctttaacagtctttttggagcatttcccatcttcagcaacaagtctccactggctaggaggagactaggaacccagagccaccactgtatacagttcatctggctttgacaaggaaaaagcaaacaggttggagtatttattatgttttttatgttgatcatttggtgactcagacgataaagaatttgcatgcaatgcaggagacccaggtttgatcgggtcgggaagctccgttggagaagggcatggcatcccactccagtatgctcacctggaaaatcccatggacagaggagcctggcggggtacagtccatagggttgcaaagacttggacatgactgagcaacgaacacttgaagtgttatgctcatttaggccccccaagtttctcaaagatctctcattcctgggtcaattctgtcttaacgtacttaccactcaatacacatcatctgaacagagatgactgatgctaagaaagggaaattaggaccgatcttcattaccttcacccaggacagtgctggctccaaatatttctatagactggctttaagaatttccatgtgcttgatagcagaggctgggggtttggccatgaagtggtgtttgcacatcaagcttgcagttttcagttgggtgtcatgcttctttgaggtagctggaggagggatgttgatgatcagggtcggggcagggttttggctgaagacgctaaagacctctccactcaatctacccctttgagatttcaaggaacttagatattgtggctaaagtaataaacattctaggttttggatttcatttgcacaggtgtcattaaatctgtgtgaagctgttcaactgatgatgagctctgtcatttgcaaatccattcactgattcatctaatctacaaaccacccaccctaaatgaaaatcaaggatactgctacagctacatctcaagatgttacattttgagaaatcccctaactcagcattgacattcagaaagtcctaaacctggagaaggaaatggcaacccattccagtattcttgcctggataatcccatggatagaggagcctggcaggctacagtccagggggtcacaaggagttgaacgaaactgaagtgacttagcacacatactgcccaagaaaactcaaacctcaggggaaataaaaaaaatacactacagaaatgcagtggctctgctgaagttgcaagaaagggtgatcgtctttgtttggtgttttgagcgtcttgccctccgctccaaggaagggagagggaggtcgtgggggtaggaaggagtgtggatttctgatcacaactcaaatggcactgtttgaattatata

SEQ ID NO: 47906 - DNA, 1586 bp, Bovine  19866880997959
ccctggcctggagaattgcacggactgtataatccttggggtcgcaaagagttggacacaactaagcgactttcacttattgagcaaagtagaaagtctgcctcagttctttcctaatatcctagaatgctagactagaagattcttttgcaacacttaagccagtatctgtacttatataaatcaagaactagcttccaagaagtgacttcataaactgtcaatccagtcttttgatatcctggcttagtgttgcttacaccatattggtagcctcactggattcaacttgacagaactgggtagagacaataacatttctaggttctggtatgactttaacctaatgcaaccctttggatatatacaacccttaagatcatgggaaaattgagttatgcattattttatgtaatcatggtaaaatgtatatagccagttaatgggattccctggtgcctcagaggtaaagaatccacctgccaatgaaggagacatgggttcgatgcctgggtctggaagatcctctagagaagggaatggcagcccactctgatattcttgcctgcaaaatcccatggacagaaggagcccggtgggctacagtccacggggtctcaaaagagtcagacacgactgagcaactaaacaacaaacacaaggccaacattaatgagtagatgcagacttctacccctactcttctatttccagccaactgatttattgaaaaacataaatattttcagtgctcattagtttatagtgctcattagtttgtagtcctcattagcaatttacgataatataaatgaaaaaaaaaccggtcttaggaaccaaaagtgcacacaaaattaatcatttttatgtgctggaaaatggaatatataactaggctaaaatagaagctgaacaagaagcaaaaaaaaatttttaaagaaatgtacccacaagcatcaaaaaaagagcaatagtagagatgacctgcctgatccagatgattccaggaaatttggaaaacatttattttgtttcactcaatctacaatgccatcagctgtaggatgtaccattattttatgtgcaccaaaaaaagaaaggaaaaaaaccaattaaaccatgacacaagcttcttaatcagctcaattataagatggatcctgctttctcaagtgttaaaatgttttttttttttaactgcatatagtaaaatcagtgaaatatgagatcttatgtttgaccacacaggaattgacgacgtctctaaacttgatgacctccccagtgagaagccccatcacacatgagattttcatctctctgttctgagaggagaaattttttaagtgaccacgaatctcccacccacccctccccaccccacccccgacgcccttctcaaaaagaagatcagttacatccattctctgctcttggatgataagagtgacaaaataaaaagtatgtgaagatatcttatacatgtggcttttttagggaggtagagacattccataatgttttaaagatgagcacacatgttaaatatcaggctgtcctttcaaagcttctgtattgggaactgt

SEQ ID NO: 47907 - DNA, 994 bp, Bovine  19866881011185
cactacacacttccgttaaaatagctggctcttcctggcatgcacaaatagatgactcaaactgagaaacagctgctggagaacttcactcgcagaacctccactcatgacgacggatgattcaaggtcagtctcggcagaaagtgaaatgtatctgaacttcctttccttcacagtgggcagcgctgctttgggttctggcacttaaagaagggtgaggctcctgacctcattttctcagtgactaaagaagcacaccacacacactggaaagcaggattagccgggggagaacttggcagaaattaagcacccccacatgaggttccccctgcacaagaatccttcgaaacgaaaggctttagtcccatcaggtgacgtgtgaacatccccaaagacagctccgtaacacattctggagcatctgaggttgtggagatgacgcgtattgtaagcagaagcatcgtgttcataactacacacacgaacccatacccttgagtgtgggtacagacctttccttactgcagtaacattcagagatcccaatttaaatcaattccccaaggctgtggaagtatcccatttgggaagcaattccgtcaacagaatgactcatttaataaatattttagcttgcatctcattctctattatagtagacagtaaaagaccggctttagatcatctcactaatccatttatatatcccataggtgtcgtcagcttatagagtagccaaaggaccaaacgcatgtcagtgtgtggatatcctcccgcagacctcccaggagttgctgcctcctgtgctgtgtgcctgcctttctccagcatggttttcctcctaccgccatccggcacagcctctcttgcagtttcatcaaagaaaagtataattacgttagcaggactcctaattttgaaaagacattagccaagccagtcacttcattacgctgcacttcagaggccagcaagataccagagaaggccc

SEQ ID NO: 47908 - DNA, 2586 bp, Bovine  19866881052115
tgacccaggaagctctgaagcatggattgtctgcagagttggtcccacctttaggcagggggccagccctttgtcccctgggccagtcattcattcactggctgccagctgctctgggtgggacatgagtggagggtgagtgggcataacctcccagatgaagccggtctgcatggtttagggcgggtctccagagcagtgcttctcacactttgctacacattggacactcctggagatctttaaaaaaataaccactgtacttctttcataatcagacctcatgatttaaagtgcttcctcctgaaactccctgatgtccccctctgttcctgcaagcctcacacaccttcctttgggcagctgttctgcagccctgcctcagacggggaagacacatcaactccgctctcttccagcccctccgcctctccttgttacaggatccatcaccctctatggaagaggtctttctacccatccacattgcccactgggccgggctctccctgaaggatgtggacagttttaatgtgtctctctcatggctcctatcccactgcccagcacagaggacagtgttagcatttgctacatgaatgaatggatgggcacaactgcagcacttcagatgggtggtaccgacactaatgctccagggtctccaagcaggaagtaatccttcagggatggagcaggctttgagggaaagggggaaattaaaccaggattctgaagaaaaaagaaaaccaaatccctgtaatttcctagttctccatcattctaggaccctgggggctaatttcgagtcagctttgggggtaggtttcaggaaggaaggtgaaagaaccaggcatttcggtgctgctctctgctgcctggcagaagcactaaccatggttttcaacacatggagagaaaagggctttggaaagagatcttgtcctttccccatggtcacctgaagatgatcactcacccatcagtgggccttcctctcaggaggcatctgtccttctcttgctcaacatattaaagaattctgggtgaaacggtggtgtgtatgggcacagagccatccccccagcaatgatcaatggctctgaggtccctcctcatctgagcctgacagaggggctccgaagcgtccacagagcctgcacgtggccaggactcgaatgagagccaacatccctgctgaggttcacgactggtgagacagagatgatgctcaaggcagggacagagcaagagacacctgccggcagcatcagaggtctcactctcttaaccgggagatttgctaacctgccgggatcacatttcctggagacggcaaaggctgtgcagaaaggttacatctgccttcttacaggtgggcttctggatgttgctgggtttgcttttcaccacactgctctccacaaacacactttacattctccaatggtcctgagtcccaggctttgtcatcagggcatttggtgtgtgcatgccaagctgtgatacaagggtgatgttagtggtaaagaacccacctaccaatgcaggagacacaagagacatgggtttgatcccttggttgggaagatagcctggagaagaaaatggcaaccacactccagtgctcttgcctgggaaatcccatggacagaggagcctggcaggctacagcccatggggttgcaaacagctggaccctgctgagcacagaatggcacatccatgatacagtatatatgcatgcacctgttttatccactgtggcatttaggtccagaagcaagcctggactcaaatcctggctgtgtgactaagcaaacactgagtttctttgagtcccagttttatggtctctataatggaagtaataatagtatcttcttcatactaaaaagtgtgttaactaagtgagattatcaaagcgaaaacatttagagttgttcctacaacagaagaagggatttaaaatgccgatgagtgggacttccccggtggtccagtggctaagactccgtgctctcagtgcagggggcccgggttcaatccctggtcagggaactagatcccacatgccacaactaaagattccacatgctgcaactaagaatttgcatgttataactaaagaatgcccgaatgccacaactaagacccgacacagccaaataaataaaaaaactttaaatgttgatagtatttttgttattgttatgattaaccttacaaaattgacagcctttaaaaatctatgcaagagattggaccatgcattgaggacaaaaatcaaagtcttgagacctagttctaaagaactcatagtctaaaggggcagacatattgcagagcactaaacagaagttcctgtttgacgctgggtcaccactagcctatatcgcacctttatgtgaattagaaaaatggatgctccttcctgccaggcgactggactttagacccttgccctcttgaccaggtgtccttgctcaatgagcaaccttaacaactgtacataatgactatgtatatatacatacaggctggttccaaataggaaaaggaatacgtcaaggctatatattgtca

SEQ ID NO: 47909 - DNA, 1281 bp, Bovine  19866881057867
tgatgacacgttaactacttggttaaggacatccccacaaagacagaaaagatgcagcccgttttgctgtgctggccctagcagagctctgaggggcagatgggtgaatggaaacggttaggtccagctgggagctgtgccctcagcaaggacacagctgctttagaatcactgtttttgcctcagtcctcaaagagcgaattatgagctacgtgtaagaaagtttcaggggacggacgtggagaaggaatataacctgctcaggtgtctggctccaatgtagggcttaggtgggtatccacggccaccttccaggagcgtgaacggcagccagcttgaggattaagcattcccaagtataaggacttgcctaggtagtaaaggtctgaagaaggaaggagaaaggaatctcaactaaaggacagcccagagctagtttctggaacgtgttcagagcagtttttgacttgatctcaagtaagttcatcagagtaaatgttgaggggttcaagccttccttttatttttaggcaaaataaaaactcagccttcacagactattgtatattaaaaagtccttctaagaaggatactattcaggaacccctggaaatcgattttaaaaggttaattcttttcaatagtgcaccaactccctcctgctgtattttctgtttgcttttgctttttcccccctgctttatagaaggtacatccgagttgatgactttcttccatttcctgcttctctatgtatttgaaaattaattttgcctgtccctcccctcagccttaagcagagtctctatttccaactaaagattttaattatttaaaggtcttagggagtttttattttctctatcatgaattgtcaaaagtcctttccttgaatcccaagtttctctttgtaacgcagatttaagcattttcattcctttagttccaccgagacctttagtaaatcttaatacttccactgtatatcaaggatggtactaggcatccagaatatggtatttaagatcaccaccatctatgtaggtaacaggcacctaataacaaaacaagagtttcagtaactaatcaataataacaatgtaccaagcacttcataagcacacctccttcattctcagaaacccctatgaatgtggatctagtattatatgcattttgattaggaccctgaggcttagagaagtaaagccatctacatgaactcatgcatctagtaagtgggtggaagcagaataatataatatgctagtggctagaata

SEQ ID NO: 47910 - DNA, 535 bp, Bovine  19866881073696
tgggactttctgagattacaattgttttgagtttggcttcaagcccagactgcacagaaatggagtagaatcactctgattccaatcttggatatctgctgaggtttctagtttttctgctctactttagggagtcaactcattcttatacatttgacctctttagttcttaactgtatctccacatcagaggtccatatattcttagtataaaatgtttgttactaaggatttcacggtttgtagacatcaacctttgtttttcctcctgatgtatttcatatggagaaaaaacaagatgttgatccattacgccctctttcaaggcatgttaaataatgtaaacatttgaatgctactaactgtagacagggcttcccagctggctcagtggtaaagaattcaactgccaatgcaggagacacaggttcggtcatgggtcagaaagatccctgcagaaggaaatgtcaacccattccagtattcttgcctgggaaatcccatggacagaggagcctggcaggctacagtccat

SEQ ID NO: 47911 - DNA, 1459 bp, Bovine  19866881109165
tgcagtgcattctgtttatccgttcatctgtcgacaggcccttggcgttgcttccacttcttggctatggtgaacagccctgccgtgagcatgcgtgtgcaaacatcctttgagatcttgctttagttcttgtgggtgcatacccagaagtgaatgctgcgccatgtgtgtggtagctctgttttctatttttaggaaccaccatactattttccagagttactgcaccattttacatccccacccaaagtgcacagggctccaatctttccacatcctcaccatttttgcttttttaaatgtagccatccgaacgggtgtgaggagatgagcttagtttgaagaggtcaaaactcaggggcaggaaaattataagaatctagtatctaatatctggctatgagcttaaatgcttttaaaagctgccatttattcgcctcagggcacagaaatattacaagccaaaggcctcctttgaccctctgggattataagacttgatttcgttatagaggaagagtaaggatacattttatggaaaggatgaataagaaggaaggttatatttttcagagacagagataaaggtttcattgttattgtcatttttattttcaaaatagaaacttatccagaaatttcttcacaattcacgaaggacagtaacttcactgcaaattcttatatctctccactgtgtgtgatgaaagtcgttatacagagtcagcgtttccagtttatgaggaaacctggctacttggtatgcacttattctctttctttgaaacttctatggggcttgaaacaatgctgtccactcaacctgagttcctcaaatgaaaatttaggaggaaatacaattgcatccaaaggtagcaagtacagattttgtgaggttttcaactctacacttcaaacagatggagaatatatttataatgaaaaaagaatctgtgattatgtaaaacaggtattgacaaactttttctgtaaagggccagagagccactgtctttatggaaacgatgatactcaactctgtcacagcggctctagacagtatacaaatgaataaggcggctgtgttccagtaaagctttatctacaaacacaggactggagatggattttccctgtgggtcatagtttgctaacccctgctttagaagacccaagaaaaggaactttacagagttttcctgtcagttgaaagaggaagaacaaatcttcaagccctgtggcaaaaaaaaaaaaaaaaaggccaaccagcaaaagaaaccttgacaacatttctttcaaaactaagtacaaacctgtggcttttccataaaaactgtacctcagggctccaacgttactttcacatcttgatccttgatctaaagaagcttatcgtatatgagaatcgacataacctcagatgtagaaaccgaaatcctaagtcgctcaaaagctagag

SEQ ID NO: 47912 - DNA, 1522 bp, Bovine  19866881211208
tggacatataattatattttaataaaaaatagatttataactcaacagtaaaccatgagattaagcggcccagaagctgctttgaactcgcagccatcaaaccctggcctgcccgcttgtactgggctcctgagggagggggtgatgggaacacactcacccacagtgggctgcaagggcttctgggagccaccttctctgactggcacttacacttcaaggaccagtgatgcatcagaactccaattttgataaacaaaagtgaaatccgtatttaacagaacatgacaaaaatcactgatttaaaaaatctaaagactaatggaaaagtcctgtcatgaaatcgacctgaaacacgctctgctgtagttcccatttgcttttgctgctccagcttgactattaaaaatgattttttttctcctactcgaactagcctataatttgatttctaggttcttccagggttgtgctctgaacagaagcaaaatgaaaatatttcaggggcttatttgacaagcattgcgaaagaaaacgcatggctatctgtggagtcataggttaaacctataaatttattttattaaacagaaagggaatgggtgaaatttaaagacactgtaaccctgaccctgattagaatgactaatattcttatctgatttattcatttaatttttgcttagagacatcacatacacatcgatggtaaccccttctttttggtaagtttttatctctctcaagattctgatgtattcagtgatgaatttggatccaagcaagtttttccaaaaaattcatagacttaaaaccacaaagaatgcattagcatttgaactaaagaaagaaaagttaaagttgtaacattttttccaagagagaacagtttttcacagtttttatataatctttcagaatataacatcaaatatgttttttattttattatgtattttaaatatatacaatatatatttaatatattgtatatcttaatatatacaatgtgtataatttttagtaacacaataacagtctccattaatactagactagatcactcttccagatgtctattcatacttgtagtaattgagttcatttttttcccaaacaataaaatgtctaatacaaataagtaaaggtcggatgagtctcaaataacatgaccagagtactcataaaattcgaagaagctgagtcagatcatttcaagaggacaaatgcagtgcttctccaaattcagtaagtggtggaatgtagcgatcttgccttgtctctcctctgagccaagcaacctggtgctgtcaaggccgtctttcatctcctgcgccttccaccaagtgctatatcgcttgaagaaaaatgcatgactttcttaattaaaaggaaagtgagtctatgaaaatgaagttgagcctaactgatcctgattctttcactcagactatgaacaggccgaagaagctgctgtaagatgtgacttattgaccatagctgttgtgactcatggacatgt

SEQ ID NO: 47913 - DNA, 1174 bp, Bovine  19866881223483
taagtacatacctattaatccttgcaagtcaatattgtctttgttttataggagagcaagctggtgatcacacagttaatttgttagaactcttgtggttgccagtgaaagtgaaccaaacccaccctggcttaagtgaaaaggataattcattggttcatataattcattggtctgggtttagaatggtttcaggcatggctggatccagggcctcaaatgattcaggggctaacctgagcaataccaccctcaaccttttattttcttctctgttggctgagaattgagccaattctcgggtgggctcttccttcgagatggcggaaagattaccagcaactccatgctatagggcaagggttgacatggtcccaaaggctggctgcctgtttgggtaaataagagtctttgaaacacagccatgtgcatttgtgtacatttgtttgaggctgctttcgtggtgcagcagcagaattgagtatttgcagcagaagcgaatggcccatattggagcttcccaggtggcacagtgataaagaactgcctgccagtacaggagacacagaagatacaggttcagtccctgggttgggaagatcccttggaggagggcatggcaacccactccagtattcctgcctggagaatcccatggacagagagaggaccctggcggctggagtcgctggggtcacaaggagtcgtgacagactgagccactgaacatacatatttatgatttggctttacagaaagagtttgctgacccctgcaggagaaaccaggtttcgttgaggtctaatttaaagctgtgagagacattatgtagttattcaagagcatgggactcaaggatctgaggttttaggataagcacagaatttacattatttagattgtccctttggattaacaaaagacttgagaattcttttaagtgcagaggttccattcccagcacaaatttgtagattaaaggaacaatagaatgtgttataaatttttgtagttgttacattctttggtggttgactgggagatgaaacaggaactttgttttgactatctcaggaagaattttttggataacatctactatctcaatgaatagaaacacctctataaatttaaattcccctcctgtttagtctgttagcagtgttctttgtcc

SEQ ID NO: 47914 - DNA, 1771 bp, Bovine  19866881224566
gagactatccctaaatcctaggcccaaaatgtacttttgaagatgaaaagagggtagctctgctggttctgaactttagaggtcattgtataagcagctatatgactaacatgaactctgcagactctgaacaggatatgagatccttgtaacaggaagagagattttaatcaggaggtgcttccgtaagtattgatgtgaatgacgaccatgacgatgatgataatagtattataacagtgaccagtttttagacacaaagtcagccaggcacttaacctaagcactcgatacataacaccttacacaatcctcacattaatcttatgagttactgttattattcagtctccactttacaggtgggaaaattgagaaactgatgaataggaagatgtgattgtcagcaaagagaaaaaacccaggccttaaatgaagatttgtctattttcaagaataccttcccacactatgaaaatctggctcttcaaatctctatgttagtgactaatgtaataggacttcagtgatgagggagaaaacaagcctctttttgaaaaggctacaaaacagatgccagtataagtaaatctagacagcatattaaaaagtagacattactttgccaacaaaggtccgtcgagtcaaagctatggtttttccagtagtcatgaggagtgagagttgcaccataaagaaagctgagtgctgaagaattgatgctttagtcccttggactgcaagatcaaacaagtccatcctaaaggaaatcagtcctgaacattcattggaaggactgatgctgaagctgaaacttcaatactttggtcacttgatcccaaagaactgactcaatgggaaagaccctgacactgggaaagactgaaggcaggaggagaaggggatgacagaggatgagatggcatcactgactagacagacatgagtttgagcaagctccaggagttggtgatgaacagggaagcctggagtgctgcaatccatggggtcacaaaaaagtcggtcacaactgagcgactgagctgagccaaagaaaagtggtgtcattggtcttatcctaaaatgtcataaaacgtacatatatataaaatgcacatgcatataatataagcaaacatgccctggaggatatccacccaaagtcactaggacacgcagaaccagtaggatgttctccatgaagcccttgtgccccaggctacaattaggagctcagcaggtgccagtgtggcctgaaataggctcagatctgctttacttagaaaaggctatacacgtgtatggtggcaagaatctcagttttgaaaccaggaggatgtgggttcagatctgcaatctactgcctactagctgtaagataagggttctttttggcttctgggcaggaggtctgggtttcctgatttttctccagagaatcacctctcctccacttccaagtcctggcaactcaggaaagtgctatctcactcctgaggccagaggcaggcacgtgacccagcgccagccaatcagaacactgcattctccacccaccctcctaccggtagtcattcattcaaggatgaggaagttagccctgccaggcaataagactaaattatggattttgttggggctattgataggcgtgtgctctcaactgggattgcctattaggccctaagcctggtcaaagcagggaccataaattttaaatccttctctcagacttggttaaatattaaaaaaaaaaaaaaaatctagggcg

SEQ ID NO: 47915 - DNA, 970 bp, Bovine  19866881407486
gtacatctacatatatattctcatacacatccgttactttcaattttttctataggttataaactagtgtatatattttcaagttgtatgctgctgctgttaagtcgcttcagtcatatccaactctgtgtgaccccatagacggcagcccaccaggctcccccgtccctgggattttccaggcaaaaatactggagtgggttgccatttccttctccaatgcatgaaagcgaaaaatgaaagtgaagtcgctcagtcgtgtctgactcttcatgaccccatggactgcagcccaccaggctcccctgtccatgggattttctaggcaagagtactggagtgggtcaagttgtgtgaatatatgacaaatatcaaagagctaaggaatcaaatatttttacaagtggatgagaactcaaggactttctaatcttctaaaagacagaagctggaagagattccagtgatgtatgcactcaacattcacagtcagtaactaaatccaaaagctgaactctaggatactttcagtcacatggagaatcaatgtcaggaagatcagatgcatgtcatacacaaacctctcttactttgcattttcattccttgagtcttattccctcaaaacagccagatacgcacttcatattgaccttctatcaaggagtcaggtgggagaaatggaaaaggaagaaggatttcccaacggttaatagtttaaatttctgcaggtagtcaatatctgccaaaatttaaaaacttctggtcagacgattcacgtctatagtcaacttctatatgattctttagaaatagtgtcaattgtttgcactgtataaaacattaaaaaatatatacatcaatttatacttcagcacctactagagagagaaaaggcaaataagaatattgacacttatctccaacaattcaaactcaaatccagaaatacaggttgatgcataaagtt

SEQ ID NO: 47916 - DNA, 1211 bp, Bovine  19866881426951
tggactatagcctgccaggctcctctgtccatggatttctccagcaaggatactggagtgggttgccaagcccttatccaggggaacttcctgacccaaggatcaagcccaggtatccttcatcgcaggtggattctttaccatctgagcctccaagggaagccgttgactgattatgtttgtcaattaatgcctctcttgctatgaatgaccagctgtggaagctggaggccagatctcagttataaaactctacacacctaacttaaacgccgatggaacaaaaacgtatcaggtcatttcactgtttctggagaacagagtgaacttgcctgaatcagtgtgacacagaagagctctcagtcactgatatgaatactgggttgctggctggtgtataaaatcttagctagtgtttctcccccagtccaagtcatctgagtcattgcggttgtactgggtaaggcatcccgatttggagatgcctgcttgcctcttcgtgtacaggcaagcactcactagttgtctcatctccctcagaaaaagcatttcagttgggcgttgggactaaatatgagccagagggagccttctgatagccgttacatgggcttcagctgtctaaggactttgggagcagctaattgttaatgagtcaggaggttgccagggcaaccagcaaactgctctttctggtaagctctgcctcaagtccaagaggggttatgaaagagttgcagcttagagaaggaaggttttcccctttccctgatgtttatagaaaagttttatgatgttaaagcttttctactcatccaaggagagaaatctgagatagctaaaaagttctaatctgaattatttggaaataagagaaatggaagcagaacatattaaacaagatgatacaggataggaaaaagttaagccaaagacaaaaagaaacattcccttcatgtggagcctttaggaacacatggccatgaattcataggagtgaagagaatttatttgaaagctttttgtagctacttcgttcaatctaggagatgactacaattctgttgaataagtgtaatacagtgaagaatattagaataaagtatgaagagatctcttgagtctccatctgattgtgtaaacagaatgctaagaggaaatccaccttgcccaatagtcagcaaaggacgtcatccagtgacaggtgtcag

SEQ ID NO: 47917 - DNA, 1116 bp, Bovine  19866881527977
cagcattcagcacacatctatatatatcacagtatgactttcatgaaatcttctaccaatgaacaacttctctggacacagcctttccccagattcttccctaaatctgccctaggaatcagttcttccaaaaagccaactgagttaacttgggttgcaaagatgaaaactttcagagtggtttgtcctccaagagatcaatacattctttggtggataaaacgaaaggattggactagtagatgattgctaaggtcattccaaaaatgtggttcttgtactctgctactgctactgctaagtcacttcagtcgtgtccgactctgtgtgaccccatagacgtcagcccaccaggctctcctgcccctgggattctccaggcaagaacactggagtgggttgccatttccttctccaatgcatgaaagtgaaaaagtgaaagtgaagtcactcagtcatgtccgactcttagcaaccccatggactgcagcccaccaggctcctccatccatgggattttccaggcaagaatactggagtggggtgccattgccttctccgtcttgtactctctgctgctgctgctgctgctgctgctgctgctgctgctaagtcgctcagtcgtgtccgactctgtgtgaccccagagacggcagcccaccaggctctgccatccctgggattctccaggcaagaacactggagtgggttgccattaaattgcaacaaccagaagagtgtcttgaggaggaaagaaacataaagaaccaattgtgttcttgatatagaagtaagagctttcagtgaacatttacgctttctaagatatcaaatctcagctgacagcaaagacaggtctgatctggaggcacatcttctgtagccttgtgtatctcctgccacttcgtggtcagctgctccagggcactcacagctcccccagttccgtgctgtctcctcctgctcctggaccttgccctcccctttccgggagcctctttctcattctccacatcacagcattcacagtgctcagcactcagccagacagaactacctgctcatcgctcagtgcttcctcggaagctactgcgatgaattctcactgtaacatcc

SEQ ID NO: 47918 - DNA, 1460 bp, Bovine  19866881581288
aattatgttttcaagtccaaggaacctgaaaatagtatccctaatattaactgttaccaatttgggataacagtgttttctccttaaagcagagaaactcctaatattccatgtctccttgagtttgacatcaagtttggcattttgagtttggcgctaactaatccattttacagaagaggcttagagaaatgaaggaacttgtccaaggtccaaaccaggactaagcaggggcagatgaggtatcttgggtgcaaaatttaaggaggcaccagttctcaggtttgtgtcagttgccattggagagtgagttcctccttaaattttacaccccagatgttttaaataaggagcacctctttaatttattaattcaatcttgaaagatataatcaccaaatacaaattatggtttctattttcttggaagtattttagagtatataaaaagatttatcctgcaggttaaattgaccaataatgtggattattgaaactgtatgttctagattatgtgtatgtatataaacatatatatacacatatttttatggatttggatagatacagatgtatatatgagtatacacacatatataccaacctgtgtacattcatactaggttatttaagccatatacaaataaaaatataagttttcattattggttttattgtgtgtttctataaacaaccacactcaacttgttaaatttctcattaacactgatttgccaagcttttgacaatgcaccaatttccataaattcttaatgagatacaaagtgaaatgaaaattcttaaattatagtaagtcatcatgtttagcagttgcttatactcatttggacccatatttaaaatgcaaaagtgctttttattatgtatttatattacaagttgatgatcacaatggaaatagacattttcaagccatttctttctcgtattacccttcaaaatgtaccatttatgatggaagtcatctgtgagaagctcattatgccagcatgagttgtttctctgggttttattctctttcagatccatcatctaagttgcttatttatcttggcatatgctttcttagcagtagctactaatacagatgcacggcagatgtcatttttattttatatacagtcaaatatctcataggaaatttgtgatgcaaatttcaaacacagatagctcccaacaactttatcacctttcaattgaggcctcaactaacccattgatataccacagttaaattgtgatatccgctgtaggttgacagtgaaatttttctctttttcctacagattataaatatatttgagtaaacatgagagtctattaattaatcagtaagcagtgagagtgtattgactgctcatgactgtggaaggcagggtacagaagggagtataggatatagtagctactctagaagaatatcagtgtaaacaagaaga

SEQ ID NO: 47919 - DNA, 1168 bp, Bovine  19866881672555
tggagaatactattggcagagggtcctggcagactacagttcataggggtgcaaagagttggacttgactgaagcgacttagcacacatgccttgtgaacagaaaaatcatttggaaatctcaaacagtaaacaaaataaggggacaatattattctcactagtaatcagagatgtgaaaattgaaacatttaaggtactgtttttcacccagcaagagagcagaaatatttgtcactgataatatcaaccatgtaaataaagatgtaatcaaattaggacttttacacactactggaaggagtataaatggttaccacttttcaagaacacacagtgacatacagaatgcacactctttgatccagtgtgcatatttctttcaattttcacataaaaaataatgcaaggaaaaaataagtaataggcacaaatatattcaaaatcattaacttttctaacaggccagagatgtgtaacactgcatagcttgcgtatgatacaaagttaaattttaaaatgggaaaaccagaattttccttaaaacagtaggaatccatgctgggtagtttcacccctcaaattaaattaaaacattacaaaagtgttcctgcaaatgtgcttcatcttcaaagaaattcacggaaagaaatctgacaagaacaaaagaatttaggtttctgagaatttttcagaccataccactgaactagataagaattcacagaactcaaatgaaaatactgatggttttgcaaaacttctaacaaaagatcaaaaccaacaagaactaattagatgggactaaatgaactgaggagaataattataatgtgactttttaatctgaaacacggctgaatttttcttaacattttagttttccagatttaaggaaactttttctcttaggctatctatgactcacagcaatttgataaaatgtatctttgtaaacaaaaacaaagaatttactttttccctctgtctgatctctccagaatttggaaactctcactgagtattcttattttcatggtagtatagtcatttgcatgagttcaataagaacttgttctccgtgtaacaggatacaacacaatcagatagattggttacaataccaagaattgactagaatgtcatacggagagagatacaaagactca

SEQ ID NO: 47920 - DNA, 737 bp, Bovine  19866882246475
acaacctttataatcaggttagtatttaaagaaaacctcttgaaatgggtcaactgatctattacaatccagggaggccaaagacattttatttcctacaggtccgatttcgttcaatgcttcacgtgcagagactctagtgttagaatctcctgacttttaactaatttactcggaagattgaaatactatattatttttcatttccaatgcacgattcacattggctcctcattacatctaatcacacaacgaattaagtaaggaaaagagtctccaagcacggacgacagctgatgggagagataatggcgtaagagaccagaaaggcagcttcggtgagggtaggagttttagtattttccaaatctgtcagcctcacaataacggttgagtcatgacttcacttcaattacttcacaaaagaaagaaaattatacgtgacagtcgaccacgaacaccctagagctgctaaatctgcaaaaagaaagggcagggattgtacactttatccgtaatgtggtgaagagcaccccgttgtttgaaaggcaggtgtgaggtgtgttctctgtgtgtgtgtgtgtgtgagagagagagagagagagagagagaaagagagagacagacatggaaagagagagaagagagacgagacaaaagggataaacagagaatggatagaaccaagagagggacgcagaagtaaaaacagtcaattctagtgacatcgaaatact

SEQ ID NO: 47921 - DNA, 1458 bp, Bovine  19866880210190
aacccactccagtgttcttgcctggaaaatcctatggacagaggagcctggcaggctacagtccatagaatcacaaagagtcagacatgactaaagtgacttagcatgtacacatgcatgcacattggcccctaaatggatctaaagtgaccactgctttacagtttgtgatcctaaggaagagcagccaggtgagttcttccgaagaggaccagataaaataccagacaaggtctctacttcaacgtccactgaacttactgctctgtttcccctactttcttgcatatagcatttcatcactccagctgcatcattaatgcagagcgtcctggctccgtacagacaaagagtgatggtgcgtgagaatggaatccatagaaggtcattaactgcccaaattactgggtaaattcaagcacctaaatactttagctcataaatacacctggcttctaaaaaactggggcagggaggggagagaaagagggcagtcactgaagccaaagtgacaattcaggtgactaaagagaataaggtaaggaaagagggtggatggttcaactccaaggatttagacaatccatctccaatgaaaacacttacagagaaggctctgcttataaacatctttctttaccttctttttggatggattttttaattttcctaaagagtccaggttattgaaaataaccacactgctcatgtctcttggttaaagacatgtcaaaaattctagaagaacactaacaactaaagccccaaatagcataatgtccttcatcaatctcatctcagaggctttaccgacccacagaagtccagctgcttacacatgcaatttattactccttcagcgagccctctttgggattctcagccatgtgggatatgtcataacagtatagtaacaatcatccctgggcttcccaggtggccctagtggtaaagagcctgccttccaatgtaggagagaaaagaaacacaagttcgattcctgagtcaggaagattccctggaggagggcacagcaccccactccagtattcttacctggagaatcacatggacagaagagcctggtgggctaaagtccacagggtcacagagagtcagacacaactgaagcaacttagcacaacaaccatcccctccataagaacacacttataatatcacctggaagaaatgcagggctgccgacaccacagtctatacatttcacttcctggttttcttagtcctcccctcatctggttatcatcttccaggaagtcccaaccagcaacaaaaacactgaactgtgttgcatcgaaaagatttcaaatgaaaccaaaacaaattcatctcactgctttatggctccttccttttcactgcccagtgtctgttctccttccaagcagctcagggaacagcccatcttaattgccacacacatcatattaagtatta

SEQ ID NO: 47922 - DNA, 877 bp, Bovine  19866880355053
ccctggatgaacaagtttttttaaaaaaattatttttattgacaaggaatgaattctctgaaaccagcagaagaaccattgtattttaccaataggtgtgcattacctgaataaatggataaaagactttatttgcaagagggaaaaaatccatttagtgattgaaacaactttctcttttatagctagtagtattaattagcctccccttcctctcctcttttaaaaagagcatgttttaattgttaccttttttcatatcctttttttttttatgtctgcagttcccaaattgatacttggcctactagtaagatcttaaaaataggtttgcattacttttgagaaagacagttttcaattaattaaaaataatttcatttcaaaacttagaaacctactgtgaattccgaacctaatacttacgttctttaattgcatgaaggaggaatgcagaagtaaatttggttgaatgtgtaattggcatgctcgtagtaagattactgtttcaccctcttatgcttcccagggaatatacagaagtctcaacttccaccaaaagcttttgaattctttggcatcaagtggtttaggagtgaaaatgtgcagaaagcaagtggggtacccacgggtgggctgaaggaagagaaagatgaagcagccttccttggggttctccccagatttctttgtatagaggaagtacggcaaatgttccatgtttctgatttctcctagagctagaaacctgaaaacagctgtaacattcccacacaatcaaaactgtgttgctttcacctttttccctccaactgaacctccttctttgtcatagatctgcctcaatacacagtactctaaagaatggtattattga

SEQ ID NO: 47923 - DNA, 1494 bp, Bovine  19866880360818
tgtggggcattttttttttttttttttttttgagtatttttataagaatccacccctagcctgtgggtccagggtctagaatctcttcagatgaacttgaatatttctgagatacattgcatgttgctgttgcctgtttctgttgcagagatctcatttctcttgtgctctttttgtaccctctttccacatgtttccatgcacatgcttattcctcctgcttttgtccccataattctgagtgcatgctcagtcattcagttgtgtccaactttttgcaatccccctggactacagcctgccaggctcttctgtccatgggattttcttgacaagaatactggagaggattgccgtttactcctccagaatatctttccaacccagggatcaaacctgtggcttctgcattggcaggcagattctttaccactgagccacctggaacatcccctataatgctatcatctttaaagttcaagtgtcacttcctctggatatgctctccccacacctaggaagtagatgcttccccacctcattgcacctgatgtgctctgagaatatttccagcatatagtacttatgaccttctactgttgctttttgatgaacatgtaaatggttaaattcttaatgcctctaggccatgacagggcttcccttgtggctcagctggtaaagaatccacctgcagtgcaggagacctgggttgggtagatcccctggagaagggaaaggctacccactccagtattctggcctggagaattccatggactgtacagtccatagggtcacaaagagtcagttatgactgagcaacttgctctcacaggccatggcaagaatatttttcatctccgctggtgggcagagatggcatagtgcctggcgtgaataggtactcagaatatttgttgtgtgaatttaattgtttacgttctatagaaagcttcgggtaggtactcacagtccttggcatctctttttacatgagccaattatccttctcactgcctggaaggtttgaatttaaagccagttcagcctgctatagcagagcccatggctattgcccgcttctgtgtgggaagaagggccagagggcatttgttgagcaggacacctggaatccagggtcctggaatcccatgctttctcactttcccattatattcttccctatgcttttttcctgttcccctcaacttctctcccctaaaggcaggacttgacaaaactgattattttgctcacttaagcatcatggaaatatagcaaataaaatgatgaccctggcaagtcactagaacacagttggaacattgccgaaaacagttatgcatgtggaattagcaatcagggctctgaaatcacagctgttgcttgagaagcaagaggctggaagggccagatactgaggcttcttcctcctccatcccctgactctaactataatcatcccaggcagtgattcgcagccttattagc

SEQ ID NO: 47924 - DNA, 1972 bp, Bovine  19866880580269
aatggaattgttggatcatattccaagtagcccatttttgaaagtagtggggctgaaagtaattttagctatcaatacccacattcctctcttattttgcattcaacatagtaaaaaattacaggggtttaatgatcagctaccccactgacagttatattttctatttttttttatagctccttctccaaatttctatatgcttagcttattttcacttatatggtgacttttcagaatggtacttacaaatccctaggactcacactttgttggatcccagagtggggcaccctgatcatgctaaacaagactgagatgaagcacaatggatcagattaccagggcccttaggagagggaacttctcaaccaaaccaatagtttctagcctccaggtacaactgtgcttgagcaagagcgctcataacaatttaaagacacagtatgacctgacctacaagttctctgaaagatgaagtataaatcagcatgatggtgggtcccttgtccagaggaggtgagcagggaagccccacaggtagataaggtaaatgtgccgctaacctagtctcacatctggaataggtagtcaagacttgggtcagtcactttaccatcaacacgcatgcccagctgagcagattaaaacttcaaacaagccatccaagatggaaaattctgtatgtaccattctatcttgaaattccataagaaacacccttattagtggctcctctgctttaggagcctaaagtgctgctcagaccctgacactgggagaaaggccctccatttgaaggctacaagtcatgatttggcaggaggacagggtgacaaccatatctaatgaaggtcaccatgctgctgtctgttcttcactggtcccaagagccctggggtgaagttgtctatgctctcaaaggataattttaaaaatcgactcccaaacaggagcctgtatgtttgtacaggaagatatatcatatgtgtgtttatatacttacaaaatggattattatgagaaggaagagtgtccacaagaaactcaccaaaatcctgcttcccgctgacttgctagttggtggagctaaacttttaggaaatttaaaaagcacactaatttgtgaaatagacagcaagggcttccatgtgattctcaactataacttccaatttacaagtctttcatctgtcttcacttattatcttcccttttctctttcaacattatttgaaccacaacattcccatcagcatggagattctgaagaattgcctgaaggcttccctaaggagtacagaaccatctattcagatattttagggtactttcaaccataggacaatggtgtctggacacatgccatatgtcatatcgattggtgaaatccaatcagctcatgatcaacttgaaataataataatcgtagtacgtattaataacagtagtagtggtagtagtagtaacagtggtagtggtaataataatagtaatagtagtagtaatatttgccaccatcttgatcattttatacacattgtctcattaaatgctgttgacaagctataagatagcacttttaaaaatagaagaaactgacttctaaagccatgtagctaatacatggcagaggcagaattaaacccaggctcagttactcatactcttaactgcttctccatgtttttccttgagaaacaaagatcaggctaatttgcacgttgcacaagtgctagactgcaaccctgagattattggcggctttacccagagatgctcaagctgcagctcttagggacccaacagtcacaggcaggcagaacacagacaaagatcaaccatacacccggcatgaagccccatcatggagcttagatcatgcctgggaagaaagacacattggaggatgtggaaacttgagaggctgactctgagtggaaagtattttgagagcaaccagaacaaagga

SEQ ID NO: 47925 - DNA, 1265 bp, Bovine  19866880613976
ctgagaaaatgggcaatggctcgggagacagctcagaccaagaatgatatattaggctgctgagaaataactcatgaagttacttagaggcaggatacaggaagagtcattggaggactgtgctttctcagacatcctcatctcagctgagaggcttgggtctggctgcagggaatttacagcctcccctacaccaatatttcactgcaaatggaaggatcgagtaaacactcaggttactatggagggaacttcacagcctcctgatacctttagggaaaggagaaaaagacagcagagaaggctgctgctctaaatgtttcctggctcttgtcaccatccttgagataaattgtgattatatataagggtgaaaactcagagaacccagggagccagtgagcagggctgtataagaaacagtagttctgacttggctttttcatggcttatctcctctgtcacactcagcccctagggatgccagaccccagagaggactgtgggcaggaagttcccatagtgacagggcgctttgcagctgtgtctgtataagtgtagctgattgtcagacccatcatggctcctttcaagtgcactgcctgtgccctaccccagcagcagagacaaagtacttgaagccggagatgagccgttgcctgtgtgtgtgcaatcagcgccaatctctctcagttctttatcaacagcagccagccgggagagccaggtggttcggagagaaattgagaaagtcctcagcagtcgctttcctgtgcactcactcaccattcagatgagctgctcgccgaccaggatcccgcctgtcttttatccgaagaccctcaggactagccagttgctccgccagctccccaagtttgataggccactgtgtgctgctccacagtttctaagaaaccaacagaagaagtctgagaaactcatgatacagtatgatgcacactgtagctccatccaccataaatgaaaacgtgcttagattcatcagtcaattggattctccattcatcggtagctgtgttcattctagaaatgtatgtatagattattcctgcctggggctgaaataacagctatttgtaaccacaggtaatagaaagttcacctcccttcagtaacgcgtccccaggctgaacgggcaaagctgaactcaggaaggagtcttaccaggaatcagtggcaagcaaagagtcacaaaaattttcccaaaacatgaaaagcaaaagtaaggagagccgagtcag

SEQ ID NO: 47926 - DNA, 887 bp, Bovine  19866880620300
tccaataatatctgacttagatatgaatataaacctctcagtaacactttcataatgagttctgaacagctctctcaatgatgagaaatatccttccctggtattccaagaatataggctgttgaaaattcaggactttgctttcacaattctatgtttttgacttccagggaagtctttctgtgaagttctggtgtgaacaacagtcacaagtgggaagagcaatgggacaaggaggaggaggaagcaaacagtcccataattttagaaagagtgtgaaaaagagaagttagacttctaggttctatttctagctctgcttctgttttctagccagccaggcagctttctattgggttgcccccaaaattcatttgagttattccataagatggtatgaaaaaacccaaaaaatctttttggccaacccaatacctttctattaactgtaaaaagtagagaaaaatacagactacatatagagcaccttgtcatgtttggatgaaagatcctgcttcatggccaatgcacaactagaatcaataatgttgggaagtccacgttgtgttgtaatatatcagcttcaaggttcacgggaatacatttactctgaatacgtaaagtcagggatggcaaaattgcatcctgaggtggaaacaccaaagatggatctcacacactaaaaagtgaggatgactatgagcagagcttgccccacaccaacctgtaatgtcagcgaaatttgtgatctgttctatcccttctcttcctacattctttcttcctcatcaaatgagccactccctatgcttagttacgctcagtcatgtccagctctttgcgaccccatggactgtatcctgccaagttcctctgtacatggggtt

SEQ ID NO: 47927 - DNA, 1942 bp, Bovine  19866880711771
ctatcacgcttacaaccctgcggcactcaaactctgtgttcttgaatatcccaatgcaaatatgtattttggtaactcatacccttattttatatgttttaatgttcagacctctgtcacagtatcttaacacaggaaatcacaggtacagagagaactcgggttgtcaaaacacgttggttgtaaatttgaggggcaggtatttaatatttaatgacaaccaacctcgatagctcaatgctgtgttcaaagctccctgtttctggttgacagaacgccaggcagaggggaatgaatgaactgcttttatcagctcttacctaagacaacacaagggctaaggaaagagagggcttgttcctttttcagatcagcccatcaccccacaaagcctctgtatttggaaaactgtgcacccatatttgctcaagtaaaatggtggcctgatttggcaacataattcccctgagatgcatgcaaagaacacaaaatggatgctggtggatgggaggaagaagggttaccttcaggactggaacttcccagattaccctctggttggagtctgctctcagccaacacctccagtggagtactgatccagaagctctaaattccactgtcagaactactgatggaaaacgcctgccctgtccagacatgatagtaaccatttgcatgagttatcttaaaacaggaggtcctggtaaggaacatgaaactaacaagctaccaccaaccagaagaatttgggcaaggtcaaaaggagagggaagactccagtccaaatgtcctattaacctcccagaatccttcttgctggaattcatcttggctgaacgatgcacacaccaccaggaaggaccctgagtcagaatgatgggccagagacaaccaggaaaactaaccccgtgatcataaaacccgagaccgcgagccacgtggcagcacagttctcctgggctcccttaccctgctactgtcccctcgggtgcccctcctcaataaaatctcttgctttgtcagcacgtgtgtctccttggagaattccttgtcggatgctagacaagagcccactctcaggccctggaaggggtccccctccctgcgacagatgtacttgagactcctcacgtcccaaccagtctcataaacctccactggtcaagaagacactccaatggagaaataaacgtccatctcatcaaaaatgaccaaatcttgagaaaaccaagctcatcatccacaaagtcaacccggaaccctgacatcacagtgatttataagacacagcaataagaaatgcccctttagaactgtctaccatctcaattcttttcctgcaagatagtaaattttccttattgtgtaacctacttggggttgggcagtctcttatatgtggcctgaagcatcccaatacactcagtcaagccagtaccagccacacagatcagtaaacagcaccaggttatcactactatctttctccatctcctcctcgactcccttccccactgctacttctgcatccaacatccctccagaaaaccctgtttagctaattcaaaacccttttttaagaaatttatgcttgtttggcaatttttcccagcatggctgtgtgtatttaatatgattaacagctttagtcattaaacagcgctttctttaagaggattgcacgagattacccttagggtctcaagcggcagtcactgcacagactcgtccacagccaaggtaatggaagttcatcatcatgtaacaactccactcaggacttaatacggtcgacgacacaacccataaaaatattcttcctaaactaatcaaatcattaaaatgtcagcttccacagcagacactccgcggcgtgaaggcccctggcccagagtcaatgcaaatgcaatctcgccaaattgtcctatttataagcctg

SEQ ID NO: 47928 - DNA, 1014 bp, Bovine  19866880717665
tagatatgaagcatgccaggaaaatggtaaaggattgcagaggagaaggaaaaaagaattttatccagagctagtcaagagtggcaagagtctatttttgatagctcgacagaaaatgtttgctatcaaatctcatgtgggttctgcagaacattttattcagagccctaagactcctaccacattttttttttttttttacttaactctgattctctccaaatgttttgatgagggagaaaaagaaatagcttttggtgaggaaagggcagaccttgatctccagttcaaggtccttgaaattcagtctctgggagaccatgccaactatttaacctcactggaccttaatttggccatctgtgaaatggggtggacaaaattgaactacagaaccactttggtgataatgagcttcaatcagtgcttggaaatgcccagttacggtcggtctccagggagtggaacttaaaaagctaacataggggctcagagctgatgattttcagatagggctggtgggtgatcattttttcatatgtgatcttctctctaattgcaaaaagatgacagagagtagaaaagctgtggcatgagcccaaggttctgcagttcggatagaaatatccttggttattatatgcacgtggagagctcagcttcaaatcccaatgcccttattcttaaattacagctactgaagcacatcctgaattggctcctccaaacatagcagcatttgttgggctgcagagagtgacttctgatcccctcaacagctgtcacagggctcagcatggtcccctctttcgctccttttaggatatcactttgatttgggtcccaaatgtcacttcaaatctgcattccttgtttcctacttcttcagttagctagcatttcttttctatgttctgtgcattcttaccctattgtgatcatcattattgtttcagttccacaggcttgtgagagccatttgagcatcccacatgaaatggcgagataatgata

SEQ ID NO: 47929 - DNA, 802 bp, Bovine  19866880760986
tcctagctctcaccccatcctaccccactaggtttttttcagagtcccagtttgagttcctggagtcacagcaaatgctcatttttctgcctaacctttaatgaaacaatatcccacaggaacagagggagcaggaagaaccatcatagagcagggccaagcagattcatacgtgaggtccgttctggatcgacaacctgttcacctagtctcacatgacatcctcacgcatgaaatatgcccattcagtcctgcatatctgatgagaagggccatggaaggaaaaacccatttataggtgatgtttgatggtggcagtttagtggctaagtcatatccaactcttgcaaccccatggggtgtagcctgccaggctagtctgtgcgtgggattctccaggaaagaatactggagtgcattgccatttccttttccaaggagatgcttattttcccattaataaagggaaagtatcgatactttgttagttgggagcccagatttgaaaactgcttccgggactgtttataaaatcaactcagtatttttaaactcaaatgtatttgtcttaatagacttgagggtgtcatatcttttgacatgatcagccgtaaaatgttccatgggaacagaatgaggcatactgaggggagtgggttgaggaaaactgccatcatttatgtccagaggggcacagtaaatgcttgggacaaagtcagcttcagagaacacaagaacattcacccaaatggatggaagatgcttatgttattgttgaccctgtagtgtgattaaaggaggt

SEQ ID NO: 47930 - DNA, 1997 bp, Bovine  19866880800800
gcgctgttgtgtgttcctatctcagagttgccgtctacatttttctttttctctgttttgtctcattttcaaacaaacaaacaaaataaccaaagaactattttagggtcctttttcaccaccaccaatattagcatcaatattactaagacaacttaagcttttagatataaagaaacattgatataatatagcaatttgtttttgctgtttaatttacatttaaatctagacaagctcccacattttaatatttacttaaaatatttacttttacacatatacacagcacttgataggaatgcattgaagatgagtgttgatttacttgatttgttttttagtaagtaatgctgtctgtattgcagtgtgttccaaggcggtcattacatcagcagctcttcagtctgaagagtgtattgatgtgtaggctctgccctcacacccttttctgtactctgatggtgtcatggtagctttcaaaataaagctacctatttgtagctgtttttagattcatctctaatgcattactcaaggagaaaaaaaacaaactcagcagaccctctgttaattgggaagccccttctgtgttgcatttcaatctgtttttaagctgaagctgatttgcactttgtgaaaagtgaatctaaatcttttgtgctaaccaagggacattgagccatgttgttactgcggaaagctggaaggaggaatggataaaatggcaagtgtcttttattattattattattattaactatacagtgtatagcttggtgccacacctaccctcttccctaacagacaccattactaagtgctggtttaataaagcaacctagcaggtgaatatttagggtttagtggaattcggatagtttcacttcagtgcagtagagagaggagaatttggggatgaggccatttccagcatgctgttaaggaaagtgtgcgagctgacatacattatgacacaatcgtaattttgaagcatgatgtgtttgtgaattggctgtgtttactgtaatttgtggctgttcatccttgggtggtgttttcagatgcaggttttatcgttattattcagatatggtggggctgacagaccaggaagtgattgctattgaaaagatagtttgttactgacagtttttgggtggaggtggggcatgctgttcattcagggccatgtggggaagcacctgggttatttaggaggcagaggaagcaagggaggaacctagacaagtgtgtgtgggggtaggaagggatttgatgggaaggaaagggtgagtcccagtaaacagtcttaggattgactagttgaaaatcacttcagccaactgactctggagcacacaggctgtctcttatctggtacctggccctggaatgaatagggtcaggggatggtggcatggggtataaaaccctaatagaggaggggattggaggtgtgggttctgggctgatgggtttatagtctctaagaattagctagctctgagaggggcagtcccttcagtgtccaccaggtcccagacgccaaaaatacctgtataaagataagcttaatacaggtggtacgaagctccctgccccttggacagctggcactgatgattgcatatgacactcatctacctctgccacctccagatgccacaagctgggcaggtgggtgcatcgtcttgacctacagctgattgcattctttaccaagcagtggcaccaaagagtcatttgttgattctcttcccccttcatttttctttcaaggctcttgagaatgtgagactcctctttgttttcttactgcctagtatggcgcaaggaacgatgccagggaatggggtggagaagagggagggaggtctcatagtatttagttttgttctttttcatgcttaaacagacttaaggaattttcagagcagagtcttgtttcaagtatatgaccatttttcaattagagtcactataacctccacttc

SEQ ID NO: 47931 - DNA, 1838 bp, Bovine  19866880814254
ttttgactttgtggagtccctctgctgacctgttttggtttggccttgtattctttactgctctccctccccatgccatcctctcctccacaatttctctttctgatcagcgtgaacactactagcttgtccttcctttgttccttgggtttcttaaggtgaaactctttaatctttatctggtttcctactttgttcccactctctttcttcctgtcttgctatcagcatctgagctcagtgtcagagtagacctgcccctctttttccatcctctaccactatcttttgggctctggaatggcatctccaccctctgttctgaccactcaacctgcatgtcctgctgacactttcaactcaacattatccaaaacgaaacttactatctccctcccaaaccagctcctcctcattcccctgcttccattaatggcatccatagctcaaagctctttttccttaactcccacattcaatcaattgcttctgcagtgatttttaatatctgttccctccatcttatcccctcggcccccacactagttcagcgcctcattagtcttcgcctggtctactgggcaaaaccactccattgatcttcctgccttcacccactccaatccatcctacacacccagctatcagattaatcatcctgaaagacagccccaattcccttgttcacccccagttataaaactttaaaacacctcactgtctttgggatgaagcacaaacatttcatcctgccactcaagtaactttacaatagaacttcaacccatctgttgagatttatcaaccactactgccttattgtccatctaaaccaatgtcatagcgaagaactcaagaaaagtccagaactgggcttttgtctagaagttcaggcatgcatattattcatgggtaggggcgtgggaatgtcaagcagtggcccaaaggcaaagagggttgtccaagacaatacctgccagttgcatagttctttcctcagcctattactctggaaacagtagacactccaggaattcttgctgagcaacttgcttttactacattttaagctaggatgttacatttggacaaatctcaatcaaagagcagatgttttcttatgcttctataaatcagtgtggcttattattctcaactttctgttaatatgcactgtgttacaaatacattccctaggcaaggactcagctatatttttaatggggaagaaggaatgactttcactgcagccagattagaaacagcagtccttctctttcatctctcaacaaacaattcatgcagaagtcaatgaaaagtctgcagagtcaaattgtttaggggtcagttagtcatactgttggatattcagactcccacaaatgtgattccaatataaaaacaaaagcaacagtaataattacaatttcccagggtcataggggctttgcatgatgaaaaaatctttcacaagctttgcagacttttctcccatcaactagtttttaagttaggcaaagagggtgtagtgaagggtttggcaaactttttctataaaatggctaagtagtaactattttaggcttgtgagccagatggtctctccctcaatcccttttggagcacaaaagcagccacagacaatgtgtaaaattacaggtatgtctgtgtttcccccaacatgttatttatggatgctgagatttgaatttcatctgattttttttttctgttttacaattttttttcatatttatttctttggctgggtcaaatctttagtcatgcgggatcttttcgttgcggggcacagtctgattgtggttacagcatgcagg

SEQ ID NO: 47932 - DNA, 710 bp, Bovine  19866880840873
catttagtgatataaatgcattagcgtacaattcaaccctatgtaaaaagataaagatattaacttaaatatattaactctacttcaaattttaaaaaaagatatgaaaaaattcaagactgcttccttgttaaaaatatatatacatctggaataccacctttcaatttagtctttaaaaaaaacagtccttggaccacaaatgttttaaaggaataggaaaaattttaaggcaacaacagttatgttgcacaaatttaagaatactcaggataacaaagtctttgagctttaggacaaagtacacattttagtttaaggcttaaagactcctctatctagcttaaacttccttgggaattcaaggaaaagaaaatgaattactcaaactggaactacatcaaaatgtcaagttaacacattttcgcttgtaatggtgccaaaggatctaatgcctgagtgatgagggccttaggtttccaaatcattttaaagataatttcattaccaggatgctggagctttcattttatgtttttcttagctcttttctatttctgttttaacccatgcaaggctaaccaagacctgataagatcacattgcaatttattgaaaaacttgcaaaacaaaacaaaagactgcaaagaaaaatgtcaacacagaaaactacaaatcgagaaagaaaattaacaattttctcacaataa

SEQ ID NO: 47933 - DNA, 1149 bp, Bovine  19866880915830
tttaaaaatgcttagtatcactggtaatcaagcaatgcaaattaaagctttgagatacctccaactgtttaattgaaagtgtctaaaagtttgataggaaataaaatgcatatccttgtttgaatcagagattgcagagacctccatcaaaatctcagaaaagaggcagatggcagattgcagtcattttcaaacttactgaaagagccatgttcctttttctctttcctcctcacttaattgatattgtgtcattaataaagctcacaataaaccacatcagaaagctgaaacaaaacacaaaatcaaaataccttcagaatgcttactccattctgtctattgtgacttgcttcctccgcacagtacatcttcatggaaagagcatttgttaccataggctgttttctgtttgatctttgtttttttgttttgctttatttctattcacaagacatttgctatcccagagacctaagttaatcaggaggttctgaaaactgatgaagtgtgaggagaatgtgagattggcaattgttcatgttattctgaataacaaaatctcttgagtttttggaaagaagataagaatgtactttaggtaggggcctcagacccattttctctaggaagcagagaaaaccaggaaagagaaaaagttgggcacagcagagaactttgagaactgctagcaacagataagtaatcactatgtgataaacaccatgcatttcacagagcagctctttaacgagattcactttctgctgactcattcagatctacctagtggtagaacttcaaaaataaaaaatgaagagaattaaggcatgatcccattatcctcccgggagaactgctgacttcactggcatcaatcctctaaagacttatgtaaattttcaattgggtagctagaattctattttttttttcttgtaagtatttttactgagatgctctctggataacttccatcttctaacattttctggatgaacaccctcaagaaggatcaaatggcttttattcagtttggctttcttcagaagttaaagaaaaataaccctttgtaagatacattatgggagaaggcaatggcaccccactccagtactcttgcctggaaaatcccatggatggaggagc

SEQ ID NO: 47934 - DNA, 851 bp, Bovine  19866880995277
tgaagtggtgacactgacaccaggaaataggggcttttcttttctaatagatgtttgatttgttagtggagtccataaggacattttaaatctcatgttgctcaactcttagaaatgtggctcaacatcttgacaattgttttatcttcatgcatggagccaatagtactaaatatcagaggtccaaccttatccacccagggttaagttttctcagcagcttttggaatcctctgtcccaaagaaattgtatgattgaggcaggctacctacctggtcctcactttggcatcatgatcactaaaggagggatagtggtggttttctaaacttttttaggacagctctgaggatctaatgagacagtgagggggaggggtcattctccattcatcggttcagcagggcccctcctttgagcatcttccagtctcttgctaaagcagtactagcaattcactccttgaagccatctctggagtttctgtctaaattaaagaagaaaaggcttcatgtaatatattacaccagctgtggccattgttacatatcactctaaacaccattctgtttattcttgctatttgggagcatttgattttaattagcctgtttaaatattggcctcctttatagatttctcatccagcagtccttatgcaggcaaaactcccattaacttaaataaaagttaaaacattaaatattgttaggaggtggtttatattttattcatactgccgaagattattttaaatgtttccattgttccatcggtgccccaaggttggtttagggagaaagatagttttacttatcaaaataaaacattatacaaatataaaatgatg

SEQ ID NO: 47935 - DNA, 1626 bp, Bovine  19866881024009
tatttgcttgtctgagttgcagagaattgcttactgagatcttcctttaaggctacttgaccataaggctgcaaatccatggagactcagaaataatttttctggtggcaactgttgttatcatttcagtaaacattggctgagcagttttatatgcctagccctgtatctggggaactcaaggtgatgcaatggaaaatgaggtagagtgtctgatctcaaattccccctgccccagcaccagaggctaactttataatacagggttctaattggaaggtcttgattcacttgggagaatgttgacacaattagacatctctgaatgccatatacctggctgaagcaggtaatgaagttaagaaagtaattacaggatgcattctgtgacttaaaatagaattctaccactaattaacatgttggaggagacagcttctatactaatgttatattggaattcaggatactcttgaccttcagataatttttagaaggtttggaagtcaagggctgggtgcttccagaaggtacagttggctcaaaaaagcttgaccactttcctaacaagaaaacgaacctggcatctattctatgagaagtattattggagtgacaaagccacaaaccacctccccaccccaaacgtgttcagactcttaaagtgagggtctggcagcagtgtttattcaaattagggttttgctttattataaaggaaaatctctgctttccagtgaatcagtccagctgacaggagtgaagtgaagcagaagaaaaatcaccgtcctgattgatgtgggctttggtgcatcacacacctctttaggaggaattagcatctcagacaggagggcttggagaattttaacattaagttgattagaagccaaataacttggtttagtcagaggccccacaggcttcctgaaggccctgtctgcactggtccagatggccttttttggctgtgctaccctcagccacacatccagccagcttcatgttccagcttcactcagagagagagaggttgcccccacctccttctgtgccccacaaatgccaccccatcttagtgctcagtgagtcctcactaacagcctgaaattggcatgtcccttcaggagtcttggagaaaggactggagacactgaattgatggctggaaggagagactacggttaaccttttctaaaggatagtcacaatagtgatacgttgttgacaataacgttgaaaataacattattacggcctggcaaggtgtcaggtactgggttgaggaattaagtaaattttcttatttgactgtcagctaaattttatgacgtatgtatgataacctccatgttgttagtgcatgcgtgttcaatcgcttcagtcgtgtccgactctttgaaacccaatttactgtagccctcaaggctcctctgtccatgggattctccaggcaagaatactggagtgggttgccatgccctcctccagggaatcttcccaacccagggattgaacccaagtctcctgggtctccagcactgctggcagattcttcactgcagatccacctgggaagcccaacgtccatgttacagagggaaatagctcagagggtataaataa

SEQ ID NO: 47936 - DNA, 2226 bp, Bovine  19866881035505
aatgatgctgatgcagcatcttgggggctcagagacaatgagcttcgcagtcagtcagtggtggggaccacgtaagaggaaagaggcatttgctatcactgatgtcctggaaaggactcccagcgtgggagtcacaacagcgggattctggccccagcactgcctaactggtactcaaaggaggctctgggaccaggggaactgacatcctatgggaacaaagtgttagaaatgcagaattttagactctgccttcatttagaatctacggagatttagtagatttagaatcatttagaatcacaacctgcattttaagaaaataatgagatgattcatacagactgatttggccaaaattctttcctctatttctactgtattagtgacataatcagtgccctctctgtacatggcactgggctagagctactgcagaaaactagctgatcccatctatagctcacatgggattaagagattgactttacatgtcatcagctacctcgtatccaggagcggtgaggggcgggtatttttggctgctataaaaaccaagggggagcaatgctcaatgagtagaatccctttaggttgtattgttaacagaggctaaaaggaaatgatctgtttatgcctttatgcaacatctttataagtctgagcacaaagacaatcagcagctgccagtaattatggtgccatgtgggtaccactgacctcacattggcctccatggttacatcatatgcttcagagaaaaatactgatcattacagggcaaacaggtagagtgagaaggaaatcagagaagcacacagctttctacataacagatgtagagggaagaggagcagagggagaagggaaagtctggtctgctatggttcaggaggacacgaaacctgacccaagtgtgataaagattaggcaaaattaacatccctttattctgcatgttagagtctgttggttcaaaggggattttaatatcagaaacaagcattatcaacaaagcatgtaagtaaatggctcttgaaatgtatcaaatttttgatatgtaatgggctcattaaatgatgcttaaatctcagcaacctgtttccctaataaactcacaagtaggtattctgttagtttctgactctgaaatgattttcattataaatacagacatattcttatggaggaaaatattccagaagatagactagaaatgttttaggtaagaagggactatgctatgtatgtttatggctgagttccttctctgttcacccgaaactaccacaacattgtctgttaatcggctaagcattctaagttgcttcagttgtgtccgactctctgcaacactatgcactgtagcccgccaggctcctgtgtccttgggattctccaggcaagaatactgcagtgggttgccacgccctcctccaggagatcttcctgacccagggatcttcctgacccaaggttcttatgtctcctgcattcacaggtgggttcttaaccactagcgccacctgggaatcggctacacctcaatacaaaataaaaagtttttaaaaagaagtgactatgttaatacccacccagtgccactgtggatatctttagattagaaaacgagaatgctttttaaatgttctatgatgtgactcccccaccccagctatagtttatggctttcttcacatgacaggaggcagctctaagaggtacaaggacaggaactacatctgccttttcgtcagttctttccacagcatttaatataacactggcacctaagtgttgagaaagaatgaatggatcagtgaaccaaacaaaacataacccacaacttatgattgaagggggagacctggtacagtatttcaaagctgcggcagaactatgcagagaaaaggacttttttctccaaaagacaaatggtaccatcgtcacttcatagccttttccagttacagaaggcacatggttccaggtgtatgagaatatatctgaggtattctgggccgaaagccctaggatcctgcaatagtcaggtcccatgttgtttctatgagctttttcatttgaaagttaaggaaactgggacccagaaagttaagcagtctgattcaggtctagttcaagttagaagagcctggactggatcccaggctggcctccccggttcatgcttctttcccctccagcatgttgacaccctcactctaa

SEQ ID NO: 47937 - DNA, 930 bp, Bovine  19866881058716
ggattgatgtcttagcagtttcttaatctggattgacagcttcagcagtgagtttaacatagttgcacacctagagatggtctgtttttcttcttttttaaaaaattcatttttaattttggggaaattgctttataatgctgtgttgtcttctgccatacaacaacatggataagccataattataaatgtatttcctccctcttgagtctccctcccttcccccatcccacctctcttggtcatcaccatagagttgtccttgaagcaccaaaggaaaagccttctgcagcctttaaaaaagcttttaagctttttttcctgaaggtcttcctgtgttgctgtgatttttctttaattgtgacaaaacttgcttgggataactttaaaacattaagctaccggcaacctacataagaaccaagatcacttctgatgttttaagaacatctttctctttaccagtcatccgtggaataatttacatcaaagaattggccattttacaaaaacaaatcctcctaattcatgtgctgtgtaaggttcctacatcatgttgtgaatgccagattagtctctataaacctctgtctccttggctgtattccgaacttgattcatcattaatccatgccagagttttacaataataatacagtaaacacgattttgcatgttgactagcagtgtagagttgctgtgcctggtggtggtggcctttaaggaaggacgaggtaatatctttgaaaagaagaaagaaaaaaaccacctctgtaagtagttctaacatagttttaactgtgatggtatatttgacaccaaataactacactgtttcttttccagctaaacgtttcatcctttcttctttccctttttctttccttgctttcgcgccttcattttttagtctcatgttttcttttatct

SEQ ID NO: 47938 - DNA, 943 bp, Bovine  19866881095500
ggctgtttccgaatgccctggactcagtacccagtaaactattcatatatttagaatgggagattttcccctacttgctcactatctgtttcttaagtggactccagaaatacgccttcaaaggatgccatgagtgtgaatgacaggccaatcattagctacctgtctctgaaatgatataagtcagagccgatctctgtgtcaaggagtgtattcctcctaagttagtgttcctctgtggagctcgtcaagaatggagagcaggtcaaagcggttaactgatacatccaagtgcagaaagctcagtgttgccacatttgaccaattacacattgacaacagcaaaagaggaggctaagagaaacacataaaggaccattattcgagactgaaagccaaggcatctcacttacctctagtgtagttaatacaatcttctcaactgaagaaaaataagcctcccacaagaattgtgtctgctgtctaagtgctaggattttatcctgatgaatagacctgattgtagaaggaatctgtaacacaaggtgaacacataataactataactggaaaacaatgagatgccatttgatcacaataactcactcaggttagagtttttttcttcatagcattctgcttctagcgtacagatctactaaaaaccaccaacccctagactgaaaggtccttaagaggtgttagctaaaaacagcacttactgggagtcagcaatgatgacctttaatgaccaaatacacaacagttagagctcacttctaagatttggtagcagcttatcacttgtgtagcattcctctgccattttctaagaatcccacatgcccttgaacctgcccgtgaacaatcaaatcctgcagagaaggggctacagtctggagcaaagcgagagccattatgtcccaagcacttctaagacagt

SEQ ID NO: 47939 - DNA, 1562 bp, Bovine  19866881131677
ttaaaaataaatgtgccaattaaagcatatataaattcagtttcaatgatttttggcaaggaagtactgttttcttcccactggcatcttcccctgatctacttgcaagttttacagaaatttttgtttttgaatgtgtttaaatgcaaattttaagtttatccacacattctgttaatgatgtgagagttctaatgtattttatttctggcttaaaagatgaagcaaaatgcaaatttgaagaacactgaaggagttttctttctgcctttttaaatgccttcaacaagtgctacccttcaggttaaatactcagaaaaaaaatgcctaataacaattactgctaggccttgacagctggcattgtatttcttgcaagtgaatatctcggggttgagtcacagaactatttgccacataaaagtgcatggatactaacttcctccaagggaaaggaaggcttgaaaacactgtggagtctgtaaagccctcatggtccagtggctcagcagtctgagaagttcacttggaagcagtgctcggatgggaaagaatgggaagaggaacacagttggcagaaggccaaagacagagcagaaaaggaaaaaaaaaagtcataatctgaattttagccgtagcagagtggtgactgacttagacattatggaatatttgacaggaaaatcaaaactttaagcactgggctaagagactgaatcaaaatgttaagattttttttttttttaaacagaagccaagttactcacatagaacatattgtttcccctgagacagacttaatagccacaatttcctgccatcccaacgtggaagcttgagacttcaccacttttccttcaagaagtggagtcaaagtccctctcacgtggactctgggcttgaccatgtaacatgttttggcaaaagggatttcacacaaggatgcgctttggaaatattatatgcagtttctctgcctctctggaaacaccactcaagacgtgatacagcttgtaaagaagaggctattattagtttcctattgctgttctaacagagtaccacaaactcagtgatctaaaagaccccacaaatctattgtcttataattttcaaggccagaaatctatcatgggtcagcagggttgaattcctcctggagtatctatgggagaattcatctccttgccttttccagtttttagaacccatctgcatcccgtggctggttaacctcttccttgcatccctgtgaccactctatctttgtcacatctcctctgactctcctgcgccccttcttaaaataactcttataattagattgggcccacaagcagaatccaggataatcttcccgtctcaagatctttatcttaatcacatctgcaaaatcccctttctcctggaaggtaacatatccatattcacaggttttgaggattagaatttagatgtcttttggggaccattattctgtctaccacaaaagccaagtacaggagaaccaaggagctccatcccacagccagcaccaaagagccaggtatgggaatgaggcc

SEQ ID NO: 47940 - DNA, 840 bp, Bovine  19866881160147
acccaagcctacatctttctgtctgtttccagatttaaaatatcaggaaaggaactctgacccatcctgggtctagtgccactcctggagttatagtggggatgaggggagtaggatcatgactgaatacgggcatttctactgaaaaatcacaataccggaagtgaggggaggagaagcgctcccagaaaaggggacagtggtggtgttgccccaggaaaaaaggaagaggagctaggaaaacaaaacaggaggtttttatggaagaaacagtgtgacgacataacacagacaacatatacgcattagcaaaggctttttattcttacaaagcagatcaagcacgacgtgaaactttgccaactgcaaaaccaggatgactttttttcccttactaaaaatcaaaaggaaagcaacccagatgccttaattactttgattgtggaggtgaaggacagccttgcttttaaatgaacattgtatttgtccattaattgtaccaggaaattgaagagacgctttggttttatatgtgattatcttgatacctattgaataaaaaaagtagttttgcctcattagcagtaaagtatatagggataatgatggatcagtctaagtattatttccttatttctggttctaatcactatatttaataaggaagagccaggttcaataaaggatgcatctggcttcaaatgattaatcaatttttatagaactcacatgctggcaatttctttgagaaactagacaagacatcatgaatcacaactcacagcacacattccccagccctctctagcagctttgcttttgctaatcagcttcaattgt

SEQ ID NO: 47941 - DNA, 1173 bp, Bovine  19866881209397
aatgagaaaatctatctgtaatctcagtcattaccttttatttgaaattgcttctctatgagaagggtgcaaagaagagcatcattaggcatgaagcagtgaaagttctggggtgccatcatcccattctactgtcttccaaaaaccccttgatactttactgcagagtcagcttacatgcagcaagtgtgggagtacaccccccctcaccccatgtccatagcagacactgttaatcaatcacaacacttaattttcctgctgagcctgcccttggcctgagactttttctccacccagcaccaggcaaccactatccattgatccaagttggcacttaaaacaaaacttatctgcaatctccagacacagaacaatgctggaaaggtggagtgtttctacatctgatatacctaacagatgtgataattgtgggtcctaggccattggatactgctggggctccttgggttctggaaaaacccaccaggaataggacaggcctctatctaactgtataaagggccggtattctgtctcgaggcagactgattccacacatatctatatcctttcctccttcacattctgagtttcagatcctcaagctgagaattctaagcccatttgaaatagaatgagtcaggaactaccagagaacctgaaactaaggtaatcatttaaattctggataccacagagaacttcctaagagtaaaagtacatgtacattgatggacagatggagtggaacttgtttttaagatgtgatctcatatgtgttcacatttcctatgttgactataaataacagctactatttatttatctgacaaggtattaagtaccaaaggacacgcactttctttgtaaaaaattagtttactttttttaattggaagaaaattgctttacaatgctgtgatggtttttgccatatatcaacataaattagccacaggtatacatgtgtttcccctgcaatcctgaaccccaccttctacctccctccccactctgtccctctgggttgtcccagagcaccagctttgggtgccctgcttcatgcattgaacttgtactggtcatctgttttacatatggtaatatacatgttgcagtgctactttctcaaatcatcccatcctcaccttctcccacgagttcaaaagt

SEQ ID NO: 47942 - DNA, 986 bp, Bovine  19866881240535
ctcaccttgtctgtgacaatgctaattctccagattaagctgcgaattaattgagaatctcaaagtatgggggtagagctacagagtcataagattcattactcaaagatgtttatgagttgagtcctgcccctgaacccaaatgagctaaggaagtgcttttcccttcgtacctggtttctagaatcacttcaatattccttcagtattttatccattagatttattttccttacattttctgaactcagaacttctgtgtgagatggacagagaaaactgcagaccccttcaggccacagaccaggaattatttcaattattccttttcctgatgcagcccaggatataggtcttgatgaagctacatcagcactttttctgttttccttacagaacaaattgccagcagggttcctgtttacgaggatagcaattgccttgtacaaatttcccataaggattctgacagtagcttctctctgctcaggcagagagtatctgtgtcactgatgttgggcacgactccagaataagtctgcaatctcttatgtctaccgagataccctctgccaaaactgtacagtctgatttgtttgagaaactcggtttattcctgtaattatctcagaagggagaagtctaagtctgcataattatggtgttcatgcatattgaggattttttcaaggttgggtgacaggagggtgcccaggcaagggctaaaagctgaatgggaatgctgaggctcccagaaagatggggtggtggaggccctacaacatgttataggccaactccacactgaataatgccactctgaggggctgggaagagcagcagcagcagcagtggaacagccagccatcctccctaggctaattcacctgagcaaaagtaagaggagaatgaggaggcttctgtggtgacagcccagattagaacagtgactgtcgactaaggaagtcttcacatatggtgcacag

SEQ ID NO: 47943 - DNA, 1063 bp, Bovine  19866881248072
actttggctacctgatgggaagaactgactcttggaaaagaccctgatgctgggaaagattgaaggtgggaggagaaggggacgacagaggatgagatggttggatgacatcaccaactggatggacataaatttgagcaagctccagaagttggtgatggacagggaggcctggcgtgctgcaatctctggagttgcaaagagtttgacacaactgagcaactgaactgaactgaatgccgtagccagcgacataatgtacatgggatgtatgtcaaaggaatgtttatcaaaggaattgtgttagatgtctattgtctaatcaattatctaacaattcacccaacatccatttatggaagacttgctttgttgtttgaactgtgcttacttgatactgaggagacaaagatgaagagacacaccgtcctcactctctggtagctcacagaggacacggaagaacaaacatttaaagaagtgatattgaaaaattaaaattaagatagacccataatcttaaccatctattgtttttagtttcaacatatgtgtatatatgtgttatcttgtttgatagtgatgttgcagattttgcaatgatattctctctctctggaattattatttcaatgcataattagttaaaatttggtaagatctcaagttgaattatcactagcaaagtacttgagagaataaaaacatttcctctttaaggagtgtgttcctaagaagaatatgatccttgctaggaaaacgaaaatatcatgggatcctataattaactatagtcctaatagaaatacaaattcactttgtggctaccaggcttgagcatgaatcaagatgcagtgaacttaaggactgtagccaaaagctagtgataaaactctgagaatactgattattccaggtagactgaaaacctgactgaagaaaattaattaaacaccccagaaaggccaaggaaaaaaaagcagaccttagagttttcccctgaaatcatcttatctcaaccactttcttgcaagcttatgtgaaaagactctttcaggaaagt

SEQ ID NO: 47944 - DNA, 913 bp, Bovine  19866881270127
gttccctcttcaactttgccagtgcagattgctttccattttgaatttgcagatccacttgaacttttatctctaaaatatcgcagcatgggagaaggtattatgacctccaagtagacagttctaacttaaaactttatatttggggagtatggtcatctttttcactgggagaggtggggaaattagtaccaagaaaacattagtgtaattaagaaatgtgcaatttgcacaaggaaccatgcaaacagttcaccagcatattaatgaggtggaaatactgacccataatagttatccagtgcttttcagggagatgggcgagattacacattcagccactgacacaagtctacttaacgttgggaaaggctttggcgtagaggcaaagaaagaatgaatgtgctggtggcacaagcagaggtcacaagacaagttctttcgtggttgagtgacccgaagtttcagagtctttactattgagaaagaaatgacaacgtctaaattctcagcactgaacttgaggactgctgaggagcgtatctcaccactgggaccctgataccatttttagccaaacactgttgtgagcaagaatctggcaaacaaaataatcaggaacaaatgtgaaagccattttatttcgttttaatttttaaatctatagtgtggttgtgctttttcttaaaaagaatatttcttttcctacaaatactgctttggcttcggattattataaaattgcaattacttgcaattacaagctgatatatcccttaactccagtgtaaaagatggagacttctgaaatgaaatgcttgcttctacttggaagaagcaagagagaatagagaagagaaagccctcttatgctaaataaacaagaaatactttaaattgttttgcccctcaa

SEQ ID NO: 47945 - DNA, 1040 bp, Bovine  19866881353327
ataacagatgggcagttgcttttactctatttgtgagcaactgttgttttgaaaggttttttctttttttgtgtgacagaaagagaaaaaaaggagagggggtacaatatctggacccagaaggtttctgagttaaatttgcaagagctaaaattcttcacaaaggtaggataaaagtagtgatacaatttggtaacctctagcaaatgaattcttgctcatgttcataaggaaaaggcaaatgtaataaaaagagaaaaatgagagataccttgctggtagcattaacttgcaattttaccttaaaagccaaatatttaggtcgcaaggccttctacctctgaccgttttaggtttcaatgaagatttcatcatcatggttcttgatatgctagtggctccctgctgagataaaaccagaggggtcttcatctctaagctgagacctctggttctccttttcatcttataaaattcatttagagccatctttcctgacatctgtacataaagcaatataaaacattacaatataaattacatctgagggattcatctgaaattctatttcactgtttaataattaaaagtcaaaaacctctctgtggctttatagcagtctctatcgagaataaattttcttgataaggcatcctcctccccaacaatggaggccgttggcatattctgcagaaatgagtttagttattaataaatcctatcctctggaatgtgactccatttctgaacctctttggaggtggtgttacatattcagagttcccagattatccacccatttacaagtgttggaatttaacataagtgcctccatgtttttcattcataaaacgatgttgggcagttacctgctacacatggttgtgcaaggactgaatgagtcagtatgaatgaagtgctcagaatagagcctggaaaacagaaaacactaggtgctggctgttattttaactgctatgttttgtgttattcagaagaacctttctgtttcacagaatgagaaattctccaaaggaaaa

SEQ ID NO: 47946 - DNA, 704 bp, Bovine  19866881443273
tctttgcgaccccatgaactttaaccccaccaggctcttctatccatgggattctccaggcaagaatactggagtgggttgccatgccccccccaggggatcttgctggcccaggaatcgaacctacatctctcgggtctcctgcattggcaggagggttctttcccactagcaccacctgggaagccccatgtatatattaaatatatgcaattttttgtatatatgcaaataaagctgtaaaaaagaatagaaaaattgaaagtatataaaataaacaattattttaatagcacattctgtatttttaacaaaagattaatactactactattacattgataatatatgcatgtttaattctagtttagaaaaaaaacaaaataaaaaataaattttaaaatcttggattttcacactactacaatttttttttcccctccaaactcttctgcattctcctttccaaagcaaaatctgagaacattacccataatgtgcattgggtcaacactatggtatcatgctacattaggtgccaatgtgtcaactggcaccatctggactgaaacacgttttcttcgcttgatgtcaaaagagcaaagacagcagaagtcatatttagtgtgctggaaacttctaagtatccatccacagaaggcttctgaggttgagaaagcagaatcctaagagtcacaaatagc

SEQ ID NO: 47947 - DNA, 2314 bp, Bovine  19866881874176
tcatatttgataaggcacaattgcctatctgattacaggctgattttacaaatgaagaattaatatggatatcctttgttcactgagaaattactattagctttaaatgtgaaattcatttattataaataattgaatttaatctttatcacagtcctatgagaaaaattttattgtccccattttatagataagaaaacaggttcataaaggttatcgtagcctggctagtgagtagagagatacacaagtctacatgagttcaaaaggcttactctgggatcgacatgtacacatcactatatttaaaatagataaccgacaaagtcctactgaataacacagagaactctgctcaatgttatgtggcagcctggatgggaggggagtttgggggagaatggatacacatatatgtatggctgagtccctttgctgtccatctgaaactattacaatgttgttaatcagctctactccaatataaaatgaaaagttaaaaaaaaacaaaaacaaaaactagcaggtaagcagagttcccagagatggtatcatgcaaattaattttaacttcatcatcacgtgaataaagagatccctgccaaagaatctgcctgcaatgcaggagactcagctttgatccctggatcaggaagatcccctggagaagggaatggctacccactccagtattcttgcctggagaattccatggacagaggaacctgatgggctacagtccatggggtcacaaagagttgaacacgaatgagcacctagtactttactttcaacacttaaaaaaaaaaaaaggcttactctgaatcataagtaattacagtactctgaatgtaattcttacttgtatctttcattcatccatccaaccattcatgcaatcatttatttttccattcactgaattctaaaaaatcttattattcacccactctcccaccataaaccggatactgtgtaccaagaataggggatacaacagtgtgaaacagcaaagtccctgatcccctaagagcttacattcttgtagcagtagatgagaactgaaatagaaaacaaagagggtaacatgcatggtgagaagagctctgaaaggaatgaagagagcactgtgaagaagagagattaggtgtggctgagaccccactgcttttcacagggaggtctgagaagggctctctgaagaggggctaactgagctgagaccctcaagatgagaaggcggcatccacgtgcatggccagaaggagcagtgttccagaagagcaggcagggttggagaggtgtctaggagggccaattccaggcaatggaagtttattcttatgagtgcccatttaaaaatccagataacttgttcagtggaaagtatccacaatcaattctacaccatgctcttttctagaagacaggttactgaatgtgtcctctagtttttgttgattaaattaagaccaccattacatcttcaggtgttcactttagataactctcaagcctatttatgtatgtacatttatttttgagacctaggagaaaggagcctcatgtgggagttcttaggggaaaataatgggcaagtcacacatctaattagttttttcaaattatttaatgtcttagttactttttggtagccttcccatttcctctcatctactgaataataagttgctgaatgtttgtaaacactgtgctgaagagtaatgactgaaattctccataaaagagatctgcagtgtggagtggcagggtaattttgccctcagggtgttggaagatatactgcatcttgtgcactgtcattactcccacaattagaggaagccagacaagatgcgccttcctgtgacattcccctgaaagacaagaacgtatttggattcatacgacaaaataaatgtttcatttgaaattgtctaactctttcagaacaatgttataagcatcagtgtctgtcatttcaggctctaagatagagattttcttttcagatctgtaagcaactgtaagataacgcatgatgtgtggtattatttttgattgacagagccagatctgataatccaagaggctaagataagagctgctaatttttaatgttggtgtacaaaatgactggggatggtgatattcactttaatattcactctgttcaagttttgtgggagagtattatatatatatatatatatatatacatagttagtaaaggccaactatatatatatatatatatatatatatatatatatatatatatatataaaagtctctctgttgtgtctgacttttt

SEQ ID NO: 47948 - DNA, 755 bp, Bovine  19866882047261
agtccgaatttatatcttggggataatatattaacagtggagaatctgaatttaatgacttactacatcagaaaatcttttttcttttagaacgtcatacacacctacatatacacacacacacacatatgtgctatgtgtgcatgctcagtcatgcccaactctttgtgaccccatggattacagctcatcaaactcctctgaccatgggatttcccaggcaagaatacaggagtgggttgccatttctttcttcaggggatcttccaaaaccaaggatcaaacctgtgcctcctactttggcaggcggattctttaccactgctccactatataaatactttagtgtaactcattgtgataccagatttattaatagtcaataaatatttatgaaactgaacttgatcttgcatgtctccatccaaatgataattgtgctatatttcctacccctttcattgtgtatgaagtaaagcctatccatactgtatctaccaagtcttataggctattgacaactcaacatatccaggagaaattcatcctcttttgaaccatagatggttcgtgtcatcaacatctgcctaatcatgcaagccaggaattttaaagtcatcttttctttgctctctttcaatcatccctgtccatccatttctgtcagctttgtcactactccgtatatgaccactgccttattttagtgcaccatatttttattttttattttaattttttttagtgcaccatat

SEQ ID NO: 47949 - DNA, 1429 bp, Bovine  19866882074087
cctgtgtactctagtcctgattccaacacaaagcctcaataacttcgatgatgacttgctttcattacccatcctcacaataatccaataaaaagctctcatttcaaggcaagccacaaattcaactcaacaactcaatactgccactgcggcacatcagctgactccgatttgcctttatctaatcgatacaaagactgagctccctccctccagcggaaagcagaggccaaggacctggaatcagcaaatcagtctgggcttggacaaaactaagaggacttatttgtatgtggactcttaaagaaaccagcattctccctacccaaagtctgcccatcccaggactcaaatcgctccacacaggctgcagtttaagaaaaatgcttatcaatgggcctggctggcacctatgagaatttggtagactagatcaggggtcccccacctccaggccgcagaccagtacctccaaatcaaatcagaccagtcaaatcagcagcagcacctagagtagaaataaagtgcatgataaatgtaatgcacttgaatcatcctgaaaccacccccccaaccccaatccatggaaaaactgccttctatgaaatcagtcactgtgccaaaaaggttgaggatgactgatctagattatagataccttcagttcagttcagtcactcagtcgtgtccgactctttgcgaccccacgaattgcagcatgccaggcctccctgtccatcaccaactcccggagttcactcagactcacgtccattgagttgctgatgccatccagccatctcatcctctgtcatcccctttttctcctgcccccaaaccctcccagcatcagaggcttttccaatgagtcaactcttcgcatgaggtggccaaagtactggagtttcagctttagcatcattccttccaatgaacacccaggactgatctcctttagaatggattggttggatcagcaatacgtgaaccgtgaacttccagatgttcaagctggttttagaaaaggcagaggaaccaaagataaaattgccaacatctgttggatcatagaaaaagcaagaaagttccataaaaatgcctatttctgcttcattgactatgttaaaatctttgtgtggatcacagcacactgtggaaaattcttaaagagatgggaataccagactactttacttgcctcctgagaaacctatatgcaggtcaagaagcaacagttagaacctgacatggaacaatagactggttccaaattgggaaaggagtacatcaaggctgtatatggtcaacctgcttatttaacttatatgcaaagtacatcatgcaaaatgccaggctggatgaaccatgagctgaaatcaagattgccaggagaaatattaataacctcagatatgcagatctcaccacc

SEQ ID NO: 47950 - DNA, 2446 bp, Bovine  19866880390015
cttgaatgtatagaaaggaagatgaccaattttagcagtcaaagtaacttcaatatctcagctaaatacttcatttcttacttgaaggaattataccccaaaatgagagtatagacacattaattaaaagtaccactaaatgcagagcaatgtcatccataagggaaactaatggatatgtttttcattatataaacatttctggtatcagtatcaagtaaacaaagaagcaacagcaacaatttctagatgaaagaaaaataaatcaaatggatattttgtgatttaacatactaaactccctttttaaagtatatatatgtactctttatcccagatctttgtatatcttcttatatctgaaagaagtgaagcttgacctctacattacagtatctaaaagagttggcaagaaaatctcatcaactgaagtttgggaaatttcttaccaccaatatttcaactctatattcagacattctatccactctcctggggaccattatttaaccattttatgagttgtttcatttatgtaatgggaataaaataaaaatacccaaaatcagagggtttgaatcatgcaatgtaaaaatatatatttatttttggctatgctgagtgtccatcactgtgcaggcttttctctggttgtgaacagggacctctctctagtggcggtgcacaggcttctcagtgcagtggcttctcttgtggagcatgggctctagagtgcatgggcttcaatagtcgcagcacatggctcagcagttgtggttctcagactctgcagcacaggctcagtagttgtggcacacaggcttagttgctctgtgacttgtgggatcttcccggatcagggatcgaacccatgtttcctgcattggcaggttgattctttaccactgagccaccagggaagccctctgaatcatgcaatttttgatatcttttcccagcttaagatttctagctctatttaaaaaaaaaaattatccaagttatagcaaaaacctatctagaaactttctccaggtgtaaatttggcaatcaactttgatggactgtactcaaaagaaaatttatgaaagctatttgcatgtggtaagaatgattctcaggtggcttagtggtaaagaatccacctgccagtgcaagagacacaggagacaagggttcaaactctacgttgggaagatcccttggaggaggaaacggcaacctgctaccatattcttgcttggagaatcctgtggatagaggagcctggtgggctacagttcatggggtcacaaagggttggacacaacttaatgactgagcgggtacacacacttgtaagaatagaagtggtatataaaatgtatctaatgcaagcagagcaaatttttcattttcatttcagaaaaaataaaataaaaataactaaaataaaattcctattgaaaatgagtattcctctatactcagtaagaaagaaaggttgatattttaaattttggatgtattttaaaattggacaagtctgtaaaatatctaaagtaatgataagtatatagtagttggtcaacattgcttataaacttaatttttatatgatcatgtgatctattaaatcacattctcaaggaattcttataacactctcactacagttttatcaaatgttgagtccccaaatgtgataagaaactcattacttcttgacagaggcagtgatattattagacagttctaattggcaataaacaattaaattgagttcaaatgtatcttttattaacttgcactcacaagttctatcaactgcttgtgcagaaatggataacagatttttgctttgttttctatacaactagccctttaagtatttgaagccaacatctttgtcatccaccagttattccttaatttaaaaaaaattaaatatcttagatttgctttatttggtttgctagtgagggatcagttttaaatttcctttctattttttaaagaacaggtatgtgttgctaaagtgatttgttaatgttgttatggaaacaaaatgaaaaaaaatggtaaagtgtgaaaaatgctggtgtactcattagaatgtgattaaatgtttaaacttccagtacattaacactgacattttatcttttaaatggtgtcaggtagtgaaggtcaacacaagcgaacattctgtttttggcccttagttagaagcacattgcacttggacttcacagcgggaaactgccagacgctgtctcctccgtgaggcttcttctaagtactggcttgcagctggctccagcatatggtagtatatggagatattttctgaggtccactgcctcaatcactatttaatgattaattactacagtctgatgtcagggtgagacagtcagttcttcaggtaaagatcttaactatagaaaaatgacagcaggcagtt

SEQ ID NO: 47951 - DNA, 1640 bp, Bovine  19866880427049
ttctgaaggagatcagccctgggatttctttggaaggaacgatgctaaagctgaaactcccagtactttggctacctcatgcagagttgactcattggaaaagactctgatgctgggagggattgggggcaggaggagaaggggacgacagaggatgagatggctggatggcatcactaactcgatggacgtgagtctgagtgaactctgggagttgtgatggacagggagacctggcgtgctgtgattcacagggttgcaaagagtcggacacgactgagggactgaactgaactgaaggactttcctagtggatctgttgttaataattggcctttaatgcaagagactcgggttagatccctggccggggaattaagatcccacttgccatggggcaactaagctcatgcaccagaattactgagcccatgcagagtaactagagaagcccacacagggcaactaaggttcctgaatgctgaaaaaaagattccctgtgctactaagatttgtgcctgagtatgtgctaagtctcttcagtcgtgtctgactctttgcgactatggactgactctatggactatagcccgccaggatcctctgtccatgggattctccaggcaagaatactggagtggattgccattccctgatccagggaatcttcctgacccagggatcaaacccatagctcttatgtctcctgcattggcaggtgggttctttaccactaaagccacttgggaagctccaagtaagacttgatgtagccaaataaataagcaaattaatactttaaaacttgtttgttaaaaaaaaatttcagccatgctcagggtatcaaagagtgttaggttaccctaaagcgaatctccatacctcaaagacatgttttccattcctggagtttattcaaacttctgtccattgagttggtgatgcaatccaacctactcattctctgtggtccccttctcttcccaccttcaggtcccgatattatttaacaaacaatactatcatcatctcagtctagctatggaaatagatatgttgataaatatctacaatataaatcatattgttaaaaatacttagcatatgctgatcacaatggcaaaagagaagcagcaattaattttggtttaaggactcatgagaggttctaactgaaaaacctttcccttaggaatgctcatgagagatccttaagattttgtaaaggcaatataattcaattagacaaacacttatgagtggccatcatgtctaagatactaaggcactgtgtaagacatttacttgcaaagtacaaagacaggaaaaacaattacttatttccgtcaaactggctgagatatcatggaagagataggcatgtacaaatctcattatgtgctcagttgctcaattttgtctgactctgtgacaccatggactacagcccaccagcttccctctgtccatgagatttcccaggcaagaatactggagtgggttgccattcccttctccaggggatcttcctaacccagggatcaaacctgcgtctctgggatctactgtattggcaagcagattctttaccactgacccatctgggaagcctttaggatggatgagaattccagaaaaag

SEQ ID NO: 47952 - DNA, 1112 bp, Bovine  19866880563025
tctctttagggttctcatctaaaattgggaatattccaccctagagacaggaaatgctgggagggacaccaagaataccactttttaaaaataccacttttttaaaaagcagatgtgctcttcaaagatagtttctttctcatcatgcatatggctaagcaattaaataaaatctgggttatgttaagaaaaggagaacaaacacattatagacaccaaaaatattttagataactagttagtcttatagaagtactactataggcctcagtagtctttctgtagaaactagaaaatgatctcccaggacttggcaatagagcaaaattctgaggatgcaatcatcatgaatcactatgtaattaaaaaaattttaatgacatgtagaaataatacaccttctggaatgtttgtgtaagagtgagaaaacttaagaaataattgagtctaactagtacagttatcctggagaaggcaatggcacccccactccagtactcttgcttggaaaatcccatggagggaggagcctggtaggctgtagtccatggggtcgctaagagtcagacacgactgagcaacttcactttcacctttcactttcatgcattggagaaggaaatggcaacccactccagtgttcttgcctggagaatcccagggatggctgagcctggcaggctgccgtctatgaggtcgcacagagtcggacacgactgaagcgacttagcagcagcagcagcagtacagttatattggagaaagcaatggcaacccactccagcactcttgcctgaaaaatcccaagcacagaggagcctggtaggctacagtccttgtggtagtaaagagtcggacacgactgagcgacttcactttcacttttcactttcatgcattggagaaggaaatggcaagcaactccagtgttcttgcctggagaaccccagggacgggggagcctgatgggatgccgtctatggagtcgcacggagtcagacacgactgaagcaacttagcagcagcagcggtacagttatatggggcttcccagctgactcagtggtaatgaatccctggccaatgcaggagatgcaagagatgagggttca

SEQ ID NO: 47953 - DNA, 1870 bp, Bovine  19866880618090
gtataatatatttatattaccatactatgctttatattaaggattattggtttgaaaataaaaccaccccttcctaattttgtaattattaaaatacatactttgaaataaattttatatgtataattaagtactgaataactgtgggagcaatgagaagactcaataaattttattagagcctgaattctatcctttttgacaataagaataaacaaaattgctaacttttgcatagcatttaaaatatgccaagaactatagtattcatactatgtaaattatgacatttaatctttataacaatcaaatgtagcaggaatgatcactgtgaaagttttaaatgtgaagacaatgaggcctaacaaggttaaatatttgaaaatatacatagctaataagatagtgagatttctttggtaaatcgtatgaaattatttttgaaatatgtacttacatttttctcttccccttttactttggatcagtaaactaaagttccaactataaaattgtattgctttgaaaactgatgatgcatttcagagactattttcaacaatgaaaattaagatgattttctctttctccttataagcagatggaataaagaactggaaaaaaaatgtgaaaaatgattcactgaactcactccggtattcttgcctggaaaatgccatgaaccaaggagcctggtgagctacagctcatggggtcgcaaagagttggacatgactgagcacagcatagcatacttcacagtgcagtaaataactggtaataataccttcagtatatagatcagtcagtatcaggttattactgtctcacttttatttcagaactggttatctctaacttctctttctctacacctctgttcctctttctctgtctttcttttcaagtacctctcttcctaacatcaatttccacttttctaatgtctgccacctccagagtaggctcttaaatttactatttctatgtaatatggtagtttttcagtatacttagtgatgttcagaagccatttttaatttttttaaccatacctgcagatgcaatagccaactgaaacttatttataaaaaccaaggtgaacttcacgctaatacatagtttttggagcattgtacactttttcctctcctcttccttcagatttattttgttcagaggttgtccctcctgacttttcttatatctgtataactcatttatgggcttatgaacttagtgaacttccagtgtagttacttcttagagagagaaagaaatgcattggctaggcaggcatttctcctactctttaaatttgcagtgaatgatattattgctggggcagtaggaatactctctcttggtgctgcatatatattatttgatctggtaataaatgtaaaatatagtcttacataaacatacatataagctaacagttgaaggtggcaaatgaattatagaatacaaaactagtccctggtagcctgactgtcctgtgtatatgaaattgcatactgtgtgaacagaacttctttaaaagacttcctgaataatatttctaacagtgtaaggaactgggaccttgaagtaaaccttttcatttttgaaagtgcatttactactttaagattctgtctggaatcctctgtgcatttatacgctgcttcctacttcttggcctgtgtacccgagttctgacacagtggaacatgagaaaccagcttatcgtctaaagctcatttctgactgctgatggggtataggtcagtgctagtatagactgtgaattctgttgctttgttacctgtgagctgtgtattgaaactcaagtgaaatacagtatttgaatcaatcagtcagcaaa

SEQ ID NO: 47954 - DNA, 1585 bp, Bovine  19866880696720
agtttggattcttagacaagaaaaatatgcatttggccactttagatatttctatggaatgttgtttatttttcaatgaaatagaatatttcattatattgtgtgctggcatttttaaaagtacctaggcatggaaactctaccagttgatggtcaaggggaaatgatgattcaaaggatggtattggcacagaactgtaccatctgtaagtaaccactatgttgaaatatctatggaaaagggacatgatgatatcactagtaccttaagcttaaagcttcttggtgtattataaactgaaattcatagtgatctgaatgcttacaaagcgctagaaactagagaatatggaaacctgcaggtggaaactttaagtattgcatattgcactggatagttctctctccatgttgtaaatatcaattattaaatactaccaacaatatttaagtagtcacttttaatcataatattttacatgtgtatttataccacataaatgaaagctcccaatgtgtttcacagactatacacagctttattaataaaatgtggctgtgtctactaaaagcacatttttattcaagatataattgtaaaatgcaatagtcatagattatgctaatagacaagagaaagaacatgaataaataaaagccacagataatcccccaaacctaattttaacaactatgttcagcttcccgcttctaccaaacctttgtaagggcttgctaacaagtaataaaactgattgattggcatttcaacaacccttctttctgttgctcacctacgggtggaaatgctaacaagcacggaaatagtcaatgggtagggagtagaggaaaacagaaggaggaacactggtaattcaccacctagataatcagctcatgaataacagagagctgactgaaaagatagcacttaagtaagtactgtaataaactcagtaatcagtattcttagtggcttagtggcaagaaatagaactaccatctttacagctagagggaagtccatgatttttacagaatttatactgcaatgagaatatcaagtttcaatgccaaacatccaggatgttcaaactggagcatttagatcatctctaaaatgcctttgcttatgttaaataaaggatccaagtttacaaaacagcttaaggggcctgtatatatcattacaatgttataactgcttattgaattcaatcatgaaatttaagatatgtaatatgtgacaatgtgaattgttttgatcttcttcaaattattattcttatttttcttaactgcctgaagttacagattatttccttggaaacacaaggaagacttgtgacaagatgggtttttggggtcaatgacagcactatggcctgactaacgaagcccatccatctgtaataatactgcttgggtacacagtttattacagttatttttaacataattcctaattggaggatcacatcttatctttttgtttgctctgtcgcaaaatactacacttcttaaaaagagttggttgctaaatggcaggaaataggctatatcttcctcttaaatttctttcaat

SEQ ID NO: 47955 - DNA, 1301 bp, Bovine  19866880845691
ttgcctgccatttgatttaatcttcaaataagctccaggaagcaggtccctggacagttaatctttagttttgtagcccatgcacattttcaataaggttactagggaattaggcccagtggggagaggaaaagcatattgtcttattccacaggcagctgttgtgagctctgttagcaaattataatgttcttaattatgaaatactttgttaatagaatctcgatcatcatatctgtactcgtcaaagaaagtcattgcaaatctttagtataaagtttcaaacaattaaaaaaaaattatcttggctaataacaaattccatataaggtttcttatcacacctatcaccaaaaatcaaagctcagatagataacttgaaatattaaagaagagagataatagcatctaaagataacaatcaaaacaaaacacttgaggaaaggtgtaatataaataaagagtgataggaactgttcattttcaattgtgttgctgtcctcatcaataatatgtacacattctttttcaagcatcttttcatttgttcctatttaaacaaaaacatcaaaaaacaacaaaccatttgataaaaatcatgaatcatctggaaaaaaatcataaaagtttaatatctttctgagagccatccagaaaaaaaaaaaaataaatagaggagcataaagcaaggggacattaaccacaagttgctgacttgaagttttgggggattttttgtttttctttgtggtcagcaacagcatgcaataactcaggagcaattttcagtgaattattatacctgctcaatttattttggaacgatctttgtaagttaaggccccatttatataaacctaccagttaccttcagatagaccataagctgcataagaacactctcagcctaatttgttttagttcctctgatcttcatgtttagcctcatccactgttcctgaaaggcataaatagcaaggaatcatcttttccagaccaaatactaaataaataggagaaaatgtgaaactgagtttcaaaaaatgaaacaggtgaagccaatcaaatttgcattgactttcttggtgatatgcgacctgctggttctgagaaagactttttacctcctctgaaactacaatagagccactccctgcatgctcttcttaactttgtctaagtgccccgttaagtacttctcacataaccccagcagctatttcaattattctgccagttacctcagccttctgttccatatctttcaacatcccatgcagcagtgcttgtctcctacttca

SEQ ID NO: 47956 - DNA, 979 bp, Bovine  19866880997830
ccccaacagtgtactttttccatgtatgctgttatcagttttatttccttactatttttctgtctctattgttgacgtagtattctataagaatgactacattaatcatacttctaaaaatgtaacattctatactgtggtccaaacatacaaattttgcctctcctcttgactttcatatcaaacattgatattaggaactcaagttggaatccacaatgttaaggtgtaaaactacaaacattttggtatcaataatctaattgtttactgccatttattttgtaattattgcttagggaaaaaaaaatctatcattgctccatgccagctttaactgcagcagaggatttaaagacgaattcagacttcagccttcccctgaggctgatggacttctcctttcaaagtaggacacttctatctgatggcattaaccataaaatcccccatttcaagtctatgatatcctgaaggacaacggctcatttcatttcttatcaagaaatcgagcagatcagtcatatttcccgaatcaaatgacatttcagaaaattcatttgaaccaaaaatgaggtttcctctcggcagactccaattagtttaaaagtggtttttgatgacaattttcaaaataactgagcagtatattttttttaaatccacatttgtatgtatatgactaaatcaactcatacttcacagacacacatatgcaattactaagacacgcattcatatacaccatccatgtccctacatacacacacacatacacacacacacacagaggcttcccaagagccaaggcttgccaccctgtcaagcagtataaatctttaattttagtgatcagcattaatagtaaaatacttaagatctttcctccttccttcttttttttatcccattaccctaggtattccagggggactatgctctctcgtttgctccctaagtacacaaaattagctgctta

SEQ ID NO: 47957 - DNA, 1549 bp, Bovine  19866881058992
gggttattattaaagaatcagaagaagttctaaaaatgagcagttcctatcctctcaacttcactgtgaggaagctgaaccaaagtttaattaactcagcaaaagagttaacatggctagaagatagcaaagcagagaccatgattcctttctttgagtattcaaatgctttttccactagatttttttttttcttacagtaggaactacagcctcagcaacttaaaatgcaggagtgttttttgttgattgctaaaatgtttcttttgcttcagacttgatggaagtaaaggaaggactcctctttttttcagatccatttcaaaacacccttcaggtttaaacacaatgcagttttctagaaattatactttgtcattaatttaaatttcaaggaggagctggtggaagtaaaaaaaaaaaaaagcaaaggaaaataaatacagttctctctgtaacagaattgtctttgtaatctctagtgtttggtgtgatataacaaacgaatttattatttctttagagagacgtgttcaagtggacaatgattcttcctcaatgaaaacttttaagaaatttgattgagatggaagaaataattctcttctatcagagggaattttgtaaccttatcaactccctattttgtgactaaccaaaatccactgtacaatttaaaaaataagaacctattcattgctttgctcatttagcactataaccagcagaaattaagcctgtcaattataagcatatgaacagcttttattatcaaagagaatgacagaattctctactttaatgagtaatggctgaggccaaccgatacttcattcacagatgacaggacatcctattgttgatgctgtgtgtttcagcctggaagttatcacttatagatttactgtgcccctattataatgtaaaagtacaagtaaacctggaacatttagccaaataacaacaaaaatgaccaggaaatatcattttattaacagtcaagcatgtggccttaaccttagcaagattctatgtaataggaaataaaactcatatgacaccataaagacagggaggaataaaaacaagcctacaactgttacatatctttttgttcctgttttcaagtaatgtgctaatagaaattcacacttccaaagatataaaccaagatacactattgaattgttaaagaacatcactattatatactgtacatggaaaaataaaaagcataaggaatgtttacttttagaaatttaccagttacttggtattctcacaaagtttgcatgttataattaagataaaaattttagcattattactatcttgtgacagttttatagcacctgtcctactgatttggtgcaattgaacttaaattggccaattaaagggtaggtgtcttatgtcaaattaaaaaaaatttttttttttttttcagattatttcagtccaactttgggcagtcagttcaaatgcaactccctgtcagagtaatttgtatttctgtcacttctcatttactccctactccttgtttagc

SEQ ID NO: 47958 - DNA, 1314 bp, Bovine  19866881122710
cttactttgcttaacttccacccttttaaaaaatatgataaaccagaaatccacatgagcccgaatcagtgggaatgtttccctgatacagctgtgtgttctgaaattcttactgaattacttttatgtgcttctaactaccttctttcaaatttcctgtataatgttaagatgaactaatagcctatcattgatgatatgatcatgaataatccctgaattgtacacaaatctgtgttcattaccaggcatgcctttgttaatgaaaaaaatcaataaaacaaagggcttcatctaaggttcttagttaaaagcatcaggatgggggaaaaatatttttaaacaataagagtatcattacaagcaaatttagactcagtaaattagtaaaaatctgacaaaccaaggttggaaaattggcagaactcaaaagacagcaggaatcacacaaggagcatgcagccaaagccatatggtttgcacaacacctaggctgctgctggaaatctgacctccaatttttccctctctcactcgtacaagatcctgtttttcaaggttcctgattggctgagatgaagtcacatgtccaacttctggctgaatctgtgaatgaaaaaggggaagactgggcttctctccctccagcagaactgaccacctacataagtttgctgtggaaggatgagtcttaggaatttccactcaaatacgaatacacaaatatgaaatttgcatgttatgttgctataacaggtgcaataagaagagagaatcagtgggaaattggatccaaaggggggaaaaaaaaaaaactttataaattaaaaaaagcaaaatgtacactactcacagggcttccctggtgtctcaggctgtatagagtctgcctgcaactcaggagaccgaggttcaatccttgggtcaggaagataccctggagaagggaatggcagcccacttcagtattcttgcctggagaattccatcaacagaggagcctggtgggctacatagggtcacaaagagtcagacacaactgagcagctttcacttcagactactgagaagtactcacaaacatatgatttgtaaaaatattgtctactcgtgttttcctacttttcaaaaaactactaaggaaaatattattatattcacatatgtctgtttttaaatctaaaaactttatgcatgtatctatttgttttataaaattatattttacttttaattagataattactttacaatattatgatggtttctattgtacatcaacacgaatcagccgtaggtatacatatgtctctt

SEQ ID NO: 47959 - DNA, 1941 bp, Bovine  19866881138299
tttatttcctatcccagtttcttctctttcttggacccagaactgttgcttttccaactattctgcaaaactacctagaaagctcacttttaatattcttgtcctagatattcaaaaggcggcacatttaattttctttaacatgtcacctcctcaaagtcttccatgattacccctgtgtaaagaaggaaactctcacagttgttccttgattattactgacattatattttatattgatttgttctttgtctgaactcctcaccagaatataatattcttgagcatggaaactcagtccactgtaatacccctaaatactaaaaataataactgtcacacaatggttattctgtaagtattggataaactaatggctattacatttgtttatatttatgtaaaatatgttgaaagaataaatacattgcttgtgaaaacagttcaatctgaatgcatgcacatacatacaggtgctcctaatttgctagatgtttaattagataagtgacaggttaattgggaggaaaaagcaatataacagggtaatgataaaatgaagaagatgtaaatgtgtgagagaagagaatctcaagggaaaacatgcaaagaaagcaaatgaaaataaagtggatcattggagtaactgaagaaaagaagtattgtatgagtattgtgagcttccctggtagctcagctggtaaagaatctgcctgcaatgtgggaggcctgcatttgatagctgggttgggaagatctccagggaacagctatgcactccagtattctggcctggagggttccacggactgtatagtattgtatgagtaaaacaagagaaatttgtgaagaaagtggttttatttacttacatgtacatgtacatgtgttcatgctcagtcatgttccgccaggcacctctgtccatggaattttctaggcaagaatactggagcgcattgctatttcttcaaccaggggatcttcctgacccaggaatcaaaaccaagtgtcttgcatctcctgcattggcaggtggattctttaccaccgcaccacctgggaagccctgtatttacttagcagagtggatatttgtgtgtatcaatgggcaaaacgcaatcagtagacagcctggactgtatgatgctagttaagatgggttccttaaaattatattctcctgggctgcctgcttcaccaagatatccctcccgaaacaagtgagagcaaggttaccaacaatgttagatgactggctccttttctcccccctgattcttaacaacgatagtttttcaactctggaagtcaaatcatgacatctctttaaactcgtacgtattatttccctggtgccagaaattgatgtgtcatggaaagatggcctacagctatgccttataaggctgaaaaataaataaagcgcactgtgttcctcctgttgtcaagctttctccttgtaactaaaccaggctgtcccccttcattctgtttgttctgacaagtttgcaagtcaggccatctattccctttcagagtgttctgttgataaagtacttggtcgtaggaatagtcctagagagctcatcagtgcaagattttcactgatccagctgtttatactatttttcatggcaagtcagcaaggctgatgtgagcaaccattgccagagtgcaccggaaatgatagatccaggcagctgtttttcgggttgtttgtaaaatgtattctatcagatctgctcagtgttttgatataaatgttctacttgaatcctaagaaaaactcaggaatcaccatttttttcttttggtacttagaaaatgatcatcatcacaactaaattccatttagtggaagccattagacacttgttaccaagacacgcctttaagaaaccccttccacgcagtctaagaagagttaaaaaagctgcc

SEQ ID NO: 47960 - DNA, 1103 bp, Bovine  19866881209188
actatagtttaaaaaactgaccaaattaaactccttgtttgaaaatgttatcattattttatacatttcttaatttaggtcaatttcaatgtatttgtattcgttacttttttctcagctgttttaaaaaacacattaatttatttatagtaatgcatcattacatgttcaattttcaatggaaatatccttgtaaattagatatataatagaatatatttggcttataaaatacttaccataaatattaaaatttgcataaaactaacattaacattggagaaggcaatggcaccccactccagtactcttgcctggaaaatcccatggatggaggagcctggaaggctgcagtccatggggttgctaagggtcggacacgactgagcgacttcactttcacttttcaccttcatgcattggagaaggaaatggcaacccactccagtgttcttgcctggagaatcacagggacgggggagcctggtgggctgctgtctctggggtcgcacagagtctgacacaactgaagcgacttagcagcagcagcagcaacattaacataaaacaaaattaaataatctgatcatctggaatttcagacggtgaagcaacaaatgcgttttgattattaacctgcgatgttagttaatttgtggtggactgtctttatgtactctgcaaataaatttaagttagttgtctagggaaaacttgaccatttcccacagaaaaaccttgttacattataagttccagatttaaatagtcaataccaagaccagcaggttgtttcaaccccaaattatctctctttatgctgacatttgaaatctcaatgtacttacttgaaacatttaatcatctccctaaacccagactctgcaggatttctgtagaaagttttatgttgcaaactacataacataaaacattagtgagtgtgagaaagtgtgaatatcactttcatagatttcttcacagtctttatttcgtgcctgctactaaacccacttaatcagcaccctgataaatggtgcatccacttaattggaataattgccaaggagaagaatcagtgtagttcatttcaagactccgaa

SEQ ID NO: 47961 - DNA, 766 bp, Bovine  19866881310298
tgttcctaatgggaatctcctcttatatttatataacactttgaaaaaattatttgctttaatgaagggttatgcaaggagatatgtttgttttttttttttcatcccttcctagtcatttaactttagatttttagaaaaagaaactacatttgatctttccttcacagaaaaaataattctcttatattattgatacagaaataattcctatactatcaacagttgtgaagcactttaaaccaaatagttccgtggttgggaaattctcccctcccccaagtctgtaaactttcagaaacaaggaagaaattgcaatgttttcttgttagactccataaaggttactttactaagtcacttagaagttacagacacatattactgttgagggaaaagtaatttgttataatcatttttaattatagttatttttaattatctgtgctgtatgtgtaaacattaaaaatacaaacagagctgctatagcacagatggttggtgcttgttacccaggctgtcaagcatcatttgaacaccactgcctcctcttctctaattgtgaggaaaagcaataaagttgcttcttggaaacaattttcatgtttgagaaaactggctgttactaaagatgggagaaccaatttatggaaaattccgtcatcctttctctctccctcagcaatgccccttgaactcctctcacttgaggcccttctcactacttggtttcgggtttgcccagtaggcaacacagacatacgca

SEQ ID NO: 47962 - DNA, 1681 bp, Bovine  19866881359193
ctaggtggcactagtggtaaagaaccccctgccaatacaggtgacataagaggcgtggattcatcatcgcgtcaggaagatcctctggagcagggcatggcaatccactctagtattcttgcctgtggaatcccatggacagaagagcctggtgggctacagtccagagagtcacaaagagtcagacacaactgaagcacaacactcatgtgacagccctcatgttgcctgatgtccacccattgttctcaaggaaggtcatcctaggtctgtgaatataagtttgacatttacttagaggtgggcaaaatctgtaggtggacatttacttgcttactcatgcaataaatctttactgagcaactactgtaccccagtcactgcctggcaaattaacccatctgtaccaaaagacctgaagtctaatagtttgaatctgaattgatcttactaccccttttgagttatgtgatctaggggaaacttcatgagtattagtttccctataacaatactcacctcactttgtacttgtgaggattaaatttaaaaattccacatagagtacttatcattcttgatacataggaagttaataatatatgttacctgtttttattactgtttaagaaacggaaccttccaaaatcaactgcaaagaatgaggtatatatttacataatagaattttaattagtacaaggtattaagaaaattaaatatctcaatttcataacccataaagcaataaaattaataagatacaatattttaaatacagaagcatagtatgtctatacacatacatatatatatgcctgaaagttcagttcagtttagttcagttgctcagtcgtgtccaactgatatacacataatatgcccaaaagttatgaaacataattaaatttttatttttttttaacagcatgccatgtgggatcttacttccccaactagggatcaaagccatgctcctggccttggaaacacaatattaaccactggactgccaggaaagtcccatgaagcataattaaattgttgtgttttaatctatagatataagaaagcaaaacaaaacaaaatgtgctgactatggcttcacacacatttgatcttatgaagcaagtaaagattttagctgaccttattagccttgatccattgctcaactgacagccaagactatcaaaaattcatggaatcacagtctcaggagagcccaagtgtgatcaagggaatatcagggaaaccggggcctggaaactgtttgtaccattgttcctgtagtaattattcaccctatgcccacagatatttggagaaaaaaaagtgagttgaggtcccacctgatgatgagaattctcctatcttgcaaatatattccacctcttcttttacctgccactggattatttcacaaaaacattgtttctctctaagattttggcagaagcctctgaactgaatatttgctggctagtctcttctttctgtattaaactctacatcgatggcagaggacttttttaatgccattttggttatgtcagacacctgcttaaaagccttcggtggtgttctactgtctttgggatgaaaactcaaggcattctaataaggcataaatcacttataatttgccccgatgactcaccagcttcatctctcaacactg

SEQ ID NO: 47963 - DNA, 760 bp, Bovine  19866881841491
tatcccaaaattacaaacttctactgatgctgaagagtaaactccagtactttggccacctgatacaaagaagtgattcaagaccctgatgctgggaaagacttaagacaggaggacaaggggacgacagaggatgagatggctgaatggcatcgttgattcaatggatgtgagtttgagcaagcaccaggagttggtgatgaacaaggaagcctggagtgctacagtccaaggtgtcgcaaagggtgggatgggactgagcgactgaactgaattgaatttaactgaactgactgaagctctgcactcattagtttatttatttaacctttaacatagtaaatgaacttctatgttcctgtgtatagtttgttcaccattttatccctagcactgaatataatgcctggcatatagtaggcatacaacagaagtattgcaggtatatttggtagtgttatgcaatggcagaacaaaagttgtacttaggaaaagagtcctgaaattccatgcttcttttttgaattctaacagaaaattgtcactcaagccatgacacacttacatggataataagcacatatatttgtcatagactggatgaaagccacattatcctgttatattattatcctgtcactgtcctagagccacacaagcagacaaactgatatataatagggttgaaaagcaaagcaagatcccagatgaaacctagattaagagatttctctattatcttacataaacacgggaaagg

SEQ ID NO: 47964 - DNA, 2536 bp, Bovine  19866880383574
gagaagcttctaggctgtagtatgtggagacctggagctcaaggctctagtccctgagctctctaggctggaggagaccggggctgggagctgtgcccacgcagtgaaagatgtgcgttcagtcagcaaggaccttcaccagagtcctcatcgtcttctgggcaatcaggacatgtccttgacttggcttcttttcatttcactgacgtcagcgccgccttgtcttctgtccaaaccccatcctgccaccccactgagtcactataatttaagaggatgtgggggtggacagagcgttgagccaaggaagcaggaggccaatgttctgttttatgctcccccgccgaccttccatgggaccttggacccaataattagccccaaacccttcttgtctctttatcggctgcaacagaggtcatagcaagtaactcacccagccaggagggtctctctgaaaagcagatgagctcatgcaagcaaaggtatagcctgatgtgcaaggaagaagcatttttataatgtgcttttactgaaactgtttcctttgctctcagatgggactaataacatgagcactcttcaggggggtgtgcttcaactagtaaacacatgattcaccccttaatgaatagaagaggaagtgtgtgtagcaatcagaacccagcaagcacagttgctagtagccactgtttagaaaacaacaactggaatccagacactgcagacctctttaataaatatcgtcttaattttctgaacaattgaaaatcttaagcagaggaagaagcctgtggaccaaagttcgaaggggaggatggtcagacagctgagtttctgaagacacatctttatttagcatcttgtttccacagccaagttatagacacccagcgctcatgcgaagaattgtgagagctggtacaagaagcaggggtggaaccctagctttatcatgtgcaggccacctcaataggaagggagatgattgaaaaactgaaaatcgaaataaaataataccattattagtatctgaaacatgtaatacttagagacaaatttaacaaaacatacttaatacctgtagactaaaaagcatattgacaaacctgagagaaaggaagcaaactgtaaaaaacagatggagaaatatattattttcatgaattggcagatttaatattattaaaatgacagttctccctatgttggtcgatagaatcagtgctttcataatacaaatcccagtaagcaagtgggttctgttgatattataaaagtaaggggcttaaaaaaaaaaaaaagcagttttcagaaaaagagaagagaactagaatacagctgaaaaacctacgttacaagatttcaaacattacgataaagctacagtaatcgggaaagttgaatactggcataaaaataatatgtacacccatggaaaatagagaatccagaaacactcttgctcttatatggctcactgattttgaaagaggtgccaaggtaattcaatgtggaaaggagtctctgtttaaaaatgtatgtgtgtgtgtgttgctgttcagtcactaaatcatgtccaactcttctgcaaccccatggactgtatcccaccagggctcctctgtccatggggtttcccaggcaagaacgctggagtgggaagccatttccttctccaggagatttccctgacccagtgattgaacctgtgtctcctgtattgtagattctttaccaacgaaccaccagggaagcccttttgtatgtatgtatttgttcatttgtgtaagcagatatctatttatttatcaactttactgaggtaacattcacaaatacaattgtgtatatttaaagtgtaccttgattgacataagtgtaccgtgtgaaatgttgccacaatcaaattaatgaacgtatctatcacttcacgttgttactatttctgtgatatattccgagggttttaggaattcagagaactggaaaaacatcctcagttgggtagtcagataaatttttatgaaggagatgaaatttaagtaagcttggagcaaccttcatccccgttaaacattctttctgggaccattagcctatccctcgggtcatttcaagctctttcctccagaacccacaggaaaaatggggttatttcctaacaaagctggtggcgtgagggtacacctgagagagtttagtggagaaatatgcaaaatgggcatctctccggatcgcagctgcaagattttgcagggatctagagaactgagctttgaactttgcagcttgtttctgtcatcttacattcttcttgcttgctctgcaggagcaagtatgccacaggaatatcaagatcctggaagttacaaaaacaaactctcaggaagcaagttttcttgctaaatctggtagaaaggaaaggagtcacatgtaccaggaaagatggcaaaatctataaggaggcatcactcatagagaatatgctagaaacacagcatactccgtcatcttctacccatcagtttcatta

SEQ ID NO: 47965 - DNA, 1812 bp, Bovine  19866880410664
actgaattaactgagcccgatgatcatgacaatctgtaatcagtgaaaccaaacttcacagataacaggactctgcttgtccttgtccagctcaggcgagccctgtgtggacgtagtgtggaaggaaagagaaatgttctagcctgcagaaatgttccacctagttctgtgcagcctcaaggacacctgggttttgtttcttggatgttgttcaccttggtggtcctactagtcaggatgagctggttagtggaatgtggcagcagtttttggcttccagctctagtcgggaccctgggatctggccactgtttagagcaggtctcttgagtggttctgttatcaaggtgaacacaggtaagcaccatataccaataaaatgcagatgagggcagtagccatgatcagattactctccagagtcaatttatagcaaattcaatgctactaaatcccaatgctgaatatctaaagagccctacgggatctgtccaaaagaaagaatggatggttttagtaagctgttagaggcaggaaaggaatttatcagaattaactatacagtttctcaaactttggcttcttaaagacatagcattatttctctctaaatcttttgtaaattacaaaagttttcagctgaaacaaaaggaatgtttactattttccagtagaatttccttgcttttgatttacttttttgtaatcttaaaaatatttatttattagtttgtgtcgctcttgctgcacacaggatcttcattgcgttgtggcacacagactggctagttgtagctcgaagcctcagtagctgtggagtgaaagcttaattgcttcgtggcatgtggaatcttagcttcccaaccagggatcaaacctgtgtcccctgcattgcaaggcacgcttcttaaccactcagggaaatccctgcttttgatttctaaatgttggcatctagcataaatatcagagcatccacagtacagggggcagcagagcaagcttaccactctgtgggcaagcagatgcgtgcccacctcctgccccgggtgagtcaccttgagagaatgaaccttaataaacgttttggataatagcaggtcccacctccgaggatgcctctcaggcaagaggcccccaccatggtccacattggccttcagcccacctttgacagctctaatcgttaggaagcttttcttttggttaagccctcatcaactttcctatgcctcccatgtcttcacaaaggagacatggattttaaaatgtctttgccccggagcaaaaaagcactcagatataaatactgcatttgccaaagtcagataaaaggtggatgtgtattcttgagtggcagtaaaccagtgtgtcccatatatgcagactcatatgaacacggctggagtcaacctcagcattctattaagtggaaccacatgaaattgctaattttgtaggtagcaaatgatgaacaattggcatctttgtacagttcagccttataatgtgatggttaagaatgtggacttctgagggcttcaatgtaaatttttgacattatctccaaataaaggtagacaagcagtaatacagatacactgacaaggtttatgaactactattaattcatagtaagttattaattcctagcattgtttttattataatatttaggggcttgttttagcatatcttcatttttaataaacttgaacctcataaaaacatacaattggcttgaatttcttaatctctgagaagctttagagaaggttaatagctaaaaggcattaacctctgtgtatttct

SEQ ID NO: 47966 - DNA, 3779 bp, Bovine  19866880441668
aggagacattgggaaaggcattagaacgtgtctgattggacagggaaggattctggaagtgggaattattctaaaagcttataggcactcacagaatcttcccaatgtttgcgtatcaacatcctccttctacaatgggtgatatcaactagaatgaaggtacttaccgagaggttaagtgacttgcccaaggttacccagttagtaacctgcagagccaagatttgaacgcagacaaatgagtcttggggctgatctcatcatcatgtacgccaagaacattccccatttcccaggtggctccgtctctctcggctcattttctccaaattcttcagtaattggtgttataacctggaattatgtttttccaattatccttagcagagctctttgggtgatgttattcaacttttactgtttcaaagagttgtctaaggatctcatttaaaacgcagatgaccattctccatgcctgaaagaagatgatccagaggttctaagtgaagtccgaaaaactgtcattctattaagcactcccagtgactgtccgtaaggtgactcctataccctctttccctgggcctgtggttccacttcacttgaatcaattccttgtcatgttggatgcattattgggcttctatctaacatttccttcaagaaggaagttcatctgccatttctacagctttctttgtgtattaatagtttgacggaactgcagcaaagccaattcagtgggtgtaatctagtcaaggaccagaatcagagtcaggcactctgttgcccagtgatcaaggatgcatttgaaagcagctagaccttagggtaagtcagtaaattatggcctgtgggtcaaatgtgttttattttttgttttttgttttgttttgtttttgtatttataagtggttgaaaaaagattttatggcatgaaaattatataaaattccaatttcagtattaataattaaaaccttatcagaacacataattctcatttagtcacgtattttctatgcctgcgtttgtactataagagcagttacatagttggaacagaacatgctgctcacaaggtctgaaatatttactagctggcctttacagagaaagcttgaaggggacggaccgaccgaatcgccttccatcttgtttttcttaccgagaaagaccaggagtaaagttaaagtccctgatgagtaggtagcgggggtgtgtgcgtgttcttttcctcctattaaagtaggatagactttaaaaaattttttttaattatttttcttggctgcgccatgcagcatgtgggatcttcattccccaactggggaccaagtctgcaccccctgcagtggcagcgtggaatcttaaccactggaccaccagggaagtcccaagacaggtatttttaaacagtcggttgagctgggggtagagacactgcccctcctctgacacctgaaaaactgaacacaggtgtgtgacatgttagtgatataaaccaccaccatgagcacacacctacaggggaagagaaacaagctgttgaatcagcagggtcctctgttactgagtttccttgactatttgctatttgttcacccacgttgtcatctgccagtgtattctaatggccttgtggggaaccagcatcaaggatttaagaaagatatatgtgaggaaatccacttgacaatcataactccatctttttcctcgcagttgtctctgcctggtgttgttggacactacttgtggaatattttggcctggcttctggagccctattattttaagaaaacagtttgagaatgaatagtctaaaacacaagtgaactcttcagtcctttattgcaagactggtgcctgaaattttccagggagagaatctcaaagtgactccatcatcaaccaacaactatataattgtaccataacaatgatttttatacagtctgggtgcctggatatgtatgttcctacaagtgcctaatgtgaacatctctgaccaagtttgtttggggttcattagtgtaagcacatgccagtcccctaagcatgagtccatgaggtgacagaattcctaggatgcactttttttttctattgtaaattagaaaagttggctagggtacgtgctccctaatcatgttccgaaggtggggagaaggctgtcctggctccagttgtcaatctgtgtctagaaatttcaccaataatttctagcctgggagtgcttgacttggggacccctggagctaattggattcactgattttctgtaaaatccccgcctgtcatcagctcagcagtaggtatgatactgaagctctaatgaacccagggatagctttgagtcggtctgatttctttggagtgaattatcaggccgtaaatttggatttttagggaggaaacttcttgtattgtctcttacaacctttcattaggatccaagctatttaagaaggtgatcaggtttcatcctgaaagacacgccattcttgcagaaaggttgttagaatctaagaactcgtcagtcaggtggagcttggttagaacctgcaaggaaaatgaatctggaattcttgttaactgggaactgacctgctccacaacagcaacagaaaaacccatcccagggagtgggggagccggtgacctgggctctgggttgctgcctgagttgttttgcttcggtagctagtttctttggtgcttccatgtcagagcagaattcacttgcaaacctgttttatctcgctctgggagttccccatctctaaaaacagagactgtcctgtcacggagtaccgtcctctgggaggaacaggaatacatttggatgggctccagcacgcctggctgttctttgatatcacagatgaggccaccagtcttttcttagcagggcactcacaggagctgtctgtggcgaaggggacatgggctacactgtctgcagatagtcaccacttccatttgggcctgaagtgctgtggtctttgtcagaatcttctcctgatgttatttttatctaggtcagaaaaatatgtttacatccttatgtttagttagatgtaaatgcaaaatgcctcccttccccaaacataccccatcagccacctgaaaatccctcaaggacccaaatgttcttaagaaatgtgggtgtttattgtcaagaaagcagtttgcttttatggcgatggagaacttgagaacccgcagagaaaacacacttgtacattgctatacccttggctcagactagcactttaataccctgccccatcaaccaaggtccaattgattacaccgattttattcttgttcgagaagccctccggcccttgctgcggctcccacccagggaccagcatagacgcgcgaggaaagacttgttaagtcacgtagccctatcatctgatccctctggtgtgtctctctgatgcctggacttgcttggatttgagtgatgccaggagtgggtcgtcagtgtgttcacttgggagtggataatatattctcttttggattcaattttttttccccatttcttgagtttttgcaatcattcctgggaagctgactctctttagggcttcctccctcctcctcctcctctgggtattttctgatatttacccaccaagggggatgaggcttgtctcagacctccaattcgtagtcatccatttgctcctctctgttcactgtggattcctttgcgacgcaagctttcctccccccttcactgtgtcattgtcattgctgcg

SEQ ID NO: 47967 - DNA, 1371 bp, Bovine  19866880443701
cagagcgtttgaaggtggacacgtagacgtcgggactgggcgcttcagccttgttccccgtcctgactgtcctctacatatggaaatatgacttccatctgtggcaaaggagcgtgggagtttgccaaaattctccccgccgccaagcttttctcccgccaaagatgactcatccgggttttaagcgaaagacctggaaggcctgtcacttgccggggccgtgtgccaagcacgggatggaagagctcacgtctttctctctgcccacgtcccactctgcacagcatcaatctcccctccagcctcaggtgaccttccttttgggagtacaaaggcaccagctcactctgggcacagctttgccagcagtcacagatttctgcgctgtggtgtctcccctctttccctggagagcatcccaaacctcctctcaccttggaatacgtgggggcactgggagccgggtgggaatggcagcgtgagggactgaaaggagctgaactttccccattcccttctctactccagccttcccttgtctcagtggaaatagagaaagggggtaatcgtgaacagtacatagaagacactctataaatggtgttgaaatatttggtctccaaacacaaactgtgatagattctcaagcatcactaaaaagactgatccttataggattcatcctggaattgttaattaaaggactcctgaaccatgggaaagaatacagtatctggtatgtagagtgtgtccacatccctgcatgtgtgtgtgcgtgcatgcttagtcgcttcagttgtgtctgactctttgtgaccctatggaccgtagcctgccaggctcctctgtccatgggattctccaggcaaggatgctggagtgggttgccatttcctcctccagaggatctttctggtccagggatggaacccaggtctcttatgtctcctgcattggcaggcgggttctttaccactgggaagacctccacatcagtgggtaatcaacagagaattatttccctatcatttctgttaaactcagcaaacgtgaagtgactagtctatgcaaacctctgtgccacattccaggccagaatgagaaggacacagtgtctgctttcaggcagcacaactgtactgggagaaggaagggttcgcaattcataaagatgtgttgagacccaggtatggtgacactccctggcatgagtcttccttgaggtgggactggtggatggaggcaaggagaggttgatttacaaagcaaggtttcgctgggctctgaagaagggctgagtttcgtaaatattgatatcgggtgttgcatgatgtacttgggtggggctgagagtgaggatggaccagcatt

SEQ ID NO: 47968 - DNA, 568 bp, Bovine  19866880467064
gtagggaggataggataaaatgtcttggtgaaatatgcatcttagttgtgagtgttaaggatacataaagggaattccctggtggttcagtggtaaagaatctgcctgacaatgcaggagatgcaagagatgtgggtttgaaccctgggtcaggaagatccccagaaggagggcatgacaacccattccagttttcttgcctggagagtcccatggacagaggaaagtggtgggttacagcccatggggtcgcaaagagtgtcctttggtttcaaaggagcattggggaacaagaaaacaaaaaaggattcaactacagaaaactggggctttattttaaattctaagaaactgccactggaaatctccaaggtatgtctttggaactaattttggatgtggccgctcacccttgtgccgtgagctaatccctcaggttcatgtacctatccccatggggacacaaatgaacacaacgacgatgacaaggctacataacctgttgatctgtgtaacgggaagtagtttggtctcaagagaaggtctaccatgcccatcccacaaaagg

SEQ ID NO: 47969 - DNA, 1460 bp, Bovine  19866880579821
tcagtagatggatggataaagaagatatagtgtaaatatacaatggaatactactcagccataaagaacaaaacttgccatttgcctggatggacgtggagggcattatgctaagtgaaagaagtcaaagaaaaagactgcatgacatcacttacatgtggaatctaaaaaaatacaaggaactagtgaatataacaaaaaagcagccgactcacagatacagagagcaaactagttaccaatggggcaagggaagaagggaggggcaattttatagaggtaggggattaagaggtacagactattaggtttaaaataagctacaaggatatattgtacaatacaggaaacacaaccaatattttataatagctataaatggagtacaacttttaaaaattctgaatcactgtatcgtacccctataatttatatcataatatacatcagctatacttcaatctagaaataaaagaactgtctttatcaaagtttaatcacattccacaagttgctggacgttttcttgggcatagtccatgctggtagaacttaaccgactctaaaggcaacttagcagaagatgaaaagcatatgctccccagcacacacaggtggctgcattttaaagaactgaactgttgccagagacagacagcaatttctatgggagaaacacaaggagagaagaaaacgaaaagcaagagataatgaaaagaggatacatcagaggataaagaaaagttaatttcctctagagaagccatctcctccccttccttcctgcctcatagctcctccagacaccagactcaagtctcacctccattcacctaataaaaaccatttccaccccctcctctccacttgaatctgtctcaggcgttctaccctaaacttgaacggttcctctctctctaccttgaaattgttctctgaacgtctctgcacgcgtggggctgcaagatggcagatgagtaactcatgattcatcatcaagctcacagccgagtaagtgtttgatggcccttgactctgaagcttgaactcaacaaagcagaacagacttcaacataatctatcgtgacacaaaggtcctacctgttgtagtgactagaacttaggctaacggctgaacggaagtatcttctcgcactttggttattattatttctgttcacagattttctgcagctccaaacactacgtatttggtatttgcatcacttcctgtgattcagctaaaacatgtgtcatctataacatggagggttagaaatggtcgtatacattccctcatgcctccagttttatcaatctatgattctgtacatgggataacacaaaatcagagtagccctcagtaaattagtcgttcactgattctataacatatttatttgaatggtcagtatgtgcccgatgctatacaaggcccctaggatacaaaatgtgaacaa

SEQ ID NO: 47970 - DNA, 1717 bp, Bovine  19866880589357
ctaaatccaaatgccacactcacatctgaatatccagatccaggcccattctgaattgctgggtgcaatgagcgggtaatcagtggacaaagatggcaggtctcctgggatgggagagccacacaattcagcttcctgtaaaataatttcaagagctatataaacttccctttgtgcactgaaatttctggaagccaaacgtctgagatgtacgaactgtaagtttacgaaggttcatagccgtttcctcaaatttaagatttcacttccaggatgtcaacgtaagcagcttattttgtgtaaaatctgagattcattacgtgggtgtatgaacagggagaaaaagaaagaaagcacctaaaaatataaaagtattttttgacacatgagccttacacatcttttgaatctgctggtcagatagtgttatgtgcagagagcaaagctctactatgcttcattttatccacataattcctctgttataaatggaataatttgtgaagtctacttatatcaaattttaatgattattcattaaacatgtttgaatgagattaatgtcaattttcaaatatacatgaatcaacctcacctgattcccccactaattagaaaaatgtttcagagttcctgactctaacttaagttgtccagactgatgaaaaccttcaagacagttttatatgttcacaaatttatcagcaaattcagaattttttcttgatagtggacatgctgagctgggtagaaggcactgctgtaaggaggtctttagggctgtgatggtgaggttgggtggtggttggtggggagtatgctggggtcctaggaagaggtctcggtcttgatgagcctgtgactctggaccatgaacttcaaacatgcttcttggctccatagtctgtcccttagatggcacaggatagtgggctgcagttgggtattacccctcctggtggtcagtggggtctgatgaaaccccagtaggtgaggctgaggttaactagtctctcctgagggcagccctggttaatggaacaaaatgtctggaatatttcgtgatggttgcttttccctccccaactgaagcactcagagagtttgctctgctcttccttatgagaaccaggtagatctccaggaggcaaaaactcacccaagactaggaatgtcctccttcgtcccctccaccgtgactgggcctccctggagtttttaactctcagacttgtccacactgaggctccaggaattcagttcaagttcagtccatgacagttgaagtttccctgccccagcactgtttcccaggagggttgtggcttgtgggtttctgctccagtaagtcatgattttctgtatttgcctctcagtgtctccaatttgggaagcagcagtttgtcctgtgacctcacctctgctgctgctgctgctgctaagtcacttcagtcgccgtgtctgaccctgtgtgaccccatagacggcagcctacaaggctcccctgtccatgggactccaggcaaaaacacaggagtgggttgccatttccttctccaatacatgaaagtgaaaagtgaaagtgaagtcgcccagtcgtgtctgactcttagtgaccccatggactgcagcctaccaggttcctctgtctatgggagtttccaggcaagagtactggagtgggttgccattgccttctccggacctcgcctctagg

SEQ ID NO: 47971 - DNA, 860 bp, Bovine  19866880646224
aaaaaaaggagcagaggaaagattctgattttcctctggatttctgaccaggctgaggatggtaatcccaacattaccatgcaaaagcctagcctctcgacagcgtctccttagagcaaaatcaccaaaaacagtaccaccaacctctttaccaaagttcagaaatgtttcagcatggtgtcataaaccaaggaagaagcttggatgagtttctaaaagttgaattcaatgaatgagtggacatgaaaggattttgcaaagtataaattgccatttaattgcctggtgttattattattaattaaaatctattcaacttctatttgaggctggtgtccttttctgagaaatatgcaaattgttcttagatgtagtacttaattgaaggataagagcagtttttatcagggaaggaaaacaaactggggcctagtgagaatgagggaatcaagatgactttgaaattcggggaaaaaaaaaaagtggtgacagtttaagtcaattctctgaaactaaagtaccaaacattcattcctaattttaaaaaggtggtggtggggtgggggagttttgcattggaatgctgacaaaccaacaggaggctatcaactggtttgggaaatggagagaaaagttattgccatgttgctaggcaacagattcccaagctgagttctcttcctttcttaaaggacgggtgcaatgttttagttctgtaaatactagccatttatttacttcttcactgtgaattagaggggctagtctcagaacaagactggctaagccagaaagagtccaaatgcaggcaattagaatacgattaggaaggcaacactgtgtaggaaataaataaagca

SEQ ID NO: 47972 - DNA, 1462 bp, Bovine  19866880668350
agcaggagagctcccctccctcctcatcctactgtggaagtgggtttcatctgagcctaagatctgacagactgtgcatttgtgggcaatttgggcacacctggggtggtattagaaagcatacggtcagagatgggggctttagcttcctaaagacttggaatcatgaccctgaaatgcacagcttgggctcctttttacaattgtgcagcagaatacattaaaataaagaaagcaagggacaaaggcataagtgaaaactggtagacgggggtaagaaatcaatgtcaaaccataatactactcttttttaagttttctcagtcgtgtccaactccttgcagccacacggatgtagcccatcaggcttttccaggcaagaatactggagcaggttgccatttcctactccagggtaacttcctgacccagggatcaaaccctggtctcttatatctcctgcattggcaggcgggttctttaccactagcgccacccaggaagccctagaccattttaagcttttgtatttagatttctaaaggcatttccgaaagctcatccctttacagagcttctccactttcttatgcacaataagacccaattgtctacaaagagcttctgatctgtttctctgcatttcttaatgaagttggtaagacctggaaaggttttgtttgagaagagaactttgccaagtggggtctgcattagtttttagatttaggccagcggtctgaatgggacagggacacttggggaagggtagaactgctttgggtcagcaaagcacaactgagtaactgctgagaaattcaggacagcctgtataaaaatgagtcctgtgatgggttgaaaagtagttcccccaaatatctacgccttagtccctggaacctgtgaatgttaccttctatggcaaaaaaaatagtctttgcagttgtggttaatttagggatattgagatggagagattattctggattgcccagtgtgccttagatgtagtcatgtttccttgtaagagggaggcagagggagggtctacacatacgcgcgtgcgcgcgcacacacacgcacacacacacagagacacacacaaaggaggcgatgtgaccacgcggcagagattgccgtgatgcaaccataagccaaagagtgccgaagcctctagaagctggaggaacaaagcacccattcacccctaaacctgaggagggagctagattttgacccagtaatgccaactttggactttggaacctcaagagtgtcagcgaatacatttctttcattttaggcttcccgtttcatggtaaattgttacagcagcatcaggagaggattcaagtcccagtgggtttggggcttctgctctttgagcccgcactccaccatgctccatgactattctttttcaaaaaaaatttaatagactattcttcaaggcatcattatt

SEQ ID NO: 47973 - DNA, 842 bp, Bovine  19866880673868
tgaagaaatgagcattcaattaaatatataactcagacaatctgttttatcaaagcagattgatcataaatcagaagaagaggtacattccgaatcacatacatgaaacagaaacttggcaacgggcccatcctggactgccatcctcccaggtctatacaaggtcaatatggtaattcatttccagaaattacttaattctagtgtctgtaaccaaatggtgatttatcttcaagtacagaagcatgtcatgtcaggtaaaactgttatttgaaaattcaagtttacactcaggtgaattgttactatatcataaaactgactcttttatagaaggaacatttcttaaacacgctaaaactggactccactgacaaaagtcctctctcgctacctttcctagagcactgtgcctacccagagctgggcgtatctctacagaaaccttccgctgcggtcagcagataatgtctgtgctcaggcaagttccaaaagtctgagtggtaaaagtctttacgctgccaagccagactgctggaggtcagtcgtaacttcctttcaaattattgtaattaataacagatttccttcctgttattgacccaggcataaatgcaggcttgaaaaatagccaagacagatttacatgatgccctaccagaaagtttccctctatggcaccaacataagccttactccagatttctggcagagcgcatctccgttgccttgctccagcaaagtgggcctacgcacactgcaaaataaactcagagaatgctcagcaatctgctggcggaggtgcttgctaagtgagcagctctcccctccgccagccaaag

SEQ ID NO: 47974 - DNA, 1913 bp, Bovine  19866880683242
ccctcccccaagcacggcttgtcagtttatattgatattcccctcccctcctctcctgttcctccacatgaggcagttgacaacggtaataaatgtggccgcactcaaggatagggctgtgacaggctcaataagaagtggactgatttgttgctttggggttgaaagctcagactttcatgaaacaaaaatattatattcggggtaatgatttatggcctcgactcctgtttgattgcaaaccataaatacttgcaaacggtacttacagcatctctagaggacattaggaacatactcaagtttattttatacagcaattactgagtcagtataagcatggccattatttgaaagacaaggtttttcccccaataagtctttggaaatgataagtttcaacagcgatctttacacactccagccttatccatgtgactctaaaggactcgaagaaacccaatgacaggtcaactggtgacccaaaagctgatgcccatcaacactctgacaaagatgtcatccttttttcccctgtaataatcaagcttcacaacgtggtctacgactagcatcaaaatttagaagccatcaagtcagtataaacttgctgactaggctcccaactcgatcagatagcctaatttcttcggctgtgaagcaggaaccatgttttcaatagatagtttggctcctggtcacactgtttctatctgctggccttttggggaatcatcttgtcactactctcaccccagactgggtcctgatttctcttgccttttcgaccacccctaaaccttggagtcacctgaataacacaccgttagctatttgtaactgaagactgtaccagccagaatggaaagaagtaactcgtgtagtgtttcatttatattagagaaacatttcaatccctggaggaacttatttatactctctatacccagggctccatgaattaatttatttaaagcagtgatattaaataaatataaatatttatttatatttttctgggatacagatttgatccctacttggaagaaaaaagacctctctaaaagcttctattgacttatagaactgggatcccaaagatgctactctgcagtgctattgaaggaaagtctccagcagatgagggcatggtgtaggtgctattttacatgtattattatattagtagggagccactttcccttccctatcttgtttgacaggcttcccagaagatagagaccaattaactctttattttggcagagatcattctaggtgttcttttaatgggtattattcttgttaaattatggatgagcttgatagtaagacaaatgccattatctgagttatttattcatgggatgtcgtctgtaacatacccacactagtttttcttcaactttggtatcgatcaatcgctttaatcagttgtaccaagggatgctaaaagacagctatcacagcttgaggaccagcatctctctttgggtctctgccaggccaagagtgaaaactgtggctactttcaaacccttggaacatcttgcggaaaacccgaacaaatattttgtccaacccaatagaagtggagggatggctcctcactctcagagtgggtgaatggacagcctcctctcaacctcactcatggaaagtcttcactttcatactgccatgtttctgttcacacattttgttcaactgtgatgttcgttggaaggaccataggcatcccgctctgccctctcttaatgatgcccacacatcttttcagcctttgctttcaaagcaagtcacaaggtctgctggctccctggaaacacatggccaagacttcagtagacaatcagcattctgtctagaggcaattaaaagatgatatagttggggctctgtttttatttata

SEQ ID NO: 47975 - DNA, 1063 bp, Bovine  19866880691160
ttgcaggcttacctacaatgttaatgtcacttttcaaatggtcaatttccttggggcagaaatgaggctttgatttaatccagttttactccagatcagcacttacagaatattatcaatgatggctgattgacaaagttaatcctcaacaaactccatttatcatccctgcttttcctggaaagtcagagagggcaggattcacagtatcagggtagatgtgagctttcaggccatcaagttgtaacaaattatgtccaacacaagtatggtaattttgtgacaactgttactctgcaggaagttgagatgagatgaccaaatatataattttcgtgtttcaacttttctgtaccaccttattatctttaaatagaaaataatgtacaaacaaaacgattaggtgctctttttttgtttcctctctttatctgtgaggtctcttcaaaatctttcagtcttcaagctgtctacaaggtgctgctttcaaatattaagggccaaagtttcaattggacttctttctcttgactcctgttatttacaggtgctgattctaaatgcaaaagttccaatttactagtataattacttaatttatatgcataaaggtgggtgccactcacaaaaattaatgcagcccaaaataccacaggtaaggccgattcaactgtgattctcacttaacgtatttagattggatggggaactccgctggctagattattttagttttgccacatctcctactgggcttccccagtgtctcagaggtaaaaaatctgcctgccaatgcaggagactcaggttcaatccctggatcagaaagatcccttggaggaggaaatggcaacccactccagtattcttgcctagagaatcccatggacagagaagcctgctgcgatacagtccatagggttgcaaagagtcagacatgactgagtagcttagcacatctcctaattttgcatcggtgccataacggggttccatccgagtgcccaggaaggaatccagattggattcttggtggggagcttcagcgggttcttcaggaagg

SEQ ID NO: 47976 - DNA, 1604 bp, Bovine  19866880692543
cagggtgagatactcatcactgcctcccccagttctatcagaggctggtacaagcttcactttctgctcattagttttctctggcttatagatcttcccctgatggcacaagcagtaaagaatccacctgcaatgcaggagacacaggagacatgggtttgatctccaggtcaggaagatcccctgggggaggaaatggcaacccactccagtattcttgcctggaaaatttcatggacagaggagcctggcgggctatagtccatagggttgcaaagaatcagacatgactgagcacacatgaacttatagatcttaaacaaaagcagcagccaagagtctcctacccagcaaaagtgaccaagagcaggacagcagggccatgcaccctgggtctcctctccctggaggtctgcactgcttcatgctggccttgtctctttccccactccccatgcctgccagacagcccccaggcacatgcaaagtgcctccattttctgtatcactttactcctctgctcccaggccttggaataataaattctagttccctggattggttcccctttgcattatattattcaatcctttctcctccaagttttcgcttaacatagtgcgtgctcaaggctgctgtctgggtctttatcagaggagaattttaaggttttggcaattaagagaaagaaccatggaaaattccttccactgctcccagccaggtcaaacagaggagaggagaggacagcaaatattaaactaatgccagccatcatcttcgaataaaggccagaaagcagaaattattgctctgtgtcagtgcacatgtgtattttagtcagcaaatgaaactgctgtagacccaacaccccactcttctgtgtaggtggctggcccagactgaaggatggatctgatattacattctgcgatgtcgcaccagtgacttcaataaccacattttctttttacatccagatcacattaggaacccatttgctttactcaaaaaaactgtaagctgtttagtcctgagtctccggttattgttgacatttgtacatgactgagcacagtgactaaagcctctgctcttgtcaccaaacattcagaaacatttagaactgtgatttttacgttttaacctggggctcttcagttttcctaatggaagaaatccagatgataacattagacattatgctatcagattagctattttacaaaaaagaaaacaatagggaacaagaataaatgaaataacaccagtcaggtgagataattaaacccatcttcacactgagagaggaatgtcagcccattccttcttcttcttcttcttttttttttaactgtgtaagctttagctcttatttcatttcaaacagctttccatatcactgcttgttttacagatataaattggcagaatgaattaagttttgctcgcagcatttagtttagtgataatctgcttctcagaggaggggaaacgaatggggaaaaaattagcaaagtgcatccaccctacaatgccaggtctgcaatgagatctaaagaggctgagagaaaagcactgttcaagagtattacagccaggt

SEQ ID NO: 47977 - DNA, 1408 bp, Bovine  19866880725549
ttgcctgagaaaatagatgaaaaaaatacatgtgtcatgtgaaacccaggccacagtcagtccttcttatctaattaaaaacctttcagcctagctccatgggtttggcttttccatgctttctagagggtatttccaccaggatgctggagttctgggaagcctgccactgagtccaatgtgctctgcaatacggagctggatatgtggtgcctgaaccagtatgaccattttctccttgctgctgctactctaatacacttcacactactcagcaacacagggtgttgttgtttagtcactcagtcatgtccagctcttagcaaccccatgcactgtcacccaccaggctgctctgtccatgggatttcccagacaagaatactggagcgggttgccatttccttctccaggggatcttcctgacccagggattgaatgtgcatctcttgcattggcaggcgggttctttaccactgagccacctgggaagccccagcatccttgggatagatcttggttaaaagtcatttcccagtccccaaagtgcaactgtaactcatgagactgttaggagatggtgcatgaccatcatgtatttgacagaggacttagatttcatttgtgaatactttttcattaaaaatgagtcataaaaatgtaagaaagatattgaaaaatgtcatcttaacacaatggctacaatttccttattgtgcatattttacatatgacaatcatagtatcatttttaattctgattttaaaaataactttattggcatgtagttgatttacaatgttgtgtcagtttcaggtatgcagcaaagtgagtcagttacacatatacatatatccactcttttttaacattgttttcccttataggccagtaaagagtatccagtagagttccctgtgctacacagtaaggtcttaattttttaaaaataatgtttcatcacatttctcacattgttcatatattcttcttaagctatttctcttggtgactacatgttaattcattgtatactgtacccacatgatcctatggttggacatttagagagtgtcctttccccttcatgttggtaatgttttagagaatactcttcatagagctttggcttctactaaattattttcttaagataaagtcttaggagagaaattactaggtcaaactttatgacaaacttctttgttgccctattctgtgtcaaattactttccccaaaaggtttataccaattcacaatgccaactcttatccttatccatcagagggcaaacagaatgaaaactacaatcacataaaactaatcaaactgatcacatggaccacagccttgtttaactcaagaaactataagccacatcatgtaaggccacccaagacggacag

SEQ ID NO: 47978 - DNA, 1679 bp, Bovine  19866880790825
cgctgtaaaatggctccatcgccaatgagaagagacatggttggaaattacaatactcttcttattttaactggaaataccagcagatgtcacaagaaacgtatagaactaggcacaggcaaatacagaatgctttgggggtgtgtaatagagaagagggagcgtccaccttggactgtggaggagggcgacagtggaccaggagttcagcaaggagtttggccgagtctgaacagtattaatcatcttggaaatttaaacatttccggtcaggcagttttagcatactatccataattatatttatttcacaacaggttgatcccagacatcttttcaaatgtgctcaccaatgaatctgcacgttgttgtaggttccctctttgagtttcggagggaaacaagagacaggcagcaaaattgggacagggagatggtgtccatcggcagttccccctgcagagttctcctaaccctgtgccggcttcttaatttcttgctcttgcctgtctgtcaaaagaatggagacggtatttgacagcccacacattttttttaagctgaatttttatacatttccctgatttccaaaaatatgaccactgttattctggcagaggtgtttttctccccgagaatgggagtaacagagtaaatgttctctcactcgtgtgctacactgaatcgtgctatcatgagatatcgagaagaaaatcacaaactgtctttccttaagtgatatttatccttcccaaatagaggtcgtccccggtggctcaggcggtaaagcatctgcctgcaatgtgggagacctgggtttgatccctgggttgggtagatctcctggagaagggaatggcaactcactccagtattctggcctggagaatcccatggacagaggagcttggagggctatagtccattaagggtcgcaaagagtcagacacaaccgagcaactacacacacacacacacacacacatctttcccaaatagttgactggtggggctgcgataggaataaaagagtttctaaactcacgagttttgtttctaaggatgaaagagccctgaaaccctggctgacattcaagttggaggtactgtgaatctgtggaaaaataagattttacacactgacaccaccaataagagttctgaaaggcgtgtttgtcatgaaagagttccatttggaacagcccagactgtggactaaaacggtctccatgtggcagagaatgtttgtgaatgaagtgcctttcaatgaggagaaatcaattttaacagctcatttattgatgaaaccaagtctagtctcagcagttagagagctttcttggaacaaggactcgaggattcatctgtctcacctgaacggatcaaagaaaaagcttctcataaaagatgtttatggtccctctgctcctggagtttggatgagctagcatttgataatgagttactagggaattggggcgactagaatgcctactaacatttcccattcctgttggactctgtggagttaagattattcaaatacacttaaagatgaaccctccaatggccgaatcgtggattcatttaatgtcttaattccactaagcttccttagcactaccctttgctttgggctatgctggctcatttcctgttccaacacggtgcctgtcatt

SEQ ID NO: 47979 - DNA, 1274 bp, Bovine  19866880803601
cctgctggtcagcatttccccaaggaccctctggctgtcctcatctggttttccacgctgcttcctggggcctggcctgtcagtgtgctgctgagagggcataaatcaggaatgctctcccgtctttatctccagtgagcatctccactgtgggaaggactgatgcttcataaccaaatgtatcgatcggggtctgagcaagtctggtgtaatgctacgctgaaatggagtttgccattatgtgtggagctaaatagttcattttctgccatgagacagaaggaaatcactcagggaagcctttgagatggacgatcccaatagctgcaaagctacggagaaaaaaaaaattaagtttttcggaactgattgcaatatttcgaaagatattctttacctcttcacaaaaatcaaactttccatttggacttgtcagagtcagcttttagtgagacctatttttttttggttcttttgattaatggcaaggagccgtttttctttttcttcactgtaataaaaatcaagctgtcagagggtgcccttcaaaatagaaatcaggagatgatttgaacagaatattaatattgctcttttaaaccccagtgttcgtatcctggtttaataaactaaatttgcagccgatttcttctctagaaggcaagcgacattttgtggaaatatgagagtttccgacagaacttgatcacaatctttcatacattctttcctatttacagatagcagtgagaagaaaggctgggtctcattcttttgtgcttgaataggccagacagaatgtgtgattagatgaattttggcatctcaatcattttattgtagctattgttatcgttcagaattcatggggcataatttttaattcaagaatagagtggatttttctcttggaaaaaaaaaaaatgatttctcagtttccagcgataaggctctttaaaatccggctcggagctaactgacaacacaatggagtgtgcgttacgatgcgttgctttaatttcaccccatcatggcccgtcttaaaacttttgccagtgacgatgtcttccagaaactgtgcggccccccttggaatcttcagcaggcatcgggtttattttagcggttctttttatctgagcatcctgagttttttctgccaccaaatttgcatcagccttgttcactgaaacagtatttcaagattaatgaattaatcttctcctacaccaccctgccaagatttttagacaccttttttctcaattgggttt

SEQ ID NO: 47980 - DNA, 3044 bp, Bovine  19866880999320
ataaagatgtatttgtgagcatacgcctagtataatcttcatggctctacctatatctacctatctacttatcttcaaataatattcaaatttcacttcttgtccaccttaaaacttatgattcatgacagaaacaggaatgacaattctgatggagaaaaatagacatctcaaaacttgggatgtatcaattatactttaattaaaacagatgaaaaaataacacagttaagtgttgtgttattctctgcaattcttcatatttgttgctggtatattttgaggtatcggaagttctcaacagaatgaaattcactaaggtggacttagaatggatttgtggaagtgttgagtttaagaggatcacattcaaccctccccggcgggctcctgtagacgtcttcgtcgctggcagtcttggaataacagactgtcttatgatctttcagcatcttctctttggcactcaggcaggctgggtattgcagtttgaatctggaagactcttagttgtgtggatcttggtttaagaagaaactgtcttctcttcacttactaaatagtcttcaagttgagaacaattactctcgctgtctgatttcatctggtaaatcacaagaatctcatccagtgttaaacatgcttggaataacagacatgcagggagcacatgcaggggccccgccttctgaagttttcgtatttcatttgtttgtttttgtaatttgtaattagagtactctaatctatgatgcttgagaaatattccaggaaatgtcaaacatacatatatatgtgcatacacacacacatatatatacacacacacaacaatctttaaaaaattacctatataaataaaaagtgcaaattgtcttataacacaatgatattaacagcatgctattaaaatactcaaaaacctactggatttggcacactatctcaaagaagtaaagggaacagggaagggaagcgggggggagtggcaacagttgaacagaacacacaagtttgaaaggtctcgttgcaaactgtctccccaatattctagaggcagtgtctttggccattccattcctgtgtccaatttgttgacttctgtgattactagtttgatggaagcacagggagggtggcaatgtggatgggtacccagcaaaaatagtggcacagactcataaagttaatatatacctggtgtaggttactaactgtgtgccagccctcagggcaagtgatttctgtattctgccgtatgatttctcatagagcatggatttgggggtcaaacagaactcgctccaaatcttagccgtgccattgaactagcagcacgaacatggaaaggttattcagtctatccaaacctttgtttgttcacctgtaatcagttatgatccactgaccatttctgaagaaagctttataaatgagcatttgtgtgtgttgaatttctatggatcacattttactatgtgtgagtgctgtgtgccttaaatttcagaattatatttctattccccaaatactgtagtttctttggttttctcatggagctcatttcggaggcatcaaattatattcactgttctttctgaatcatgtccaaattctccataattcattttagttcagttccaaatgaaaaacagctccttaacccaggcctgtctgaagctgagttaaagacggggacaaacgtgggtttcttgtgtgcagtgcatcggtgttctaatgcccagtacatcccctggaagagctgccccctgttccttttctcttttaaattaattttttggaatatagttgctttgcaatgttgtgttagcttccactgtacagcaaagtgaatcagctatcatatatgcatatccccccgccttcttatttccttccagtttaagtcaccacagagcactgagtagagttccctgtgctatacagcaggttctcataagttatctttttatacatactatcaataaggagcagagacacagagaaaagagatgcttcactctgacatcacgtggacccagcagcaactcagccttccctcctccaacctaatgttcattgaacaccaatgctctgtctttacctgctctcttaaggaaaggacagtaacacgctctttgtaagattagactaagatattggctttttcttttgcaagtacatcagtgatgtttgaatttttgtatcattaggggtagagcgacctgaggcagcatgctgtaagtgtcctgattagaaccacactgaagtagaaattaagttgacttggtgttttgcaagtaaaactactcagttcaagttttttggtgaggagtgttttctggttccttggagacttttaaaccaatatcatcaagacaattggaaacaggataaaggaaaattaattcctttagtcatgttatatcggggaccatttaggtggaataaagaaggctaaatgaaaggcaaagaattctggaagcatctgaatgcaattccttaatgtcatagtgtctgctgttcatgttccagttttgtatgtattgttgtatatataacgtcctctcatatgataatttacctagtaaaaccctaagctcaagttcaagagttcgttttgaatgaggaggatggaaatcaaaggtctatcattacatctgcacctgagacaatggcagaagccttggctttttctcgctgtaatgagtgttatacatatgaaaaaccaccccaaaggatgacgatttcagtgagactccagaggaaagtttcagattgtgaccaggtttcttctgtgtctctagcaacaagtctttgtaaatattgtttagcatcttctgggtggttgctggtttccatcttaccttctgcctttgggaatctggcttttcctctcttttggtggcattaccccctgaaatggcaagagggaacatcaacattttaggaatcagtgaactaaaatggactggaatggacagatttaattcagatgacaattatatatagtaccgtgggcaagaatcccttagaagatatgg

SEQ ID NO: 47981 - DNA, 1141 bp, Bovine  19866881024280
ttagctggctgattgctgactcttctggctaacggtgtatggatctggcctcaaaaacagcagagacacaaatctccttggcattcctttaataaactgtttcctaaattatcagtcggagtgtggtctaatttttgttgtcatgcatgatttgggatacagtcttgctgaatcccataaatcctttcacatctgaatcattacaggaattggtttcactattttcagacataatctcattcaaatctggaatatgggctcctgagtcatcattcctaaatttctgaggtaatctgagctttgcgatgataatagttataattccggatttaatgtagaccctttcatcttcaaagtgcttggcaaacattaattaatgagcccttcagtccttaagaaaataccattgcgccattttaaaaatgagatgtaaagagaaaaaatgaagtttattgttcattagcttgaagcaaagtgtgggaattaaacctagaacctgctccagttatgtagatatttgaggtcatacctataccagaggacttcagcaaaatcataaattctagttatcttcttttgcaaggatatgtattttaaatgctgttactttaaagggctggaatttctttgtaggcactgatattccctctatctaaagaattaacctacaaatcttgagtactgcctaggtagtagtaacctcatattttaaagaaatttatcctggtgctcatgccaatataagagtacagctgcccagtcacagttatgtcagtacaggaatgtctagctgcagccccttcttgatcctttggactcagaccattttcacagtaagaaatggagactatctgcatgcctgatcaaactctacccaaagtccctttattggtgaagcctacatttcatatcccctgccttcaaattactcaccctaataatctggagggcttcccgggtagctcagctggtaaagaatagccggtagctcagctgccctacaatgcaggagacccctggttcaactcctgggttgggaatttcccctggagaagggccaggccacccatgccagcatccttgggcttctctggtggctcagacagtaaagaatcctcctgcaatgcaggagacctgaatt

SEQ ID NO: 47982 - DNA, 2254 bp, Bovine  19866881034336
tcttatttaaagatctctttattctgatggtctctctagacagcctgtgtttctttcccctggaccaaaaaaaaaaaaacaaaaaaaaacctgtcatctctcccaagctcagtcatatcttgaatgcacagcacaattctcagcatgtagcatgtgtttaataattatgtgttaaataaagaaatgaaatcatgtgaccacagcctaggctgcctgaaaaacaacgatggtattactttcctaagacgcctgacttcaaaatgccatcgtatatatgtagtagttctattgctgttctctttaacaaaaaaaaaaacgaaaaacccaaaaacaaataggccaaggaaaaatccttctggaaccatctttggtgaactcaagctgctattaaacatggttgacatctcctgagtctgtgcggggaaagaccactggagtgaaccgcgtgttgggagaagaggctccctaggatctgtcatcctctgggttgagtcctccccagggagtggggaagggcctgtttcgctggcagccgttgagtaagccaaccacattctctctttgactctcaagagaggcacgtgccctttgaaccttagagagagcctctggattcacagtgaagccagggctcaggagaacgcttcagaataaacttgtaccagatgaaataggagcaatcgacctagatagttgccaaaggggcaaacgccaatgccaggaggccgggggtgggctagctagtcactgatggcagaaggggtgctgttgcctgagtagagctaggaaaagggaggccggtcttgggaatccgagagggaggggccgccccctggaggctgcacttcacttcctgtgagcacacctctccttacataatttctcccgcgaacccgcaaaataggcaagatgcgtgctcaagaggctttcctttggctaaatagcattttctgcacacatgattggcagagccctctcctctcagcccgagtctatgattggccttgattactcgacaacgggaggtcagggatgggttacccggctccccaccgcctcctctcccatccagggataatcatcaagattctcaaattctaaattcgctaagggctgattcgccacacttgccacttatccaaccaatttagcagcaaggcactcttggggcctaatttgtgctttgcatcgtgttcatccgcatcttagaataaatgaagaccgatctgatgggaatgcggggggttagttgttgtgaggctggttagatctcgggtgtagaatggatgcagtggtggcagagagagatgctggagttcggtggtgtccatgacccttctccaccttcatccccctggagtgaatgcctgccaggcctcagaagtaaacagggaaccaactgggtggcaatgcgatgactcgcagtggacacagagctgcaggaggcggtggcggctactcctgctttgcagataagggaggaagctgggacccccagagctgagtgtcctttacagactcaacaggtctcaatgccccttgctgttctcacaccagaagccacgtggtctgagttcttctggggcctctctgttaggagccctgacattgggtccatcagtatttcacagacttaccttcttcagtcccttgttgcccctctcacacccctctcctttctcgggttctctaccttgaacacttggtgctatgtcatccaccaactacacaacctattcatcagtgtttcctaaaagcctcttagccaaccggagaatcattacttttactccctggcaaactgtttcttcagtatttacctgcctcaactcaaagtgccctagcgggcactgatctaccctgactgaccctgaccagacagtgcattcccctgcctcagttctttcctgaatctgcttcttacactgaaatctacctcctctgtatcctatcccatccacctacctgttcccagtcagccggctgtctggttcaatgcaatgcagtaagatagctagagacattaaacaacagcatggacctgctttaattggtgatgtgaggctttaatccaaagcaaggactgcaataccaggaatttgagactctcaggaggacagtgggtggatgagtccaaatacatcaggtcagtcttttcagagcccctcagctcccacttgctccctcagtgccgcctactcagaccagccttagggtagacttagtcatccctcacgcgcactttgttccaaac

SEQ ID NO: 47983 - DNA, 1443 bp, Bovine  19866881060252
ggcagatttctatgtgcagccccttcgtgctgtcctgacggcaaatatcaatatgtgcaatatcaaggcaattgtcttcctttttggctcaaaaaccagattaagtacatgcgactgaaatttaaaaatttagcctcactaatgaccatccccccgcctcaaaaaagatctgtgatataagcaagtaaacaaggcattaattctgaccctgcacagccccccctctagatgtatgctgatattaataaatcaggtattccttctgactctgcacttaagacatgctcagcattagcactctgcttttcacttattttattcataattattcaaaatcatccactgaggcatagaatgatttctatggcaatttcatggtcctgacttcaaagaagtcacattattttctgagattcacccaacagtctgaatgacaaaatcagagaagtgcttatttctagctctctgcttggcagtgacccagatgagtgatggtgtgacgtgggcaaacacttcatttcgggtcctgggacctggttcggggccccagctccagacccctcctggcccggtggtgtcagatgagtcttcagtgaggccttgctttatttttgtttcctttaaaaccatagagcactgacatatatactctaccatgtgtaaaatagctcatgggaagctgctgcataacatagggagctcagcttggtgctctgtgatggtctagaggggtgggatgggggtggggtgagatggaggttcaaagtaggaaagggatatacatacacttacagctgatccacgttattatacacagaaatcagcacaatattgtaaagcagttatcctccaatttaaaaagagagagaaaataaagggggaaagagaagggggaaccatattcccattgtttccctcccttctgaaattcttcagccttgccatcaaacatttttactatgctcactagaattatgcttttatgaaacattgatatgctaaagaatacaatttcaagctacctaaccattgcataaatacagcctggaaggagataccatagtgactcacataaagttaatgaaaaagaacgactaatgcatagcagagtgttagatggtctgtttttattaaatcaatattcgtgcataatttacagagtaaaatgtactacaaagtttatcatggataacgagagtcattcccttccccacacctctttccaccaaagtcctgctgcccagtggcaagagcttcagctttttagctgattctttcagtgcttgctttcatgttgcgaaatattataattaaattcagaccggatatatcaattctcttttaaaataggggaggatttaactctcttataccaataaatacacacacacacacacacacacacacacacacacacacacagttctctgttacccattatcc

SEQ ID NO: 47984 - DNA, 823 bp, Bovine  19866881154711
ccagattccccagatggtggaaatacttgagcacaggccttccccctcccctcccctctcttaggattctttccctagaatcatggagtgtgagagttggatagacccttggagattatatcatccaggctctttgtttctttatttcttcaagtacaaatggctcacattccctttctccttcctgacaaggggcataaactcttgtaagacctactcgatttgctgccagattctctgaaccttagggaagtcctgccaagtgaggccccaatgacaaaaaattaggagaaattagtggtgggggtggaaggggtaggcgagatgggattctttgaaagccctgaaatgctagcagaaaattgatcaaagccgagatgaatttcgcccatctcttctaacgagctgctaatattggagtggcagtcctgtcaggataatttgtcacacatgtccccgtgtgggctggagccccttcagagtcatcttcccaactcactgccacaggcaacttgtctgaaacaaagctcgaagacataatggaaagggaaatgtgggcggtggagggagagggatggccacccactcctcaggtctcccagcctccagcatccaccatcattaggctggaagaacccgatgggacttccaactcatttgtgctcctgccaaggctgcagtgtccactgctgcaaatacgctgtccagaaaagaacaccacctcctgaaaaataacacggtgtcaacactagttagcagacccattaagctctgtgataagcgagatttctcgctaggcaggcggcaggaatttctctgccag

SEQ ID NO: 47985 - DNA, 1240 bp, Bovine  19866881223480
attgaccctaaaccttctaaacccaagctgtaggcctggtttgggtttaagaagttttaagatggctgtaggaccctctctggctctttgtcctccctcctgatggagagctgaggtgctccgtgtgcggcaacaggaggcactaggaagccaggactgcatgcttgagggtctgcctgccttggctgccaggctaggaggagcagcatgcatgtgccgcttctgtaaggcacgccgcctgttggggagagacacccctgacagctggccaatgaagagccctgatgtcaactgtcaaagcacccagtagtctctgcttgcgagcagggggagggaatgagatttcactgcagcaataagagagcagacaatatgttcgacactaaaccaaccttaagtgagtcccttgaatttatttgatactgagagttctcctgggcaagctgatataattatcgttaaggtgatacttacaacgaatggcacatcattagcatagtgatgaatattgtaatctttgtgtttggtttgaacacccaggggatatcctactctttctctttaaccacacacacacacacacaaataaccttcctcatttatcactatctcctattgctaaagctttttttttaagggaccaaaatcagaaaatttgggaactggggagctctgaatgagtgtttctagaacaaaatgtcaatattgatttcatagatttctcacacagaggcccaacattgagcctgaagttgatgcaaataaggtagtgatgtgagattcttactgtaccgtgggtcagggtctatttcagcataccactaaaaggcaacagtgaaacacttcaggaccattgcactgcactctccatgtaattaagagacagttgggagtttgggatggacatgtacacactgctgtttaaaatggataaccaacaaggtcctactgtttagcacagggaactctgctcagtgttatgtgacagcctggatgggagggcagtttgggcagaatggatacatatgtatgtatggctagttccttctctgttcacctgaaactatcactaatccactataaaataaaaaaagtttctttaaaaaagcattttgactttctttacaggtttttcttttatacttttaactctgttattcacctcaagccatttaccatatcgagagatcctagagagtaagggatgaagttttagtcattcttctgtcccctacatggc

SEQ ID NO: 47986 - DNA, 3109 bp, Bovine  19866881249894
tatttaattttaatactttaagtttaaattgtcatatgtggtcagtggtactacacaataatgccatttaaggcgtattccattctgcataagagttggaccttaaagaaggctgagtgccgaagaattgatgccttcggattgtggtactggagaaaactcttgagagtcgcttagactgcaaggagatcaaacctgtcaatcctaatgaaccctgaatattcattgcaagggctgatgctgaaactgaagctccaataatttggccacctgatgtgaagaactgactcattgaaaaagaccctgacgtctggaaagattgggggaaagagaagaagagggcggcagaggatgagatggttgtatggcatcattgactcaatgggcatgagtctgagcaaactctgggagatagtgaaagacagagaagcctgacgtgctgcagtccctagggtcgcaaagagtggggcatgactgactgaaaaccagcaaaattctgcaatatctttcagcctcactcaagtaaaaatgagttcttagttctgaaatgaaaaacaaaataaaatagatagggcccttttgtggagttgcttcagaaagaagggcagtgaaatatagtccatgacctcaacatgagctagaaaactctgccattcggctgagccacagcctggataaaaattaaatgaaccactagcttcatcattgacaaaaacctctaacacaccaacacttgatttgcactggggggaaaagtcaagttgaaatgttgcaacagccaccttttttcaagtttccagcacttcctgatttctttggtatcaaatgactgcttgtcacattcctgtgacattagcacttcctggttccataaatactggacatggacattttgggatccccaaaccaaacaaagcaaggcaccaaggtttttgtttttagtaacttaaccttttgaacctcctttgttgttcattccaatgggtaacaagggcgggacttagatccccagataatctgaaaagcaagaaagcaacacttaattctgagagttagaaagtaaacgattagttaaaatctctaattaacaactgagctttttaaacctttggtggttcagaccgtaaagaatctgcctgcaatgcaggagacccgggtttgttccctgggtcaggaagatcccttggaggagggcataggaacccacttccaaatattcttgcctggagaattcagattgcagagcattgagaaatggaagagggaagagagagtaggccagcgcctcggaagcaatccagaccttcacaagaaggggccgctgcatggaggcaggagatgggatagcacagcctgtgcatttaccccagcctctccagcccaaggtccatgggcgtagacatgactgagcgactaacattttcactttcctcacacccttaacagttgtctcaacctgaattaagttgcctctcccaccctctcccttccctgtgtctggccccttgagctccatgcacaaatgtttaagagctggtctttggactcagactgcctggagttgaaaattcacctgagtatctgggtgaccttgggccagctacttaatactctagccatattctctttacatgctaaatggggatgataacagcctcattcacagagttaagaaatagatgagttaatgttcctaaaacgcttagaaggtctagtgcatttgctattgtttactctctaagtcgtgtctgactctctttttcgactcatttcttaactgcatttaagcagtcacaattagtgacatgaaatttttgctctgcagcccactggttatcgaaactttgtctgtgtgcttcccttctaggaccttctgtttgtcttcattaaaaaagaacaatccactcacgctaagaggactgtcatgaagaacgcaggagagggtgcttgtggaagtgacattagataggaagctggtggacgttctcaaaggttcaagggtaatggcagctggactcccccagagcctcgggagtgtccacatccacatccaagtccgctttgcagactggaaatctgatgggcagcatgagaggcagacacatcccgcagcagcagggcagagggggctactgaccacagccacgccatcgtgcgctccagaaaaggcatttcctgggtggaggaggtgaccccaggtacatccctctctgcaacaggctgagggtccactccgggtcagactggttccttcctcagcctgagcactctctcccagtgctgaaataagcattgccaaaatcttgccccctagacccactcacacgagttgctgaccagcacgttgcttcctagaggcacacaggctcgctggttatttcctggtcctgctgaccaggaagtcatctggtctctttttacctttagacgtagatatcatcgattgatgctcacagggtaatctttttccttctgcttctcagggactgcctcccaagtgcctataaccaaaaggctaaaacagtatgtgattgtttcaatgcagctagtggttaaaggttatagtttcatcctgaaagcgtctgaagccattttgtccctagggtgtgtttatttgttttctttgtgtgccagtgctttccctttgatcttccagatctacactctgtcttctccaccctgcttcctgccccagaaagctggtggatatggattccatcaatggactccctgactccaggcttggcggaaggcagggagggcagggaggagctcgggttatttactacccttggcccctttctgagatattgccgtggcctatttgcattgctccagcaaacgtccctgcccctctccggaaggtctcctctattagtggcttaagaattccagacaccactggccccctccctcctgttgtctccccagtcctagtcgtggtgacttctctgctgctattaaccccaggttactaccatattcctttgtgcttctccacattttcataaagggcctctttgtgaaccaacctttgaaatgtcctaattccagtgagccatctgttccttgttgctgtcttgaatgatgcactttgtttcgggtctta

SEQ ID NO: 47987 - DNA, 2163 bp, Bovine  19866881361086
cttatcagatgaagtaccagtatccatctcagaaagtcagagaccccagtcatgccccctttaatttttttaaactgaaaaagtagacataaaatatattccagaatcccaaataactgaaaatcattctccctggcttcttgggtacctatgggggcagagttccctcatcttattgtcaaggaacctgtcaaatgcaaaataacccatttgctcttagaagatctcaattggtgttggaaacttacatcttctagtttaatacattaaatactccaaatgtaaggatttatctcgtcttgaaaggaaatcttcagtcttggttcccaacacttctttttgagttgtcctgggcacagattcctaacaaagcgtcagagctggtgagtggcggcttggtgccactgatcatcactgtgtgtcttctctgtgtaaactttgaggactcaaaaggattgagaaaagaggcccctctaacctttcatacctcttccacttgtaacctttgaacttcatgggacttaagcaaattaaagtactagattccaccatgactcaaggtaatgaaaacctttctccaagacttcagatgagctgcagaaaataaagactgtatgtgaattttttaggtccacgatggtctgttaatgggtgtttagaggggcaccaagatcatgttaaccaggccccatcctaaggtaagtgttggtttggaactcaagtgctctgagttctagcctcagccctgctgctcattcacagtgtggccttggagcccttggaggagttgggttaaactgtctcttttaaagatccttccagggctttcttggtggctcagtggtaaagaatctgtctgccaatgcaggagacatgggttcaatccctgatccaggaagatcccacatgcctcggagcaactaagccctggggccacaactactgagcctgtgctctagagcccaggagctgcaactatggaagccttcgcaccctagagcccttgctccactacgagagaagccaccacaatgagaagcctgtccgccacagtgaagagtagcccctactcccggcaactggagaaaatcccagacagcaaccaagacccagcacagccagaaataaataaacagatgcattatttaaaaaaaaaaaaaaaaaaaagatacttcaaatgtcctgggtttaagtggacagaatgaaataccagcattaagggaaaactcagctttgggtgtgtgtatttcagaatgcaacgcatacatctttataggcaaaagacagtttttcctctggactctcagtgattagagtgtacatgcaaaaatagactaattcctgggaattacattagtcaattatatgattgtatgaaaagttcaagcagtgcgcagggcaagtttctcaaccctgttctataaagagacaaaaatccatagaatctagtccccttggtgagagttagcaattaccctcaggtgtttgcaagtcagaaattctatacctctgatgtctggcagtcccggatcctgtccactcctgaccagaggatgctatgcccttttattttatagtaggaagaagtaaatatggcttcccaactcagggaaaggctgacactcaagaagtctaataaatatacttaacacttataatattatggaattaacaatttaccaaattaaaagaagggcttctggtgcctttgttgtgtgtgatttttaataatagtgcaatatttgggtacaacttttcttttttgcacattgcctccatcctgagtacaaaaacatttggaaaactgctggcttgaattcagaggtgaaatatgcaactttggaagaaaaaaactaactgatgaacttaaagcttgggtccactgtttagtcttgttcgagccatactacaatgagatcaaaatgagaaaatctaagatatctcattctgtctctcagctgctgttttccatttgatttccaccaagagtgctaaatgttttgtttcctctccatgaggaaaattcttattttttttcccagacaaactttatgttgtatgataggaaagttcaaaataaattagattctaaattacacaagaaaaggaatatatgttggcatctcctgacctgatggggtccctggtactggtaggtgtttt

SEQ ID NO: 47988 - DNA, 1627 bp, Bovine  19866881391326
acaatatttctgattttggttattacgcttcatactaagtgatgtagtaaaatatatcagcaatattcacatgttaaagctttcatgatctgcatggagtgacttcctgagtaaaagttaacctcctacacatacatgctacatttaaagctcatttattgaacttttgagggcttccctgatagctcagttggtaaaaaatccgcctgcaatgcaggagaccccagttggattcctgggtctggaaggtcttctgatgaactgatagaccacccactccagtgttcttgggcttcctttgtggctcagctggtagagaatccacctgcaatgcgggagacctgggttcgatccctgggttgggaagatcccctggagaagggaaagactacccactccagtattctggcctggagaatgactatatagtccatggggtcacaaagagtcagacacgactgaccgactttcactgttggacttttgagatattattgcacctctgctcagttgcgatccccatctgctccccctgaaagagcagacccctggcttcctttgcttctctgtttcctaatcttccttcatttccctcatgccagcatcaccctctgacaattatcagagattcctccttagaataagacctgtgttactcactggagtgtttctagcatctaacccaacactcactgcacagcaggaactacaaacgagtgagtgagtgagtgagtgaaggaaggaataaatgatttttcctaaactgactccacattacacatggtgcatttcaggccctatacagtggcaccttctttaaaaatcaatattggcctcttcatgggcttacaattaccttgaatagatcacacatacaggatatccgtgactttcaattaatccagagggaaccctaaaaggacttaagatgagcagcagaagatactcacagagtgtatgaagtagccaatcagaaattagaagtccctggtgagccatcccctaacgaacagagagagagcatttcctggcttacgggaaggagagcggagcccggggaagtgcctcatacagctggattagttattggaaactcgtttccttgggccagccagtccttccagacgctgagtctgtggctgtctgtgtctctccttcaggggcacagatcaggggaacggagtgggccctgtagcatccgctgctggcttccgcctcacaactccacagtccatttaaaggagcagaggatggacacagctgtgcagtgaagcaacagacaaaccccagagagcctcctggaagaggtgtcccatcctcctgagccacccaaccctgctcattgcctggaaagacacccagtaaccacttgtgtttctctccagactctgtgactgtgtttgattaggatcttgagtgaaataagctgggaatgtcttcagagctaaaagttcctttctatgcataattaatattccacctctgtggagataaattttatctatccaactctgtaaatggatcgtttccccttggctattagtatgtcgtctctttaccaaaaatacaataaaacacaaagaaaaatgataggtaaagaagaacgcctcgctaaaaatgatttaaa

SEQ ID NO: 47989 - DNA, 1052 bp, Bovine  19866881414660
ggacctcctaggggcttatctctccctgacatgggccacgttaatgacgtcacaaacaggggcaagtctactttctccaaggctgtgtctttccttctgccgacaatctcccatcatctcagcctatccagtgctgtgcttcatcccacttaggtgctatggtctaagaaacacgacctttctttcctattcccatttcacctttcgcccctatgtcatcagatagtgatgtatgacattatttcttatacatgctgaaatactcatcattgagagcaaggaaaagatcaaatctgcaaaaacaagacatgatttcagcccttaagtacaatatggtaatataatgaaactcgtcatttattgctgcctattcaactgtactttaatattcattatttctattgagacctatctatttaaacatcagctctgcacagtcaagcctgtaagtatctgttgaatgagtgaatggatgtctgatgttcagtctgaactggtaaggcggccacgggttccattttcaggttttctagtgctatgatacacttttcctattttgatatttttctttaggttctctgttcatttctaaagaatggcaaagagcggcatgcactgtgggaggtaaattttggcgaatttcacttttgggtgaatttcattatctttacctgtcagctaacttccagaaatgcatgaactgggagacggggagaggagaaaacacagcacacgatcgctgacagttggtggagcagcaagtgccccagagtgggtgtcactagcccctgcttccacgctctgatctgaagcttgtacaacagatgtactgggggttggagaacagggtgctcatttgcggaggtgaaagagcagggaaaacgcgccggccatgatggttgggggagggtggggaagccgagacagtgccgcgggctggtgaccctgttgcttctgctgggtgtttttccttcagaaatatttttaaccatttgcaaggctagaagctacagaaaacattgctaatttaccctttctttcgaaggccagag

SEQ ID NO: 47990 - DNA, 1216 bp, Bovine  19866881636850
gtcttgggctccaagtagcagagcagcagctaattctattcggttgaacaatgagaatgagtctgtttgcggctttgttagaagtagaatcactcaagcgtggcatgaagcttgggtccaaaatgagctgtctccaatggtaaacaatgaccactcgctgttctctcggatgcaaccagaggataaggagcactttattattttaactagcatctagctaccctagtagacatcagtcaccaaatttacgcgttgtagtggtatctacagaagtgtaggagatgagaccacaatgtctctaagagtcactttcgtaaaataggaagtcaaattgaactttaatctttagagcaaagaaaagtacatccttctccctagggaatttaaaaaaaaatgtgagcaaattgtaagtgacttttaaactatacaataagcctgccagccctattcagggggaaaaaataattggcattttatgtcagtattttccatgaattatttgaaaaacagacaaaatatgtcatttatatggagctgtgtcccactgttcttcaaagcttcttctcctgaataagtaatcacttttcattggtgattggcacagttgtataaggccaacttgggcaaaatatatcagaaaagccttaggttggtgttatatgtaatgcatccagagtccttgggggaaagaaagaaattgaaaaaacaaaagaagacgctcaaacctgtcaccctggggtgacaaacccaggtgtctattcttcctctggatgctgaattttagggactgggagagagttctgtgcagataaaagccccaggcccgcaggggttacaaaccacatcttttttttttttttttggcctttgtttgaaatttcagctcttagtgaaacacttctctgacatttacccttaaattagatgaaaaatcatctcaagataagctaatttgttggagaatggtgtgtgttcctggtgtttctcatctttgtgagaaaagctgaaaacctaagcaaaaagatttccactctctataggagaggggtgttgcaaaagctcgccaatgcaatgtgttgtggattgtgtatggaaggggaggttagctatctcagagacaaatattttgctatttcttggcagaagcactgggagtgggcgtttgaagttaaaaccccaagtcctgcttctaaacgtttccatgtccttcttcttg

SEQ ID NO: 47991 - DNA, 1336 bp, Bovine  19866881808491
agggaaattttttaaagtaactgaaagatccggtgaaaaataacataaaaagcatgttgggtctacagggtaaaattaaaggatttaactagatatcttttttcatcttccaaaacaaaatctaatcttgatcctctgtaaagccattttaggttaaaaaaaaaaaaactattacgatatttagttggcacattcatttggtgccaaatttctaaaaatttcttagtactatagatagatagctatagctatatatatatatattctctagaatcttgtgttttcttgtataagtaatacatagatcacagttaaactcattttacagtgtttgcagtctacttttactattaagctaactataaagatttagaattattatatctttgcttatatgagccattgttactgtatcatggccttgtctggcgccaactccttggtcagaaacgtaacctccaattataagattgcttctatgggaaaatgtgattcactttatgatgtggtttttaggaacacactgtggcaaaaagttgagaatgcctgcctttttaaaaatataagcttttcaaccctttataccatcagttacaacttggcaagatgtgatatgactagggttggaggttattcatggattgaatttgactaaagtctcagagcctgccccccacaagtggatacaaaaggggtaacaaatgcatatgtcaaacttaagctttagttggaaagtttggttttcccaggtggctcagtggtaaagaatccacctgtcaatgcaggagactcaagagatgcgggtttaatccctgggtcaggaagatctcctggaagaggaaatggcaacccactccagtattcttgcctgaaaaatcacatggacagaggagcctagggggctatagtccatatacacccatgttttgaatgaaagttttacttaaaatgttatcaaataaaagatttctgtaatgctaaacagcttgatcttccaaacacagattatggtcatcgttactgataaatcctggcttttctcttaaaaattcaaaacctcgttttccttttgtgctccttttgttcattaattagacttacattattggtaaaaaatctttaaaatgatattttaattgcttctaaaatcctgagatcttagttacaagattaaaaggacaaaaaataaagcttattaagtttggggggtctttttttttttttttggaaagtgcttaaattaattgaacttgtccaatcaactttttttttttttaagtctccttcatagtaatatccattgggactttaaaagttacacaaattgagtaactga

SEQ ID NO: 47992 - DNA, 979 bp, Bovine  19866881831958
ctaagtggaaccagtcgcttcagaatttattgtctactagcaaatccaaccattaaaaaataccagatcaacatctttctctttagagatcacttagttttgaaatatagtcaaatagaatgtaatcttctatttttaatttctgtttccctcctctctttatagtgtctgattttacatctcttctgacaaatgtatatattatgcattcaaaaaaattatataaagaaaatgagaaccatggtgcattagaactctaagaacatttaaaagatttagtccaactcctaattttagagatgaagatgcatgtctgagaactatttactgaaagcagggttagtgtcatagatggtgtggggccttggttcctaccctcagcccaacattttgggggctccactgcccattagtgagatgtcagatggacacacatttccattcatcttggcacaatgccattagtggttatgataattctattattaggaaaaataactaatataaatattcttatttcaaactcaaaagatggaaatgaaacagacgtattgaagttcattgcatagaacaccgaaatcattctatcagccctaccctcatatatatatatatatatattttttttttttttttgccacactgcgcaggttgtaagatcttagtttcccaaccagggattgagcacatgttctcagcagtagaagcacgtaatcctaagcactggaccatcagggaattccttgtcttcatctgtaaagtgactgggttgagtagccgatccttgcattcttctgcaactgaaatactcgagaattctaaaccttgctgaatattctctgtgaggtttgcctttttcctctcctgaaatataacaatcctaaaccttcaatttcctcaaatgcaaagcagagctaattatatttaccagggcagtggtgacagtaaacaagatgatacacataaagcacatttaatt

SEQ ID NO: 47993 - DNA, 938 bp, Bovine  19866881910020
tggcgtgctgcagttcatggggttgcaaagagtcagacaggactgttctgacactcttctttaaaaaaaaaaaatctcataatgatgatctgttccttttcaaggaatcaacgtatgagcacttcaatcagtagaatgcacagaccttgaagaaaaagtgacacaaaagcactgagagataaaattgagtaaaatgtcctcagttaatttgaaaaattccaatacacccttgaaactgctggcaactgaaagaaacctcacagccacgcaaactggaattttcttttcctgtgagttcatgaagctggtggaattgcatatctgaatgtatatgctggtgtttatactggccttgaatgtgttgatcttggagactattcttacataacttattaatgttaacattttctcccaatgcaatatgagctaccataagcgtttgagtcctaaagcagcttgattcctttgtatttagtgttccataaacataatgaggagagcccatttctgtccctccccagagctgtcatttaaaacagccccaccttacacatgtttgccccatctgtctcccttcaagtctgcctttgttttgcagcagaaaaaaaaaaaaaaatgggcaaaatggagatgaaaaacacagaaaccaccatagattgaaaaatatttgaatcatgcccttaaaagtggtttaatttgggattcttggaaaaataaaattcagatgcaattaaccaaagcacgagtggatctggtttcaagacagggactagttttttccagaaagctggacacgctccgtgttgctcccagcccttggggatgtgatgcagtagagttaatgcctcctagtaaatcaggcccggggagttggccattcttcctgcaggccatagggtgccagaactcaaagttagccatcactgtttgcatattag

SEQ ID NO: 47994 - DNA, 3725 bp, Bovine  19866880484152
aagttcctggttgatgcactgctgaagcctaacttgaagggttttgagcgtttacaatgtttttaatattttttatctttcaaatataaaagcacattaaatacatatggaagattctgcccctatttttccaagagttatatatgttcttttttcttcttatcttagtacataggtaaaaagagtgatatttcaagtattttctagtaagcccatgggttagaaggtgatggagctttagattcatgtgcttattaaatccaaagcagtcttatgtctgtgtgattcacctgttacttttatgcaaacagtttaatgtgacacaagtattaagctattgaattgtgtatttatcataaagtaaattaaaaaatgatctaaacagtaggttcacagcaagtattctcctttccatctatgtaattagcatacatgtcagatatctctgtatttttttaaaatcttattcttgatttgttttctttacaataattttcatatacaattatttttactctggtccataaactcttttaaatgacctgaattcattttaacgacaaggagggcactaaatgcttatattacatgtttattggcatgaaattttaatcaaacacatataaaataaacaactatgagtaagcaactgtcttccattatgagcacatatccttcatgtttcccaaattaaaatccctcctgctatttagttagaatatatttctaatattctctgcctgaaaaattataattttctgtacttattattgacaggaagcattttacttatagtttagctctttgtctgttattaagtaagagcagcccactctcagttagtagcaacttccatattatcgaagatgccctttaaaatatgtggaaactgagtacctagtgttatacagaggttgagttggtcaaacaaccattatgtgatgtgtttagtgaattaattttattatttcaactctgtaatgtggtagctttcactggcagatacagttcactattgatacctttttgatctagggtttttgtacgctcattttgaaggaaagttttcaacattctgattttcttcacttatcttctgtaattttagagaaataaattgcctcagtaggttttatgagatcatttcagtatctgcattatttgaaagacttaatggttcaccgaaaatcagagatacattttgtgtttctgaatttaaaatattcactccattggaaatgaggccagagtgaaactgagatcttattatattagtgacaacagtaactgtgatagtataatttagattcattaatgtattcagttatataagacatttactgagagcataccattttgtcaggcatttgaagtaaagtagtgaacaagtagatgaaaacacatatcctgctataatgctataatggagactgtattttataaaatgaatacaaactctgtgtttgtgtgtgtgtgtgtgtgtgtgtgtgtgaacacactgtgtacatgcattgggtgagggaacaataagtgctgtaggaataaaaatgaagtagggaaatggagtctttatttgtagaaggaagttcctgtttaaataggttatttaggggagatctcactgaaaaagctatagtggaatacaaacgaataacatgaatgagggagcagtgaaggtacagggtagaaattctagccaaagtgaagttcaaaaacaatgacattgcaatacattggggaaatgcctttcaaattattacaaatgcaatggagaaagttaggaaaaaatagtaggttaattcaatgaagtaatgggggatctgattgtgtgtgtcttgaaaaaaataaacgcagtgccataatatgaatcatggtttgctgatgtggtaaaaaattgactgatacagataagaaccaaagtaaggagatgagttaggagattatcttaataatccaggtaagaaacatgatgcttagatcatcagctttgttttaataatgttattaagaagtcctttgattctatatattttaaagttagtcaaaataatttctgggagattcaatatgagatttctcagagagggatcagagatgactccaagaatattttcataagagtaactaagaactgtaagaactttaacagaaaaaggcttttaggttccttttgtctaattttgcttttatttatttaacccttaaatttaaaaacttttgcatagcaaaagaagtcattgatgaaacaaaaagacaattaatttaatggtagaaaatatttgccaaataactgataaaagattaatatccaaagtagcaacattatctacaatagtcaagatatagaagcagctaacaacagatgaatgaatacagaagatgtgatatatatctaatctcacagtggaatattacttagccataaaaaaggaaatttccctatttgcaacaacatggatagatccagtgggtattatgcttagtgatataagcctgacaaagaaagacacatactgtatgtgatgatgttaaaaaaacttatcgatacatgcatcatcatggaagtatcaaacgtattttgaaagtgaatgaaggcaaacaaaagattacatgttacacttggcgattgaataacacagggggttaggaatgttgaccctccatgtaattgaatatccaggtaaagctttatatttgctctctgtctccatagttctccatgcacagattcaaccaatcacaaattgtgtggtaacttagtacacatttgttggaataaaatctgcatataatgctgctgctgctaagtcacttcagtcgtgtccgactctatgcgaccccatagacagcagcccaccaggctcccccgtccctgggattctccaggcaagaacactggaagtaggttgccatttccttctccaatgcatgaaagtgaaaagtgaaagtgaaatcgctcagtcatgtccgactcttagcaactcccatggactgcaggcttaccaggctcctccatccatgggactttcccaggcaagagtactggagtggggtgccattgccttctccactgcatataatggatccatgcaattccatcccatgtttttcaaggccaaccatttcttttaaattctagaaagggcacagttatcataaaagaaagcagattaagcatttcatgaagcaaagagatagaccatgggcttccctggtacttcagctggtaaagactccacctgcaatgtaggagaccctagtttgattcctagcttggaaagatctggtagagaagggataggctacccactccagtatttttgggctacccactccagtattcttgggcttccctggtggctcagctgataaagaatccacctgcaatgtgggagacttgattcgatccctggcttggaaagatcccctggagaagtgaatgactactcactccagtattctggcctggagaattccttggactaccaactgaatatggtatagtttcttttaaattctagaaagggcaatattataataaaagaaagcagattaagagttccatggagcaaagagatagatcaaggtagttgcctgcaaaaagtcatgagaacaatatttggggcagtgggaacattctgtattttgattgtggttgtgcctatatgactgtatatattttaaaatacccattggggatttttaatgtttataaactatttctc

SEQ ID NO: 47995 - DNA, 1442 bp, Bovine  19866880633175
tccaaaaaaaaaaaaaaatgaatggttagttttaatagcctcaccttataattaaaatcaacaacaatattaaaaaatcttaagatattagaagagagaatatcaattattttccatcaactcatggttataggtttatcaagtaactggctatatcacactcaaataattcggacatgcctctggcactagaaaactaattacactctttttttacacttaataagtcccataaatcataatgtttaattttgcagcacaataattcatctcaaaaatgtagcttttcttggcaggaaaataacagaacctttattcatatatgaaaagttactggtctataaatttatagtattaggttattttattgttttcatcacttgagattcatgtttatacattgttcatctttcttcacaggtacacttctttattaaaactaaatgtaaacaaaattcaaaagtggctccatggcaatgccactcatttcagttccatggcagtgccgctccatgacagttccacaaatttcaaaccaaacagttctgctaagttgatctctgtaggttcattcctgcatttcacattaagacaactgaagacctttgaaatgtagttatgagagaaagacagcaaagcttctgaaatcctctatttaggaagcttagaatatattttattgctgtttggacttcatttggtttgagggatatacattcatatctttatgattattgaggagtttcaaaatatttccagtagaaatttaggagtattttaatttttgtgccttctgttagtatccatatacactacttcagaaaatatttatgtgtcccacaatttttttaaaaaattgctgaaatatgtataatttagaatcattgtgtctcaggattcaagaacacacaatgagttgtattataagcctttcctttattcctctgttccagtgcttggaaaactacacatcctgatgaccaaatcagggctaccatctggtcagcctgttgatttgtgaaatgtctctggctgctctcatgccacagtggcagaggtgagtacttgcgaaagagactgggtgtcttgaaaagtctaaaagattacctaagtggctctttagagaacatgtttactgactcttgctctattaaatgccatttaatatacatggttactggagtggaattgtacacagtttaacgtataaaatgagagaattggattctagaaaacaagtggttgcttaacatcgtatagtaaactgaagttaattctggtactcagctgatgttatgttatttggaattcagtgtgcttcctctactgcaagaatgtgagaactgcttgttaagctgtgcaagctagacatcatttaaaattaggacacttagggagtgggagggatttgggagaaggcataaaacatgtataatatcata

SEQ ID NO: 47996 - DNA, 789 bp, Bovine  19866880675959
tcatgcgaagagttgactcattggaaaagactctgatgctgggagggattgggggcaggaggagaatgggacaacagaggaagagatggctggatggcatcactgacttgatggacgtgagtctgagtgaactccaggagttagtgatggacagggaggcctggcgtgctgcgattcatggggtcacaaaaagtcggacacgactgagtggctgaactgaactgaactgatgttgcattattattgaattatttccaatttatcattattagatttgttgagcacttgaaagctccattatgattttttttttctaaatatgtgaaaatgagtattttagaaacaaaatatattgtggtgtaaccaaccaagtattaatactccagaaagcctagagtattaatgaaagctgcagtattaatgaagagataatctcaattttatttttgaggttatgaagttaattcaaaccagtgtttcactggcaatgtttcaaactataataaaaaatgccatgacaagaaaaaaatgagttgagtactatagatgtcacatttatctttgctcttgcttctaataacttagaaaatccactgggtgtgttttcatatatacattcactgacaccactgtcatacaagcagtgacaactggacagttcattctttcctcattggtggctgaaagtaattcttttttctagatgggattttaattcacagaaagacatatcaatcatctactgtcttggactatattgtcaaggtatccgttttcatatcaatcagt

SEQ ID NO: 47997 - DNA, 1384 bp, Bovine  19866880841930
acactggagtgggttgccatttccttctccatgcatgaaagtgaaaagtgaaagtgaagtcgctcagtcgtgtctgactctaagcaacctcatggactgcagcccaccaggctcctccatccatgggattttccaggcaagagtactggagtgggctgccatttccttctccaatgcatgaaagcgaaaagtggaaatgaagtcgctcagttgtgtccgactcctagcgaccccatggactgcggcctaccaggctcctccatccatgggattttccaggcaagaatactggagtggggtgccattgcctactccggcaggaactacaaggatggaacaaagttcatagccacttagggatatcccatatcagctttaccttgtgaatatggaagagaaatataattaagaaaaaaaatcaaacacatatcataaaatccctagggatatcttatccttccttaacacaaatactttgttttatcaggcaaatctgggtaaacaatctacctggattttggtatggtattttgcaaagtctcttatagcaacataatggacagaagagaggaatgtagactgcattatagtacagctgtgtggatgcttaggtggtccagtgagaagggagaccctgagtgtatgtgaggggtcatgcataggacaacaggaaatggaatgaagacacaggagacatttttgatcaaattttagataatcaatttgctggtgtgaacatattagaaacagaattcatattcagaagaatgctgaaaggtagattaatggatcaaattaatgagactgaactttgaaggaagaaaaaaatataatacaaagtataatacccctttctgatctttagtgaaacacttcaagtgtttttccccccctcacattattgttttacctcaagggataatcttatctaattagtgttcatttagtacctagaagtcaataactggaattaaaagaatccctagattcatttccagagtatatgatcaaagaaaactaagaggggaatttgagaattacccctcccggcaaatgaagttttatcacaggtaactcatccaccacaagttcatatccttgagcccttgacagattaaatgtttattgcctaaaactgaaaaaaaacaaaaactttaaaggaagagcatgacactcgcctttcagtcccaacattttccaaggtttggcaaccttctaagctttgaaatatgaacaaaatgtaaagactaacagattctctcagtatgatgaggctagctggaatccctacagaggggcagtggctaatggatgtaagtcaagaagtggcagaggaagctcaggtgggtggagggtggggaagacaacttgcactctgctctgt

SEQ ID NO: 47998 - DNA, 1126 bp, Bovine  19866881061299
tatttatctatttagaattccctgaatgttgtgtgccctttgacaaattgtgcctgttatgcaatgttcccactgcttggcctactttacattcacaatctgctggcaggatttctaattacccttcaggactcagcattaatgtcacctttctctgaaatctttccttgtacccttggcaaaaatactgtttccttcctctgtattcttacggtaatctgtacatatatctactatggaacctatcaaaacacaccatagtggcttgcttatgcaccctttcccactttgacagccctgctgttctctgagattctgccacgcatggactatatattgttcaactttttatccctagggataagcagagagcttcagatagagtcagttctaaattaatgcttgaaatattttttgaatgcatgagcacatgcctgatttcctgtcccaaatatattccagtgtaaccaaacaatagagctcttgaaaatcttcacaaattttaaaataagaaagctttcatatgtgacattatggtcaaatattccttctctgaagcaatagccttctttatatgcataataaataatcagacagaattctgccaatatcaactttatctagcttaatttttttttagtttttccaagcttctatattaatctattttctagaataatatcccagatatagtttacaacccttttgttatactatttccatatcaagtcatggtattataattacattgtaagaaatatgatttcactggataaaacaaaattcatttgagcttgatggataaaactacagagctacttgcagaatcgattccatcccactggtatccaaaagtagttcagagggcacaccagaggcaactgataccttatcacaaatgaaaccctgtttctcttaatgcttacgacaaaactcactctcctgggcactcatgcctgactgtgcttgaaatttctgctgtgggaattctctggtggtccagtggttgaaactgagtgctttcactgccatggcccatgttcaatctctggttaggtaactaagatcccacaaatcacacagcttgtccaagagagaaaaaaggagggaggagagaaagaaacat

SEQ ID NO: 47999 - DNA, 1253 bp, Bovine  19866881156145
ttgcagaagaaattattgcttcaatatttatatctctatttctctgtgtctaatttaatgactcatttaacatgcttgtaattcctgagataatattaaaaatctgttgcataattatgcctcagttcttacatggtatttaaattccaggccattatatattattgatctactaagattataatttgaaacttaactccttactgtctgaaattaactaatgctgaaagtatgtttgtcctcatgataaattatcttttcatttgatcaaagtataaaattgtcagtaaagaaggtctgtgttatagaagcaagatggtgataaaatgccaataaattttagaaacacaattatctctgaaagcaagttcttgtctggtgttaagtcgcttcagtcatgtctgctctttgtgactccatggcctgtagcccgccaggctcccttttccttgggattttacaggcacgaatactggagtgggttgtcatttcctcctccaggagaccttccagacccaagattcagacaagcttcttctaggtctcctacattggcaagctggttctttaacactagcgccatctgggaagcctctaagttcttgtctagggcacatcttattagattgctacatttcggaagcttctgcagctgcatgtgtctttgttgatataaggtacctaaaatagcattatctccatgacccagaaagtcagttaaaaggcagccttggttgtaatgatatcatccacatttaatgtctgcaccttggaagtaaagaggcaataaaagcttccccagtaaccctaaatactaggtttaacagcagtgttatacatcagagaaaaaatacaacaatacagttttgccttatctcctgtccttcaatatttctacagattactttttaaaattctaaatatgttacttacaaaatacttttaaaatgtgttgttttgcccaaaatttatgttcagagcctttttcagaggatcagcttcacagattcctccaagtgctcccacaggaggtttaaaaatgcctgcttcagaagaactgcttaacatggtcctccagtagtatttaatataaatgagcttacctaaatctactttgaacttttgaggtaagcttacttgcatataggtgaatatatttctgtttcatcagaaaattttttaaaagtctgaattaattaagctattgtgtgatgaatggcaaggtattatactacagaaagtcacaaagcagg

SEQ ID NO: 48000 - DNA, 1487 bp, Bovine  19866882070970
agaataagttgtttatgcaactataagtctccttctgtttaattgcagcatcaatagcttccatgaaaaatcattgagcttagaattctagcagagtaatggttagacattattttgaaatttctttcttaaaagtccaaagcattaaattgcatggttataaactcacagctcaaataaaaaatatcaagtcatgcaaagcaaatattattcctgtaaaaaaaaaaagtcacataaatagagaaaagctgaatcaagtggaaagcttggcaaatacgtaaatatgataacaaaagctatttccttagcaaagccagattgatgcttcctgttcttataaaacaaatcatattacctcctagaaatctcaagctttataaaaatgtatggtttaagaaagaatgatctaggtaaatgcacatgatgtaacatatgctgaactttacctagtgataaaaattgaaaactgtaaaatcaacaacggtggatttgatagagtctttagaaacagtgctgagtaggttctgtttatattgctgtcatcacatgtaccaagaaaaccagattctgcagaaactaccactccttctcccaccagaatctttcataggcatacacacctataacttgtcaggaagcaattcctataaaggtgtgcatgagtgatggaacttaaacacaactcaagaaggggctcatctctcaaattgttcttttggaagaggatgtaaattagcacgttacatgtgggcagggatggaaagttgatcataactgtagaccgctacattctatctttgggacattattgtgggaataaagccctcagcctgaagtgtttgttttaccttggtcttctattttaaattgaagtatagttaatttaaagagtatagttaatttatgctagtttctggtgtacagcagtgattcagtcatgtttttgttctgtcgctaaatcatgtctgagtctttgtaactccatggactgcagcatgccaggcttcctgaacttcgctatgtcccaaagtttgcttaaattcatttccattgagtcagtgatgctgcttaaccatttcaaactcttccgccctcttctccttttgcctttaatctttcccagcatttatacacatacagacacacacacacacatatatatacacacacatacacacacacatacacacacacacacacatatatatattatttttcagattcttttccattataggttattttgagatatcaaatatatttcccatcttatacaacaggaccttgttgtttatttatttcatatatgtgtatctgttaatcccaaactcctaatgtattcttcctctactttttccctttggtaaccataagtttgttttctatgtctgtgcgtctgtttctgattataaataagttcatttgtatcatttttcttagattccgggtataaataatatatgggggtctgtctttgctgacttcat

SEQ ID NO: 48001 - DNA, 1502 bp, Bovine  19866880070565
ttcagttcagttcagttgctcagtcgtgtccgactctttgcgaccccatgaatcgcagcacgccaggcctccctgtccatcaccaactcccggagttcactcagactcatgtccatcgagtcagtgatgccatctagccatctcatcctctgttgtccccttctcctccctcccccaatccctcccagcatcagagtcttttccaatgagtcagctcttcacatgaggtggccaaagtactggagtttcagcttgagcatcattacttccaaagaacacccagggctgatctccttcagaatggactttattaatttggctttattaatttgccagtctaaggaggaacacagtaatctactgcctcaagaactgtgtcccagtccctgatgagttgctgttgttcagtcacccagtcatgtccgactctttgtgaccccatggactgcagcacgccaggcctccctgtccctcaccatctcccaaagtttgcccaagttcatgtccatcaactatacttcaatatacttcaacagaaaaagagaaaaaacttcttcttcagcaaaagtgaaccctatcccaccccaacccccaaaaggatcacaattagtatataagcaaagttggtccatcttggggcctcttggactatcttatcttcttgtcttttccataggaaagaagatgactagatccagaaagttacagagattcctgccctgcacggagaatgggagatttctgcctccttatctcatttcattagtattgtttttaactctgtgtgttgtattattaaccttcacaaatcttttgctaaattatatgaaatcaaagatgataagagcttgcctaatgatatttaatgttttaggaaatatgataaaggatcagcatgtaaaataaaagttggcttatcttaacaattttcttatgcttacttctgttaaactaatgtgcttttacattagcaaaattatgattttttttcactataagaaaccatttcactgtaaacacatgattcaggaaattaaaaataaaagttcatctgatacttcagtgtgtacacagatcaattttagttaatgcatgtagaactaataactaaaagagaggaaacaaagctagagaaacggaaaggagacaaaaagggaagtgtttctgctcaagtacattttacgtttaccaggaatttttttaatattcaagtacatatccatgtgcagatggctgaaggagagtgtttaggactaagtaaactatgcttctttcatgtgtaatataaataaaaggacatagtccactgatccattataagcactagttaaaaataatcctgacccttcagcatgaagcttatgcaatgtactcattaggacttcattcagcctaaggcaagtcaaaaagggttttaaaaatccacacataaaattcagaatataggataccccagctatagttgttagtattctgttctatgcttttggtgaataaaaatg

SEQ ID NO: 48002 - DNA, 1719 bp, Bovine  19866880126431
tggtacatatacacaatggagtattactcagccattaaaaagaatacatttgaatcagttctaatgaggtggatgaaactggagcctattatacagagtgaagtaagccagaaggaaaaacataaatacaataaactaacgcatatatatggaatttagaaagatggtaacaataacccagtgtatgagacagcaaaagagacactgatgtatggaacagtcttatggactctgtgggagagagagagggtgggaagatttgggagaatggcattgaaacatgtaaaatatcatgtaagaaacgagttgccagtccaggttcgatgcacgatactggatgctttgggctagtgcactgggacgacccagagggatggtaatgggagggaggagggaggagggttcaggatggggaacacatgtatacctgtggtggattcattttgatatttggcaaaactaatacaattatgtaaggtttaaaaatgaaaaaataaaaaaagcagagacattactttgccaacaaaggttcatctagtcaaggctatggtttttccagtagtcatgtatgtatgtgagagttggactataaagaaagctgagcgccaaagaactgatgcttttgaactgtggtattggagaagactcttgacagtcccttggacagcaaggagatccaactagttcatcttaaaggaaatcagtccaaatattcattggaagggctgatgctgaaactccaatattttggccacttaatgggaaaaactgactcactggaaaagaccctgatgatgggcaagattggaggcaggaggagaaggggatgacagaggatgagatggttggatggcatcactgtctcaatggacatgagcttgagcaagctctgggagttggtgatggacaaggaagcctggcatgttgcagtccacagggttgcaaagaattggacttgactgagtgaactgaagtgacaacagcctccattttgggcatacaatctgtgggtattaattagaaaagcctgcacatcactatttccttatcatcttcaggaactgttgttctttgtccttcatgggacagagatgataaaaacttcaaggctctgaagtttaaacacatattcatgcattcaaaaagcatccaggtggcacttcttgccaagagagctagactgctaatttgacacatcaaatgagccttttgaactgcaaagggttaacccagcctgccagccaagctgggggagaggagctgactcccagatgccagtgctagcaaaattcatcctggagcttagcatctggatgctccacctgccaggcaggccccagcaggtcctttttgtcactggaccagattaaaagagaatgatgagcagaagaggttctgcaccaccagggacaaaaaggaaaatggcaaaaaagccatcctctgccaacagcaaggctccccaccgcctccaggtactaatgtcctggaaacactggacaggagcgtgtgttaccttgtccagacaccacctcagctgtctggctgctggaggaaggctcgggaacatcagaaaccacagggtaggccaggctgaaccagtcccagaaccttcagggtgctacctgtcaagttttcacctgagcagacaggatttttaagtatgttctttggtttcaggctccggcaacatttgtcaggacacccagcccccatctccac

SEQ ID NO: 48003 - DNA, 978 bp, Bovine  19866880173318
cctgggatttctttggaaggaatgatgctaaagctgaaactccagtactttggccacctcatgcgaagagtagactcattggaaaagactctgatgctgggaaggattgggggcaggaggagaaggggacgacagaggatgagatggctggatggcatcactgactcgatggacgtgagtctgagtgaactccgggagttggtgatggacagggaggcctggcatgctgcaattcatggggttgcaaagagtcggacaccactgagtgactgctttgatctgatcttgaggccacagtagaactggtctcttccacttattcaacatctaacataatccagcagttttgctagttgctgcatttctgggctagtctcttagacttctggagtcacaggtgctcaggagaaactgcagcggggtctatggtctgacaggcttggtttggtgccaaggccgctcctccatgatattccttctcagtcagctaactcctctaatcttcaggctgcccacctttcaaactgggataggaatactttaaatcacaggttgtgaggagtctcaaaattcccaacgcaaaaagacttcactgacatggagcaaacagagagcaaaaccccctacaattccccctcatttcaggtttaggacataggttcccagcaagatgtgcctgaaagcaaataaaacatccccaaagtgcttaggcattacaaaagacagatgtcacctatctgataacaggtgggaggagagagaaggtgaaatgtggaacttccatgggagattctttaagtagatatattctagtattatgactctttttgtagttttgctctggggaaagtggtttctctttgcttgcttaacctgtgttgtagaattcctgtgtgcagcctggcaaattattgccatatcctgtttcagagatggccgctcttctgtcatgggtagaaattttccagtgcataaaag

SEQ ID NO: 48004 - DNA, 3880 bp, Bovine  19866880406041
atggaagaggaggaagaaggaacagggagacacaactgaaacatcctttttaaacagaaggagaaccaggaagataaactgcctcaggagtcaaatagggggagtccaatcctaaattcattaaaggcaatgggcactaaggaaaattctggatttaataattgaaaagttactgatagaccctgagattattattcgggatagaaaatagatgatagggagttgatgcactcagtgagaaatggaaggaagcagatatcaggctcagggaagtctggttatgaaagaagggaagaaaaaattgtagcatctggaccatgaagcttagtggagggtgttctaattgccattgtcattggagtgtttggagaatgttgagtaagtgcaaatgcataatattaaatttatgaaacaattcacccaaagccagaaaaagtattcccagtactaaacatggcttggttatggtaccaacaaatgtttattgaatttgatctattaaatttgacaaagaggctaagaacaggattcagtttaaagttcaaaaattaagtttgggatcatgttgggatcagaccaaaggagaggtgttcctggggctctggacatcaagtttaacgcttcacagatgtacacgtgtgaccatctgtttcaaaggagaggaagaaagacaagcctaccatctcacaaaactgttgcaaaaattaaagtatgtatgtgaaaaattaaagtatgtatgtctaagctacgacagtcattattcataaatttattttaattctatgtgatgtaacacaagactaataagggcagagaaagtcttaaatttgcagctttaacccctgtatgtagaacagtacctattatgtagcagatgcttgctcattgcttatcaattgaagaatggccattccttatatataaaataagttaaatcaatagaaaactctgtagagtgatttagtcctactccttaaaatgtcaggctctccttagaggaatttaatttaaaggttctgaaaataatatacagtcacacatatgaaagggtgttttaaaattgagatggtagaatacacaaatcattcctttaaagataacttcaagacctatgtccctagttaattgccattaatacttgaaaatcaagtcaagcattatctcctccaaaaagtctgccttgactacccagtctcggctaaatactcaccacaaccccaccaccgacccaccacacccagaccttctgtaggacagtgggaatatccctttcacagcacccttcctgttgctttgaaatgtactggtgtcatcccaccagtctttaagtcccttcaggtcaattgggttgtcttattcttctaatggctgctatttactaacatagtatctggcatgtagtagatgctaaataagttttcactggcgtgaactgaattcatgatgactttcacagatggtatcaattttataacctaattcactcatgcattagctttcagccagtttttcagctaatccctgttcatacctggaaggaatgataacatatcatttcataaagactttcaggaccactttcaagttaccaaacatcattttaaaggaattctgatcagtactagcttaaattagatatcagaaaatgcaatgcatacataagtgtttgcagtgtttatataaagctaaactcaacagtttcgtccgtctcctttccttgaactgctgggtaaagcaaatgcatttctattagagccagtttgttttgtgagattttgccaacaggtgctccagcttcttcattctatgtacactttccctttacttgcttgattactaaaactagaattctgtattaaagaatttacttgtgatctctataaagactgatctttacaaataaggctttgtgggattacatacaaagtgaaaatttaaggaccaactgttccccagcaatgtacaacatgtggtcagttgacagtgtcctgacgttttcttacctactcctttgctcagtactgaaattctggtggtggtaagggtggggaggggaacagggagagatattccaggcacgcatctttatattcacaactctcagtatgccaaacacatacaaagtcccactctaagaaaatacagtgtaatctttcccttccacatatgacatgccagcctatgtccatatattccagataactctctctgataaatatatactttgtgttacccatctgtgcaaccgccatacggttttaaagccccacagttcacagaaaactgtcttagagaaacaaacaatggaaaaaacatataaatatctgatttatttctctgaatagggacctccccagaagaaaatatactacaacatcttcaaagcatgcggtttatttttgagagaagagggtgagggtgaaggaggcatcatttttctgcagttttaagtggtatctctagtgatatttgcaaaagtatttatgattctcatgagttttaaaaagttggctttgctatgtactaattaatcttaaactcccccaatactgctttactcttcttttccccagaaattcataatataggcatgcgcacgcacacacacacacaacacactttatttccctggctaattacaattgtattcattatcttctgtccttttccctcctccatatctcttgccccaacagagcattcttgcacattttattttgtcttatcctgctgaacatccccccactattattactctgcagcagcccctgctggtaaaacgcatcattcagtttatctgtccttagctgtgtgtgtcaggctggtgctaaatcctcaacaggccatgccatggtctagccgtgggcgacctgcaggcccggtggggcctcaacagggctgccaaccctctgcaggggagcaactgtgccttgtttccagtgtggaaagagcaccagagaaacacataattttcaggaggttttatttcccttgtttctagagcacagaaggaaaagggggtttgaaactgtttgtgactaaaatgataaaagaaaatcaatgcagcaaagcgtagactaccagaaaatctttggttgaagcacaagttgtgacatgatgtcaaaaaggcattcttttcacagagaaggcgtattaaattatgcgagtgctgactgcttctccaaggactgttgatagatgcttaggaggggaaaaatcttccttcctggttgaccttaaaaactgtcttactccaggccttaaatgtttaaatgtgaatataaaacactttttcattgatcctagaaaaaaaatattctcaacctgttctctttggttgtggctcatcatctgcccatgcataaagatctatgtatgtgtagatgggtagatagatgtatagatatattaattcttagctaaagagtaaatacatttatcattcagaatgacagaactagagtggaaaacacccaggtgattgcaatttgctttgccatgcacccatgaaaagtccctgtagtggaaagaaaatagagcaagcaggttatgataatagaatatatctatttttcctcacatttgtcactatatttaagccaatattcccaaacagggtaaaatgtatacatttgtaatatggatacaattcccccaggactttgattgtggcaaaagctgtggaactaatctacaagcaggtcaatcatgtcacagagcaaacaaggcgttgattgggaaaaatagaagagaacaatgggggacaggaaacaggacacagaagacaaaccgatttgagaatctggaatatgtggctattttggtatcaggaaacctatctttaaaaggaaggagaataagcctagaacaggggagacgc

SEQ ID NO: 48005 - DNA, 1044 bp, Bovine  19866880418538
aaaaaaaacagtggattagaaagagcccttaaaattagaaatatggtagcagaatacacaattcaataaaaggactagaggatgaaattgaggatctcagaaaatagaaccaaaggggacagaaaatagaagaaagaaaagaaaattagaaaatcaatccagaaagtctaatatcaaactagtaagagagacataaaaacaaagatgaggaaattataagaaaaataataaaagattttccagtcatgagaatacttaaaaaaaaaaaaggatcttccctgttttccttcttgggaggcagctggaagatgagctcaggcaaatagagagtaaacagagaaagaccccgaaaagtgggtagccatggaaaacagcaaggagatcaaatcagtccatcctcaaggaaatcaaccttgaatattcattggtaggactgatgctgacgctccaatactttggccacctgatttgaagagctgacccactggaaaagatcctgtgggaaagactgaaggcagaaggagaaggggacaacagaggatgagatggttggatggcatcactgactctatggacatgagtttgagcaagctccaggagattggtaaggacagggaagcctggtgtgctgaagtccatggggtcccaaagagtcggacgtgactaagtgactgaaaataacaacatcaacaatctaaaacaagaaggaagaaaacaaagccttagatgtgcttgggaggaggagctgacaacttgatctagatcgacatctagttaaaaactggaagaatattagggacaattacagagaaaaggagaaacaattaactttaggaaaagataatgtacaagaaaggaaatgtaactgtagcacacttgttgactcagtacagtatttgtgtagctataataacagaaaataacaattatgagataatattgacaggaagaagggatgggaagcaaggatgaatggggctgaggatgaggcagcaatgttaagtctcagccaccgtgtatatgtgtgtgtgttctgtgtgtgcg

SEQ ID NO: 48006 - DNA, 805 bp, Bovine  19866880433046
tagatgtcatctcatcccagtagatggcagataaggaggtttgtactttgcagcagtatcatgccaagctatataggagcctgaggcaaaagcaaaaaatcagttgtcctggggctacctttattttaaattttgatattttattcatcatggattttttggtactacttttggtttaaatattttcttgaaacattatctctattgttcctccttacatttggcacccaaaacaaaagggtgtgaggatacataaaagggtcttggggtctcgccctagtcctggccatgcatttcagagtccagccctggctatctgcatgaattctgccaagttcatctgcctttctggaccttagagcacctgagatgtgtcaccagatgatgtttcctcgcttcgcattattatctgacagttgagaaagccagtgccatgtacgatgcctgaagagctggcattaaacaacaccagagcagtcttgctgttgtcaaaaatgccagccccaacctgcatggggcaggctcataacagagctggtgccatcatccttgaggtgggagccacttcgacacgtcaaagagctccaaacggggtaaataatcagctgtgaaccctttaggaggagttttcttcttttttaaaaggaccgtgcacaaaactacgaaaacctgcagatatttaataagaaccagcatctgtgctttgcctgcttccaattacacagcattatcctagtgccagactggggctgcttacacgcactgatgcttaaagcacagccatagcaaaagctggactgacatt

SEQ ID NO: 48007 - DNA, 1732 bp, Bovine  19866880460880
atataaacatttatgagccatggggcttccttcataactcagttggtaaagagtctgcctgcagtgcaggaaacccaggtttgatccctgggttgggaagatgccctggagaaggaaatggcaacccacttcaatattcttgcatggagaattccatggacagaggagcctggctggctacagtccatggggtcaaaagaatcggacatggcttagtgactaaaccaccagcaaacatttatgggctgaatgtagaaccctagtcagataggtttgtcatgaaaatgagaatagacaaggaaaagacaaaacaagttgaatggaagtttcagccccattatatacttacaatcattgagaggaatcttaattttctttgttttactttcttctccaaagaagcagaagtgctgaaagcagaactttgcagaataaagtttcttattttcttacaacttacttgcatagtactttaaatggatctagatatctgttattgtcctaagctcttcctccgggtttaacttattaaactgtaatggttttatttttttagtattttatgtgttcttgtttattcctgtaagaattttttgaaggacacttgtctttcatcagaggaaaaaaatggagtatagtttaatttttggaatgttgtttttcgtgattctgaccatggccatgaaatgcaacagcccagagagaaggcagcaatcaaacagtatttggagggatgtgatactctttcagtagaggaattgtcaaataattcataaatataggcaaatttgaccttatttactttttatagttgcaccatttaattgaatagcagaccttttctgacttgcataagccttaggagaaagttaaatatttaataaaacttggcttttcctaaaagatttttttttactgtctcctaacaacttgaaatgcaatttagaatgaactctttagtagctgaattgtttctgaaggtttggtaaaacaaagtatttatcaggaagacagaggaatagatgttcagccttctctccactccaccctgtcgatctgctggacacttcccgatgaatgttctattgaaaaactgaatatgtaaaatcctgaacttctttttcctttccttgctttatcctttcatttcttctttccatccctccctcctttcattctacagttaccaaatctctgtatgtatcatccacatgaagacctgtgcctgtaactcagcttctctacaggaaacagtgtctgtcaactaaaacaatttcacagttaaaaagttgagaattatgttttattcagtggacaaatctgaggtcttaagcctgggacactcctggtggctcagatggtaaagaatctgcctgcaatgcaggagacctgggttgggaagatcccctggagaacgtttgatccctgggttgggaagatcccatggagaatggttatccactccagtattgttgcctggataattccatggacaaaggagcctgatgggctataagccatggtgtcacaaagagtcagacacaactgagtgactaacactttcagcttttaagcctggaacacagcatctcagataactcttgagactgctccaaaaagacaaggttgggacatccaggatatgtaggaatttttgcaacaaagaccagagagttggaacatccaaagtataagagtaatgttaattacagcaaagtaatagctcaagata

SEQ ID NO: 48008 - DNA, 1412 bp, Bovine  19866880505986
tttctggagaataatactgtgcactaattatgtgggaatcctgagcaatagaacatactgcagacaaggcaattgcaaagtgtacattgagtaatcagacggtaacaagagatgccagtgtaaatgaggaagaaggcagaagatgcaggaaatggatgagaaatcctaagagaaaaaatcctaacagatgatgacagaatgtaacaaatttacaattttgttaaggtgcaccacagaaaactgctaccagaaataaaataccaagatgaattacttgtaaaacaggagacggcactgcccaatctactgctagtcaaatgactctagtcgaatccaatgccctgataccattccgttctctgatggaagaagaaacaaaacagagaaaaaaggaaagggggaaaaagccgcgtttatgggcacacactccccaatactatataagcaaatccaaccctcctccctttctgtttacagcatcaccacagtatataagaaaacatgtctacttacagggacttttaaagcttctatcacaacatgccaaaggtatgctgggtaactaagcatgtgactgacgcattctgtggacctgaaaattgcctgtagctctaacctaaacaacccctttctataccctctctctctaggtttccctctaaagctttcagaataaattctggtttcttttgcaatacaacagagaatacaattggtaacaatgagatactccctaatggtgaaacaagcatgacattcctgacctacctcataatttccttaaagttgttttcagattcagtcacacagacaaaaaccaaaatagatccctagaaaaatatttaattctccacaaacttcctccccaatcttcctaaattagtgtttgtcaaatgtcttcagaaatctgcaagatattgaagatatgttcattttggcatcatttctatattaacatgccctcaagaaccatatttctctgttacaaattatattgttcatcttaatgcaggcttcggaggtagttcaggatttttatacactttggcttgtacagagtaataaattgtgtttcaaacacaaagacacatcctgaacacagccaagtcactgggataatccatggtttatcactctctacctcaatactttgtccactgaactatgatgtcagaaatctaagcttgatttgtttttaagtacataatccattaactgtttccatatgccataactggttcagttgagaaattatttataaaccagtttattgactctatctggcaaagaggacacacctgttataaaatgtgattacttcagaaagctaacaattgtggaatcacattttcataattaatcagtctaaacgaattagactattcatatactttcagaaagccctttaatcc

SEQ ID NO: 48009 - DNA, 2515 bp, Bovine  19866880568187
ctttgtttgtgaaccgtacagggtgggcagtgcttctcgctcacttccaactctgctgagttttcttggtgaacacctcagcatctgctcaatgaagagggcaaagaaaatagcagataagttgcaaggaatcagacacaaccgagtgactcagcacagcacagctcagcaagtgaataatagatgaaatcaaattagatcaccggccatcaccagatggcaagagcacagtcatgggactcactccagggtccttaccacagctctgccctcgaccagccgggtgggcgatgagttccaagctgggaggctgtatcacgacatggagctgagcgctgggatggctggtgactcgctctgcacggatgttagtttctgttcagtttgacacatggttctgttttatttaggccctctggctttgctttaatgacttgagagaaacagcagattttcattcctttttgcaaatattttaacacttcaagattgtcattcgcacagttgttacatcagtaacaaagcaagcctgagcggggctggagcaggggtgggttccagggaaatagcctgtctgtttcttctttgcctcatctgccatgtatatttcagatgtaaactggagatggaaatgtttccaagttttcttcttccagaagtattgatctcttgggcagaacataaagtcttcaccccttaagctttatcaccatgctttctctaccttatcaattcaaatggatttagcatgcattatcagtagttagatcttgactttctttctacttctttctcctttaaagcaatctatctagttgcaaatgtcttgttagaagagattatatgattgttttttgggtttgcagtctgtttgaagaactggcagcatacttggggatttaaaatgatgtcttaacaggaaacagcttctctgttgaaaacctgatttctcacataactgctttttctttcttcacaaaaatttttctacatttgatcacattgctaccaggatatttggttttatttaaatgcagcaacacaaacatcactaatctggtttacgcaaattcatttgtgcactccctgtcaacaatggctttatcagccatcagaatctaattgaaatggtagtgctgcatgtagtcatccaataattagaaaataaacagattgaaaattcagaggcatttgaacaaaagccatcaaagtaacataaataggagaaaaggtaattaaagagctttctctcttcagctttcagcattacaggtttatttaaatacagctgtagcaagagacctgagctggattgattggacaaatttgttggctaatgctgttctgaaatatgccccattaaaaatgtggcaaagaaattaaaaaagcatgataatcatggcacctcaaagcacactttattccccctctgagaacctccatggcaatgcatacatgtgacagttaataatagatgaccaaaggcactgccctttatcatctaaataccaaatcttcagagacctggggaaaaagagcagtctggtccctgactataaaattgtgacgtcagaaggttgctctacacaggctacaaacctccacttgggcttttctcctgctggagaaaaggaagctctctgactatcagaggcagtaatgcatgaatgcaagcagtttagcaataagcaattcaaacttctgaaagagaggtaacaaagcccaaagaataagccctggtcatgaatgtatatatagtcccggggctggttggcatagcaactatttctgagaacctggtgctgcttaagtaaacagctgaagcacagagcatgcctcagcgaaagctgggtccatctgtagtattagcatgcaaggatcagaacaggaacattttctcccgcgaatcaatgatattttggtatttcctcctaataactctactattctcagtgtctcatggcaaggctgtagttctctttgttttttcatacaggcatttcgttgaagagtctcagtataggtgaatctgactgaattggtttgggagtaactaaaagagtctggggcgcccctggtggctcagatggcaaagaaaccacctgcaatgcaggagactccaggtttgatcctgattcaggaggattctctggggaagggaatcttcagtattcttgccttgagaattttgtggacagaggaccctggcgagctacagtccattgggtcgcagagagtcatacacaactgagtgactaacacacactcactgaaaattgtccaagatcagcatctttcacctgttatttgctaagagcttccaaagaaatcaaatcaatgattcaacagcaactcatgatgatgatccaacaaaaaccatatctgctgaaggttttactgcaaagttcagcacaccaggtaattgcaaaggttttggaatcagaccaacttaggtatagtttctggctccactatgaaaaatgatgtgacattgggcatatcacggtcttttagg

SEQ ID NO: 48010 - DNA, 2457 bp, Bovine  19866880580131
caaggagatccaacccagtccattctgaagatcaggcctgggatttctttggaaggaatgatgctaaagctgcaactccagtactttggccacctcatgtgaagagttgactcattggaaaagactctgatgctgggagggattgggggcaggaagagaaagggatgacagaagatgagatggctgggtggcatcactgacttgatggacgtgagtctgagtgaactccggtagttggtgatagacagggaagcctggcatgctgtgattcatggggtcgcaaagagtaggacacgactgagcgactgatctgatctgatctttatgcttttaatttcttttagatttaccaaggaataattgacaaacagaatttatatataagtaaggtataaatttgatgttttgatatatatatggcagaagtttgagctgtgactccctcggcggtgaaaggaggaagcattgtgagcggtgtcgctctgggcagtgagtcagcagagggaaggggccagcagcttcactccccttgttcctgtctcctgattcttaaaggagttacaacggcccagtcaggtctcaggttgacagttccaacaagtatttctcaatatgattcataacaaaacttaagggttgaaggatcttgtgtaaaacatacacacagaggtgatgggccaggaatgaagagaccttacctcttgttctgatattcatcattcagtttcctcatgtgcaagacacgaggacagttttgaaaggcttcttacattaaaattgtataattctgtcaaaaccaccgatgtaaacatttccgtgttccgttgaactatcatgcttcattaccctattgttatttaactcccatttcaaaattactgggtttccctgatagctcagttggtaaagaatccgcctgtaatgcaggagacctgggttcgatccctgggttgggaagatcccctggagaagggcaaggctacccactccagtattctggcccggagaatttcatggcctgtatagtccatggggtcgccaagagtcggacacgactgagcgactttcacttcacttcaaaattactatgttaatatttatctgaagatatatttatctgtcaaagatatacatgtatatgtgtgtatttatgtatatttacacatactatatgtaatataattttaccattattaggaaatattaagaagtattggggcatatgccattatcagggcttccctggcagctcagaggtaaagaatctgcatgccataggacatttgggtaatcccaggtttgggaagattccctggagagtgcatggaaacccatgtattcttgcctggagactcccacggacagaggactctggtgggctatagtccatggagtcccacagagtcaggacacagctgaagtgatctcacatgaatgcaagcaaagcacattttaaaactgataatggtatgcataaatgcttaattctgtgtgagtgaatgctgtagacagacaagtctatttgctgaactggagggcctgtgtgttaaggggaggtgggggtcggggacagtaagattttggcaggaaaggcactccaggggccactttgccccttaaatctttgctctccaatgaattgaagactccttagaagggaagttcttccttggggaagagttacacaccttactgcaatgcttatgtccatacctagaggagctctattagggagcagacggagagagaaggaggtagggagacagaagggtggaggtgcgcgcagaaggcccaagcttttagtctgtctgccttcagctaccccagtgctgtatccggctttcaaggattcccatttgaggtgaccaccccagaaaaacctagaatgaattacctctattatcattctctcctaacattagatataaattgccacagataaaaattactttacagcgaaagtactcttaaggaagaagttcattgtctaacaaaaataaacaatttcatctgaatctgaataaaagcagtaatcttcaacaaagagcttctttcaatactaaactcatttcacttgttttaaagtatctaacctcagcaatatgtcttttgtgctcattaaaagaaaagctttgatgtactttttgtttccagatatgttacatcttagttttgctaattttggtttaaaaaagaaaaaaaaacctctcacaaattgtgttttttttttccttcggattctaacaggtaattcattttgttttgtatttttgttaatgcttggtggatattctaataagcctcaatgcatcagatgtaatggtaaattttgacttaggtattcgcttctgattatttccctactgatcattccaccacttacaagagcacagcaattcacacgtattaagaagaaaatagaatacaccagaatatttctctttatgaaatatccaa

SEQ ID NO: 48011 - DNA, 1602 bp, Bovine  19866880605386
tgtgtttattaagaatgcaagctcttttctttgcataattcattttctgtagctactcttcctaatcaggtcgttgcattctgtaataagcgtcttaataggaatgcatgactataaaaataggctgaaattcaatacacagaaacagtgagcttcagaccagctagcagaaagatttattttagcaatatagctctgtggaggctgctgcctggtactttttatccagcttacaacattttatctccttatgttggtcagagttagtcctaagagtaggattcatctttaggaaatcttgagtgtcaataaactatactggccttcctgaaggctccagccccatacattctgaggagtaaggcacaccatcccagtaacatattggttctttccgactctacactcgacctgcctcttcagtcaatttgtccgtccctctcctagtaacagtagagtcatagcatttgcagggggcaggtcacagagctgtaagcagggccattaaaacacaataatctttgggaatcgtccacgttcacagcaccttcccctccctgccactgcttttctgaatgcaaatacagctaaacagaaccctatggagcatcccccaagttcccttccccatatcctctgctttagctcctctctgaagtacatagataatagtatctgatgcgcaaatcctgaactgttttcagttcagttcagttcagtcactcagtcgtgtccaactctttgcgaccccatgaactgcagcacgccaggcctccttgtccatcatcaactcccggagtccacccaaacccatgtccattgagttggtgatgccatccaaccatctcatcctctgtcgtccccttctcctcctgccctcaatccttttccagaatcagggtcttttcaaatgagtcagctcttcgcatcaggtggccaaagtattggagtttcagcttcaacatcagtccttccaatgaactgttttacaaatgctaaaatccccaccaaatggaagaaattaactactctactgatgaccatgagcacatggccccaggtcttctggtgcctgaggactgataatgataatccctgtgacatcatcatcaaacagtcagagaattgtgtatgagccgatcacatagcctgggatgtcctcccctcatcttgcctttaaaaatgctttgctgaaacccatcgtggagtctgggctctttgagcactagttgtcttgaactccttgtgtggagccttaaacactgcaatttcctttaccataaaccaggatcaacagatggactatactgtgtgccagtgagtggaccctcatttggttgggtaacactaatagccagttttatggtgcctttcacaaaattcccttgccctcagtgagggattagagaattttttgagaaataactctttcagataaagagatctccagatactgacatttctcttttaccaaaagccttgttttcttcagaactaaacatcatccagtttagctcatgggtgggagaagtcatgccagtgtgcaccatgctccactgatggacaagtcatactcaggaacactgaacttctaaccagcaa

SEQ ID NO: 48012 - DNA, 3489 bp, Bovine  19866880613222
ccaaggagaccatacagccaataggacagtatggaggccacatggttaaagctgagttagccagaggagagtggtggaaaatgaggcacaaaacatcggggccgtgttacatatgcagaaacttgtcacctatagcaaagacttaggctcctcctccaaggtggaagccagaataaggttacagggagagacaaagcattctccaccttatgtcactgcctgcttacacgtgtgctcagtcgtgcctgactctttgcaaccccgtggactgtggcccaccagctcctctgtccaccgcatttcccagacaggaacactagagtgggttgccatttccttatgtcactagctgctatgttaagaacagactgcagtgaagatgagttgacatagatatcacttcttagtattatcaaattatttcacaacattttacatttttacatgcctgtaagatagaacataaacaatacaatgtaccttttgctaacacatgaaaaagtggttagaccaatatacatcacacttgaaaattcaaactttttgagaaactcacgagagttagcaactcaatgaaatagcatattgttctgatcatgctgtgtttttattagttttcataaattaaagaattgcagagttatttaacatagctgacattctactaattccaggggaatatgggtaacaaacgcttctaagagaatcactccgagttcaagtccacttaccttcccactctacagagaacacaatcggtagtagatgagtggtttttcccattaatgacaggatttggtattactattttgatgtagatttgaactaaatgaactctatcccttgaataaacgagagttactgtatcacagaatatgtctgcacacttctggcattttaacattatcttagttcataatataggcactatacattttttactatatcagaaatgattccattttccttcccaagagcaagacctacaggcaaaagtagttttttctttcttttcacagatacatattccatgaccactgttctcatgaccaccagcttctttccaaaagtccctgatgaattttatcccacaaatgccaaacagccctctcaccctgcctcatgcctagcttttgaaacaaactgcaatagtgtcatatcaaaaaatcaccttgtacaattccctagacccgggattgcagttttcctcagagaggtggtaaccagcagcaaaaacaaataaacccttgcagatggtgagtccctctccagggagaagactgagataaacagtcaggtttgcatattttgttgtgccctcatggcctcctgtgttacatttctgattcacaccctgggtgatctcatctagttccagagctttaaattccacaagtatgtgactagctcccgaatttatgccttcagcctgacttccagcttacatcccaactgctttctgtataggtccactcacacagatgtttcaggtgatcttccctccctgagtctgcttctctctcttaagtcttctcctattctctggaaataggatctcctatctatctaattgtacagggcaagcaccttggggtcatcctggactcttcttattccctaaatccaacgtattggataccctggcttccttaattttgaaatattatatagcccttcgtaccatggacactgccatcaagccaccaccctttctcaccttcatcattgttctagcatgttaagtggccattggcttcaatttatgcccctaccccaccacctgttcctcacacagctgacagaataatcaacctgacctaaacctaaagcacagaccagataacttcacttctccatataaagatctccagtgatttcctagcatgacggccatgggccccacaccctgcaggcacggtcctggggcctccctctcctttctcctgctgcccgcccctccactcgctctgcatcagccaggcttccctgtgccaagccccactgaccccaaagcccggtgctccgcggcctctgtctgtgggcagtcccccgagccagtcactctggtgcttgctcagagggcagaggccctccccaggcatttgatcacacacatgtacccgcctcgtaccaccatgggctgaggagtactgagggtcacctgacccagagctttcatttcttatctattgtcactatatgcgactacaatgtaagaccaaggaggagtaagagacgtattccctgcaacaaactcagaatccagaaaaaggccaagcacagaggaggtgtccaataaatatttgtcaaataaatgtacaaatgagtgaatcactgctgaaccaagaggacaggtactgaaatgaaacacatgagatagtggtttcgttaccaatataatctcaaggtctaaattcatccatacaagtctggtaattcagacccactaaccaaaggctagtggacatggagccactttctcagaatcatctaaatgagaactcaaattaatatcagaaatgttcttaaatatactcaatctaccaacagtgaagccatgttaagttcaaccataaaaaaaagtctctaattttctgtatatttcagtatatttgcctaaatcaataaatctgttatacattattttatactaccaaaaatcatgtaaagaaaaggtgtaaatggccttttaagagttttgtcaacatgtacctccaccatgtcatatgtaggcagaattaagatgcaatctgtgagagaaaaaaaatcttcagagaaaatactaggatgggtgaaacagaaatttctcttacctgacaactgatgtttaactacttaaacctacaaaatttctgtaagttttgctaaaaattcaaacggcgttgtgatcattttgacttggaccactgactgagatgaaaagcagaaatcagattataaggaaaatgacagcagcatgacatgtctcaagaatttcaggctacagaccaatgacaactgaaagcaagctaaattaataagctttaaactaggtggaagaaaagccatctgtgctagagagcctatattaagtactggatcctggtagaaacatgtcaagaaggttgcaaagcaaagagacaagaataactgaacaacagctgaatgtttatgatcttaagagaagcagacctttaagatttaaatagctatggacagagttataacagtttattattctaaacaaacatcctcctgggatggtgaaagatctgcaaatgaggttgccaaagtgctgtctagagcatactgaaatgtgaaggacctgggacaaaggctgcaactgaagacaaacagggctcctatcttccaggaggagagactggagagatttatgtcactgacagacaagactgaagaagaatactaaggagaaaaggaaacagtaattacaagaagccaaaatggattctaaaagaagaaaccgataattctgtaaacatgaacgat

SEQ ID NO: 48013 - DNA, 1564 bp, Bovine  19866880637769
catgttccaaggtcaggatgttttctgggagctagaaaagacagacttggaaagcactaccctcatttttatcttattgaaatatgtcacctggacatggcagaaagaagaaaaattaccattgaaacagttagtttcctgctttttgagactgaaaagatgattgcacatgattaggtcatagaagagtgactgataaatggtcatatattcaaatattggtcatatattcagcttttctggaataattccaagaaatcagcctgttcctgctctccatcttgaccatgtttttactggacgtgagagggtcaaagccagagccggccttggattttagggatgtcaacaggctgctggctctccgccctggagcgttctcctgctctctgcttgttatgcaggtcaaacctgagagcccttctgtgagctggctgcaggccttccatctgtctgaagctcagtggaacttcaggtatcacaataggagattcacatgcactgacaggatttttatttcacctgctgttgatggttgataaaggagacaaaagtggaagtgccatatactcaggctattccttttctatccaggattcactgaataaatatttattgaccacctactaagtgccagacgcgtcctctccttggtgctaaggatgctgtatggaatgcaaatggacacaattctgactagtacagttggggagggatagaaagacagtaattaaataatttttgaagtaaatgtagcatttcagctataatcagtgttaaggagaaaaagtgtattatgttttgagaacaggtgagatgttcttttctcacttggtgaggttagggaggattcttagaggaagtgacatctgagttgagatgcgactgatgggtaggaactcactaggtgtagagtgggaggaatgggttaaggccctgagcagaaaggaaccaaaggatggttgtgggcttgcattcagagaatgtggtgaagtgtgggtcaagatgagccctcagaagggaaaaaaaaaagaaaaaaaaaaccctttaccattcttttagagaggagttataagttaatatttatgaaagatcactcactgcagtatagagaatagacccaaggtgggaaaaatgattattgggtaataacagttaagggataatttcagtggcccagctaatcaataaaaataggctggagtaggactgtggcagtagagaactcacactgcattttggagacagactagtaggacgtactgatggattaatgtgcctcaggcagagggaaagtgaggagcgacagatgatttccggaacactgcttcgcaactgtggcgatggtggtggcagttagtgttcaatcagaaggctaaaggggaaaaccattttggtctgttagggccccagattaatacaataatgtttttttttttcatttcatataaagttcagaactcctaaatcattatttttagttttttaaaatttgtaaacaaggtatttgtgaaaagtgtatttgggatctttgaaattgtcatttaaattatcatgactacat

SEQ ID NO: 48014 - DNA, 1063 bp, Bovine  19866880757375
ttactttatgtaaaatgacataaatcagaaattaagtttgagaataagtacagtttttgacaacagtacattacaattagcattaaatgtattgactggtctatgacacggtgctgtttaccaaagcaatcttgtcgtgtctgctcttctgcttattcaggtggaagtttatgacattttctatgctaagtatcttaccttatatctctttttctttcacgttggtaaatagaaataagttttcttcttcaaagatacagaacagaaagggatcactagaaagccattaatatgtctttcaagattaacagatgttaataaaatgaagtaataaaattgctaattagatttggaaggtagaactgtggcaaggaatattttttagagagtttaaaaaaattacttttcttattcaaaggaggtagattagaatacaaccctggtgttgggatctggaatggcctattttctttggaaggcctctatttgctgatttattgaatcctattttcattgcttccttgggacagaatactcagttttcttagattttattctctgttgcaaatgacaaggcttgaaattatttgatttcaattgatgcctttttcctctggaaagctgcagaaaaggcagcaggcagcaactatttatgcatttatttcattattagtgcccatataccttccaactcttaactgctgcaaataagcatttcatatttgccaaccttcacaatgatactttggtcactatcaactactactgccttttcataggtgtgtgtaatccacacatatatgtctttgcagaaaagaatattctgtatatgctattggaagaattttgaataaaagtggctataactttgatttttcagatagaatgcaaggaaatacaattttagttttggcctattgtcaacataatttgaggtctagaaaattataagcctttcattaatgaaccagagaaggcaatgacaaccctctctagtactcttgcctggaaaatcccatggatggaggagcctggtgggctgcagtccatggggtcactaaga

SEQ ID NO: 48015 - DNA, 1068 bp, Bovine  19866880785349
tgggtagcctttcccttctctaagggatcgaacccaggtctctcacattgcaggcggattctttaccagctgagccacaagggaagcccaagaatactggagtgggtagcctatcccttctccagggcatcttcccgacccaggaatcaaaccgggggtctcctgcattgcaggtggattcgttaccaactgagctatcagggaagccctgtcgtttataagaagaataatctgagaaacagattagcttttatgctgttatatgtttttgagctttttactaacatgaacagattagatctgtagggtaccttgtgtatgtgaagaggcagggtgattttcttctgtaaatcaaggaaaagaagaaacaaaggaagacgggctttcactataaatgttaacagtgatacttgaaagtactactcagaattgtggaggcaaataattgtgtaattagctggagggatagaaaaacaaattgcttcattttaaaggctggaacagctggtggttttgacagcactcccccaacattttttggtaaattcccaatgaagttttgttgtgtttttctttctacataaacataatcaacacaataaagaagaaaatgaaccgatgactaagagcatcagcacatttttttcttcagatgtgccagatctttatccttcactgaaccatcaaatagagactggcaaattagaacatccatgtttatttaatcagctctctccaccctgactttggactccacctccccaattccaaaaaataaaacttgagggtgccgaataaaaagaagtgtccttatttgacatagtgtaactttttagcaagaaaatatacaaaattttatataaaatactttaaatgccatgttttaaaatgtaaattaaacatttaaaaggaattcaatttgcatgtacctatctaaccttagaaatagcataaagcatcaaaaccagtatatttggaaatggcattctagcactttacaggcattgagtccgcctatctttagtgtgtggtgggcaaactacgtcagaataagtgcgcccacatgac

SEQ ID NO: 48016 - DNA, 3069 bp, Bovine  19866880851212
ctggatggcatcactgactcgatagtatatgaatttgagtgaactccgggagttggtgatggacagggaggcctggcatgctgtgattcatggggtcacaaagagtcggacacaactgaacaactgaactcaactgaaattagagtgagttaggtttatttatgtgcatatataaataatttttttaactctaagattatttgttcttgttcttgacctggtttggttgtccttaactgaaaatctaagtaatacaatagtattacagtacagtctgaactctggagataccattttgaagctgataggattatttctagcagacaataaaatattcttacttttcatacttactactaataacgaataacagcttcttactactaataaggacttccatggtggttcagacagtaaataatctgctcacagtgcaggagacctaggttcgatcccggtattgtgaagatcccctggagcaggaattgcgatccactctagtattcttgcctggagaatcccacgtacagaaggtaaagtccatagtgtcaccaacactttcactttcactactaataaagagtttacttttttaaatcctttataaaatgataataaatgtgtgctttagtaaagggatataatttctgatcagcttgtttattatgtatgtgttcagacatcttataccaaaacccatagccagtgtgctcagcgagagttcatttctctctctttacgccaacttcaccacatccccagataataatttaagcagtctgagtaaattgaatatcattatgcttactgtacgtaccactaattttgttttcagttagactttttccattttagaatttgtgcttactgttgttgtgggaaaaggaaactgaagttttggaattactgaattactaataatagttgtatagcacaacacagttgaggtaaagagaatgttatagacttggttttgaatttcagctttactgcttatatgctggcagttactgagtctctttgcaccttggtttcatctaatgccagtgaggagaatttatgcccaccttataggatgactgtgaaaactgaatttaacaagccatgcacaacactgtgtactcattaaaagttaactgttattattgatgataatagctggttccatgctgacaggagtgttggttgagaaggggaaatatttgagttttgaaaattttagcaaagatgaaaggaagattgtcctctgccaaattctagcaactaggcctcactgtcccatgctgcctgcacatcctgcccttcctggctcgttaagtgctcttggatcagatccgcagagtggtttacatgactgtgagtggcactgatccaattatgtagctcgcctgcagagccatttagtggtagccaaggtagcttatttctatgtcatttagattaatttttccatttaacttgtattactaccaaacccattgcaagatatttccagttttctgctttcaaaatttacttttaaaagcagtgataaatagccttctgtttgattttaaatggttttctatagctacacaattttagcttcacataaaaattgcttagatgttgttgctccttcctccataaaattgcaaacacctagggcttggttgaatatccaggtgtacggaagctcaatgttaatttttcaaaggttgtatatatttctgatatagcaactgattgcggaaaaaatgggtttgtatattgttgcagcaatataagtaacagctgcctcttaaaataggaaatagaaaaaccaagttaagaggcatctaatgtgatcactaattattttaccggagttttcaaagaatgtatcaataatgggtttttgtttcaggctatttgcatccagaaccttggcttccaaaattaagaaatcagctcttattaattacacttaaatatgacggcggcagagatctttgtgctgtgaagcgagagcctgatctctggctgtttggatctgtacttggtgtaatgtggtgcactgttctcagccaaagccctgtgttgtctgggcaactcccgttgccatagcaatgaaattcttttgcgggagcagggcgaatgctaattgtagccatttgttgttccttctgtcgatcccttaactagcacagttgtagagcagccagagattctgggtgaacagcacggagtgcccccaaaagcattactgctgaaggcaaccggctgctctgcttaaaaaatcactggagcagccgccggtgcaggcagtgccgctgtgtgggcagaagcacagcgtggctccggcctgacaactgttgagctgggcctgggagggaaagagaaggctgtttgaaacctgttgagaagttgctgatgacatggagattaatttgacatcagtccctcggaggtaggtaggcatatcataacaactgtttatccaggctaaaagcagtattggaatgcccagaggctgtgggagacagatcagtggttcttcctttcatttccatccgaaactgcattactgtggcctaaggtaaaatgattcatttggttggaaccaaccaattgtaattcacataggtattagattcagttaatattggtaactccccccctctctttataatcccttatttttagagactcatgatttagctgccagaaatgagttgaaactgaaaaacatctcaacataaatgagaacagactccttttgaaaaataaatgaccaagtaatgtctaccaattatgtggtctatcatgctactttaattcaagaaaatactattaacctagctcataattcattgtaaggtctaattgctataggtacttgggtaagaaaaaaaatattataatggtaagagaaaacatgtgaggcacaattatactattacattacattttccctctagaagtgtactgacccataaagattggtcaagttcatgagacttttaaaaactagcttctagtgtaagcatactaataaatttcaaggtagtttttataaggtataaatttaatgtatctgcctcttaatat

SEQ ID NO: 48017 - DNA, 1973 bp, Bovine  19866880902179
tgctttagaaagatcctgtggctgccgacagaatgcatgaattagaagagaggagacagaagaaaaattatgttaacagcaaggaatggtcaatgtggcagtttaaacaaaggggagttagaaagcaagggtttggcagtgtttttctagcactgtcagggaaggagcagtcaatctgcggttggaacactgcggcgagtgcagaggaagtatataatggtggctacgggcctgggtctggaggcagacagacctggctttaacctcagatccatcactctgtagctcatgagatctagtacaagttaccaattctaactggacaagttcctttcctgtaaagtaggaataaaacctgtgagcatgtgaactgtttaggtctctgcctattaggtctggatgctaaataagtattagttttaacgtgacataattaggtgtgccatgttatagccgtgaacccttctagcaagttaccccatgactgggatgtactacctacaccccatagtctgcacctcttttaatgtgattctctgcaagtcagcagcttgttcattactaactcgacttcctacatacctgactcattagtatcctggctgccagtaaaagcatatttcccgatgaatattaataagataataccctgtctacatttagactcctgagtttggttagctggagtcctcgctgggaaacaccagactcagaggggcgcggcctctaaggctgtgctgagccgccccgggggagtggcctccggctgacctggacgcggcccccgctgtgcacgtggactccccgctgctgtgatcaaccactcttccacagggtaactcttccattgctgcaaatgtcttatttatcttacccccttccctccctcccacctcccgttgaagatggatatccacatagaataagaaatcaccagggctgtttcacagtttcgcgcttcaaatgggtcaggagtgatgcccgccgaggcatttgatgtgtttttcttttcatctgtctttgggggaaaggtctgtatgttatagatttaacatttttagaaatttaataggctcatttagagataaatattttaaacgggcccacccatgagttgctttaactataccttattgcggcattatcacagaggcttcaaacctcaggggcccagaaaccttttaacactctgtttagtaaacgataaacttggttgatgatctgagttcactctcccttagtgcagatcaggctgccgaggcgagtgatacttgagtcatttgaatgtcagtctaaaagcacgaaggtctctgccacacaccatcagcaccccagctcatttacgcttgtgattggcttacttcacagcccagggccttccccgagctgctgtcattctgaccccgaggctgcccttcacagcctcctgactccaatccccacatcctctttcaagccgacgcagagcagaagttgaccttgttccatcaactacttacccacacagacccaattaatctctggttgccagtcagtctacctcactcccctccttgaatactgtagaatctccagaagggatgcttgggctgcgtttgcctccacatgggatgagctgtggctgaaacagatgctgtctatggaaggatttgagggccctggagaccaaaggcctcttcttgtggagtgttagggtgtgggaacctccccgactcctttcctttgctcctcagggttgctttccaaggataagaaattcctgggtaattaatcaattgcttctaacccaggagtctgccctcggacaaattccgccaaaaataaggggatatggatgatcatgggcaccaagaaggcattttgcatgtctcaagagggatgagggtgctgggtgcctaagcatagtgagtgtcccggtgagttcaaccacggccggattggcttcagtcggggacacgaaaacataaaccagt

SEQ ID NO: 48018 - DNA, 674 bp, Bovine  19866880902252
gttctggtctttgcagtgtttccttgttgtgctacgctctgttctacttctgaaggctgtttctgcaatgctttggtgcacatggttttgcctgagggtgtgtgatgggatctgctttagaatgtgctcacctggtgtattaactgtgataaacccctggcaccaagcaggcaaaagccttcctggtctacaaaactttctgtacctctagccctaagtttatcagacactgtatttggcgcaacaaaggcaatgtctaaaaatatgttaaaagtgaatgccctgttttgtcaatgaaagcattctttacgttattccaatgggaaaaaagatccttgaatttattaaatatcagcaacttttctctgaagagcccaaagtgcttcatcattttcctgtttattctgttagaacctgtgaggacgcctgctggcaaccacctgtgactgtctttctttttcaagtagaacatcgatgtgactagacagcctttgtgatgtcgttcttactgtataagataagaagcgtacacggcatctccaaggcgctaaatccaaccagcagcaatgggcagattacagcttagaaatgctctgtcgtcatagtgtctgaagtgagggtcctgcatgttccttcatttcagaagaaagggtgaaaggctgagcatcacattt

SEQ ID NO: 48019 - DNA, 1842 bp, Bovine  19866880906696
attgtttttttcgtagcaacttacctctaacacactaggtattttattctttagtttatctcttctctcttctatagaatgtatcctccaagagaagttgagttttgtctattgtttttacacctgcaccttcaggtctcaaaaacggtggaaagaataaaaggatgaatgtgtgatcaatgtattggtaagataagagaagcctgaataataattattcttaaataagataatttgtctttccaagaaatacttaaaaattctaccaccatttagtgggtccttatcatgtgccaaacagggttgtgcattcaaaaatgaacaacagcacagagagtaactatacacaatgtatatacaaatgttgagtcattatgctgtacatctggaactaatataatattgaatgtcaattacacttcaataaaaaaataaaacagcacattttgtacaccaaagacacagactggcaaaaaattttgattataaaaaaagtcctttcttggcatgacaagagagcaacaatgaatttttaaacctatcaggaccctaattaacaataagcccttcaaaagtttctttgaaaactcatattctcagtccctgatagccctcagattctggtcagaacaatctgtcatttttctatttcagggcctgcagcgtctttgttttcaatagtggctggaaaagtttcccctggaaagtagatatggccttaggaaaaaaaaaaccgaatccctttggagcgaggtttgataaaaaaggcaactcataaaatttctgatcaatgagggaagactatgaggtaaatgggatttcttgtggggtttgtaaattggctctgaaggcaatttcaagaaactggaaaattactaagagtgaaatatggctgaagtaagtatttcaggatttcgtttatagtccgacggttaactgtataattttcaaagtatacaatgtgcactggaaagtgagaagtaagaatacatggaagaagagtacgtggaagtacatggaaggttatggcagatgaaattactcagatttcacaaagtcttttctagatttatcatggtgatcatttcacaatgcatgcaaatgtcaaatcacgatgtagtacacctgaaactaacataatattgcatatcaactttatttcaactaaaaaaagaattgattgagaaaaacaaacaaaacatcccacaaaaaacccaaacaaagcctgtatctctaggcttagaatataacacttctctgtgccaatgtcactaagcaggtctctaacaattctattctgtttcacggaactgaacagtgtccatactgtttataggcttcctcactcttgacttccctggtggctcagatgtaaagtgtctgcctacaatgcaggagacccatgttcgatccctgggttgggaagatcctctggagaaggaaatggcaccccactccagtactcttgcctggaaaaccccatggatggaggagcatggtaggctacagtgcatggggttgcaaagagtcggacacgactgagtgacttcacttcacttcactcttgatactgctgttatcacttaagatacatgtatgcatgtagttcttatatcttataattcttagacacatttaaacttaaacttaataatacataaaatgaaaaaaatagtaaagaaatgaagccacctcttcctggcttcagttgaggacttactagatcaaacagagaagaagaaatgagagtcattaagaacacgagtagaatataaactgtggaactgaaagctggctgcaaataatggtgcttaagttacgtcagtatattttcttaatata

SEQ ID NO: 48020 - DNA, 2970 bp, Bovine  19866880942081
ccacacatcatcagtttaagaggttatttcttttgttatctagattcttaaacaagaattcttaaaacaagctttagctgtgaaagatctctgtttactaacatcagtaaacagagtggcccccaagagataacctctcttccttctctgtcttctctctcctattagtcattctcagatgttgtggataatttagttatatgagcacttttggacagtaagagaattatattgctttcttcaaattgaaactaccaacaaaaatgttaatattttatattaataacatattttctatgggaatattttgattgagtagaattgacacatacatataaatgaagtaattatgaatttattattagcagttattgtggaaataatttcagaaaatggttatatccatctgtctgagaaaacagactgtaacacaaagtgaaatcatattcattacatgaaaaaagtgattagaacctactagtagagccagctgaatgtgtttctcccaagctccgagtgtaggttttaatgcattttaaaatgtttctggtctcaaaacattgaacagctgacaatttcccccaagagaacaataccttgaggagaaaggcaattagaatacggattgaccagcaatcagtaatcattacttggtacattaaatgtagcatgttggcacctggttaagtaatttagaaaccagttaaatatctggaaaacagggctttctcaagttaactgtgaaagctcagagaaataaaatggactttctcacagttacaacatatcaggaagaaaagtgctgagtaaggtttgagaaggttaaaattgggtgaacatattagaggtaattggaatcaaagggactgaaggagaaaatctggtatttatagaaagtttaaatcccccacagtttataagttacaagaggagaagatatatttcataccaaggttgaatatttctgtgaaagtagtttaaataaactgtacaatacagaaaaagcttcccataaaattcttaaagtagaagacaagaaatgaagattacttacaaactggtgaggcaagaactacaaaatcccttcactgtgccatccttcccctgcttccctccccacaacaccgtgccttccctccatctccaccatgaaccggtccagctctaaggaggccaccccgtcctctgacccagaccacacagcctcccattcaaggacaagactcctgcgacccactcaccatcttcttacagcatcaacttctatctgtgtccctgggttcttctctttagcaaacaaatgcactttcatcttaaaacaaacaaataacctttcctggacctaaatttttcctcagactaccaattcattcttctccttcctcttatatcaaatttccttgaaagaattatctataatctcagtttccaattcctcttattcccttttgaacctgtttcaatcaggtatttgtccttccctttgcagagtctcctccacaataagaaaaccaatggtcccgtctcagttctcacctaacttgactccctccgtggtagtgagccgtggtgtcactcactcgacctgagatcgccctgcttggcttccaggacatcagaacgcttggtcttcctctcagtgttctgtgtgtctcctcgccgtcctgagcccttaagtgttatcacagcaagtcccagggctcaggccctgagcattacctttctgcccacacttatttttgaggtcagccactcagtctaactgtttaagtgacatgtgtctattgagaattcccaaatttgtaccccacaagcctaacctatatctggaatacattttctgaatattttaaagctgtattgcttttataatctccccccaccccatatactgtctttcttctggacttaaaaaaagggggggactctccttattgtggatagtcaaaaactaaaagttcattgtttcaaaaaatctatattgacatgtatgattttcttaactgctaagtatgacggctataaaaatgaataaatcacctctttccataaactacagataactatgtgagacatatataaacttattaaaatctataaaaaatacacaggatctatgtccatttgaaacaaaatagcaattaaaaatgtttttaaatgggcatatatctttttaaactatttattttaattggaggataccttgggctgcaaggagatcaaaccagtcaatcataaaggaaatcagtcctaatattcattggaaggattgatgctgaagctgaaactccaatactttggccacctgatgtgaagaactgactcactggaaaagaccctgatgctgggagagattgaaggtgggaggagaaggggatgacagagaatgagatggttggatggtatcaccgagtcaatggacatgagtttgagtaaactctggtagctagtgatggacagaaaagcctggcgtgctgtagtccacggggtcacaaagagtcagacatgactgaatgactgaactgaactgaactgaactcagccttagtaaatctgattctctgcttaaattaaccagcaatggttctgccacttgaaagtaaaagtcctgatggataccctgttcaggtaacactaccagtttctaccagtatgaacagtttcctatctgtttaaaacaacctctttcagagtaagtcctcagttgtacagactgatgtcctctttcctttttcttccacaaaaagtgcctaggtctgcatagtccagtagagcagccattagtcacagaggctattgagcacctgaggtatggttattctgagttggagatgtgctgtaagtgtgaaaaacaactgaatttcaaagacttattacaaaaaaagatgtagaatacctccttaacaatgtttcatattaattacatattgaaattatattatgaaaatattaaggttaaatgaaatatat

SEQ ID NO: 48021 - DNA, 985 bp, Bovine  19866880980202
acagggcactgacccatttgctataaatgctgtgtcttttcaaagctctgtactcaaaagtgctcatactaccttagggagattttcaagggtgtgttaggttatgctgtaatttgtgttataccccagtgagactccagtgaaccagaaaaacctaataatatataaaacacatatataatgtatgtaataatacaataataaaagcttatagtatctcatattttgagttcttactatagtatgtactatatattttataatattttataaatatatttatgcagttataatattgatagttatatattatatataactttatataatattttatacagttactcttagaatattttatacagttatgatattttatacagttaattttcaaagggactccttaagatcagtgtgttaagtatttacattgatgtataaggaaactaagactttgagaaggttagtaacttgctcaagatggtactgctgaaagtggttctgtcgggttataaatggaggcagggaggctccagaactaccagcttctctgtttgctaaagcaaagccgttggagcttccccaaaagcaatagaaagaagatctctgaggaagaatcactaaaatgttcccacaatcaatcatctagtgaagaaacatcgatcaagtgatgaggaaagctgggatttagacaggaggtctataaatgtaagtaatcagccttaggttctaattggaaccctggtgtaaaatttcatcctgcagaaacctactgagttcaaagcatcagtcacatctctggaactcacttccagcttctaggaactactaacgagggaatcacaaataatgcaactgggatctagaggctggaaacaggctgtttgctgtttcaggactctgacctgagagttgatatgtgtaagtcatactcttgaggtctttcactcacttttcagttaaaagaaagttattatgcttgttc

SEQ ID NO: 48022 - DNA, 1292 bp, Bovine  19866881061608
tatcctttaagatagggaaactcacttatttcctttaattccttatgtgattcttactgtagacttggttctacagtcccacacagttgttgttgttgttttctgaaactaaatgaaaagttggaaattgttgaaaagttgaatgggtctcaaatacagagaatctgctagacctgagagagagagagagagagagagagagagagagagagagagaataaaagccttaaaccacgaactgggctggatccaacatgaccttggcagaatacagatttggatgacaaagaaagttagaaacaaaaaaccatgaccaacccaccatcctgagttaacttttccatcatttcttgagtaacataaaagacacaagaaccgggaaagtcgctgagaaaaaagaaaatataaatgtatgtaatccagcatctaaatgaggaagtatttcagccaacagctgttatgtttcctgagctaagaaggcaaggctaaggctctggctgacagcccttggggaaaaccctctctgctacaggaaatatcagttatggttcagaaagaggcattatttcctttaagtcagtattgatcctccatcacattgtggttctaatgggcactgggttcttagaagtgccaattctcagatgaaatatgaaatagagctcctgccttttgtggtcaatggtgagcctgtggtagtttgacaggaggaagaatagagaactctggtgtcctaaattgactgcatctcttcagtcttcctgaaatttgatctctccttacagttctttaccttttgctcttaactattactttgacctattaagcagctgtttggtttacccagtaataccatttctttggcaggagaaaaaatgacccataaatataattttaaagcactactgggcctacatgatagtaaagtgtgtgacaaatatatgtttttaatctatgcaataactgaagttactgctggccacctgcagcctttacccctgtggttttccttactattgatttactggtgctataaataattgtcttttctttgcttcatttttgctgtttattttactttttgtattgaaaacatataaaaaatgatcaaaaagataaaaaaagataaagatcaaaagggcattttgtatgtatctaaaaatcttttaggagtgtcaagaaattcttatagaaaccaattaagtagaaacaaaaatgataaaaaaagattactcccccaatttaaacaaaagaaagcagagatgacagataaaagccatttctgaataaag

SEQ ID NO: 48023 - DNA, 1742 bp, Bovine  19866881073155
attttgaaatttgggtccatccttcccctgaacaatattagaaaattatccttatctttcgtcagcccagtccataaaaacacaagtgactctctgtagcataaaacaatgcacttgtaacgaaaatgtaaaaaatgatggaaacagcaaaaagcaattccagtgcaccattattttaaatactctagcccaggaacttctgggaataggtgcctgagtgattcagccaggcctgcattggctctgaaacacattcccactaagctgtaaatgactgatttcagatcagcctttgagctgaaagcaggaagagagagagaacatgaatatgtgggatgcctggatggagcagtagcaaaatagtcaaggcagtagcaacaatagtttaaatctctcactaggagagtttaatcgtgttgacctccttcagttcacacgagtcatttgcttcttatattaccagatgcactgccacctcacttttgtcagtcccctgtaaggattcaggttgaagagcactgtaattagctatttaggctaaaaaagctttctccccaacctaaattccctcttagacaggaatcaggaccctaatgaggaggggtgttgttgttgctctttgttcagttgctcagtcatgtccgactctttgaaaccccattgtcagcagcacgccaggcttccctgtcctacaccatctcctggagcttgctcaaactcatgtccattgagtcggtgatgccatccaaccatctcgtcctctgtcgtccccttctcctctgccttcaatctttcccagcatcagggtcttttctaaagagtcggttcttcccatcaggtagccaaagtattagagtttcagcttcagcatccgtccttccaatgaatattctggactgatttcctttaggatggactggttggatctccttgcagcccaaggaactctcaagagtcttctccaataccacagttcaaaaacatcaatccttcagtgctcagctttctttatagtccaactctaacatccatacatgactactggaaaaaccatagccttgactagatggacccttgttgacatagtaatgtctctgctttttaatatggtgtctaggttggtcatagcttttcttccaagaaacaagggccttttaatttcttggctgaaatttaatttcagtcaccatatgcagtgattttggagccccagaaataaaagtctgtcactgtttccattgcttctccatctatttgccatgaagtgatgggactggatgccatgatctttgttttttgaatgttgagttttaagtcagctttttcactctctttcatcttcatcaagaggctcttgaattcctctttggtttctgctgttaggtggctgtttctaaacattcctgttcaaagtccaagttttaatttttaattgttgttttttgttccagggtatggctctttcatgatttatttatcactcctattgattggcatcttttccctcaattttttatggtcatcaacagtgctacaatgaacatccatgtatatgatgtaatggtgtgtatttaaaactgagtggtctttaaaactgactgctgaaagtaaggaagggaggctgtattctgggcaggaatttcagccacgtaggaaaaatgctactgtttcccagagtcacctttagagaaaaaatgcaggtggtagagtgggaaaaaagttagaggtgagaatttcctttt

SEQ ID NO: 48024 - DNA, 1775 bp, Bovine  19866881159053
acaaagaggcaagtacgttcaaataaaaggcattattttctataccaacttaagacccagaatatgaaaatgttttctataaaagcacaaacctttactagctttgtccaaatgtcccaaatcatccacaaaattcaggatatcaggatgcttttcttcacatatttccacaagaaaatgaagaagtgttgttttctgatctgctgattttgtgtcctttagctaaacagaaggagagggagaaaaaattacagagaatcaaaaatattttgataatctttttatttaaataacgttaatcctgtttttttacagataagaaataaatcagttctaaaactagttaatgctgtatttgaaaagccaatgtttaaacacttgaaaagctacttatcatatactgttctttggtctaaatcattaatatttcccataaagaaagaataagcttaattcaatctagtatgcaatatttcatggggggaaaatatatggtaaaatgctcaggaaaacaggacaacctaagaatctatacaatattagcacttaaagcagcctcacacacttgttcattttttcatttggcacatatttatagaatgcctgctagatactacaggatttggagattcagcaacaaataagctgttcctcaggaagccgtttagtgtaaaaaaaggaaaatacacatttcttcctatgtgacgaagagtatggtaaaaataatcacacagtgtgcctaggaggacagggtacctgaactgaacagcagtagacaggaagtggtatgtggctgcagaagcaaagcaaaaacctcaaaggcacagtagcagagcatttgaataagaccgaagatgacgaagaaagtggcacttgagaggagtctaagtgactccagaataaaagtgtatgttggggggagggggaagtagagagagtagaaagaaatctgagaaggaaaaagccagaaaattaaaataaaggcagaccattctgcggataaagaattctgatccctaagaaccgggaggtttttaactagatgagagataatcaggcgtacattttagaaagatccttctagcacaatgtggataaaagattagaacaagggtaagcacagagcaggaagaatgatttttaaagctgcagtaataatccaggcagtggaagaaaacagactgcactgcggtaaggcctctggcatgagataaggggacgaggtgggcacggaccggcacgtgacgccattcacagaagctgaacagggagggcgaggagaaaggcctgggcagggcagagggaaaggattgcttcagtttcggacaagggagcttgaagcttctactcaacatctaaatgcagacattgggaaaggatggagatgtatgtaagtgtatattatatttcatttcttaacttatttttcattattgctgactaagtttttcaggcatgtttttcctaatcatttgtaaatatgaaatttaaaaatgatacatacactgtatatctgtttctgtactgcatggacatctatgctttacacaaaaagactgtaagacaggaaagacaattttgctccctaagaaccaactttttatcccttgagggtgataaactgtagagagcatacttagaatttaagattatggcatctggttctatcacttcatggcaaaaagatggcgaaaatgtggtaacagtgtcagatttccttttcttgggttccaaaataaatgcagacaggattgcagccataaaattaaaggatg

SEQ ID NO: 48025 - DNA, 1356 bp, Bovine  19866881229935
tgcctgctgagaaatccaaatcccagagcagaaatgtattggagaccactggagtgtgtatgaaagggtgaaatgacgggtgatattaccatgaagatgtaccaaatgtcatatggccccatgtaagaaaaaagtgacttatttctgatgtaagtcaaataagttgcatgcatacaatacacagtaagaaggaaaatttaaaaactggggagatgtataatgggagtctcattcagcaaatagtaaaacttctttacttgcttttgtctcaaaatgtatctcccagagttattgaaagcaactgggaataatgattactttgtatttgagtaacaaagagacagtatttggcaaaattgaaattgttatataactacaaggacgtggccatatcctttcaaggtatatgattccaagggaaggaaagagtagtcattgcatattccctggattctgggaaagtagatttcaatatgttcagaaacatggtcagcacgattttgtggcatgaaaattcagagggacagctgtctcaagaagagtgtgataattgaaggcttatcatttagaatagggattggttatactgaacatggctttaaagatgaatgctggaatgggtggatgagagctaaaggaaaacagattttcagctcagtgtaagaaacagcattctaactttcagaactgtccaaagataaaaatgggctagcgtgggaagcagagttattcatcacttgatgtagccaagcataagctggatgacttcttacctaaatgtctagataagagttgagcatcagataggtattaataattggagtaggtgatttagaattcttttcaatactacatgtgccaattactgacaaaaacacttgctatgacaaagctcagctatttatctctacactggataccagtgctctcgtaataagcgtctgtttaaattgcgcacgatagtttcttcccattctcttaatgattactcaaactgtcaattaaaacttctaactgctttctttctccaaagtacacatatttagattctgccatttcagctatacacacttcatctgatggggtgcaacactgaaattgtattggctactgatctcactatagtcacttacggtggcttagtcgttaagttgtgtctgactcttgcaaccccatgaactgtagcccaccaggctccctctgtccatgggatttccctggcaagaatactggagcaggttgtcatttgcttctcaagggatcttcccgacccaataatcaaaccctgggtctcctgcattggcaggtagctactttactgactgagctatgagggaagccctatagtcacttaaa

SEQ ID NO: 48026 - DNA, 1610 bp, Bovine  19866881233338
tttaagtcaactctgcttagctatcaaattttcacctatcaaatgataaaatgatcactatagaccctattaactttctaatttaatgttcacttaacaaacattcccactttttctatttgttacaagatgcaaagcactgtgatccttatggattgtcctttcaactaaaaaggttaaaaacaaatatctgtgtaacattttacactttacaaagcataaaagctgaaaaccaagttctggtttattaattatgaagaaaataagaaagccttatcaacaccacttaatactgttccatgcagtcatttctttaaaaaaaaaaaaggctgtattttaagtttttggtcaatatatagcatgtgaaacgcaatgttcacaaaaatcaactcaaaggattcctagggaatatatacacagctaattttaattagcatacaaataacaaatgctaaaaattatttcagtcatcatttcaaaatatgtgcaaactgacacaaagagaaagaacatgtgctgatgaatactggcccatgcttatcaacatgaacagctactggatacaataatttgatcatacttaaaattgcagctattagtctaaaaaacataagtacctaatgctgctgtgggtaagtcgcttcagtcgtgtctgattctgtgtgaccccatagacagcagcccactaggctcccctgtccctagaattctccaggcaagaacactggagtgggttgccatttccttctccaatgcatgaaagtgaaaagtcaaagagaagtcgctcagtcgtgtctgactcttcgtgaccccatggactgcagcctaccaggctcctccatccagtattggagtggggtgccatcgtcttctccgaatacacatattaaaaaaaaaaatttaaatgacaccaccactgccaggcacatctttcaaataatgtgtaatataaaatgagagaatgtgaaaatctcgtacaatagaaaaaaatgaaaactgtaaaacaaaactgatgctgaagtgtggtgctgcactgggggtcaacaacactgtgtctattgttgagctgaaacacagaatctgcctttagataccattttaatgttcaatcaaaaactgtcaatcagcaccatttgtttgtaatccctcatcagaacccattgcctcagtctgatcattcacaggaaagcatgcagagagcgtatctgcaaccacttaaccttcatcaaccaacattcatgcacactcattaacattttttttatcccactttcgagcatgacacagctcataccggaataataacttgctgataattgttcaagacaacagctggacaggcagagtgcagaggtgaacactctcatagattatggggtacagtaatgcattacaattagtataaagactcatatgctcattttcaatagttttcaaaaaaagttaagaaaatgtcattagcaaaagcagcaattctagctttaactctgcatagctcactccctgattcttttaacactttacgggtttgaaataaactgatggcaagcatcgaccctagttactgtgccacttcatcaatagaagcaataattctgatgcagcaacat

SEQ ID NO: 48027 - DNA, 707 bp, Bovine  19866881268843
tttggtaacagagccaagtattaaataggccttaccatgacgtcctattgagtctctataaagtatccttctttttcttagttctgtcctctgtgacagttaagagaagctggccagtgccttcctcattataacctttcatatccttgaaggagaatattaagttttctcattctcctttcatctgtctaaagtcctgattctcttggcgtttcctcataatcatatatccacctgctcatcatttttattgctcttccctgaagcccattttcaatttcccccccttcccactcctgtccccacctctgttcctaagaggatgtgaggggaaggggatgtgcccgcagaaactttttgaatgcgtaactttgacggctactctcctaggtctttcatgtaacttcacaggaactggtaacttttttttctcagtttttattttaaaaattataatgttacatgaaagggtagaaagtattggtcactttcttcatatttattcaaacatagtcaactgcatcctttggtaccaaaaatattcatttatttagtcctcaaatattgattgaacacctagaaagtgccaggcactgtgaagactgtatctggaggatgtggagttcccttttgttcagctgattttatttaggcaggtcctaatcacttgagaatgtggaaaatgtttccacaactctaccaacggt

SEQ ID NO: 48028 - DNA, 1429 bp, Bovine  19866881277708
ggatgaaaagatgattttctagataatctaatccacacactgactatgccatttaggtagaaactgcaccgcctggctgaggtcagcacctgccaccccagtctgtccacaaagcctctgttcacagaagccctcatctaaccaaaattaccctagcttctgagacatcagtcatagttagctgttgtgacccaccaaggtcaaaatcaacctgatctctatttacaaaagctgaataaccagtcattcagaaaacctcatctccatactattttaactctcaatttccagttcttgtctatttttcaatgttcctagccaattcataaagttgctaggctttttaaggggccaataaatgaccttttttcatctgtcaagatgtgagtggaagtttcaactaaaattcacattatcatttactgatcaatctgaactagagacagtggcttggatttaatgctaaatgtctttctgaattcaacttaatttgccatacaacaaactcacccccttcaatgaaatggtgaaggtgaaaatcagattagaattggatgaaaagtgaatagaaggtaaagaggtagagatagaaaataaagcttgatcattcacaaagttgggctcctgagagcaatggagaaatggagcatagttgatgggaatgtcaggtccctgaaagactgcattttaagaaggaaagtagtgaggcatgtttacacgtacgtggaaataagcaagagggaaagaccaaggatgtaggaaagtgtgcgcgtagcaggaaaggtgactgagagtccctgagagtgtgtgggcgaggctcagagccatggtggagagaccgccctccatagtaacaggcgggaacgcaacagacacgaggtaaaggagcttaggtttctagatttagctgtgggcagattgagttttcattctatgttttctattttctgaatgaaaaataaagtgatgtattcagcaaagaatgagagggtgggaagtgtgaaagacagaaggtttgaaattaaaatcttgctggggagcatagttactttagaaacatttctgagtggtggtgaacgtccatccatggcatcagatcagatcagatcagatcagtcgctcagtcgtgtccgactctttgcgaccccgtgaatcccagcacgccaggcctccctgtccatcaccaactcccggagttcactcagactcacgtccattgagtcagtgatgccatccagccatctcattctctgtcgtccccttctcctcttgctcccaacccctcccagcatcagagtcttttccaatgagtcaactctttgcatgaggtgtccaaagtactggagttacagcttcagcatcattccttccaaagaaatcccagggctccttcagaaggacggtggatctccttgcagtccaagggact

SEQ ID NO: 48029 - DNA, 1724 bp, Bovine  19866881314030
ttatataagaaaatattgtaactttaccattggaaaaactgatggacatcacccttagctaaatattacatattattataatatatgtacacatatatttttcctttagtatacatatatatgaagaggaagagagaaaatatgatgaagcaaatgatacaaaatggaaatatttggttaatctaggtaaagagttttttgtatttttgaaactaaacttgtaataaaagcattttaacattccatttacagtaataaaaccataaaatacttaggaacaaatttttaaaaatctgtgggggtctccctggaggctgggctgtgcatatgtggagcaagatttgccatatggcacctgttgcacagtgagagtaggacagagataccaggggtccatcattcctaggagtcattggagttctggccctgccagagtagaggtaactctcactaacatacttggcattcactcaaacaactagtaaggttgtacctcaggaaacatgaccaacatcctaaaggagtacctacactaaactgaccctagcaaaattaaatctacagtcttctctgggaagaatgagtcctaacaagttagaggggccagggaaacacctcccactttccacagaatgtgagactaagccttttaagactataagtaagcctatggagaaacttaaaggtgattacccaatgattgatttgcctgctaaatcaagaaggaacattcttcaaagtagtattatacctcagtagttattatggcattttattatttaagaagttgtagctcagctggtaaagaatctgcttgcaatgcaggagaccctaattaaatttctgggtcaggaagatccactggagaagggaaagtctacccactcattctcgggcttcccttgtggctcagctggtaaagaatctgcctacaaagcaggagacctgggttcgatccctgggttgggaagatcccctggagaagggaaaatatacccactccagcattctagcctagagaattccgtggactgtatagtccatggggtcgcaaagagttggacaggactgaccaactttcactttcacagttaataaaatagaatgtatagtcaaaggaaaaagcagtcaaatcaacaagaggggcctgattttagatttcaaatgtaaagactttaatgtggatattataaatatgtttaacgaactaaaggaaattatctttgagaattaaaggaaagcaaaactgaaaagttcagtaactgaattaaaatattcaatttgtaggttaagtatattggaaatagacaatctaaaacacctgtaattgtagtcccaacaggacaagagagtgagattgtggctggcaaaatatttgaagaaataagggcaaagaaatgtcaaattgagtggaaaaaataaacttatggttcaagaatctcagtaaactacattcaggataaatataaagaaaaagacactttggcacattctagtgaaactgcttatagacaaagatgagaaagtaatttgaggctaaaggaaacatgaaaaattaaggagatggatatagctgattttctagaaataatcaaaagccagaagtcaacagaatggtgtatttaaaatgctgaagtaaacaaactctgtaaactcaaaattctctatttagtagatacccttccaaaataggggtaaagtgaatacacttttaattatgtgaa

SEQ ID NO: 48030 - DNA, 746 bp, Bovine  19866881326538
tctgtagcaactcacaccctcccacattccccaaacactcattttgagatagccaggataaccttcctcatttcctgcccagacagttgtggagtgttgtaattcattgttagacagctgcagccttcctccttggaaaagaatacttcttgtcaagggctgcagtcattctcaaagttttagtttgtttcttaaacagtgatgtacccaccagatgttgaaatagcctagccctagaaacctcaaagacaggccacagctaacatgtgcatccctgcttagaggtcagtactacaaacaccctccctaggttacttataatctcctctgcttcagcaaacagtctaaaccactcctgttggcaaatcctgaaaataactccttactagctgagcaaactttaacctttccctacaagcagataagaaaatgccacacagctagaaggcgaggggtagccaattttaatccccaactatctcctgcctccacaaaacagccctgctatcttctgatctttactatgaaactgcggagacgagaggagagaaaaagctgaaagaagataaaatctctccactacgcgtgtgtgcatgtgcatgcgtgcacacagtcatgtgggagggggacaaggcacaaccacataaagactgaaaatcacctcagatgacgacgaggaggtgggacttgggagactctggggagcagagatattagagtgagtgggcatgttggagagggctaag

SEQ ID NO: 48031 - DNA, 1675 bp, Bovine  19866881332898
agtcagtttcctgaatgaagaagccacttcattgtggagttaactctactgtggcaaaggtgtgggcttaaagctgtccagatcatcagacagtgactctcagcacatagctcttgctagagacatgggagaaggttgtaatgagtgaggaatttttgcatctttgagctaagagagttgctgaggtggatgaatgaacccagaaaatgctatcaagcactggatttgaaccttctttagactggggacagaaaaaaaacaattgaggggaaaagagttaaaacctaaaatcagctgcttttcatggggttagtcatctacgctcaatcactagcaaaagcttctggtttctctgtctggcatattaaaaaaaaaaaagtgaacccttcggggcttgaaaacctattcatctgacacaatggcaccactgaaaattcatcggttgatgacctgcgcatatcatttgtaaaaattgcttcagtctgagttacctttcaccagctctgtaagtctactcactaggtcactagaagtgagtagaactttgtgacaaattctgtttccatgacaatgaatgaaccagtgaaaatggggaggagaagaaagatctgtattctgtagaatactctcaaatgtttgcctgttttcttttttagccgtttagttctcgtggctctgttccaggactctttaatttgccagtagctgtttttcctacacagattacaggagtaattcatcagtgaatgtttcactccgtggtcccatctaatgcaaggaaacataaaaatgatttttttccagttatgtgtttttgtttgtttagaaagaatgtaataagcttttttcctttcttttttcacaatctagctttaatgttcttattcgctcttatttattgactattactttacacagactacaactgcaatttgtaagttgtgggatctgcttttaaatgccaataaatcccaaaaaggcaatgatttttgaatttattggactaaaacccagagggggatgtaaagagaaaaggaacattaaaatatgtagacccaatacacgctacaatgaaacaaagtgtttaggaaaaattaagagagcaacagagcctttcctttactaaattaccttaaattggcttacatatttacatacagtaggatgtgtttatgttatttcagctcttatccacttcctgaacttagtgatagcgctactatttcctgggggagagagggaaaattgattccaatggttttagtttttaaatgatgaaaacagcaaaaagaactcatgtttgcaccaggaaaaaaaatatatatgcaactatttctttctgaggtatgaaataagaaaaatatcccctgaaaccatgtattttcaatttagctttagtttgtatctcaacaagtaactaagctcatttttaaagctaagttcaaataataggattttccccttgccttccttttcaactaaaacaaagaaaattaaccagtcttcaattttcaagtgttcattctgccattttgtagccacagacttaaaggacaattatttcttttccaacttcattcatttgctcagagcaggaagaaatgttactcctaaatgttgtagaactgccagcaatgaacaaactaatcagatttcatcttcatctgagactaaa

SEQ ID NO: 48032 - DNA, 783 bp, Bovine  19866881349021
tccctttctctttgtctgctcttagtggagcctctgcataaagagagtctagaccaaaaggcaatattaaaaacaaaaggttagagatcatcatgggacattaattatgcaaaagaaggcaaactgaatttaatcagaagcagcagactcagggcaggaagaattttctctttttgacagaagcagttagggaaacatttatggtaataccatagcatctgctgattacagtcaaagctgcaggacaccaacgttaaatcactgagccatcctgacagctcctgggtactcaagtcacatcgaacagaaatttacagtgaaattcatccaagtctaaaaatcagccaacatgtttaaaccagagagaagtaacttagtttggattaaaaaaaaatttttttttaaaaggaaattacagctgataaaacttttcatctaatatatgtcctcaataagtatatattttaaaagaacacattaattttcagatctgttaatgtactttgagataataaggttttgaaatttggagaaaggattttataaggtcaaaaatataagaagtagagttttaactctttttacaaaaaggacaaaatctgacatctcagtgctttgaaatgatatatctaaaggattcagcataattaattagaataataacttttgaacaattaacttggttgctaagcaaatgtaagtaaaactaaaagctcacagaaataatgaactacaatgcagtgtaacattaggagattattctataaaacgcctatagaaaga

SEQ ID NO: 48033 - DNA, 927 bp, Bovine  19866881399754
agagaggtctggaacattctctctcacagtcttcagaaggatgcaaccctgctgatacttggatcccagacttctagcttccagacccatgaagcagtacatttctgttgtttaactgactcagtttgtaattctttggtaaagcagccttaggaaactcacgcactaactgacattaagtctaccataccaggttaggatagttccaccaattgggagtctttatttgggttacatgggatcccaggttagcgtgtcacttcatgtaaaattgcaccacccagactttttaagaccctctatttatttttcctccttagcacttactgtctaacatgctgcatatttatttgttcttttttgtcatctttcccttcactagaatgtgatcttcgtaagcgcagggagtgttgactgttttgcttaacaatatccccagcttgtacaagtgcggttctcagatacttgtgaaatgaatgactgaaaggattaatcgcctcctcttctttgtcatctccctgcatcccatatacacctcaacacccatcttactcggaacacaactgctgcacagaagaagaggtaaagtgagagtacgttccctataaggtgctgggaaatttgcctaatccaggatctagtccattccagatcacaggtggtaggagaataagatgatcgttctttagggcagattctttcacctttcatttctattcatccctatgtcttggggtcagcccatttcaaatcgatgagatttcagtaattctggggtaaatagcatttatttcataaaggatggcacagcaattttgaatgtccatattttgcttgaaatctgtttttagactaactgctcataaggaaaagtcaacaagctgtaacctgcctgggctcaaatttccacccagtacatttggtagg

SEQ ID NO: 48034 - DNA, 1087 bp, Bovine  19866881421106
ttaaaaattgaatatttatagcaaacttgtattaaacaagttctattgacatcattttcaaacagatttttactcatgtatctgtgtcacattttggtaattcttgcaatatttcaaactacattattattatatttgttatggttattcatggtcagtcatctttgatgttactattataaaaagattacagctgactgaaggctcagaagatagttaacattttctagcaataaagcatttttaaggtatatacattagttttttttaacataatggtattacacattaatttactacaatacagcataaacataacttttacaagcactggaaaaccaaaaacttcatatgactttcttcactctgatcttcacttcattgcagtggtctggaaccaaactcataatatctcaaaggtaagtctgcatctgtcttgaataatgaacatccaaaagatatttgtaattcataaatcatttacacatgttctgttaaccatcttatacaatttgttctttgcaggtatggtcagataattccatcaagtgagaaaatgttctgccataatgacagattaaaatgttttcttcataaaaattacataagggaagggtagataaaaggcaaagcatttcttcaagtatacatttaatcaatcaaaaaatatagtgcaattacccatgctgagtagttgtctaggtactgggcatacatagagagatatagcaagcatgattcctgctcccttgatatctatagtctagtgaaataaataataatcaaaattaagagccagaggaatatgttccaaatgaaaggaatgatgacacccagaaaaagaaataaacaatgtggagaaaaacagtctatctgatgaggagttcaaaggaacgatcataaagatgctcagtaaactcaggagaagagtagataaataaagtacaattttaaaaaaagaattacaaacaaagctgaagaatataattactaaaataaaaaagacaccagaaggaataaacactagattagatgatgcagggtaatagattgacaaaccagaatacaaagtgaggaaagcatccaa

SEQ ID NO: 48035 - DNA, 3004 bp, Bovine  19866881521110
atttcaccagtttttctactaacgtccttttttctgttcctggctccaatcaccccgcctttcctctatgtgcttgccccacatacggcctttactcatgtcactgcatcactttaaaaccttctcttaccctcactctccccccggccctcttcactatgtgctttctgtccactattcagatcccagttccagaagtcacctcctcagaggaacctctctgaaatctgggtctcgggctggtttctgtgtatgtatctttatacaaccacgtgtcctccctttataacactttctctttaatgtgattatttaattttgtccctatttgtcacaagactctaaagacccatgaaagcagaaagtgggtctgtttttcttaatctttatatccccctagatttagcatggtatgtggcatatcatatgtattcacaggatatgttgaattaataaatgaataaatgactgaaaagagaaaagttaagtgataataggaggaaacacattacagaacatcaaaaatgagtaacccaggcaatacagatgatcacagagcttcaaaagagcgaaagatctaagtgagttcattttaagcaaggaaatggtatgattggtgtgacatgttataaaaataatagagcaataggggggatggattggttaagaagaagccagaaagtttaaaaaaaaaaaaagttaataatctagctaagaaacactgagatctcaaaactaagacagagggtatgctgctgctgctgctgctgctgctaagtcgcttcagtcgtgtccgactctgtgtgaccccaatagacagcaagcccaccaaggctcccccgtccctgggattctccaggcaagaacactgggagtgggctgccatttccttctccaagacagaggtatagagaaaggaaatactgaggaggtcaactcaacaagcacttggcagtaacatatattagaataagaaatccccaggggattaaacagctacaaaaattagttgagtgaaaaaaaggcatggatatctggaatacagtgataatacttccaggttaaataaagggctcgtgatgcaagcaatggaataaaaacttggatagataaattctgcttctgaaaaagtcaaggagattggactttattctattagtaatgagtcattaagcaacagtgacatgatgaaaaggagatataggatgaagagaatttagacaaaagcaggttcattgagaaactgatgaagaaacctaagcacgtgctttagagtgtcagcattagaaataaagaggaagtgacataccccaccacattctatgaaagaagatcgatgtacaggtgcctaaatcagcgtccagatactataggcacagagtgttttattctgaagagcttcatttgacttggtcttctttctagagaaagcaccctggaagactagtaggctttacatagccataaatattcattgaaaacccttcatatgacaagtacatggagcatacaaaacacgtacgtatgtaattctcccttggactttcagttttattcctgctttcaggagaaatgcatgcatgtgatatatgtctgtggtcatgaacctccacgacgacccccgcgatctccagttcacgctctccagctccgcccagttcacgcgctgcataggcccctccctgtcgcactggggatggactgggaaaccagtgaccacggcagaactgacggcttagcatttcccagaggacacataaaaaacagcatcttccgttttggctttctctccttcctcagatgactcactctgggagaaaccagctgctgcgtcatgagtgcgttcaggccacgtgtgaagaagtacctggagtagaagggaagcctccggacaacagccagcgaggaactgaggcccgccaacgaccacaccagtgagcttagaactggattatctggttccagacaagccctgctgcacagccgctgctgccaacagcctgactgcagttggagactgtgagcctgaaccccctccccgcttaagcagctccctgcttcctgcccctgagaagctgtgagagagaataaatgtttgttgtttcaagatgctaaatttgggggtaatttattacacagcaatagataaccaaagcaactttatactactgaacattgaaaactaagcaagggaatcatgtttccatttttgtcctagctgctaagagatataagctaaatgttatttctgattgtggttggttttctcagtcaatacttgttgatttatcttcttttcacctccttttattttttgtttcccatccactgtccactggtttttattttatccttcttactcatttattgtaaagcttctaaaatctttttggatatagatgcacggtaaaacagcaaagtaagaacagtagatattaagataaggttccaagcactatcagagggatcacaatctcattgggagtgaaaagtgatcaagcaatgtggcacagtatattactaatgttcaagcaaagattgctgttagatttcaaagaaaggggataccaggaaagttatatttttcagtcaagttccccaggagcagactttgagataggatgtgcattatgaaaaagctctcaaaataaactgctaaggaaatgaggaaagtaagacagggaagaggaagaagctatttcaaagtctcatggaagatgactccaaccaggtcctgcatgagaaggctggaacgtgagaacacttcagaaagaggcctgagctcccatgcttctctaccggtcacccaccggcccagggcctctgaaggacagggacgctcccagcacaccccctcttagggccccttgaacatgcaggcaaaggcgctgcagcagcttgagggaagtcctctagagacccagaaactgtcagtgatccgaagaaagagcacgctgaaaccaaatgaggacacagaaatgttgaagcgatctgagggcaactg

SEQ ID NO: 48036 - DNA, 797 bp, Bovine  19866881533412
cactcagctttcttcacagtccaactctcacatccaacctgaccactggaaaaaccatagccttgactagatggatctttgttggcacagtaatgtctctgctttttaatataccatctaggttggtcataactttccttccaaggagtaagcgtcttttaatttcatggcaaggcttgtagctgctccaaaagaaagatcaccgtcaggattccagcagagagaaccctgcgctgaggtgagagccgtttactcagggagggaaggtaggtaacaccatttctatgtgaaatggatccagtgactcggccagagcgatcttcacacagaatgctgaagaattcaggagagctgcactcaccaatctttctctagcatttcatcagggttgaatgacagctgtttctgaagcaatttggacatcttgctttctcaggaagactcttgttgagatgtaagcctggtatttctgaatagaatgttcaaagattattgatcacggaaacacctttcctccaaataacttcttactgccagtccggtcagcagtggtgccaggtggggctaggggtttgctcacatttttgacctgaggcttgggttgtgatgttcctcatcccatagctctgcttcttagttttatcatattgagcttcttcctgtggaccagatacatattaaaaaaatgggcaatatgaaaaaaaatattttcaagatttctgagagctagccatctttcccaaatgctgagactgaggtgtatctaacaggcagtggacttctagcatttgtgagtt

SEQ ID NO: 48037 - DNA, 795 bp, Bovine  19866881625823
tttttagccatgaaatatttttaacctcctgctttctctaatcgatataatttcagggaaaatttctgttatagaaatcacaaccccattctatgttgaactgattgttctgtgacagtttgattttagatatattatgtaacttagtgaataaaggaatcagactgttaataaggggtttcccaactgagcctgtaatgcttgctgtggcagcagttggggtggggggtgggaccgcctaaagtaggaatatgaattgggaatatcagtggtgaaagctgagtaaaaaaaactcaggaatgttttttaaaaaccaaaggagtatttgaatcataatttgaatttgagaagaatgtcatggttaaagtgaggggttatataggaggtaatattcttacttggtttgagatcaaattggaaagagagtaaactttatgtgtttatattctaattaatataatgtgatttaattgttatagtagtggatcattttgtttctagtttatgtatatggagtttatatatagtttatgtatatacattaaatatattatcatttgcatttattgctaccactcatgctgatacaaataaaaaattactaaaaaactttactggtacttggaattagtattttaatgtctgaattgtaaagttaattgtatgtgggattttttggttaattttttttcccgtacctactgtcaaatctgtataaaagttaattgaatgatgaaaaatatagtctttaagagaaaaaacaagtatgatacctattatgagcaaatctaatag

SEQ ID NO: 48038 - DNA, 838 bp, Bovine  19866881707280
tgggagacaggataattccttgtgcaggactagtccatgtgtcgcagaatgtctagcatacctttcccctgtaaatactggtagcatcacctcagtcaccatgacaactgaaatgccctgagacatttccaaaatgcttcctaagtagtgttaaggcctgttgaaaatcactggcttagagagaaaataagaaaataaataattattcacataataggatgtttctaacctgaacagccaagagtgacattactaattactaccttttattggaatttcaaatgcaacaacttctaagatctgaaattttatgtcaaggtgaaatgaagggaattttgacttttaagtgcttcagaggtttggtagccaaaacctgagtcagctaaaggcataaactgtagcgtctgaattgtagcacccttataaaacttagaaaaaaatttagctttcagcctccctaggtgatccaaagccctgatttttatgggcccagttctgagtgtatatggagtttatatacattcaaatgtcttagcattgcacacaaatgacccaaggctaagatcagaaggaagtccatttgaactgctctttccttcagccacttttgtcttacctcagcctcccttcctttgtcagaataaccttttccttaagcagattaattgatagattctggttgcatttcatatctttatctggatattcatgacttgtgttttttagtcacagttagacctatagctggatctaggttacataaacccttattttgaatggtgctgttaagaaatgttaggtttttaggtggtacctcttttcatgagagcaactttta

SEQ ID NO: 48039 - DNA, 687 bp, Bovine  19866881734474
cttacttgcctttctttatccaagaactcccattctcccaaccccttctcagctcgtctctacccttcccactcattagcatcattctttccctgacctgctctcctcttgcattttgttcggagatcaattttgcaacttactactgtctgccagaccatatatattaggtgtgtatctgtccttccctatgaactgtgcacctctggtggacagctatctcatgctacacatttctgcctcttctgcagtattttgaacaatttctacatagagcaggtaccaataaaagtttgctggagttgaataaagctcacaaattgtgtgaaatcacccctctagatgggtttctcttgaaaagttgaaactcactggctttcagagaaacctcttcaatgttctttcctgagaagatacgtcttactcctcggtaattaggaatctctcctgggtggtttttgaaaaaggttttgatttggaggatctatgagtgtgactacgtgggctaagcttcttaaaggggcaacccagctgagaatcacaaaagaaagctgaggctgcttcttttgcctatcatacaaactggcttttccttgtgctaatgagagctgcttgtgttgactgtgtaacaggaagtaccttaatcctttttcaatcgacttctaaaattagctttattttgtcctt

SEQ ID NO: 48040 - DNA, 823 bp, Bovine  19866881767903
cttgcaaatatgtactcagagcgtgttacagggtaccacttttaagagagccctcatagtgagatgctgcttctgctgctatttagttacagtcatgttcgactctttgagaccctgtggactgtagcctgccatgcacttctgtccatggaatttccgaagcaagagtactgcaggtcctgaataaagtataataatctcaaactgcttattatccaaatttaagtaatatctttggaggattttacgaatgacaagcactctctccattcttctatatagtctgatgtttatccttttaaaaagccaagccatcagaaagcaaggcacttataccattttgcttaaactagggatagcattactataactgaaaagtacagatatatcatctgttaataagcagtttgagattacattcttttatccggacctgctcttgactaaatgcaaatttgtatccttagaaatccaatcagcaatcaggtaggtgcttgtctgaccaaaatgcccacctagaaatatgtgtatgttgttggtgctaaaattagtaattttagagaatctgtgtggagccagttaagtcagtattctagaaaaagggggttgactcaaccatcaaactcaacaccatatcaaatatatgagatgattttaacttgtttttgaaaagatgttgtcaattcagaaacaatgattataacatacttgtatatattactgatgtctgctaaaatgtttgatttctaaataacgaatcatcctaatcagtacagttgaatgatggagctcttgttctaggtagctaaactgactacctgta

SEQ ID NO: 48041 - DNA, 755 bp, Bovine  19866881884146
ggttccggggttagatgtagacatcttggacaaaagtagagtctgttactctgcccaccatgggcagcaacttgtggcaatgtaatcagagacagtagttcttaccagctctcagttacaatgggaatttttgaaaggctcactccaaaccctgtgtggtcactttcccacttaaccaccatcactgctactccatcattcatttattctggactagtcttcgcccacatctatgtactcctccatgtctgcagctcgtatccatacttgggtggaaattagggtaggtggactatgactccctgaatatgaggtttccaagaatggtgtctggattccctcataccattgtcttgggcaagaaagctctaacaggaagtcttttttctagccaactgtttcaaactctactaaacttacatcagagattgtgtgcaagaaaaaatgcccatgttataggcaatatcacaatttcctacccctctctacttaaaattttgcagactggtttattgcagttaattagagctagcagaatccattctgtatcagttaggatgacttcaactgcaagtaaaagaaaccctgatttaaactggcatacacaatatgaaaaattactacttcacattacaaaaagcacagacacagataagacttcagggttagttaattctgtggctcagaagaataatcaaggttcgaattttgttctctctctcttcaccctgccattcttggtattgtcaaactgg

SEQ ID NO: 48042 - DNA, 1065 bp, Bovine  19866880509424
agggacaagaatctcctgcatagcggactggttatcagtctcactctgctactgctgtgtacccttgaactccttcctgcttaattaaaactgtgggaggacagcatcactgcgatcagttcagcttcccggatcgaccgtgatgctgattccacattcataattaattctcctcagtgttaagaatggagacttggctgattaaggattctcggtggattattggagatgtctgaattgctgaaacaacaggcagccatgcaatgtctttttgatctacataaatatgggatgtggaagaagaaagaaggcatttttcttttccctccagaaatcttacttgacattttgcaaggggcatttattagaatgtcagtttgataaaactgtttgcaggagtcaccccgcatttgctactgagctgtaacaattgttaggagccttaattactctgggcaggtttaaagaaaaaaaaaagaaaagaaaatgttatcagacgatttgggcaaaatacctccaagaaagtagctctgcttcctcttgcttcctgttgtgttacagtctctctgatacactcctactgaatctgaactctgggttagtacaaagttaccaacagttgtcatagcagatgggaatgtagtggtgtggatcagagagacaaatcttatgggctgcagagatgtcttcaaatatagaagatgatataaagcttgggtgtaggattttaatatatgtgggtcagacacgactgagcgacttcactttcacttttcactttcatgcattggagaaggaaatggcaacccactccagtgttcttgcctggagaatcccagggatcggggagcctggtgggcttccgtctatggggtcccacagagtcagacacaactgaagcaacttagcagcagcagcagcattgctttagtagtagtaataataatgatgataaataatggccaacatctgattgaactcactgtgaattacttaacgttctaagagctttacacatagttcattatctaattttagtctcaggtacaggggattttttttttc

SEQ ID NO: 48043 - DNA, 1209 bp, Bovine  19866880652636
tttgaaagagttggagatttccatgttctcaccaggaaggtcagacttcatcatctagtgagtggcaaagatgttcaacacgggaaaaggtaagtgtaccctcttgcagtagtcatggactgatatgagagttggaccataaagaaggctgagtgacaaagaatttatgctttcaaactgtggtgctggagaagactcttgagaatcccttggacagctaggagatcaaatcagtcaatccaaaagaaaattaaccttcaatattcatcggaaggactgacactgaagctgaagttccaatactttggccaagtgatgtgaagagggaacacattggaaaagacctgattctgggaaagactgaaggcgggaggagaaggggacgacagaggatgagatggctggatggtatcaccgactcaatggacatgagtttgagcaaagtccaggagatggtgaaggacagggaagcttggcatgctgcagtccatggggtcacagagttggacacaacttagtgactgaacaacaacactcaaccctcagactacatagaagaagactttattcactgaacaaggagtccaaagtgagaggagaaataggaagttttggaattaagtatttatttacttctaagaatactaacttggcgcattgtgttcataatttacatttaggtttctaagtaaaagcctgaaattaataatatcaaactgtgacttcatactgtgggccatgctcaacctactttgacttgtgcccgatgaaattataatacatttagcattgtgtttattacataggcagatggatatcattagggacaaattttccttactttatgctataatgtgcatttttacaatggtttcacatttgccagataatcaaagactatgataaaaggatgcatattatagttctctccatgccctttctagtacagaagtgtcaaatcataacattacaacaataaatcttgacacatgtctcctgtaaaaatctgttttgaactagagcatgagaaagatagaaaagctaggaaatctaatgaataatttttggaaaggctaactaagtgaagaaaatgcaaaccaaagacattaaaaatcaatttagaaacaaatagcattttgtcagacttaagaattattcattaggggctgaaggtacatcttatcaccaagaaaacgtaagaaaatgaag

SEQ ID NO: 48044 - DNA, 2987 bp, Bovine  19866880669462
tgcactttatctcctatgccggatgttcatgcaaaagtaaccctggagggagtaggggggagaactttgaataatcttcatctggagaaagggaaatgaaagcattcacagtctttcacccaacaggccctgagtgacgaaatccagctcatattgtgataatgttccaaacaaatcaagacatctgattaaataacttgaacctttggcttcctaaagttctaaggactatcagttgaagcattgtggcataattttattagactcattggagctataattaaccatcggagagaaacaaaaaaatttttaaatccattatgattaattttcacaggatgtcttggaaaccttacaggaggcattaggagtctgcctatttataattaacagatcgcaaacactaatgcattttcccaacagggactatttaaatggaatgttttgtttgatgtgggacttaaatacctaggcgtgagtccgggaaagctgtgttttacagagattttaggacaatgcactatgttctgctgatgagatattcttgtcattgctcctgtttgaagcgatcataagggaacatccccttggcttcctttgactaagacagcatgttcattgtggcaacttgaactgtatgctcaccttggagagaaatatgcaaccagtgcagacacaacagttcttatgttaagtgctggaatctagtatctaaagtatttacacgtggaattttatgatcacctcactcaattaacccaaatgctaatgttatatatgtatatgtatacttaggtgtatgtatatatatatatatatacacacacacacacatatatatatatacacacatatatatacacacacacacatatatatatatatacatatttaatttttattgaagtatagtctatttaaaatgtgttagtttcaggtgtacatcaaagtgaatgagtaatacacatacatatatatatatactttttctttagattattttcccacataggtccttacagagtaggtcattacaaagtactgagtagaatttcctgtgctatggcttcctgggtggcactagtggtaaagaatccacctgccaatgcaggagatatgacagacgcaggttggatccctggatagggaagatccccaggacaagggcacagtatacagtaggtacttttagttatctattttctatatagtagtgtgtatttgtcaatatcagtatcccaattattccctcccccacccccttgtaaccttaagtttgttttctatatttgtaattctatttatgttttatagataaggtcattcgtaccctttttttggattccacatataagtgatatcatatgatatttatctttgtctggcttactttactcaatatgacagtctctaggcccacctatgttgctgcaaatgacactgttttctttttatggctgagtaatattccattgtatatttataccacatcttctttgttcattcctctgttgatgtctgttgtgaataatgctgaagtgaatactggggatcatgtgtctttctgcattatggttttctctgggtatatgcccctgagtgggattgctggatcatatgctagctctatttttagtttttttaaggaatctctaaaattcttagaggaaaatataggctgaacactctttgacataaattgcagcaaaatcatttttgattcaccttctacagtcatgaaaataaaaacaaaaataaatgggacctacttaaaaacttttatacagcaaaggaaactataaataaaatgaaaagacaaccttcagaatgggagaaaatatttgctaatgccatatatttatcagatacctctagtttccagaccaattccagaacattctttctatgtaaaaatctaggattatcactccacgtacaatatggacttcttcaaggacagccactcatttttttttttttaatcatgtggtaaaagccattgtaatctagccatatcttacacatgagatctcaatccattatattttctaatgttccagtcttataagttaaggtttcaggacctcacccatatgctttccaatcctcctgtcctttctcttctcaatctgaaaagtttctacttaatattcaaaacctttaaaacttgaagcacatctgtaactcttacttgaatctcttttggtccaaccttttctattgcctcttcatggctaacagtatatcccattttagtgctaatataacattttgtgtgtgtgtctattgctatgcctattagtttatgctccagcccttgaaggaattggattgtgtatccccaaaacctagagaatgtctgtcgcatgttctttatcaccttggaggatatctgactgtaagtgatcactgaaaagacttgttagtgaactgatcagcatacctgtttatatcatcttgcacaaaacaattgtgttttctgtgctaatatttaacatggtctcaacaaaggatgtagtttttatgagctgaaacttgagttgataagtggcagctgaattccgtaagtagatctaaagtatagagcagtaaacttattttagaaatctcactgaggataccaattaaaaaaaagagagggagaccatgaaggacatgttgaagaagttgttattgaaatatgaccttgcatttttattgtactaaacctggaatgcatgtaaattaggagagggggaagccgaaaatactttagatattggtgtgtaatgaaccatggacattttgtatggaacaaactagatgtcagtgacgagagactaaactaattgacagatcataccttacctgaaataaacattgtagttgtaacaacagaattttaatttcttttaagttcctttcctagcctgaattatgtatagctatagatgttaaataagaaagaaggtctaaaattccaaacttcattcctttccttttcttag

SEQ ID NO: 48045 - DNA, 1737 bp, Bovine  19866880671164
ttcaagaaaccaaaccataaaccagaaatttcgaggcagtaaaacaatttgggacgagcattctattccactgaatggtatgcttctatttcagagagcaactcctaaattgagtgtcttgcacagagatggcacagcagtaacaaattgtagaatgattttatatatatatatgtacacttggaaattacaaagtagaaccaagatgtgctggaaaaccagctctatgagggaaaaaaaagaagaaaaaaggcaaaaaactcggtttgtagtgttttcctcttttgatggtttaaatacttgccctatggcccattttaataccaattttaatgaccaattaccattttaatgtgtgtcatagcacagaggtgggaaaagatgggcacaatgttctcttacaggctggtacaggctggctccagtcccctgctagttaagtcccctagatttgcgttcatgtgatttggcaaaagaaatcatgccactgattttctgtaggttaatcagctgacttgattttgatgtggacttttcacggcaatacaagagacccaggtttgattcctgggtcaggaagatccactggagaacggacaggctacccactccagtatccttgggcttcccttgtggttcatctggcaaagaatccgtctgcaatgtgcgagacctgggtttgatccttgggttgggaagatcccctggagaagggaaaggctacccgctccagtattctagcctggagaattcagagagtcggacacaactgagcgacttacactctcactttcacttttcacaagtaatgatgacaaagtattactttttcccaggcaggctacttgtaggaagaaaaattgtaagaatacctccccaggagttcccatgcttttgaaagcagataaaaaccaaggaagaccttgaggattttcctgaggttgaaaaagaattctctttaactagggccacctactttggggcctgggcactgttaagcatgccttgaagaatccttattcttagccactctaaggtcaaaaactgaataggaaagccttaggcaaagcactctttagtagcatggtatattaactcttagaatttacaaaatccttccagtcccccatgttgctgaactattttttaagtcaagaaatttagtgcacagaaatgtaggaaaaaactaaagaaatcttgaggatagtttatgattaaaacaattattcattttagaactcttatgggtcaaactctgagctggaaagtctcacttattttatatttgtatttgtgtgtttactctttagggtaaaagtggaaattctttcatttaatgaagatggaaaagggcatctcaagttattaaaaatattttactaacaacaacaatccgttaaacatatactatatcctagacaattctcatttaccattgtagttagtaatcaacaatatttctattttatagatggaataaacgtgactgtggctgagtgttatgcatgaggtcatgaactaataaagaggaaaaactggatcactagtcagtgtttcttcggatttgttgcttaacatgtgttaattcagtcagtcagtccataaatgtttattgagcacccactaagattcagccattcttcttggcttcagggctatagcagagaaccacaccaatacaaaattcagctcttttaaaatttctgcattttaattggcagagacaatcaacaaaca

SEQ ID NO: 48046 - DNA, 681 bp, Bovine  19866880723140
aaataaaaatttagcaatatatctgagcatggaataatactcttctttattcatggatgaagttactaagttgcctttttaaaaagttaagcaaggaaactctaagtgtaaccaaaattcagtaccaccactttcacatgctactttcccattttttcaaagactaagaagctgggggaaaaacaaaacacatataaaatccttgcaaccttctgaattttatcagcagtcttctgagtatgaaatatacatattcttttcctgaatgtatgccttaagttaccaattctcaaaataaatctgctataaactttatcttctccatttcataagtatccaaaacaaaataaataaataagtaaatattccaacctttttcatagaataacccagtgacatgtttcatctttacaatgaaatgcagctgtagattccccattaaaaagcaaatcctcaattttgaagtcttgaatagctcggtacttcaaaaagaattgctgctgatgaaatttatggcattgataagagtccaattcaaaaatcttaacttggataaacaggattttcatttgatgaagaactggaatagatgggcattcactttaaacccaatgcctatcagtaattttttttctgaagtagtaaaacaagttttgagtaactacttggactaggtaatat

SEQ ID NO: 48047 - DNA, 2178 bp, Bovine  19866880866888
tgagaggcaaaggagaccaggagtgactgctaatgggtatgaggattcttttttgaagtgatgaaatgttctaaaattagatactggtgaccattgtacaactttgtgattatgctattcaataaaacccctggattatatattgtaacagggtgactttttggtatgtgaataatatcttagtaaagctcagataaaaagtaacatcagatcagatcagatcagtcgctcagtcgtgtccgactctttgcgaccccatgaatcgcagcacgccaggcctccctgtccattcattaataaaaaaaaatagaaattgggaatggtggaaatgaatgggaaaatcatgactaaatagtttatcatcttaagcctttcaggtttaacattcagtataaagtatttttattttaaataactttggaattaattattttaattaaatgactacagtttacttaagcatttctttgtttcaagtataggtgattgctgactattcactagtatatagttttttttttctttcttttttcaacgggaactgggaaaagtgtctgtggttaccaatacacacttagtatcatggtcagtattctaggacctgggcatgtactccaggaaataactagcagctggcagcctggttatcctaatggttgtcctctcacctggatcactgctgttattgtaactcattctagattcctgcagacttacagtgacatggctaacagcaattgaaactgtctttcatatactccttatttggggcaaaatgttggtgtccattttttttatcattgaaaacagatttcaagacttctcacagctaaatgtggcaagcaggtaattcacagacttgtagacaacaaactctgatagtctaggatggagaatagggcaacaggttagttgaaaagcttcatgtgtctttttactaatgcaagatttagtacacttaaggatattataatgagatcaaatcaaatttacaggagaatgaacaaatgagaatagcaaatggaggtcaaaatgcacttccacagttctctgttacaccagttagatttacaaggcagggacttaatgtaagttgatgtgtgattgctccagttttaaaacgatgccattcagcttacatctgatttcattaaggctgttgagacagcacttgagtaattcaaagagaatagaatgggaggggtagagagtgtgtgtacggaagtgtattttgatcctgcactttattgttataacacgcgtgggtctagcaactctttaacatgtagtctgttatgatttcatcttgtataactgcgagctaacagctttgcctctcaaagaagtgatgtgatcagcccactaaaccttttgccatgtgagacattcactgtgtggtggagatgattcagagagtagacttagacacacagtcacgtgacgtgttgcttaaaccaaattaaaatgagtgtgctaacactttgtcagttttcatctcttcagcctcatagctatttataaaagggagatgtttgtatgagaagaggtcccagttggggattaacgcccaagtctctacaaaattttacataaaataaacaaacattgtcacaggatttgatgttttactaaatcatttcatggaataattaacacatatcctgtcataattccatgagaatatttatattatagagttgacactatatagaaactgagaatcaaagtgattttaacttcacaataatcaaagtgtaaaagcaagaactaggaaagaaagtaagaaaataaaatcttatttatgaagcccctgttccagcactatttgagaagattctaaagtgttaacacattaaatcctctagaagtcacaggaggtggactttgttattttcatttcatatagaagaaagccgaaggtcccacgtcacaagcctaggttttagcagatttgcaatttagcgcaacaggttttaagatttacatttttactgtagaccatatattctaaacatagtcatgatgttgagaagatacccagccttagcttttgttatgaagatggaatcatcactgtcttgccgatattgatcagttttttaatacaacggtcaccctcatgtttgatttgctacatgtgttttcaaaaaggtaattcactgtttggtcagggcactg

SEQ ID NO: 48048 - DNA, 1583 bp, Bovine  19866880895771
atatacggagatatttccctgttcctgtcatcttttccctttgcccttttaccaactgggggtcacagaagatgcaaaaaagtcagtgttgggcacagctcctgtcgctgatgtttattcagatcaccatatcaccagctagcttgctagaacttcctgattgcctgcttccctccctctggctctttatacccttagtgtcaccctctactccaagttttctgatacctgtcttgggtctaccttcttctttggtgacatatccgaccgctttcaaatcttcaccttttgttccagtctcaggtccagacactcacatggttttatgataagccacgaaggacttcattgtctctgctatctcctgccttgtagtgtgaagctgtaatactcaagtctcctgccttcttgccaagagtgaggggtgggaactacctttcataataactccaagtctttccaacttgcaaccctagttataaactttacaactattttatttctctgtcatttgatgtaaacatcttttaattaggataatattcctgtctgcaaaatttggatcatgttacaactagcattagtttagcatttgctgggtatctagagccttatatttattatcaaaaatgtaatgacctgaaaaaaaattatacaaacgttaaagataaagacaaccttagagaggttaaataaatggccaagatcacataaaagaggcctggttgaatcagatacttatgtttggaaatatggtatttgccttctaagttatttaaaaaattatataatagtttcccttacaggagaatacctggggttttgtttggatatgtaagaaaaagctttgtaaactttaaagctctatgcaaatgttaattgttgctgtgttctaccctaagattatttatggatgacactgcatatatttatgtagctcagtataacaaatagctgattaaggggcaatcatttctcaattttaaagccgaaattttgtggatgcttatgaaatagcgctccaaaagcagatgtgtgtggccgcctggttggtatgtctggtgaaatacagtagaacctgactaaattacactaatgagttggagacccattacaaattatcacatttgcccaattagtgaaggagcaatgtagagaaaaaagactgctagggaagcaaagctggtatggcaagaagacaaaactgcaagtaagcctaaaagatgttaataacacacaccacacaggcatgctcatttgtgtgcacacacacacacacatgtacaaccacacatccctctgcagtaggtgaagttgatcatgaaatatacaaatatttgtacaaaatggatctctgtgtacatagaaatagttcagtttctttctctctctcaggaaaaagcaatcaatggaagttcattgttttatgtttccaagaaaactattttgttttaatggaatcagaatgtggtttacaattggaacattgttatgtggcaaattgtagtgctacatctagttaaattttattatatgctttgaggtacaccctaccatcctgagcacttcagtaggtattatta

SEQ ID NO: 48049 - DNA, 1188 bp, Bovine  19866880950829
agcataaaatatacgctctgtgttctttttaaccattaattaataactcaagcgtaaagttagccgttctgtggtgacttaacccagggaatatattttggcaattacgagttcaatcgcctgtctaaactcagagaaattctttgtagaggcagtgatccaattctttctcattattttaccaactagaataaatcacttactaaatgatgctaaattgtattagcaaatacagagcatataagataaggctataagagttatcctaagcaggcttttaagctttttattcttcctgtcatatgttgtagatctcacatgttgccgacctccacatttccctctttcttgatgggctggaagtacggcttttcatttcttaattgaagtgtacacctagggatattatcccacattatcttggctgtttcaagaagatattgggattagaaggtggttatctactgaggcaggcactactcaagactgacacacttcctaactaaagctttaaaatttgttgatgaatgcctatcgatatagaagacctgtttcatttcccttttcttggctaagtgaatgtctaggaactatccaaagtctgcttatgtttctttcttgggttttctatatttgtcatatcctttgcctaagactgaaaatctcttacatggttcaatgtatccgtaaaccctttaaaactctgccaatcaccctgtctgaaagccagcttccaagactcctgagattttcaaaaaatattcctaagaataaaaagggttaaacttttccagatctatgagctcttccaaaggaacagttttatgatagtgcagtgctactgctaagtcacttcagtcgtgtccgactctgtgctaccccagaggtggcagcccaccaggctcccccgtccctgggactctccaggcaagaacactggagtgggttgccatttccttctccaatgcatgaaagtgaaaagtgaaagtgaagtcactcagtcgtatccgactcttcttgaccccatagactgcagcccaccaggctcctccatccatgggattttccaggcaagagtactggagtggggtgccattgccatatggtatttaccagtctagagtaatgtttggggattcagattatggagaaaactgccgtagaatcctcaatgtgctacttactctg

SEQ ID NO: 48050 - DNA, 1296 bp, Bovine  19866880951813
tttctattttgcaaataaattcatttgtattatagtttaaattccatatataattgatgtcatttgatatttctctttgtctgccttacttcacttagtacaatcatctgtaggcccatctatattgctgtaaatagcattatttcattcttttttagagctaaattgtattgcattatatatatatatatatacacacacacacacacacacacacacacacaccgcatcttcaaagacagcatctttgacttctctttctctgaatcactaaatcctgtttgtcctgtgagtaacaagtattttgcaagtatttgcctctacactaaagtccatctccccttttatcaaccccttcatatcatcaccacctctcagttggacagttccaacagcttccttatagcttcctgtttccacacaccccacatgctaccaatcattttcataaaataccaacaaggattctgagggaggtgatcacctcgccagattaacttcatgccattctccactttgctcaccaatctcaagccactggggtctgtggtgttttcctaagttgctaaatctgaaaatccctcttccatctggctgaactgttcacttccatggctttgaaggtcttgtgcttttgactccctcagtaatcagcataaacacaacctttaagaagaggcatttcttcccttcctcaacctaaggtgtccctcaattactaactcatcaccctgcttatttctctttctgtgagcatattcttaccgcaatataaaatattccattcatatatttacttactttacaattatgttttttctactatgctctgcatttcatcagggcaattaccactatatgtcctttcattatccatgcaccagtctttgtcatatagtatgtaatcaatagttatttgatgaataaatgaatgaatgaaatgaatgaataaatgaataaacatgaatagccactacccaaagagtcataatatttaaaaaagagctgatgctataaacccagcctccaagctgactcttccttatcacttgctgttcattaagagttattaaatgactcgtcatctttactattataatgcttcttgtctaatggaccttttttgtctaaattaaattatgtctgaagtgcaagctatgcagatattttgtccattttttttctttccgagttgctttttctcagagctggcatgattagttttggacattgattgccccttctgctcccatagtgaactaaagtttcattattctccaagtaggggaaaatata

SEQ ID NO: 48051 - DNA, 1690 bp, Bovine  19866880967611
cattttccccacttccattttctttaaagaatagtagactaatacaggggatgaagcctttcctctcctgacaaaagacaagtcgtgtccccattaaagagtccaccagagtccacttagtgttgacatgtgctagatggatgccagggagccagtaaaggccaaaagattcctggaatgaaagaggccacttatgtgtgtgtgagaatatatatatatgtgtgtgtgtatgtatatatataaactaaacaacaacaatcaactacttatacatatagttgatttttgtttagtcactcagttgtgtctgattctttgtgaccccatagactgtggcccaccaggctcctctgtccagaggattctccaggcaagaatactagagtggattgccatgccctccttcagtggatcttgcctacccagggatcaaagctgcctcttttaagtcacctgcattggcaggcaggttctttaccactagcggcaactgggaagccctaaatatgtacatataaataataaatttttttcaagaaaaattgagaaacagcaccttttttcttaacttcctgtatcttcttcacattattttttattctttgggcctcacatatattcaatgggtacaaggagaatgaaataagaaaactgttgggtttattaagatttctttcttatggcacaccctgatgtagttcatgaggcaagaaaccaggaatagatttatacaggggagaaagacagttattttcgctcgcaggtagaactaactggttgttaaagagcaaatcattcctttctatttagccagattgctgtctctcaattgcttactaaatcatggaaatggagctttcttcctgcagatacaatttttctttgcagtcaatacatagtcaatgcatgttaatacagtcaagctcttccttcctcctccatttcaacttgaagtcccattaataatggcgataacagcaacatttgacatttatacagcctgaaggattccaaaaagatttcaccaattactgtgaatagagttctgatgagctgcagcaacttctgaggcaggaggagaataagcagaaacacaaagttgcagtaagggagatcctgcccaagggtatgccagtcgtcccctctaaaaatggaaaaacattactcacaaccgcacacaaaaaaatcaggtcttttactttgaaaatattgaaaatatatcactggaagtcaaacgatattgagctagccaactgacatgagacatgggaaaagcgagaacattccacggcaagcttatttccagtggattctatttttatgattattaactatctgactggctttaataccaattggaagagtggagatgaaacaggccttcccagttgtcctgatatttcaaaagttcccacatacacccaaacagtgtaagagactggctaaggttcagtaaaacatttgaacatgggttatttcaattcaataagcaaaatattcccatatgaacaaagaacaagcgtttccagaatatttaaatatctaacttttaatccttatcaaaaacaaaacactactaacagcagaaacaaagcttttatgagacctatgaaattatactctctttgaagaccctgaaactatattttactaaaaatgtatgggcatcttcagataagtaaccattcag

SEQ ID NO: 48052 - DNA, 1524 bp, Bovine  19866881046071
aaaatgtattagttatatttaaattacctttcccttttaaacgtctcctttctatttaacaagtatttagggaatatttcctgaagttatggtgccattatgttatatatttagtcttccaccagaattttttttatcctaagcttcagggtttttttttttttttttttttctctcagttaaatgcatttgtttgaagttcattgagattggagtccagcaggttacttttttggaactcaataggaaatgccctgcatctttagatacactccgatgctgtgtgtggaattctgagttatatattttgtacccaaagtttctgtagggaagagagtcaagcctgctctcataaaaatggccatcactccaggtgcaaagtgcatttgtatggctcaaactgtgatgaacatttgtgatttaaaacataacttgcatgcaattttttatttgctgtggtggaaggatggagagagagggttttaataagagtttgggtcatggcagtattttactatctcaactcctaatctctttgatattgaactaggccaaaggagctgaaaaaaagaattcttgttagatggaggaaactgctttttgctatttgctttctagcttctaaaagattctggtgcattgatgcaaaaaattgcaaaacaatctttgcatttcatttggcctctttcctggtatacacagtcatgggcaatttttattaaaagttatatgagatggatgtcttcacggatatagctgatatatatggtacttgtcccaaagggaaagaatttattgaataatgaactgtgctttcttgtgaattcttctaatctcatgatttattcacgaacatggctatgtctttatgtagaatcttggtaagagtaaagacttataaaagcccaagtaagaatctgttttctgcatctagtattttgcctgtgtaaggtcaagcaaaatcaatgaaagagagattaatgaagtgattgctatccatttcctatgcttgataactttgtgaatcaaatatttacataaggtatacagatatctttgccattttaaaacattctttctcattttaaacatattaatctaccaaaattttggtagattaccacagacacctttaattggatgtcatttgcttttattctagtaacagactttggtaggggtcttgcagggtatctcagttttacagatgaagaatctgactctaggaaatgtgatgttaagcagtgtgcctgaggtcaaaagttagtttttaaaggagctggaattcaagtccagatccatcttttttatgcaagctttgtttttcctatttggtattctcagtgctttgtataatgtcaagaacttagatggtactcagttcagttttatttgcccttttaagatgtaattttaattctgtctgagactcactttggatcatctgtattctccttttgacgcgatgtgtattcttattctttctgtttgttgtgtctcaggttcttttctccagtctatact

SEQ ID NO: 48053 - DNA, 799 bp, Bovine  19866881062014
catggaactgggttcatgggcccaagaaagaaggagcatgattgaaaatgatggtgagagagtatcatcatcttccttagcgtaactatagctggagaacctttgagtcattgctgccaccttcacttaaaacaaggaaacaaaactactattctcccatgaacagacactgcaggagccaacatatctgtggaggaaccagctggacttgatcctgtcctgccacgcatcaaaaaccttgtgaggcccgttacactgcacaatctcctaagcattgatcctcacagaggcagggagagttcagctgggtatttttttttttttttttaatcccacaaggagtcagaggcattggcacttagcaaatcctcttttaatttgctcactgagaaaattcaatcaagacatcattaaaagaaaagagaccagcatggcaccatttgtcaagtctatctttgagctatcactgcttttcaaggggtggtgagtgatgggcagaattatattttctggcttctgaataagcttctgtagaagagctcacaattctttttttaagtcagaaaccaataaaaaatttgtatatatatacacataaatgcattttacccacctgtaacctgctgagcccttcacacagcagtagatgaccaattaagcgacaccatagctctgcgttcagatagcagagtcaatttggaaccccctgggggaaatgggaatcatgaatgaaggatgcctgctgaaaagcagggatttctgaagcatgattggaaaataggccaggcaaaaattacga

SEQ ID NO: 48054 - DNA, 1827 bp, Bovine  19866881093241
aacaaaggtccatctagtcaaggctatggtttttccagtggtcatgtatggatgtgagatttggactataaagaaagctgagtgctgaagaattgatgcttttcaactgtggttttggaaaagactcttgatagttcctaggacagcaaggagatccaacccagtccttcttaaaggagatcagtcctgggtgctcattagaaggactgatgctgaagctgaaactccaatactttggccacctgatgcaaagacttgactcatttcaaaagcccctgatgctcagaaagatttacggcaggggagaaggggatgacagaggatgagatggttggatggcatcaccgactcaatggacatgggtgtggatggactctgagaattggtgatggacagggagacctggctagctgcggttcttggggtcacaaagactcggacatgactgagctactgaactgaactgattagataaataaatcaagatagatgcctataaataaataccacacaaactataaaacaaaattatacacatacccactaaatatatttataataaatacacaattgtaatatgtgcatagaaataggatctgcatgcatctgtgcatccatgataatgaaggctacgttcagcaagggaatagcatgaatgttcatgatcttaaggatgttctgtgtactctgatattttttaaataagtatgcattgtcattttgtaaataaaaatagataaataaaattagtaaaaaacacaagcaaattttggtaaaaatataacctagcttgtagttgtattacaacaggccctgactatgggaaatatatcaccaaacatctagaccctagcaaagtaatacaacgtgtatctgctgatggctgatcaatttgtgtcaccaataataaccataaatgtttttttaagttgcctagaaagatctcttgagtccacagtgatatgctagattcttacaagagtagcaagaatgcaaaatatacatgtcaattctgaacggctgaattaaaaatgaaagaattccagcccttttctctttgaaatgactcattagacggatgattttcctgttattaaaatatctgcaggcagtcaaaaatggattaatagcaaaaggtatattgattaacctgtaatttctattattataactaaatgatgtccttgcctgcaagtggaaagtactcagaggcttctttttcctttgacatattattgttcactttagtgttctacacagaacttgacttctactgaattattgggaggactagtatctctatcaggccactatatagttatttttaaacagatgatattatctcatcaggaggaaaaactcttcattcatttttaacactttttcctaaggaatcaatgtaaacatttttgtctttataaactgattcaaagtacacttgacttcaaatattatttaaaagtttaaaaaggaattgtagaacaaatattttcttaaacacactgtaactcaagcaattaaaataaccagtttctttttatttcactaaattttatggcattttttagtagcaactttctcagtttaaacaataaaggactttcagacagcatgtaagtgagaaggtataatctttctttcagaattcattgtcaaagacactatggagaaaagtatgaagatttctttaaaaactaggaataaaactaccataggacccaacaatcgcaccactggtcatttaactgtgagaaaaccgcaattcaaaaggacatatgtaccccaatgttcactgcagtgtatttataagagctaggacatagaagc

SEQ ID NO: 48055 - DNA, 1726 bp, Bovine  19866881108817
tcctataaatggaataatataacatgtggccttttgtatttatcttttttcattgtctatagtgacttccccggtggctcagacggtaaagcgtctgtctacaatgcgggagacccgggtttgatccctgggttgggaagatcccctggagaaggaaatggcaatccattccaggactattgcctgaaaaatcccatggacagaggagcctggtaggctgcagcccatgggatcgcacagagtcggacacgactgagcgacgtcactatagcctttgcccagtccacccacgttacagccacgttacagcatgcaccagcacttcattcctttttagtggtgaaatacttttcttatgatctagtatatttcatttattcattcatcagttgatagacatttgggttgtttccactttataatgaataatgctgctatgagcattcacgtacaaaattttgtgcagagatataaatacttaattctcttagatatgtacctatggccagtccaggttcgatgcacgatactggatgcttggggctagtgcactgggacgccccagagggatggtatggggacggaggagggaggagggttcaggatggggaacacatgtatacctgtggcggattcatttggatatttggcaaaactaatacaattatgtaaagttttaaaaaaaaaagatatgtacctatgggcagcatttctaaatcatatgtttaacatctcgagaacctgccaacctgctttacaaagcggatgcactatttcacgatcccaccacatacgcagtataaaaaggaaactgatttaacaaaattaccatatagactacctaattttggcacactgtaactatagaggctacagattttttttttttcctgcctttttaaagagcaaataactgagctatagcattgcccttttattgcagcaagattttagcccttccagttcttcatttaaaagattatttctacccattgccattataaatttaagccaaattggagaacagagagcaactgtaacactacagagaatttaggacacagagaatagagtagtaaatgtagatacatgaaatagccagtaagcaatcaacattaactttgcatttttatgtcatggaggaaaagctacactcagataaacaacttttaggatctgtaaatatctcaaattaggagttcaaagatactctttgggataaaaatgatgtttcccctttgaatatattcttaaagcagataaaggtaggtagaaattgaaagcagatttcaactaaatgccagggcttctaacaacccactgatgagaatccagctgttcttctctgcttcttacattagcaataataatggtaaagaagatgccttccttatttgctgacagttgtgttgataatgcaggaggcaaaatagcatttctcttctgggccatgttaattatggaatgctgacaagagttcaaaaataaatctggatccttcaagtcaatgccccacatcaatataaaatgaaaactcatgatacactgacaagcatgagagaagtgtagagtttacacaacacctattttttcaataagtagaaagattcatggcagattattaaatccaaaatgaataataggtcgtaccagaatatcaatttagagatctaggtaacatctctctatctcttatatttctcatctgatttgttgaagcagaaag

SEQ ID NO: 48056 - DNA, 1128 bp, Bovine  19866881120478
aatctgcctatgatgcaggagacccaggttccatccctgggtcaagaaaatcccctgcagaagggaatggctacccaatctagtattcttacctggagaattccatggacagaggagcctggcaagatacagtgcatgggattgcagagttggacttgactgagcaactaacactttcactttttctcattttttattagattgggcctacttagataatctaaaataatctcatttcaaagtttttaacttaaattatatgtgcaaaagaattttttgttatataatctaacaaattaggatgtggacattttgggaggggtacaattttctgcctaccacaaaggtttaaatgtcctatgtgtgcgtgggcttgtctgagataaacgaatgaatgttagaagtaaacaggaaagtagctactcatggatttggaaaaatctaaatgcagtgtaccctattagcatgggggaaataatcgtatgcctttctcactacaaaaataataggaaaaacttcatacttagcccagaactgtttctgatctccataaaccaatgcataaaggagttcaaaaccaagctgctgtcacctaagaacatgaaaatgctttgtgggcttagaagtaattgaacaaataaaatgttttcctttaatatcttcaccaagttatgattctgaatgtttgaccatatctgctgaacctgtcctaagaagatgaatacaaatatggatgtgtgattaaactcgactgaagtggatttaattaacctggagaagagaaaaatcaaggagtatttgaaaggtctctttattttgataaggggctaatatgaaattagaaatgtgctgtgcaatcttagggattgacgtggtcccaatgaacacttgctttcagaatgttgagttctagtcaacataaagaaagtttttctaataatctgagcagtctaaacatggataggactgtatcataagatcatatccttcctgttattagaggtcattgagcagtgaaggataagcccttagtaaggttgtttggggtatattttaagtactaaagggttatatattgtttttaggaatgtggttcctttttccaaatcaaactttccagttctataa

SEQ ID NO: 48057 - DNA, 1553 bp, Bovine  19866881221929
tgggttcctggtatggatgctgtgactttctaagtgaattcttctcaggcattcacaaaaagaacagtggtctacactggcctcttggcgatgctatgaattcccgtggatttggggtggaggaaacactgggatacagaaagagctaaccagtgtttcagcaagttagctcaaaataactggggtgggtgtttgcttttcacatgggtaaatttaattagctttgtgggtggctcagaactgatacagacctcctctggctgtggtacaaaattatccagggccacatttagcatttctcaaaacatgcctcaatctccatcaaactcgcatgtgcctccatcaggagaattttgaaccagtacagagaaaattaaatttaaaataaatttaataaagtatttcttcaactctataatctgcacttagaaaattatcatctcttggtacatacaattacaatatatttgaaaagccttttcagaccacgttagctgctgtggtttgttaatgaaacacacacacacactccatagcacttataaaagggaaaatattaagtgctgaaacaatattttaaagaattaaagtgaaactactcccttgagtaaaacagatgctttctctactccttggctttgaagaaagaagatatgcttattaccacttgcctcttaccctacctgatttttgaacgtttatagcacacataatcagaaatgtcaataaatcgcagggcatttattttctaaatcattatttacgaatcagaaatatgacttagattattccgttcccaagcagatccagctgaataaagggactaaggattgggaccttgtgctcagttgctaaattgtgtccaactctttgcaaccccatgaactgacacctgggagttacattcctctgtccctggaattttgcaggcaagaatactagaatgggttgtcatttacttgtccagggtattttcctgccccagggattgaacccctgcctcctgcattggcagagagactctttaccactgggctacctgggaagcggccagaaactagacagctctaaatgtgagcataacacttggttcacacgagtgtgtacatattcaacaattgcttattaagactttctatgaactagttaccgatcagacagtagaaacaaagcttctgccttcctagagctcatattccaggaatggaagcagaatatacatacatacatatatatatatatatatatatatatataataggtagaaaacacaatttcaggcagttgctagtgctatcacgaaaaagtaaagcagtaatgcaggcgtacagtgatggcaaggcactgatggacatttgaacagagatctgggaaagtgaggcacagcagagatccacataattgagggaagggctttagaaacggggacaggaaatataaatgacttggtttgcatgtcaggaaacagcagggggttgaagtggctggagaattgaaagtaaatgggaagagcattgagaagagagacggagaggggatcatgtcagatccac

SEQ ID NO: 48058 - DNA, 1729 bp, Bovine  19866881313592
cttcagtcatgtctgactctgtgtgaccgcatagacgccagcccaccaggcttcccatccctgggattctccaggcaagaacactggagtgggttgccatttcctttctcccagttcatgaaagagaaaagtgaagtcgttcagtcatgtccgactcttagtgagcccatggactgcagcctaccaggctcctccgtccatggtattttccaggcaaaagtactggagtggggtgccattgccttctccaggattactgttcacggagtcacaaaaagtcggaaacgactaagcgactgagcgcacacgcgtgcacacacatacacacacacacacaccgtcactggtagagtgacttgtcgaactttttttttccttttcttccagccaaaataactagctcctgtgttgctgagttacttttcctttcccctgaacttgtaggagcagatcagcttctgcaagtctcagctaaccatactgcaagaaagaaagttattgaggggatggccttcgcatgttttcctttaagaaactcaccataagcaaggaatgaaatgtggcaatcactattcaggagagtgtcaaaatcattcagaaatcaaaacaggctattggagttcacaggttctttaatatgcacagctactatcttccttttagcttaataaggggttgtgtatccttacaattaaagataattgcagagtgtaaaaactgcattgtgattatagaaacacagactgaagcttagtgatgacaagacaaagacttcatcaactgcacaccttggaagttttaagtgtttaaaatataattcctcctctatacagcttttttctttttatgctgagttcccttctttcttaattcccaacaagaatacattgttcaatgtcttgactcattggaaacttagctgtgagatttccttacatttttttttaaattcataagtatcaatggtgcttctttaaatcatttagaagttgacttgttctaaaatcaggttttactgcattattgttttgtggtttctctggaaaccctgtcaaaaatatctctctacatctcattttgttaaattattccagtatctttcacttcaaattatttgggtagatagaataaggtatttagatgctatgaaatatgaaacacaggtacttttatgtgatcaagcgcagagcttcaatttaagagcatagcatcagaaaaagcaagggtagtgttttgctttttacatactgaataggctagactatggcttgataagcatcatgctggatatttctctttgagactatttgtataaaaatttgtagagctaacttacttggataatagactcagcaggaggataaaagaaattgtaaaagaaccagtttatctttaaattgacaaagaggccaagttcaatcataagtttatatgaagtatcaagagctgcaatgccacaagccacagacattttctctgtcttgaataaagtatgacttctcaataaaacaacaaattggcaaagaagtaacttttaagcagcttcagctacttgtcatcgtttactcacaaggcctgatcagctttacttatcaaagaaacattgatcaattccctcaaactaagtacatgaagtcaacaaagcaaagggactcaaaaagtggtgaacaaatactgtaaataagaatttccaaggaaagttcattggggaaaaaaacaaacaaaaaaa

SEQ ID NO: 48059 - DNA, 958 bp, Bovine  19866881351439
aaaatccccatctgattttctttgttgagtcatcttttaaaggggtacataaacaatgtaggcatagcaggactttctgccataaagagaacctgcacgactccctctgagggtgaagttttgatgtttgaaattggcaattggctgtccccacaacggggtcatagtgaaacttgaaatttcaatccctaacaggtgaagttggaacccagtgatcactgtgattaaacgcagcttccctgttccttttccaaaatgattgtgctatcgtagaggtagcttagtgggacttttcccacaccactcctctgacctccctaatccttacaaacagacccagacacccccaagtgtgcacacagtttaagtaaaagcagcatgtttacaatgcagacactctcaagacaagtcttgtaagtttccttaaaaaaccagatgactcttccccaatgcttcctagacataaattctggagccttacctaaatctcttctctctgcaagttgcaaaatagctaaaaggaggtgcatttcatgagttagtgtgagtttctctcactggatcacgtaaaatgctgaagtcatgtgggtctttcataaccatttccctggtgcattgccagagccacagagtctaatgagctttccggatgggatgcggcaagctgaggtgtgcatcaggtgcacttgtcacaggcacagacctccgaagagactggctttcaggtctgatttgcaagctggatatgcccgtcactttggattagcttccaatttaaattcagctgttgtcatttccgtcttagcatcacatgcattctgacggaaggccttgaataaaatcacagttccagaaaatcctgtctgttatcataatgctaagaagccactgtggtagactaaaatgaactagacatcaagtatgttgccttagcaatctatctgcctttcctttttca

SEQ ID NO: 48060 - DNA, 844 bp, Bovine  19866881356420
gttgaatgcgagggttaagtgaactagtctatgggaagctctaagaatggtacctggcctaaggtcagcaatcaaaatcgagtatctgtatcagtattgctgagaactgtttctgcacgcaatcttcacagcccaaaatgcctttgccgtcaagttagcctgtgggagaacgttttctggattcctccctcagaggtgatgcttatgagatttaggaggcatctcaccaggggtggtctcccttttctctctcccaccctccctccctccttccttctgtctctctctctgaagcagccacacacaattgccagatcaaaatgaatcctcacttttttttttttttttaattctccagatgatggatagcaaaactaaaataagtcctcttgagataatgttttttgagtgtccagctggtggagacaggaaaagcaatttcaatgagacaagagcctctgagaacagatttggagagaaagtatcatcctggtcttctagaaatagaagtgccatgatgcagactgcaaggaattcagattatccgcagagggacggtgctgctcagtgaaaggggaaatgacggaagctacaagggcagaaatggccttgccaaatcccgatttgaccagctagcctgcagaaaccagcgtaggcctgattgggtgccatatcctgctttgcacacttaacatcttgggcgaggtgtgatttgtggtggaagcaatttggtgccaaaatccttgcacagtgggttattttcagctagctctaggatttaccgaatgcaaaaatctagagattgatagccaaaccatactacttcgagagacaccacttccct

SEQ ID NO: 48061 - DNA, 1025 bp, Bovine  19866881365163
ccggctttaagtgattgcatttctaagggtaatgttaaggtagagctggatcagtgaggcctaatattcctcccagagattaaggtttgataccacttatatcagaaacttctttatttaaatactgccccaattttgttccctagtctcctaaaatgctcctgaccatatcctgaacacacgagagagagagagaaaaaaaaagctagctctcttaggaagcatgttcaattttttgtgggactggctggtggggaaaaatggtttttaagactaaaggttgggagaagaacacacagtatgtgggagggtgcattgcaaggagtgtatgaaattacagcacaaaggatcaaagagaaaaattgcctttagagtgacaggctctccttcaaggagaagaaaaaccaaataatttatgcctgcggaggtaccgtagggctcatatattagctggcagaattcctcaggattgctataactgaggcttttgcagggaggacctattaatcctttgcatgctttgccattaatattgtttattgggccacaagaaggggacataaacctttaatgtcactttttcgcactaaggattttttccttaaaaattcaatgttgtctgccaatttgatacggcactttaaggtgattagagaagcagatggctgattcttaatgactattttttttttttttgcatcaaccattgattcgttatttaatgcacacggcacagaatagcaacattcctttttaatggagttgaactgtgctgcaaataggcaaaagtttttactgacaaataaagatttgacttagaagggtctagaaggaaaacagagcgctaggactcacaaactaaccaaaacataaaattctggaggagagggaggaagcagagagaagcccagtactcactacgcactcagtgtcaattgtgaaggaagtgtcaagcaaggattacaaaaagtcttcaggttaaaaagcaaggcaggcggctatgcttcaaatcaccggacagccat

SEQ ID NO: 48062 - DNA, 1145 bp, Bovine  19866881421208
atggacagggaagcctggagtgctgcattccatggggtagcaaagaatcggacacaactgagtgactgaactgaaaatattacaaactaatcagtaaactctgtaagatgcaattttaataagaactgttataaatcaagctgtttgtctgcttcgttcattgtgaaaacgggcacctgaaaagagagtctcgcccgtggttggcacacagcacccacttgttagtgttgcttttcttatttactgcaagacctatcaagacaaaaaaattccttatcctagaaatatctaaaataaatttaatagttttgaagtcattttcttggctaaactagaatggataagacattagaaaatgactcaaaatattctagatagagcattaaagttaggtttatggacatatctggaacttaaatagcaacaacccacagtggtctttctacgtttcttctttttgaacagttttgagaagatataataacatactacacaattcacccactgcaagtgtaaaaatcttatgattttcagtagatttctagagctgtgtaattatctgcacaaatcaattttggaacatttccatcaccccacgatgttgtctggcgcccgtttccagttaatccctgctcatccctgacagccattgtctatacttattatgtgtttggacaagctgactcttcaagccagcaaggagtgaccctccaaaggaaagagtttccccaaagaatatagtaaatatcactgccttctgttccttttgctttctgccccaagtttatgtcaatcacagtaactcacctgagacaggcagaaataggattgaggagaggtgtagacatagttgaaaccatgcctgcgactaggcgaaaagaaagtgatgggactgctgtgctcagatgtggttttcaggggtgtgtgtgtgtgtgtgtgtgtgtgtgtgtgtgtgtgtatgtgttaaagagacaaaaggtggtacctgtcttaagggaaacgcaccctgagtttgggagtacacgcagcataacaacgcttaaggaattgatagtaaagccttcttgactatatctaaccaatttccaagccttttcaactttaggtctaaatactttgaatccatcaattttcctccatctcca

SEQ ID NO: 48063 - DNA, 743 bp, Bovine  19866881533709
tgcaggcaatgttactttagagcgacagctggatgggggaaactggtcaaaggctgatccacagcatatggcctcaccagtttcttgattcccccacacataacattcttggcaaggtcaagggcaggcaagaaaggattcagtaaacttttgcaggtgatgtgcgctagatgtgtcctgcaagtcagcatcctgtacatgcagacctaggcgccagcccttttgtttaaaagacaaagattttactttttttttttaagtaaggaacatgaaatccacatggatggcactgatatgttgacaatacagatcgtcaacccgatagaatttcactgttcagtcttaagttgtaatttttggaaaaagatgttgtaattagtactagtatttctaagtctaagctttgcccttccacactttaaggagtgtagctaaatagcaaggataatattctaatttgttatttgtcatttagatggagtgtagtgttgtattactttgtcttcagccagcaaatactgagtctctgttcccccaggaagcttatcatcatctaaacacatttgtctttttgatcaagctaaatggtaatccagctccgaaattttatttacagataaggttaatattagctaaaggatcaagagaaagtcttgatgtcctagaaaatacagaatagtctcttagagtagtataagataatttttcatcctttttattccctctttactcatcttttatag

SEQ ID NO: 48064 - DNA, 746 bp, Bovine  19866881546097
caacctataaatctcggaactggcaacaagtatctgaatttgactgatgggacccaggataaatggattcctggtaatagaaaaagtttgctcatgcattctgcttcctacccatgtacccagtgtatgcagggatctaggtaccgttcattcactttgaatatggatttagagtctcttcttttatggtcttcctctaatacacagcttttatcacctaagtatcaaatcgtaggggatgtctgagtggcattgtgtcactatggggattgtttgataattgacaacagtattaccatacataacactcttccatggaatgagtttggaattttccgggaaagaaaaatcttatatctcttttattactaagccttgaaagaaaatatatacaaataggctaagtgaataattcctcagcctccaaaaggttaacttttcgtcttctataattgagtctcatgttaaattacctctcttcttttgataaggatactcagtgagctccttaaggtgaattaaaggtagtatctgaataagtaagccttggacagttggagaaggcagggaagtgtgaattatggagcactgtaataccaggtgttaccagcagatgtcacaaaagcagatgaaggtaaaagaattctaccagtatttacaagcatttaatttagtaaacacagattgtaataaaatgtgcaacattaatctgaagtgtgatatttttataaaatgcaaaggtgcaa

SEQ ID NO: 48065 - DNA, 759 bp, Bovine  19866881558167
cctccgtattctggcctggagaattccttgactgtatagtcctggggtcgcagagtcagacgcaactaagtgactttcattttcactttcaagccgttggccagcttctcagtccaagtcaagacagtgtttccaaaagccaccgccaaggtggtttcaaacttagtcacttgagatgaattttaataaactttctttccttgcttcctgcttttcaatgtctacttaagaacaaacagaaagtcaactccagtactcttgtcagtttgagcccgataaaaagacattaacattccaataagcaataatgttcttttatggcatttcagtactgaaaaagtaagtagttctaagaccgctgtgactgttagtacttaaatggccaaattatcttaattgtctcagaagtggtactaaagtttgaaaaagagagaccgcacaggtgagaaagagggaaacatgccaacattatcctcagcctttagaagggaacatttgtttgcatttcactcaacagcaaaccacttcccagtaaatcaaagcccaaagaggtccgggtggcaaaattatatggcacgtgctacccttggctgagttgtagtaaatctaactccgttagtgcagaaagctgctgtgaagaattatgagaccatttgatttcaatttaatcaacttagagttccaggctggcccattttgaggctgcaggacattgcgtcgcaaggcctgagacatatttttactgttaggcagaaagct

SEQ ID NO: 48066 - DNA, 2015 bp, Bovine  19866880928708
tgaactccctggtatttttttcattgtttctttgcagacatgtatttgaatactgtcactgtagccactaaatgacacttaaaagacagcaaagaaaaacttgccaaattgggagaacatttccacatttatgttttattataaatagtatatcacaattttcatgtaattttaggcaacatggttatatcaaattatgactataatttcctgtttcttttattttaatatacatggtgtcacttgttgaaacacatagccactgatagtttttctcataataaaatcatttatttactctctccttaactaacctgttaattcatttatctatgtcattttcagttttcctaatttcattcaagccttggattggttttatttaatttttaagatattatttgacttttaattttttgtagtccattttttataaatttagtgttttataggttgcaaggattttaattttcacttaaaaaaaattcctaaccatcctagaatttcccatttccacagcctctttgatttgaatgaaaatacatactggaataatgtgaaatactactttaaaagcttctcagatatagtaacacaccattcaaataggtttgtttataatgaatataaagtagaaatgctaagttgtttactgccaattttgtgtatttttaaaatgtgtttacttttcatgatgatatctgcttttatgttctgtttttacagaattcattactattgggaattaatccagacatacgtagaagatgactgactcagggaaattaagataacctgaaaaaatacaaatagccccctgacattttctggagtagaaaatgaagaataggcaatatgatttttatatacaagaagatgcaaagtaaaaggaagcatcttaaaaagctaattttaattaatttaatcttcttattgtaaccctgatagttaaccccttattcttttctctttccagaaatagggccaaggtccgcaccttgatcactggagtcctatctctattttagttttacagccatactagcaagctgtcttctacatttaagaaatgtaaactagttaataaaactgtgagaaccttgacttttacatttcctaggtgttacgggtttcaatttgcagtggcagcattgtattatcatagtttattttccctatgatttatcaaaataaaacaataaacttgaaataagggtgtgaaatagagagtagaccaagaattttattttattgcttaattttttaaattgaagtagagttgatttacaatatagtgttaatttcaagtatacagcatagtgatccagcatttttttagcagaccattgtcagttattgtatttcctgtgctatacactatatccttgttgcttatccattttatgtatagtagtttgtatctgttaaccccataattctcatttgcttggactctgtagttgtggcacatgggctcccgagtgaaagggctctctggttgtggcgcacaggcttagttgctcctcagcatgtgtgatcttagttctctgaccagggattgaacctgtgtcccctgcattgcaaggcgaattctgaaccacccaggaaagtccctgtttgtatatcttagatattaacccttaattagttacattgtttgcagatattttcttccgttccataggttgtcttttcattttgttcctttgctgtgaaaaaaagtttttaagtttgatgaggtctcatctgtttttgttttttttttttggctcttatttattttgcctcagaaaactgatctaagaaatagtatacaacctaatagtacaaaaagtaattgcagctttggactgtgaatattaaatcattatcactaggctcatgtttattaatcaaaataggaaccattacaatcaatgtatttttgcaaatgagaagtagtttgtttattcctgtagcataaaaatccatgcttcaggattcaacaaagtctggaaagcattttctgcctcccg

SEQ ID NO: 48067 - DNA, 826 bp, Bovine  19866881036535
aactggaaaggctgctcaactttgcctccagtagagggtagagggtagatgtccatgtgtggccttcagtctttaggaacagacagtcacatgattggaacaggaatgtaggcaagagaggagtgcaggaaaagtgttccttcaagtaactacatggaaagaataggtggtaagtaaaagaattataacatcttggcatcctaatgagtccacagtacaggtgtcgggaaactgaaataggagtttgacagggaagtaaaggcttatttgcaataagagagcttcagtaattttcttacccttttcacttctacagcagacatcaacttggatatatcaaagcctttgaaagcaaacctgagttttaccaagttggatcaaataaaccattttttgaagaagataaaaaatgtagacagcaaaagcgtcctcagcaccgtcagacactgtgctgagtaaggatgcgcttccagcctccaaatgttaccgtgggaagttatccaagcttaaagttcatggtgatggagcacaaaagattccatttcaagaaaacatatggagaacgatttcctgctttcaaaaaatttctgttcatactactcagattgtggtctccgtggaaactgtcccccatcctaataaaccatgcctgttggcatctttatccaccctcagtggaagccttaatgtcaaagcagcgcagaaagtacctggtaagtcacagtaaaggggcaagagagatgtcaatgacttgttaacatctaaaactgcataatgttgaaggtttgtgttatgtaggggcaaaaagtttcaagaaccattagag

SEQ ID NO: 48068 - DNA, 866 bp, Bovine  19866881083369
tgttttctgagatttcctggtttctactggtatttatgcttagaagaggcaatctttctatcccctgctaactcctcacaggatgggtgttcttttcacagctgcatttcatatatgtaaaatcaacacccaactcctctagcatattttcaccagtcgtactttagtaggtaatatactaggaaggtaattatttttaaagagcccaaatgacctagaaatagagtatgtaaagtataagacatattattattaagcaaacaaagtaattaatgaaaaaaagactgtgaggctacagactaaaatgcgaacagaggtttgtattgtgtgaatatgatgggtaatggtattattttctttatttcccaaatgttcttcaaggaacacatattattactaattacaaaagagaaagtatttacaactatctataatataaaataggaatcagaatacaaaatggtatgctatgattatgaccccgtaaaggcatacaatgatggcaaaaataaaggtaaaaaaaaagagaaaacagttcagctgcaaggtgttggaatagtggattttttttctctctgttagtgtcaaaatggtgcttgggaaagaaagggagggagggattatatataaggaataagatgatgctaaagcgaatctgtcaggagaattcaaaggtaggacattgaaagcgatgggcagcaacatcaatatgggtccacagcacacataccacatgacccaagaaactgttccacttatggtgattcagtgtctttttcttgtcattatgagagcataacagaaagatagaacagatatgtaatctagaaggagcgctgaagaacacattgctaagccattttttc

SEQ ID NO: 48069 - DNA, 1408 bp, Bovine  19866881293061
aaaaaaaatgtaaaatagaaaatgaacaaatagtatgggtgggacttaaaaagaaaaacaacaacaacccagcaataagctgtgcccacaaaacagtttttccatccacacaaaatgaccaagcaccttcttgggtgttccctacagaatcctcttcctctgaccctgctgcccaagggaaaagagtatttttggaacacgtcactctcaaaaaagtaaaaaaccacaaagaacaaattcttttatattccccaatacaaccacttcttaaaaattcagtaacaattaaaataaatggtagtaattttagaaatgtttccatataagataaagaacagcttacttgcagggttaaacagcgtaaacattttctgtcatatgttatatagttaaacaatattttaaagatttttattttcatttgtaattttcaatatacaaatactgctaattccaaagaccatcggaatgattttactcctgaaggagaaacacaggattacagattctctaaaaagtacaatctggcacaggtctgaggaactgagagttggtctgtatttccttgaatggaatgaactataattttttcccaactatatatcctcaaccacaggactgtattgtacctcaactgaatattatggcctaatagtttgatttaagtatcaaaaaaaaattcttttggctaaaggccaaattcaaaacattttttgtgtgtgtgtgtagtggggggagtacaacaacatatctatttctgactcttggcctgcttctttctccctttggacctcatccctgacagacatctgtattttgtaacttttcctacatgctggctctgaagatactctgagttttggcctaataatccttctctgtttgaattcattagtgtgagaatcacaggactagaaaggactttgggaggtcatatagacatcaacttgctctggacaagactaactccaaacgaggaagaccaaatgatgtttaaagactcgtagacgaaatttcaagatttctctcatcaacactgcagtgctttgcatgcttcactattagaaaatgttttatgatatagttttcattttataaaaatgttacttggcagacatcaggactttctataaaatgaagtaccatacagcttacatttttagtccattaaagggatatttaagactgaaataaattatttgttggactccaatggaccataactgggacagaggaggtacctagcttatgtgacactgacatcatttactgatagtactacaaatgctatagatgttttcattcaatttggtctttatatttaatctatcttgctgctgcttagccacttcagtcgtgtctgactctgtgcaacatcaatggattaaagcccagtaggttcctctgt

SEQ ID NO: 48070 - DNA, 812 bp, Bovine  19866880703536
ctggacctgttttgttttgttttgttttagagttggatgaacaaagagatttacaaaggtcagatatttaatgagttgactgctttggtagtgaaacaccaaatgagttgccagaatgagatgtcttaaaaactcaagagaagggttgtcgcacatgtaggtgtaaacacagataataaaatatctgatgtgtttaaaaatatgcactactgaaatgaattgcaaagtcttatttaacataaatcttcacattttaaagttggtctttgttaagtaatgaaagttcatattttatcggttttcacacaagtcattacaatacctggagaatacaatatttgcttctaattttagttttaaaaccttttataaaaaactaagagctacttacaaacactagcacataaatatacattcattgtggagaattcaacacaaaatatatgtggatttttttttttaatgttggcaatttgatctctgattcctctgcctttttaaaatcatcttgaacgttgggaagttctcggttcatgtactgttgaagcctggcttgaaggattttgagcattactttgctagtgtgtgaaacgagcacaattgtaccgtagtttgaaggttctttggcattgccttcctttgggactggaatgaaaactgaccttttccagtcctgtggctattgatgatttccaaattttctggcatattgagtgaagcaacgtcttcttttacagcatcatcttttaggatttgaaatagttcagctgtaattccatcatctctactaagttttgttcatagtagtactt

SEQ ID NO: 48071 - DNA, 788 bp, Bovine  19866880346722
gtgaatcatttgtaatatgtttacatttgttatctggtctttcctttaatagatgcctataagaaaattttagaaaccacaatgactccaactggaatagacactgctaaactttatcccatcctgatgtcatctgggcttcccagggaaactcttggacagatatgggccttggccaatcgaaccacacctggaaaactgactaaagaagaactttatgccgttctcgccatgatagcagcaacacaggtagacatcctttagaaggttaggtgtatattttcaatataaactgggagaatatgaatcctttttcctacaacttatagaactctttgaacattaaaatttaggttattttcaggatagagttcttcagaatgtactgtttatatgatatgcgtgctagcacaatactcttttatttaaaggctttactatattaacattctctgacctaactgtaatccttttgagcttgaaagttagtaatagatgaagtttctctgtcctttgaagtccttgtctaaaattccttagatatagataaagtgtactcggtctggcagcagtttttctcatattacaaaatcattgtaaaggatttgattacagtgaattaaccaaacttgtcagagtgaaaatgtcatattgagtgtgtgttggccatttctttgctacatattagatttacattaaccttataacttactttctgaagtcaaattcctgcgtcctgggagagtcagagagaaaaccccagggctgcagattttacatttaggtct

SEQ ID NO: 48072 - DNA, 3194 bp, Bovine  19866880387208
aggtggttcctcttttcctgtggttgtgtgattttccataaatacatatgcatttaaaattttttctctcattgataccctgataaaaatgcagctgataattttttctttctcactgtgttttttgcaaagcatgcatgtactcgttcatttattcagcacacacttactgagcactatgttccaggcaccggccaggaccctggggatgcaaagatggaagatgcagttttttggagataaaatatttgaaggatccagtttcattagctgtgcattcggagggcttatcatatgctaagtatcatgagaagaattgaaaagagcttgaatagttccttcagaaaacttaatgtagtgagagagatcacatattgacatgaaaaatactcaacactggtagagcgagtgtgaattaatgcggtgagacctgagtacagaaattcaggggagatgtaaaatggagatgcagcccacagggcctgcaccctgtatctcacgaaagacagtgcactttttttttttttaagatgtatttgttttcgttttggctgtgctgggtctccgtcactgcgcaggctttctctggccgcggccagcaggggctcctcttcgttgtgttgcttgggcttcttgttgcggtaacttctcttgttgtggagcacaggcttagcagttgcggcacacgggcatagttgccctgcgcatgtggaatcctcctggaccaggggtcaaacctgtgtcccctgcatgggcaggcagattcttaacccgtagaccaccagggacacccagacagtgcacagctggcgtgctttggaagatcgcctggggtcttaaacaggacacagctggggacactggccgctttagtctccaggacctggggtggctgcaccgccagacctgtcacctctggccacgagtgccttatttctccgtgtaccgtgacgggagcagtgtttggaagcaccgcttcatggcctttgatttgtctctttctccccagatatgtacgaccaggtgctgaagttcggcgcttacatcgtggacggcttacgggagtgctcgcagcccgtgatggtctacatcccgcctcaggccgagctccgaggcggctcctgggtggtgattgaccccaccatcaacccgcggcacatggagatgtatgcggaccgcgagagcaggtagtgctccttccttgcttcctctcactgcccctggggagcctcccgctgtcgggtgtcctccggagagcctgtctaaccgaggggcctttatctgactcagactgtccccagagggctccagggtcacaaagctaggctttctaggtagcatccgccagcacgagaagggagccaggctggagtcagactttcccatgtgatcccccaccctcgattcttttactgtgaaatcctccatccgggccctccaacttgagagactctctcctattggttgttcacatcgacctattcagtatctttttttttttaagttttttttttttcttaatatggaccatttttaaagtctcctttgaatttgtgacagtattgcttctatttcatgttttggttttttggccatgaggcgtgtggaatcctagctccccgactaggaatcgaacccacactccctgcattggaaggagaaatctcaaccactggaccgccagggaagtccctcactatctccttcttaggtatgtggcagaggtggcttacagcgaggtggggcagaagcactgagctgttagtctggagtcctggagtcttcaccagaccctgccgcaggctagagggaaatcggagcggtcctcactctccctgagctgcttccccttgtctgtgggatgagctggatgaccatcgaggtgcttcgcggcacccacgttctgtggttccaacccaagcttctcccccagggcagtgcctccctcgaggcttggacagcagtgttcgcagctcgcagagaactgcagtgaaaatcccaagcttctgttaggcatcggcgcctgaaacaaaatggaccaaatccaacttcctttcgtgattggttttcagccttttcataaatcttacaccatatttccttgacattttccacgccagtccctatatccagtcattttgttagagcacctacgtctcccccctttcccccaaatttcagcctcttatttcaatagctgcttaagagaatccagtggttttattgtcaaatcgctgtgctaacgttctatacttaaggactgacctttaagtcccagcttagcctctgatctgataccaggttatacacatatacacatacacatatcaaccggtgaatgtgttagtcgctcagtcgtgtctgactctttcgaccccatggactgtagcctgccaggcccctctgtccatggaattttccaggcaagaagagtggcgtggggtgccactttctactccaggggatgttccccacccaggcatcgaacccacatctcttgcattgctgcatcggcagattctttaccacaggcgccacctaggaagtcactgtgtgtgtgtgtatatatatattcttttttttttttttttaataaaaccttctacacgtcaaaaattatatatatgtaaaacaatatacatatgtatattatttttttaatgtgtagaaggtttttttaaaagaaaggtgtttagggtgaacttcctggtaatagaacgtcatcagtatgtactggaagtgaccctgaagcccctcggcctgtcatttccatggcggcaggctgaccgtttcctccccagcttggcctggccccgtgagcccgagtgcaaacagcaggctgccgtgcgtgcgtgggactggtcggcacccactcccctcgttgcacagcatgcatgatggagattgtccaactgtcactgcacctacatcaacttttttttttttttctttttctggaaaatgtgacttctttcacccttctcagctgtagatggtggaacctgtatcttctccctttgagatggaagtagactgatgtcataatgagaatgaatttatttgctttctgccaggcctctctcgcagcccacttagactctctggtgcctgctcttcccctccggggttacttctgtgaaccgtgggtgggcagaaccatagcgaagctatttccggtccacagacagtaaccg

SEQ ID NO: 48073 - DNA, 3082 bp, Bovine  19866880434273
aagagcagtgtcgtttagaaagtatgaccagaattgctcttttatagaaagaagcaaagaggtggggtctcctgggcagtgagagaggctcagcttgaccccatgtggcctttgaccccgaatcctgggggtccctttcactggggtctgtgagctgcacccagaatccggtgggatgcctttcacccttgacatttccaagccaatcacccatccctgataatgcaggaatgttcctctggctggtggacctctgccagctcaagggctcgtcccagccaccaacagagtaaacattactcaaccgaccagggccctgtcacacacattcttcccctgtgttcctaacctcacgcagagcacagcccggccctgtcgggtctggaaatgggaatcgaaaaatcaggcaggagcgagagtgcagaggagaaagagcttccagaaaggaaacaaccacgtccatcaattataagcagacagagctgtcttccctgtgaagtcaaaacacactgggctggcaggggtggtggctgcgacagaaaggaattaagccagtcttgatgggtccagtaccgcatccttataagtcctctcctccttttcctaaagaggagccactttttaatttttagttgccgcctgtgggatcttgagttgaggcacgtgaactcagtagcggcatgtgggatctggttccctgaccagggatcaaaccctggtcccctgcattgggacctcagtcgtagccactggaccaccagggaagtcccgaggagttccctttcttgaggagagaggcagagacacaaattattcagactggtgaacttataagacactcatttggggatgaaagaatgcgaacaattcccccggcttgaaattgagaactcaaaacttgaaaactttccaagaggctggcattgctgcctcagtttcctcgctggccacacaggaccatcgccggttcttattaacattttcttctctccgaggatacagatggatgtttgccaaagattaaaaatctgaaagcctgggagtaaaaatctgaggcaagatgaaagcaatttaaacacggggctggcttcaattccagatctctttctccccgaggtggcttagttaggagtccaattcaaaagaggagaaacacagacaggcctgcggggacggtaaacattcttgaactcaaggagtaaaagttgagtgatacttcagggaagcccacaaactggttttcttataaaaatcaaagcaaacgtaaccaaggaaagaaaaaggcttctatcaaaagcatcttggctgagaaaagaagcaaatgtgcatgcacctgagaaatggctcaggtagggaggtggacagggcgccagcagctccgcctgtcctccgcacaaagcccagcttggccaccacgcctgctccttagcagagagagggtttctgctggcaaacgccagagggtttgcagggagcacgccagcctggagatgcaattgcaggtggaagccacccaggttaaccctcgagaagctgagaggtcttcacacctgtaagtgttttacacggtctgcttctcagtgggttccagatgcccactggacagagtggaaagccaaggttcaaagaggaagaagtcattttcaccacctcttacctagggtctcccagcaaagaagagctattctaaagctgacctctctcctttcctgaaagccccacattgaccccagatacacactgaccccagaatgaacctcggggcttcccaggtggcgctagcggtaaagaacctgcctgctaatgcaggagacataagagacacgggttcgaatcctaggtcaggatgatcccctggaggagggcatggaaacccactccggtattcttgcctggagactcccatggacagagaagcctagcagactacagtccacagggtcgcaaagagtcagacacaactgaagtgacttggcatacacacacatgctgagtctcccatgataatgcacaaatagtttgaaatgactttgtctcttttcttgtttcttggctgcatctctcactggaacataagcccgatgagtgcaggaccttgtctgtcttctccacaatctccttcctcagaaccttgcacagactatgctctgccctcgataagaggacatgaggaatgaatgcatgacctgcccttcaacctgaccaagcagtggagaagtgacgacagtatcactgatcctctgaatctcttgagttttctgaggttgatgagacacatgtatttttaaggaggaagaagggggactgagagagatggagagagagagattaaaatacaatcaaaatgaagagagagcattgatgcatttcagcaacttcaccttggaaggtgcaaaatgcgggtgcctaggagtaagtatgacacagcagctctttcttttcccaccggagaccccagatagtgctttatctagagtggaaagagccagtgggatgcctgtggggagcctacccattccccacttcctttttttaaaaaaagctttttattttatattggagtatggccaattaacagggttgtgacagtctcgggtggacagtgaatggaatcagtcatacatatatgtgtatccatctcccccagactccctctcatccaggctgccacataacattaagcagctcctggtgctagacagtaggttatccatttcagatatagcagtgtgcccatgtttattccgacctccttaactatccctccctctcccatccttcccatccttccctacctcttgaggcctaagcatatacaaggggcctttaacagcgtgggaataggcacctccattaacacgagctgaccatttctaaagggtttaggctgctggcaggaaccccaaatgtagtcttgccatgttagaatgcagttttaggccccttgggttaattcgggggtcaggaggatcaattactggggatttaccatggcaacctgggtaactcaaacggctttttatccagaggagtctaaggtgaaactaagaaggggtaacgatggacatcgttaggcctaaag

SEQ ID NO: 48074 - DNA, 1509 bp, Bovine  19866880450651
tacccttgggccaaataatcaaaaaaaaaaggaaaagaaatttacagaagatgtccaacttggtgtcatttaaaactatctcacagtaagttaaccacagcacatctctcttactagctgttacttgttgaagcggttctcttacaggtctggacatccttctaaagctcacaacacctccatcacagatgtagaaaccaaggctcagagcacggtcactgaatgcctaataaatggcggaacccaggcttgaacaaaagactttgttccactcatccccaggattacttgggacccagacacccgagcggtgagtgtcaggagtggcactcctgacgtgatgccatgacctccacggtgagcatgaagatgtttcagccaggttaaaggggccttcctgaaagaaccttatgggaccagagaaggactccaaattaaacccacagtttgataatattcataaaaatatgtgtaaaaactgaaagcagagacttccctggggatccagtggttaagaatctgcctttcagtgcttgggaagtgggtttctggtttgggaactaagatcccacgtgccatgggcaatgaagccagtgggataccactactgagtccacttgatctagtgccttcgggacacaactactgagcctgctcgatctagagcccgggcgccgcagcaagagaagcttatgcaacacagctagagaaacccagcgcagccaaaataaataaaaatgtttgaaaacttgaaagcagtacagaggaaaatagttggcctagcatttaggggaggaaatgagtggatgttttattctgtttatatgttcttaaatgttttcatgccaaggtcttaacagcaagcctcaaaaacaaacaaacaaaaaaacccaccttggtcactgactggggctttatcaatgtatgtaggtgtttttctctgtctcctacctttgagtaacttctccaccccaccagttctgtctcggtttcatgatgcttgcaccttgttgaaaccacaacttcccctccggggattgctgagtgctcaggagggaatcatggggaggactttttcagcagaggtgagaggatattggaatatgacatcactattcaaatggcgaaggagagagggagagtaccaagtgccaaggagaaaaccagtgggcttttatggctctgtttatgggaagcgctccaccggccgaaaggtcaggagctgacgtgtccaatggcactggagcatcacatgaaaaaacagaaccttataaaaattcataagctcaccaagcacccacttgacttgggtaagggggtggtggtggccagaatgttgtcaggccccagaaaaaaagaagcccagtagctagctgaccccctgaggacctagcacggtgctaggtccttctagtaaaagaacactcataacacttctttcggtggtccagtggttaggaatctacctgccaaggcaggggactttgggttccatccctggtccaggaa

SEQ ID NO: 48075 - DNA, 2205 bp, Bovine  19866880560395
gagagaccagcgaattctacctgtatattcccattttgccccttcctgttcagagctgtgagcggggctgggttagccccgggatcaagacctgccaaaggctgaggaagggagcagccagagccatcacctctctgggacccagctggcctgggttccatttagcttcagctacaaagaggagaggggcagacttcccagggggctcactggtaaagaatccgcctgacaatgcagcagatgtaggttcgatccctgggtggggaagaacccctagagaaggaaatcacaatccactctagtattcttgcctggaaaattccatggacagaggagcctggagggctacagtctacggggtcgcaaaagaatcagacactcacttagcaactacacagcagaaggaaaggtggaagagattcttctgaaaggaatatgggaggcaaaatggctctcagatttctgctttccttactagagaagcacagaaacaagcctccgcaggcacctctgagctgagcgacgggcctggcagcgcctttgaaggagcccccggaagcggggaggccgaatctgaccactgggctcccatcctccgcccggtctgcctttcatctcagcccaggcgcctcggctctattctcattctcctgctgtctctttccatttgccctctccctgactgatacactgatctctcggtcacttggctttctgctccactgcgtccatattactaataacacctccgccacggccagtttacctcatgaaggcaggagcacatcattacaaaataaactcataactttgacattctagcaaatacacgccgtttgttatttttatggctttagtctttctaacaggcagagggcattacatacctgtttcctttctatctttaaatgtgtgcacacatgcacactcgcacatgcaccaggaaacaagacagagcaaaaaaaacaaaaaacaaacccaacccccagcaaatgtccagaacagtcagacgacgggggaccctggtggaggcagaagccctgtcactcaggaggccgcgctccgatctggctctggttttatggacgtcataaacccgatggcccacagctggtccttctgggacagactgcctctctgccagaagtcgttcggtgtgatcagcagtatttttaattattaaaataaaattggaaagggggaaaagaaataaaaaggagacactgcactgaccctgaatatctgatacccagagagtatgtcaggggcccagaatgccttgctgcctagaagcaagaaaatagctagggctattttgtactcagaaatggtatttcctttcccatgaaaccctgtctctaggacttgataaggtccaaccacttagaaccccacgcctctcccaaatcagtaatggccccatcgagaaccaatctcagaaaaagggactgaaactgatgaagagatgcttagctgttcaaatacaccttcctcagacatctttaccccctcatttcaaagaggaagagagcctccagaactgggttcctcctggaggcttccttgtccacccattccaccccatattcttacatctaatgggagtcagatctggaaggagctaatcacttagcatgtcttccctttaccagtggaaactcaggttctgacatcttggcattgttctgaaaaggcagcagtatttctacatttcttctcctctgaggaagaaaaccagggcttactacagccaagaacatcatcctgggctaaagaaatgtttgccatctgagaggattcattgcatttgggaactaaagataaaaattatatggcagacagagtgtccgaagagctccttctggtcagccttatcgcaggaggtaggcggtagtgggtgggggcaggtgcagaggggaaggacacgcaaaaaatgaagcctgcttcactaaccacaaacaaatgccaacaatcatggctacttaacaactggggaagagaaagcaggagcctccagttcatcttcaatgactgtatgtgtgcagcatgtaccaggagaatggggcgcacacagcagctcctgactgataggggtcggggctgactcaagtggttttaatgattttggaatacttcacaacaaaagctccaactgcagaagctgaatctgggcgaagacaaaacccattctgcccaactctgaaa

SEQ ID NO: 48076 - DNA, 1477 bp, Bovine  19866880561131
ttgtcacatgctattgtgcaggaattggttagtgacggaagggaacactgaaagcgcgagggccagggtgccacggaccctctaaaatacacatacttgggtgaggccggcctgccagcatccaccgagggtcatacggcgccttcgtgggcacaaactcgatgactctgtctattggatccttggagttcaggagaggaactgaactgtatacactctagaaggcgatgggagggaaagagcacagcggtcagtgaacaactcgtaactcagcaacagtgacagacaaaaagagcaggacccacatacggaagcacacccgttagtctcatccatcagctggaaggaccccaatcgagagccaggccctaagaaacaggtacagctctcaagtctcacgtgggagcctggtagaaagtggggcgattggactcttgacttcagtgcgcccaggctctctgggaagtcccctagaggggtggacaccgatgacaaaggggaaagccccacaatgagaacgaagccttaagaagctagggtctgagcccagacaggactcaaggcttccctggctggatatcatcagaagggggcctgacccctgaaatccaaaggtgtttttaaagaaaggtaggaggcaaaagatggctttaagaaaaaaaaaaaagaaagaaatcaacagcttctagagaatattctgtaagaaaaaaatccttctcccataaaggagtcccatatgctgaggcagtgagctgtggtgaaaaggccgggttctccgggcctttcggtgccggcagcaagcggggaggactcaccttcggcatgtaagacagccagtgcaggacggtgaacaccccctcgaagtcgtcacagacggtgctgtgcgtcaccccattgttgtgcatgatctggatgccccccagctggttgttggaggtgtatacttccctcccgaggacctagggaaacaggccagacaaaagacgttcatccagtcagagagaaaggcaaggtctgtctcgtaactgccactaaaatggattcttttttctgcaagacagagtctggcctccgagggctgtgtcgagggactgtctggacctttgtcctaaaaagaaaactcagaagacacaaagggcattttagacaatcacatactctgctgcaatttaaacaccagcaagcccctctctatcagccgccacagacgcgtggtggcatcctgggctctggggggagaccacagtggtgggtaacgctggggccccgagacgcaggccacgccacgctgctgcccgcagacgcagaaaggggagtgcctggctgctgacaccctcgagcgacgagtctcagttaaacaggagcatagagaggtttggactcctcgttttttccaagggttacttttcccctttatattttgatgtttcaagtgaaatcctgaagcaactcatgacacatacatgaagccttgagc

SEQ ID NO: 48077 - DNA, 2156 bp, Bovine  19866880580320
tgtcattcactgaatatttaccgtcccaaacacagtgctgagtacctctcgtgttatcatatttgttccgccaacaaccctagtgttattacccacgttttatagacgagaaagaaagagcttagaacctggccaaggctacaccgcaattaagtgccagagctgggattggaacccggtcattgcaaacttcaaagtcggtgttccccacttccccccccagactccaccctccgcaataagccccaccccacacaccgttctgtgctatgatcctcacgggtgcccagtggccttcaaaaccccagggccggaagcttcaccacctcctgccacccactcaatcctgacttccctcaccctactaggcagcatcaggggagtgctgaagagaaaggggaggggagtttcaaagtgaggtgctccctgggttaaaaaatctggctttggaggccctgggttggttgagggggggtggggatgaacgaacatttttatcaacttaaatgtcactggcagccccaaaacaaacagggtcccacccggcttgctcctttatgaggcattcaatcaataaaatgagagcagggctctgtcagatttattggctgggttcaaaccgaacacctcttccacccgccggaggctgggtcaccggctctacctttccgttccaactctggacggcccccgttttccccggtggggctacaatggttcattgtttcaggcaggccttgtgagaagttgtgtttgttttgcctcttatcttatcagctccagagctacaatggcccaggtgtactcaccattttaccatcaggtgagaggagattgtggcctgggtccaggctggctggagagacttgctgtaaaaccgactggctagtcaccatggcgctgttgccatggtgactgattgttgaggaggaagtgacctcattgcttgcctgctggctgtagcgcactcctgcaaaacaaggcagacccaacagtgggatattagtgccacctgagcccccgggatcacttgttttctaggggagctgacaagcggggaaaacactgccctctttcccctgtctttctgtgagacatatcagctgtctttctctagggcagaggttgctcggcctctgcttgaagtctggaatggaagctccatgagggcagagtgtttttatttctgtgttgttttgctccttgctgtattctcttggttggtgttgtttaattgctaggtcatgtttgattcttttgcgacttcacggactatagcctgccgggctcctctctctgtgggattttccaagcaagtatactggagtaggtggcccttttcttctccaggggaccttcccaatccaaggattgaacctgtgtctcctgcattggcagacagattccttaccactgagccacctgggaagccccttcccttggtagccacatgataaatatgtcaaatgaatgaacaaacagatggatggattctacttcttgttgcttctacatagtgcttttaggttttaggggctttcccatcccagctggagtatttcttttgctcttcaaaataccttttagaaatgtttccctggcattgcttggctaggtagggctgcagagtatgaactgacaggttttacagagaggcattggcccagtgacccttgaaagtgaaagtggctccgtcgtgtccaactctttgtgactccatggactgtagtccatggtattctccaggccagaatacttgagtgggtagccttttcccttctccagggtatcttcccaacctagggatcgaacccaggtctcctgcattgcggcagattccttaccagctgagctacaagggaagcccaagaatactggaatgggtagcctatcccttctccagtggttcttcccgacccaggaatagacctggggtctcctgcattgcaggtggattctttaccaactgagctatcagggaagccatgacccttgtaagggccacaacaaaatgcatcgttctgtgtaccaccattctggccaaggcccagtgaccgatgggacaacagcagagcacgatggggccagggctgtagctaggacgctttggtcctggaactcacattcccttcagtggggtcccctctggctgactt

SEQ ID NO: 48078 - DNA, 1395 bp, Bovine  19866880620990
cccaccagactcctctgtccacagaattctccaggcaagaataatggagtgggttgtcattcccttctccaggggatcttcccaactgagggactgaacctgggtctcctgcactgtaggcagattctttatcatctgagccaccagggacgctccctacacaagatatatactctttataaaaaaaaatacaatgtttgaaaaatctacaacagttatgttgaggtaagccttcccaaactgcacacggtatcacttttctggtgcagttagctcttcctcacaacttctcatcccaacagccatatgaatgtggtccacctacagtcacttcacttttttatttggtaaatatcgtttctttttggctgcactgggtcttggttgtgccacatgggatcttttcgctgtggcacatgggttctgccttgaggtgtgcaggcttctctctagttgagttgtacaggcttagctgccccatcgcatgtgggatctgagttcccccaccagggatcaaacccatgtcccctgcattgcaaggcagagtcttaaccactggaccaccagggaattccctcacttcacttttcagaagtgtgaaaatgtgcacaactagacaggtacatctgtgctcaggtaagtttatgtgtgtaacagtgaatgaattctagagatgactgggttggaatgctccattcacagaggaaaactgtaattcagagaagtcaagcagctttctcacgttgatacatttaactgcaggggctcacctggaacccacttctgttgactcccagtccagtgccctcttcagtgtaactcactgaatcagtcctagttgtctgcactactctagaaatacttttccttaatagaaatctcggcacgtctttatgttggtgtgtaaatctatgtgcttgtgtcagtgagcatgcgtgcgaatgtctacgtgtctccctgtgagtatttgttaagcatatcacctctgtttatgccctttctccaggagaaacctctagttaattacagttccttatgtctccactagcagtgaagtcaggtgaagatattctgaatcaatcattaacaagcaaacttggtcctctctccaataaactctattcctgggtcctgagaaaatgtggcagatcaattagggtggaaccagactcgcccagggtcaaacttagttctagggcagtgaaagcattcagagacaaggctgtgagtggcggtgtcagaccagccacatacagtctctacaaggagaatgtgctcaagctaacatggataccatcttggttttcagcctaatcattacatcctacgatgttaccaagaaaggtaagtactcttctagccgactgtcctgagaaatcctaagagaggcctaga

SEQ ID NO: 48079 - DNA, 3440 bp, Bovine  19866880725785
ctttttcttgcagatcatgtttcaggcatatggagacaaacagggcccattacatggaatgttaatcaacactccgtacgtgaccaaagacctgcttcaatccaagaggttccaggcacagtccttagggacaacatacatatatgacatcccagaaatgtttcggcaggtaaaggtggctacctgggggtgcgggctctgacgtgtgccagagagacaagatttttcctgaattttcatcagatacagcttacactgaaataggacactttcaaaaggcaggaattgtcttgacgctgttctcacttctttgtcttctggggttgagactgctagctcagatggtggatggttctttatgaatgaacaggaagaatgatgaggatagaggcctctgttgagtagagaagagtaaacagactacgcacatctgatggtagtttatgatgacctctgtgaggagttaccttcaggtgtctatttccaaagcctgtattcaagtcaaaaagaggtttgaaattctggttctcattttccaaaataacccaggtctctaactgatagccctaggttaatatgatgagaatcagtatataacatatacaaatggatatagagtgcatggtacacattttaaagtatcagttcttttgtgggagatttattacagtggaacaaaaactagtgtgagaaaatacgacattatgaatctcatcctccgtatgaaaataaattcctttgatctgtatggtgaatcatgtctaggctgcagatttttcttccatcaatagaaggcaagaaaagtatatcaccagcagaaaatgcaacagataaagaagaaggtatcaaaagaatactgaatttgtccttaaaaaaaaaatctatgaatatagaattttcccaactcttctagtcaaaaataccagcgttactacatttgaattttaataaagtaatatgtgtggtcttagtaaatagtctatttgtaattcctgtattattcagaaatacgagagatttccattatgtagccatttgtttacaaggtctctctctcgacacatagctgtcttcattcagtattactagtactgtcagcctataagttgagtgttgattctgttccctagtgctggcgccataaacagaaatcactttccatataatttatcctatagaatagacgtaagcacagtgatttgggcttgtaggtatgaatgaatcaccttggatttaaatgctgctctgagtcaagcagaaaaacaaccgaactagttcccacttcatgccgcattcgttttggtaatatgaaatttgaaatggacatcagaatggtttaaaaatgatgtgtgtctccattctctcatatctgagcagacttgatctatatatgtacaaacagtcatccacctctagtgagctaattcccacgtatggacatgtagctttgaaaatatactagagcatgcatcccctgaacctctagtagaaactctatccttgtgttcttgggtttgctttgtattagctgagtgtcagtcagtttcctggttatttttctatggctaagtttctctaggatttttcttccttttttaaagaggtgttgctgctactttagtttttaattttcccaggacattgttaggtccattgtgtttgttaatggtctcctactgattcatgatccctcagtagtttaatgttattggcaaagcatctgatttggggcatgtaaaaaatgttatgtgaaaaataattacaagtctattttaatggagaatgagaactctagaatttggtgtaacatttagatgctcagtagaatgcttggaagagaaagagcaaaactaaattgaccatgttttaatatttattttgttcatgttgaaatgctgattgttactgattagtcaaacttttctcctcctctagtccctgatcaaactctgggaatctatgtcctcccaagcattccttccaccgccccctctgccttcagacatactgacgtacactgagctcgtgttggatgatcaaggtcaactggttcacatgaacaggcttccaggaggaaatgaggcaagtcctggagattcccctccccactttcttatctctgtgcccacgaataccaactttccaaggaggtggtcattaaatagtataaataagatctgagtggcataggcagcattggtagaagtagtctagtcttattgaagtagaagttgtagtcctattggcagaattctttagccagagaacacagactggacagtgaggactatccttaatttttcaggtgtgataataagattacatttttttaaacagtattacaattttgctttataaaaaagagtattgtcttctgttagagatgcctactaaaatagttaccgatgaaatgagctaatgtctaggagttgcttcaaaagtatgtagggatgtgcgtgtgggagtgcagatgaaacaagactggtcatgagttgttaattgaagctaggtgatagaaacacaggaatagattattttctctatttttgtacatgtttgagattctgagatttttctatgataaaagccttgaaatatttctggatgttttttcttatttggatccttactggtgtatggtttttagtatgtttttcatgctcaggtgattttatctagtgctgttgtgagcatgagagattattttcttcataaaaggactccatcagaaccaggagtttaaacatcaaatgagataacagagaacctgtgactcatgtgtttttggctttagatccctctttcctctagaacactgttaataatgatgtaaagtcatattctgccccatgcattgagattcttcctgattctaactatgcttctaaagtacagttataacaacagtgataacaatagtaataagcctaaaatgagatatgtttttattttaaccttagaactcatccctagataaaactggtcccttagaaggagtaatctctacctgagtgttcaccataaacagactgggtagacctttggagataaatgcaattatttcctgttttattcaatatcttttttttttttttcaaaaaattttgctaaacgtacaaggtgcatgactatttattaagtataccagggctgccaaatttaaatcgtttagtattaagatggatgcgagcattggacccaattggacttgtaggagttctaatctaatgcctcaacagttagcagaaatgaaaggctggggaggcaggatgtattgaattttgacaagagtaggtatatgcgtacttgttggcacacaaagttgcagcagagggtgtgtgccactggtgcgtagcatctgcttagtgaagccctcagcagaaagaaaagcctcatcgtgccagacttaaattctgattattgaacagtgtcgtcttcag

SEQ ID NO: 48080 - DNA, 750 bp, Bovine  19866880834203
tcggactgcagattacagagccgacattcaacaaagtacagtttgggacaagaccatcatggggaggttttcctcctttctactcataaacatgagttgtcagcttaaaaagaaaccctcagacagaaagagaaagctttctctcactataacctctttatttcaaatctatctgtaacgtttgaaggcaaaacataatcagaaaaccaacctcccaagcaggtacaaggatctgagctggactcctgggattacacactggtttagttctatttctactaacactgtgatgtgaggtactatggttcttgttttagttacaagaggtgttaggaatgaatgcccacacacaattaacaatagcttatctagcacataactctgcagcacaataccaacaacaggagtattttaaagccgggtggagaagaaagcagacactaataaaactgaagatttcctttgttcttcccctcttttcacaatgagaattcagttcaaaaacaaggctccagaatgcccgtgcggtcctttggcccgccacactcctggggagcctcaggctttggtgatgtatccttctcggatgaggaaatcatagattttccgggttttgttcacgtctatcttgatgagtgctcttgcctgtgccagtctcaagcctccttgcttgttacattcgttcaatagagcagacttgtattctaaataggctcccgggaccaacctcaccatctgacagagctgaaa

SEQ ID NO: 48081 - DNA, 898 bp, Bovine  19866880859947
cagcggggcctcggcagtgcacaggtcgctggtgacccctctctgtcccacccaagcctcgccactgaggaatcctgcccaggtgaggcgggggagcactgtcagggccggggaggaaggacagtgtgacacacgtggttccaggctctgctgcaggctgtagcagattttttaaaagccacgaaaatgtgattggaatgtgagatggtacgtaggaaccagctctgcaggcctggggcgggatggagccccgagcgtagaaggaggctgaacttagccattgcccctcagactcgcagccagaagagcaactgaaatcctgtttcccagccctgcctcctcctattagacacccttaataaataattatttgcatttttataactctttttaaatatttatttttcaaattttttggccaagtggcatgtggtatcttagttccccaaccaggggtcaaacccacaccccttgcactggaagcatgaagtcttaaccactggaccaccagggaagtccgcattttaataactcttaatgcttaccaaacacagttcatacctacttttgtttcactttcatagtgactccacatgcacactatttccattttaagatgaaaaaactgaagttgagagtagctgaggaaatcaccaccggctacatagctgtgaaggctcagagccaggattaaatctaggtctgtctgatgcaagaccattgctccattccagaggcagcccaggtgtgtgcacgggcttgtgctggaagatagaaaaccatccttcccattttttctccccagactcggaggcaagggccgcctgacatagccagagggctggggctctggggctcaggagggggagaaatgggggctaggggtgggtgggaagta

SEQ ID NO: 48082 - DNA, 1303 bp, Bovine  19866880886793
tgctcccatagtatgaccttggggacttgcttagaagttattttagggctatgttggctagtggtcagcattagaatatttttgttatttgaatcaagaactatcttctggaaacgtgtaggtttcttaaacactgagcaattaaacagaattttcttttgctgcatgcttctttttcttttaaaacaattgagtaatgagtttggcttttttaagtcaaaccagaatactggagtgggtagcctttcctttctccagggaatcttcccaacctagggatcgaacccaggtctctcgcactgcgggcagattctttcccagctgagccacaagggaagcccaagaatactgaagtggttagcctatcccttctccagcagatcttcccaacccaggaatcgaaccagggtctcttgcattacaggcggattctttaccaattgagctatcagggaagcccttttattcatttattttggctgcactgagccttcgttgttgaataggctttctctagttgcggagagcaggggctactctctagtagcggtgtgcgggcttctcactgtggtggcttctctggttgcagagcatgagccttagagctcacggccttcagtggttgtgtcacctaggctgagtagttgtggctctcaggctctagagtgcaggctccatagttgctgtgcacgggctcagttgccctgaggcatgtggaaccttccgggaccagggatcgaacccatgtcccctgcattggcaggtggattcttaaccactggaccaccaaggaagtctcactgccttcttctttagcatcttcctcactgtacaaaactaaagaaggtgtacgttatcttgcaggtcatagggcaagtgtatagttgcaatcaaggatagctaatcaggcttacctcaaatgcaggacacactccggagctctgtctcatttaattgatgtaaatagtgtacagacttatgcattacaagcaattaactataaaaatgttctatagagtactactgtaatcaaataaaactcacaaggttactctgatgcatatttaatgatacatataattgttattgtgctgcatgataattaaaccttaaatgttaagctgtttacataaatggtctaaccagttgtttttatgcagcgaaacacattatttagtgtttgctcactttattaattttctggaatctataatcatgccaaggacagcagttttccctgaagcactttactattaaatcatgcactcatacacacacaaacatactcttcaaaatgacacag

SEQ ID NO: 48083 - DNA, 1373 bp, Bovine  19866880919608
taatgtcagcaaaacttcttgatcagatacgggcatgttcgcctccacgccccccggttttctttctttggtcgtattgtcagcctttggtcctcccaggtggctcagggggaaagaatccgcctgccagtgcaggagatgtgggttcagtccttgggttgggaagatcccctggagcagtcaatggcaacctgctccagtattcttgcctgggaaatcctatggacagaggagcctggtgggctctctgtccatggagtcgcacaagagttgaacacgacagagcaactaaacagcagttttcagtctcaatggtatttatgtctaaacagtcctaagcacaaagcagccaaatcaccatcaagggaaagaaactgccaaatagataggtgagtaggcacagtgaccaggctggacctctgatcttctaactgttaaaggctgtaaataatgataattaatacatacagcactctctgtttgccaggtaccgtttaagttcttgatacgtgtgaactcacttaatcctcacaaagctctttgagttgggcattcctatgcccattttgtagatggggaaattgaggagtggaaatatcaaggtcaagttataacctgcaagtggcagagccatctcaagctcgtaatactactgtgcttcattcatctgtgctcttaatactactagacttacggtatctaccatcttgaaccttttttttctttttagatttcacattttttataatctatgacttaatcacattcctgagaagtggaaatagtcattttcccattctgccttcagggaaatgtacaaaggagtgaagtgacttgcttcaggcttcctggttgctgactttgaccatgaggtcacacagtcatccttttttcatagccccgattgtgtccatctcagccaaaagcttcagggcaggggaatgacttttaagaagcttcattctggggaatacctgattcacaggtttgtgctcgtgtgcttgcttgattggtttccccagagttaaggcctctgagttgcttttcctgccaagaaagcagtaagtgccttctgtcaggaaaacagaaacatgttgccagctattttgaacagtgttagaaatacactgcagtgggaaggagctgcctctgactgctgcccacttcttgcaatattttaaggcagccatttggagactttgttatcagtcccgagtgtaatcacagggagactagtcatcccccaagactgggatttcagaggcctggcagcagtggagaggttatgggtggtttgggttggttggttggtttttaaggagctctgggtctttgtgtgcctactctactcaactctccagtcactttttaag

SEQ ID NO: 48084 - DNA, 1948 bp, Bovine  19866881025193
cctgtgagtctgctctctcacgcatgtgtgccaagtcgcttcagtcatgtccatttctgactctttggactataccccgccaggctcctctgtccatgggattctccaagcaagaatactggagtgggttgccatgccctcctccagggaatcttcccaacccagggattgaacccaattctcttgcattagcaggtgggttctttaccactagcaccacctagaagccctctgatctctatacctttggcaaatattcctatcacccaaagaaatataaccatattgaagacttctcaaggacagaagattatgcctctctttactggcttaacccagagcttcatacctttgacaatattctttgtacatgctctatatacaaagcctcttaagtgcagcagagagatacacaatagatgcccattcactcattcatccaacaaatgtcttttgcacaccgacttgagctgggcacagtggtgggtactgcatattccaagatgtcttgaaggaattgcctgcctgactggggagacagaaaaattagcaagttatcgtgaccaatgtgctatgtcagtgttagaagatagagtggtaggacagtggaagaaatcttgtttgggtggaaatcagagacgtttccctggaggacacttgaactgcgtcatgaatgaatgtcagttcaccaggcaggtggtggagggggtgggaagacagttcagacctacggcctacaaaatgcaaaaagaaagtccagatcaattccagtatggtctcagcccaaaacttgttttctgtgtgcccaagacccccctgcctgaaattctcttgccctggctctgcaaatcgtgatctgacacagtgaaatatgttctccaggctgtaggttcttgggtcaaggtaatgggtcactagccagccagtgcctctgagaagtgaactaaggcctgagaatcagatacgtgggccccacatctcagatgagcagagcggaggcatggggtaaggcatgtgatgtttacgttcagaaactgcaaagccactagcttgtagagtgtcattatgtctgcaggtggagggtaattttcctgttactcaaggactcctggtcaggctctgattggtctctggggaattgttttatgacccagagccaggcagtgctagataggagatgtggtttgctgggcagaaatttacaaggcaggaaattgcttcactgggcacaaccattcattagaaacacctttgggaaaaggagcctgggctcctggcaggtctgtcccaggccatgtatttacatcagcaacaacctgtgttcctggttacacaatgtggcagcgtcactttgagtgggggatctttgccccttggaagaataaacacattcctcactcgcaggggaattagcagacctcacaagacttttcagtggctcccctggaggtcttaatgtcataagaaggtgactctacacatgattagctatacaacctaactgactctggatttggttgaattgtgtgcaggctaagatgcagagaatctagtgctgaagggtgaaaagggtggcaatccaagcagctgccaaggctacactagatttcttatgaacaatccaggggttcaggggtcactggtcagtcttcagggaggaggagacaggctgcggggttgtttagatggattccaaagcccaggtttccattgtccaccagctcttggccgagttctagagtttagagctttcaggatgagtgccatcagaccagaacagatcctaaggagaaaagataagcgtctgtggttagagtctccggaactatgggcatctgtctggcgagttatgggagtttccagccccccgctattcagtagagtcaagagtcacaattaggccccactctgccctcactcccctccccgtgtaaaccccatcccaggc

SEQ ID NO: 48085 - DNA, 1637 bp, Bovine  19866881062443
aactttctccctaaaaagtgtgttacttttattgagtaattgttcaatttatgaatgtgattatgttttatgcacagttatgttcattttctgcagcctgatttaaaggagaaaggagttaaagcagccccagatggaccactctaccactaaactccactgacaaaagaattccttcaccaaacccaaaagactggcataagaaaatttcaaacaaaaggcaactgatattattgctagacagaagctacaccaaaatctttcttccaaattagttagcacagatcataattaaaacataatatgattacacaaggttttgcaaagcaagtattattcaacttgctaaagcattatgctccggaaaacacaatattttgaagggtagacccacactttcttagtctcaatatgcaatctccacacccgccccctccaacagcatactttagttactgaaagtaatctctcaggaattctattcaaaatcttcaccttcaatggtttaattttctttctgactcaaatttttaaaaggaagtgtcaaaatataagaaaaaaattaaaacgatggaaataactccttttccccaaagtttttcactattattatactctaaaatggtaaaaaaaaaaaaaaaaagcgttcaaatttggcttactcttgtggctgactttcatgggtctttctaaaaaaaattcttttcttaaaaatgcagagttaagaacttgcctcatggactaagttaaaaaagaccaaaggaaggtggcttcataatacattctgaagctggaaaggtaatgcaccctacagttagaggaggaagtactcaacttcacccccaaatcaaactcagtccgggacactccagtattaacaatgagcactttccactgcagagattatctatatttggttcacatatactctgttcagaagtccatctcaatatcttttgataatttataaatacttagttattaacagatgtggccctctttccccaacactaaactgaggtctttcctctctctctcagtttaactcctggttgaggcaggctccaagatgtttacaaagcaataaaatctactcagttttgtcactagaggtaagaaataaaatttctaacatgtaacataatgtaaggtttatactttttaaatgttttaagttatattttaatccagtgccatgttaaacagttatatcagtggaattataagaagaaaaggctaaaatgtaccaatactttcttaggaaaaaggtgtttgaggaaacaaaataaacaaaaaggaaaaaaccctcaaaccacaggagggtttaaatttgatatggaccaggtatttttctttggtctaaccctggagaagtataaattacacacatccccacactttcaaaatatgccaaagaattatttattaacgtaggacttacagatcacaaaagagagtgatacagaagagctggaaaaaaagtcatcagaataagcatgcagatcagtatttgcagaggaatataccaaagcaagtttgaaaaggcacattcacacagaaaatgtcccaattggaaaaaaaaaaaaaaaaagacatcagaaaagcagccaaaaaataataataaggcgctgattaaa

SEQ ID NO: 48086 - DNA, 2074 bp, Bovine  19866881121196
cctttaaatttcccctgtgagacaatcttgaagtttgtggtagataaaatcatagtaaacaaactgcctgtgaacactggtaaaatagaaaaaacacctgtctgaggtcctctcctccccgtctttgtactgtaaacccgagggaagttcctgtttggccatgaagattctaacaacttgctgatgtttatgaatctatataacaatcaccattcctttgcctaagcacctggctcccacaaaggcgggaggatttgttgggtcactataattcccaagatgaaaactccacaattgtgacttgctccaacctgaaaaataattacctgaattcgaagtcatgggaacagaaggactcaggccagaatcactacaaaaaagaagaggaatttaaacttatgtcacatcgaagaaagcaattcccaaagcccatgatcccgggtaacatttatcaggtcagctactttgaagagaagtaatgagacagactagactatgtttttacaggctatcccaactgtacacaactcaggaaaggaaatcaggaaggaaactgcttagatttgttaagaagacatcctggtatggcacatcacagagaccattcatgagcaaaaagcaggcatttgatcttccagtgaaaatcacaccagtagatacagaagaaggtgtggcaagggaatacactaatcttaaaaaataaggccaaagtagcaaagtaggattctaggaggccagttacatttctcaaaactgtcagtactgtactgtttgagacagcctgctcaagttttctgaattcttctagctacctaattattatagctctgccatttagggtagggcacccatgggactgtctgaaaatacaggtaaaggccgaaagctccatgaaggtgtccccggactaactcctcacatgtcagcctgccggcggagccactgctggcaggcgcctgctgtccttggatgtacttggaggacctcagagagcatggtgcgcttgaggcgctcctcttcacgagtcttcttgaggtgatcgtaggtcctggcacctgtaggtgttaaaaaagtgactacaatgacaaggtagtagaactaaccaaagggcttcctaactcatcaacaaacagttcatcttttttaatttttaatttttgtggccttgctgtgaggctcgtgggatctcagttccccaaccaaggatcaaacccaggcccatggcagtgaaagcgcagagccctaaccattggacaccaggggattcccagtcgttttttaatttcctttgaaaaactgcttccagaattatttttctaagagcaaacaaagtgatttcccctagtttgaaatctcttttttgataagaaatgaaaatgtgtttattccttttctacctttaagaaatttgagagagggaatccccaaaacagaaaagtacaaagaaagttggagttgctcatatttccatcccctaaaagtaacttaatactgttatatttacttcctgctctattttttctatccatatattttttcaagtcacacaaatgctatgcacatacactgttccttaaaaaccagtcaggattacaaataaaaataaatcctctttgactattactattctgttcacctctttcctggagacagccagcatcaggcaacccaaatctggcatcagagtctttacacgcatcttgctaacagctgtagagtgttttccacactattaatgtataaaaatccaaaatatcaaaccagtgggtttcaagccaagttccacagaggcccaggttaccatgaaaatatctcagggattactgtgaacatactgggtggtcctgggctccacaagacttcaacctaaggagttccacttttatttatggattagtactccacattaaatttaattttgtaaaatttccaatgttagaaataaagagccattttgctgggctgaacttgagcactgggtgaacgggtgacagctttcaaccaacaggaaggaggaaatgctgaagaccatccccaaaacaacaacagaacaacagaaactgctatttattga

SEQ ID NO: 48087 - DNA, 1026 bp, Bovine  19866881177906
tgcactgagtgttcaagttataaaaatagcctaatggtccttgccaccaattctgtccctgaagatggaagagtgtttgtaagtgctttgagatcctccagcagaaaactatcacattccactgatgacatataaacattcatacttggcacttaccttatttttcatcaaggactttaaaaaaccaattttgaatccttttagcctagcaagataggaatttcaagtatggaaaaagacatattatgaaatacatggtaagatagttttatttaaaattattgtgtacatttcttcttttagcctctaagagagcgtatttagttacaagtctttgaaatgatcttcaggaccaaagttgagtccctcatgagaaaaataggctaattttgaaagctaggtcttcctgccatggaattacttctaatgaattcctaacccttttgggatatgtatagtttttttcaaattccctcttaatgcctgtcattggagctggagatttctcattgattctgactcatttcactagtagcaaaccaaggcccaatgaacttgactaacttgggaaatcctgatgtatcccttggccaaccaaagcagcacttgcggagagggcccctccatgcctttctaaaagtaagtcctgggacttccctggtgctccagtggctaagactttaccctccagtgccaggggcatggatttgatccctgcttggggagttgggatcccacgtgcctccgtggccaaaacaacaacaacaacaacaaaacacagaagcaatattgtaacaaattcaataaagacttcttaaaaaatggtccacaacagaaaatcttaaaaaaaaaaaaaaaaagcaaatcctaaagatagcctttaagcaaaaggatatacttgctagcattttcatacatcttaatttttaagactttacagaaaaaggctgtgatatagtaccctatgacaagtaattttacagctccaactagaggcaataatgagcatcaggacagcaacagatg

SEQ ID NO: 48088 - DNA, 2577 bp, Bovine  19866881198086
cttccctggtggctagcggtgacgaatccacctggaatgtaggagacgtgggtttgatccctagattgagaagatcccctggaggaggaaatggcaacccaatccagtattcttgtctgagaaatcccgtggacagaggagcctggtgggctacagtctatggggttgcagaatcagacacaactgagagattaaacaacacgaagaaccagaagagtgctcacctctgggtgagggtggggtggggactgaatggcaagggtatgaaactgctgaaattcactcaactgtgcacttaacatctatgtattttttcggtacttaaatatagctcaataataaaaggtactgggatatgggaattccctggcagtccagtggttaggactctgtgatttcactgctgagggtgtgggtacaatccctggttggggaactaagatcccacaagctgcgcggcatgggcaaaatcttttaaagtactggaattaaaaacaaagtcaggttatatacaagaattcagcacttctgaaatagttcttggatattataaaccaaatcaatgatggataaacagaacatagtctctatgctcagaagatgaacacatttagttaaatggaaaatgtaagtgcagttagtgcaaatacatagtatataaagtgtaagataaatgttgcaagaaaaagaaaacatggagaattgggtgttaggggaaagagtgttggtaaaggaaaaagatcacatcaagcagtagtgatcaagacaaattttatggagacacaggtattagagatggagtttagagcatggcaaggatttcaacaaggggagataaggcggaagggaggatctcacagacagaggaaacagaatgaacgcacacacacacacacgcacacacacccacttcgaggccttcacactcacatgcagcataactggaatggcttgcatttggattggtgtaggtgtctggaagcctgcatctagaatgttctgaagcagtcgagaattgattttatattcctggtcaagttgctgaaacgtagcaattgggtcaggaagatcagttccttggacatgaattttatgtttattccggaagaagtttagctgaaaagtaaaataaagggatttggtaaaatacattgtcagatgttgtaaagcaatagtaagtttctgaaataagctttagtagcatatgaagctttctagttaaattccaggccgtgaaagagacatattaggtacaatttccaccctttcatagaaggatgaccttcctaacaatgaaacctatctagccacactttccacatttaatgtgtcaatgccacgaagaacattattcatactcatgtgctactgtcacagtcacaatcttatataaactgctagaagacaggcactgactccatctagttgctttatgtggcacttagcacacaagtgccgatgctttctaacgatctaccctaaaagctctacttattaagactgaatgccactagaagagtcaggtgatgttgggttttttttttttttggctttcccactctctgatccagacagccaaattctggattcaggattactaaacgagctgaacaacactccatctataacatggcaggagtgcagcaaactcgacaatggcgtatttgttgtctcttctgaagtccactcctcctagtcccaagttagaaaacaggtttcttaagaattccaactctcaaatccccgtcacatgaaattcttcaaaaccagtgagtttaacataaaggataaagtgggccaattttatgtttatcaaaggcaaataaatctaaaaaaattaattctaaacacattctcaaatttgaccctaagtttcaagattttaagatactttcaagaattttaaattttaaaaatttcagccacagcacaaaggctacctttaagttttcattaaagtaaaatctagactactacaaataaccttctatcttaacaaaatcatactgtgatgaaccaaaaaacccaagcacagtgaaaaaggcacaaggccagaaaaacaattagggtgaagatatttttctcaccttttcttttcttagctgctctaactttcctgaagttagtttattttttcttttaacatttttatcttcaatctttgcttccacagatgatatccactgtatagtagaaacttcttcttcagaagtaatttctaaaatatatatttttaaaaatttaaagattttaactgtaacattctcaggtggcacaaataggccatatcttcacaatgaaagaaaaagtaacagttgatacaactagatagttttggtaactggcctagttgactttgaagtttacgtgataaaataaatatgcaagaatagctaaaaaaattttaagaacaataattagtaaagactacttctggaatttcttttaaatttttttcaacttcactgataaactgcatatatttaaagtatgcaatttgaggagttttgacatatgtatatacctgttggagttcccctggtggctcccgtggtaaagaatccacctgcaatgcag

SEQ ID NO: 48089 - DNA, 3046 bp, Bovine  19866881237623
agccgcacgtcttctgggcgcactgatttctggtttattcgcagctccaggacacagcggttcccagggccagagactgatctctgtggacgcgaggtcaaggcggcggtggctggcgactcccacgccaagttgggaaggggccgaccaagccagcgagggacagaagtgattgttcacgccggcccggcccaggaaggaaggcgggaacctctcagcgctatcggagttcacggaggcgctcagaggcgaggaagaaggcaggaggtgcgccccgactccaggctgccctggacctgcagaagatccagggtagcgggggctttttaggacccatggctcacagtcccgtagttcctggggcagaggacacctccttcccctctctaagcctcaggttcatcacctaagaaatactgaaacctaaagcccagaggatgcggcattgtgtacactgagtgagcccacctgtgaaaccctgtattccaggaacagtgttcacacttttctgagaaggcaggcagtcggttcctagtagtaaaatctagccctagggaggttcaggattctcagaaccaggcaaattcagcgctgggcgtgggggggactgggagcttagggacaaacattcagaatgagcagggcatttgcaaaggagcttctaagcaaagtctccccactttcccaccttttaaagacagttaggaggaagaggggaatttcagcaggagtaggagtgggaatgcgaagggtcatcagatctgtctgcttggttcaggtaccagggctgaagcccagatgttgttgatccaagtcaggctgctaaggagcctgtcgttgttatttagtccctaagtcatgccctactcttttgcgatcccatggacagtggccctgccaggctcctctgtccatgggatttcccaggcaagaatactggagtgggtagccatttccttctccaggggattttttcccgactcagggatggaacccatgtctgctgcattggcaggaggattctttaccactgagccaccagggaagccccgctaaggacctaggttgactttttaaattacagggtttgctctgtactcctggaccacccacgagaaaggggtggttgtgtgcacggagctctggtgacctttacagcatctcagtgtctttccccgagaaaggggtaagaagttcatagaaacgagggctcttcatttcaccttattgtcttggagtttgttgtgacatatggcacctccttgcccctcacagttcagcccaatgggagaacattttttgcctccccagcttccctcagcagggataatgaagtgttcagagtaaatgtccctggagaacaatcgctttttctctgtccctcacttgctatcatgatagaagcagtcaagtgtaatgaagatcagtttctgtgtttagctgggaaaacccattaaaaaaccagccatcacttcccttttaacaacaaagctttgatttgtagttccgactgctgtgtgcccagtctgactctcaagcttccttatctctcaaaattcaggtgtcagcaaacccattcttcccccctaccccagccaatggaaacacacagaacgttgcccagagcacagggaaatttcctatgcatgtccaggtaatctggctagtcaaagtcagcagcttcctgtaactctcttgctcaggtatcggtatatactacctgatgcaatatgggtgctcaccaagtaactgcagctatagatctgtgggcagacccattatctatctcttcatatggaaatttagaaagaaaaagtggaaggatcccagcagggggtccttagggatgtgggtcacaaacactcaccaaatgaattatctcaaaaagcactttggttaggcttcctccgaacagaggaagccagaacataagtgaaatactcttgtttatgcttcacaaaggataaagtaatgatggactgagacagtagccccattttaaagaactgggaaaagacgatgtaggacgttttaaagaggtggcttggagctcctgtaataagttaaagaagggttgagattggggctcaggatttttgagtagggctttaggatgaaagagaaagggctccagttttactgtgttgggagacgggaagttgaaagagggcattctgctgtgattccacagcagagaatagagaacagatgttggcatcaaacagacctaaatgtgggttctgcaatctacttaaccagctgtgcaacttggataagcttgcgttgcataagcgtctgagcctcagtttccttaggtggaaaatgatcctaatactctactgggtttttgtgacggtgaaaaaataatgagttggtaactgcaggttcaagtgtctgacatgtttagaaagagacagcccatcatgaaaacatgcaaagaagtaaggcagctggtcttctggggctcttttattcccggcttttgtttttcttttttgagttactgaatttaaggagaacagattaggttcttctactcaaacaatgaatccactcgttcacatcccaagatttttctatggggaaatgtagtccctgatccaagataatttaaaatccagttggctcactagtctatgaaagttttctaggcaccgtcttggaagtttcacagaagggcacttgtggttcccatggcctcagtctcccccgtaacttcacagcccaggtgaccctgctttctgagcttgtgcacagtcttcttcctactttccatggttcccctgatttgcttacagctgggggaacccagtcctctctgttctctgatgctcccctctccacattgattcgggagagtctctagaaagcctcacaatgaaagcatctctagagttaagcatgaataccaccctgtcctagtctgaaagtggttggaagccttattgttaagagagcagcgttgcagcctagagagcattctagactgtgtcattagagcctgagttcccatctcggatacaaaactcttttccgggaactcttc

SEQ ID NO: 48090 - DNA, 3175 bp, Bovine  19866881281680
aggaaggctcagcaactgcacttcggattctaaccactgcgattaagtagtgggagaggagtttggggcagattttggactcaatcaatggtagccacgttacagagcctgatgggaggatggaattttccttgttgggatttgagttcaaaagtcaacctcctaaaaaaaaaaaaaaagtcaacctccttagttagtgaagaatggaagggcttggagaaggtgctattagtctgtcctgaaggtcactctttataaaaatattagttcaacagggactggtcttaatattattaatgtaactttctgtctttaagaggacaagagttgtttttttcaggttccttgacagacagtgcttagtgagggagcaacaaggtactgagttgtctctcctagcacaggttaagcacagatcactggaagcatgcaagagggatacccgatccagacctggggagggcagaagagatgtacctgaggaaatgaagtctaagttgaagtgaaggtaccttagcaaaggaaacttggaagtagtgcctaggggcaaaaggaggtgcttctacctggtgggagaatgaagagtaagatgggggcaataatgacaaagaaagagaaagacattggaccctgaagggccttcttcaaagagtgaccatataatttactgtacagagacacttctaagagggaaatgcaacctcgctaattatagggggataacaggtataaaccaggactgttctgagtaaatcgggacttatcaccctactcagaggtcatgttcaggtgtgtggccctctggtgaaagcataaactggacatcacctctttttaccttacacaatctttcttttgcctgaggacttcatgcatgcgtttgcttttacctgctcattttgcaaatatttgtccaggaagttcttccgggtactgaggttacaaagaaaacctacatccaaagaaacagttctaatacagttaaatcgttttagccctggtctctcctcttagcttcagacttatttatgtcattcccatatgcaggttgcaaagcagatctgaaacagaatctttcatttctcctccaaatttgtgttcctcatgttataactgatgccactgcaatactgaaggcagaaactgagaaaaacactgctttcatcactgttatccttcccctcactatgcatttttaatttctccacatctttcttaaacacaatggctaaattggggcttagaattctaatgagggcctaacatcaattgaagaggaagggtaatttccaggtgcttgaatgctatgtttctaatgaatagatccctgaatcacgtgggactgtttttcaacggtaaaacgctgatgactcatatcagtttgttgatagtgatgacgtccagatctggatacacgccctagccagtatcaaaaactttcagtttaggagaaaaaaacatgaagataagtcctaaaggtttgatgccagtttccgtttgtggaggtgagtggttgtaaaggcgtaggtgaaacaccagtacactgttaaaaatggatgattgaaagggcaattttaatgcttccactatctattctccatacaactgctagtgattctttttaaaacaaatctgataaacaatccgcctgcaatgcaggagacctggattcaatcccagggttgggaagatcccctggagaagggaaaggttacccactgcagtattctggcctagagaatcccaccgactgtacagtccacggggtcgcaaagggtcagacaggactgagcaactttcactttcactaatccaaggctgcaattaaaacaaatctgatgattcctttgttctcaacccttccatggtattctgtcacattctaataaaatccaaagtccaacgtggcttaccagatacatgatctggtttctgcctatttcccaacttctttctctaatatctagcttcttctccaagatgccaagcaatcagggctattttaattgccatttcttttctcccagaacagtttctctctagaaatacacacagctacctccctcattaatgattagatttcagcttatgatgtagaggccttttttgtctgccccatctaatacagcatcatcccatcactcttatcccattgtcttgatttttttaaaaacctgccacattattgggcattagctattacatagtaatatagtttatgtattgcttactgtcaatctcccccattattatatgaggcagaaactgattcactgctgaattcccagcatgtacaacagtgtcttctcattagatatttgattaatgaatgaataaacagattttcaggatacaacatatgtaaaactattctatatttactgacattaagcataaaaaatatctaaaagagtgtatagcaaaatgttaaattacatggggtgagctggttttcacattatttttgctcatgcaaatcttttttttttcagaacgaacttgtattactcagatactaaaagaaaaaaaaaatgaataaagaggccacgctggcagaaagtgtaaatgaattctataagaggttgggcaaatttatgaatgaaagacttaaacagatatagtagcataatggttaagctcagcaactgtgtgaatcccctttcatacatgatctagcatgtaatcccaagttattcacaaggcagcgtctaaaggttttcatctggaaaatggggatggtaataatgagtgtctaccccacaaggttgtttctgaatattaaatgagaccatgtttgctacctcctttgtacaatacctggcatgcagtaaatacccaacaaatggcagctattacaataattagtagtagtaacaagagatgttgggacatacctagccctcaagattgacatcagagtggaccaccacatcctctcatcattgcgcctcaatctgggcccctgaagcccaaagaggggatggttctttccaaagatgataatttcgacattccaggagcatctgaatcaaacgtaccccgtgtacccttaaaccattcaggcagtctgattaatccaccagcggcactgcaagatacggcttcgagaggccacccccgctcgccgtccttgggcccaggcgcttagcctcgatctccttcgaggcggtaacaa

SEQ ID NO: 48091 - DNA, 1493 bp, Bovine  19866881288663
acccagcacagccaaaaataaaaataaacaaatagaaaatatttattatttttaaaaagtaaatggaccctcaaagagcaccctctcctggtggctgtctggccacgattccaaattccttaaatggcagagtcagtgatagacctttaggacagtattcttgactgggaaatcccatggacagaggagcctggcaggctgcagtccatggcgtcgcataagagtcggacacgacttagcaactaaacaacagcacaatacaggggatataatacgatgttatttcccactggcccccaatacagaacacttacactaatctggcttccagctcctgccatgcttatctttacttttgcttatgctggcaaacttgtcctgcctctttcctaattttctgaatttttctgtagtctgtgggagtcccattttctcaaagaagacctcttttatgtctccagctcctactgattacccttcctttgaattctactagcaatctggtcaccaccacatgattcagcatttactgggctaaaaattttttgtgggtatgttggtttcagctctctagctgaattttaattgtcttaaaagcagagagcatttcttacactttggtacagccctcaatagctgctgctgctgctgctaagtcgcttcagttgtgtccgactctgtgcaaccccagagaccgcagcccaccaggctcccccgtccctgggattctccaggcaggaacactggagtgggttgccatttccttctccaatgcactgaaagtgataagtgaaagtgaagtcgctcagtcgtgtccgactcctagcgaccccatggactgcagcccaccaggctcctccgcccatgggattttccaggcaagagtactggagtggggtgccactgccttctcccctcaatagcctaggtagagatattcgtacgggcttcactgactgaaaataaatgctggctctgtacctcagagacctctctgcttccaacgtctgcttgtccgtcttcaggtcgcgtatgggaggcaaaaacctccagaaggatacttcacagatggacagacttcaagaaagtcattgccttgaccagaacagaggctctagtcgtaagataagagaaaaaagacaagaagacctgatcagaacactgtgttcttcaactccggtcagccgtgcaggtttgtccaggattaagagcctgagggaacttcacaccaaaaggtcagaaactgtccgcaggaaggcagctttttaagtctggtcctgatgatgaaaggcaagattacacaacaagaaagacagagttcgccacagaggctccacacaatgttttcacgtggacacttgagttttcacaaggcatttcagattctcctccctccttattatccaattgcagacactgccaaggccctagctgtcctatctatatttggcagtcaccaaaacttggctgcctcttgcatgacacctccagta

SEQ ID NO: 48092 - DNA, 1012 bp, Bovine  19866881316237
tgctaggggagcataagccccttcagcctgtggcccatcttctttgccttgtgacctcagggattcttttagaaagtacccagggagcctcagaaggaccacactgaggccgagtgcatacttgtcacgctctctgcacatcagcagtcacagtcatccctcccctccccctaccttcttgccagcattacctgtttactggaagacatgttggtgagcgtactgatgctgctggtatctgtgaccaccatcgcagatggaaaccgggaggtgtgggaatactggggaggttcctgcttgtgtgtgtacactgcagagacagagtgaagacaaggtcaaggtgcagatcccgcaagaatgtaagcacagctacagaccacccctcatcccacaccactgttcctttttccccaggcagataaaagggggtgggggtgggttggtagttatgtttgggcaaggcagtgtgatgtgatcaaaaagaatggctatgtgtttaaatcctggctccttaatcaacgcagttagcctcagtttcctcctctgtaaaatgggaatgatatctgttgtaggattaaaagagactgtgtttaaagcagtttaccaaatagataaataggtttccacagtgcctggtggatagaggtggctggcacttctgtggcgggagcactttctttccctgacttccaaagtattagatgcctggatatcagcaagtaatcctgggacttccctggtagtccagtggctaagactccatgctcccaatgcagggggccggggttagatccctggtcaggaaactaggtcccacatgctgcaactaagattggcacagctaagtaaataaagaaatattcaaagacaaacaaacaaacatcccaaacacaactgatcctggggtatatgtggtgcatctgagaatttaagtccaaaaaagttcatagtaactggcaaaatgaaggagctggcctgtttgcttagtttttctgtagtgactcaagtccta

SEQ ID NO: 48093 - DNA, 1389 bp, Bovine  19866881317437
ttgaaacaagtcctctgaattcaggaaatggcctcttaatcaaaacgcttcgagatgctctctgagatgctgtaccggcccccaaatgggactgagtggccagccgaccttgacgccacatgaacgagcctctagaactactgtgaagtcatctcgaaacccccagacatttcaggagtctgacgatagactcacagttttataggatgatgacgatgacatttagtaaggctagcactcttcatataacactgtacaatttatgcttctcatgaacgttatctagttgttttctttttgccaaaacctcctaagaagtacaaagaaataaaccaaggctcagagatgcagggtaacctgcccaaagtcacaagagatgatatgctaggactgaacttccagacttttgatcttagcttctaaatcctggacttttcccacttaaacactactcatcttccaataccgatctttttatttatttttcactgctttgggtcttctgctgtgcacgggctttctctagttgcagcaagcagggactgctcttccttgcagtacagaggcttctcattgaggcagcttctcttgttgcagagcacaggctctagggctcatgggctccgtagttgaggtgcagggacttaattgagccaaggcttgtggggccttatttcccagaccaggttcattggcaggcagattcttaaccactggaccaccggggaagtcctggcaatacccgtctttaaaacgcctatggtaatcacttctcttgtggtctgtaacagtcaggaacaagagtaaaaattaaacctacataactatattccagtcaggaaaccttcttcttgcaaacaacaggagaagagagggtatgaaagatggaatgaaataagaggagagtgaagatgctgcctcttggcagcaggaggaacccaaggggaggaaaagttgtacacactctgttctgaaggcaaagggtcagaggtgagtttcagaagggaattggtggcaattctgcttttttgttgtttgaaagtgttcttttccaaaaagcatttcaagactattgctaggagtcggaagcccatgacataaggagaggaagattccttggccaaatatgttgggggaacagctgggtttagcagaaaccccacaggacagggcttctcagaatctctcctgtgccaatgtgggcattgaaccaggacccgtcccgggcagggctgctttagaggcatcgtagaatgctaagaaaagggtctgagccaatcctggctccttcacacctgctccatgaccttgggcaattaattcagggctgtgagtcttgggttcttcatctccaaaggggaagctcccacctccctcatacagaatata

SEQ ID NO: 48094 - DNA, 2635 bp, Bovine  19866881322145
cacgtgaccctcagcgcctgggggaggggccgcgccacctcgtcacgtgacccggccgccgaagaggggactccgggtgcagttctggttcggggagactggcggggcggtctgggcccagttttaagggagctgattcgttctctgggaagactttgtggaggacacagctgtccgagctgcagggagtcgtcgttcctgcgtttgaaaaaccatcatcttggttaatggaaatagaacgagtccagtttgaaaaactggatggtgggtacacgggtgttctttaattgctactttttacacaaaggatagatggagcctgaatgcccctttgatagcttcacaacgtccattagtgatgagctctacttttcccctgcaacttggaagattttttttggcacctgtcctagaagctgaagctgtttagtcacctggtttccgcgtttttcttttacttacaatcagggccaaaacggtggtgcatgggaaggtttattgcacctaacctatctgggcatatttttactgtgattgttttccttgtcaaactactgtaagaaaatgtaaaagttgaacgtaaactttttcaagccttgaggtatcgtttgcttattagcaagtaacgggtttgtcgggttgaaggaattacaagttggaatcaagattgcgggtggggatatcgacaacctcagatatgcaaatgattgacagaaagtgaagaaaaattagagcctcttgatgagggcgaaagaggagtgaaaaagctggcttgaaactcaacatgaaaacaactaaggtcagaacatccagccccatcacttcagggcaaacagaaggggaaaaggggaaagtgacagattttattttcttgggctccaaaatcactacggacagtgcagaaggtagcggcagtcatgaaattaaaggacgcttactgcttggaaggaaatctatgacaaacatagacagtgtaaaaagcagagacttcactttgccgacaaaggttagtgtactcaaagctgtcgtttttcaaatagtcatgtacgggtgtgagttggactataaagaaggctgagcaccaaagaagtgattcgttgcaagtgtggtgctggagaactcttcagagtcccttggctgtaaggagatcaaactagtcaatccccaaggaaatcaatcctgaatattcattggaaagactaatgctaaagctccaatactttggctccctgatgcgaagagctgagtcattgcaaaaggctctgcagctggcaaagagtaaaggcaaagggagacgggggcagcggaggatgagatgattagacagcatcacccaatggacacgaatctgagccaactctgggagatagtggaggacaggggagcctggcatgctgcagtccttgggattgcagaatcagacacacttagccactgagcaagtaatattatagttagctttatcttttactcttgcttcagggcttttacagggagacagttcataataatagttatcctttattgggcacaaatcactggttagaaactttactgtttcaaatcctcagtgtccctaagagttactattggcatttcagataaaaaaaacaaggttaaaagaatttgtaattcagaccacacagctgcaaaataccaggaccaggatccaagttaaagtgtttgacctcaaagtccttgcttatttcaactacagtgtgctatttttttccctcatgtccacaaatttcattcctcccctttttagatggaactgtgtagcagatgttccagttgatataaactgatacatacgaccaaactccatataaatccattgacaaatcaagtagatataggcttatgtagccactttaaaagatgggtgatttaaagacaggagaaactacctaaaaaaaaaagggggggaggagtatttcaaggatcataaagacataatttctgtttctgctgggaatactttgttctcttttgcatgctggctgttgtaagtctccggctgtcagccgctcctgacatttccagtacaggttagctgctctcatgtgacgcttcagcactgtggccttatgtctaacatggcacttaccacactatttgtcctttactttatccccgccactacactgttagggcagggactatgttatgaggctttgtattcctaaccaaacaatgtgtatttaaagaatatttttttgtgacgtgatcacatgtcgggcacagtgctaagtgcttctgatcttgagacatagttggtattaccctcaatttcagtaataataaaaaaaagattggcaaaagggtggcaccagtgcatccacctccagagtatattgtgagtcaaggatctgtttgcaagaacgaaaacatcacaggcttggtacagtatttcttgcaccttgcagcaataggtctccatttacgtaaattctgaagatgaacaatttttgtcccatctaaaatattttaagttggagtctacccatcctgactctagaataaaagactgactaaaggaaataagtaagtttaattcaaatgttgctgagtaaagtttattacagtatcgatgaccataactaacattcatgtcaggtgccactccaagtac

SEQ ID NO: 48095 - DNA, 758 bp, Bovine  19866881388566
taatatatacagtaaaaagtgaaagtttatatctactcatcttccctttataaatcccagtggtcgatagtctagactagtttttttgtacttacatatgtaagtgtatgaatgtgtacataattttatatatatatatatgtatatatatatgtgtgtgtgtgtgtgtgtgtgtgtgtgtatatagttttactttgtttttgacctatatgggattattttagattgaaccatacaaaattgccaatatagaaccattttttacctaccaaaaagtgcagtttcttttgggacttttctggtggtccagtggttaagagtctgccttgcaatgcaggggactttgttttgatccctggtcagggaactaagggcccacgtgccacagagcaactgagcccacataccacagccagagagtccatgggccacagtgaaagaccccacatgccacatctgagacccatcactgttgaataaataaagaagtattttttaaaaaaggacaaacacagtttcttttggatcaatccattactgcaaatactattctggtacttcttttctcatctaataccatatcttcaggatctttctattttaatgtatgtatattaatagacctaccagatgacagcatttttttaaagggagaaaatgccagttttctccttctctacgaataccattctcacttcaatttttctctttcttcttgaaggcagcggaggaagttggatatccagtaatgatcaagg

SEQ ID NO: 48096 - DNA, 1140 bp, Bovine  19866881406250
atacttttttttggttgagcccttacaggtaaattgtagacataatttccttttttttaaaatgaagagaaagtaaatacgaggtttatcaactccaacgagtaatagcatctagctagtatttagtaatactgttttgattcaccatatttattttttggttatcctctgttacaacgaatgaggttttctatttacttaataacaaaagactcctttaagaagttttttaaaacataacaaattaaaaatgttaattaaataatacatggcaaaaaaaaaaaagcccactcctgtaatcaagacagtggagtagaaggacgtgtgctcatcttctcctacaagagcacaaaaaatacaaatacctgctgaacaaccattgacaggaggatgttgtaacccaccaaaaaaagaatagcccatggccaaggacaaaggaaaagccgcaagtaggaggggcgcaatcacattaaaatcaaatcccatacttgccaggtgggcgacccacaaactggagagcgataatgccaaagaaggtatcgcactgttgcaaagcttctaggccccacatcagacttcccaacctgaggatccagcaaagggacagggaacccccagggaatctgactctggacagtgggatttgattacagaacttccacaggactcggcaaaacagagactctcagagggcacaaacaaaaccttgtgcgcaccaggacccagcagaaaggaacagtgaccccccaagactgagccagacctgcctgggagcgtttgagcatctccccgtgggagacgtgggttggggcagtggcatatattcactttatttcaaaggaagccacctaagatgcagaccacacttatttctaaatataacattaagctccgagtacgtagcttggtatgtagacaattaacaataactttgtaaacactggctaagaagaggcaagtacctgcatacaataggtccctgggacatctgagaactgtaattcatccctatcatgccttgcatgttaggctgcttgacagagacctaggaaatcctttgctgctgcatcggcatcagacctgctgaaaaacaaagatattgtttaaggtcgaaagtaagcactttactttcttaaaact

SEQ ID NO: 48097 - DNA, 1597 bp, Bovine  19866881425124
aaaagaggatgatagcatttctgagtttatacagctctgaatcccggtttctagtgagcaccatgtgtaagacttgcttgccatgtgcttcgtctgtctgtttcattcatggtatcaatggtttcctctcccactctaccttctagtccctggtactgtcagaagatgaagtactttttcatggtcgtctgccaagggaataaaaacctggagtgtcagtctctatagtctgtgtgagcaacagtcccatttataaaaaattccattgccatttataattgcaacagagtatattacatttgcaacagagtatttgcaacaatatatacccatatctggagtccaccctgctggtgtcttgcgccctgcaatactgcaggtggtgcatttggagatttttgagcagctcccagagttcaggtgccattgccatgctctgaacttgcttccgctcagtatgccggtaacagtgtcgggcaagtcctggaggcaccctttagggtggtccttcctgagaggctgtcctgattggctgggcatcaccacactgtccagcagtgcctgtcagtacacactgctgcagcatatcaaggaacatccagattcattacgtttttagattgaacagatccatcccctttcagcatctccatttacacgttggtcctgcttacacatactttgagacgcatgctctgcccttttgtactctgctgggatgaattaagggcttttactgacgatatgcctactttggtatagaaatgtttaaatataaaaaaggcaatttggcaaaactgtttctctttcaaaaagggaggagctatgatccttatgactactcttcccatcagcccagtaaaggaaaagatagatacctcaagtaaagttccttttatagactacgacttgcttctctttgatgaaacatgggtttttgtgtgtgtgtgtgtgttttaataatgattcactaaaccattccagatgacttagagttgttgttgtacatgtggatatctatctgtgaatccttaatctattacagttcctagagaaaaatacctccagtgttgcctagctaccactcacttggctggcttacttccttttaaaagagaggatgttttggggaaggggaagatgcaggatggtttttcacccctatgtgctcttcattcactagacatgtcctgatgtcagtgtgtgaaaaccgccatgttattatttgttaggtttttacgtggagaaatttacggggtggtaaaaatgttgtttgtgtggagggaaaatcccaaggcaagggttaccgtgagcctagaaacatgggcttctccatagtgggtcaaaaaccaagcctgctccctgcctcctgcccctggttcacctctctcccagctccttttctctgttgaggctctgccagtccttgctcctaccctccttgtctaacgcactcgattgaattaccatttagaatgtccttctcctccaacctcaaccactacggcatgactcacgtagccagtgtcagcgacgtgctgctggacaacgcgttcactccgccgtgtcagcggatgggcgggatggtctcttttcg

SEQ ID NO: 48098 - DNA, 963 bp, Bovine  19866881532018
atgtggtataatgtaaacatatgcatatataggtttatccaatattaatatctctacctgagaagtaactgcttcagtgtttttctggtctgatggttaaatacatatttatacttttaaagtcaatatttgtacaatagacaagaacagtgcctatcagctaaatacatatttaggactgtaccacatgtattacaaacatgtactaaaatcgaaagctcatatttatacagagcctttcatcttgaagggggctaaagagctttataaacatatgtacataaaaggacgtttgccactgataggcaggcaaggtatcacttcacctgctcccctgctccttccagcagtcctgggtaggaacgcatggtgtcatcagatgcaggtctgtgtcagctgcggagacacacaacacaatcacccacactgccgtgcacagtccctgaaaaggggctgcaacctgagctcagcaactgctctcctccagagcagaagcatcacggccatttccagctttgtttttaaattattctctaccaaactcaactaatcacttgacagaattgaatttgatactggaaatggtttctgaatgcaaaatactttgtctgatgatgaaaactaggctgaaaagcgcttccctctgctcttgttcgatttagagggagagagggggggaaaaaaaggggtcacaacattcaggagaaatgattcaaaatatcctatctaagaatagctttgtctcagaggattgggtcattacttcagaagacagtcgtatttgcctcccgtttaattaggacactgttaagtttttcagtcaaattactttatatggacagggtctatctatattatatacacaatggaggttttatattgaaaattctgtaactgccatataaaagcatacacaagtgcgataatggatcaggaatatgacattcttcacctaaagccaag

SEQ ID NO: 48099 - DNA, 1139 bp, Bovine  19866881575079
aatctaggcaatttttctatggatataagcaggctacaacctacctggcaaatgaagtaaaagcaggctgttgctgggacaggtggctctcctcgaaaaggaaggggcagcgtgggagctcgcagtggcttcccaggggcatggaatggacactcgcagaaacgggtacctaccctgttgtgctgtcagatttacgaggggtggtgacatttccaagtttcaacaaaggaagccattgtgttagcttatcatttgtgctgaggttccgtttagggcatttctgtgtaagtcagtaggcaggcagaggggcataccttttgttaaaaaacaacttcttttgtggaggactcactgcatcggtgccctccggttaccaagagacagctgagaactacactttcttagtgtagaagaccacgctgtttgtctcctgaggttaataccgcccatctgcaaggatgggaaacgctgacacaactcaaggcgatgtctgttttaagcagcgttcacaattatcacaggagccatacccttaatggttactcaagagctatcttttgtccatcaacacacacaccccctccccccgaaattctcagtaaaaattccaatgttaagcagatgtatttattaaaaataatgctaatatactcctggggcacactgattccaagagggtgtttgcagcagattgcattataattatttaacagctaaataataaaggcttttttttttttaaacttacagagtcactaaataatagaaggaaaggaaaagagtagggctgatccagtggagactgatgctggtatcagtgttccctaagcatttgtttggttggcagcctgggcaaagcctgtacctaaagggttaatgggggtccaaagtgatttttgcactgagctcctcccacgatgccaagaggcatggggttgagaacacagcagaaccaaacagtttattaaactgttgaaattgttaaaaatgttgaaacttgaaactgtttaaaagccagttcaagattttcataaacactattccaaaatgttagttttaaaaatgttagtagcaatgtgagcattccccgtgtcttcctcccctcccctccctctctctcaaaataaaacatgaacacc

SEQ ID NO: 48100 - DNA, 582 bp, Bovine  19866881600413
tgtggagacaggtttctggcccttctgcattcttgagcccctgggcagggtcctctgatatcttttgcctcctcttcctccctccacccacccctgctctctccagtctctttactcctcactatcaagctttttccaattttcagatttcaggtggaggagagagaaaacggcttgtgaccttgcaggtttcaatggaagagcaaacaccaagaacagataagcagacgccagcgagattctatgacctgtcattagggatgggcttcccagctatcaaatgtttgctcacataataaaatggtggcagagccctaaatgttgtcaaaggatctagagttatttgcccccttcagagtctaaacacaaacatctgataaggggcgcgctgggttccctcagaactgaggcccggctcagccagccccgcggggaccctgcctgggggtccctgagtgactacagagccctccgtctggagggtagggcagctggaggattcttaaggacatcctccaccctaagaagatctgatccataatgggaagagctgacatttactgaggtcctactgtgtgccag

SEQ ID NO: 48101 - DNA, 1607 bp, Bovine  19866881746980
cttttctattatgaccccaattatgtaggaaaagagatgtatatacatatgacagaaagaatataatatatattaatacctgtgatctcttggtaggactatagctggtttttactttttattcataattatttgtatgttccaacttttcaaatgcatataataaacaattttaaagcctcaatgaataattttgctttttagctagtaagtggtagagcagagatacctaaggctttagattatgcaacaagcaatcttcattgctcaaggtcataatcaacaggacagtgagaaaaaaatgatcaaattctcctttcttgaatccatggccaaattattctgatggataatacctacctggattctccttcatcttccacatgttcacaatggacagagttgagagcactgactctcttgtaatcttgaggggtcagatataaatatttgtatccctgtgggaagcacaaatagtttttaacccattatttgccatcaccacatgaccagaagacccagcaaagtacatatgatgcagtggttctaagctagctttaaatcgccaaatcatgtcttagagttactgtctcatagaatactagcatagagagtgctcctttgaaagatggaggtgtctgtttctgtatcattgtacccttgaaattaggtatcttgcagctgcaacctcaggtactaatacattccactcatttccttttcatcaaggttaaggggtcattctctaatcttaagtgatacctccattaaaaatatcaacacaaaattaaagatttgcatgaattactattcatcattttctcacaatgggaccatcataccatcaaaatatagatgggtcaaggataattgagagcatcacaaaactggagtattcaatcttaaaatcagatgtctatgctaatgatcagtaaacactaagcttgaaccgtttgcttttttaaataaacattttattttttaaataaaaaagcaaaaaaatatttgctttttaaaataaataatccctaggtacattaaaaaatcatactaacatttcatgattggcttatttttatacatacatatgcacactcacatacagagttatttaatacacatattcaccttaagtgaaggagtcactcagaccaaaagacaaaaaaagcaagcagagaaaaacacttaaaatactacaagaaactatgtccgcggtttaactgaacttgtcccacagtgagcacaacatgccagagacatgaatttgaatttgccaccgattctgcctgactcttgctgagaaggcagggaatgtcagcagtatgtcagccagccacatttatcgggcgcctactacatggaaggcaccggccaaagcatggggaaaacaggaacggacaaaacaggcaaaagtttctggcgttacacaacttatcttctagtaggagatacagaaaatacacaaaataagtaagttaaatatacgatgttaatgggaataacgtttgaggggaaaaaataaaatagaggaaggagacaggacagcttggagagtcgaccttctagaagaacagccaggaaaggctttgctgaaaatgtcacttgag

SEQ ID NO: 48102 - DNA, 1464 bp, Bovine  19866881840555
cacgggggccggggagggagaggctagtgtccttcctatttatccaccatctttcactggagcatctcggagcacgagaggccgcagctctttaatcctccccgaggaggacgctgatttcaagggctccctggggagcaagaaataaaccccaggatcagagtccagggccgacctcctctctgcctctcaacacccttcactgcagacggcccagcctacggcacgtgagaagcaggtgggccctagaacaagcctctgtcagaactttcaaagtatttggacacattcacttggttcattttactcccgaagatccacgccaagaaaaacaataatttcaaaggacaacaaagaagctttatgcaggaatattctcctgaaacaatattcataatagcaaacaagtgtaacagtctaagtgttcaacaagagggggatttggtttagtaggcaaagactaatggaattattagttagcaattaaaatacttcagtgagatctttaaaaatgtggaaacaaccttctcgtgtagtactactaataaaatgtagcgtgcaacctatgggtggttctcaatgggtggtgtatggatgttaggtggagggggccgcatgcattttgtttttgctgctttgaaaagggtaacatttcaaacagtccagaaggacaaacgaagcctcccacctgcactgctccctggaccctccccccaccccgagaagaggccactgggtaccacagcgtgtatacacaggcgagggtgatgaaggaacacaggttaacgagaaggggatcttcttgagtggagggataatttttgttgttgttcagtcactaagtcatgtcttgcgaccccttggactgtagcacaccaggcgtggcttccctgtccttcactatctcccggagtttgctcagactcaagtccattgagtcggtgatgctatccaaccatgtcatcctcggctgcccccttctcattttgccttcaatctttctcagcatcagggtcttttccaaacagttggctctttgtatcaggtgaccaaagtatggggttatagccaagtcttattttcatttgctccttccacgtttctgtaatttttgacgtgaaataaactaagacaagaagacagccttatcttctccatcctgaagggaacagcccacggcctgctctggccccatgcgcaaacctgggccgggtgggcctgtggcttcctcatggctctggtggtgtcttcaggggctgtggtttaggagcgccgtgcaaggaggtgtcaaaatggatgaaaaggaaataagcaaacttcacacaaaagggagaaatgcttcagtcaacactgaaaaaagggccccggattgaaactctttgataacggttctcaactcatttcaaaatcagcattagccaccaaaatgtaaagtattagttttattaaaatgcaaatcaatca

SEQ ID NO: 48103 - DNA, 1467 bp, Bovine  19866880406428
tttggatttctctggagcaccaacaattttagctttgtctcctggtgaagaaattctgtccagattggcaactttgcttcaaataaatcagaaagcttttgaagactcaacagtagcagcattgacaagtgtttctgtgcaaagttcattataaaatacagttcctgcttttaagaagcttagaattttatggaaatttttatgactgccttattgtgattcatgtagctatggagaatccatcctgattctaccatggatgaaacattggggaaaagtaatctccaattttatcttggcatttctgagctgtgataggtggtgaagtgaaagaagtagaaactccttattgttaagatttcagttcagttcagtcactcagtcatgtccgactctttgcgaccccatggactgcagcatgccagtcttccctgtccagcaccaactcccagaagttgctcaaactcatgtccaatgagtaggtgatgccatccacccaccgactcgatggacatgagtttgagcaagctctgggagttcagacttagacattgttaaatataccatttaggacaccatttatagtaaaaagaatgtgttcttgtttagtatattgggttatctttatggtttggcaggccatacctgcaattgacttctatgatatttaatcattcattcactcaatgttatagagtttctactttgtccagcaacataaagtgtatcctaggaatacaaatctaagtagtcaaagtccctaactgcaagtggcatagagtcacttatggaagacacctgaattaagcaatggtcatagaataataaaagcagaagaaaatcctaacaaatagcccagtttcttcacttgagcatattatatttgaaataaaagcactggatataatcttgtcttccaatcttagcctctcctgtaattaatatacaaacatttcaaaatggaaacctccaaaagtttataaaacacaatgaagggtatttgtgggctggaagttagttgcttcatctttgatatttcctgattctacacctgcctgtaaaactctgtcctttcattcacgttccttgcatggtgtctgacatttatttttagtcttacccttcttggttctggcttcctgttgtatctcagcaagcccttccacctacagtctagacatgaaccacttgaagttacttctaattctatgatttacacatttggaaaagaaaagagaagagacagaaggagaaacatatgtcttacataaaagttaaagtctggatatagttctttgctggggaagtttttatggagcaagtttgcaaaattatatgctgtaagatgagaaaatcttttaaaagttttaaataaaaatttagaaaataattagtaacattaaagtcatcagtaaaactgacttaaaacagatgagaaaattccagcatcaggaaaggtttgtttat

SEQ ID NO: 48104 - DNA, 1508 bp, Bovine  19866880458900
cccactccagtactcttgcctggaaaatcccatggatggaggagcctggtgggctgcagtccatggggtcactaagagtcagacacgactgagcgatttcactttcacttttcactttcatgcattggagaaggaaatggcaacccactccagtgttcttgcctggagaatcccagggacgggggagcctgctgggctgctgtctatggggtagcgcagagttggacacgactgaagcgacttagcagcagcagcagcatgactattcaaattgctttgtggttttgtctattatatggatttaaaatttttgttattattttatacacagatctcagtacataaaccttaaggtttgcctagaacagtcccattttatgcctattgtccacaaattctctctgctttactatttgtcctgggccaaagttttatggtttggacaataaattatacggtcaccattaaatgagttagtataactttgtgaaagcacacaatacataattcaataagtatcaaccgattgcacataaaaatcttctttttttcctctagacatgaaatttggagttttgtagctatgatttattgtggactgcctgctaatctgaccccatgaaatccttttatttctattagtatctgaactgagctaagcttctcagcagtgactccaccagtgaagtgatgcaaatgccagtcaaccagacttgacccccttgagctccagattagttttattaatcaagattcacgacattatttgctacatcaatggaatctgtagcatctctcacccagagccaattctgctaaacaagttccaagaattaaatctgtgtcagttgagcaagtgaatttctctctcctttcactctcccttttaatttcttaggaataatctaactccatctcgtgtatacctcatctaagtacattttcttttctataataagaatgtactggaagatgttatctaaacctaaccagagaggagattctgtgaccaataactggtaggtggctcttaaatttctgggccaaattagtgtagagagttgatttcaatgcgttatgtgagtttgaagaaataaactgctcccatgtcccctttttggggttggattgaatttctatctcttttttagaagctaagctaaagttctaaatgttagatttctcctggaacagtggatatagtaatatctttcagggagcatgtacagatttttctgtttgaccctaaaacatcacagggtgtcacgccacatcaaacagcttgactctagaaagacagtatacaacattttttctgccctcagaacttaagtatacaacctagaaaattccctttatagaaaaagaaaaatataattgtagctatttagcatatgccaactgaaactgatctatatttataacaagttgctcaggcaagtaagcaattatttaaagaggggtggatatgtacataggcgcaacataagcaagagggtgaagtcaag

SEQ ID NO: 48105 - DNA, 804 bp, Bovine  19866880548114
gaattatcaaagactgtatttagaactcataatgcttttgtttaatgtttacaacagtaaatagtttgaattcaataaatattattggtcattgtgtactgatcaatgcatgttacccattcaaccatttataaatgaccaatttcttctgtatgttaaaaaaaaacctggaatactttccttgaacatattcattaattccaagttgattttttaaattatgcgaacaatttgatcagccactgaacaactatccatctttgaccttctgactacttgttgtatctgctggatatttagtttgattgtatagttttatttgcttctgtatgtgtatttttgtgaattattcacagggttaagttaaaataaaaccaagggatatcttaaaaaaaatattttaggtaacaaaaataagtatattcctttaaattggtttcttaagctacacttacatgcaatatttttcaattattttagactaaatttctatattttctgtatatgcaaacataataaaggaagctttcttttcctttatacacataagctcttcttttctatgtattgtgtgatgcctcaaccttttacgacttgactcaaaagtcaactcttctgggaaacactcattggctgctctaggcagattcaagtgtttttttttttttttttttaattttacttctttgtctccttctggaggtctttaattcttttgcttgggcctcctacctagactttaaaatacaagtgcagagactttgtcatctttaagacaaagcatttagcaaagcaactgccaca

SEQ ID NO: 48106 - DNA, 751 bp, Bovine  19866880554880
acaagaagactctcccctcgttttcttcaagcagagctctgggcaattagaatacatcaaagtgtctaaaaggacagaaccgattgctagctccctcctgatcacctgtgtagtatattctcaccactgggggccattggtcttgtggcttttgcttcctgctcactagactgttggttgatgggctgagggtgtgactttgctcatttcctttttgtcacctcacaaagccctggtttgtttgctttatctaagacctctctgctacctagctaagcctggcttcctgtccagtgctgtgcactgcatctccatggtcccagctcagttggaagaaacttgactgagggtctgaaagtctgctgagtgtttaatgacttcctcaaacttctcacttaccttcagtgctggcaacagccaggtcagaggagaaagtcctaggggtgacttaaattttagcacaataaaaatgctaagcattctgctagctgaacctgcatgggctaaggaagggaatggaaattttagggcaaagcactcgtttatattgtgtgtatgtgtttgggtttaataatatttttggtaacttctcttggtgaggagcaataagaatttgacatcctttcatggtggtgcttaagtaaatcactccttactctaaggagaagtaggatgattttggagctggtgcaagtcagaagtctggatttaaaaagcatactggtgggtccacagtcaatattagggacag

SEQ ID NO: 48107 - DNA, 1662 bp, Bovine  19866880609813
ctcatacaactcaacaatgaaaaaacaactcaacccaactaaaaaatgggtagaagaccttaatagacacttctccaaagaagacatacacatggccagtaggcatataagaagatgttcgacattactaattattagaaagatgaaaatcaaaattataacctcacttacctgagagagatgaactcaaacatagcatcttaaaccacaaggcctcacgaaggaaacttcatcttacagaaacatcttgaactttacttccaaaatgattgacaacaccattatacattactgtataaagctaacattattaagtcttcatatttccagtggtacttaaaaaatgatatacattgttaatttgataatgttcattttttttaatttcctctgcaagaagctaaactttacatagagtgatgtcttggtggatagatattttgtgtgagatttggggcacctcatctataagacaggaccaagggcagaaccaaagctactaccaagtaagataactttcctggttagttgtttgtcagcagtcattatgcacaatctgccacccagattactgaaagcatgttacacgggtcctaagggatttcttccttgttctctgtaaccttaaccatagtaatcagtgttaaatgttataaaacagcactggagctttattactgaatccatcagttaaattacagtgatcattaaaacttctatttagcaacacaatattttgactatcaaattcagagagattaatcattgttttaaatatgctctgccggcaatctgatccttttttctggtccagaatatcacttagtacagcttctgctgcttctactttgcaggctggaaattaaatgaaggacaagtggacaggactaacctttttgggaaatttttaaaataagttaatgatccatttctgaagcatgagaagctgaaggtgggtcattaaagctagtgatatttataatcagtatttgcaaagaacaccagataattggttacaacagaacagaagtaaaggcatttcagactgagacgcatttccgagggtagcaagttctgccaccaaagcgtctttgacatcttactcaaaaaaaaaaaaaaaaaaaacaacggaattttcaaaatgtgatcaagtgatgaaagttagaagatgtttgataagctgaagaagtaagaaaatattgactcagagtacagattttgttataacattggcagggccctcaagataggtttgacagtgattgaattaggttacataaattgacacatcttgctgccttgcttcatttgtctgatcaaaattgagacttactaaattgtatcatttttacttgcttctcttccctatctcttaccactgttataaaatctatgatatttgctttaattttctgaagcattaccaagatttatttttaaaacataacaaattatatcaagtgactactcaaacacttgctagagttataaaaatactatttctttgaaagaaaaaaaaatctcttcaattttcagcaacagaacctgacccctacgagtgaactcatttgtctaaagcaaggacaagtatgtacattagttttaccctttctgatgtcaaagcctaccctagatagtaactgtcaaaatgacaaattttct

SEQ ID NO: 48108 - DNA, 894 bp, Bovine  19866880616048
tatgtatttacacacatgacactaaccgccctgagagtgtgctttgacattaaattagagattttaaaggcagctgtggatgaaggtgagagcaaataaagatagagtggtaataatgtgaataaaaatgtgcttgagtttatcattacattgatggatggattgtatttttgctgggaacattcataacactacttctctctaaatagtataggaaagaattctagctgtgtactagtgattcttaaagtttagtatgcatcagtgtctcttgagggcttgttaaaacacagatccatgggttgcactctcagagaattaattcagtagctgatgctgctcatccagcaacccggtttgaggactaccactatagatgatacccaaagaccacctcgttcatccttctgccctccacaagaggtgctgcaaacaatgaatcaggaaccatggctaccaggtcctaactgttatcaatatatcatgaatgctctaatttcagaagcagctcagataagggggagggactgagtcatgggtcaagagcctcaggagtaaaatgaaggagaatcttaaaagtgttccctggtcataggaacaggtacaaagaagtacctgggagtacaaagtgccactgggagttataaccttccccaacacaacacaggccctgcgtgttgctgtttcagggaaacagttattgttggtgctactgtgggtgtcacagctttcccagcactgctgaaactaagatgagaagagatggaacattccagagagatggaagctaagcaaaggaagggcacggggtaatggtgggtggagagcggagcagcttcattttattcatctaactctccagtacctattatggtacacaagagacattcagta

SEQ ID NO: 48109 - DNA, 1828 bp, Bovine  19866880694909
cgaagagctgactctggaaaagaccctgatgctgggaaagattgagggcaagaggagaacgggatgacagaggatgagatggttggatggcatcgctgactccatggacataggtttgagcaagctccaggagacggggaaggacatggaagcctgatatactgcagtctatggggtcgcaaagagtcagacgtgacagagcaactgaacaacaacaaaggtggcagctgaggaagaggaggaagagaatggagcaaaggcaaaatctgaaaagaaaatggacaacaatttcccaaatctaatgaaagatatcaaccccaagatgagagacagaggaagggaaggagggagagaaagagagaaggtgaaagagacagaaaaagagaaagaaggaaagacagactgcctgcctcacctaggtatgatacattacagaagagatgctaaaaatcaaagacaaggctacattttaataactaacaaaacaaaaaggcagtatcttcaaagaaataataaaaatccttgctgactttgcaacagtaattctggaaaccagagagaatggagtatcttcacgtttttgaaggacagtaactgcaaacctagaattttatgcccaaaaacaatatgcttcaaaaaccaaaatgaacatgttcttagataaacagagagcaaatctgctgacagttgatatttaggaaaagaaatactcaaagagttctataggaaaacaaaaaaaggctcccacagaaaaacatagaaatgcagtataaagtaaaaacagtaaataagtatatatttagataaataaataagtaccaaccatataaagcaatactgtttaatgagtactgaagcataaatgaaaattaaggacaataatgtataaaacagcagcagtataatataagtacagttaaagtgttccaagttcttagcattgttaaggaagtggtaaaagtaagtattttgtgtagattgcaataagtcaatgataagtactgtaatctctagggcaaccactaaaagatcaagactgtcagaaaggataaaaaataaaacacaagagatacatcttaaatgaaagaacacaggaaagttgattgtgaaaggacggaaaaagtcataccatgctagcacgaaacaaaaaattacaccagacaagctagattttaagtattaatacagataataagggtcatttcataataattaaaggaccgattcaccaggaatttaagctaagctgatgcggcatataaccaataacacaatatcaaaatataaaccacagtaggttgggaaactttaacatgcttctcttaatggttgataaaagcagcaaacaaaagaaaacaaaacattaaacataaaaatatatgaccaagactcataaacataatgtaatgacctacacagaaataacatccaataataaaagaataaatattattttcaagtgaacatgcaacatgtgtcaaaactgctgctgctgctgctaagtcgcttcagtcgtgtccgactctgtgcagccccagagacggcagcccacaggctcccccgtccctgggattctccaggcaagagtactggagtgggttgccatttccttctccaatgcacgaaagtgaaaagtcaaagtgaagtcgctcagtcgtgtctgactcttagcgaccccatggactgcagcccaccaggctcctccgtccatgggattttccaggcaagagtcaaaattgctatatgctatatcaaaaaggaagacccctttcaaaggactgaaaccattcagaacaatgttctcaggactgatattaagaaatcacaa

SEQ ID NO: 48110 - DNA, 1577 bp, Bovine  19866880703158
attttttaaaaaacctgggaaaagcaatagtctcaaatagtatactggagaaggaaatggcaacccactccactattcttgcctggaaaatcccgtggacagaggagcctggcaggctacagttcatggggtcacaaagagtcggacacaacggagcaattgagcacacaaatagtatgaagcaactttgaaagatatcaaataggacttctagaactaaaaatatactcattgaagttacatgtatatagaagtagaagtttgttaagtttgatttgcctaagatcactctacttgtatgtggtgaatttgtaaaaacaatgcccgtaatccttttgttatactgtattctgaatttagtgggaaaatgaataagcaaagagggctttctatttataatttctcctccagtcttttgactttatattaactaatgtttgagtcattaataatgaaattaatttagcatctttataattgtgaccttaaaaagaagcactaacacacatgctttaggctaaagcaagcttagctcattttattgaactgaaacttgaataaaactgggcctactctatttcagcttcagacccatgtcaatacatccaaaataaatatagatatttatttatagatataactctaaaatcaaattatgcacattccaatcacccttcaaaatttcattaaaaccttttttacatggcttgctttccctaaaaatcctttctctgcctaataaaatcaacaaacacaaccctcctccctgcctccatattgcttttttccttattccttctttatgatgccatgtctctattatattcaatcttattctgtttctctcatttacatctttgtgacatacttgaaaacaacttttattttttatttttcttggtccttccacctcactgtatacctttcttttttttctgaaacagagatgaaaataaacattatttaacttctggcttgaatcaccaagagggatctggcttggcaactaaccataccacactcactagccctttcctcctgttcttttaactaacatttttgcagaagtgaatcctgataaaaaatgaagctatacgattagaaaaagttgagtgagaattcagtacaaatgtagctttaatgtacctcaagctgtttgtcttagttcatttcaaatcaaaggatatttgaatcttagaattgaaatagatgttagaggatatatatatacacacatatatatatatatatgtatgttaattagtttatgtattttgatcctctctaatttaaatgccttggtgtttttattttatattctaaatttgccttaacagcttgaataacagtgaagagaaagaccgtttgttaacaaaagaaataataaatagctacaaaactatgacataatgtcctaaaagctggggtgtgatattgactcctaacaactagtcaaccacactaatggagtgttgtaatgcaacttcagtctaatgaaaagacattgtgtttttaagaatgtttggtagatgtcttcagatccatttgtactgtcctcctttcaggcttttccttca

SEQ ID NO: 48111 - DNA, 979 bp, Bovine  19866880728929
tgggaaggttccctggaaggaggaaatgacaacccagtccagtatttcttgcctggaaaatcccatggacagaggagcctggtgggctacagtccattgggtcataaagagtcagagacaaccgagcgactgagcacacgtactgccaatgttttccttaactatgaataaaaatactcaatggaaaaataatgcaatatgtagtagttgttctcattgacgtctcatgttctagattttggtaattaactggtgagaaacacctggaatttagaattgacaagtagacatttaaggtaaagaaaattttggtggtagactttctcatggtgaacattcaagacaggaattttgaaatccatctgctttattttgaaagcggcctttgatggagctgtttccaaatgggtgagattcatttaaataatttcctccacccaaagaacttgactttgacagacatggactaaacaaatctaacctgtttttcaatatcaggatctagtgggaagccagccaaccaagtagaaaaacaactgtgtagtgcaggagaaacaaaatcacgtagagaagagccaagggaaatgtagttaaggaaggccactctgatctgtcaaaagtaggctggaattttaggagtcagtccccaaaccaactttggactcaggatgtggaagagaagaggttagtgaaacatgtatgtggaaagagaaaaaatgcctttctttaagttggttagtgagtccttcagaggtgcggcctggctgaatgccaaaagcaacaggaaaactaaagtattttgccaacccatgcctaaagactgctacttgtatgatgggactgtgttgggattagcctaggagcagagaggggtcctcttaaaaaaaaaaaaaaagtatgtttgaggcagaagtagtgccagaattggaaatttaagactaaaattaagacataaagaaaagtgatacttctattttca

SEQ ID NO: 48112 - DNA, 2784 bp, Bovine  19866880750169
tttgaaagccctccgcgtcgcttctcctttaaatcttgtcgggaaggggcggagctagggccaggaaaggaggagcggcttctgtgggccacgcccacttggggtagcaggcgctggagacaccaggagccgttctcctcctaatccgctccggaaacgcgactggggacggaattaccacgtgaggttgacgtcatcgcccccgcgccgggttctcctgacttggcttccgtgggatcctggaggtggcttaggtgcttaacgtcaggttttgtacagttcgtggtcttctctctacaggctccctgggcctcgcctccgatttcccgatgtaccacaacagtagccagaagaggcactggactttcgccagcgaggagcagctggcgcggttgcgggccgacgccaaccgcaaattcaaatgcaaagcggtggcgaacgggaaggtgagggctcgggctctgtaaactcttgcctgtccccccctcccccaggacgtaccccacacctccctcccgcctcctcggcgcagagtgcgtttatccatctaatcaacagcgagcaccttgccaggtacagtgggtaaggagacggacaaggccgtccatcccctcagtcgagcggcggactgtatagtcagtaacaaggcaaagaaaacactttgtaggatgctaaggtaccgggggtaggtttctcttagtggctggtgtggagatggggaaaggactttcccggcggacagagccacaggtgcaaaggcggagttcagaaatcgcagagctggtctctggaacgctcttgatcgtgtgtggcggaagcagagtgttgagaggctggagaacacaggcagggaacttgtaagcggaagtaagtagtttgaactctgtgatggagagatgggaaaccttagaaagattctaaatgggaaattaatcttgtcagattctgttctagaaagagctttctgggaaagattggattgattggatggggcagggcagaagaagggggatgagacaccgttagcacaaaccagttgactacagaaggtttggactatagtctgtccgccacgcccttccagttttacttttacctgtaactctcgtttacttaatatcattttatttttgtgctgtacagagtagtacttcctttgctaaattttcagtatttggcaactgttagctcatagaatcctcacaactaccccatgaggtagatactgttattatccttgcattacatctgaggacactgaagtacagagaggttgaataacttctcaggctatagctagtaagtggcagagccaggatttgaacccatggaatctggtttcagctgtccttctgtgaatcgcaatgccatgctgtctctataaaatgagccccacctgtgttagtttcctaggcccgccacaataccatacactaagtgacttaacacagcagagatttattgtttgagttctggaggctagaagtgtgagaccaaggtgtttgtggagtagtgctctctacaacttctagacccttccttttcagcttctggtgaccccaggtgtttttccgctagtggcagccaactccagcctctagctccttctttccagagtgttctccttgtgtctctgtctctttacatgttcttcttacaaagctaccagtcatattggattagaagccttttctacttcagtaggacctcatcttaactaattgtatctgcaaagaccttattttctcacattgtgaggtactggtgttaggactcaacataccttttttggcacttgtaattaaaccagtagtggcaccaaatagatatttttgttgtaaaattgtagtatttattaaccctacagtgtatttcgtagaaattttatagagatgcagaagaggtaatatgttaagggtcagaaatatccttgagacacttgatttttacttcaacctctgtgactcaataaccgactgagaaagggctattgaaagttttccaaccattgacggtttcttccttttgatctgtaaaagtgacatcaaacttgtgagcatatacacacgctcctcatgattacttataccttagtgagcaaatattcagctgacattctgagaagttatgcaattgtggcacagttttagtttattgaatattttttaaaacttatttttgtgtaatattagcaattctgtaaagagaaaatgaggtacatttccctttggttagagataaaaacttaattaaatctgcacagagaaatattaagattatctaacttattaaacttttgttctaacttttgatctaaaggttcttccaaatgaccccgtctttcttgagcctcatgaagaaataacgctctgcaagtattatgagaaaagattattggaattctgttcggtgtttaagccagcaatgccaagatctgttgtggtaagctttagtggtaatgaggtataaatttctgtagctaacttacaagagcttataaagattaatcttataagctaacttatatcctcttataaatatttaactcaattctctatccactttactcagaaatgcaccttagttatgtatataatttatgcatcaatatttgttgtcacatttttcaatgaatgcattaaattatgaattcttacattgtatcttacacaatgtttcaaaactcatttcatgtcaaaagaattttgaggtctgctggatatgtcatgacattctcattttatagggaaagaaaagaattactttccctctgggttctcatgc

SEQ ID NO: 48113 - DNA, 1658 bp, Bovine  19866880806473
atttctttcgttgataataagagagtcaaaccaaagtaatttatgcaagcaatttctatgaaacaattcaaagccttcacaacttttagagagaacatgaatacaatttttaaaataatgttaaccccaaagcatctctttataaactaaatacagcatgttgttgtaagaatacaggcaaactgtgggctgtctatacattaagatgctaactggaaacaaattcatttctgcaactatagctactctctcttaactgttccaatttttagatccaaaagtatattggattcagaattagagaacagttctagttcctattccgccactcagtaacttgaattttggcaacctgctttctctctgtaatttattcatctgtaaaatggggataacaagaactgctgtgcctcaccaggatgttacaaggtagaaatgaaatacaatatatgacaacttttatatcactatacagattacatttttacatgatcactaatggtcttgagaccagagtgacaagaatctgacccagggtgttttcttacttctgacgttacctcatgctcttggccatggttgttgaccttccagggcattgtgccagagatacctttttgtgtttttattccgttcctggtttcctgctaggatatgtttttttacttctgttttttatgcaaaatttcattcttcagcaaatgtatttcagttgattatggtttttatttttataccaccagagctctgtcatttataaatccattttattaaatttaaaaataaattcatttcaaaatgattaaataattttaaaaggccaatagaaatactccaaagattttcacaaaaaaagggaaattcattgctatatcttaattacaaaaaaattttgacaaaagtggttaatatgaaaagaaagcattataatgaaggaaacaagtaaatttcctatgatcagtgataacacataaaaatatgtacatatatctaattatttattataatatggaaaagcattttaaaaaacagtaagttttccatgcgcacaaatgttcctttatttgcagatcactgctgcaaagttactggtttactcagactttccctaggaaacagtcaccatctgcctgattagtctgtttccttggtatcctgcccattctcgctatttaagtttctgctctatttcgagaaacgcactcattaggatggtcacatctgttatcatttgaaaagaagtacacatactcaaaaaacaaaataggaccttgatattttattaactataaacaggaaaagtctcttttcaactatcttatccttaagtgctaacaaaggatagtttgatctttcaggtccctctctcatattccatgaacctgaaataaagaaggagtgctcagatagtaaaatgacaactcacacattttcattatgtgcatactgagaagcacattaaaaataccatctattaaaattagttgactgaatactagcatagaataacaagtaaaacagtaatattttgctgttcttaagactatttatatctggctatctcctaaaactagtaatatactagaatcttacatatatatgtatgtatacacacattaaacaaaatactcattattacaaacttcatactcatcagc

SEQ ID NO: 48114 - DNA, 1235 bp, Bovine  19866880819727
tcaaagactatttctatcatttgccaaggccagtgctctatcaattccaccactgtatttatagacagagttcattatgtacgttgatggggaatgagatgggaaaatagtggggataggaaagcatgagatatcagcattaaagggagaataaatactcatttcaggtgtgatggttattcttattctatttttcagttgtaaatggacaccaatggaatttataacaactttctaaatttataaagatatccctcatcatttgctgcataccagtgggtattgggatgattcatggattcagagagtattcaaaaaagaagcaacaatagagatcatctaatagaactgttccctttttaaaaaaaaatagttatgagagaatattgtgaagcactctttcgtgtataatttcaactgctgctgctacatagaatatcaaaagatgattgggcatggatttagatttgtttgaaaactcctctaatagcacacacatctgtactctaaatgcagtgaatgtcacatatatttaaggaaataggttatggtggaagaaggggcaagacatggaactggaactagaagcctggagctttggtttctattttggtttctaacaagttgtacgactttgatcacttccactatcagattagggcttccctggtggctcagtcagtaagaatccgcctgcaatgcaggagacccacattccatccctgggtcaagaagataacctggagaaggaaatggctacctactccagtattcttgcctggaaattcatggacagagaatccataaacagaggagcctgtcaggctactatggggtctcaagacttagcaactaaaccaccaccactatcagattactcatgagtaaacagaaatacctggactgagttcacttctcctggacccagtaaacggaaacagccttagagttctagtattgaggactcagcttctctgcttacatacaagggtgcactgtgattagactttgaagtcacccagacaaagaatgctttctcaaaatataagtaaatccaagagtatatattttgcctccccagagttctagattactaaatgaatagaaaacaaagaaaaattgcagtaataccaggtagagtgtgaccagtgtaaggttttccacggtcctttctgtaatgcaattaagatagtgtaacctcaaccaagtagaaaggaaatcagaaatagcaagaa

SEQ ID NO: 48115 - DNA, 795 bp, Bovine  19866880838790
tatggatgtgagagttggactgtgaggaaagctgagtgccaaagaattgatgcttttgaactgtggtgttggagaagactcttgagagtcccttggactgcaaggagatccaaccagtccattctgaaggagatcaaccctgagatttctttggaaggaatgatgttaaagctgaaactccagtactttggccacctcatgcgaagagttgactcagtgaaaaggactctgatactgggaggaattgggggcaggaggaaaaggggatgacagaggatgagatggctggatggcatcactgactcgatggacgtgagtctgagtgaactccgggagttggtgacggacagggaggcttggcgtgctgtgattcatggagttacagagagttggacacgactgagcgactgaactgaactgaactgaactgagaaggagggagagcagtgagtttactttatggaatagaactcaaagcagaaaaccaatggggcacccagctgcctcagaaacagtatgccaggacacactaaattaattttggaagatcctcttaaacttgataaattccctgtgtattatttccattctgctctgtctattttccagtcttgatcatacagtagtaaaacccatctaatgaaagtgtctgtttgcttttctttatgggaaactagggaagcccaagaaaatcaagtagtggcaaggcagctttagagaagagaagaaaaccagtttaatcctgcaagccctggtcatgctgaaaaaaagaaagaaaaggaaaaaggaaataga

SEQ ID NO: 48116 - DNA, 632 bp, Bovine  19866880945362
caaaagtgtcagtgaaatcaggctactgctactccagccttctcagtctatttgaaatgccctaggatgcacaagggtattgaaaaataccaaccccagagaacaggatttatcacccctgtcaagttacactcacactgatgaattctgacattcacctcaatataagtcagaatcctcttattatttaattagccagttctgtgtgtcttttgccattaagtttgacaacataggtagcctctctcttttcttgtattgtggtgtaatctaacatgaattaaagaggaatttaaaacggagagttcagtcttcaaagtcatatattttttgacctggagcttggcatcctgtggatgatatgaatttctctgaagaactaaaccctgttgtaatactataaggtcttgtgtggcattttttaaatgcaaattcttgacatcaaattgagaattctttctagaaatgggtagcttaggagtacttaatggttcgtgtgtgtatctgaaatattactgttgctatttaagtagttttggcttgagtatttaagaactgaaccactcattcagtctctgtgggaataatttggccatagaaattgaaaatgctttgaattccacatcttgcat

SEQ ID NO: 48117 - DNA, 1960 bp, Bovine  19866881060477
gaagggtggcatttactgcctggcagaggagggtagaactcacatctgagagctagcagaaacccagagtccaggccctggggaagggcttggcaagtgtagaagcagaggatggctgtgttgctttccctagaaagttacttgagaacttgtccacttgaaaatgaaatgtgtgtgtatttggtcatgtctgactcttggcaacagcatggactgtagcctgccaggttcctctgtccatggaattctccatgtgagaatacttgagtggatttccattcccttctccagaggaccttcccaccccagggatcaaacccaggtcttctgcattgcaggcagattctttaccatctgagccaccagggagcccaacacagtttacttaaatcttattgtgtcatgcatgtgtgctaagtcgcttcagtcatgcccagctctgcaaccccatggactgtagcccaccaggctcctctctccatgggattttccaggctagaatactggagtgggttgccatttctttctcctgtgctcatactggtggagttcttgcttggaaacttctactgtctttgttaagtagattatattctaagtgcaaagaggaagtgttaaggaaattggggatgatttgaataatcaccacaaggcataaaagggagtattgatgaggaaaacagaaagatcccaaagcattaaattcccagttaattggaaattatggctttttggtggcaccagtctttgccattatgtggcttcctccatgagcatttggctgccttgatgtgagggcaggaagattgataactagatccaaggtcaggaatttaacaaaaagatcaatgacagagcaaagaaaactgatcagagagtggagatgttagactctgaagctttaaggacctctcttccaagtgttgactaagtcaaggaatgggtgtaaaggaaaactgatggggggagaagcaggtgaagacctttggaaacaaggaggtcaaaatttgacatttgcatggaaaatgcattgcttagtgtacggtctatgtgaacatgtttgccagacatggtgctttacatagataaggtcaattagaatttacaacaccttcaagaggaaattatttttattccaattttcagatgaataaattgactcttggaaagtttgaggaacttttgtaaagtcgagcagatattagcagcaataataaacattttatagcaatttactatgtattagacatcattctaagcgctttacattctaagttctgagtgctcagaagattgtgttattaacatcatagaaaggagggaagcacagaaagcttcagaaactcaagttacatggcatctaagtggcaaaaaggtggacttcaaggaagtgtcagaaataggctattaatcaaagtcaatgttactccaaaacccttgttttagccactcagaaatagcatctatttatgacatttagagtgctttttcatttaagaaattctttagggaaaaaaagtctcttccaagaatggtaataaaagttttaataagtttcatttcatctatttcattacacttaaaattcacactgtaaaaaatatgaaatgaaacagaatatttaggctgaaggaggaagaaggaaggaaaggcagaaatatgagggaaaatgagataaaattcagaaatcattgcagaggtctctgttaatttttcctgtctgtgaagtggcaagagattttttcctactgatttaaagctaacccatattcatgggttcctcatgaatatgttgtcgttcagttgctaagtcatatctgactctttgtgaccccacggattgcagcatgctaggctcctgtcctccactctcccgtggtttcctcaaattcatatccatttaatcagtgatgttgtctaaccatcacatcctctgctgcccacttcttttgccttctat

SEQ ID NO: 48118 - DNA, 1634 bp, Bovine  19866881062543
acaagagaattaatagcaagaaaaatattctccctgccgtcctcctggaacaataatcagagcacatgtttcagcatattaccaggttcaaggcataatttaaaaatagtcactctgaaggttgtgaaaagaataacagaaaaccattccatcctgctggacaaatccaaatgagtgaattcctaaactataatataacgtttaatatgttttggggatactgaatactgtatttgaagtgcaaatgctgcttgaatgctgatctgtatctaaaaatgcatatatagaattatttatactgtgtctaagactgctgataatgtactttttgatgacactgaaaacaagccaaatattcacaatataaaaccatgtgataatatacgtgtaatgtaactaaatttctccaaggttactagaaaattatacatatatttgggagataaagactttgaaagcaaacacgtgcaaccatttgagattccacagtcagtttgacataacatcatttacgaggaagaccaagaagatttttaaaaagggatacaaacaagcacaaacgttaaaacatttttaattcttagaaactcatgaaaatttcctgaaaattggcagctacagaatgatgtggttaacttggatgtgcgctttacaaataaatagcatttaccaacagtaaatgcattttaatgaaaaattacttgcacttatgaattaaggtttcataaaagaaatgttatctatagctgatttccctgattatgggcaagtttcaaatttaagaagtatttaaagttttaagaaggagaagaaaaaataaaacttaccacctcttctactaagtcttcaacaataagaccttgttcatctgttcttagatttgtaacccacatccatccatcttctaattcgttatgaacaatgaacatatctccttttaagaaactgaaaatagtaattatgaagttatcaaaattaaatgaaattttgaaacatggaaatttacgtgatcatataccacatcacagagataatactataaaatgcaagggtttttttaaagtcaaataccctagatttttgttctgtttctgtcatcatttacatgtaaaactttgaagatacttgtaaacctgaatctgaatttcatcatgtgtaaaatgggtttaataatggtaattgtactatctatatcactggattattattagactcaaactggaatttatatggacagtaattatacatatattacagctttgggggtgtaactacaagaaaactgaactttaaaatttaagtttcaatgttattactctttcaaaagtaggttaaactaaaattataaacataaacatgaactcattccacatacacaggttactttataaaaagttgattttaaataagcatatttagccttatcacacagatgcttatgaaactaacatttctctcattaaaaaaaaaaatagggtttatttaatccacttagctatcacggtccaacaagtatagcactctttctccaaaagtagaaccaagtggtatgaaaatgcatgcatgttttttctgtcatcaatatccaagtggagggatacacacacacacacacacactatagtttactttca

SEQ ID NO: 48119 - DNA, 776 bp, Bovine  19866881071977
ataagagaaaaacataatgataggttaacctttcttatgaatgcacatgcaaatatcttaaagtgttgaccaattaaatcaaatgagtatttttttaaagtacattatgggtgaggatgatttatcccaggataatgtttgggcattataacattcccataagtattaggaacaagcaaataatacttattagctccacaagtaatcatcattgctctggagtttctagccaatgaaataagaaagaataacagttgtatgatttaggaagaatcaaatatttattatttgaaggttatttgaacagaaatccaataatatctgcaactaaacaactagaattaatgttacagttaagcagagtttctgactacaagagcaaggtaccaaaatcaatagaatatctgtatgccagctgctaatgaggttgaaacaacgctttaacatttccccgtgcaatgcataaatgtgtcactgatattttcctactgaatattgatatcctaaaattatattaataaagctgtgttgttgtttcgtgaataaattgatagaccaataaaacaaaacccagagataggaatagacacacatatgtaaaaacttggcatatgaaaggcatggaattacaattcagagcttgaaagaaaaagccatctcaataaaagatgctgggacaactattattcacatgggaagaaataaaaatctctgccttacactatttctgagaatataatgcagatgaattaaatttaaaaataaagagcaaaact

SEQ ID NO: 48120 - DNA, 1163 bp, Bovine  19866881265710
atgctgggaaagattgaaggcgggaggagaaggggatggcagaggatgagatggttggatggcatcaccaactccatggacgtgagtttgagtaagctctgggagttggtgatggatagggaagcctggcatgctgcaatccatagggtcacaaagagttggacacgactgagcgactaaactgaacggaatataatgaatcctgaaatttattttagagtgaaaccccacacggtggcactgtttactaagaaactgttacagtgcagaggcctcacagcggtcagcttgctttataagcagctgcctccttttgtctgtcaaactcgccctgtatttcacctgttaagaatgtatactagattcttaagtgtggaaatggtaagtgctttttattttataaattgttttatgtatacagagcctatgacagcatctttcacaaatactgaaaaaaattagaaaacattgttgaatttggtttgcagattcatacattgtgcatttgtttacagatgaaaagcaacagaagaaagtgaataataaatatggactatatatttgctagaatattccaccagtgtgtatttttaataaccataatagtggttggttgaataatgatgggagtgtttcaaaatgagaacccaaagcactcaagcatgaatacaatgggtttaaagctgcagatcacttaaaactgaaggagaagattgaagaaatgctgatctagaaccttcttcctcttttcctactgtcacaccctgtttgcttgcccaaaatctgtcattaaatattttctaacctgtttaaattgtttcattccttttgttttcggaactcttacccatgaaggtataaatacttttcataagtctgccctggggttagcttgcaaaaagcttccatatatcccactcagaggaatgtgactcattactgagagaatctgtcatcagtcaaaggaaaaaatagcaacagcatgcaagcggagacaacaaatcacagatctccagtctctgggctgggagcgtgggcagaattcttctccagtcacatctccttcctccccacggtggcctgtatttgttgccctgctcttttccaccgcctcaaacaggctctcattttcttccttctcagttataaagacgaccccaggg

SEQ ID NO: 48121 - DNA, 883 bp, Bovine  19866881303137
agccatgaaagacaaatttaatagatatttttctaagagacacttttatcttcaaacattcaccatttttatgtggtttttttttttccttcactctacttgctttcaattcaagaacataaggcatactgttcattggcttaaatacacttgtatttcataatttgtattctattcaatctcttttatctatttagtacatctcaatattaggcctttattttaactacaattgtacattataaactaaatccaacattttaccccatcatagtttcacttgaaaccagtaagaactcatttataatataaactctaagcaacatagagcaagattgaaaaaacatgccttaagatatttcaattattcaggcagacaccattgtaatgggacttgtgagcagtaatgttagagtccatcaaagtagaactctgctttaagtgaatttttaaaatagccatgaactatatttgtccttggacagagcacagtattataagaccagagagaaaagtgaattttaaaataaaatgtttgaggtgacaaagtgaaacgttctgtctcctcctcctctgcccttcatcaagtttgcagaatatttgtcttgtaatgatgataagaatatcattatcattactaccatgacaacactgtaataagcatattccatttatgaacattgactctcacaaccaaatcttctggtttatatagttatccctctattacagtgaaaaaccatagctttgactagacagccctttgttggcaaagtaatgtctctgctttttaatatgctgtctaggttggtcataactttccttccaaggagcaaatgtcttttaatttcatggctgtagtcaccatctgtagtgattttgg

SEQ ID NO: 48122 - DNA, 1347 bp, Bovine  19866881339709
tcatgtgagagcccttgataatgacatgagtgttctgggtagttaaatggaaatcatattcattaaatgtattttggctacccgtttgagtgagtggtcaggagaatgataccaagaccagcagtatgagaattcagattaccagtggcaagttgaaaatgaaagtacatataaatagagcacagttgaaaatagaggaggtgagctaattatattagaagaaaaaataatttctaaatatatgggtaagagtgtgtaggcagagatacctagagaggacctggggctagacctattgtgtgaccagcaatgtaaatttatttaaggagcaaatgagaggtgtgcaaaagcaagagcaaaccatggctgaacagaaatcctcctatcctaatcagctctggtagaagtcagggtgggtttaagtgctgaaaattttatgttaaggaaactggtggaggatatttaatagcaagtcaaaaatataaatgggatgaaaaacccgcatgagggaaggataaagaaataatgatgccatggatagcagaaggaaaggctgcaatgagatttacttacccccaaaaaatattgttaaaaaaaaatggagatgatacccaaatagctttacttttttactgtaaaatctcaggggaaagctctcttatacctgtcactggggccattttccatcagctttgtagggacaaaggaactgaatttggcatccttgatggtctatacttcgtaaataattcacagtatttaatttattttattgaacatgtactgaatactatcctgggcactgggaatctataaatgagtaagtcatacagtctttgaccttgaggagttaacagttctgtgtatgtatgttgggagtgattataagtaatttgatgtttctggactataaatttcactgtgaggaaatttaaataaaacataggcatgaaaagaacacatatttattagtactgaatatgaaggcgttaatatacatgcaaaatatacaagcagagagaaaatattatgttattatgctaaaagatagctcagcacctgaaaagtttgttttcccccgttaccttaggaacttactagcacagagtactcataaattttctattctgtgtgtgtttctgaggggctagggtagggtgtgttgacttacatattcaacactaaagaatgaagaagtaaactagaatgttcatctaaaaatctttaaatttttgaaagtgaagtaaagtgaaagtcactcagttgtgtccaactctttgaaaccccatggactatagcctgccaggctcctctgtccatggaattctctaggtcagaatactggag

SEQ ID NO: 48123 - DNA, 1381 bp, Bovine  19866881441129
ttcttggacagtctttaatgaaattttaaaaatctactgcaaaagcgagaaaaggaaagaaaaaagaaggaagtagggaaggaagataaataaaataacagaataatgcaacagaaatataaagaattctctcctggctttacggcataaggactgtactgaatttacagctaaggcttccctagaagtgaacacacagcaaagaagcaaaaaccttttatgtacaaacatctcttaaatttatgtctataaagtgaaaagtagaggtcccacacttggaaacataactatgaccaatcacagactcacagactgcctcacctacattaaaagcacttattgagcatattacagacttgaaattgccttaagaagtatctataagagtatcatttcaggatggtttatgatgaacaaattccagttagctgattggagttattttgcacaggaaaaatcatatagcaaagctgtagacattaaagggcttccctagtggctcaaatggtaaagaatctgcctgagatgtaggacacccaggttcaatccctgggtcgggaaaagcctctggagaaagaagtgtttacccactccagtattcttgcctggagaattccatggacagaggagtctggagggctacagtccatggggtcacaaagagttggatacaactgagccactaacactaactgtagacattaaaagtcaacagaatcatctataacaaaaatgctctgaaatgtcagatgttaaaataagacacacccttgtgatttatgacgcaggaaaaaagaatttaaatttaaggaataaaccttaacaaaagatacaacagcttgaatctcaactgaaagaatggcaatttttgtacagttccctgaagggcatttagttgatccatggcttttgatgtatggccttgaaatttgtttttagccatggaaccacttgttcaaataggaaaagaaaaagtaaagattagttctgatccctagagctgagctagtatctgataatcttccagttttagtccacatgcaactttacaagaaaatccctaatttaagtctcaccagagtagatgaagaaaaagggaaggatgaggagggggaaaaagaaagaaggtgccggcaaccttgtacatccctggggaaattttcacccaaaccccaatcccaatttgggaccttaagaaaaagactaagagaatcgtagagacttctaatgtttttgagccactgaaccagcagctacctacctccaaacttctgtacaaaagaaaaacaagtcctaatgtgtttaagtcactatgactaatcgtcatattagttatattagtcatatacctaactgatagaatagccaactacctgacatt

SEQ ID NO: 48124 - DNA, 1038 bp, Bovine  19866881505934
ctggggaaggaatagcaacaaatgccagccaagaaaactttggtgcataaaaatgaagtgtgttaagaccagagacttttctattattaatgaaatggagttccaggagagaatgcaaggagaccagaagtaatagcaaagtcatgaattaaatagtgacttaaaggcaagagttcctaggtccctggcacatgacacctccccctactaaagtttattcagtggggaatgatgaaatggtactattgcttcaaagaaatacattcaaaatgtagaaaaatgatttcaatatcaagataattatggtgaacaacatcaagatctattgcagttattttaacagcttgtactagtcacatgccttcctcggctcacacataaggacttttctgtgatgtacatctttcttacaccaaaatgaaaatcaaacccataaactttacgtagtttatcttgtctgaacttgctgcgctacagatgaattttgtaactgtgataacattataagtattaatactgaaagagaagtgtcagaacgtaggagcaggaccaatgcacagcccctgtgataactcttggaactactcccgtaacagtcactttgaaaagctcacaatgaaggtaaaacagttcttcctattcctccataacagaaagggaaaaggacttaacctttaatgaagttcattttcacagcctatcaagcttcacttaagtatttgggaaaaatgtcttattcatttataattcctcagtgcctatcatgacagctattatttaattacttctatttaattagaaggttattgaaaagaataaatgaaataagacatctattctttattagatattataaggacggactgtgaccaatggcaacaaggtacaacttattttattcccttggagcctacatttacaaatgaagtgaacactactcaatgtaccataagaatcaaggaaaataaaagttagattagcaaattatatcattttagttagttaagtcgctcagtcatgtccgactctttgcgaccc

SEQ ID NO: 48125 - DNA, 1677 bp, Bovine  19866881934831
atttatacttttagcagattagtccacccgctacacagcactatcctgagggaatagatggaatagtgtggatggcagaaggagtaaagaccaaaacatggaagatgtttggctaggatttcagatctatgagttaaacgcctcaggacggagcctttaataatagaggttccagcatgagggatttaagttcctggggaagactgagaaggaagagtatgagaaaataaaatgagatgaggactcaggaagagagataaggaatacagtttgcttacttttcacgctcagggtattatgagttaatccttgaaagaacgggtggctcccattcattttcctaccaacataacatgcataacatagtcattcagaatgccagcccctgtgagtctcattaggcttactctgaggagctaccctctctagagatgacatgtgttctgtttcagctctgtacttaaagtatcaaaatatacaagtaggtaaatatactgatcaataacagtaggtcagaagttccaaagtatttgggtttcttccatttagctcctgggcaaggtcacctgaccctttacctgagtttcccatggctaaagcaagtcaaatcagttctctcctactgtttcaggtgagtatacattggatacatttttaagaaccatgtaggagttcaatgttataacactaaacatatggaatcttcctaggtaaacttcaaaatattcccttattttggtttaaaaatgcgaaattcctcttcaattactcttgctctgtgccatgtccctacaatgttatcattgtaaatgttctgaaattaacagacgtacttcttgctgaagcacagatagctgataaaacagggttatggaccctaaaaagaacaaagccctatgcacaaaagacttttccttccaaaggctacaaaattcagcttgaaggatcagcaaacaccccgtacttcattcagcatacctgtatattatcggaatccattctggcaagccagctaaacggtgagacctgctctctggagattaattctgtttccttttatattcctgtattgaagtgtctctttataaggtactttcagaacttcaatgtccaatttacacacgatattaaaaacagtggactcacaggtctgagttgatctttttcctcattctcgtgcttattttcagaaaacacaaagaatgaccaatgactgcaaataaccatataatttccagttagagattctgtagcatttttgtgaaagacttttgctttccttgccgttaagctacttctgtaaggattgtctaaagaaagtagacttctcagaggaaatgatagataattaatctcccaggacaaaaagaatggagaacaattgagtgcctcttcccaattttagtcatacagactttaattttgaaatccaacactattggagctgcaaatataagaccttttaagagagaaacaaataatacactttgtggtatattgttccagttcacaatcattgtggataatctaaatcctttttatagatttcatagtacctaccataaggtaagatatatgacatatatttaatacttaggaaaacttagattcagacttcagttcaccctgaattttttcttaaaaaataaaactttatgtaaattctaataagactca

SEQ ID NO: 48126 - DNA, 2622 bp, Bovine  19866880404440
agacgcagaatgtatagaagtcttttggactttgtgggagaggtggggggtggggaacgatttgggagaatggcattaaaacatgtataatatcacaaaaaaatgaagaaccaccaccaccaaaaaaataaaaaccagagaaagtaatatcaagggtataaacaaacatttctatccctgggaaagtaatctctcaggaaatggtcttgagggagtgtctgaataatgaagtcactgagatctacaatcttaataaaactccccattctcctgttatccactagtcaggaaaaggcacagtctccttccttgtaactggaggggttttgagtaaaccaataatcggaaacatgctcttcatagcagaatgagatatgagataaatcagagattctgattcttaagaccagattgtgaggagagagttctgagctcaaagcagctatcttcaattcactatggtcattttctttcccaggacaattgtggacaagagacagtgtagtatggcctgtacggctctatactaaaggaaggtgagttcgtgattggccctggtgagtcatgcaacatggtggttaccagtgcaaactgtgagagtcagactgcccaagttcaccttctggcagctgctcagtagttttagggctgagttttgggtaagttacttaactcagctttctcatctgcaaaatgtggataatagtattgtcacatagctcttagtacacagcctcacatagtagccgcttaaataagtgctagcttgaaacaattatcattaactctaaagccactagagacaggagatcctggaaaaatatgggatctccttctttgtttgtcaacactgacccagaggtgggagctctgagaagtcacagtgtcttctgcctgtcaagggaaagtccccattgtcaaacagaagtaggagagacagggcacagaaaatggactgacgtaaagacctaaaagacatctcttatttttgaatgaactggaatatgaatatatgtctgcttcttgtagaagtgccagcggtcactctggaggcaaagtctagcctctttattgttctctggaagctcaagtcacttagctattaaggtagatccatagcaaatggtaaaaaccttccttccacacgaaatctcaaatgtcttggtggatttcattctcaagaatgggaggtgggtactgggagggtggtagttggtgtttctctcaaaatggttctcttttcgttcccccatggactgggttttctccaggggagaatggcagctgagaactcttcggtgacagaattcatccttgcaggcttaacagaccagccaggactccagatccccctcttcctcctgtttctaggtttctatgtggtcactgtagtggggaacctgggcttgataatgctgattgggttgaactcgcgcctgcacacccccatgtacttcttcctcttcaacctctccttaatagacttctgttactccactaccatcactcccaaaatgctgatgagttttgtctcaaggaagaacagcatcttgcatgcagagtgtttgactcaactgtttttcttctgcttcttcgtcatctctgagtccttcgtcctgtcagcgatggcatatgaccgctatgtggccatctgtaagccactggtatacacagtcaccatgtctcctaaggtctgtttactgcttttgttgggtgtgtatgtgatggggttttcaggggccatggcccacacaggaagcatagcaagtctgatcttctgtgctgacaacctcatcaatcatttcttgtgtgatatccctcctctgcttgagctggcttgcaacagctcttctgtgcacgaactggtggtcttcatagttgtgaccactgttattggaatggtcattgtcaccatctccatctcttacactctaatcctttccagcatttctccgcattcactccactgagggcagatccaaagctttcagtacatgcagctcccacataattgtggttttccttttttttggttctgcagcttttgtgtatctcaaaccaccttccgttttgcaccttgaccaagggaaagtgtcatccctgttttataccattgtggtgcccatgttaaatccactgatatatagtttgaggaacaaggatgtcaaagctgcagtgaggaaaaccttggggaaaattaatttcttgagaaaggagtagtatttgaaaaagtagataaaatgttttatttattagcttgtgtgtattttcaatgaaaggtgtaagtgtcattttttcccctctcttctacagaaagctttaagtctttgtgtctggatgtgcaactaacactttcacttcgggcttcccaggtggcactagtggtaaagaacacaactgccaatgcaggagacataagagatgcgttagatctcccggaggagggcatggcaacccacttcagtattcctttttaaaaaatgaatttatttatttcaattggaggctaattactttacaatattgtggtgggtttttgccatacattgacatgaatcagccacgggtgtccattgtgtccccccatcttgatcccccctccctcctccctccccatcccat

SEQ ID NO: 48127 - DNA, 1317 bp, Bovine  19866880549169
aaataggatgataggaagaaacatggaaacctgaactgacaccctctctcctacgctcgggctcctggctctgggtctgtgataggcatgggctatttggggcgggtgatgtctgacccatgggaagggttttccaggcctgtcaggggctcccccttagctgggatcaaagatattgagcctctgctggcttgaggatgaaacagaaggttctagacaatgacgcccagtagcatgatttctgtgtccttcacaggggaccggtgttgcttctaggggttgaggaacaggaagatgtgaataactttgctgccctgtgccatgtcaccttctccccgctacggcagtgcccacaggatgctaccccctgggttctagccaggctctgggctgtatattcaccttcttttgtcagcttctgcctttataagaacacattcccattcatccactgtgtcctatgggtaaagagattcataatctctttctggacttctcggatgttgaacgctacctggatatgtgtttcgtgttcgaattttctaagtggactttctctcccctcatttgcacctggagtgcatgcctggctcagctttcagcccctcccctgtctcattcattcattcactcaatactcactgagcagactctgtgcctcagatattctgcagggcgcttggttttcagaagagacgtggttcctgacccccgaggctctggtttcagttctactcggtccatccatgtatgcgctgtcacaaaactagcagagttaagggaaagctggcagtaacttgatgacttcctcaagagaaaaagaaaaaaaccaccagttctttagggagtcatctcctctgcaggccctgctccagctcatgggcctgttcctggctccactcactcagcccacggagcccagaagtgaggtaactgcagctggagccgcagaggggcccggcgtgctgatggggaggctgccactgcctgtccccacgggacagatgaccactcttcccttggcctgttgataaaaccccctcttgctttcctgatgtctagcgcctggagtttcagggccagggccaccagtgctatggtgacaaagccagagagcatgacaagcccagagccgctcagggccttttattaaacctgacatccaataacccaggcctctcgcctagtctcctggaacatttggaacaaattgcatggaggcctggaggaggggcagagatgagagctggcagccgcggtgcctctgggtctctaagagcggggctgtgaggacagcaaggcatctgtctcgatggg

SEQ ID NO: 48128 - DNA, 1983 bp, Bovine  19866880551670
aggatttccaggtccagcctcgggacacagtggctgcagtgggcgagcaggtgcttctgcagtgcgagccgccctggggccacccagagcccactgtctcatggtggaaggatgagaaacccctggccctgcagtcagggcggcactcggtgagtgtagccccttcccaaacctcatcctgtccgggccacagctgtgcacacccgaggtcctgacccattccccccgccccagccccatgtctcctgcagtatttgaggaaggggcggccgtgaggccttaggccttcctccgcacgtgggagacttctcaagacacctggtcctgacaggtgtcccagggctccctgctgatggcaagagcagagaagagtgacgcggggacctacatgtgtatggccaccaacagcgcaggacaacggaagagccgggtggctagggtgtccatccagggtaaggggaaggcggtcagctaacgccagggccaaggtggggggcaccagtcagcatggtgccctctggtttgggctggggttaggcgatgtgggggttcgacccaggatcagggtcagagtggtggggacctcatctagaggcagttcctccatccgagggcttccctcatagctcagttggtaaagaatctccctgcagttcaggagacccaggtttgatccctgggtcgggaagatctcctggagaagggaatggcaacccactccagtgttcttgcctggagaaacccatggacagaggagcccggtgggctacagtccatggagtcgcaagagtcagacacgactgagctgctaaatcatcatcatcctccatctgaggatagacattggagagctcacgacgggggcagtctgggagttctggctcctctgtggctgagggatgctccactcttcaatttcttccctccgacctttgagcccatccccaccctgtgtgctcccagagccccgggactacaaggagcccctggagcttctggctgtgcacattcagctggaaaacgtgaccctgttgaacccagaccccaagaagggcaccaagcctgggccagctgtatggctcagctggaaggtgaggcccgggacctaggggtgaaacagtcacagctccagaaagggctgctcacaagagccctgagtcctccctgccctccgtcttccaggtgagtggccccgctgcacctgctcagtcctacacggccctgttcaggacccaggccgcccctgggggccagggagccccgtgggcagaggtcctgctggctggctggcagagcgcagagcttgggggcctccactggggccaggactacgagttcaaagtgagaccgtcctccggccgcgctcagggccccgacagcaacgtgctgctcctgaggctgcctgaacaaggtcaggaatggatgcttccagaacccagtggtataccccccagcccctttctatccctctgtagtcaggaggaagaggaatagtggcttccactcctgggccccctcttgtcctggctctgaaagcagagctgagagaagctcttgttcttgtcagtatggctgggaccttatgtccccagtcctgctcttttccctagaaagagattcccgaggattccttcagcattcctgacagtttgtctccctgccctccagtgcccagtgctcctccccaggaggtgaccctaaaacctggcaacggcactatccttgtgagctggatcccaccacctgctgaaaaccacaatggcatcatccgtggctaccaggtaccccccacaagctgacgcacccctccatggtgttgccaagacttccctcttccctggctctgggcactaagaaatggcacctgcagagcagggactctcctgtttgccagacactgccaagcgcttacccacatgacctcatctcatctcacagtctctcctgggttgttatccccagtctacagacgggaaagtagac

SEQ ID NO: 48129 - DNA, 787 bp, Bovine  19866880567798
acctgcattttaatgagtgcttcctgatagttcccctgaagtttgaacaccagtgacctcagagctactgcaggagaagataaacacagagaggaccagcaatggtgagtgcaaatgatggaatgacaacagggattgaatttgtcaggcaaaccacctcaacaaatgccaaagagagggcgttcaaatagtagtgagtaacaaagaagcaacatttcatccacgtgagagaaagcttagctcccggtccagcccacaacagcagttagggaggtctggacagcactgggagaactgccaagctggtcctgttgcaaagtgaaacttgccccgtctccagctacagggctggggaatcccacaggtgcagtgttaccacacagtgcggctgtgtgtgtagactgaaggcagtgagtctctaccccagtggtgctaatggctagtgtttaatagtcaggtctccaggaaaaataaaacctggtcttgtagcatttgccaatttccatggtgtaaatgctcccaccatggctaattttgagccatttaacatgagatgtcattgcatgcggacttagggaaacagacacctaatggctcatgtaagctaatatgacagaggagcctgatgtgctgcagttcatggggtctctaagagttggacacgactgagctacttcactttcacttttcactttcatgcattggagaaggaaatggcaacacacaccagtgttcttgcctggagaatcccagggatgggggagcttggtgggctgccgtctatggg

SEQ ID NO: 48130 - DNA, 3775 bp, Bovine  19866880592057
gtgagctttaagccaactttttcactctccactttcactttcatcaagaggcttttgagttcctcttcactttctgccataagggtggtgtcatctgcatatctgaggtgattgcttttctcccggcaatcttgattccagcttgtgtttcttccagtccagcgtttctcatgatgtactctgcatagaagttaaataagcagggtgaccaatatacagccttgacgtactccttttcctatttggaaccagtctgttgttccatgtcctgattgtaggagttagtaattggcttaagaacaaatttgtttaaaggcaacagactaaatgttccataaaagtggagtggagatttgacccaggggtatgtttgtaactttaggagaagggtggtaagggtttggacccaaaaggcctgcagggctgactcccaaagtggcaaacattattcctggaagcccaattgcctttgaagggatgccaacagatggacttgtagcaggcactgtgtgcctggcacccgccctagcaggttcactgggagatgctgatgttgcacatgttgtaggaaacatgggagatgaagggctgaatatctagaggggttggatgttatacagtatttcccacccaagggccagctattttctggttgtccctccagaagactgtagaggcaacattgtggactgggatggggctgaggaaaacagcaagaaacaggagggaagggggcagagcacaacctttgacagaatgacattgcacaagggcataacgtaaactgattaaaatcaattgggtccaagatgacaagtcaaattcaagtaaaccttaatccccaatttgtaagccaaaagacacacccagaggtggcaggacagctctaaggcaatgtcaaaaggggagtgggtggttccccaatgattgggatgatcctccccaccatagcatatgaattcaccccatagcaaaacctagccaggccacattccttggcccaagcccttgccctcggctatggcccacaccctgaagagtgtgctgctctgtgaatcctaacaaatccacctcttatggctttgtcgctcactgaatttttgcaatgagacatcagagcctgagctacattaggtcctgaagccgggcatcctgggttttggccgggctcaagtcccagaagagagctaaaggataggaggaaaaagcactgggaaaagtgtgccaagggatccccttcatagcctgccggaaaatctgctaaatacctgacccgtgctcacagttttcattggcctgatccttgccacagagaagagtaaggacagaagaacccccaacggcttgggtaacagctactggggctcagcagatagtgcctttgggacatgccaaagagtagcctctccagagtccctcatttgcactcactgcggcctgttcgtggggcgggtaaaatgttggtttgaatgagtttacattgatcaacagtatctcagtaaaagtggatttttgaaagattgattgattgattgatttttggctgtgctgggttttccttgtcgtgcgccctttctctagtagcaagcaggggctactctccagtttacggtacacaggcttctctgtggtggcttctattgttggaaccatgggctctaggacatgagggatcagtagttgtggttcctggacttagttgttctgaggcatgtgggatcttcccagacccgggattgaacccgtgccctctgaattgggaggtggattctcaaccactagacagaccaccaggcaagccccaaagtgggttttctttgagcctcttttttgtgtgagagtcaagacaatatgacattccataagtgtagatgtgaacacaattttatttattgatggtcattaatggcctataaccagggcataacctcccaggtaaacatttaactttggagcattagtagaagatgattcactaacttttaacattattttccccttatatcaatatcctattacatttgtagctttgaagtccatacacacagacacaggtacaaataaattcacatatatgtgatcgtttacataaaggcttcctagtgcaaaaaggggttgttagttttacatctcaaattagtttctgctaccccagcaactaaagcaaatttctttgtggaaaaaaagtttctaagcatggtctactaattgtcttaatggattttcagtgaggggtgaagtaccctgctatgtgccctgtgggcattccataaacatgggtttgactgactctgttaacaatccacagagaaaaaccccaaaatgtgtactatttcaattatctaatttattccctcacagtctctgtctttagtgcaagatttctataaacatttaagatgaccaagggagctgctgcagagtcagggaactgcccactgaagctttctgggctaagagttttagttagtctaaagtggtcattattacctgggatttacacatccccaagccttggactgcaaggagatcaaaccaatcaatcctaaaggaaatcaactctgaatattcattggaaagactgatgctgaagctgaagctccaatactttggccacaggatgatgagagctgactcattagaaaagaccctgatgctgggaaagactgagggcaaatggagaaggggacgacagaggatgagatggctaggtggcatcactgacccaacggacacgagcttgagcaagctcggggagatagtgaaggacagggaagcctggagtgctgcagttcatgaggtcacagagtcagacgactgaacgattgaacaacagtgcttcaagctgatgagctaagtgaaggtaatgtcccacctgcgtttgagaacatgagaatggtatagcaacttcctgttttctttcttttttaaatcaatttttattggagtatgatgttgtgttcgtttctactgtacagcaagatcaatcagtcatacatgtacatacatcccctctctgttggatttccttcccattcaggtcaccacagagcattaagtagagttccctgtgctggacagtaggttctcattagttatctattttatacatagtaccagtagtatatatgtgtcaatcccaatgtcacaacttcctgtttcctgtgtaggtatagatctgctcccactctggccctgaggtgggtactattatattctcagtatctgttgcacatacaactgagataaaaacagtgcatgaaacagaatcttcaccttctcttgtcccaaaacattcattgagctctcctgtaagacactgagaatatattttaacacacatatgaatattcttgggcttccctggtggctgagtggtaaagaatccacctgtcaatgtaggagatgtggggttcgatctctgggtcaggatgatcccttagaggaggtaaggcaacccacgccagtattcttgcctgggaaatcccatggacagaggagcctggtgggctacagtccttgagatctcaaagagtcagacacaacttagtgactgaacaacaacaacaatgtatattcttgctatgagcatgtttgctaaagttacaatttgctaaagttactgtatgatttaggttttgtaacatctgagggaaggtcatgatcacttgggagacaccaccctggtgtccattagatggaaaactggaatttagtaagaagactccagagtggactttagagttaaaataaagcgggcatttttattaataat

SEQ ID NO: 48131 - DNA, 1563 bp, Bovine  19866880626684
tgcttggggagtgaggtcccctggactgggtgtgggagtgagaaagagggcagaggcaggatggaagatgcttctcagatgccggcacctggtggcagattctgagatgggaatattggagagaagcatgttgggggtgggcttcgcaggtggctcagtggtaaagaatccacctgccaatgcatgagatgcaagttcaatcctgggttgggaagatcctctggagaaggaaatggcaactatgccagtattcttgcctgggaaatcctgtggctagaggagcctggtggactacagtccatggggtcacaaagagtcagacatgacttagagactaaacaaaaagaagaacacaatgttgggggaggcgaggcggcctggagaatcatttcacccttgaactcaatctctgtgattctcgagtcactgagttcctgagaccctaccttgtcctagctgtccatccaccagcagtgtatctggctagacttctagcttcctggtgatgttcctcctgccagacacacggtcagcgcagccacgtgggtgtgaatcccaagagagaactggggctgcagatggctctgggcaaccgtctgagcacagagtttcccaggaagcagaggctaatgtctggagcactaggggtggggaggaggcccgatgagtggaactgacagcagaaatccacattccccactgggtcagcctgttctcgagaaagggcaggtcttggtgttttacttcccatcttggttccgatcgctttggctcactctctgctgctggagaggactcagggctacgagcctggcgctgggcatcccaggagacaatgtgctgtgctctccaggactaatagatccaggcacaccgtgtacagacggcagtgctgacgggcaggaagcggaccccaaggaggagaactcgaggccaagtggacatccctgggagatgccagtgggcttggggtgtctttggcgtgcatctacccctttgctgccagtgatagtcccctcctccaagccctgctccaggcccatctgcagagtcagggaccagagtgaaaaatggatgagatagctaatggcagcccttgttgtttggcgtcggaagcattatgaactggtatgtgaaatatggccacactcctggttttcattgtagctggaaaggattaggagacaattaataaatcatttagtgccctgagtttaagtaacttattattatgagctagctgcatatatttattatgcttcactgagcaacattggcaaatttccttcaaatgtcacacaatttgtatgtaatttgtttcagaagaggctttttatttttaaagaaacacatatataaattattaacccgaattcttcagaacacattgcccgaattccaagctctcccaaccaccccttatgagtgtcataaagattttcctgtctcccaaacgatgacagcaccatgtcccttggcctgccgtctgagagactggggagaggatgaagagtcccttgctgtcccctctggtcagtcatctggggcagagatctaaaggga

SEQ ID NO: 48132 - DNA, 3760 bp, Bovine  19866880680331
ttgtgtggagtttgagcattctttggcattgcctttctttgggactggggtgaaaattgaccttttctagtcttgtggccactgctgagttttccaaatttgctggcatattgagtgcagcactttcacaggatcatcttttaggatctgaaatagctcaactggaaatccatctcctccactagctttgtttgtagtgatgcttcctaaggcccacttgacttcacattccaggatgtctggctctaagtgaatgatcacaccattgtggttatctgcatcattaagatcttttttctataattgttctgtgtattcttgccacctcttcttaatatcttttccttctgttaggtccataccatttctgtcctttatcgtgcccatctttgcatgaaatgttcccttggtatctctaattttcttgaagagatctctagtctttcccattctattgttttcctctatttctttgcattgatcaccgaggaaggctttcttatctctccttgttgttctttggaactctgaatttagatgggtctttagatctttccttttctcctttgcctttagcttctcagaaaaatagggaccctttaatccttatttttaaagagtatgttctttgaactgaaggctccataaagaacgaaaatagcttttttaaccaccgactctgatgcgggagggattgggggtgggaggagaaggggatgacagaggatgagatggctggatggcatcactgactcaatggatgtgagtttgagtgaactccgggagttggacagagaggcctggcgtgctgcaattcatggggttgcaaagagtcggacatgactgagcgactgaactgaactgaaccttatctcgatgtatgggacatagtggatacttcacaaattctcttttttgaatgattgaaaaatgggtgaaagaatttcaacatgaagtaaggggtaaaggaaagtgcatatttctgtggtcaggcatgatctaatttgcagtgggagatttgttgagagcttcccaggtggctcgtgtgtaacaaacctgcctgccaatacaggagactcaggttccatctctgggttgggaagatcccctggaggaggaaatggcaacccactctagtattcttgcctgggaaatcccatggacataggatcctggcgggctatagtccatggagtcgcaaagagttggacacgactgagagactcagcatacacacacacacacacatatgattctggtggaggcccaggtatgtcttcagcaagaatgtagtaggtgggccttaaatagggaggcgactcctccactctctgagattcagcttcagggcttccattctcaggagccgagacattgggatctgtgttccgtggaaatccttgctgagatccccctccccaccccttcatgggaggagcatggaagacagaacatgacagggcctgagagcctgagaaggaacttagcctacaaccagtttatctagtttcgtgtttctcttgctgttttatggtttccttcctttagctcagtcgagcatttcagctttgtcttagctacacaaaaagacatcaaaggaagaatgacacaccccagggctcgaggtccacaggccagctgggtggcagcatccttcagtaagagagcttaagaggaaattggctgtcagggaatcagagcctgactttgtggctttgatgtccttttttaaaaaaaaaaaaaactttttggccacaccccctccacctgtgggatcttagttcattgaccaggagtcaaaaacacaccatctgcattgaaaggcaaagttttaaccatgggaatgtgaaggaagtctgctgtccttttttaatttggaggttttctttacagtgataagcttagagggttttcttttcattttaaaaagtgggatttttctttcatttggtggtctgatgcagttgatccctattcccttgaataattttctatgctaatgatttctgcctaccaggccaaaccaatggctggttgggtagatgaagatcagtctgccactgccatttataggaaagcaaggatctacctggtggctttagcttgtggctcaaacggtaaagaattagcctgtaatacaggagacccgggtttgattgttgggttgggaagatcccctgaagaaggaaatggcaacccattccagtattcttgcctggagaattccaggacagagcaggctggcgggctagagtccatggggttgcaaagagtcggacatgacttagcgactaacactttcactttttaagggccttccgcagtcacttttgttgaaccaatacagatctgccatctggctggagatggtgttatcaataagcatctactgaattttcacacggacttgtgcgaggacagttagtgttggtatggaaaggtttcttatctagacttcacaaggaaggggacacagacaaatctgtcctcacagactgccatcctattggatggcatatgtgacccagacataggagaacagatactagaattcagccattgtagggtctagatggcaggccttctacgagaaaaagcttcctcgagggcttccctggtggctcagtggtaaagagatcgcctgccaatgcaggagacactggttccatccctggtctgagaagatcccacgtgccgtggagcaactaagcctgtgcgccacaactattgagcctgtgctgtagagccggcgaactgcaaaatactgagcccatgagctgcaactgccgaagcccatgcaccctagagccgtgctctgcaacaagagaagccgcctcagtgagaagcgcacctcaagtagagagcagccctctctcgcctcaactagagaaaaagacctgtgcagcaacaaagacccagcacagccaaaaataaataaaatttttacattattaaaaagaaaaaacacttcttcaagcgcaccacccaatatgaaaggcatgtcacacacccctcagattagaccatgacacaggaatttgatcgtttggtcaaatgcctttccctatgtaaaaatgacagaagttctacccagagtaaccctgactctaactttggtgatgtttctttggtttgacttttttcttttttactctttttggtcagactgaagcactggaaagtaaaggattattaacaacaagcttttgttattctgcagtttgagtggagtgtttgcattcaacgaggcaagaactgatcgttatttgggttgatatacttttgttatttttgctttgcctgccgtgggatcctgtgtcggagtggtatgagggtggggagtgctggaacatgagctgttttggggttgggttgttagtggaaatgttcctactgcttagcggagaaggcatgttaggtaaaaccactctgtccctttgagtcttaaggtgtttaaatagcgtttccagaggtgttcagtattcacacatgcctggaagaccgagtcaacaatctgtacagtagacacaatcctgtaacagatgttcctcataagtgagactagaaagtttggttcttttaaaaaaaaattattttattatagttgattgacaattttgtattagcttccagtgtacagcaaactgattcagttatatgtatacatatatacatacatgtatatacacacgtacatatatatatacacgtatgtgcttagtagtcgtgttcgacacaatctttttcaacttttttccaa

SEQ ID NO: 48133 - DNA, 3625 bp, Bovine  19866880701876
aaaacgctatgagtgacctctgtttaaaactgtaaattgtacgtacatattacttctgctccctcatgaaacctcactagaatgacaataaagggacccccccataatcctgtaaggacaaggaaaataggagaggagacaagagcgacagtgtgttgaaacctgggaagcagttgtgtaatagagggtaccagcctgcagagaggatgtggtgttgaggtaggggccacaagctgcttttcaccacgcacagaagcagaaaggctcaggaatgggagataaccagatacgtctgaaagtggggatgcacgtggagctggaaacaggaatactgagaaaacagacccgcaggtcctttctgaaacatgatgccctcagctaaccacccttatggtttattctttggaaatgttaaatcagacagattctgcacttgggtccattgagggcagggggccatactgagaatgggggacagggggcagtgacctgtgtaagtactggatgttgacacccacagttgagttccaagaggattggcagacaagcttgatgccaactgcctgctgctccctctgcataagttagggactgactgattcttcttgggaaaactgaccagtccagaatatcagattgcagctgttatcagctgatatttgaggttttcctaatgaaatggcccaaagaggtccctttaaattgactgcttcaacccgaggcagtcagataaaagcgagtgagcaaatatatgaccagatattcgaagaatgcctgaaacatgaaagtcaatgaccaaaataaaatggcaggggcaggcaaggagagaatgtaatgactcagttcctccccctccacccagttggtagagccccagccactttaccttgtgaggccagagggatttcgtcttggactggccagactcatcctgttcgtggtgaaccagggagtcccaacaagaactgtccacgtaggcagcctgccggatgctgaagttactgggacaaaagcagctgataggagaccctgaaacaggaacaaagcttgaggcagccctgggtaggggtgggggaacagggagctgggggacaatcagttaagagctttccaagggtcacttccagaactctgaccatctctgtatctgtcaggcactgtcttcttcccaggccctagctttctgggtgaatgaagaagtagggggaagctgacacatctccctgggaaagttagtgagctcactacgtaaccagaaaagagagtcagaaatcccaaatcagggactcccctggtggccctgtggctaagattctatgctcccaatacagggggcccaggttcaatccctggtcagggaattagatctcacatgctgcaactaagacctggcacagccaaataaataaataaatattaagaaaaacaaatcccgattctgagaaagctcacgttgtctttaatagaggtggcagatttgctgagttaatctagcacctggaccactcagtatatgtatttgttagtgtttctgctcagggctggggttcttgaagatgagtggattcattgatgctgtgatgacacagcatttattgagcacccgtgttgctgtcaggctctgtcaggcacttaacatgtgttcttaagtcaacaatccaggaggtagggagtaagaaaaggccccaagaagataagagatttatctaaagcttggctaactaaaacctttagaggtcctggaaagatgatacaactctagtatcttccgtccacatgaaaatcaaaacaaactaattattgcaatgatttcaagcatactggaattaaggctattttttattgcaaaattttggaagtgactttcaaagtttttctgcgtctcagctttgctggcatcctaaacagatgcataatctcccttttgggtgatgcccggcccaagtcatgcgatctggacagggtgggggctgtcttgcttcagggcctactggggcttggaagccacttaccggaggagaactcctgggcaaaggctagtgacaccagcagcagggggaagcccacggctacgaacttgaccattcggtccaggggaagctccagacgcagtcctttgaggcgggggccctttgcggtcgggcagcaaggcatctgagagcatgtactctgcagctgtgtgtgcgagcgacatgctgcttgggcccagggctggcagacgggggtcctggagagtggggtcccggagagtggagtcccagtaggtggcagcttcagggagcaggctttcagcagatggttcctgcagcctgggcctcacgagtatctgtgtgaggagcgggcactggttctctaaataactggctaggccctgagccaggcacctggtaattagagggaggcatcgcccagtgggtcgttactggaggagggtcgggtgtcggctggggctggtgccaggccgccctctggactgttgaaggcagacgcagtcctatggctttaagctgccctgtcattaatctagtatttttggtgaggtgggggagaggaggagggctgtcaagcaggccccctgtgtaattggtgtggaatctgggtggagattgcttaaatgtgtggaaggccctcattttgtggtttggggtgggaatggagcccccaggactccgctagggttgcggctccaacatagtacttgtcccagtgatgatttctgcttcgggcccaggctccttcccagaaactgatctgtttttggcgttaggtcccctgctctgcttctggtctgtttctaaaatgtttcaaccacatatttacaatttccttatgtttacatttttttttttaaagctcccattagttctctagaaagctgagggaagagtgggagtgttgacgtgcagcgagaacatgacctgtgaaatctggagggaaagtcttcactggacacacagcagcactgtttttttttttaaatttttattgagtgactgcaggaatcacctttggctcagtattctcatctatcaaaaggtactatattggttgcgaaaaattgtaaagattgatgaagagtattgtataggaagatggattgtaaactgtaaagtgtagtgcaaatgtcaacgtttcatttatttatttaaaatttatttagctgtgctgggtcttcgttgttgtgtgtggggttttctctagttctggtgaggataggcgactttagttgtggtgcttgggcttctccttgctgtggcttctcttgttgcggagaacaggctctaggggcatgggcttcagtagttgccctgtggcatgtgggatcttcctggaccagggatcaaacccatgtcccctgcatgggcaggcagattcttaactactggatcaccagggaagtccaactcttactttgatttggtggggctggatgggtagttggaaaagcaaacactggggcctatggtaattgttgaggcagtctgaacgcgggttggaaaaagaatttccagacacagaacatttcagaagggagtgaggttattaagaacaaagaccaaagataaagtgggcactgtgagcacagcgggcagacctccgacagactggggaaagctaacagttt

SEQ ID NO: 48134 - DNA, 754 bp, Bovine  19866880771598
gacaaataggccaccaagtctgtgtaggagacccattagtgatactgccctgttaagtatagcctgaggggctgtcaccatttggagcttctggggagaaaaaaatgtcaactttgttagttttgattctctttcctgcctatcatttttatttaaaacacttgaaaaaaaaaatcttaattttgttaattattttcttctagggggttttggtctgttttcttcagataaagtgggatgtaagtgaaaaacattttttttccttcccttattaagttttgatgaattcactgagataatttggatagatacttgttattaataaaatacttcgatataggctggagcttaaaaataggaatgatctcgttaaagtgaattcttactcagccttgttagtgactgtctagaatagaatccacagtttcaagggctctttctcttttcatataatttagcttgcaaaatgggcgaattgcaaggaaaaacctttggttgagacactttgaccttctctctctcactgaccttattttttgcatcttaattgatttgaatttaccttagaaagagtcagacttgtcacataaactcataaaggtttatttagaatcttcagtgggttgtcaaaaaaaacacaataaggagagttatttgagggaaattgacactgagaatggaagaggggagataaagagtggagggaaaagattagaaagggctgtgatggagagaggcagcctcttattccaat

SEQ ID NO: 48135 - DNA, 3245 bp, Bovine  19866880793273
ggctccgtttagttgtggtgcttggagttctcattgtggtggcttctgttatttcggagcacaggctcttggcatgcgggtttcaacagctgtggcacgtgggctcagtagttggggctcccaggctctagagcacaggctcagtagttggggctcccgggctctagagcacaggctcagtagttgtagcacactggattagatgttcctcagcatgtgggatcctctaggaccagggatcaaacccaactgatccaccagggaagcccccaagagatgagtcttaaaagtgaaaaaaatacactttccatcaagtggcagaactgtggtgacggacatacggaaaagaatataggtttagagcataagctgaggtcggacagtcccagcatcaaagttgagatttatcacttaccagtgatctgattttagaaaagtaacaacttctctgacttaaggctaaacttctcacttgtaacatgaggcttcaatcagacaaatatgtaaaatgcgtagtatagtgtctactagaatgcatcagtgagtggaagttcttggcatcctgcaaagctctgtgagagtcgaagcctgcttcacctctgacacttcaagtggcttctggttgatcttcacctctgatcaagaaactattgggttggccaaaaagttcgtttgggttttttttttttttccatttgggttttccataacatcttatggccaaacttcttggccaacccactgtgcatgcagcgtatcagaaaactcactgatctgccagtaagtcggcataccccatcatagaactttctatttggggagaaactctgtgggatagatgtcaataggtgagcaagatcctttcctttttttggtagggaaattattggtaggttagattggatctcccagagatagatgctgagataaggattagagtgcaagcagttatctggggaagtcaccagcagggaaatggaggtgtttgaaagaaaggaaggagtgtggacaactggggtttaatcccataagggagccctgggagacagtgtaggacacactttggagcttctcccccaggaagagcaaggaagtttatttatttaccaacttctcatcatcagttaagatctgctttcaggagcattaactgttgcagcagagccgtgtagcacaaccctcgaggtctacgccacagctttcccagtggagcttgcaaaagactctgcatggcatacaactgcaactaacgccgctagcaccaaggaatctactggtcacagggccaggcagcaaggccacttaaactgctctcagaacctgctgaaggtctgctcttgctctggcccccctcataatgtgtggtcttcaaagttacctaatacatggattggagcagtattcccaaatgtggtacgtgttgtctccaagatcggaagaagcctaccgttactgcaccgccacgtggtataaggagcaggatgcaggaacttgtcctcaagcttggagtggacctcttagggatgcccaagacaactgaaccttaaaaactttactgacatggcaggcctgccaatcatttcagggcttatgtcctccctgctggtattcaagtgatccaattaacacgctgctttcaaaataggggaacttgggacttccctgctggcccagtggttaagaacccacctgccaatgcaggggacacaggttgaatccctagtctgggaactaggatcccacatgccatggggcaactaagcctgcaagccaaaactactgaagcctgtgcaccctagagcacgtgctctgcaacaagagaagccactgcaaccagaagcccagtcaccacagtccctgctcacggcagctacagaaagccctcatgcagcagcaaagattcagtgcagtcaaaaataaacaattaaaaaaatatatataggggaatctggtgatgttttgtgtctatgtaccaagacaatcaaggtctttggagtaataatttggaggtgctgtgggaaaacacccttaggattctcagaagcccttgatgagagagcatttatcttaaatcattcaggagtcttcacagatgtccttccagccatacccttgatttgatatgtggccttggactccttcaatgctgaaaaatatttaccagctgggagaactgggaataagagtcagttctatcagccaaaccagccagtcctggcgcttctgtgtctcctccagattctgcttacaaattgcacgatgccttctctcgctcatccctctcttgctgcaagttaccagactcggttagaagaaaccaaatggcactttcaacattctgtctggaaatctccttatcatgtattttaaagtttactaggtacattttctatcttccaagttgccacatgcaacatttctccaattactccgtcacacttgacacgtgttgtccttctccagcctctaataacttttctcgctgctttctcagcctccagcaactgtttgttcaccatccctccaggctttgctaacagcctctttggtgtttttccagcttctaaccaccaactgggccaagggcagaattccaagaacactagagtggaagatacaagcctcttgagggtaggctggaacacttctgctacattttattgcaagggagccatggggccattccagattcaaggagtagaggaaacagactcatctagtaaggaaggagtcataaaatattgtgacaatgttttttggtatacagcagacatcattacactaacatgtggatacatctttgggatacattcccagaagtgaacttgctgagtcaagggcaagtatgcatttgtgaaatactgcctaggcacccttcatagacgttataccaattttgaatttcaccagcaaactagaaggggatggcagatgaagtttcctcacatttcacaagacaatgtattatccaacttattttcccctgccattataacaggggaaaatgacatctttggacttccctggaggtagtacagtggataggaatctgcctgccagtgcaggggacatgggttcaatccctggtccaagaagattccacatgccgccaagcaactaggcccatgggtgtcaactattgaagcccgagagcctggaacctgtgctctgcaacaagagaagtcactgcaatgagaagcctgtaaccataacaaagagtagccccctcttgctgcaacggagcg

SEQ ID NO: 48136 - DNA, 1912 bp, Bovine  19866880798789
accagcacaaagtaccagagcacgtggatgttccagaaataccccagcccccagagtgaggtgaaaaggccgctgagcagcattccggctgtgaggtagtaccggagggggagccgctccccaaagatgccgctgcagagagagttggattcgtggttaatctcggctacctcgcacccctgccctccgcctcctggctcccccagggccccaccagggacctctgtgttgccactaggcccctctgctttgtttgacgacacgcctcgcaacatgcccggcaaagtggcctctgtaacatccccgtgaccttcttcttcccccttggctgaccagtccatctcatgcattctctcttgcatcacgtttatggttttacctgtcatgtatgtacatgtacacagcccagctgtgtgtctacagccctgaactttctcccaggatcatatccacattgcttctggacatcctgactgcgttgcctcccaaatagctgctaatcaacaactccaaagactggactcctctgcccccctcccagaccctgccccatgtctgcgcccctcagtggactcgatggcatccccacatttggccactcaagccggaagcgagctacctcagtctcctgtccctgcggcccaccctccacaagcgacctccaagacctgcctgctgctcctcttatttctctccagcgcgtcatttctctccatctctattattaataataccattctaactcaagctttcctccaagcccaggtggagctactatcaaatctgttccttagtgtgacctgctagtcagccctgaagtgaactgtcagtcactccgtcatgtccaactctttgtgaccccatggactatagcccagttgggctcctttgcccatgggcaagaatactggagtgggttgccattcacttctccagggcatcttccgcattgcaggcagattctttaccatctgagttaccagaaaagccaatcagcccttctctccctcaagtccacctccgtcagcctctcagtatctgtctgacatgtggatctgaacatgacacccactgagccacccactcagtggctctcctgtgcccacagcctagtacacaatgacctcgttcttcagccccgtcttctgcattttacatgttggtaaacctgttaggagtcccccactccaccccctgccctctgtgcagtcatgctgcttcaaattacacctgccttatttcaccaagccatgactccattgtgcgagtgtgctcagtcatgtctaactttctgccaccctgtggactgtagccctccaggctcctctgtccaaggaattttttagacaagaatatgggagagggttgccatttcctcttcgagaaaatcgccccacccagggatcaaacctgagtctcctgtgtctctcgccttgcaggtggattctttacccactgagccactgggaaagactcttgtctctattcagttcagttcagtcgctcagtcgtgtccgactctttgtgaccccatggactacaggatgccaggcctccctgtccatcaccaactcccggagtttgctccaactcctgtccattgagttggtgatgccatgcaaccatttcatcctctgtcgtccccttctcctcccgccttcaatccttcccagcatcagggtcttttcaaatgagtcaagtccaatttctcttcatcagttcaagtgtcatcttctccaagaagcctttcctgacccctcttttctaatcccagctcagactaagcgactccttggagctccatacgtagccacctctgtctcagagccaccacactgtttataacatagctgctgaagcatcggtcactccagtaggctgtgagctctctagaggtagtacccagcctcag

SEQ ID NO: 48137 - DNA, 3986 bp, Bovine  19866880841384
ccgtgctgggctttcgctttcgggtttccgtgaaggatccctgtccggacagaccatattccagcccaccgttgacatgccatctgagtgaataaactcaaaagaagatccaggaaggtctttgcaggaaagttactaaaagagggagtcagccaggtgaaggagcaggctgggtgatggtggcaacacgccagctacgggtgacgggatgtgtggaaggcttgtctcatttccaacaactttgtctctgaccccatggccccaggttggtgtagagaagacagcagcctgaaccaccctacaggccaacatgggctctgcctcttacctgataaacatgccgatggcataggccacgaggaaggcgttgtccacggcccccagtaactccttgtagttgctcttatctgaaggcagacaggggagacagaaagctggctatctggatgccccctgcaagaagcccttcccgggcctggatggggagcaggcatggggaggagtggctcgccccgctcttaccaaagggggcccagttgcaccacgtggtgtcgttgagactgtgggtgctgttgacgggttggattacctctgagcagttgtggtgcagacggctctggagaggcaacgggtgtgcaggtcaggggttagctggtggctccagagtcaacccagcccgcaagggagccagtaacctcccccaccacagcaggccactgcccgtccccactggactccctgcgtcttcctctgacacccggtctggcaaggggccacggcagagcctcggtgaagggcaaggggtgtctatgagcagcacccaggggacccaaggtgcctgctctctggttccacccccagttccccgacaccactctcttggtgaagaaacccaggaaactctcctgggaaaaagaactgctgaaagtgggagtcagccaagggggaagagacagacttggtgaccaagacaagggacaaggacggtgctccactgagctccgggctgtgctactgaagtatttccgtatttctgctgagcccagcagtcctgcattcttccttacccccgggccagactcaccttgacgacactgatgggcttccgggacatgtgatagcaggtgtagattaagaaggtgatgagcaggatgaaggctcggtacctgcaggggaaggtgggcatctgggttagcagagagtccaggcctaccgtctccactgtgtccaggaagcagtccacctgtgctcgttctggcagcaccaccaacgctcccctccagacacaagcttggggcagaggccaaggggaggggagggacaggtgcccagaggccagagtgctcagagttcctgctcccgagggcagaggcctcccaacagagctgggccaacagcggcgtcctagacggcaccaaagtgccctctgtggctcttgtcactgcccatcgcctctacttctccctgtcctccctaagatcagggtgcctctgtgtgcgtgtgtgtgagagagatgggggcgcagggagacaggactgtgtttaaataccagaaacggtggaagccaggaggagaaggatgcatgccaagtgtctctttgtttaaaaaactttttgctttttattggggcagagctgatgaacaaggtggtgatagttccaggtgaacagcaaggggctcagccatacatacacgtgtatccattctcccccacactcccctcctgtccagcctgcgacataacactgagcagagttctctgtctatacagtaggtccttgctggttatccattttattttacttttaaaaatttttattatttttaacaccagaaacattttgtattggggtagagtcgattaacaatgttgaggtagtttccagtgaacagcgaagggactaagacatacatatacatcacccatttaaaatacatcagtgtttgttgattacatgttgagtacatgttgattccaaacttccagaaagggtctatctttaaagagaggtcaactactcctcacaagcctagttggttgctcagttgtgtctgactctttgccaccccatggactgtagccctccaggctcctctgtctgtgagattctccaggtatgaatactgaaatgggtagccattcccttctccaggggatcttccccacccagggaccaaactcaggtctcctgcgttgcaggcagattctttaccgtctgagccaccagagaagcctagaacgctgcagaaatggtgcctgctacagtccagtaggagcagagtccaaaacatagagggaaatgtggcagcagaggaaaagccagttgacaggacccaggtcctctgcctggctctattctagtccattcctccagacagaagggtcactctttccattgtggctcacgcatcacacagccctctcccaccctcgcttctcatcccatgcactgatctgaggtggaaaacacaggtcagccaggaaccactgaagtttccactgaccgccccactccccacttctcctgaggatctgggggagggccaccgtgtcctcctgagtcactgcttccccagcagagcatcagctgagccgactcagcatccaggagccaggaagtacatggaaaaagagagttcagcgtggactccagcccaggagaaaggccagagccttgtcttcttaaagatcccctggagaagatggggaaggaggggagggggcccggaaactccattctatccctgggctccttgaatcaaagagccaggacactggaggctcggtctgccctctctagcgatctgcctccaaaccccaaatcacttccccacaagcatgttatgaaggctcaagtttgtgaaatgaagggtgttacatcagaggctgaactcaggttgggctgccaggacccttctcacttcgcccctggacttctggtctatctccatctctccactgcctcgtagttcatcttctgaagagaatgaaggtacatgtaccctgccgtcaccaggctgaacatttctcagtggctctccattccattaagtatgaagctctgtacaaaataaaaagcttaaagcttgggggaagaatgaagctccaactctttagcctggctttctggctcctctactgtgtggtctgtctggctcctacttccagacacggggtgcacaggggcagggagtcacaagggattctccagggaatctggggttattcccagggactgccacagtgacccacatagacaagcttggtggtagcaatgttttccaactggtaaatggctcatgactcctggatcggggactttcagaatctggcagcgggtggggggagggggtggaaggatttggagactgtgcccaactgggcttcttcagaaagcaaaggatggaagaaaaccacagccctgcagattaacactcaccagtgtcctatctggaaaaaagcttcaagttttgtagatgtgcgtgcgtgtgtgtgtgtgcgtgtgtgtgtgcgtgcgcatgcttgcgcactcagtcatgtctgactctgcaactccatgactcctctgtccatggaattttccaggcaagaatactggagtgggttgccatttcctgctctaggtgatcttcccaatccagggatccaacctgtgtcccctgtattggcaggtggattctttaccactgagccacctgggaagcctctaattaattgtgcaaccaaatgcaagttctttaattttttgcctctagtttcctcatcagatgtacagggagaacagcatcaaccacatataagtcaaacacaggcgaatacaatgtaactctcaccctggtccccaggtctctgctgtgctacccttaagacctccacccctgggctcagccaagtctcttttcgctgctacatggatgcagtgaccctggtgacaaatcagatctccttggcttcccagatggtgccatggtaaagaatctgcctg

SEQ ID NO: 48138 - DNA, 1763 bp, Bovine  19866880849262
gctctgagtggtgggcgggtaggggcattctgatgctcatcgggactcatccccccagttgggctggggagggcccctcctgggagacacagcccaggctgcatttccctccctggatgattccaggaagctggagcccaccctgtgtggccagctgagggctctctggggtgatttcagggggaagcggggagagaacagccctggctactggcttccatgagcccaccctcgggcctgcactctcatctctcagggctgggctgggcctgaggctacctgggggcttctgagcgcagcccggccagagtgtctcctacctgtacacagcgcgcttgtcagcctccagctgggcctgggggtcaatgggggcggtgggcacgggcgtgctggcagcagctgagggcgtggagatgtggacagcctgggccttagagggggcttgagcggtcgccgtcatctgcagagacaagggagaggaggtgtgggttagtgggccaggactgctggttccccgactggaatcgtgaggtctacatcgtcccgtgttgtgtgtgtggataagagaaaaggtacagagaaatgcgagtgtataatgagcacccatatgtacatgtgttacaagtgggcagagagcaggcgtttcttcaaagcagaaagttctggagaacagtttaggaccatccaaagccaagtgatgctgaagtgagctcactttaaaagccatagttcttaatgcaaattaaggtggtggcctctgcccagaagctgggggaaaaaaaaaacccgaatgatgagccctttaaattttgcttacgagtcacttgggctgtgccgagcagtgctgcgtttgattctgtgactttggagggcaggaaaaaattagctgagtcagttctcagttgggcaaagatttattccatttaacgtaagccagaggtaactgttttaatggttttgatggataactgagtgttctgcaaattttggtttacctgggcacttgaagataagcgggttttagtggacaatgagcagatttctgttctcaagtctaacaaatatttggagtagtcattttcctcctctgttacatgccttggaaggtgtcccaagtttacatcaatcagagcaccttttaaaaatatattggactttctgtataagatttcatttgacaaaatgattaaatggctttaaaatttttggcaacaaccatcattacagaacttaatgcttttatattttattttctttgattaaatgggatccctgaaacatcatatgtggtgataagcctcaactgttgccttcctccagcctgtccacagcacctcacagctctcatcccctctgctcttgggacttgacatccttgtctgcctctcgagataacaccttgttcactccttcatccccagcacgcggatggcacagagtgaatgcttggtatctcttgagaagacgaatgagggactaacgagtgaacacaccttgagagaattatgttttccagctggaaagttcgtcttatgatctaggaccctgcttcctagaagaaagagtatggtatttccacaaatacgtgactggtggtgccagtggcccccaaacgcttgctgtctcagtttcttcattagatctgtcagatgccacatcttcagagtgaaatagagtccctctgcccttgctctcccccttgctctgcctcatttcacagcccttatcggaccatgtatttcacaaccctggactagacacta

SEQ ID NO: 48139 - DNA, 1564 bp, Bovine  19866880889801
caggaccataaagtgcccctaaaagcctctgctcagaagtgacctacatcacttctgcccaagcctcattggttaaagctactcagatgaccacatctgacgtcaatgacccaggttaagtacagtcctctctcggtgaaaggaagtaaagaactgcatacagtaacaccatctactgcagtctccttggtggggtccacagcttatttttgcatccgggacctgacataatgtttggcaccaagtaggcattcagtgcattttcaccaacttgaactgaattatcaaatatacaaatctgagaacagaaagagaaaaaaggggaagggctgaggtacaaactcatggtatgtgaaatagcactgggcttggaatcaaaagactaaactccaaaagccaaggaacctttctgggctcatctttaactgaaggagatgaactagaggatctctagggtcccttccagttctaacctttaaaagagtttgtaatgtgttccttagtatctgcttgtcaatctgccaacttctattagtcaagtgtctaggcctaaaactggaaaaaaataaaaataagcccctaaatcagttcacgtgccaaaactgaaaattcacccatgtctgtaaaagaaaacaaaactatacttcaaaagggaatatgttttcaacaaaaatattgtggcaacagtgtttttctttaataaactattttctgttttgagcacattgttctaagccacaagatttccagctacaggaaagctagtgtggcattgcagaggggtgattacacatctgaatggatcaacacggggttcaggttcacacgtggaaattgtcacatcaattaaaactgtctcacacatagcagaaattctttgtttgttgaacaaatacatacccgtctaggttggatttgttaggctttgaagctatcattcccaatccaatttatccttatttctgtatatgtgtacgtggtcttttttttaaagcttttagaaaaaaaaaatataaaaagggttgagaaatcctgtagctaatgggctgatctactaagagaattatttaacagaggctgagtcctgagccctgtgttcgcctcagcagaaggtgaatgctgtgatgaccctgtttgattagagaaatgtgtatccttaagtttccatccataaatcacaggtgccaacccaggtatccatcactgtcagatcataaaaacaacatgtacatggcatttactatataccaggactgttccagattctttacatatatgaactctcatattgatcagagccactctaggaaataggtcttgttatcatttccatgttactgatggggaatcaaggtacagaaagtttaaataacccatctgaggtcacacattaagaagcagggctgggttttaaaactgagcaatcaggttccagtctgaactaaagtcagctcttctttattctgcctgagcacgtggcatgctgtcaagtgagctggttccattcctggatacaggtatagcctgaagccatcagcatacaatctctctcgtcttaaagacc

SEQ ID NO: 48140 - DNA, 923 bp, Bovine  19866880905985
gcacctttaacagcaacctgctttggcgtcaggtctccttgtgggcgctgacaaattgcagacacttccttccctcgccagcagggctctctcgcggtcacttcacccagccccctccagagctagaaagcgttggaggccgggccaatccctccccaggaccacatggactaggctcttcgctgcccatcatcagtactaaggtaaccaacatgaattgactatctcaccgggcgctgcacaggacgcgagggtcaccaaggtcatcctgtccgcccaccgacggcggcagtagtgggatggggattggggtgagggccgaaagccaggggaaaggagtcgcggttgcttcgctaggcgacggtttccagcgtctccctggggaagttcctcttctcgtctaacctgcagctttactgttgcagagccttgtcgagctccgggtccaacctagactgcttagcggatgggcgcccagacgcccccgcgagttgggagcatttttcctagggcttccaagtcaggcgggcgccttccaccacccaccattcgcgtctcagcaggcacccttatggctcctaggtcttctgcacccacttccatccctcacttcccactgcccctccaggagcttctcggtagccccttccccagaccaagctgagtgcccgtcccccaggcccgctcacttacggtgcagcagtccatgtttgatgtcaggagtccttggctgggacggaggctggcgcagggggtctgcgcggtgacaggtggggaccctggggcggtggcgaggcagccgatccgcgccgaactagcagctcagctctcgggtcctctctcccgcgctccgctctgctggagaaagtatcctgagccctgcggaagagaagccaatcaggagaaaccctcggcagagtggg

SEQ ID NO: 48141 - DNA, 703 bp, Bovine  19866880916170
tgcacctacaataaaagataagcagaaaactcggaagactcacaagagtagcagaagccgggactattgaaagtttcatgtgcctgttcagggaaggggtcggctgtgggtgtgcggagtgcatgggaacaggatgcggtaatgaagtaataaactagaatcaggtgtttgacttgttggagtcagggctctgccagagttctcaagtttctttggagaaccaaaggcatttccaaggattctgcggcaataaggaaaatgactaacgcttactgacacatcttctaggtacttgccccttaactttcctcatttaatcttcattaactcagcaaggtagttagttattagcgctcatttgcagacgaggaaacagaattacaggaattatgtaattcgcacatggctaaccacaagtaatgtaccctggaagagctaacattctattaacactgccactctgggaaggggaacagttcggggaaagatttcgcgagttaggagaggctaaaggtggagaaggcccgagcgccggcatacttacaaacaccgtggctttggccgctctgcgcagccgcaggtacttgagccggtacttttcgttttgactcttcttcgggagctttttcatcctggctttgctggactgcagcgggtctcgcggcgaggaggccaggctgcccagcaggctcatggtccggcc

SEQ ID NO: 48142 - DNA, 1598 bp, Bovine  19866880927737
acccctggttgggaagctaagatcccgcatgctgcggggcaactaagcccattcgttgcaactactgagcccacgagccacagctagagctgagagctggaaggaaagatcccacatgacgcaacaaagacctgacagtcaaataaataaatactaaaaaaaaaaaaaaaatgaagctcattcgccaccccgcccccaacctcgaactcaatttccaatcctcttctttggccattagaggctatgaaggtgctctaacaggaaaatctcttaaaaattgtcagatcccctttgctgtcttctctcccccatctcctacaaccaggtgagtcgaggggtgggagaggagaagggagccaggattcctccagtgctgagttgtaatgtatgttcttttgtaaacaagaacaatcatttgtgaacaggcccagatgcaaacagtccccaaatcaggaattccagctcagaggcgcagaataatacagctttggggaagatttaataatagtaaaattaaaattgtaactgaagcataatgaagaatgtggtacaaacaggcactccaaagagggggcaaaaaaaaacccagcacagattagcccctacggaatagtgattggttgagagcaacagtaaacaatgcacagaaatgcaacttaattatctcgcaattcttaacattctaccaaagccacgcagaaagctttgatgttggcagcagcggaggcagcggcagcagctcctctctctccctggatcctggaagaagatcattactaagaaatctgtacccacctcagcagctgggtgggggaagagcagtggggtccatctgctgagagacccggagtggccaatgacccgggaagaaagcatctctccaggggctactgagtcaggggactggtggacaaaaagggattgagcacaagaatcaatacactaggaggggaggcccggctgaccattaacccctagggctaggtgaataggcccccttggggattcccggatctgtcagcccaggactggactgaatgaaatctggcctgcccctctgtgcctaccccaaatacagacacagtgggtgttatctggccaagaatgtctctgttgttcctggttttgcacctgagatgcccagttagggtgggaggcaatgaggatgaggcccagaagaaggaagacacttgattctgagtcaaatgtttcttttaagaattcttctgatggatgtccaaattgtagcggagggaagtccctgagcccctcaaggggatactggtgaaatctgaggggtcttattctggattcgctacttcctgctgtgggttggaggctgggcagggaggagacaatttcaatactgctacatcatttgggagcctgagctttagaggtgaggggatagagctgagcagaagttctccgtatgccacacccctcattcctggcagggcaacttttagaagcaaagaaaatctgcctcaaccccctggcccacaccccaccttcactgccccctaacccactatctgggtaagctctactaaatcacactgcaaaggagtgcagtgccccctgaaggcaggagaaca

SEQ ID NO: 48143 - DNA, 1411 bp, Bovine  19866880959620
agaatactggagtgggttgccgtttcctcctccagggcatcttcctgacccagggattgaaccctggtctcctgcattgcaggtggattctttactgactgagccaccacggaagatcttcagcaagctagttcagccttatttatcatttacatggcagtgtcaggcttccaagtgtgtcaggagagaacaaactccagagccgatctgctcttgcagtcgtgtttgctgatggcccatcagccacagcaaacctgaggccagtccagcgagacctcaggatggaggctagggagcaatgtggggtcatcttgcgtctaccccaactccctctcacagtttggactgttttcaggggagtccaatgtaaactttaacagggacctgtacaattgtacattccctctgctcattgacgactggcgccagaccttccacgatggctcccaggggcagacagagcgcctcttcccgttcggatttgtccaggtaggtgctgaaaggaagagggtttgtgggctttggtgggggagatgctgctgagacctcttccctggaatccatgttctgttttttttgccctcatagcctgcctgctgttcatctcagctcactgacaggacaattaaatcttaaaaaaattaataagtaaccagtatttgggcttcccaggtggctcagtggtaaagaatccgcctgcaatgcgggagatgttggttcaatccctgggtcgggaagatcccctggagaaggaaatggcaacccactctagtattcttgcctgggaaatcccatggacagaggaaccctggtgggcaacagtccatggggtcgcaagagtcagacaccactgaagcaagttagcacgcacacagccaagttcttaagtgcttcacctcgcctgttcacacgacccctccaggaccaagatgtcccagcggggcagtagttctgacttttctggaatataggaattaaacaagtaaggtgtgacataaacaagatccgcctcacaacatagacacgaaacaggcgttagtatttggctggacacccctgtctgtaggcgtccgcctctggtagcccacagatacttccctctcaccaacccccgcttgcctcccccaccccgttcctcttctctgtcctagttcatagggctttttttggataaaagatttttatagacctgctttccacttacaattactttacaatcatttcctttctcctttcttaacatttgttttgactttgaacgagaatattctgctcattattttcaaaatagcaacgcctgtcaccacttctgtgttactcttggtagaaactgcattttggtccttgaaggtgcttcttttgcctctcagcctgtgtacatggtgattggaatgtgacgtcaatcaactta

SEQ ID NO: 48144 - DNA, 1519 bp, Bovine  19866880966902
ctggcgaaaccaacctcacaaacttgcccactgccacctgcagtggtgagttctggaagacacccccacccagccccacaacctcttattctactaagttggtcagaaagttcatttggatttttccctgagatgtggtggggaaatctgaacaaactttttggccaacccaagagtacagcctggaaataccaaaaagtgaccatctccatgctctcccctggcccacactacctgggtctctcaggggtctgctcacggaaagactcagatttcttcatctaatccagcaagacgtggtagtatccaccatgtgccatgcctgatctgagggtggggttgctggaggaggtgccccagtggccccagacccctggtgctccctgggcttctatcccaagtgatgggctgggagtcatccactggcggagcaggcttagcaccgcccacccctcacatggacccagaggagtttacctgggggagttggccacagtcagtgactgatggatgggtcaattatttaaatggaggtggttgaaggagccaaggacccgaggccaagctcaccttctgggagactttgacgacagctcctttgaagctcggtttccccatctgtagagccagtacacctgcctcctgtgactgtcatgaaaaataaatgccatgactagtggaactaaatggcctttgaaaatgcgtggcatccagaaggttaaggtcaaatgcagtatcactaaggccaggcattccagccgcctcgcctcacctccaggccatcagagagaccatgtggcggagagcctgaaactttccgggggttggggcttgggatcaggcagtgccctttgccatcccacgtgtggtcctgtgtcaggaggggggaggtgaggaggccgaccacaggagccatcattagaacaagagtcgtgcagccggcactgccgagatgcacataattagaaattagaaaaaggtcagatcgcgtcattatcagctcaatcagctgccgagtgccacagccagttaatttggcatctgtattttttacaaccccgcacacgtagcccagcggactgtaactctttatccggacagatatactgcgcagcggagcagggacataaaatgagaccccaagcaaatgagctgagataattgagagatttattttttatatatatgtgtgtcagggcggctttcctttgcccttgaatgttgactttcacagatgggcttgtcacgaggatactgggatccccccaaactgtcccaccctggatcctggagcggggctcagatcctgcctgctccccagccccaccaggcatcccatcccccaggacacgggtcctccccgctcctgctggtccctctcctcccatccaagcaaatcgctgtgtccacctccctggctcctgcgatctcctgacaggttcccatgggaaccatggctgacaaagccctcccagagatgttcagagaccagagaggttcccagagtgtaggtttctaa

SEQ ID NO: 48145 - DNA, 2123 bp, Bovine  19866880983315
tgtgcacacgtggcacgcagtgagggtccatggagctctcagtctgtttgtctctctgtctcgcacttaacagcaccaccatcatcatcaccattgtctctgctacccccactgcccaagggaaacagaggcgtaagggcctcccctgcctcggccaggccttggatcaggggtgcgcgggttaggagcggggaggcccggcgggtactcacccgtgaggagcaggagaggcagggcccagtggaccccgaggaggcgcgctcctccagcgcccatggctgctcgcggggctctgacctggtccgcagcacttggccctactgctctgagctcacagcggcgggggaaggaggggcggggcgggctggtggtggttgtttgtgaccgagactctgccccaggagggaagcagctttgaggaaaccgatgcttcctgcccggccttcagggccttggagaactgggaggagaccagaggagagagactctatgaccttgacccgttagtcataacctctgactctaacctcaaaccctagtctgggatttcttagaggtaatcctaactgtaactccaggagtttcgttcctttaattccaagcctctagtgaaccattcaatcccaatcccaattcctttgtttccagatgacacccctcacccctaccccactgctagagtggattagaaatccagggctgagatctcagggcacaggcattctgaggctaaaggtagagaaaagcgacaaggaagataacttcatggggggcagtgtctcatgtccatttcccagggagaggtggggtggtaatccagaagataaggaagataagagactctgggacagtctgggagatgcctatagttcacgtagtcagcccagagacagacataaacttctgggagaccttgagcaagtacttaacccttgaaagtcagtttccttatttgtaaagagggaataataataataacaacaataatagttcctactttgagagatggagtaagagaagagatgaagcataaaatcaaccaaaacagtgcctgatgcttcgtattgatattgacattgacattgaagtcgctcagtcgtgtccaactgtttgcaatcccatggactgtagcctaccaggctcctccatccatggaattttccaggcaagagtactggagttggttgccatttccctctccaggagctcttcccgacccagggatcgaacccaggtctcctgcattataggcagacactttaccgtctgaaccaccaggaagtccacttgcttcgtaagtgatcagtaaagcttagccagtactgtgatttatttatttttatgcacaccccatcactgaaactatttgagcatccttggctgggatatttttcaggccctggaaagatagctggagtaaatgacctttaagatttttttccagccctaggacttcccaggtggtccagtggttaggaatccaccttccaatgcagggggtgagggttcaatccctggttaaggaactaaggtcccacatgagtgtggcaaaaaaataaaataaaaataaatcgttttcccagtcctgaaatattgtgtttagagcagacagacctgtagcttctgagcctgcaatgtcagcgcacaccccgcttctccccaccccctccctagagatccgctgctctcccctttcagagcccagctcctgtttacaggtctcttccttccaaatctggaatctcagatatttcctggagctgttcccggaagaccaaggccaggctctgggggctcagcggaagaatgtccagcctttgttccccattgttcctggccagctcctttgtggggcccctaacccagctgactgcctcccttcctcccccgtcccagcctggcctccatgccagccccagtctcagccccagccccagccttcatagcctgaaagaggaaggcctccttcacgccttcttctcccctcaaatgcagaacaagtctgattaagacaatcagggcaagagaacactgtgttctctacaaactgggcatttccaaggggtaaagaacagacagagtgaaagtaacagagggtcagagctggaagaatagaaattggt

SEQ ID NO: 48146 - DNA, 1371 bp, Bovine  19866881053474
tgaccagctgtcctccgttgcctctgcatgtggagcaaggggaaacgggcttagaccgaaggcagggataagattagagacaaggaagaacttggcagtgagggatgttgtataacctactttacagacacttggggactgaggagactcccacattcctggtcccggcccagtggactggatgcggggatggtctggcaggctggcggggaatggaggaggaagggatcctgggggccctccgtccgtggcccgatcttcctcggtgtcctcaatttcccgttggaaaattcagtttcccagttttggagctggcaaggcagcacctcccccacccaccacgcactgcaccagtgttctgggctgggtaataatgcctgtcatttcctctcccgggggagtggggctgcaaccgccctgacagccccgagggattgaaggcaactaaaaatagtgcattaaatataatctgttgaggggcacgtttgcattgctcttctttccccctctggtctttttatcctgctgggcaggccaggcctgggtccagctcgggggccctgggaatcaggttttgagctccagctgctctcattttgttgcagaaggattctctcggcaagagatttcagggagcaaatccacaaagtacaaccggggatcttcaggggccacctctcctcacttcccagtgggccctctgggtccttcagggcccgaaggtacagggagagaagctggaagtgggggagacagtgttgagaaggagagccagctccggctttgttctcccatcagccacttccgtctgctgcacaatctctctgaggttaaatattaattaagagcagaatgacagtgagcgctgagcagtgtcactttctgtcccaacacaaatgctaatttccttcccggtatgaagtgactttggagtgggattggcagcgcaaggagaaagctggtgggggtggggtggggaggaggagaggggaggagagatgggtagcccagctttagagaactaagaggaatgatgcgagggagggggaagaagagggctgtcaggtgacaaaatgtggtcatgatgccagcagggccctgtgggactcctgggcacggatgcctttggtcccccatcccttgtaggcaagattctagcctccacgaccttctctgagttccaggagggaaaacagttgctgatcaaaggagaagcagcaatgaaatcacctgaggcagagtctcatccacagtaggagatggaccacttaggaccctgtgcacaccctaatctgtcagcaaccccgcccttttgaaactgcagaagaaagaagaatgcaaggttgttactgccttatccttccccattct

SEQ ID NO: 48147 - DNA, 2007 bp, Bovine  19866881062634
tgcttctctgccccgcccccattgtccaggatggatcacagcgactccccctggctggcggacacatggcgctccacctccggctctcgagacctcagcagcagcagcagcctcagcagtcggctgggagtggacccccgggacccgctagacggtcgccgctcttgtgagcatgccctcccccaggggtgggggtagggggcctagcagctgagcggggctgctggagaaagggggccatgggtgggctgcattcaccataatccctcctgtcattttttaccgcagtgatctcctgggatccccgaagccctggggtgcccctgcttcctgacaccagcactttctatggctccctcatcgcccgaggggccttccagccccccagcccggccaagcccccaggccccagctgccaggcggctcacaccccagctggcccagctctccagcccctggcccagttcagacagcctctgtggccgccggggcctctcttccccgcgcttgtctctggcccctgcagaggcctggaaggccagaaagaagcagggtaaggatggggggatgcacgcagcctgaatcagggtttatggggcacgggagcctcggtgctagtcgtgggctgccctccacccgcagtctgtcctaatgggcacctattaccgcgcacccagacaggagtatgctggcctcagttttcctttctttctttctttgggtctttgttgagccacgcaggatcttctttcattcatgcgtcatctttgttgctgtgcacggactctctctctctagctgtggagtgggagcttcagtagttgtggccagtaggcttggttgctacgaggcatgtgggatcctacctccccgaccagggatcaaacccatggcccctgcattgccaacagattcttaaccaccggaccaccagggaagccctaggcctcagattttctttacacggggctcttgcttgggttttgcacaccagcagtgagtcctgtttctgcagtcagctcaattcagcgaatactgaataagcatcactaggggtgggatagggcttaggggaacacagtgatactaaacagaatccttgctctctaccagctccaagtctaatgaaagtgcctgaccagcacacgggtaattctagaacctggagcagtgtgaccagtgctagcacgaaacctcaggcttgcatgacctctgtactatgtaatgtgtacatacgtgctatgcaccatgtacgggtcctgcccaggtaccgactctcagcttgcttcccagagaatgagcatttcctttctgtccaactttctcctgacttctagctatctgctttgactttccagagagaaataagtacagtctctatttcttcagcaactactctatgttaggtgcgttactcatatttgttatctcactgaatcctcacaacatattggcaaggtgttatttctctaattttacagataagaggatcagaatggggtagcttgttttaaaccctacgtcggtaagctgcagatctcaaatttgaaaccagaatcatctgcttccaaaagttactttgaatctctctgggagcacccttggggaaactgtcctctcactgactctgtttctccatttctgaaccctgacttcactctccaccatctccatgagcctcctgtactgattagtaagatttataaacattcagcagccagttttgttaagaggatataatccaacttttatcaagataaagatagatttagagtaattaagggcttggccaatatccagaattttatgactctaaatattagcaaagctggcatcctttccagctttgcctcagagctattgcattagaaatcctctgtgatcatgaaataccagctaaaaagaggttgcataaatctcatttttaaagtagctttttcatggataaccacactgatttgaatataatgtatgtcctacttgaaaacattaatgctagccccaaaa

SEQ ID NO: 48148 - DNA, 1008 bp, Bovine  19866881069315
ccctgcgtgggttggctcctgttgctaggagaacctgaccatttgcatttcctgctgtttttattttagattagcagccgcactgctgcagaaacacaggatattttaagaaagacagaaaaaggaagggcgagggaaggacctagcatgggatctccttcccaaaggcctgcaaaacacttggaccaaggtggctcccatcccagcccccaccctggcctcttgcctcctctccctgaacacctccatctcaccgtcctgacaccttgaccagaactttcaagctatacaagaacaagagggacttccctcatggtccagtggttaagaatctgccttgcaatgcaggggctgcaggtttgatccctagtcggggaactaagatgccatgtgccaaaacgaagaccagaggcagccaagtaagcaaacacaaaaaatatttttaaaaataaaataaagaacaacacagtctccttccagaataaaaagtcaggctttgtactcaacccaacatagagagcatagtttccctgtgttaaacagaaacacttctagattcccaaaggaattctccagccctgccaaaacatctgatctccaaagattatgttttctcttcctcctgccccttctttcccagttcaattcagttcagttcagtcgctcagtcgtgtccgattctgtgaccccatgaatcgcagcacaccaggcctccctgtccatcaccaactcccggagttcactcaaactcatgtccatcgagtcagtgatgccatccagccatctcatcctctgtcgtccccttctcctcctgcccccaatccctcccagcctcagagtcttttccaatgagtcatctctttgcatgaggtggccaaagtattggagcttcagcctctgcatcagtccttccaatgaacacccaggactgatctttaggatggactggttggatctccttgcagtccaagggactctcaagagtcttctccaacactacagttccag

SEQ ID NO: 48149 - DNA, 3025 bp, Bovine  19866881088652
tgttgttttccgttcttctcctggctcagctctactttcccctctagactctgaactggatacaaggggccaagggctctataaagccaagggtgggcagcccctatctcagctcctccccctccctcttctctcccctccctccctccctctctcatcagaagactttaataaatgcatctcagcatgtggtccttcctggggctttataagaatgaattgcttatcccggcctacagtacttcctagaaatgacaatctacaatcaacacacatttattaagcaccactgtgtgtggtacccagttctaggcctggcagggtcagcctgggagtgatccctgggcttcctgtctcctcccaagggccccgatgaccgttgctttctttggctttgccagatcccaagacaatccgccattgctaacaggactggggattttggtacccttacctgcctctcgacttctgtacaaggtcgtctctgccttgaagtgccctccatcccatccccctcatttacctggttagagctcaggctctccatgatcagtaggtctgtgacctcatctcagctagggtttatcctccttgagctcctggtgcacactgggcatctctctgagactactgttgttgtcgtttagtcgctcagtcatgtacgactctttcgaccccatggactgtagcctgccaggctcctctgttcatgggattttccaggcaagaatactggagtgggttgccatttccttctccaggggatcttcccgaaccaggcatccaacttacatctcctgctttacaggaagattctctaccactgagccacctggggaagtcttctgtgactattaatcacatcgtattttcattatgcttctactagggatgctggggctctttaagaggaaagctactgtatgcagcaccctaggactcgttcgttcttctcgttctacctcgccgcaggccaggtcctgctcaattcatccctcagagcagagaatgcctgttattagaatgccttcccctcccgttagcctctggttctcaggaagtgcttattttgttggaggaaccactggcaggctcgaagggaggctgtcatggcagcacgcctggctctctagtttccagggtgtttggtctgagagcatgtccctgtcccttttatattcaattctataagtattctctccctttcaccggcctcaggatatgggatctccagatggagctgagaatggcagagaagaatgcgcccattgatttattgcccctgtgtctttgccacgggcatttcctcttcctgaaaagtcctccctgctcagccaaagcctgcccttcctccccagtcccccaaccacctcttccagagccctgaggggaacgcaagcagtgtctcccttcccaagagcctggtgactctgaacagagtctgcctgcatcctgggtgtacctgtctgtccttttccatggagatatgtcagaacagggcacatagctgatgcagtaagccctcactccacgtggcatggcgcctggcacattctgaatttattgcacatgtttgccaaatgaacaggattactcctggtctgtctcagagagggggatgtctgggttctccctacatcctcttgctttgacttttctaccccacgattctaaaggagctggaggctcatttgtcaccaagttctggaaactggaggctccagccagcaaaagaaaaacaggtgttaaattctgtttggtgtactgagcagactggaattacttctctatggcaggactgtcaagtcccagacactgatacgctacacgcagagtctccaaaccagagtgagcaagatgggccattggaataagagaagaaaacagtacaactttgtttctgtgctgtgtgcgtgctaagttgcttcactcgtgtctgactctttgcgacaccatggtctgtagcccaccaagctcctctgtccatgggattctccaagcaagaatatggagtgggttgccatgccctcctccagggaaatcttcccagcccagggatcgaactagcagttcttatgtttcctgtgttggttctttaccactagcaacacctgggaagccctttgtttatatggatattttatctcatcctgtccagatttctatttttgaatatgctccgtaagacatttcatgtattggcagagcagtaggctttatatatactctcccacacatgcatcttcgtatatataggtactgaggtatgttaaacattctttactgatagagttgtaaacacgtctgaaagccttggacttgggcccctggctcactgtccaggacgtgagttcaatgcatacgtgccagtgtctccggacaaatgtcctgtcccctagcctggccccatatcatgcctaaagctttacagcctgaatctcgctggagggcagactccttggggatggtaatttggggaccctcttcagcggtgacacgtggcagtgactccacagggtctggagcatggcagatactcaataaattacatggggcttgaacactatttatttaaattgagacatctgagagtcttttaaagttttaaaatttgactttaatcctcaaatgtctgctctcagagagtatgcttgatatatttacttggggtctattatataacaacaaaaaataagtatataggctggcagaggatgagatgttaggtagcatctctgactcagtggacatgaatctgagcaaactccagaagacagtggaggacagggaagactggcagtgctgcagtccatagggttgcaaaaagtttgacgtgacatagcgactgaacagcaatgcctcctgggtaccaggttgtgagttaggtcctgggtgacaaatccgaggtctctgatctcaagttatttatattcctttttcaaaatgtttatttatttatttatttatttttcggtcataggtcctgtggaatcttaccatttcctcagcagatgctctagactgt

SEQ ID NO: 48150 - DNA, 1865 bp, Bovine  19866881105733
tcacacaccgtctcctacagttactgcccgagttctggtaactcctccctccccttgatcctttaagccttccatcagcatctgtgaggctctgccccatctcttactgttttttactttttcttgtgtatctgctgcatataccagcactgcatttccaccactctggagtccatgtcttaaagcagccatttgttctgacagatctccaggtcagctagaactggggtgacttaggatgggctcagctggacttctttacttcatgctttggaagctggggcagctgcttttctcactggaggtctgtgagatggaagcaactctgctccacaggcctctcaccctccttggatcggtagggtatgtttctctcatgacagtggcagagcctcaaaagagcaaacacaacacaggcttcctcttaaggcctaagcttgggactggcatggtctcacgttcacccacatactattggccaaaaagtcatccaagcccaaagaagtgagacagggaattacactctacaaataacaataccatgtaaggatatggataaaaataaggataaagaattgaagtcagttattcaatctgctggtcccatcttcgtcattataaatagccccttttattaaatccacctcaattacattatttgaatgtgccatatgttgccttccagactctagacaaaagtaagaatagatatcaaaaaaggaccgaagaaaaccatccctaaaaatgggattctaatattctatagctattctaatattctatttaataaatattaaatatttatattcatatatatttatatatgctatttaataaatattaaatattctatttaataaatattaaaaatatttatttctttgactgcactgggtcttagttgaggcaggcaggatctttgatcttcattggggcatgagggatttttttttaggttgaggcatataggatctagttctctgaccagggatcaaacctgggccttcagaattaggagtgcagaatcttagccactcactggaccaccagagaagtctctattactctcacatttaagaagcacacaactaacttttttaccaggagaaaatgggatactgataatccatggcatttagtggcatcacagtgactcaatttatcattggtgttgcaagggatgaagttcaggtggtgggcaatagaaataaagtgactgtgatacttagtcaccatggtgacaatagctattataaagattgtagagtcagatggctgcttctgatggctccaaagagagtaagaagggaaaaggacctgttgaaaacttttaatacccaactcagaaccaggtggaaaatcaggaagtctcagtgtttgctctaaagaaatacttctcctcctgtagcctctggattgatgtgggtgaggatcaagtctagaaaatgattttaatgtggcagagttgcaaacccaattaaatactcaaaccctttggtttaagtcccttacaataagtggagggtatgatgggaaaggcctccctggtggctcagtggtaaagaatttgcctgcagtacaggggacccaggttcaatctccaagtcagaaagatcccctggagaaggaaatggcaacccactccagtgttcttgcctagagaatcccatgcacagaggagcctcacgggctacagtccatggggtcacaaaagagttggacatgactgaagtgagtgagcatgcacacacagatgaggaagaaggaagattccaaggtatggaatggagacatttgtgcagacacagatgaaactgagacctgaatatgcaaatccttctaaccttcccaaataaaacctttca

SEQ ID NO: 48151 - DNA, 1040 bp, Bovine  19866881127208
ttggtgcattgacccccacacccagcctctccagtcaggtcctgccctcgccaaggctgcccaggacagatggggcccaccctcagccaatatctcccggccctggtggggtctcttcctctgctctgagccgaatgggtgctgtccctgtgatggttcctgcccagagtcaggctgggtctctagtgtgatggcccagccactcggtggctaagccatttggtttctctccttcctgcaaggttcagtcacacctggcacagaggcctgagattgggagggtggccgccttccagacctctggtcctccgccctcacctttctgaggctcagttgaaacccaagtttccaggaagtaggagaagaggaagtggacctgggattaagaagcactcccacccctggctgtctctaagtctgcagtgggatgctgctgaaattgctaccactgcctccccccaacccccagacctggtggggatcgccagtcaaccaatcctctaggcccctttggtaccccaccccacctaacctcatccttcactccccacttcagctccttgcattaatataacctaccctgctggcttggttgggttttgttggggcaggggataaggaagatattttttcccactcacttgaaatgcatgattttgtttttatttcgccaacttcaataaagatatattgtgtttgtatggaaagtgagagtccagtcgccttttcaaacttggaactcccagggagaagctgactctcgggatgatgcaaagaggatggtacccagactgtggacccagcagggcttctccacacagcctctgacttggctttctggctcaggatagctcttctagagtctttacaagggtcatgtgctgtcaggtggtgctggagaggcggggggaggtcctaactcactttaagcagcaaggggatgaaattggtgactttctgctggagctcgcagcttgggtgcctgtgcacttaatcttctgcttcctcttcaagtgcagggcctgaagaacctgactcct

SEQ ID NO: 48152 - DNA, 807 bp, Bovine  19866881170190
cctgggttcaatccctgggtgggaaagaccccccatagaggagagcttggcaatccactccagtatgcttgcctggagaatcccatggacagaagagcttggggggctacagtccatagggtcgcaaagagtcggacatgactgaagcaacttagcacacatacaaggagacacatgatcgtcagagcaacagaccttccttgatgcccccgatggcttcacactgaccccctacccaggcagaccaacccagcctttacccagcatcccctaccagtcacagagagggtcagctcacaggacgcactgcccatctggttggtggccacacagcggtaggtgcccgaggaagccagggagagattggtgagaatgagctggccagacacctcatctagagaataaggaagaaatgtccatcactcattcgactcacagtgagctacactatgacaaaactgtatctcacttcatccttaccacaatcccatcaggaaggaactaacctcgttctataagtgggcacactggctcagagaaggaaagtaattgtccaaggtgacccagagaaggaagtgcaaaaccactgcaacttctgtactctttccaccctacacagctgccttttcagggaaggggaaatggcacacatgaagggttcagacacccacagtgaaactggggtgggctggctactggctgatgtcaggttcttggttggtggaaagggtttgattggtagaaattgtattctctggagtgggctctaagctgaccccaaatgttcttctaagctgcttaccttcc

SEQ ID NO: 48153 - DNA, 608 bp, Bovine  19866881190941
aatctcgcctagggcccctacgcctccccacacctcgccaaagactcccaacaatccttggaaagctagtaacgctacaaattaacggctcctcccgcgttagggtccccgagcctggcccctgcgatcccggcttccctgatccacagctcgtgctccgctgtccccacggatccgcctgcaaaccctcactcgtcccggctccccaggccgggcaggacgcggccgcggctcccggactccagccacccggcccgagtctggggctgctccggcttccagccgctcgaaggcagctccaagctgttggcgccaaggaagcgccggcccgaagggcgcccgaagccgggagaaagaaagcgaacctggagccggcccgccgatctcagcctcccccgcggagcgcccagcccggagctcccggcaccggggctccaccggcccgcgcgcgagtccctactcgggtccccggcgcacccagagcgcagctccccgcccgcccgctacggtgtcttaggcccgcgggggtccgagtccgcagccccgctcctcgcactcgtggacaatgcacgccccgccaagggcccgagcggggcgaggcggccggg

SEQ ID NO: 48154 - DNA, 647 bp, Bovine  19866881242883
gggggtgtcatggggtaggggtgcctctactcccctcaccactctgacccccgcagcgtccccgccggagctggagcctgggctcgaggcgggcccggggctggcggagcggctggcgagggtgctgcgggagccagccttcctcgcgggcagcggcgccgcctgcggggcgctgctcctcgggctctgcgccgccctctaccggcgccggaggcagcgcaaggagctcagtcactacaccggtgagaacccagcccggggatgcccgggcggctgggagactcgatggaggggtgggcggagccttgagatctcgctcccctagaagggaggcgcggagaatggaaatctcgagagttcagtcgctcagtcgtgtccgactctttgcgaccccatggactgcagcacgccaggcttccccgtccatcaccaactccccagagcttgctcaaactcatgtccatcgaggcggtgatgccatccaatcatctcatcctctaacctccccttctcttcctgccttcagtctttccccgcatcagggtcttttcagatgagtcagttcttcgcatcaggcggccaaagtattggagtttcagcttcaccatcaatccttccaagaacattcaggacgatttcctttagga

SEQ ID NO: 48155 - DNA, 814 bp, Bovine  19866881267420
actctccaaagccctcactaggtgtatttatgtcaccccagcttgatctgtggtcagaaactctggctgctgacagtataatcgcacttatatattatacattgataataatataataataatgaacacacttgccctttttatgtagtacagaagcagccagattctccaactcagaggctggaggtcaggctgccataaactctcagagggaagcccagttcagatccaggaaggggagggaagatccactagcccctggatccctggaggggagggttttctctctttcccagggctcccagtgagctgctgtagcttgcagagtcagagggaagaatcaggctgcatgtaaatacttaaccccatcagagaggtgtcactgagccgtaaatagtgctgcaggcaacggccatgcatcactgattcacacttgtcacacccctcattttctgaaatctagttccctgcccatctctctctctcggtacaggagatccattgccatgagctattttggagtctacttaaatactgtgatttctacactaatattcttttgaggctttaaaatacacattgtaattttaaataaagatattttactttgactatttttgtaatttgcagaagttttaaaatgattatctaaatgtaactgttctgggacttccctggcagtccagtggttaagaatccgcctgccagtgcggggacacagatttgatccctagtccagaaactaggatcccacatgccacacagcaagtaagcccattcgccataactactgagcccaagctctagagcctga

SEQ ID NO: 48156 - DNA, 1586 bp, Bovine  19866881326004
gtgtattctccttcccctggtggctagacagtccagagtccacctgcaatgcaggagacctcggttcaatctgtgggttgggaagaaaccctggaggagagcatggcaacccactcctgtattcttggaaatatccctggacagaggaatatgcctggaaatatgcctggaaaatcccatggacagaagagcctggagggctacagtctgcagggctgcaaatagtcagacacgactgagtgactaagcatttcttcccctttcccctccaagttccgtgtgagccgggcctcaggctccctctgggagggacatctgcagctggagcccttggccctttcccgctcagggggctggcgaggctgtttggccagagttcccaggggtggcttggccagaatgcgtggggaaggatggtgcatgtcgtaagtgtcaggcagagtacagctggaggttcttcttgttccttcctgaaagggccggagtcaccgatgctttcatcctggatgtgggtcccctcatgagaccaggctcatgagagctcatgagagcaggcccttctgaaccctctgctgcccagctgcttgccagccggggatgcggagaccctttgacttgggcctttctctcccttggcccctcaccattaaccatcttactgcattaatccccatcatcaccgtatgaagtgcagattttactatcccattttatagatgagaaaacagaggcacaaggagatcttgtagctactacgcagtggcatggggactctgttcagatctgtgtgaccccagggtccaggccaatgctgtagcatttagggagtgactggtgggaaaagaagaagcagcatctctttgagggaagattcaagtggaggctcagccgaggcaccctgcatgcaggctactcacccactcccaactccaccaagctgactgagcatctcttgtggggtgacttggcaaagactactccccaaccctgcacagagccactggggctgcagcctggggagaggatgtgttagcagccaaatactctgggggtccttctagaaaaagagcccagatcccccacctgtgttggcagggaggaaggggtcctcagggtctcaccagacagggtagtcactccctctccgctctatccaaagccttggaatccacaggcagacagcaacacgtggctttgggctagttcccagctaagggggtggggcggtggggaggaggaatggggctggaaattcctgaagacttagtcttctgaggaacaaacgaatcttccccctcccgggtctcctcggcagctgctgccgagctgcagaatttatcgaaggccttcacgtgctatgacagactgctaatgagggcggccagggcttctgctttctttgctttctaatttgcctgggattctgcccccgagagggggcaagtgacttggaagccaggagggccccccagagccctgcagcctgtcagcagggcttggcttgaaaggcccctgccgagggccacccagggggctgctcccaggtacctgccagggatgtgaaacatgccctgggattaatggga

SEQ ID NO: 48157 - DNA, 1136 bp, Bovine  19866881358733
agtcctccacatgtagatacaatattcttgagcatgatgcttaccaataagtgactgatgcaaacagaaccatttcagaagagaactgtcttcagggtttttctcagagcaagtttaacgtccttattcctcagactgtagatcaaagggttaagcatgggaaccacattggtatagaagactgaggcaaatttaccctggtcctttgatccaggaaaagaggttgttaaataggtgaatgcccccgacccaaagaacagagccacagcaactacatgggagccacatgtgctgaaggctttggacctgccctcagcggaaggaatacggaggatactggagagaatcagagcatatgaggtgaagatactgatactggatattgtgatgacccctccaacaacaataaaaaacaccagctcattgatgtgagtgctggtgcaggagagctgcaagagggggaggacttcacacagatagtggtggatgatgttggaatcacagaagctcagtctcagcatgcttccggtgtgggccatggccccagcaaaccctatcatgtacgaaccaagcatcatcagtgaacagacctgaggggacatggtgaccgtgtacagcagaggatggcaaatagccacaaagcgatcataagccatcgataccaacacatagcactcagaattgacaaagaaacagaagaaaaatagttgtgtcatgcatcccacataagaaattatattttctgatatgaaatcaattagcattttgggggtaaacacacaagaataacagaaatctataaaagacaagttgaagaggaaaaagtacattggagtgtgaaggctagaattcatcgcaattaaggtgatcaagcccaagttgcccaccaccgtggacacatagatccctaaaaacaggaggaagagggggagctgaagctctgatcgttcatgataatcccacaaggatgaactcagtcaatgaggagctgtttaccagagccattctcttctggggagctgtctgtagaaacaagggacaaaatgtttcaaatgattatagtcacaagcatagctgatgccccaaagtctagaagataagccagtgcatgaatgccctccttttgcctttcttct

SEQ ID NO: 48158 - DNA, 1529 bp, Bovine  19866881406819
ccttgtctttcaggatgtagagtgccatggggttcttccgttcctgctctccgcttcgggggagggtgtcatgctgcacggggcaaagaagggggcggctggcgcaggtccagaaccctctccaccagccagcaactatactccttgcttcccagcggccagtcagggtcccgccacaacctctaccaaaggatccgtcatccccggggtcctaccttggctgctcctctccctgctctgcagtcttcgtgcagttggtggaggaaggggccctgcagagctggcttccttgtcgcccagatctgccttttcccagcagcccactgctctgagtgacgatgggatgggtgagtgggcggctgggagctcaccttcgggtttcaggcgatcatcactctgatccatatactccatggagttttgcttctccagtttcctcttcttcctgcaaatcaacccagcacctggtgaacacagctgctgagtgtgagcagaagttctgggcgtggggacacagtggggcagtatctgatggccataaatgaggctgtgtaataggaagacgggctgggtgtggtgggatggggtatatcccatctaggtttgcagcctgagtctggccctggcaagtcatttaactcatctgagtcccgagtcagtatctgtaaactgcagagaatcacactaagataatcacactgaaaggtagtgtgctaaccacaaacacagtgcctggctcacaggtgatgtgcaagtgaaactattattaacaatgctgggattgttgggggttttgagcacaggatgtaattccatatacaacgcatgcaatggtaaaatggatctcctggggaagagctttggcctgggaggaaaggcatttaaagagactaagaagaggggacttccttggtggtttgatggctaagactttgccttccaatgcagagggtgtaggtttgatccctggtcggagagctaagatcccacatgccttacagccaaaaaaccaaaacataaaacagaagcaatattgtaacaagttcaaaaaagactttaaaaatggttcacattaaaaaaaaaagtttttttttttttttttaaataaataaagagaccaagaggagcttagtgatggtccagtaaatggttaagaatcctccttgcaatgcgggggacacgatttcgaaccctggtctgggaagatcccacatgccttggggcaactaagcccgtgtgccacaactactgagtcaatgtgctgcaactaccgaagcccctgcaccctagagcccatgctctgcaagcagagaagccaccacaaagagaagccaccacaaagagaagcccacccactgaaactggagagtatcccccgactcactgcaactagggaaagcccatgtgcagcaatgaagacccagcacagccaaaaataaataatttttaaaaagagagagagagactaaggaaagaacggagctcggggctggggtggggaaggattcggatactcagggaggggggac

SEQ ID NO: 48159 - DNA, 855 bp, Bovine  19866881426459
tcagcagaggatatgtagaaatgtatggcacacaacatgctatgtcctttacaaagaactatatctcccggtttattactcaatccttgcaacagccctgtaaaggaggtagtattaatccctatttttgaaagagggaactgaggctagaacagtgactcgaatagtcacaaagctggttaaggggcgaagggaaagggcagagtctaaggctggcctcctttgcctccctagccccctgcccacctgtccccttccctgcccagctagggagaggatgcacagaggctgagctgctgctgctgctctgcctcacttgggaaataaacaagaagaattcttcttctcatcatttggtgagtcggtgacatttcgtttgacaaagaatctaggaaaagcctctcctgggacaagttttgggactaggctgtgataatattgctttattgaaaaaggatgctaggaactgagctccggatggccttttacttggaataatttatgcaggaaatgagaaataatttttttaaaaagaaacacacattgatctacacatggtcaccagatagaagtgatggcaacacacacacacatgaataatcccagagacacagacatgcaaaggcataaattccagttctccatcaagattgtggccacacaccctgtaaaataccgaaagattgcaagtgtggtcaattcagagccctgtggacacacccacttgcaaaactgtctgatggctgtgacttcccctccatgccttccaggggaaattgtgattttccccacacatgtaaatttcagtcattaagggacgcacaggaagcttgacattggagaaattaatctctc

SEQ ID NO: 48160 - DNA, 724 bp, Bovine  19866881731441
aaagctgttttaggttgaactgcctaggaaaatatgtcacgcatcagctttttgatcgttattgcatgaaaacaagtacatgaacatcctctgcaactaccataatcctggaattgcctctatcacatacacattccgtctcttggcccgaattctctaagttgatacaggtctctctggggaacagcacacctgagcctggggtactgaaccccccttgccggacacacacctgtagtgtcctacaccctcctgtcctagtccactatgaccctactgaacatgcatttactctgacaagattaatattggagtcagagttgaagagagtgaacttgtctaacactaccgtgctatctacaagtaaaatgtacgagtccacgactcgtcatgaagagcaaatgaaaatggagaattaggtgaggtcaaaggtgtaaaacataattaatgaatttgtagaatgttagagctacaggggaagattaaagttcacttagtataaccctctttacagaaaactgtagcccagagaaattaaattacttgccctgaattagtcataattacagaatgaaaaacaaagtaacatgatctctgtaaggacatcaaaaacattaggtaagactactaatcatgtagacgcatttggaatttaaaaaattcaagtctgtgtatttatttaacatttactgagagcttgttacgtgccagatacagcattgaa

SEQ ID NO: 48161 - DNA, 1176 bp, Bovine  19866881747749
ttaccacaagtgccacctagaaagcccacatcctctggatagccttgtccaaaacagaaagattctccaaagaattcccatataggactgttccctgccacctaactatattctcctttgttccaggccttttatattcattatcttatttaattctcccaaataacctgcatgggtttctgggaggaagggtaagactgaagcccagagagaagtttgcagaatgtgagaggagggaggctgagacccagaggaggagctgtggacaggccctgggagctggccacctacttgacttccctccttctgccagaagatggcaggcggggggttgcctttggtctcgcactggaaagccacgctgtcaccaggagctgccatctggtcctggggttgggtcaccagctgaggtgggactgggaaggggagggagataaaggaacagggagtcaggggcactaagggaggaacaggagaaagaagcctgagcttggcttagggaggagcagatatctgtctcctgctcaagcctgtttagctttctcctccttcctctcctcctagaagtctcagggtatgtgtgcttagtcgctcagtcatgcccaaatctttgtgaccccatggactgtaggctgccaggctcttcaggccacggggattctccaggcaagaatactggagtctcaggggacccactcatatctcctgctctgtcctttctccgccttctccacctccacccatcctccatctgccctcgtcccatgcccgccaaggccagcccaggggggccctcaccgtgaacaatgagggagccagatgcttcggcgcggcccacgctgttctccgccacacagggtgtatgtcccctcatcttcagcactcacacgcccaatctgaaggctgtggtcgctctggatctcgtacctgctccccctcccccacccccaggctgggttggccacaactacagaccccatctagcatcccccaggacggacaccagaatcagggcacgtaaggacaaggtagacctctgcagggacagaagctggtactcatggactcatgaatggaggtagggactggttggggcagggccacaggctctgggaacagactgcatggtccagtgagaggcatctaccttctttttctttttccagttttctaggg

SEQ ID NO: 48162 - DNA, 658 bp, Bovine  19866881922709
tggtgcctggggaggcgtagtgttcccagagtgacctgtccggctgtcttgctcatcttttctgatcaacggttatgcactttcaaagggcctagttcttccttctcttcccctcatcccatctaccctcttacccccttaaaaggacgggacagatgtcctttcttccacacaccacagctgcagccggacacattcccctagcccccggaaacaggtgtggaggatttctcagcccctggggatgaggggcattcaggaagatgaccagttttagaagctgcatgagttttcatccccctctgtgaaatgggcgtgttgccttggattagcacttcccaaagtgggctctgcagcacagtgggctccttggggggcggggggtggggaggggagagccctgaagccaagcaaacttgggaaatgctgcctaaacaattccttttgaagagttacagggctctttaccattttaaagattttaacaagttcaggatgcaagacaacccagtttaacccagggcttcctaaacatttatgaccatggcacccttagtgcacattctatgaacaaacccacctggcagttatcagcctgtaccagactttctaaggccttccaagttactcctcaacatctgaggtgcttcccccacat

SEQ ID NO: 48163 - DNA, 1556 bp, Bovine  19866880587730
tgatagagtaaacgggaaagctcagtgtgcctgtgctggcaagcccctgctgtcagccccctcccctcggtgggactgcttgtctctgaggaagctgtgctgccacagcaaatggggaaaacacccacatggctggagtccagagcaccaacttacccagtgaactgttctggataccctcctgcttattcacatatcgagccacttcgcaagtcttcctgataaaccccataaaggctttccaaaagtgtgtgtgttccaggaatgattgtgctttctcaagtgtatgaaacatcctgcaattaaaaccaatccagaaaaaacaacttttaataatgattttccagaaggtcttatcacaaactcatctaagtacaaatatatacaaatgtctgacagtccgattatacaggacattagaacctttgaaatcgttttcttatttatgaacattccgatcctgatttgcaaaatgaggaaaaattattttatggaaatacataaaacataagacaacaagccaagagaggagaaagtgggaaattaaaggatatgatatgaagcgagttctgagttacaaaaaacacatttcccatttcacatattcgactttgaacatcctagcagctgaggagaatggaaattcattacacgtacaatccatggtttgagaaaataaaagcaaggcggattttctggaaaagcacagctcctttgaaagccacttgctggtgattcacgcgagcatcctgggtgacgtgataaaacaagcaccttggggaacctccctagtgggctagtggttaagaatctgcctgccagtgcaggggatgtaggtttaaaccctggtctgggagctaagatcctacatgccccaaggcaaccttaagccctctcacctcaactaagacccaaagctgccaaaaaaaaaaatatatatatatatatatatatattttcttaaataaagctccttggactaaatgagggttctagatttcctgtgaaagattaagccaatggttaaaagggactgtttactattttataccctgtagatgctttccaatagtaccaaacaggctaatatttttaaaatagaaaaaaaaattaagtgactatttataagtagaatatgccatgctgacctatcgctcatatagaaggaagccacaggaatcccttcggtttccgatagtgcagatgttttccacctaacagctactacttacactgtggagaaaagctggtccgcacagtcagcagcagagacatcagctctcagtagccgcaggagccgagtgcagggcaggctcgcttcctgcagctgtgcccctaggtcctgccagtccggggcatcttctggtattgaaactggcatacttgtgtgcccagtaatggctgcttgcaaaagatgactctgaaaaggcagatacagcatggcttgcagtccataaagtgattaaactgtgggcaattgtgatgcagccttgccctgttctcactcagcagcgggtccctttgaactgcaccacgtagggttgggaccaccaagt

SEQ ID NO: 48164 - DNA, 3985 bp, Bovine  19866880403513
ttggactgtgatgtgcaatataaagtggattgtatatgacaaccagtgaagaccagctcagtggctggactaagcagaagctccaaaacacttcccaaagtcaaacttacaccaaaaaggggtcatggttactgtttggtggtctgctgctagtctgacccacgacagctttctgaatcccagcagaatcattacacctgagaagtacgctcagcaaactgatgagatgcagtgaaaacttcaacacctgcagctggcactggtcaacagcctgggcctgattctctgcaacaatgctccaccgcacggcacacaatcaacgcttcaaaagctgaatgagttgggccacaaagttttgcctcacctggcctctcaccaaccgactaccacttcttcaagcaccttggcaacgtttttgcagagaaaatgtttccccaaccagcgggacacaaaaattgctttccaagagttcgttgaatcctgaagcacaggtttttttgctacaggaattaacaaacttatttcttactggcaaaaatgtgttgactgtaatggttcctgtttttattaatatagatgtgtttgaggctagttataatgatttaaaattcagagtccgaaatcactattacttttgcaaaaacctaagactgatctcagctcaatgccaattctgagacctatgacaggacctctgtttcagacttagagtgcttcgttcctcttctacattctcagacacaaaacagctacaggtagagtggcaacttccgctgcagatgtaaacacaaagtgctatgctggagcaacgaggctgtaaagccagccgtcagtgaaccacgccccagtacccacggccctgtagaaacccacccacagtgaacctggcctgacttctgtgactcacttcaatcaagagaatgtgactgaagtgatgcgggcagttcccaatctatgccttaggaaggctgcctgggctctgtggtcaccttgggcagccaagtacaaagtccactgaccctgctggggaaatcatgtggagatgtcacttggggaacaagggccctgagatgtccggagactttgtggagagacagccccagataagtctggcttttccgccctcccctccgacgtgccaaggagctgtgtggatgtgtcctggggctccagatgactgctgcctccactgacatcatgtggaacaacagaacccacaagctgagctcaagcaatccaaagaattatgtgaattaataaagtgtcgtgggacttccccagtggtccagtgattaagaatccactttgcaagacagggacacaggtttgatctctggctggagaactaagattccacatgctgtggggcaaccaacagtgtgcaccacaactacagagccctcatgctgcaactgagacccaacacagccgaataaatcaaaaagtaaataaataaaatgactgtcgttttaatatactaagtagtttggggcggtttgctacacagataacaaatattcattatcttccatcttctcacttcttgaaagcaggcagaatgttacacacctctgtggccccagtacttacgcacaagaaccggcctaaaacctggccttatcatctttaaataaattaatctcatagcaaaacagacaaaatctttccaaatctcatactgagttgaacagtgtctcctcaaaattcatgcccacccagaacgtgaccttaaatgaggtcgtactgtgttagagtggaccttaaattcaatgcccagtgtccttataaaaaggccacgtgccaacaaaagcagaaactgaagcaacacagcgacaagccaagaaactccaaagggctaccagaagctgggaggagggcaagggaggactctccccccagcgccttcagagggggcccggtggacaccctgactgtggatttcgggcctccagagatttctattgtttaagccacgcagtttgtggtaattcgttccatcagtcaccaggacaaacccagaggcccagagtgggcaaaggtaacaggagccctgatggtggatcaacgggctaaaaaccacggacaggaaccatctcctttcctctcagctatagtctagttactttatagtaagttaattatgacacgtgcagtttctcttcacaaagcatcccccaaatgaatcttgttagttttcctccaaagaattagcaagcagaattacaggtttccggttataaagaagcgaagactgaccaagctggtttaactgctttgcctgggtgactggcctggaaatgcagttttcgcgtccgcccttcgggttccaggaggcttccatactgaaacgctgtctcaggccttctcagctcttatccaaatgcccccaagcccccttttccttccagcccaccccccgggtgactcagggaacgcccgcccgctgacccgaccacggctacctggggcaggatgaccttcttcagctgctcctgcgtgaagtgctccacgtaggcctccaggtgggagagcagcaccacgcgcacgtgctcctcgtgcacctcgaacagccgcagcagcacagggatcacccgcgcctggaacagggctggggagaggaggcgcggggcttctccgtgcgtgttgtcttcccccagatcggacagggaaaaaaaatcatcacttcagtgaaaggagcacgaagcctagaactccacacacaatcttaagtactcttcgagattcttacgtcccaaaccaaaggcaagtgcttctttgaccccatattactcaaggcttgactgtcctaagtacactccaccttgtaggagtgtttctgatacactcatcatacttaacgtactgcaaagaaaccttatgttttaacataattctgagtggatagctctctgtattaatacattcatgtctaatcaaggagaaatttcatatactagattcaactgatattattgttgcaatttttcctgcaaagccaggaagcattaaatgctacaacaggagctggtcctctcttccaagcagttaaggaaggtccttcaacagagacaggcatcagaaccatttggggacctttgagaatatgtattcacctgtcctccttctgtcccagacctagggggccaggcacaggcaaatttagaaaaagctccccaggtcattcagatcaccacacactaagcgcacactgtttaaatggggacaaataattccaaactctgtaactaccaggaatactttgggaaaaaaatcaccttttttagggccgaggagatatggaagaaaactcttaacagctactggctctgcaaacaccagctggttaagcagaagaggcaccaaccgtgaggctattaattcctctgacaggcagctgactctgtccagcaggaatctgggggcaaagaaggaacgcctgggacactgcagcaggttacttgcagttgagacacgtgcagccttagcccacatcatcgaagtgatgcatctgaaatgtggctagggaaactgaacgggtgggtccccagatatttaagaaaaacacagaaggcgtgagacaacaccagctagtcagtacatatacaacctccaatccaagctacgaaatttttttcaacaaattgctcctcattaataatagcgagagtgccctctttaccccctaataagccagagtccttttagtcaataaaagatattttctcaaattgaaaacacatgtgcgtgcttagtcgctcagtcatgtccaactctttgtgaccccatggactgtagcccaccaggctcttcagttcatggaattctccaggcaagaatactggagtgggttgccatttctttctcaaggggatcttcctgacccctagggactgaaccccggtctccagcattgcaggcagattctttacttcccaccagggaagcccattttaaaacacataggatattacgttacttagagttt

SEQ ID NO: 48165 - DNA, 2188 bp, Bovine  19866880420063
accccatgaattgcagtatgccaggcctccctgtccatcaccaactcccggagttgacccagactcacgtccatcaagtcagtgatgccatccagccatctcatcctctgttgtccccttctcctcctgcccctaatccctcccagcatcagagtcttttccaatgagtcagctcttcgcatgaggtggccaaagtactggagtttcagctttagcatcattctttccaaagaaatcccagggctgatctccttcagaattgactggttggagctccttgcagtccaagggactctgaagagtcttctccaacaccacagttcaaaagcatcaattcttcagcactcagccttcctcacagtccaactcccacgtccatacatgaccacaggaaaaaccatagccttgactacacggacctttgtagacccctttgctgtgtcaaccattcatctattcaagaaattttttgttcacccactgtgcatcacaaactcctcaatttcctctctttgccttcaaactcttgtcaagatcaagaggtcaaatgtaaaggatcatgcatgtgtacaagctaagtctgttcagtcatgtccaactctttgcgaccctatggactgtagccctttctctatccatgggattctccatagactggagaatactggagtaggttgccatttcctcccccagggggaaaggatcatgaggctcccataaatctgccccatatctttctgttatgcaggcacactcagcagaaaccacatcagcataactgagaaaaaataaacatgacctatatttaagaaaagggggtgggtggtggttgacagctgtccaagcacaggcctgaaaccaagatctcatcatcagggactaacttagtagctgaggcctgtttccattgcctggtttcctaactaaaacagatgttcctttagaaatctgattttccactgggactaaattcacttgagaaattgctagctggatgttcattttgttttaattctgaataaattattttcttcctttgtatttaggttattgggaacccaaattagcaaggttaaacaatggtggatcatacaatgcttggattgcagaaaaactttcaacggaatttaaccctgaaccttggatccaggtatgtcttactaacctgataatgcatgcatgctcagtcatgtccaactttttgcaaccccatggactgtagcccaccaggctcctctgtccatgggattctccaggcaagaatactggagtggtttgccatttcctcctctaggggtcttcctgacccagggattgaacttgtggctcctgccttgcctgagccacctgggaaggcccaacctgataatagttactactattgtaataaaaaatgacagtggtttaataatttcttcttgttgttcttgcaatgttgttaagggaaatggcaattactaggtgctaggcagcattctaagtactttacatactcaaaacctgtgaggttcagttcagttcagtcgctcagtcgtgtccgactctttgcgaccccatgaatcgcatcacgccgggcctccctgtccatcaccaactcccggttagtctagcaatatccagttttatagatgaaaaaaactgaggcacggagggattaactaacttcctaatgtcacactcaactagtttctggttgagtttggattcaaattcaggtatcctgtgttcaaatatgggttgcacctagccattttattagtttgtttgctgttattttgttctaaggaaagttagctgtgcattgacctcaggcagtgtgtgtgtgacttgttgacaaggatagtgctgctcagtggctttgctacattgcaggtagacatgcaaaaggaagtcctgctcacggggatccagacccagggcgccaaacactacctgaagccctactacaccaccgagttctgtgtggcttacagcttggatcggaaaaactggcgtatcttcaaagggaacagcacaaggaatgtgatggtctgtgggcaccactgtttctccccaagcctagggttactatatctttttaaaaaataccttttgggtgttataaatacagatggcatttttagtgttttatgaagaaaagtggtaaagtgatgtgtctgtatattataaactaaaaaaaaaaaaaccc

SEQ ID NO: 48166 - DNA, 2114 bp, Bovine  19866880497874
tttgcagtgatatggatgacccaagagattatcatgctaagtgaagtaaatgagacacagaaagaaaataccatgtatcattatatgtggaatctaaaatatgacatgaatgaatgtatttacaaaacagaaaaagctcgcaatctttgaaaaagaaacttatgattaccaaagggcaaactttggtgaggggaggggataaattaggagtttggaattaacatatacacacacgaatttatagataaccaaaaaggacctactacatagcacagggaattctactcaatattctataataatttatatgggaaaataatctgaaaaagaatggatatatgtgtgtgtatatatggcaccctactccagtactcttgcctggaaaatcccatggacagaggagcctggtaggctgcagtccatggggtcgctaagagtcagacacgactgagcgacttcactttgacttttcactttcatgcattggagaaggaaatggcaaccctctccagtgttcttgcctggagaatcccagggacagaggagcctggtgggctgccctctatggggtcgcacagagtcggacacgactgaagcgacttagcagcaacagcagcagccctatgtataaatagaagttggcattatagagagcacagattttaaaagcagaagaaataattcatcttgagcagtgcctttcaaatatcttttatcccagaatatagtatcatattttacattgcaacccagtacccacgtgcatgtatgtatatgtttgtatgtatatatgtgtgtatattaatatacattatgttttgcaataaatattacacattttgtttaatatgtaatttttaaatattaatgaagcagtatttaccaattctatgtgcaatgcagtatattttatattttttattctttttaaattttacttatgacttaatcattgattttatgtcctctgattgattcgatgttcagttagacaactgaactagggaaagtgatcagacttctttcccttcaaatcttcagaaatatcagtctcttttagatttttaatgtgttaattaaaagtcaacacgttagtaaataatctacattgttctagggtactccttggctggcacttggaatgattccatggaattggaatttttttggaaagaggaaaaaaccttctgtaaatcaagtatttgaagaacttgagttacattttcttcactgtagttatcaagaaggaattaaagagcatttagtatataatataatatgactggtcagtttgctttcttcattaaaagtaaattctttattcggtatatgttcaagttgacaaatgactgaatttaacattatatatagaaattacttaattttttaaagaggtaaaatgcaaaagcacttttgtaaagctatacatctggtagaacttttcagaagtgatttttaaaggatgctgtttcaactggaaatgctataagattttaagtaggtttattattatttggggaccccataactgaaaaaatcttcatatacttaataatagattattttaactagagaataatgaatcatgaatctttcaggctctaataaagctgcactatatgaacatttaatccctttcctttggatcctgaaacatttaactagtacattgcgacccctgctgttgtgagaattgctgaataactgggaaaaaatatctacttgtggaaggttttgtgatttgaataactattacaggttaaggagaaattgtgctataggtcagctcttttaccatgtgaggctcttaataaaaccaaaatttttattagtactgttttatcacatgagtattttatttagaaattttgaatttagctttttccttgacatcagggacatataaacggaattgataaggaattttagaaattatcatttaaattgttatttgttgatttatcctgaaatcaatttgcttggatagttttgatcttttcctaggcatagagaaagaaggcattatctcgcaaaatatttcaaaacttttatttgggtccttggaaaacctagtatccaaagattgtaaaaatttatatctaagttcctttatt

SEQ ID NO: 48167 - DNA, 2337 bp, Bovine  19866880587059
tgaaagggaagttgctcagttgtgtccgactccttgcgacccccatggactgcagcctaccaggctcctccatccatgggattttccaggcaagagtactggagtggggtgccattgccttctaaaagactaaattgagtctaatgactttatgaagctggttttattgtcagctcatcaaatgttcattgagagtctagtaagtgtaaggcacagtgctgagtgaaaactgtgatcactatgacaacacacttacatatattacataacacatatatgtggaatctagaaaatggtacagatgatcctatttgcaaagcagaaatagagacacagacatagaaaacacacgtatggacaccaaggggaggaggaggggaggaatgagttggaagattagaattgacatatatgtggatttgtcatatatacatgtacttacgactatatataaaatgggtaactaatgagaacctactgtatagcacagggaactctactcaatactctgtaatgaatgtatgagaatagaatctaaaaaagagtggatatatgtatatgtataactgattcactttgttgtacagtagaaactaacacaacattataaagcaactatactccaataaaaatttttttttaaataggattttagtctagaggaaacaaaacaatgtatcttaaacaggccactacttagcatgttagaaattagaagtgaacacaacacatgctgtagggacattttacagagcggatttctgcatttcccaggctttgtcaatcagcttgagcagaatgtgcaaagcaaatgagtgctcctctgagagcacttctacacaagtgtgtggagggtgttctggtggcagagcagtaactcttcctctcactaatgccatggaatgtgaagtgaaaaagcagtttggatccctatttgcaattttactcaaaagtgttctggaagagaaattcagtgtatggatcaatataaacacacttacggctgagaagtaacaggggcagaaacacacctggatagtaacagactcaggcttccataaaggaacctggggagaccgtccaatcctaaatggagaagggaaatcaatggcaatggaatttgccctgaaaactttggagcttaagttgtaagcaaaatgtaagccttgaagacagcattctgcttgcagaaatcttatcttgtgatgaaacactgtgttgggccctgagagctctaaccagccactgacatgctagggagactttcaggcaggatgtgacaattttggcagcactgaaagccctggtatgtttatgtagtcatgtccagtttacctgtgtcagatgagactttgacaggcctaagagaaggaactacatggggtcactagttagccatgccgctggaaacaccactagccctgccagtcaaagaaaaacacatgtgcctgccagaagtaacaaagtaatgaactttccatgaaagctatcagttctggacaatttggtatttttagagaaaagacttatgtatagtagggaccatgatcattaagacctgaactgatgtggctcatgtattcagaatgaaggtgagagttgctagtgaagaaatgaagcatcaatgcagaggatttgtgttctcgaaggagcagtaaagcacaaatagggaagtagacaagaacctacactttaaagcgtctagtgtcagagtccaaggattcttcatggcagtggtccccaacatttttggcaccagagaccagttttgtggaagataatttttttgtggactgtgatcaggggatggtttcaggatgattcgagcacattacatttattatgtattttatttctattattatatcagctccacctcagatcatcaggcattagaccccagaggttggggacccctgccttatggtaccaacaatctgtcatgattgcatagttttgactgagaaacaagggcttaggaagcctgaatatgctttacctacaatctatacttgtactcgctgtatcttagaaatgggaagataagacatatacaagattttcacacacactaataatccctaagggtccttggccaaacagtcctgagctaggattcaggttttgtttcattgggttttggttcattgtggtcttgtacatttccagaaatttccttagggccaatttaacactcagatcttagagttatagattttttaagtatgctttttacagcttatcaaatgagatcacacactttctcagacacaaaagcaaacaatatttgagtagtacctggagctaaaaacaaagaaatctctttttaaaaaaagg

SEQ ID NO: 48168 - DNA, 741 bp, Bovine  19866880731608
ttctccaatgcaggaaagtgaaaagtgaaagtgaagtcgctcagtcgcgtccaactcttcgagaccccatggactgcagcctaccaggctcctcccatccatgggattttccaggcaagagtactggagtggggttccattgccttctccggggctacagtccatggggtcacaaagagtcagacatgactgagcaactaacaccagcagcttaaaactgtatatgaatgatgagttgaaaagcagctcacatatttattcataaggaatttggccatatctttaatcatttaaaatataagcctaaagtttgggttcttttttagaactttgatatgagtaatagggttggttaatgcaagctaaatttgtggaagaatggttatcacaatagaatattcttgaagacatcaataattattttattaacttcacttatcgttcatatttataagacctggggtttctgaaatgcagttaaaaatactgttatttctagtaaaggtttgaggacatgagagatctattttgttgtactgtgagtagatgtcatataagcctttcaaatgtattttatttccagttcgaaaccttttgaaacctcctttaagaaaattgtctacagggagtatgaagcatattttcagaaagaaaaaccacaatccagaacttcaggtaagcctgaaatatatttttaaattttaaagataaaactctatggctaatttgatattcacatat

SEQ ID NO: 48169 - DNA, 927 bp, Bovine  19866880777685
aaaacagggcctggcttttatccgagtaattgaacaatggagagagcgaaagtggatgactgaggctcaacgtactccaagcaggaaatcttgggctcatggatctttatagacttaaaaacccagctttaagggcttttaaagagaagccctgcatttgggaatcttcagagagttgaaaacagatctccaggtgatcaatgcaaagtgaacgttttcagttacaatatccaattaaaacattcttgtacaattgaaggaaaggaaagaaatcagaagacatttaatgctttttaaatccagataagttttactataataaaaacacatgccaactccttgacttcctggcctaataagtcccaggtatggttgtgaagccagatccaaactgtaagaacaatgaaccagaaagtcttggtggaattatgaagtttctatggtcccatattctgagttagtctcagcagccaaaagagtgatttataaaacattggggaaaatgggtttttacctccaggctctaactttcaagtaaatattaagtatctcctggtcattagagattgcagccagtattccgattatatatatcacctcttggtaattaaacaaatattaaaaataaaagagtgagagttgttattatttaccatgtgtattttcaatcacagcacactattagcttctgtttatcacttccctaatctaggggaatctctctgtatggcttttagatcttcttattggtttgataaatagatctggtggattcagaatctcaaataactgttaagatatcattccccaccccaactgatggttgctcatctcactcttaatcatgcaattcctccttcctccccacccactcacagtaacgctgcttatgtgcttcgttgatctgaaggcagtaacatttgtaat

SEQ ID NO: 48170 - DNA, 1994 bp, Bovine  19866880799902
tattgtagagttaaaaaaaagaaaagaatccatctgcaatgcaggacatcccaaagataatcaaaaataaccaaattttaaaaatttaaagaaagaaaatgaaggttaatgaaagtaagtatatcacaagttgaatgtaaactacagtatcagacaactctaaacagtgcataaaatggcttttatttcacatcaacttatctttcaagtaattacacagcctccaaattattacacaagaagacaagtaactggcattctcttctctccattattacttattggacattgtaggtctgtctggaattgagaaaataatacaactctcatgatagagatgatgttcagaaagcttaatatttcccaaagattctcatgtaccaattatgtgtcaagcattggtccattgttgaccatgtaccaatggtcaactctagacctcttaagatcctttcaatcaaaagtctattattttctgtggctactctaagaattattagattatatcagtatatctaaacccattaaaagtctttggaagtatatataagctcacgaaagagatttttttttttttccttctgacatctgctgaaataattccaatattctcagagttgaaattctttcccttgaagatctacttataacagttcattgatcaaaaatcatgaaacccttagaactctgctcgatgttatgtgacagtctggatgggagaggagtttgggggagaatggatacatatatatggctacatcattttttctatgcacctgagactatcccaactttggttaatggctatactccaatataaacttttaaataaatttttaaaaagaatggcaaaaggtaaaataaataaagttgatgaattaaataagaactaaaaaagaaagaaagaaagaatcatgaaaccctgagaaggagcctcggagttcatcttgttcaattgcagtcctctccataacatccatgctcagatttagcagttccagtgatgagggtttctctgttgttgttaccattttgagaaaactctttcagggatttatttaaaatcccatatttcagtgatctctacctacaagtcatagctctttcttcttgaagaggaaagagtaagtccagatagttttgaaatgactctatggtgtgatcataagcccagaacaatactagtttatgagtcctgccctggtttcccatctggtttagtatctgatccaaacttttcattgtgcagtaaaattttactgtaatagttgctttagaatcagctttaaacagttaggcaggtctctcctttgttcctctagcttctacaatggtcttatcttgtactgggtgagacccaagtggcactagtggtaaagagccctcctgccaatgcaggagacataagagatgcagttcgatccctgggaagattccctggaggagggcatgacaacccactccagattcttgcctggagaaacccacggaggctggtgggctacagtccatagggacaaaaagagttggaacgactgaaagggcttaatcacgggtgagacatacttgtagggcacagggttcttattcttatatgagactaaatcccaaagatgcccagtgatagctcatctctctatgcctatgcctcatctttcctcagtccttcatcattccctttcaaaaaaagttttctgataaaaacaatctgtacacagacatgaattgttaggcacagctgactccttctatctgacagttctgggggcattcagcactactgtgactggccacctggtaaagcaatcagttgtactgtgaccatttgcaagggctgcaaaatacaggaagccaccaggtcacagtcagctaagtgactgtgaataagaaatgtggcaaattacagtttaggttcatctgaaataagtggaagaaataaaagcagagtagtcctatctgtggaacaggaagagaacactttaaacagttgggta

SEQ ID NO: 48171 - DNA, 720 bp, Bovine  19866880932834
tgaagcccgccaggctcctatgtccaggggattctccagactagaatactggagtgtgtagccatttgcttctccatcagagctttggagttttatccaaaaatttccagtgacaggatatttactgtttctatttaaaccaaatgtcatgtgggaacaatagtattaaaacagtaagaaattttgaaatagtttccttttgtctgattataaaagtagtactatgttcagtgtctaacatttggatacaataggaaagtgtaaaaaggtacattagagacattatagttgacacattgctgtaaagacttttagttgcccttttttatcttttcctctctctttgttataaaactgaatccacaatgttctataccctggcttttgtactaacaaaaacatcatgaatatttttaggctattaaatattctcatttttaacaattgcatggtctaccattttgtgaatatattatttatttaagtaatctccaatttttaaacatttggattattctcagcttctctcaattatagatataactgatagaaactcatttataaattattactgattgttttggacatgaaacaacagactggttccaaataggaaaaggagttcgtcaaggctgtatattgtcaccctgtttatttaacttctatgcagagtacatcatgagaaacgcggacggaagaaacacaaacggaatcaagatt

SEQ ID NO: 48172 - DNA, 2192 bp, Bovine  19866880984337
ttttaaactgcaggtgtataatgaatggaatgtagtaagttgtgacagtgaaatgaaaaataaagagaaaagcataatacctagtgttcactgagtatgataaatacttaaacacagaatctaagatctcaattggcttaattatttctgtaaaaatagaagtatttgccacaaatttaattttaaaaatttcatcctctttgacagaacttcacagaaattccagttcataaatgtattctgaggaaattatggatacatacaaaatcttagctacaggagttgtttattatgtgtgtgtgcgtcacttcagtcttgtctgattttttgggatcctatggactgtagcctaccaggctcctctgtccataggattctccaggcaagaatactggagtgggttgccatgccctcctcctggagatcttcccaacccagggattgaacccgagtctcttatgtctcctgcactggcaggcaggttctttacaggggaaaagattttgctccagtaaagtctgccatttggagggagaaagcaggggtttgggatcctgggaattgtgagtaatccttccccactgccacttccaaaggtgtagagggaatgggaccatgttccctgttggatttcactctctcaggctggccggtgggtttgtggcaaggaatgtaaagttgccttactcttgggagagctgcacacagagggaattcttatttcctatgtctttttgaaacttggataagattttcctcctacaagcaaatttgaatcttagagaagtttactctgtattcctccttcggtgcaattttccttatgtttagcccttattcatccacatgtctttctgggaattgttgtttagttgctaagtcatgtctaattcttttgtgacccctatggactgtagcccaccaagctcctctctctgtggtattttccaggtaagagtactggagtggattgccatttccttcttcaggggattttcctgacagggaccgaacctgagtctcctgcattggtgagcagattctttaccattgaaccagctggaaagcccctttctgagagtggggtttcagaaatattactgatctccaatctactgtgcttttgaaattctgggaatccactgttctgtaagcaggaaattatatattaaaagaaacaattattgaaggggtgaatggataaacagatgggtgaatggatgcatgagtggatggacatatggaagagatctcaataacagttgtttgttttttatgtctatggtgtgcttagcaccagtctcctggtaaactacagtctatgggatggcaaagaatcagacatgactgagcaacttcactagtgcttagtactgtgccagcccttgggaaaccatgagaataagaaccatgatttctattcttagggagcttaaaataatgttacgttggactacaagtcatcaagttaagtgcctccctaagttgaacctattgttaggaatggcttactccctgaaggcaagcagaatcatgctaagatcatgaactccacctgttcctaggcacaggaaagggattggaaaatattgagataccacaaatatactcctgcctatgatcttgactacttggttggaagtttatgtgctattcaggtagtaatagctaagtgatcattttttaattaattaattaatttggctgtgtcgggtcttagttgtggcaggtgggatctttactgacactccaaaggccagggctccataaagcaaggggctcagggcagaagttcttgcttatctaatggtaatagtaaaagtaggcatttttatttttttcaaataaccttcccctggactcactttgctccatatactagatacccatagttattttaggcattaaacataataaacagtgactttggtcatggaaaattctacgtccctacattaattctgacatacaccattgaatttccaaacagcttatcgttaatgacagaagtctgagcacatacttcttaaatgtatctttcaaggctccaaacagattaagggaaagagatatgaggtcttgctcctatattcagatcaaattactctaatatttttctctggtttatattggttgattgtgttaatcatgaagctgatgatttagatggctttcttctgtaaaccaagagt

SEQ ID NO: 48173 - DNA, 744 bp, Bovine  19866880993746
aaacttgaccctggggaacgtgggtatgattcctgcactacccaccctggaatgtccaggagtgattcacacttgcccctgtctgtcttcagaccacctcccagggaagtctataccccacctccctcccccttcctcagtgactgttatttctaagttgccaacatcgctcccatattatcaacattctaacttcgtgggaagggctgtggtgactttcaggaaagtgaataggaagtgcttttctaaacagcctgacagctgaggggtggctgcgagattataagaagtctgggccggacagacagcagaaagccagccgtgtcacaagagagatggtaagatcatttctttttgctatgggaagtggttggatggaagaggtttgggattgaggcaggcagataaggattcctaaaatgtggaatagcagtagttatggatttttatattgagtagccccatggagtttgtaagaattttgaaacctgctgcccgctttgatcttcccagcatccttttgagttgctatgcccatgttacaaatgaagctgctgtgccttccagagaggctaggtgtttgacctaaggtgcactgttggactggatgtggtctggatctgaatttctgtcgtcttgctccacagctactgtctttcttagcagcgcttacagggactctcttggagcaaattctggttaaccctcaactcttctccaggactgatcttctgtctgggttga

SEQ ID NO: 48174 - DNA, 927 bp, Bovine  19866881015032
aacaaaagaggttttagtgaacataagccttttcagacacccaaagattgagacctttgggccaaggtgccttgcgttctgctccatcaccaatatctttggagatattgactagagatgaaataatcatctgcaatgctagcagtgtttatattttaatttagggatctgaagaacagaaaagatatgccttgatgttagactatcaaataccaataatggttacagtgtgttaggcagtaatgtgcttgagaaagcactatgttatttcaagtttataataaccctacaaggtaattcctattgttcccattggaaacccagacaagttagtaatgtacccaaggtcatattaggaaatggaagatgtgggacagggactcaaaacttcctgacttcaatgaatatctgtgttactaacctctgtaacacaactgtgcccatacaaggtcagagtcagcgaccttgtcatttcctaggacaactcctaggatgcagcctgcccttaactcacattttcctagctctgagtcaggagtgttttataaatacctactgaatgaaggaatgagtgaatggctgttaacaagcctgggaaaggcattgaaccctaaggcaacatctctcaatttctgtaatgaaagcctgacctgggacatctccaatacaaacaggacactttcccaaagaagtcagggattcaagtccttggagccaggaatttatgtttccctgtccagaaatccctcccagatagcataaaactcatggactccctacacgactttcttcctatgccacgggccctaagctttactgtcctgccaacaattaggcgcagagaaagcagattgaagagaacaccagtttacatagtttgttagaataacttttgctggttatatttgctctgcatgggttcaagct

SEQ ID NO: 48175 - DNA, 1908 bp, Bovine  19866881063128
taaggaaatcatgatgtgtgtgtttgtgtgtgtgtgtttgaaaaggctaagagtagtggcaacatgcaaaattatggaaataagaaacaaaccagagaacagtaagactgctcaactccggaggggaatttgtagacctctgtcagacaaaatcataagacagagcccaggcagcaataccgtggcccacgaggagttacgatgcacagcccctgacaccagcttttaggacgtaacgtatgactctggagaacacaaacaagtgctcaacgaacatgtctaatgggcctaatatgtgccaggcctattccagtggatggacaaagatacatatacaacactagcaccctcaagaagctcagccactggtaaagaaggcagacacaaggaggcaattcaacaggaaacactcagtggtaaaaccacgtgcgggttactaggggcacagggggcgggcatttcatggaaaaccgaccgagccactcttccattcgcaagataccttcgctctaaaatgagaaaagaatagacgatgcctagcccctctggacagtaaaagcctacaaccctgtgaatgtgagtactgacaaaaaagtcaagtctccaaacctcagctcatactattattgaagcacagtccctaaccgcacaccaaaatgctaccagactctgagtgacatggagggcctggcacctggcttacctctggtgtggcctgagcaactttgcagactgtttccattcctcccagcttccagtgcccatcttcgctcacaaacacagacgacacgcagacattgttgtgtgtgaggtgtccctgggaaaaaagaacaggaagaagactgccattcccattttcttgagaagttttagaaaactaagaagtcatcacccccaaaaaaaaacattacggcaagccttcctacttgtggcataataaacagaactacaactttaagaaatgacaaattcaatgagccagcctaagcattatgaggttaggaaaaaaggaaaaacacaatggaaaggcttatcgccccctgcccagtgtggcaggttaataaagacacgaaagccacggcacagacactgtacatccccatctccatcggagtcgggagatacaggtgtccttacaggtaaatttacaagtcttttcagcccacgtcgtgtgcttcaaacgcctttaaaggaaaagtttatctttgctcccataaggttattgtattcattttctcctctaaattctttctcacctacattctatcacgaacccagatccacttcacctgaaatcttgtcagtaggcattaaaaaaattctgcctgaagaagaggaaaacggaatgataaggaccaccagaaatatcccacagaccacagaagagccaaatttaaaactatataaaagaagagtatagtcaaataaatgaaggaagaagaaaacgagaacgggggtgaagtatgtttttttctcaaaccagaaattatggcagtagataagcgcgcttgaaatactctacccatcagatccaatatgtacacattttatatataaaacactccaaggtatgtatatatttttttaaaggaaagcttggaatagtattagggtgtgtttccgcttgagaaaaataaaggcgaataaacacttagatatttgcttaggacacacaaagagcatctgtggcctaacacactgaccactgaggttgtctatggcaagaagcagggccctggcttcaaggacagggacttgtttccttgtctgcactctcatactattcaaactttttagtgaattcaaacatttttccaacagagaaaatattccaccacggtgcagcattaataattctacttatgtgtatcttaaaaatacttttaagagacaataaattcaaagtga

SEQ ID NO: 48176 - DNA, 1507 bp, Bovine  19866881069882
agttagacatggctgagtgactaacactttactggccgttccttttctcgaaatatcaaatgtatgtttcttgaaaaacatatcttagggaaagaatcagaaatgcagcaaagatttctgttagaagatgtttatcattgtgttactcaagttagtaaaataatggaagaaaatttaacactcaacaatgggaaatttttaaataatgtaatgcatattgatgttgggaaagattggaggcaggaggagaaggggacaacagaggatgagatggttagatgggatcaccgactcaatggacatgagtctgggtaaactccgggagttgatgatggacagggaggcctgtggttgcaaagagtcggacaccaccgagcgactgaactgaactgatacaatgaagtagtagacatccatgaaataacaagttttcaaaaaatgttttatcacagtattgtatttaagtgaaaaattaagacataacactgtgtataaatatggttttaattatgtaaaagaaacacaaggacatacacatgcacaaattggagataaatacaccataaaggaaagaatgatatcacaagtctaggtgatgaatttgtgggagatttatatattcttctttgtttaaaatttttaaagactttaaaatacaattcatgtattttttcaataatctgtggaaatattatctgaagaaagatgatgcatcaggcccacatagaaaaatggtcagtgtgcctggcaaccatttttttctactaaaaattacttgttaattctaaaccgggagaaaaacaacttcaaattaatcttctgtaacaccactcccatagccaccttgactcaaactttgagaaattcaccaggaccacaccactcagctggcctcaggaatgcagatgtctgcgccgtttcccttctgccatgtggggaacatcatccccatatatccagagctgtaagcaggccaagtcctgtcattttttgtgggcagagggagggcaggagctacgtgatggcatgcacagaatcacgtatcatctcttgtgccatgacatctaccaactttcttaaggcacaaagccttcaacacactgttcattttttcctctcaagaatgtggccaaaatttgatatgtgtagatgtctgtttagactcccttcctcagaactctcctcagtcattgaaatactggtaggaaaagaaagctgatttacattgcagctttgttattctttgtattgaattctttcttgttattgtttatttggctttgaaatgttctccttttcagaaacgaacatttacataccccacaggtaggactataaattggtgtaatattggggggaatctcttaatcataaataaacacagacaggtgtacatgtaactttacctacatatgttaagattcttgaaagcacctttaagtatcatttaacaccgtaatatcatttcttcttaaaaattttttaaaaaatttacacccagtacaac

SEQ ID NO: 48177 - DNA, 1348 bp, Bovine  19866881250976
ggggtgagagatgaattggagaatgctttatgctttctgagagagacttaccattgcattttgggagaggagtgctccattctccagaggacatgcaccgagtggcttctgtgctgcttgggaggtagccctctgcacagctgatggagcaggaagagttgtaggtgaatttccccaaagggttgcaaaccagatgtccatgctcaggatgtttctgtgctggacaggtcacaactgaaaaaggaaaacaaatcagttctgctcctctctcaccctgtagcatgtgggaagaaccctggaaaccagaactactatttatcaaacgtcaggcaccaggcttcccaggaggcactagtggtaaagaacctgtctgccaatgcaggagacaaaagagacctgggttccatccctgggttgggaagttcccccggaggaagacacagcaacccattccagtattcttgcctggagaaccccatggacagaggaacctggcaggctacagtccatggagtcgcagagagtcgtacatggctaaagggattcggcaaagaacaggcaccatgaaaatgtgtctgcatttgttcacatcatccaaaccataagtctatgaagttggtactctactgtccttgttttacaatgagaaacctgggacttgagagttttcctccctgttgtcaaggtgccataactactaagtggtggatctgggattcaaacgcaggagaatctgatttcacagcttcagctcttaacctccttctgactccatatgctccagggaaggcaaagcatgcagacctgacaccaaaaccagctgggacatgaagtgctcctacaatctcaagtgaaggaaaagctgagaccacgccttaccttgctcacatttgaggcccttgaagccagggtggcactgacaagtgtagttgttgatggtctctacacattcaccatggctgccgcagggtgtggggttacaggcagctgtggaaaagacaatccgcgataactattgttgttatgcttcaatggagtttctttgaatttaggatcaatgatgtgtaacagggatgtcaccaatgatacagagtgtcagagattttaatggaggtgcttgatgaaatgcccaagctgagttttaagctcaaaaatttcaaacccctgatgttaatatcagaggtagagctgtaactggcacccgaaatagaaaattcactttatcacaaattctaaagagaattatcctactgcaaataaataacaagtaactaaaaagtgtgttatacgtgtgcatacacactatatataagatgggggcggtttaatcgctaagtcatgtctgact

SEQ ID NO: 48178 - DNA, 1709 bp, Bovine  19866881333757
agggctgtagagatggaagtggcaagaaagctataggtgacttacttattttctaaaattaacaaataactacatttcttttcaagacttcttaccaacctacttgccactcttcaagaaaaaaaaagaaatgatctcacaattttatttcttcccctgccaagttcctgttcattctatatgggccaattccatctctctgaagaaactataattctctcaacctctcctaaacattcaactgaattgctcctcccaggcattcccaccaaatcccatccatactttgtttacagtaccttttgtctccagatttttaactggaattcacatgtacatatctctttacaccagtagattgaaatcttattgtgagtaaaaccaaaagaaaagaaagaaagtgaagtcgatcagtcatgtccgcctctttgagaccccatggactgtagccttcaggctcctccgtccatgggattttccaggcaagagtgctggagcagattgccatttctttctccaggggatcttcctgacccaggaatcaaacccgggtctcccgcattgcgggcagacactttaccgtctgagccaccagggaagcccaaagcctcattcattttcagatctgtagtgcctatctttatcatttcatttgtagataatctttgagcctaaaaacaaacctgttttggtgtttctggagaaaactacatgggccctatctcattggatggttgtaaaattagattaaataatacacaaaaattactttgcgattctaagcattcaatatatcttagattcaattgaatagccatccagtttagcccataatgctgacattttgggggttgggctttattaagtttaaacacatttgtgaatcattcctttctttttaggttcgttttaaaaatttagcatccagaccatattctcttcatgcccatgggctttcctatgaaaaatcatcagaaggaaagacttatgaagatgactctcctgaatggtttaaggaggacaatgctattcagcccaataaaacttacacctatgtatggcacgccactacgcgatccgggccagaaaaccctggatctgcctgtcgggcttgggcctactactcagcagtgaacccagtaagcatagccattgaaaatttttgtcgttcccctaagttgagtccatcaaatggaatgtcacgatttcctagtaaatatctgtcctgctttccatgaggcatgtgtaaggattagggtccacagtcaactgctaccaaaaccagggactctgcatgcagatcttcagaagacagtgagaagtggaaaggaggaaggattacttaaatggttagccccagttggagtgactgctttacagaggaagatgtttatctgcaatttccttgaacaagtattagctttctcctgctttttctttttttaaaataaaagaactataaattcaagattcccccattttgatggtggtagagagagcatagtcatagatttcaatttctatcctatctcttactgtgtagccctaggaaagttacttgatctctctcagccacagttcccagagttaaaaatgaggtaacagtacatagcatgtggagtaggcacttggtaatatttgttcaatcaatgaatttattttttaccatataggattgctgtcagaattaaataagatactacagggaa

SEQ ID NO: 48179 - DNA, 1210 bp, Bovine  19866881450742
tgattttcttccctggtggattgcactgaaagagtaattcattgataagtgatttaaaacctgtcagtgtatctccaaggactcaggctacatttttaagcctatgagtttcctcctgaaatgctgtggcagcagaaatttctccactccaccccatggagcagggccatgtccatggtgccatggtctctgcaagctcatgttaacactcagagctcatgaggatgtctgtggtctgcctctttaggacactgtgtttgatcggctgtagcaatcttgtggtccaatttttatttctgctctaaatacacaagctttctctgcacatttcacgtgagtatcttgaaggaatccagggacatttttctttaacctgcctgaaatttgttttggcagaagttctgaaggccaaagtcttgagaggtttgggttttgttaaattatagacataatttcagtgaggttaaaaagctcaggcaaaaattggagtgccttcccatcatttctgcccttgaaactctacccatccagcaaggcctgattctagtgatgtctcttccatggagctttcccaggtcatcagagctggaagggcattcttctctccccaaggctatgtgctgggatgtaaagggaagctgggcagataggggttagaatcccagatcttgctagtgggtaaccttgaccgagtttcccaacttctctaaacctcagatttctcaactataagtaatagtgaaaatagtagtatctaacattttgggggcttccctggtagaccagtgctaaaagaatttgcctgccaatgcaggagatgtggacttgatccttgggctaggaagatcccttggagaagggaatggcaacccactccagtattcttgcctgggaaatcccacagacagaggaacctgtcaggttacagtccatggggtcacaaaagagttggacacaactccaagatggaacaacacttgttgagtgcttactgtcaagtaccatgttagacattttacatctactgttttactcaatcctcttgggacaagccattttactatgccttctttatatatgaggaaaccaaaggtaacaatgaaatgataattcatagctcactgagcaatgaagattgaatttttaaaaaatgtggatcaaggtatcattgaacacttataaacatgaggttctgctccattgtactaat

SEQ ID NO: 48180 - DNA, 778 bp, Bovine  19866881504559
atgaatacagttaaaggagactgagataccaataggataaaaggtttccagattttagcctgaaagtgatcaagattttaagctgggtgtctttcagagagatcactctgtacacagctggtggatgagagaaggggtgggaaccaaagcagacaatgggaataagagagaaagggagtttaatgcaataattaagctaagaaaggttgatcttgaagcaatgtggctgaaaggtctaagagacactgaggaaggaggactgtcagttttgttccgtgagacaatgtggtggataaaggactggaggaagaggatgtaaaccaagaacaagccctgaggctacccaccatcgtgtggtgaaatagaatggtcagagaaaagagaaaagagagcgggtaaggttacatcagccacgggaagagagtgtttcaagatatcagaagcagttagttataccagatgctactggcagcaactgagtgggcagcaacacaatttcccaacaagaagaatagaaaaggagaaacaattttggataatgtttagtttcagggactgattcattcagtaaatagctgaacacctactgtgtatagaggattatgccagactcgaggaaacatagtgcccatctttgaagagcttacagtttgggaggtggagaatcaaactgcaatgaaccatgataaagagctatactagatttatgtacaagatgaactgcaagcctagaggaaggaaaatctaggtttgcctgaaggaatcagggaaggctgat

SEQ ID NO: 48181 - DNA, 869 bp, Bovine  19866881809220
ctgagtacttcactagccttgcagagttccaagcacttcaaactgataaactcaattaattctcactgtacccccataaagaaggtacttttgttataacttccattttcagatgagcaaactaaggctcagagaagttaactaacttgcctaaaacttccagaggataaatgatttcagaaaagattcaagtatatgcagcatggctgtgagttgacacttttaaccactgcactatttattacttgttggcaatgtaataacctggtgcaagaaaagcacccaagacctgaaagtattacactgatctttaatgttttatgcatatgtataaagtagaggttcttaaccatttttatatctcaactatactccctccaccctcaagaatctgatgaatgctatggacactagcaacttcatacaacattctagttaaaattataaatggaattaaacttaaacaactcaaaagcatataatgaggggactgtattcagcttaattattaacttacctaagcctggaaaaaggatagttgatagttaaacactagcagcagtaggcacagagaaggcgatggcaccccactccagtactcttgcctggaaaatcccacggacggaggagcctggtaggctgaagtccatggggctgctgaaggtcggacacgactgagcaacttcacttttacttttcactttcatgcattggagaaggaaatggcaacctactccagtgttgcctggatgctcttgcctggagcatcccagggacaggggagcctggtgggctgcagtctgtggggttgcacagagtcggacacgactgaagtgacttagcagcagcagcaggcaagtggttaagac

SEQ ID NO: 48182 - DNA, 941 bp, Bovine  19866881833764
agacagcaaatttggttttctttgggaggatctttggactttacacacagctaacatgcctgcctccaaaacccaagctcagatcaccagactgaaaattaacaagaatttgatgagagcagttctgcagccaacttctcttgcttctaaatttccaaaggaaagcaaatcacttaaaatatttttttcaagtcagtataaattttctaggataaaatatcttcccaggtttccagtattttaagtcttgatttttggcttgaatttctatatttcagtaaagtttacaatttgctaatgctgatgtgtgataatctaataaaatctggccttaaaagttataggcccaatttactaataaaacgtaattcaattttccttgggaaatgcaaatcattagtatccaagcagtagaactgaattgaattcctttgccttttttaaggttaaaaagttttctctattaaaaaggcttaacaaagaagtcaactaagactaatatataaggatttacttataggcataatacaatagcatcatgtatataaacatttacattggttaattagctaaataaaagatttgctggagacattaatccttgtagactgagattatcccactcatttcatcctcattttttgttcaactggattaatctgtagagaacttaatgaactacttaatacagtttaatggtagtgaactagttacttgatgtgttaataaattttagcaatttgtctccaagaaatctaaacaccaattttcagtaaaccatatacagtgtattaattcaaaataagtaaacaatatactgtattgtacaacaaaatctacatatcttactctgaattttaataacatttactctaaactttctaaagcatagttcactgttagactaacatatctgcttgccatttggaggcagtaatggt

SEQ ID NO: 48183 - DNA, 771 bp, Bovine  19866881844523
tttatagcatttccgtatttgtaaggacccatatagtaagatggttcggtggatacctaaaatgatgtaagaatagctcttacaatgtacaggtcaagttttttgaaatcctttaaatactatgaaatcttctctgaagtcaaaagtgaaaaataatgttctgacttattaaataaactcattaagtgcaaatttatgttgaaactgaatatataacataatccaagaaataaaaaaactagcttctttatttgaggagaaggagaggtttgagctttcaagagcattaaactagacctaatttgaacactgatggtagtacatgtgcatgtgcagtcactccctcaccctgcccctcctcatatgcacacctttctcctctcagcttattaacattctaaatctttctcccaggtttggccttgcaaccacttacttgataaaataggtcactcagaaaggaagaacaaccaataaaaggaattacaaagacaacaagattaaactgattgccctgttttcatacactgtagctgaaatctgcaaatatgcagttggctgtgttttggcatttaacagcatgcgatcagtaaggaggaggaaattttattctcattaacggttgcagatttactgcagtgaaaaagggctatgtaactcgagatgtgacagtacagaaagatcaaagccttggactggaaaccaaataaaccctctggctacttcctgcaaggaaaattcactttggcaatgtaaaacagagcccagtta

SEQ ID NO: 48184 - DNA, 1527 bp, Bovine  19866881846003
tgggagtgtttatacccccagtaatcttgcataaggcctgatgcaaagcaggtgctcaaaatgtatctggtgagtgaattattttatcacagactgctgatgacctgtgttggcccccatctctccctcagatataacagtctgtgcccatgaccacatcagttggcatctgattggaatgagctctgggccagaactgttcaccatccatttcaatggtcaggtcctggagcagaaccatcataagatctcagccatcactctcgtcagcgccacgtccacaaccgcaaacatgaccgtgagccccgagggaaggtggaccatagcttctctcatccccagacattttcaaggcaagaaattcctccacaagtcttgcttatgaatgtaggatccttctttcttcctacctaggcactaactctctcattctccttacaagctgcccacgctccagacataacatttcttggtcctcaaaaacaaaatttagatactttgctcttagacttataacttgttagttggggatggaggaagtagaaaaattgacaaatatttttaaaaaatgatgcaaaagccaacaagatctctacttccttgaaaggagaaaagaggaaggaaacaaaaacatatctgcagatattctttcttggagtattcaatatgcagctaaaggaaaagaagtagatgttggagccagtcaaacttctgtaaatttatagaaagaccaagttatagacagtgaaaaagttttaacatgaaaagattgtctttcataacaagacgagcacaaagccttgcccacagaggaactcagtggatgtgtattgactggaaaaaacagcatctaaccagctgaggattttaaaggacatcagtgaattctggtgggaaaaaaaatcaacttaggttgttatatgctgtcaggtaaacaaaataatgctctactgcacattgttgctttaaaactgttaggagaaaggtttctgtacataatagtaaatatcactataggaaatcattgtgttaccaaaataatgtgtataaaagcaagacatacaaaaaagagacacttctgggatcatttcagtttttgttcaaactgagtggtcaaaattatatttgaagtaatgaattgtcacaatattcctagaagatagagtcccaaataacaatgaaataataaaactaacattactgagtttaagtacttttgtctttttacaatttcatacagtatatattagtattaatattatcttaattttacaaacagatgataggaaaaatgagaaattgacaagatctaagtcataaagttttaagagtctggaaattacacaaaatttttctcccttgagaagtacaaagaaaacctttccaattttttccccctaacccatcctctctctttcctttgctttttattcttgccttcctcactgtactaaaatagtttcaaaccaaaatattcaaaagttttctaagtactatattcactgttattacgaaaacttccacaaa

SEQ ID NO: 48185 - DNA, 860 bp, Bovine  19866881917962
tttttttgggagaaaaaaaagaactacagtggctactgtgtatcattggttaaaatctctcaaagccatcctatctccctaactcctggtgagttggtttcctagagtgagagcttttcagaagcagccctttttttccagataagtgaactgagcccagagagacaaccacttgctgatgaccacacagcgtgtaagtggcaaacgggacacaaccagacctcctggctcttgctgctcctattgttagaccctatagcgactcttggctgaattttccgtattattccctaagtaactcaatactcaatggagtaatgatttggtatttccctcctgttccacaaagggcaacggcaaggccttcagatctgaagaaggatgaaaacccgcacctctcctgacagtttatggaagatttacctggaaagccagtgacctctgactcccaggctagagaagtggttctgagtccattaaaattcatgctcagagtctgatggttcataagggagctgctgtaacagaaatcattccttgaggtcacacggtgcgttaacccccttgctcctcgtcacggtgatgacggctcagataaacattcatggatggaatgaatcctcagctagaggagaaagtctatctgggaaaaggacaaacgaccttccccctcaatgctgcctgatatggggagacagtaaaagaagagcaaatactgacagaaacctgataatatttgcctgtctagtagtcaagacaacatccagacattctatggccaagttgagaactggaagaaataaaaaaggaagaggagcggaaggaggggaaagagagagaaagaaagacagaaaaggaaa

SEQ ID NO: 48186 - DNA, 559 bp, Bovine  19866881924285
gaggacgtgttcactctaaaaataaagtggtttaaccctgagtgtgtgattggccagtttgagtggggcagactgacagatggtaaagagaggacctaggactagcctgtaccctctggagagcctccaacatgacgatttgcttcctggcatcacctctagcacaagaccatggaccacgttgctatcaacaaaatagctggctcaccatattcacactccggtccatagaatccagggtaacaggagcaggtgtagttcccaatggtctcaatgcactctccttgcttgctgcaggacatgtcctggcaggaggctgcatggatacagaagggtcagaatcacaggcattcttaagaggtacaaagaaaagctggtttcttattccaagtcttagccccacttgagtaacctcgagctagccagacaacagaaaaccacagcgtcccctggagagccagcctgttccctgtgaagtgtgccgtaggagcctgctggagcattgcttggcttctatttttaaaatttttgattagaggatagtgctttacaatgttgt

SEQ ID NO: 48187 - DNA, 1096 bp, Bovine  19866881972479
catgctgctcagaggcttcagtcgtgtctgactctttgctgccccatggacgtaggcccgccagtctcctgtccatgagattctccaggcaagaataccggagtgggttgccatgcgcttctccaggggatcttcctgacccagggatcgaatccacgtctcctgcattgcaggtggattctttattgctgagccaccagggaagtcccctagtggcctttgggatgattcaattgtttttccaaagtaagaatttcttggaaaaactttttccaaagtaaaaatgggtacgaatggagacactaccatctactgcgtttctcttttgtaattgaccttccacttggtgcttacccactataacctatcaatacacctacctaatagtagaataatagaataactaagcttttttgagcactaaatatgcaccatcaagcactgtctgaggcactttacatgagccatgatattgaatcctcaaaaggcctctgggaaatagattacttttgatcactctttatacctaagggatctgagacacaaagaggtaaatggctcctagcccagggcacaacacattatgaggaggagcccaggatgctgctaaacaacctacattacacttggaagcccaccccaaggaagacttatctggtccaaaatgccagtagtgctaaggataagaaattttagtctatcaactgacattgacttaccaaaagtgagagcagagagatactgtgacacaatcatgacttcaagagttcttttgatccaaagattagacttgaaaatgcttttctgggggggagggagggggaggtacaaaattaattatagaatgaactcccaggctaccagatacccagatcattctacaatgatgtgtaaagtggcatcataagatgtttagattaaaggattataatcttttgccacaaggtttatttcaaagaagtttgcccaaaggaataaatacagaagttaagattttcatcatttcagtcaaaaagaaaagccaggttttaagcagtctgaatacaataagagcttgcacagatcttctatggaaggagttttgcatatctgttca

SEQ ID NO: 48188 - DNA, 847 bp, Bovine  19866882041918
tcccagcacaccaaagacaggaggccagtctgcaagagggtttctgtcaaaactgctttggtggaaactttgtggaaactaaacatagattgatttcaattaaggattccctggtggcttagagggtagagtctgcctggaatgaaggagacctggttttgatccctgggttaggaagatcccttggagaaggaaatggcaacccactctagtattcttgcctggaaaaatcccatggatggaggagcttggcaggctacagtacatggggtcgcagagagttggacacgacggagtgacttcacttcccttaagggttcagaattgattcaaacccacgtctctctctctctaagagctctttagtctggggactttttccattctcagactccaccacttgtcgtagtgaatccaaagtcattttgtcatatccttgacttagtcctaaattaagaataaaggagaaatgttcatgtagaggaaatataacaaaggagggactttcctacaagatctttgaaaaaaaaaagaatatttgcataaaccatttttaaccagcgtctttgtgtctttcttttctgaatgctttgttatactcccttgcatttccctttctgtccctggaccccagctagtcggagaccaaaatctaattctgtttcactttggaatcttcctggctccaccctcattatcatgcttgagtgattacatctattgacctgtctccctgcttccgtttctttccactccttaacccctaggagcgctaatcttcccagaatatcactgtaattctatcctctcttgctcaagctttcccagaaactaccaaataaacttc

SEQ ID NO: 48189 - DNA, 1131 bp, Bovine  19866882146614
actgaactgaactgtatactagggatatagcaatgaacaaaaccgaccctctgttcctccttacacataactttagtctatcagaatcacaaatattaaaactggctagacatttggttaaaaaaaagaagttggcatactaacccacacatcaaagtatatggcaggtgttctacacatatgccttggaattatagatagggcatgatatcttgattatatttgttttacactagtttattacttgtctaaacttatacaagtttagatgtttattaagcacaaaattttataaaaattcatttatgccttttgcaatatcttcctatctttaattctataaatttaattctagcattgggccattatataaacagtatacagctaatattagtacaaaaattctcacattcttgaagttctgccccaccccccttcctaatatacttgacatacttgtaaaatatttcttagagtgctctggatttctaaattttggcttgacagttctctggcttgactggttaactcatacatcatgtcatcaaataatctcacagtctgtgaaaacaaagcaggtcataaacagcagtaatagaagtcactagaaaagaaagacacaccgttcaagaaaaaaattgacttgattttgcattattaatagccacaggatattgtccagtataacaactgtacctaataaagttaataatgtgtgtgtgtatagtattttttgtatagtgtttctgcaatataatctctttgaaaaatacaaagtcttcaacaaaaattgatgtcttccatttctgtaataatatccataaagaaatcactcaaagttcactttctggtgttgtaacaaaagtgctactcttacacttaaataaataaaagatgatgatcttaaccaatgaacatccatgtgaacattaaaaggatattttctggtagtggtaatgaatctgtgttgaattacctatttacttgttttttatccagtttccatttttgaccagctcaaaataccattcctagattagagacacagtacgtaacctcagaactaagtgtttttgtctgaaaagttagccaaattaagatctaaacaagttaagtggcctaaacactaca

SEQ ID NO: 48190 - DNA, 1717 bp, Bovine  19866880360828
ctgttaagtgatgggaccggatgcctgatcttagttttttgaatgctgaattttaagccgctttttcactctcctctttcactttcagcaagaggctctctagttcttcttcactttctgccataagggtggtgtcatctgcatatctgaggttattgatatttctccccagcaaccttgatttcagcttgtgcttcatccagcccagcatttcacaggatgtactctgcatataagttaaagatgagtaaaactgagttttggaaaggttaagtaacttacccaaataaaaatgtgagagctgttaccattacatcagctttttccaacctctttttgacctcgtggtggtggtggtttagtcaccaagtcaaatccgacttttgtgacctgctgtggactatagcctgccaagcttctctccccatgggatttcccaggcaataatactggagtgggttgccatttccttctccaggggatcttcccaacccagggatcaaacctgtgtctccagcatttgcaggcaaatgctttactgctgggccaccaggaaagcccttgattcatggacccctctcgtaaataaatatactactgtaaatccttagggacttttaatcatttcagcatttatacatgtgtcttctttttgaaaaaattggttccttataggtctgtattattaagcagcattctataaagatcatgctacaatctttataacattaagacaagtgttgacttgtccccatttaatttgtgatataaaatgcagatttaccttaaattatttatgaaagaaaaaaataagtcaacttcagaacagagttttactatgttgtaaggcatcaacaagacagaaacctccttttatgaacggatgtttagaattctaaattttatgctgaattttaaaaaacatataattgttgttctaaaccataagccacaagaaaaggtttccagctgatgtttgcaagcacttctctgcaaataacacattgcaggtgtggagagtcattattctcaataaatgaaaagcgaaattgtatataattgtcactgtattttctatttttaactgtagttttgaaggatattttggagtaccatatcagacctttatcagatgaatatgacttgcaaatctggtgaagatcagtctgaagtagatttgctgatttattatcatatctttcttcctggttagcttgctgcatttctgtatcaccctgctgtatactttctactgtcaaataatggtgtatgctacataatctattgcttggatgcaaacagccaaatcatctcagcgtgacccggaagctcaccctggattgcttggtcaaagagataacagggatgatcaagctcccctcttctcttgctgggagtggctgcaccatggggctaatggaatcttcccaaccctggaagctgctgctgctgctaaatcgattcagttgtgtccgactctgtgcgaccccatagacggcagcccaccaggctccatcgtccctgggaatctccaggcaagaacactggactgggttgccatttccttctccaatgcatgaaagtgaaaagtgaaagtgaagttgctcactcgtgtccaactcttagtgaccccatggactgcagcctaccaggctcctccatccatgggattttccaggcaagagtcctggagtgggttgccattgccttctctgaa

SEQ ID NO: 48191 - DNA, 1154 bp, Bovine  19866880417096
atgctagagacggaaagtcagctgaaactagcccagatggcagcactgtctttcatggttcccctacattcatgcatgcatgcaaagtcaattcagtcatgtgaattgtcccaaagagtcctgtcactctttgcaatactatgctatagcccaccaggctcctctatctatggcattttccaggaagaatactggaatgcattgccatgccctcctctaggggatattcctgccccagggattaaaccctagtctcatgttgcattggcaggtgggttctttaccactagcaccacctgggaagccctacactaacctacacatctataactcattcctttgtaactaaactctccttgaataatcttaaacccataatctgggtatgtcattttcctgttgagactctgtctaatgtatgttcctcactcaagctctgctcttatagtgtactatgaattaatattttatgaaccttgtaattatcttgtgaatcatccaatgatattgcattgcacatttttacattaaaaccattaattatgtagatggaaatatttctcttcaaatgcttcattttttgcataactgttttcaccgcaaaaaataaaagtggtcctgggctttcttaatttccgtgagaccctaatctgcaaaactttttccaacagcagtgacacatcacgattcagaacatgggctttggggttagacccaagtcccagctcacctccttgctagctgaatgaccttgggtcaatcactttctctagcagccaaggaggttccagttggtccttctaaatttagatttttccctctgataatatttcccatctcagtatctgagcccagcccctgtattgagttgtggccccagttgggacagcaccctactactgccatataacacactaagtcttgtctctttaaattgaagttctcagggacttccctagtagctcagacggtaaaggaatccgcctgcaatgcaggagacccaggttcgatccctaggttagggaagatccactagaggaggaaatggcaaatcgctccagtattcttgcctggagaatcccatggacagaggagcgctggcagagtccatggggtcacaaggaatgggacatggctgggggactaaacacaca

SEQ ID NO: 48192 - DNA, 1187 bp, Bovine  19866880488393
tggaattctccaggcaagaatactggagtgggttgccatttccatctccaagcatgtgtagtggcatccagtgaaggcatggcatagcatacttaggaaattggaagtagttttctgtggctgaggagtgccagttcagattcctccagcagccaggcagatgagatatataaatgaaagtggagaataaagattgatgggatctctggtacccaccgttactggagagccctagtatgacttgaaagcatttcaaccaagctgtttaaaatacatgaacagggacagtaaaacatgacttcaggctgggcttggctgatggactgcctagtcacattctgacatgtgttggtgggggtgtgtgtgtgtataggaaatgtagttggaatggagaccaagcagagagtataatagaaaggaaagtcaaatctatgttttactaatctaggacagatattgcattggccaaaaaattcattcagggtttttcataagaagttacagaaaaacctgaaggaactttttggccacctcaatattatcaggcatatatcaggtggagatatgagttacagacatgaagtctacagagtctaggcttcttttcccatgtattgctcaagccaagatgaatgacaaccacgccagggccaaacggcccttgcaatttctggctaagattgagagggctgtaaagttggagaagagagtagattctatacctgaaaaatcaattaatgtctctttaatggtcatgaaggagatatgtacaaattccaagtcaatctcaagaattaatcaaccaaggcaacaggacctgtgtctcagtagataagcccgcagggtgtggttttcacaggcaatcctattttaccataaaacaaggaggcagggattcatgtcttaacctcctctcatgtggcacgtggggaaaagactcctgtccaatgaataaacttgaggagcagagagagaagcatataatacacaacagtagcaaaaaaaaaaaaaaaaaaaaggaagctttgtgtctcattcaatgagccagagctttgaataaagagggaagatcaatgaataaaaaaatcaaggttcgagaaggtgagaaaacttggttagcaaagtctcttctaagcagaattgaagacttcttaaaatgtgtaattctacccgctgtaattttttat

SEQ ID NO: 48193 - DNA, 705 bp, Bovine  19866880511198
tctatcctccttttctctggcctttagtttaagattattgtttttataaaaatgagaactatcttttccatcactgctcacagagaaactactgaaatttctagtcatttcaaaaccatttgtctgcttcctcagccctcatccaagtcaaatgtgtcttgaattctggcagctggaagcaatctcagaaggactgaccatcaagattagattcagagcaagttatacatgtcagtattgtagtttataaagtatcttacatgtgctctatgtaatttgagccttagaataatccagcatcacagccattagcattatcctcaatttgtatctaagaaaaccaaatctgagagagttaaatgccttaagacagaaagtaatggagctggaaattaaacttagaaatttttttcttaccccaaactgcaagcttatactacaatactacattaaattaaaatatctaactcatctctgtattaaatcagttaaagccaactgattaaccacaatgaagaagatactttttattttttatttgcccatgttatataaactgtttcagagatttaaaaaataaatcctcaaaggcaagaattacatagaaaatataaaatactttataactattaaaaatacatagaatttctattcttactacataaaaatcttttaagatcaagaaaatattctaattccattata

SEQ ID NO: 48194 - DNA, 1044 bp, Bovine  19866880594161
ctgcttctttgtctcagctgggaaaggaggagaaggcagtgtcccgagtagcattgttttgttccaagtttaaggtgtttgaagtagagcacccatcagctcctcggtctgccataaaaaaaataccacagactgggtggtttcaccaatagaaatttgtgtcttacagtctgcaggctgcaagtcttaagaccaaggtgccaacagcgttggtttctcccgaggcctctcttattggcttataggtggccacttcctcatgggcatctggtgtttctccctcttcttgtaaggacacacggcctactggatttgcagtccacatttataacctaatgtaagcttaagtagttctttaaaatggcttccctggtggctcagagggtaaagaatctgcctgcaatgcaagagacctgggttctatccctgggtcgggaagatcccctggagaaaggaatggcaaccgactccagtattcttgcctggacaattccatggacagaggagcctgcccggctacagtccttggggttgcaaagagttggacacaactgagcaactaacaacaacaacaacaacaaaatcttagtaatggggcaggactctgacttgaaccctagcctattttaagctggagcacaaactatagaactgccatgctacactgcctctctccctacactccaagacaataagtactgagaaagcatatgctttttttgttcatctgtgtttttcacaataatattccctaatcgagcattctgtttatgcataatcaccaggaaaatgtaaaggtagaaagatcaggagacatcagctcaggctgtgtaaaaatcagccagcctgatctgttatcacaatggacaggaaattactagaagttcaatatcatctgtgggggtctactttgggcattatgttaccttaaaaagtatccttagaactctaaacacatccacagacgttaaggacttgaaattttcatgacatggattgtattttccttgacaactcctcctggcataaagaagaaggaaaggg

SEQ ID NO: 48195 - DNA, 2987 bp, Bovine  19866880628576
aaactgttatttttaacctcatacaattgggaaagatctaaaaatgtaatagcttccatggttggcaaagtccctctgctaacactaattcaaataaaagtgatgacctctgtcatatacttttgccccaaatcttgcctttcctactttactacaagctactgaaaaggtagcattaaaatcttttctaccacctattttcttactttctctgaacttaacacccatactccctaaactcttgatgagaaacaaggtaaagagagaaagaaatcaactagaattccacttgccaaagtttagtcctccaagcatttgacatacaagagattacctaatgtcattttttgtaatttttttattggagtatatttggtttacaatcttgggttggtttctgttatacaatgaaggaattagcgatatgtatacatacatcccttccctcttcaacctccctcccacaccccaactccactcatctaggtcatcacagagcactgagctgagctccctgtgctataacacaggttcccactagctatctagtttatacacggtaatgtatttgatgcagaaggaaatggcaacccactccagtgttcttgcctggagaatcccatggatggaggaacccggtgagcaatagtccatggagttgcaaagagtcggacacaactgagtggctaacacacaatgtatttgaaagtcgcttagtcatgtccgacgctttgcaaccccatggactgtagtcttccaggtttctctgtccagagaattctccaggccaggatacttggttcccttctccaggggatcttcccaatccagggatcaaacacaggtctcccacactgcaggcagattctttaccacctgagccaccagggaagtggtagtgtatttatgtcaagccaaatctcccaattcaccccatgcctcccttttcccttctctatctgcatgtccattctctgtgtctgtgtccctattcgtgctctggaactaggttcaccgataccatttttctagattctacatacatcaaaggaaaccataaacaagacaaaaagacaacccgcagaatgggagaaaatatttgcaaacaaagcaagagacaaaatgtacaaatagttcaatattaaaacaaaaaaggaggccaaccaaaaaaaaaaaaaaaaatggccagaagacctaaagagacttttctccgaagaagacatacagatggccaagaaacacatgaaaagatgctcagcatcactaattattagagaaatgtaaatcaaaactataatgaggtatcaccccacatggtcagaacagccatcatcaaaaaattcacaataaatcctggagagggtgtagagaaaagggaaccctcctacactgttggtgaatggatacaagcactatggagaacagtacagaggtcccttaaaaaaacaaaaatagaatgaaccacctagtgtcttaatatggtccttttgaaggcagggatatctgaggacttgagtacttacttggactgtaagccctggaagcaacagtaagggggtgatgagaatgaggcaggaaaagggtaatcccaaaggagcagttctgagctggttaatgctgtgggcagctgggggtcagccccactgtggccctgtgaggaacagtattgcacctcaggattgtctctatgaaggagaggtagcaaggatctttgttcactgcctcccatcccttatcctttgagggttatctagaggcttgctaactttcctgctattccaggctatcacgtggcttcaggaaaatacactgaggtgtgagcgtggagattagatattagcagaatgttggcagcctccatgggaatggacctccagcaccaactctgcaatcagtggtgagccaagggcatggagcagacacacaagacacatccacccagtcctacgctgggcctcttgtgactgtgattaaggaagagctcatagtgaggaaagttcttctagctctttataaggccttgccttttccaacatggctactcctaaggtagctgagaaaaccttggctcaagaaaaataaaagtatctctaaccaagacaagaatctttgctgtttcagttcctggaaaagtcttcttgaccccctaatgtgactctgttctctccctaactccaggccctgagtctgagggccccagctaaagttctgctgaaattacagataaatgacttaaaatgactcaaaaccatctgtgtcccagtttcattccttttatggctgagtaatatttctttgtgtatatgtaccacaacttctttatccattcatctgtccaaccatttaggttgttaattgtagagaccttgaaggacctagagtctgtcatacagaatgaagaaagtcagaaggaggaaaacaaatatcacatattaacatatacatgtggaacctagaaaaatggtacagataaacatatttctagggcgggaatagagatacagacctagacacgtgtggacacggggtattgggggagggtgggatgaactgggagattagggttgacatatatacactatcacgtgtaaaaagggactagatctgatagacagagtgcctgatgaactatggacggaggttcgtgacattgtacaggagacagggagcaagaccatccccaagaaaaagaaatgcgaaaaagcaaaatggctgtctgaggaggccttacaaatagctgtgaaaagaagagaagcaaaaagcaaaggagaaaaggaaagatatacccatttgaatgcagagttccaaagaatagcaaggagagataagaaaagccttcctcagcaatcaatgcaaagaaatggaggaaaacaacagaatgggaaagactagagatctcttcaagaaaactagagataccaagggaacatttcatacaaagatgggctcaataaaggacagaaatggtagggacctaacagaagcag

SEQ ID NO: 48196 - DNA, 830 bp, Bovine  19866880639480
acactttctgttttcccacttaacctgttggtctgaaaagtctccttgacaccccccagcactgacccaataactactgaaggaagggttcagatggggagatagttcacttacggatgttgcagataaacacctgggatttgtcatccaaagctgttacttcgggatgcgaccagtggcatttatacccttaagatgaccatgacctcaggggactttgctttgggaaaggagaagtcacaagtttagtggaaaaataaccagagtcaaggctgtgtgtagatcattttttcacttttctcctttcctttgtcagatgctgtcttattagaagacatctgagtatgtttgaattttctgaaacttatccaagaaggtaccaaggaggatataggcaggaaggaaggaaatccaacctatggtgtcagaataggctgtggcctgttggaaggcaggtgactcaggtaaacgttgataaatgtttctttctgacattcgttaggagcgttacgattgttcacatctcactaggttgatttccgctgcgttgtccaaattataaatccctaatagttaagtgaagtttcacgtcactagtgtgcccagcacagagaggtgtgtgtggtgcccgtgggtgtgtgcttgtattgtgtagatgttctggaatcactgctctagagaagatgcacattaatagagtcaccacttagtaataggtacccagggttgatcattatatcaaagcatgattcaggaaagtatatgatttactataagtattaattaagcacggttatgtgtaaggctatgttcctaggcacagtgaggga

SEQ ID NO: 48197 - DNA, 750 bp, Bovine  19866880645124
tttccgtttggcgagtcccttacacattctctagatcaactttctttcttcagtcatgttgtgaaatgtggtcagagtctggggaaggcatcactcatacatccttgggtccctgatgatcgagtcagcaaagccccaggagcccctcatgcagaagccatcttccatccgagaaacaccccttactaaatattttatcctttcatcttggtggctgagaaagagcagggtgttttagtattcttgtctggtaacagatatcacttagaaatccattttgtaatcatttaaactggtttgctttgggtctatttacataattccgtgagacgcatggaaagagagccagtgtgttatttttctgcagccaaagacatggaaaaagcactttctaaggtaattaccacttcagtgctccccacacagttagagggcactgtgaagaagtatgccttctgggtccagggccaccgaagtgtggaaagaatgtactttctccctgggaaggggaagcaacacacttagtatgaagcctcttttacttatcggcgtaatctgcacaaggttaaggagctgtggcttccggagcgtgggtgtgggggtggggagatatcatctcagaacaaacaaggcactttcaagacctttgaggtgtagtgcaccgggggaggaggacacttgacctcctgcctgcaggactggaaatgcaagtcactcctgcagaggattacatcagagtttaatctttca

SEQ ID NO: 48198 - DNA, 2203 bp, Bovine  19866880733054
tctgtataatgtgtgatgctctctgagctgtagatgtgagggtgggaaggaagaagccgggctctgcagcttgtgaaaaactgccaccacactctcccaggggttcttcattccacttagcacgagggaaaagcaagcaaggctcagcaagacagttctttaaagaaacggcattgaaaataaccatcatgtcaatttcagctaatggggcacagtatgggctcattttaaagcgaggaggagtggcatgcaaccattaagaaagaaatgcttatgccatatgtaagcacacccatccaagcagagccaggagttctctggggagaactcaacacatccctcccacagacttggaacttgacctcccactgaccagaacccagaccatcattaaggaagcataattacaaatgagattagtgagatagcagccaaggttttttccactggagcttcaaagactcctactggcaagagagagagaaagggacttaattcctgaatttcactaacttcccttttacaggtgcaatcgctagaacattaagatgcatacacctgcttgccagctgacacatttatctgtgagcatcctttcaaactcaggaggaagcaagctaggacaaaccctcttgccttccaccactcctggctattactgagctggctcaagcaagattccaactatgaagtatctacaaagctggtgccccactgagaagagacccatgcctgggcatcggacggaagttggagagttccacaagactcttttagtgctggctggaagacaggtgtagtggcccagagcacagatactggtgtcaggaagacccaagcttgagtcctagacctgccacccatctcttctctgtgtgcctcagttctctgtaaaagagcagcaaaaatgacatctacctgagtaatgagaattctatggggaaatgcaatatccctgggccaacaaggtacttgttactttttatttggaagcataaatgctctggaccacaggtttaggggcttatcctgtcccatgtcctgcatggagacatgcagacatgttaaatatcttggcctcttggcctgttactgtttagttgctcaggcatgtctgactcccttgtgaccctatggactgtagcctgccaggctcctctgtccatgggatttccctggcaagaattctagagtgggtggctatttctttctccagaggctcttccaaacccagggatcaaatccgtggctcctgcattggccactctttacccctgagccaccagggaagcccccatcttgacctgttgctgctaagttgcttcagtcgtgtccgactctgtgcgaccccagagacagcagcccatcaggctcccccatccctgggcttctccaggcaagaacactggagtggggtgccatttccttctccaatgcatgcaagtgaaaagtgaaagtgaagtcgctcagtcgtgtccgactcttagcgaccccatggactgcagcccaccaggctcctccatccatgggattttccaggcaagagtactggagtggggtgccattgccttctccgatcttgacctgtagaaggcagcaaaagctcaactttccaataggtgctgtccacaagcatggtgctgaaacagatttctagttttaccttcaggactagcactcaaggctgtctctgactatcatgttcacaagcctctacttggccagaaatcaatggaaagaggacttacatgagtgtcaagaataacgcccagggtgtttcccatgtcaaagatatgcttctctccctcttttcagttcagttcagtggctcagtcgtgtccgactctttgcaaccccatgaatcacagcacgccaggcctccctgtccatcaccaactccctgtccatcaccaagtctgagttcactcagactcacatccatcgagttggtgatgccatccagccatctcgtcctctgtcgtccccttctcctcctgcccccaatccctcccagcatcagagtcttttccaatgagtcaactctttgcatgagggggccaaagtactggagtttcagctttagtatcattccttccaaagaaatcccagggctgatctccttcagaatggactggttggatttccttgcagtccaagggactctcaagagtcttctccaaaaccacagttcaaaaccatcaat

SEQ ID NO: 48199 - DNA, 1966 bp, Bovine  19866880790369
atccgggtgtaccattctgctctccattccaaatcctgccactgtatcaagtgatttcagtatacatttgagcaacccatctactgcctttcaaatcttgtgtgtgtatgtgtattaagaaccatgagcatgagattttcatcttaaccaagttttaagtgcacaatataatattgctgataataggcaatacaccatatagcagatctctagaactattaataattcatcttgcattttttaaaaacagctcttattgaggactctcaatagagaatagaacacactctacacctcagtcacctactttactcgctgtttacagggaagcctccaggcttttggaggacatggcaacccactctagtattctttcctggagaatcccatggacagagaagcctggtggactatggtccatggggttgcagagagtcagacacaactgagcaactttcagtcttttaccaagatatatacttttgctgagtcctaaaaaattgatgcttttgaactgtggtgctggataagactcttgagagtcccttagatagcaaggagattaagccagtcaatcctaaaggaaaccaaccttgaatattcattggaaggactgatactgaagttgaagctccaatactttggccacctgatgcaaagagctgactcattagaaaagaccctgatgctgggaaagattgagggcaagagaaggggtgacagaggatgagatggttggatggcatcatggcctcaatggacatgagtttgagcaaactcagggagataaggaaggacggggaagcctgctgtcctgcagttcatggggttgcagagtcagacacgacttagcaactgaacaacaatacttttgactgcatgtatttctcagcaaaaaaaaacaacaacacatataaactagcttctcctttctctcttcagagcagttcttcagagttgtctcccaggctgtggtactcagtaagatcatgaataaaaacttaaattcacaattattatgttatgtgtttttctttaagttgacattatgacaacagaactgagtagttgtaacagaaactgtgagcttcctaggtaactcagcagtaaagaatctgcctgcaatgcaggagacacgggagatatgagtttgatccctgggtcaagaaaaccccctgaaggaggaaatggcaacccactccagggttcttgcctggagaatcccatggacagaggagcctggcaggctacagtccatgggtcgcaagagtcagacacgacttagcaactgagcatgggcacacgacagaaactgcatggctcagacatccaaagtcattgcccaagaccccttgtttcaccattgcatccatataaccaaacttggcatatggcaagcctttgaaaaattatttgtccatgttaatctctctctctctctcattctctctcccctataaactgtccaagatttttttttttttaacttagctttatggttcagtagaatggattcagtaagtcttggagacaatgcccttcatggaatgtttcactagcaccaggacacttcatcaaaacagggctcattttacttttccaccagtaagtaactgcaaacagaaaatggctctccacttctccaatgagcaatggtcctctgggagacttgacattctccatttaattaccaataacagttagatgatttcctctgggtgttactgtgtctcagtcgggaaagtcactcacacaaacaagaggaggaggtgtgttcactgttcccaaggctgctcacccacaccatcaaatcaaacaaaaggaattttactttcggtcttcttttgctctcataccatcacatctcctccttctgaaaaaagtttcagttcatttggctccagattacctcaaaagaatgagtccttttccagcctgggagagataccaagaaaacagctacaga

SEQ ID NO: 48200 - DNA, 980 bp, Bovine  19866880871545
agcttgaactggttgcttaagtgacagttgaaatggtgtatttgtcagcatacaaatgaaaatcaacatcacgcagggaggtaatctagtcccaaaggcaccgtggactataaacgctaaattacaatagacctagaatataaccttgcataattcttgaataaagggtttgaggaacagaaaacccaaggtagcgagaattcagatgaaagaaaggctgtgcaatttatagttaaggtgacttcgagactattgatttggtctctaagtgcacccccaaatgtatctcagagctatttttcagtaacactgggtacgataataatgagaaagaggatttagagtggagtagctatgtggttatgtgctcatggcccctcttggggacctcagatcttctccgctcagtatgggttgatgccaatcttgatggattttctaatcttcagttcatggatgattacagatggagcttgggagatattatattttcttcttgaacagctgaccttatttggggaactgaggccaactaagatctttcccctgcagaatgttagcaaatcagagaactcgttggatgccacacagttcgttcatgttcaaatgagacatatatgaactctgaatatgaaatgtacccatatcctgctttcctttcactctgaatgaaaaatgccttaagtagacaagctggggctctgtgtggcctcaggagaaggagtttttcaataaggaagaaatctatgaggttcagtttctagacattttccaggaaatgatgtaaccttgttcttgaaagtgtctgcggcaggggagagcaaaggaagggaagagtttatcttttgcaaaatatgcctaagttattaaaaaaacaaatgcctttgggtaggggagggctccatctgaagggagtgtgtgtatgttccaaggaggatttccaggcttcccaggggcacagtataaagcatccacttgcc

SEQ ID NO: 48201 - DNA, 1082 bp, Bovine  19866880947570
tatttttcttctgcaagacagtacatcccaagagatctctcttttagcgctgatgaaataggatgttatttatgtagggaccttggtggctaagctgctgttgcacccaccatgtttgtgtgtcgtttgcgaactggcagattgattcatcaaggattccagaagcacattttattctgttattctgcgctaggccttggccaccctgtctgtttgatatactggaggatggctttgctatgggcccccagttcacgggacgtcaatactgaagattctagagaatggatctggacaatgagtatagctggtgtgtgtctgcaggatgagtagctgttgcctggttcttgccctcccacaaaagaaggcagcacatgactgcagagtgttatgtggctgaaaggacaccgattctgtcattaaaaaacatcacggcttgttagatggttcagtgggaaaaagtgctttttacaccagttcagtcatcttacctgcctccttgctgacctcgtctggctatttgttaggtgcaaaatcaactctaaagtctgcagcatggcacataaagcctttgcagtcctagggaccccatctccagctgtatccagaaagccaccccttttcaccacatctaccctggtggctcagcggtaaagaatctgcctgccagtgcagcagccactggagatgtgggtttgatccctgggtcaggtagatcccctagaggaggaaatggcacaccactccagtattctcgcctgggaaatcccacggatataggagcctcgtgggctgcagcccatgcggtcacagagagtcatacataactgagcacacatgcatacaggcacccacccatggtcacttgccattgaatttttggacttatctgcagatattttatactcatttatagctcttgcctttgcatattctctttcttttgtatggaatgcccttcttcatttttccaatggcaaactcctgcttatcctttgaacccagatgtgataactctccctttgcagaagccctctgcaaggatccataaaccaaattacttgccctcttttcacctgcca

SEQ ID NO: 48202 - DNA, 1913 bp, Bovine  19866880967663
cagtgttcttgcctggagaatcccgtggatggagaagcctggtgggctgcagtccatggggtcacaagagtcggacacgactgaagcgacttagtagtggtagtacggaagctaggaaaatggtataggtgaactatttgcagggcaggaatagagacgcagaagtagagaatggatgtgtgcacacagaaggggagcggagggcgggactagctgggaggttaggatgggacatatacacattacgaagtgcataatagagagctagtggggatctgttataaagcacaggaagccggcttggtgctctaacacgacctagaggggggggacgtgggtgggtgagagggaagtccaagaaggagggatacatgtatacatattgctgagtcacttcactatacagcaacattattttcagattaaaacagaaatccaaaagatactgtaaacaaggtgccagatgacataactagcttgttgtaattatcctaaatatacatatctaaaataacaatactctctattgtgcattttttgctgacatatgtatgtgtgcagtggagtagcaggtggcccgataaatgacaccccagatggataacagcagtcatctttggaaatgagctggggactggaattgggtgtagggggtcgtcaagattttggcactgtctataatattctgttcatttcacaaggaataacagaggcagactaaaccagtgaaattaaacttttttttttttaaaccaacttgttcaaaagcatgaatgtgtaataaagaaaccaaggaactgagctgagtgaaattgcactcgaaattgctgccgagagaaaggggaaagctgctcagagtgagaccaaggtttcttgacgcctcgatgtggttcggaggccttttattgatggctggggtctctctgtggatattctcagccccatgctacctcccggcattaaggaacttctaaaggagactgtttcattttggaacagcaacgtggaggtggagagggtgggggtgtgtggggaatagaagccgaggaggagggaaatcaccaagctctgagatcaagaaaggttccccaggcacctctactgacaccaggcttattgaaagtttttctgcatcatctgaaagggatttagagttaaatatctaaaaggacaaagtacgttggagctctgatgtaggaaaataccacgcagataaggataaacaaactacagagcagaaatgaccacaggtctgacccagtctaataattcttaacatctctcggagttgttgtagaggattaaataagattgctcatgaatgccccaggaaaattgtaaaatggaacacaaatgttgctcatgactgtgattatgtcgtagctggttttacatcagaatttgataacagagctaaaaacagaatccttaatggagtctgggattctattcagccatctaccctgactgggagtactttataagaatgatttggcttttacaagtaatcagcctcagttttttgtttgttttggcttttttaaaaaataaaaatgccacatccaaatttaaaagctggggaaatagaataagggagaaaaaagccatccatagcctcaaaaggccctcagttcagttcagttcagttcactcgctcagtcgtgtccgactctttgcgaccccatgaatcgcagcatgccaggcctccctgtccatcaccaactcctggagttcactgagactcacgtccattgagtcagtgatgccatccagccatctcatcctctgtcgtccccttctcctcctgcccccaatccctcccagcatcagagtcttttccagtgagtcaactcttccgccctaatgtcacccaatatttgttgcatgagtgatggaatgaatgaaacagcgaa

SEQ ID NO: 48203 - DNA, 2286 bp, Bovine  19866880975467
ccattaggctcctgttctaaggctttattgtgataggttttgctgccctaatctcattctcagcccttatctcctcaccaatctactcacctgggtccttaattcagcagcaatttctttacataaaaatagctagatatttcttgatatctgtctgtctgtctatctatctaggtatttctagataccagctatttctatatctagaaatagagcctccctcttcctaaaaaaataaaaataaaaaaaacaactaccaggagacagctctctaacatgtaagaccaaccccctccccacatgggctttgaatattatctccttctaccttctcaggaatttttcatcccaactttccttctctctcctggtattaagtaagttctttttgactggatctgacatttcaccatgcccatgctctcacatctttatgtgcttgaggaatggggaggtgaccagtcatgccagaggggagtgagcaaagctaaggaagtaaggaaaaggtcagggggtgtggaggaaaagaccatgaggtttgggggtgctggttcttatgggccaccggcaagacacttggttttattccatatgtgatgagaaaccactggagaacatgaaagaggagaacataagctttacattttcagagatctttctccagctgctttgctgagaacacacaggtatgtggcaagagcagaaggaagactgcctgctaagaggccattgctggaaggcaggtcggagttgagggtacagggatgcaggtagagagggcaacctgggaagtagcgttcagagttgggatgtctttaaaaagtagggccaacagtcctttaggatgggtgggatgtgtgtgaagcgagagtgtcatagaagactccaagactgttggcctgagctgatgattaactagtagtttatcaaagtggagaacactggaaaagaagccagtttcaggggaagaaaccaagtctggttttggacttgtaatctgagatactcacatggaggagtggatacgagagcctgaaattcaagggaggttccagttggaggtggacatttacatcacgtgttcacaatccacttgccagaaaagcagggtgaagggatgtcagagtctcttcaccttcactaggagaaggtgggtcatgacctttgcctatctggggagtccttctgaagagacacaggagacacaggtttgatccctgagtcaggaagatctactggaggaggaaatggcaacccactccaggattctagcctgaagaattccatggacagagaagcctcataagctacagttcaaaagactcacaaagagtcggacatgactgagtgactaagcacacacctgaatagaaaaaatgcttagacactgatgtgcaaaaataaattttaactccatcaccaagattttcaactcctttgaattcccagggtccctgataacttcctgtgttacacagcttaaaataatgtcatcatatggttaggataatgtaataatgagagaaggaaatggcaacccactctagtattcttgcctggaaaatcccagggacagaggagcatggtggactacagccccagcggtcccaaaagagtcagacacgactaagcaactgaacaacaaacatcataatatgggttggttcccatggcccccgtggctaagctcagtttctggaagacttgggcaatgtttcactcacctgtgtatcccccatgcttgacacagtccctactgcatggaagctgccccataatgctgtgtggttgttggacaaatgaatgaatgacatacaaatggaaacatgatcctttggaagtcaggagaactggggcagtttggagggctcctctaagtaggtttctggtgcatggggttcaggatttctgaattccacatcatctcccgtctgaggcaccctgcactgcagcatggaccatatggtgaggaaacactgcatctgtgcttggaaaggcttgttaacagtatctggggtgcccagagcagccgtgacatcggcatcaacacaccatcctgaagccgagaatcatcccgcaagatcacgcagttgctctcacagccccaaatgtttatgagacacgagccaacacgctctccaagctcccccacctccgctctgctggtgggggcactgggctgggcacaaaccccatctggatgcaggtcaccatctgggacaacagctttaacaacagagatcccacagtagttatcagatgccatttactgtatgtgctgtttgg

SEQ ID NO: 48204 - DNA, 720 bp, Bovine  19866880978864
tctgaggagccggaagggcctcttccccacaaaaggcctctgacacactatggctttccccaaatctcgaggctgatgcaccagttttccctgtccaattccatgaaggttttcccactgtcttcctgagatgtaatcccttttatgatatttacctggatcaacattctggaaaacgacccttttagacttttctacgaatgccgtatgctgctccatgtccttacagattacctgtgttgtatcctctttgatactactttcaatttcaaaatcactcgggttttgcagtaaacctggaggtccctggaattctggttcttgtatgatttcctcctcactcattctctcgctgccagaatcttcaacaagtgcctcctgggagtccttctcaggttcccagcctgtagattcctgaggttcaatttccatgatgtctctttcttgaactgaggacgatggggcttcttctggggaaatggtgggagaagcagatgcccgagagttaatcagggcatccatctccttgtaggatctgcaggagtctagcacatgaccatttttcactttgaggtgactcttctgaaggcttttgaacttggtctggcactgttccagagtttggaggaagccacactctcgcagctgctcagccacggtcccataccacttgctcttccgatgacaggcttgcagcacttcataagaccaagtctcatg

SEQ ID NO: 48205 - DNA, 2925 bp, Bovine  19866881040370
gcttgaaaaagaactcttcttgtcttttcatgaaaaactatcttctaagtgcagccaaaacttatacagcaagaaacaaagatgcagcattcacactcatggagcaccagcagaaaatacccatgaagaagacatactctaggcaacaaaagaaaatttctgaaagcaaaaatgtgttactctctctttaaggtttcaaaaccatacactcaatgaaataagaaataaagcaaaacctataaaacaaataacttcaatggaaagcactgtttcagataagctagaatggatggaaaacaagaataacatcagagaattaaaatgtgcattaggcgtggtaaaggaacaggtcatcttcggtggacaaaaatataatcattaatgtgagaggaccatcaggatgtcataagaagatgacatgcaaaagaagatgaaaacgttgcaagagatggaaaattcacagatgaacttctttgttcctgaagaaaagggcaagacacacaaaacgcacacattcacaggtttaggagggcaccatggtgaaatgttagacacaaagcctgcattagcagagctcaccatccagtacgggaagatcctggcaatggggtaaaatccaacagggacagtctacactttccatcattctgcaagttctactgttctacttctgcactcaactaaatcagtattttctgaactgaatctcggggcagggcggtgtggacaatgcttgcaatgctactggctcttctgagtaaaaacagtactctggtcaaagaaatttggacaagaatatgctaaattaaactaaaaccacattctttactgcatagctttaatgctgagacgcattatgaattttgaagacagtgcgatatgatgccgcatttacaaaattcagaaagggaagaggtcatttttggctgattctttggaccatgatgccacccctctgccgtctttttcatctctcgtaacagctactgacatcttctagacacggctcagaaatgccaaggtagaccctgagcaagcaaatgccaggatcataatatgtcaggctctcaccgacgtgccctcaatgctacacccacagcctttagagaagtttgatatacaaattacacatccacacaagctgtcagtgtgattttgcaaaaatcatggttggggagaccactgtcagccttgcagaacactgagatccacagactggtcagcctgcaatcctgtcccagaacttaagtacctccatttgtttctcctgccactctagcactgatgaccacggagcatgggcaagcccggagcagctgcttccgcctgcctgcagcttcactgggacatgggatgatgtgtcccctatgggtgctacatacagcatcatgtctaccctggggatcttgctccaaaccagcagcccctctgctcccactagaatccatttatcgtgtgtgtatgtgtgtgtgtgggtgttcagtcatgtctgactctttgcaatcttacagactatagcctgccagtctcttctgttcatgggattctccaggcaagcatactggagtggattgccacgccctcctccaggggatcttccccacccagggatggaacttgtgtctccggcattgcaggcagattcttcaccactgagccaccagggaagcctccaagcatcatcccaatttgtaaatttcccatatccagccccacccactgggctgcatctcggatcgcggaatgctgaaatggctctgaaactcctttctccatctccagtccagccttcctcctttctgtacgtggtccaggtctgcctctgaatagaacgtgataatgccttgagggtctccccctccctcctgccccagaactcatttgttgatttctgcctttcctcctcctcttgctttcttcctgtggaatggcttggttgctccttggagcccctgcagagtccatgtaacaattagagcagctctgatggaacatctggtgagaagaaacaggactcacttggggtgcaattaccagatgcaggaagtcttgctgggtttcttcatccaactaatacactgtgcccaggactccgaggcagagaggagcagagatcttaaggccggactgcttgggttggatttcttgtaacacgactgactagctgtgtgaattggggctactcattgaatctctctgctctcaacttcttgatctataaatcggaactagtaacagatcatgagagcaaccaaactaaagacagtgaaattggttaagtgattcttgcattaatccaagcaaaaaataatacggccaggattgagtcagtaatagagaggatgaaaataaggaggtagaatttgtaagttacttaaaggaggtcagttggcacaatgtggtgatcaaagtgaccattggggaggggctgcaagaagaagaggtggggtcagatgagaatgaaacaattcaaagtgtagtttctaattttatacctggggtagttgaataatagtgaagtgttagtagcttactcgtgctcagtcactcagtcatgtccaactctttgtgactccatggactgtagcccaccaggctcccctgtccatgggattctccaggcaagaatactggaatgggttgtcatttccttctccaggggatcttttcaacccagggatcaaaccccagtctcctgcattgctggcagattctttaccatatgatccaccagggatctgggtgttagtaaccaaggcagttgataaaagagattcatatttgctgtgtgtgtggcagggagtagtgtattcccagagttctgttgtaacgatgactatcttctttcatttttctcaccacattgtggttacaatcctcagatgaggaaactgtgtctgttaccttcctactcctcaaaccagc

SEQ ID NO: 48206 - DNA, 1752 bp, Bovine  19866881062010
tctatctgccttggggaggggccaggtcatggccacaagatataaaagatcaccaaagctcagtggtataaatcatgaagatattgacgctaagaagcctggaaatcagcttggaccaaacagagacatttttgaacatttgcagagatgctgtctgggaacagaactggggaaatgtgggcagatgcggaaactgacagttctctgtgtgacatttaattgccctacaccatatgcaagtagttgcagaaagtgtaaacttttggtgtgtggtgtgcatagacatattatggtgggttaatccagtctcttcttcttcctgatggagagtctcaattcttactccttctggccccagatcatttcataagagtcctgtaggtatcagatctacctgccttgaggagctgagcacagcgtctctgccctggtctgctgaccgcttaccctgccgctgcccttttttgtgtcctctgacgtcacagcctcctttgaatcctaggcttgcattagacttgtaacattacaggtgtgaaactgaaaatgtcaaaatgttctcactctctctccaaaagaatggtgagacagttagaaacgatgaattcctcagactgaaatgtctctcacttttcaaacactccttctagaattccaaagacaccgggggcctccctgggctccgctggctttcacagtgtaaatttccatgtttcggttgaaaggttgagcttttggataaaagtctgcaagaagacaaagtaactagtacttactcaaactctgttatgtgcctgaaacacactaaatattttctgcccgttagaaccctacaaagtaaggatgaggattgaactaacagaattgacaaaagtgaggatcacagaggctcagtaattcacccaggaccacacggctcaaatgcagaatccaaaacagttgactccaaagcataagtaagtcctttccaacataacctctggtaaaacgatacctaaatggtatagaagtgatgtattcagagtgatgcatacatgacatcgagcgcataatcttttcttcaaggtcttgttgttcagtcagtaagtcgtgtccgactctttgcaatcccatgaactgcagcacgccaggcttccctgtccttcactatctcctggagtttgttcaaactcatgttcactgagtcggtgatgccatccaaccatgtcatccttttgccttcaatctttcccagcatcagggtcttctccaatgagctggctcttcacatcggtggcttaggcacctaagctaatcttgtctgtgataagagacacccaagtgccaccttacagtatttgtcatgacaagaatactccggatcggggatcagtgaactccagccctgtaccacatctagcctgctcccatgttttgtcagcagagtttcatttcatgctacaacagcagaactgagtggttgtaacagagactgcacagtctgcagagcctagaaaacttactatctgtccctttacagaaaaagtttatcaacccccagactagaaacatcattccatcttccactatatgcgatttgaagccagaagataacaaggaagagagggagcagaatgatggaaaaccatcattaaaaacgcatggagtactgtgatggttaatttcatgtgccaactcaactggacgaaggaaggcccagacagttggtaaagcattgtttctgggtgtgtctaggacgggttttggaacagacca

SEQ ID NO: 48207 - DNA, 6537 bp, Bovine  19866881071767
ggatttcccggcagaatactggggtaggttgccatttcctccttcgggagacttcccgaccatcagcgtgattcatcatgaatttttttcttgtgtattttttttgcttttttgttttagtttttacatttttagagccaaggccacctccacacacctaatgagctggcctcacaattttgtattcctcattataatagcatttgttgctgtagtgatcccaattacttccttatacattatcacatttctctaactactgatttcttaattctcaaatttgatgtatttcagtattatccagggggatcaaaaaaagagaaaatgacacattcctgagatttattcctgagatttcagttcagaagatcttggacagattcaggtactgtgctttcctttttataaaattaaccaaaattattctgaggctcatgactcaagactgaactctgaaaaaatgtttatatgaaacttataatttattctttccagtgtattcctgagtcattagtaaattgttgtcctaaaaaaaaaagagagagagagagaacatcctgctatctacacagccacacaaccctcaaaattttgagcattaaaaagagctaagccttaaaatagaagagatttatcttctgaatgtgaagtttaaagacacctctctgcctctgggcctgtagatgctgagtgacccaaatttctctcacaactgaattgtcctaatgaaagggttcacagagaagagtcatatacttggatggccaatcagttgcacaacaccatcagaattttcaaagaatattagatggaatcccaggctatcatttgccaaagaaatcatgtaatatgattatgaatcagattggattacttatcaccatttagaaacacaaatcggggtggagagtggggtcatctcacaggtataggtttcttcatatttatttaccttataaaaagcattgggggtcaagtgggaagttgagatgtctcagtggctcatccagtgcccactaacagctccagtgaggttttcatttgtgaagctccagagagtatggaccagggaggctcaggagaatggtagcagaatggttacagtatcaatgggccatgctgattccaagagacatgagtcctgatgtccagtctctataaattaacaatagctatctttgttagactctttgctaaaaatttttattcattttctcatttgagtttcccaacacaattaccatggtccattttgcagctgaagaaaccatgttacagaagattaaatgatttgcctaatagtgcagagcttataagtggtaaaatggggatgtaaagcaggcaggttgacttagagactacaccaaactactaaaatattgtgtaaatgcttcacattttagagatctcagataactttatctatatacacctattatatacaggatacctatatgctatattctatatatatgctatattagatacaggtacctatattctgagtactgcataggactaacctatatttcaagtaaaacaaatcatgcaagaaaagcaaggtaaagttaaatgcctatagtgccctgacacataatatggaggatatgattccagttcaaaagtaagaagcatttaccttcaacccattatgtggaaatgctaatctaaaattgcaagatctcttaatgttgttttctgataaagtatgtgatatatttgaattttaaatatgaactaaaaagactgataaataaaaaaaatttttctctagaatactagcctgatttctatgcattatacaaatgtagccttattcatagaagtaggctttgtactagaagagaggaggaaatctcttagccaactaggatatctgaggtcttgtccctataatagatctgagtgtgagatatcttcaatgtatattttcttaacatcttcaattctagaccattctaaatcttcatattctatagaatatgagaaatcataatcttgatcttgagcaacttactttattgatatgattgaagatatggaaatcacataaataaaattgataaaattgatctgaaatttcttttgcaaaagctcatagaaagaacatactcctaccggctagaagcaattggaaataaaatattagaaaaaaattaaaccttctcaggcataattataagagaactgtaagaataaggtcactaaaactctaccagtagaaatatatttgagaaaattgtttaaaaagaagctagtattctaggtaaaggattttgtcagaatgcatagccatttgggagaggagactcaggaaattaaatgttttcaaatagccataggttgttttaatgcagagaagattcaaaattttcaaaattttcaaaaatggtagatctaagggttagagttagtattgattcaaagtcagcttttgcttctcaaaagtatcacatatagataagatctgtgccaagaaatagtgagttccttgtcactaaaaatatataaagcaagggctagaggaacaaacactgggactgctgaaggaggcatttgagcattaacaggtggggtgaatgtagtgtcggtttacaaacctgagtgctcatcagaatcaacaagaccttgaaacatggaattataagagagtctgattcactaggtctagagggagcctagagcttttaggagaagcaatggcttccgtggtggctcagatggtaaggaatctgcctccaatgcaggaaactcaggtttgatccctgggttgggaagattccatggagaaaggaatggctacccactccagtattcttgcctggagaatctcatggacagaggagcctggtgggctacagtttatggggtcacaaagagtcagatacgactgagcagcacaacacagcacggttgtgatggagtaggaaaatgactacatatgctgccaaatgcatgttgcattgtatttaagaagaaagttgcccctggaattagggattctgaaatagcagaagggaggtgactccgggaagatagtaacttggtagctttgtgagccatggctcatgtaaagtcttctgcctcaaccagaacagtcatgattacctgtctcccaacccaccctagagcactcagagcctcccatagcctatgaatgaaattaattcaaaggacaaaaattatgaagaaggaagctgcaaaagaagaatctttggggggaaaaaagattttccaaatgcaatgatatttatctgattaatgccttggctgcttgcctatatcttcactaagaggcacacagaattttctgaaaaggagctgattgagcaggaatgtggtgaatacataaagcatactcagtaacaaacgcagtcatggtgactagcttcagaggaggggcagtgctcatggcattacaaatttccatttctgatgcctcctcagctgtagaaagtcaacaagggcaacttatgatgatcagatggctctgtgaaactctttagtttcattttccctccaggagaggacaatggaaataagaaagactttttcttttcagtctaaagcagaacaaattttgctaaattaaaaataattctggataagtaaaggtcagtcagatcttacagctctttcttcattaacaacaaacaccaacatccagtattgttgcttcaagctctttgttttttttcttgttttttggagtttttttaatcaaatggaggttctggcagatgccatcagcagggctcatgttactttaccagaatcataaatggtcagctttgagtgcatgctcactcatgtctgactattttcagtgccacgaactgtagcctactaggctcctctgtccatgaaattttcctaggcaagaatactgaagtattctttactctaaggggatcttcctgacccagggatcaaacctgcatctcctccactggcaaacaggttctttaccactgagccacctggaaagccagccaagaaaaaagccaattttatatatgtatgtgaccaacctagacagcatattaaaaagcagagacattactttgtcaacaaaggtccgtctagtcaaggctatggtttttccagtggtcatgtatggatatgagagttggactataaagcaagctgagggccgaagtattgatgcttttgaactgtggtgttgggagaagactcttgagagtcccttggactgcaaggagatccaaccagtccatgctaaaggggatcagttgtgggtgttcattggaaggactgatgttgaagctgaaactccagtactttggccacctgatgcgaagagctgactcctttgaaaagaccctggtgctgggaaagattgagagcaggaggagaaggagacgacagagggtgagatggttggatggcatcaccgactcaatggacacgagtttgggtagactctggtagttggtgagggacagggaggcctggcgtgctgtgattcttggggttgcaaagagtcggacatgactgagcgactgaactgaactgatgtgtgtgtgtgtgtgtgtgtgtatgtatgtatgtatgtatatataggcttccctggtgtctcagacggtaaagaatctgcctgcaatgtgagagactcaggttcgatccctgggttgggaagatgcactggaaaaggggagtactgatggcagtactcttgcctggagaatccacatgggcagaggagcgtgtcaggctacagtccatgggatcacaaagagtcagactcagatgcaactgagtgacttacacatacacacacacatatatatacacagtcatataataatactataactatatatatatatatatactcacataatagcatatcatagggcttcccaggtggtgctagtggtaaagaatccgcctgttaatgcaggagatgtaagagacatgcatttgatccccgggtcgggaagagccctggagaagggaatggtaacccatgccagtactcttgcctgagaacttcatggtcagaggggcctggtgggctatagtccttgggatcacgaaaagttggacatgactgaagtgacagctcaaacacacacatatactcatataatagcattataactgtagttcaatgttttgaataatacttttacagtagagattgacctttctgaaaatagcaatgggacaattgtacaggatagttttgcttacccaggttcgatgttcttcagaaataagactgcaacaacaaaggaaatcagaaggcctctgacacatggtgacagttctctttatgaactggaccatgttgacataatctttgaagtgcagagtatctgtgagatatcaagagaaactatcttcagatcttgttaatgaatgtaatctggatggtatagaaaaagattagatagaaaaccaagttggagaccttttataatgatacagtaagagtgttgttgaaaaattaactgaggcatattaaaatttttaagattttatttgagcaaaaatctatttggattggacagtcccaaatcagaagaggttggaggtgctccactgacaggagctaggggagagactctatactccctagaaaagagacaaaagcaaatcaaggaaattatttgattggtggtagcttaagcagttactgtatttgagaaagccttcttggctgtgattggttgtctatagattttcatttcttcaccttgaggtattacagatgggttttggtttacttacgtaaggaaattgctgcctaaaaaaactcaagcaacctcagtctgatggtttccttgtttaaataatataagtatatcagttcagttcagttcagttcagtctctcagtcgtgtccgactctttgcgaccccatgaatcgcagcacaccaggcctccctgtccatcaccaactccccggagttcacagtagatatttgaaacttgcttcagataagatgtgtgccatggcatgtaaatagcatgtactcaattaatgtttgttaaactgatttgaatttggaatgtgagtagacacagaagttagaaatgattaccagatatagtgcgtgcattaggggtagacaaactacttcccagacgccagctgcctgtttttgtaaataacatttctttgggacacaggcatgcccctttgtttacatatggtctattgctgcttttgtgctacaggggcagagtttgagtagtcatagcagagaccatatgaccttccagtctacaagtctaaaatagttaccctaggggtcttcatgggatgtttgctgacatttattctgcatatttgtaatggtgatggtaagaaacacaagaagcggtttcaaagtgggtgaaaggtaatgagtttaattggatcagttggctctgcaaaaaactgctattgctgcaagtaagaaaaaaaatagaaaagacatcataacaaatagtgttgccagtgttatatcaacagatgatctttatatttaagaaatatgacattttatatttttaacatactggact

SEQ ID NO: 48208 - DNA, 1073 bp, Bovine  19866881081117
ctctttgctgggcttgctccgtgtaaccgtgtctctttagaaagatatgtcatttaaaattggacaactactttctgagtttctcagaaggtgcagaacaggtaggattctatcacacccttaatctagatcctacattatttctatgaatgcaatctaagtttgaattagcttgttttttcttttccctcctttgaagtcacataacatgctggttcaaagaaaaccctgaagtacttttcacataaaatattacactttctctcattcctgtgcagaagatcttttgaacccacacttattaacctatttatttctattataaatggatttctttgtgtgtcacccaagagtctgttctaagttttatggaacagatccaatgactctctgctgctcattgtattgttgctatttagttgctaaatcgtgtcccactgtcttgctaccccatggactgtagcctgctaggctcctctgtccttgggatttctcaggcaagattactggagtgggttgcgattgccttctccaggggaacttcctgatccagggatcaaactcacgtctcttgcattggcaggtgggttctctattacacgttttatggaacacatccaatgattctctgttgcttataggatactatatataattcccttgaataatgtaaactttgtctcatgacttgaattctggcatcaagacataaaactccccttcttcctacactttagctgttttgaactacaagcaggtcaccaaacatatactttgtcacatctctgggtcattggatttgctatttcttctgcgtagaatgtctttatgtcccatgtgtgcctggtgaatgctgttggggagaaaaaaatttcccttcttcccttctaggttctttgagtggtttaacaattaaattgacatagaacagatgaacagcagaaaaacaaatttaattttgtacatacaggagcctcatcaagacatgagaggctccctagcaatcaggtaattacgttttatatgccatcatgagctaaggagaaggggatagggatctgggctcccaaagg

SEQ ID NO: 48209 - DNA, 1329 bp, Bovine  19866881123749
ctcctttgacctctattcagatacagtcttccatcttatgatcagaatgatcctagggtactgattaattatttactcagttcatttatttacttgtgacccccatggactgtagcctgccaggctcctctgtccatggaattctccaggcaagaatgctggagtgggtagtcattcccttctccagggaatcttcccaacccagggattgaacctggatctcctgcattgtaggcggattctttactgtttgagccacaagggaagccccatttcacagatattatgtgaataacagggatgtcctttccccaagcacagacacatttgaaatgaagtcatcatctgtcttacccatggcctctttttttgccagatcccattttcccatcactccgaaaggaaatccaggtcgtctttgcttaatgccacgaagggatttaaacagcatgttttgatgccagccactatttctgctgctccaaaaactctcatttcttgtgcattgattttgaaggtgatggtatagacagcctgtcgagggagtttgcagcatccagatgtttcatcctcatccagttaccagagtttttgggattgtgagattacaaggcaatgttggggaagacacgatgaacacctgccacgtagatggatcatattgcactgcatagagtcctagttcccagttgatcctaacagattaataacacattcccactgcactaacacattcccactgcactcttgctctgtgagggctctgtcatgaccaggtctcagagaatgcaagagggagttgaaatggctgaggaaggaagaaggattagttctgttcttgtgcttcaggcaaccacaataatccattgtcctcactggtatctgagctatcatccgacagcattctttcatttcgcgaattttactgagcatcagccatgtatcaagggctgtgctaatcctggcgatgcaaagataactgggagaaaaagatgctgcagcagctgctttcaggaaggtgacagtttagtggctgagatggacacttatcaaattttatgagcaaatgtgaaactacaactgtgtaagtgaaataaaagagaaaggcatggggcttaatagcacctggaacggggaagttgacttaccaaagagctcaggaaaggcttctggaaggaagtgcccattaaactgagagttcaataggcaaagtgttagtgaaagagcttttctagtagcaagaaaagcaggtacaaaggtcctggggtgagaaggaatgatgacacccaaagaactgatcaaggacagtggaggtggagccaggaggag

SEQ ID NO: 48210 - DNA, 1450 bp, Bovine  19866881141302
cccatggactgtagcccaccaggctcctctgtccgcacaactttccatggaaaggatacaggagtgggttgccatttcctcctccaggggatcttccccccacctagggattgaacccacatctcttgtgtctccggcaatggcaggtgggttctttaccaatcacgccacctggggagatcctgaaagtcatgtggcacagccacaaaaaaaaaaaaaaaaaaaaaaaattggggaaagggtggtgtaaaaccacagacttgctagcccctggaagtcagccgaaggctctgtttgtttcaaggtcaagaccatgacacctcgtcctcccctacccttcccagctcctctgccagctccatctgagcctgaggatctcccccatcaggtgtggggttgagagcccacagagagaggggaccacgagccctcactgtcctcgctgtgcaggggatgagggctcccttctccccggttgtcccatctcctggggaccctgacacagagagctgtgcagaaagaggtaaatttcacttgctgctcgtggttttgggcgcaaaacctggcctgtgagtctggtctagctgcatctagggaaaactcctgtgttctgtttgctgcacgctaagtcgctttagtcgtgttcgactctttgtgaccccatggactgtagcccactaggctcctctgtccatgggattctccaggccagaatactggagtgggtagccattcccttctccaggggatcttcctgatccagggattgaacctgagtctccagcattgcaggcagattctttatcatctgagccaccagggaagcccgggaacggcctaagtcgggcttaaacagtgtcagcaaatctgtcgtttttgaatttaaaaatgtttcttgactgtgctgtgtggcatgtgggatcttagtcccctgaccaaggatcaaacctgtaccccctgcagtggaagctcagagtcttaactgctggggaagtcccagcagatgtctcatttttggattccactgcctctgaggtagctggttgctttctgaaaatctgtcccttgtgcatggcaatgggtgccagcccagtcttctcagcccaaatgcagtaggaaaatgcgccatctttgtcccaaaagtgtctgctgatgcctcattccctcttatggggtcgcacacagacatcctgccaccagcccttgttgtcagagggggtgtgaggcttgaggtacgtgcctctttggagcagaggcgggctgcttctcctgggggcacggaggatgagacgcgggcattttcccaaagcagaaccaggatacggttatcaaggaaaggaaatggatgctggtgccaaaacaacagatgtctgtttcaagattcttctgttcagacataatcttttgccgaagcacaacagaataaaacagatacaggtggagtgttccg

SEQ ID NO: 48211 - DNA, 903 bp, Bovine  19866881350331
acaaaaacttctgcccagtttttgactgggttgtttgtctctctccccacttctgttcatcttggtattgtgctcattttaaggtaattgaagagcatataatggcggggactttatattttccctgtaattttgctgactttgccattttagcaaaaaataatttattctaatgtgatttgcattgcataaaattataataaatgtttttaaaaacaaggtactgtatatttatgaaatcgctgtatttatatgaggaaaaattttaaatgtattggcatgtattttccacaaacacttatatgcaaagctatatactctgcagctttgacattaacatatagtatttgcataaaccataaacagtgggcaatttctttgtcaaacaaaaagtactgattaccttagaaaggatattaatatcttttctttatccatatttttaaaattttgctgactgtattttgatgatcattcatcttgtgtgatagcacaatctgtagcaaagactctctcagtattttccaaaacaaaaaaataagaaacaggaaaggcagcagcttctgcctgtgaatggtctgatacagtaattttgactgatagcagagagcctttcttcagttgaagttcacagctgttagacccttgcaaacgcaaggtggacatctgattgacagaggggtactggtaaatatattttcaaattaaatttcatgtttattttctgtcatccttaatagctgtccagttggaattttggtccactgaaactagctagtttcctttggtggggggaaaaaaaggttgttcaaataactctttgtgtgtttccccttaatggcttgggatctttgggactaatttcaactgaattgatagaaaggaataaaactgagattgcat

SEQ ID NO: 48212 - DNA, 2009 bp, Bovine  19866881421627
tgattcagatatgctttcagccctggtgggaaaaatctgtgacacaaaagagtcaggaatggcctgttaagacctactttgccctttaattatccatatcaagtcttgtcaacaatgaacactaggcggatggatagctgacttctttctctcactcagtcaaatagctttgctcgctcttaaatattttttaattggaggataattgctttaggatgttatgttggtttctgctatacaacaacgtgaatcagccataaatgcacacacacacacacacacatatatatatatatgccttcctaggtagcaccgttggtaaaagaatccgcctgccaatgcagaaaatacaagagatgcaggttcaatcccagggtcaggaagatcccctagaggaggaaatggcaacccattttagtagtcttgtctggagaatcccacagacagaggagcttggtgggctacagaccatggggtcgcaaagagttggacacaactgagcgtgtgcacgtgtgtgcgcgtgacacacacacacacacacataccctccttcttgagcctccggtccattccctacccccctaccataatcccacccctataggtcatcacagagcaccaggctggcctccctgtgctatatagcagcttcccactagctagctattttacacatggtatggaggagccttgtagcctgcagtccatggggtcgctaagagtcggacacgactgagcaacttcactttcacttttcacttgcatgcattggagaaggaaatggcaaccccactccagagttcttgcctggagaatcccagggacgggggagccttgtgagctgccgtctttggggtcacgcagagtcggacacgactgaagcgacttagcagcatcagcagtgtatgtacattaatgtaactttctcagtttgacccagcctttccttccctcactgtgtccacatatcccttctctatatctgagtctctattcctgtcctgtaaaaaggttcataagtaccatttttctcggttccatacatagcgttaatatacaatatttgtttttctctttctgacttaacttcactcttcttgatggatacactgggtttcatagtcacggttctcttcttgcacaattcattctcacttcaaaatcactcacactctcaattcatgccatgcacacagaccaccttcttccttctcttgctttttatttccagaaatctcttttattcttttctaatcatgtgccctttcttagcaactttttcaatatccctgctgctggttttctatttatcagatacgatggtttcaataatatttgtaaaccatctccacaccaagtcaaagcatgggaagtacagtgtaggctgagaggtaccatgaggatcagggtaaacaggatcacatcatcagccagcggtagactcgctttcgtggtatctactgagaatttttaagttcagtatttgttaatagagaagcttccaattacatctgccttcttggatttattttttgctaaattcactaccatgtattcatatttcactttgtaattacaaaaccagaaaacaatagaacatgaagatgtgttttaattgtgttatttactggtgggctgaatgaattgcattttggtacatgtctatagtcttatgaaaaatgtgttgggtttgtttacttgtttggatctaaacatggctggagaatcctttgtgtccagagcaacaaccaatcattgttttttatataaaagcagactatatttaattgggtactctgccaggttctggtccctagttagaagttcaaaccctgtggaacaatgtattccagaaaaccaagagtcaaattgaaatacctcaagtatagggaatataaaaggactggaatgaataattgaagttcaacatagtatgcattgagaatatgtgattatatagacaaagatggaaaatacatgtaatagcaaagaagatatatttttaaaat

SEQ ID NO: 48213 - DNA, 1118 bp, Bovine  19866881430595
gtgtgctggtcaacagaaaaccagatgtccttttggttgctatctttttacagcaacataagatgtcttgattgtccctttcatcctgataactcattggaatatgagcggtgtaagggagacagttaagaaaagactcttgtccagaattccttaaatatatgaaaaatctttgtgggaagccctctgttgcaaatattggaccgaaaggtttggttattacaacagaaatttccaactggcttagtattcctcttgccattttgagaagcaatcgtctatgacccagaagtctccctacatggtatggttctgtcaagtcagcatgacatctcaactgttccattagagtgttttgataggttacattaaataactttcatattttattttactcccaatatcaaatacattgttggtcatcatgtagcttctagcctagccagtgccttcgtgtaaatagttctcagatgctatcacattgtaatgataaagataatggaatgtcagcttcctcgaagagaaaagtgctttttttccataaagggcatttttaaatgggtcattaactcattttatgagtaccttaatgctttgagcacggtgaggaaataatgtatcaacctactgaggccaaaattgattcagaaaaggatttcatcacctagggaatatcctcttattttagatactacacaccctaatgtcctggatcaaataaacaatgcagagtttttatggttacaggcagcacccatgtaaatattacacacgggtgagcttgtggtgctgctcccaatccataggccatccgtggccaagcaggcgttctgtcctagacagaagagtctaatcgtttgccaaataaaacccactgtttacttctcctaacattttattccttcacatttaatttgagaccagggttactcccgggtagcatcttgtatctttagattagctttcacaagtgggtctgaatcgtcctctcgtctgtgagtttctcatgaaggtggcgtagtgctcattaggacctgccttagtgggtgataagcagaacatgcatgcaatgtgtttttcccattcttacagctgaaagtatagtcttaaacccagag

SEQ ID NO: 48214 - DNA, 987 bp, Bovine  19866881750871
tcaggggacaggggtgaggaccagttcatttcatgaaagcccctggcagccaaatttgtctaagccctttcacttcatggggcttccctggtggctcagctggtgaagaagtcgcctgcgatgtgggaggcctggattcaatccctgggttgggaagatcccctggagaagggaaaggctacccaccccagtattctggcctggaaaattgcatggactgtagagtccatagggtcgcacggagtcggacacgactgagcgactttcacttttcactttatgaccaagacttttcactcctttttgtgtgttttcatatcctttcatctgtcagtacaaattaaaacacattttggagtaaggaacttaactgaaacttgactctttagagagtcaaagttaaaaaaaagtaaactgaaaaaggagtcagcatatagaacattatgggaatgtatttgagatttgttcagtgtttattagacatgtaaaattatgatgaaattggccttcgacaaatcagttttgttttgttttcttagtctttaggtgtcagagactgagagcaaagaatagatggatgaatggatagacacccgaaagggaatggaattttggggggtgatctgagtccagatgaagtggttttttgggtgtagaagaggaggagatctttcttggtatccagcacccagacaggagtctcctgggccttgttatgcacgtggggctcttttgttgtgtaggaaggacttgttgtggctggtagaagcttcatctttggcctcaggagggtggcctcccggcttcctaggtggtcttcactgggttgccttcctgggcttcactgggttgatgaaggactagccagagaaggggactgtgaaccagagaatggtgatccccagggtgggggctgtgagtgcaacagcaaagtcaagggcactggaacgagacagatttgagttgaatctaatctctgtctcttca

SEQ ID NO: 48215 - DNA, 1011 bp, Bovine  19866881824497
ctactgacaataggtcctactgacccatggtcctgatggataaaagctcctattgaaccctatctcctattgacctatggcctctgctgactcatgactcttgccaactctcggtttctatagatccacagttcttcctgacccatggcttctgttgacactttgcttctatttttccatggatcctgcagaactatgatttctgatgaccctgactcttggcccctattcacttaggtcctttgctgacctatgccctttgctgaaacataggtcctgctgaccagtgccttctgttaacccatgacttgtagtgggaagatccaacccttcagaagattcagggtttcagaaaactagatctcagttcagggtaggcctggaatttcaacaaagatctgtagccctgattatggaaactgcccagtggtgcatgacccctgtacaagcattttgcgccctccccaaccctcctcaattaactccactgcccattttcaatcataagctatctgaaagagaccatgaaaaatcttccagttctaggctagtgaaactgggctaatttttgcagaaaatctctaattcaacttctttaaagcctgctttctctgtgaagccccagagaaccagcttatgcagtgtgtgagcactccaaaaaagtttatcttctattttaaaagaaataagttccttaagtggaaatactacctgaataggaaacattaaaaaagaaagacagaaagaaacacagatttataggatttcagggatgagagaacacttaaactttgaatccttcctcttttgtatgaatgtctttacaagatcctaagaacaacccagtctctccttgaatgcctccagtgaacacaagctcattaattctggaactagaccattccatttttgcatagttttattatgacaaaaatttcttaccctgattccaatatctttctccctgttgttaattcagccctatgggccaatgggttttgggagggaggg

SEQ ID NO: 48216 - DNA, 701 bp, Bovine  19866882157539
ttctacgacagtggcagtgatggctgtcagaggactgctgcaggggaatagctgtgggctcacacgagacccctgccagctgcggggcagaacagtggaccggaaaagagactgagattctccatagctgtgagaatcagcttttattacctttgagtaagttctctttttccttaatgaagacagccttcaaattatagcaaaaaccaatgcgagtcacttatttagacatttatttcacatacaagttttcaagaagacatctaagtgaacattcacacaaaacaatgagtggacatacatttatactaggaatgcattcagaggtaagggcttagcattgcacttggggtgtccccggctccctcagagttgaggcttgtctgtcatggggcaccagggtccccaaattggctttcttcactgcagctacctgccactgtctgtcgcctgctgttgaacatgagtgatttgtcccttctcctcactgagcatgctcctggactgctcacagcaacctcttgctgaagtatgggatgggctcatgggatggatttagtatggcctgaacgctgcctgcggtggtgagccagggtggcggcctggtcttataacttctctcttctgatgccccacagcctcataggagctgggagtggtcttggcaatcatgctcaacttctcttcagataaggaactca

SEQ ID NO: 48217 - DNA, 3352 bp, Bovine  19866880145642
attgccctcacatcctaccacttactcctgattcccattgtttcagttagctgggaaaaaaaaaaaaaaaaaggatgcctgatacggttctgcccttcctctgaagattttgatatgtggattgtccacttttcagaacaaacctgtgtcttttcctcacacaatctggtaaatattataatatttaagcatcacaagggcattgatgcatagctgaactctggactggccaaccaagactcacaaggagcaggtttcaggaaaccaagatgatgggtcctcagccacctgaaaaaatatgcagcaactcaggttacatctggaattcattgggtatttttctctgtctcttcctggccagttttctcaccactctacccatgaaaatgcagctatctgggtgagttcgtgcacatactctgattcagtttttcaaggagcaaatattgatcactgccatagttcaaagcagggcctcgagtgttaaggtgggagtgggggtctttcagggcagtaggggagaagtgggaggagcccccttagcagctgggattcttgaactcccaggtaatgcagagaatgcaatgatttatgaagtgtactttaccaagtaacagtaaaattgtgtgataccatttagaccatactgtatttctccaaacatagtgattgcattttttaccttaacagttactctgcagtctataaaatatttacgttacctttctaaacatatacattatttactgtacagtctgtaaaatatttatgtgcctttctctaaagatactgtatatggtatagtatttttattcttttttccccttcctgaaccatgcacgcagtgaactgggacacttttgaaatcaaggacagtggcaggaaagaagacacaatgccacagaaagaagagatggggtctttgttcttgttggtcttattctcatgggcccaagtgctgtagacctctgttggcagagaaaataagatatcaggtgctttgggttcaacgtgaaggactaaaatggaaagtcaatatacatccatacaaatttcaaagaaaggaaggatcgcatctgtgtgtattcacacaaacacatacaggaacacacacacacatgctcctaagacataaaatgagttgttcatctggcttgattgcctagagtagagactttttcctctctaattgggctaaataattgttattctctttcctcacttggttgagtcctgagaaatttccctgtgatgaaggaaaaatgtgaatgggagaaccgaggcatttattgaggaagtgcggcctgataaacactaccactatctccaaatctttaataaaatttatacaacattccgagtgaaagaatttgactgaatttcccaaagatcaaatttttcaaataattgttaaactcttcacatcatttggaatatatactctgatacagagcctatgtttatgggttgccaataatcaagtgaaaaattaagaaaaaacatagtcagtcatgagaatgttttgtcttcatgatagtaatttagtttgaagttatccagttaggatccagacttgtttcattctttggaacgcacagtatcactagttctctgtattatagagaaaatgggcttcacatgcagaaacacaggatggagggggatggggtggaactcattaaaaaccatttaatgctaaactaaatgtcggcatactttgaaagaggcctattagttaatgtacacaagaagatatcagtatttatgataagccaaagaaaccaaacagtgaaacccattacatagtgcttataagacacttgagttttaagcaatgttttagataaattagattggaattgacagaaagaaaaatagctcttatggggaaggatttttatttagaccccttacctggagccaaaaatcctgagttttgactgattctgaatgactaacttgtctgcaatgaatgggtgacctcatagcagacagataaaacataattacattacaactagagggtactttttgttgttgtttttatggatataatagacaagatcctcaccaacacataaataatgctattgtttccaaaggctgcaatttaaaacctccctttcttagtatagtcagttagcattaaagtaaaaaagcagttctggtacatacttccgataatctggcttgatctaagaataacattaagaactttcagagtaatattaattctctcaaaggggcctgcagtaaatacaaggatgtaatctctggcaatgttctatggtgacagttgagagaagagaagcataagatctgatagtcagttgaaaaggacatggataaggaaaattagtgggtctacccccaaaacaggacagagtggatgatcactccacatcagagaaatatctgtagaaaggcccaacatttttataaatgaataatacagactatagtaataggccctattacgttatcataaaacattttagatgtaaaatattaaaacggatatgattaccagctatcatcagtggaggggaaaaaaagtgatacttaggcatatgtcaaattttaatcaatttagatatttgtgaggcctctattattaactaattgaaaactgtgcctttgggtaattgaatgatttgacctcatataaaacttttggataaaagccaattaaatgccagagaatgtatttgaagctgataatttcagttttagtgtacttaatcttaaatgattctttctgctaataattagatagcagaacctgttttgtttagtaaggtcactgttagaccatagtaacaaaaaacatgttactggtttcaggaagaatcttagtcattttgcatctcaattagcaggaaactatttacttagatcatccaaaagtcaaatcaaattatcaggataagttaaaggaaggggatccaaaatgaaagtattaaatttatatcttttagttttttgtctcaatttttatgactttcatctaaactctagtagttaaataacacaataatagctaaatattttatgaatttctattatttatcagtactactctacattgtctataaatcaaaagtgaagttgctcagtcgtgtccgactttttgcgaccccacgaagcctaccaggcttctccatccacgggattttccaggcaagagtactggagtgggttgccatttccttctccaggggctcttctgacccagggatcgaatcctggttccccacattgctggtagatgctttaccctctgagccaccagggaagcccacataggcatacatttatttaattctcaaaataattctaggaggcagttacc

SEQ ID NO: 48218 - DNA, 1931 bp, Bovine  19866880503924
tataagaatgttaaatatatgaggaaaacttatttaaatcaagttgaataaaactaagtaaacccaaatagtagaagaaaagtggggaactgctaactaaattcctttttagaaaagtactcaacatctgattgaaataggtaaattatatgaccaactctgaacccagacagccttaggaaggcctcgtgcctcttctatttattagcaatatgtcattgagagcaagttgcgttacttttctatgctgcagttttgttatctgtaatagaagggcagttttattttttttttcaaaataaaaatttttaaaacattaaaaccgactttatatggtaagtacatttccccatggctggaatgcagtaggtgcttaataaattttatcttttattcctagcatcttgaaaacttaactcttctcaacaacctccctaaaactagttcagcaaaaaagaatttctgctccgaaagttaaacttcatggttcaagatgacatgttgcacactggtttccaactgaacagctctcatcccacggccatcaaggggcatgtcacagctaattatctgtcatcacgccctgttgcataggcagtaccctgcctgctgctgctgggacctcggtgctgtctgttgattcatttgcatcgcctcctgagtgtctctgctctgtacggatcacacagaatgaagcccaggggccaactagcaggcccatctgaattgtggaacatatctaaagcccctcctcattacttagtgagtaatgtgggggatgttcgctggttcacacaccctggcaatgcaaacggtcatctgctgcctcatctgcttttctgcgtctggggtgcaggaccagatcggctgaggaactttgctagcacttatgcaaatagctatgggagttcctgggtttggcaacatttcctttccgaagcctcatttgcgcctgcaccgtctgcctcttttgtgcttccacgtttttgtgaggagacctcagaatacatctctcccatattcatgttgtatttatgtcaatacatttaatccaccctgtttaatgactgttgatgtgtctgtttaaaccctaaaagaacatatttttaagatacaatcagattacatataactaattttccaaattaaggagagtgtattttccaatttaaagtacataaataaaatgttaatatgtgtatagacatacagcaatgagtccgaaactgttaggcatgcacatgtaatatcttaatttcgtaccaatactgtattcttcaaaatacattacatcatacatacttaaaaaaaaaaaaaaacaaatttgattcaaattttttaaattattttcaaccaacttcatagtacgactatggaatcagcaacagcacattaataaatgacaaagatacaatttaatcttgatacaaattcttattccattagtgaagtttctcaacttttcttcttttctccatgttgtgttataatttttaaaaacttttataaattttataatttaggagatactcctatagaaactaaattcaaaatttgcttaaacaagaaagaaaaactaaagatttagaaataagccaccactgtagaggagcttgatccataatacaaggaactgggaaaagctctgcatatatgatacttaaaactgatttcctctaggtggcagtatagtcccagaacttaaaccttaactgtaatgaaaaactaagagctccaaaaaataattgcttattaccagtccatgctatttatacatttgaaagattttttttcttttgaaaactaagctaaatttacaactgtgaatgttcatctgcagatgacatagtggattttgtactagaaagaataaaatgtggttatatttcagcacacatacatgttttccatatctttgtggcactgtaaga

SEQ ID NO: 48219 - DNA, 710 bp, Bovine  19866880597000
tgtttccccaaggcctaatatattgaaaagtaaaatcctaaaagttaaagttagggttactgtattatttgtaatataattttctggacccagactactttattatatacatcctttatctgactgcattatatatgaactgtatttgccttttgtccgtttaaatgcctaaggaatctaggacttccctggtggttcagatggtaaagaatccacctgcaatgcaggagacctgagtttgatccctgggtagggaagatcccctggagaagggaatggcaaaacacttggtattctggcctgaagaatttcatggacagaggagtctggtaggctaccgtccatggagttgcaaagagtcagacacaactgagcgactagctaggagtctaagaatggtcattaaactatggggaactttaagagactgggtttcttccccagttggattctgttcacagagaaagaaagagagcctcttatttattatcattttaaaaaatccagtatctaatgaagtgggaacattgttgaactcagatgacaaattttaaaagaatgcctcagtcacaaaaacagagtgatgtgatctaagcttcacacattccacccttagaacacttcctggtatgagacagtgttttagagcaaaagtacagtctctaagactgtgtatgttgtgagtaatgtcactctttaatctgctgctg

SEQ ID NO: 48220 - DNA, 986 bp, Bovine  19866880803465
ccattccaatcttttttcccacttagatacctaatatttccccctctggtggtagaccctctgtgacggcatttactccactgtagcctatcattcagcctggcgtgctgcagtccacggggtcacaaaggcttggagacaacttagcaactgagcaaccatggtaacatacccagaagggtaatataggatctacctgggaggagggagtcatgtcttatataaaataagactgcttagcagccttgagtttataatgcttaaaaagtcactcaacaaatattaaagcaattaaattggcggcacttgaattttttaatagcttagtagttaaccgcagtataaagagggatgagtgcacagcctgcacacttctcatgcacaaaataaggaaattattgatcatcacactccttaaatcttgcctatgaagggaaacaatgccaggaattgcttcctcggaaccatggtatgcccaacaatgatgtctcagtgccagaaatgctaatttaccagggctcgatcatcaattgttgaagcccttctcttaggagtaatgtcactgcatggcaagttggcaattatttgaggagttatttcaataactgcacagctctttgtctgattaatgaaactgccaatggatttacaactcctgttacggaaatgtatcactggagatttgctgaatgttgtgccataaattccagacacctgagaaattacgacagaatttgattagaatggctactttcatcttccttttttcactaaattcatttctcattaactactgctaccactgtatggactacgagagggctatttatgacaaaatattctgtttgctaaagccattctttctatccctgtccacactatctaaatttccttgcagatcgtatttaaacatgccaatgtagattcaatgcattgaatagggataatgtcaagtagggataatgtcaaagaaaaaagtttccttg

SEQ ID NO: 48221 - DNA, 1450 bp, Bovine  19866880907775
ttttatttcaattataataattattcctttaacttactgggaagaacaaataaaattttgtaatgatcctcttagaataatttctagagctctttcttggactttatcaaatggcagaatttcagaaagcataaccttagtattctacaagacttataaagatattactttacccctatccatttacatctcctgcccccaaatttcttgagtatcttaacaatacttgatatgatctctgctgctgctgctgctgctgctaagtcacttcagtcgtgtccgactctgtgcgaccccatagatggcagcccaccaggctcccccgtccctgggattgtccaggcaagaacactggagtgggttgccatttccttctccaatgcatgaaagtgaaaagtgaaagtgaagtcgctcagtcgtgtccaactcttagcgaccccatggactgcagcctaccaggctcctccatccatgggattttccaggcaagagtactggagtggggtgccattgccttctcagacttgccttaatagaataggcatatgtgggttgtccccaattctagttgtggatctgccatgggaaggtcttattgcacatctgagattgagctgtttgcattgttctaaacaggaaatgatgagatacaaactccttagttaaccactcaggagtaaaatgcatgttttaagttgaggacatgtttaaaaatcaaaaagcagatttgaatcagaaagatggcattcccagaggtaccttccggaatgctatgatgtgacagtcccactaggcagcaccctccagggtgattcagggtcaaagatgtgggctgacagttggtggaactgtgtctggaccatgaagaaaaatcaatgaatgagctccaagcacaaacgcaactctccagttaaacatacacaagatctttttcaatattaagcaaaacacatggacatttagtttacttcattataaacccccaaatcacagcagcattaatgtcgaagtggtgcctgagggcccattcaaagcaagcccggaaaacacttcttgagcaaaaaggcaactctcaacacagggtatcagagttttaccatctcattgttcatcttatgctcattttggcattaaataagaagcaaattacagattgaatacttccgctaagacaattttttcccttgaagaacctaactagttgacaacaaatgaaaatgtgtgtgtgtgtgtaactcactcattaggtgcagaaatggttgatggattttcattgttcatttagaagccataggtaatgctgggtcaccacacaccataaaatgtcttaagttcctttgccacagtgcgctacagagcccttatatttatctgaccccacagcagtggggatctgggccagaggactgtagagggtttcagagcagcttccttctgtgcatccactgtg

SEQ ID NO: 48222 - DNA, 1167 bp, Bovine  19866880947515
aatgtttcagatatcatgatgacattttttatggcacaatgtttaaaggaatgtctttatattcattatatcaaaactctatgacattgttgaaagcaatgaaattatttatttcaaaatgtgatatatataaaatatttcacccaggatatattcttttttaaacaattttttttaacaattttttaaacaattaatgatggactatggagcttgtttttctacacaaaatatttttcttcaatgtaaaagagcaaagctcaattggtctgtgtagtataacttgttggaatgtgtagacaatcctaagttcaaaccataatatggctctgacaatataaaaattctatgagaagcaaatggctaatcagttctgatccaaacgttgatgacatactatgctacaattagcatgacctcttccgtttataatgaagatgaaaaacacaggaaaatatttataattctgcatgaatgagaatttaaaattataactgttatattcacaaccactaagaataactatacatatgtaaatatacaacacctggaatagaataaattctaatcataatagctgcattaagtttgaaaccttttggggtagttaaaaaataatatttaaaagaatttttacataaacgtgaaaaactcatgaaaatagaacttaatatttaaaacattagtctcagtaaattcagtaattatacatgaggatgcacttaatttctgaaattactttttatacttattaatgatctgttgactacatttcatttatcccaatcacataattccttgtcttcctcctgtgaaattcagagaagtaaagtaaggtgagtggaatgatttaaagaaataagataagcagagatcttatcatgactcctttgggaatatataaggtaataaaactccacaaggttgtttttactggcaaatattcaaataccagccattgacttagagcttcactggtcaaaagttagcaaggcaagctgctgtgcaatgtctgcgagcaaaaggccctaagctgagtagggcaattgccaggctctgcccagttttattagggctgctttaaagatctagtaacaagatcctaattagctttccttattttcccccaggtattcataacacagaggccaagttcaaaatcagaga

SEQ ID NO: 48223 - DNA, 684 bp, Bovine  19866880948633
attaaaagtattcacaagccttgtttccattcaagtgaaagatatacaaattgtgtatgagacagaaagtaaggaaagggaaggaacttttagaaaatgagaagtcagcgacttggaattctaaattctttggaaaagtaaattattaatttctttgaatggtaccagttatgtgtgcgttagtttgtatttaatttctttcattcactgaaataaagactaaaaagacaggtgtgccattaccaaagcattaatgcaattcttcagcagtccttcccaggtgtgagggttttccacccataaaagattgtgactgattaaaaatctcaaatcttctgatttgggcaaagactgtctgtagaaataaaatcctaattacactagctaaaattatttcaaggcagctcacatttatacttcttttgacttaggcagtgacatgattcagctctgtgtttagtgctcagtactgaaatagggtcaagaataatttcccccagaagcctgattgcagtctaagactctggttagctctgtgtcagaggtcttctttctcttaggatgtaaccagccagtaccctttatgttggtatctatggtgggatttggtttccttgttatatttgggagttggcagaggagtcgagcggcaacaccactgtagctggtgattgggattccaat

SEQ ID NO: 48224 - DNA, 1323 bp, Bovine  19866880971894
tgttctaggttaatagctctttttgcttcctctgtctttctctcttttgtaggaagaagaagaaactttctttcctgacttacagtcagccttagaaatgttgaatcattgcctaggtgcatgaactcagttctgagcagctttaatttccagcagccaacatttctataatataagctctctaaaggaggcccacagaagaaccagaaatctgaggttgtgtagaaattttaatgagaatggaaaatctccacgtttaggcgtctatccttgcatattaatatcattacatttaaagggtgtttgatttcaaacattgaattaattaaaggaacttccaggtcgagttataaggccaaatcaaatgccaacagctccctctactggctactggaggaaattatttgatctctggctgaaattccaatcctttggccacctgatgcaaagagctgactcatttgacaagaccctgatgctgggaaagattgagggcaggaggagaaggggacgacagaggatgagatggttggatggcatcaccgactcaatggacatgggtttgggtggtctctgggagttggtgatggacagggaggcctggcgtgctgcggttcatggggtcgcaaagagtcggactgagcgactgaactgaactgaactgaatgaaaacttgctgtttatttgaaaagcgtcttcatcaaattaagttctttggaaaacattgaagcttctggggaaagatgaaagacgttcatatgtggtgatagaaagaaaaacactaagaattacagaaattgatagtcatgtgaattttctactatcaacaaagagttcctgtctccactaaaaatcatctgctcattctcttgccctaggccatctattatatagacttcggattacagttaaaatattattaaggctacctttagattttcattttcccaaatctaacacaaatattacatttattttctggaagttgaaaaatcttagtataagtagccattttttccacattatttgtcacttgatgagttctacaaaaagaaagaaagaaagaaaacaagaactacctttattgttatttcattaagaatagaaagatcacttttaagttgcatgccattcggaagcaataatgttggtttcttttatttaaactttaaaatttggtataataaagaatctaattgggacaacaaaagtaaaacatgtaaaaaataagctacattttcctcccaaactctgtgcctcaaccttcctgaagagtgccatcctctcccacctgaaacaatcgatctattttggtttcactca

SEQ ID NO: 48225 - DNA, 1114 bp, Bovine  19866881072047
tatttgcaaaagttgataagccggggatgaggaaaccttctaagattttgccaggtacctggagattttcaaaatacctaaactgaaggttaaaaagcatcaatgtttcagcggctaggttagatcctcatcagagaggtttggatttcttggaggattttcctaaccactttgcaatttccttcagtccactcactaaccttgaatcagacaatgtgtctgcacttaatggtcctttgacacacatatgctctacatttgagctggaaaggctataaatattttttccttgtcttgagccaaatatcttgcctactgtggatagctacagggtatttaaaacaataacaaaaatgttcatgtatttaactgagatatagcatgttaaaatatttacagttaatacaacaatgcttctgtacttgttttatgaacttggcctcaaaagagtaaggggaacaaagtgttaaacatgcatgagctattattgtatttgtctccctcaacaaggagtaatattgactataggacttgagaaactataactaatcccatgtctaagaagaaaaatctctacttatgtagaggccatgttcaaatgacccaaatgtcctcagaccccataaatcatgagataaaatgagtgaaaattaagtactattaacaatcactacctacatctcactactctttggccttttctggcctcaccacacagcctcagtatcccatcacccacccccaccaatgtccagtgtcctttttcctcttaagagcttccttattttttcatcacaggcttttttctccaatgtagcagaatataaggtcactgagaattcccacagtttgtattttacagactcaagaacacagacagactagaccaccaatctcctgagccaaagtgaaaaccctaaagggacagatgaactggtctaatacaaccaatccctgggtcagttaactgcagccagggggctgagccacactggacataggctgcttttgtttctgcggcagcctgtggaaagtgaataacattttaataacagtagaacatctttcctagtgaaaaaatagcagcttaagttttcatccttacatccattta

SEQ ID NO: 48226 - DNA, 3434 bp, Bovine  19866881271007
gttaggatttgaatttagggggtgtggttccaaagtcgattttaactgtcttccaagatgaagacggtgtgggtataagaataaaagaagtcatcttagggtactttgaataaattttcaggaaaaatttgaagagacttccaggatggccagtaatatagcagacataggaatttagtctggcaaagccatctaggggccaatgatagatggataaaatgaagaagatttctagaggctcagaaatagctggcttcatataagaatagaagaaatgaaattggccattcaaccagtgctacaaggacaaattgctgatgtaaacatgatgactcatctagagacgggggatgtctggggttagtccagaacaattacttagaccaagttggttttatagattatgtaatggcagcctatacatttaaaaaaaatgctagctcattgttttctataatatattaaattggatgaactaaatgggcgaagtaattgatttggcagaaattaaactacatgtaatttcttcaagatcatacactgtatttaattatttctatatcatccattgtgcctagaataggattttcacatttttcatatcagaattgctgagttcatatgggatttacagtgcaattaaaatagtaatgggtgggtgcaacatattaggacaaaaatagtcgatatttattaaatctttactatgtgttaggccttcctctaaatgcttgatggccattaagtcctttacaagatcttatttgggaagatgttattcccattttaaaataagaaaatcgagactcttagaagttatacaacaggttcacggtggaataagtggtaaagctgcaactcaaataaatttatatgcctctagaaccaaaggtaatatattatccaccatactagagacagaccaagagagactgagacagagaactgaacatttgtacctgtatgtattatgttggtgcaaacataattgcgggttcagactgtgaattttaaatcattataaatacgctcaaacacatctttattaatcaaaataggaaccattgcaatcaacacatttttgccaacaagaaatgtttctttattcctgtgccataaaaattcatccttcagatttgatgaactcttagaaagcattttctgcctcctgcaggttgtggaactcctttccctgcaaaaccttgtcaagatgcttgaagaagtgacagttggtaagaagtcaggtgaatatggtggatgatgcaaaatttcaaagtccaatttgttcaactttgggaacattgattgtatgaccttgcagttgggtgttgttgcagagaagaattgggccttttctgttgaccaacaccggctgcaggaccttgcagtttttggtgcattgcatcaatttgttgagcacacttctcagatgtaatgatttcgccagtattcagaaagctgagatggatcagatcaggagcaaacgaccaaacagtgaccattaccttgttttggtgtaagtttggctttaggaagtgtactggaggtttttctcagtccaaccactgagtgggctgtcgccaattgtcgtatacaattcacttttcatcacagatcacaatcagatcgagaaatggtttgttgttgtgtagaataaaagaagacgacacttaaaaacaatgattattatttttttaattgcggtcagctcatgaggcatccacttatcaagctttttcagctttctaagttgcttcaaatgccaaatgaccatagaaaggttgatgttgagtacttgggcagctcctcatatagttgtaagagaatcagcttcaatgatcttctccattggtcattgtcaacttccaatggctggtcactacactcctcatcttcaaggctctagtctcctttgcaaaacttcctgaagcaccaccacactgtatgttcattagtagttcctgggccaaattcgttgttgttgcattcttggctggctttacaacccattttgaacttgaaataagaaaatcgctcaaatttgcttttggtctaacatactttccctagtctaaaataaatttcaaataaatagcaattaataagtcattagcagaaaaacataaagccagaaatatgcattaaaatgatgtataacataactgcatttatttaataatctattccaattacaaacagcaaagttcaacaatgcaaaactgcacttacttctgcaccaacttaaagatagaagcaatattaacttaatggatgctaatgaaatggctatacagagctctgaaatgttttatttgagattatcagaccataattctacttcccccacacatgccttctatttcgaggctcaagatctacatgaaaaaaaatctctggtcagtgattatgtctatgaatccattagggatgaatagtgccaaatatatcttctgctgtttgtgctttgtaaactactttctcttatttaatttcattttatgatcacaatcttgaaatgtagttcagggattcttatgcaaaagcccagtcacgggaaaggactttgaggtcctagttcacagcaagacagtgatagaagatcaccacaatagaacccagagctactgatcctcaatcttgacccaggtcttgctccttagttttatttaaatggaatctctttccttaccatatgcctccagtatttactcagctctgtgtctaacccaaaaaaaggtctacagaaaacataaattgaaagaagacaagtttttctgcctgaatagctgaaattttaaagatacagtaagatgggttttaccacctaatgatgacatcattaatcgagctttattatcattgtgagtgccccagaaagtacaatacttggtaagtgcaagctttcagacaaaagcgaacatgagtcgttattttttaagttggtcaattgcacccctcttaaaagatcaagctttcacatcagcacacctgaatccagatcctaacctcaacttgtatcattagtggtaggggcaagttagactcaaattctcaagaccttagtttcctcacctatagaaatgatctaacaatactgctgtttaggatagttgtgaatattaaataaatcacataaggtattcaaatagtacctaaacaagggtaaataataactggcagttattactttaccatcatcattatcatagttttatattttatttataagagcattggttgtaatacttcctattttataccataaagaaaggataaggtttcaatccaaccctgccttgccattgactataagatgcatcaaattcaataattttaacaaagtgaaaaaaaaaagtttcatcttaagtacataaaatacagtacagatatgcactcgcatgtgtgtgtgtgtgtgcgtgtgtggttttcaaaga

SEQ ID NO: 48227 - DNA, 1534 bp, Bovine  19866881356328
ccagtatgcctgcaggctcagtcactaagtcctgtccaactctctgcaatcccacgaactgtagcccaccaggttcctctgtccatgggatttcccaggcaagactactagagtgagttgatattcctgacccagggattaaacctgcatctcctgtatctcctgaattggcaggcggattcctgaccactgagccacctgaatggcacattactaataactaaagcccacacttcaagtttcactagtcttccattagtgtccttttttggcttgaggatcccacattgcctttagtcattacgtctcatctcttctggtgttttccagactttgtttttcatgacaatgacagctttgagcacagtttagggaatcctaaagtatgtccatcaatttgatgttttttctcagctcaagtttaataaaactacaaaagatcaaaagtgataccctactactgcacacatcagctagcctgctccagaacacagctcaggccttcttcagaggaagaaaggctggcctcccaacccctgcaggaaaggccacatctggaccaagtaaagtgtgttttcatgacaaccgtacaaaagaggttatgttcttatggccacctactgcagcctggccctaaaatggcccagcactcacttctgattagagaaatattctttgctctgggcatcaggcttcttggtatcaccaccaggcttccagcgcgctggcacgtccccatatgtgtcagtgaagcggaaaggcctgaactagtgtcagtgtctcatccacagagcggccaacaggaaggtcgtttatggtaatctgtggaaagatacctttaccatcaatagtaaaaaggttcctgaatgagaagccctcatcagcctttaagaccccacagtactgagcaacggtgcgctcgggctctgatatcaagggaatgtgcatggcccccagccttccttgtttcttgggtatgttgatccacgccaggtgacagaagtgagaacccaaagaagcaccagttacttggtagttgagtttcttaaattcttctgccctatcactgaaagcaaggagctccatggggcacacaaaggcgaagtcaagagggtaaaagaagaacacaacgtatcttcctttgtggtcagacagacatatctttgaactgaccatctggcataatggttgtagttttgaactggggggcaggatgcccaattttcacatttcctgaagacatattgctatcggcagttctcagagagaaaccacacagcccagttaggatgaagacacccatcaatttgattttggctgatgcttttctcatggatagactgaggttagggctttgaggaagaataacacagaagtaggtgaagtgttgtcatcatatcttatgagggttcacactaacaatatgacttatcagtgttgctgacattgtttacctggcttagatagtatttaccagatttctctactgtaaagttcaagctagttttagaaaaggcagaggaaccagagatca

SEQ ID NO: 48228 - DNA, 1610 bp, Bovine  19866881473123
taaaatcttgactggaggaatgtcatgtagagttctttggtgtcacataaaaaccccctaagtcttatcaacatgtgcactttcactaatgagagtggccagcttagaagacagtggattctgtaggcaacgtcatgttacagactgttcttagtcacattgaaaatctgggactgaagggataaaaccggctctgaaggtttattatggagaacaaaatgtttaaaagaaagagcaagctctgaacttaacctaaacttctttatccacttatgttttctgacttccataatgatacttcaaagctgacatccgtaagtctgcatttaaagaatttcctcttattattcaactagttttaagttataatagtcctctgtttcaatttttccactataaagttttatttttacattaaaaaaaaaaaaacactagaactaaggagaattaggtactactttggaaaggaatagtgcagtgtttaatgtttttgctgttgttcactcgctcaatcgtgtctgactctttgtgaccccatggactgcagcatgccatgtttccctgtccttcactatctcctggagtttgctcaaacttacgtcttttgaatcagggatgccatctaaccaactcttcctctgttgtccccccatcctcctgccttcagtctttcccagcatcagggtcttttccaatgagttggctctttggatcaggtgaccaaagtaccggagcttcagcttcagcatcagtgcttccaatgaatattcagaattgatttcctttaggattaagtggtttgatctctttgctgtccaagggattctcaaaaatcttctctggcaccacagttcgaaagcatcaattctttggcattcagccttgtttatggtccaactctcacatttgtacatgactactggaaaaaccatagctttgactgtatggacccttgttgaaaaagtaatgtctctgctttttaacatgctgtctaggtttgtcagagcttttcttccaaggagcatcttttaactttatggctgcagtcactgtccacagtaattttggagcccaagaaagtaaagtctgttactgttttctcccccccacccccatccatttatctttccttccaaggagtaggcatcttttaatttcatggctgcagtcactgtctgaagtgattttggaggccaagaaaataaaatctgtcactgcttccacttttccctcatctattttctatgaagtgaagggattggatgccataatcttagttttttgaatgttgagttttaagccagcctttatactctctctttcactttcatcaagaggctctttacttcttcttcactttctgccattagggtggtgtcatctagatgtatgaggttattggtatttctcctggcaatcttgaatccagcttgagcttcatttaacctttaggcccaatatgaaggaagtagatataccttattcacagtcaattgcttatttattcatttcacaaatgtttattgaatacctattttccactatgtacacaatctgtacaagtaggtaataaagttaaaaaatcaaaatccccatttcatatatagaat

SEQ ID NO: 48229 - DNA, 843 bp, Bovine  19866881499133
tatagaattatctttttatttttaaaaagttttacttatttttactggcatatagttgcttttaaatgctgttagtttctgctgtacaacaaagtgcatcagctacatgtatacttatatcctctccctcttgaagctgcctgccacccccagcaccgccccccatccttgtcagcccagagccctgagctttgaattcagcagttaaaacctaaaatgacttttgattgcagtaggtaaattcacataaatatctctaagaggagatgtgtgatgcatgagttacaaaaaagagaaacccagactctagaaaacaaaagtgaaattcttggttctcctctactctttgaacttccatatttcctctaaagcctgacttgtgatttagttcatataactactttatttaccctagcatttcaaatcttagaaatttctattctttaacactcagtccctttgggtagcttgccacccacttctttgaggtttatcctatagctgaacctgtgataagcaaagaaaaacatacccttttacttcaatagttctgtaaagattagttacttcctatccagattagtatttagagctgagattaccctgaaaaaaatcaattggtcattctatatagaaacagaaaaatgtgtatgttgaccagcctcatcttcccacgcatccaaaatatgtataaaaatattgtttagaataaggaatatctcttccatgcaggtgagtggtacacaaacagagtgcaaaagagcataaggaggccaaagttcacaatggtttgatgaataaacaagggtcacaaaagctggaaatacaggcagtcttaccagg

SEQ ID NO: 48230 - DNA, 1162 bp, Bovine  19866881558449
aagctgacagctggttttgattgagaaccacagcattaaaagcaatagtagcagcagaccattgcatatagtcaactaccttttcctggggaatggagagctaattgcttgtcttgcaatttcttctcctcttcaaaggaaatcagtttgattcctccaaagttatcaagcataaaagaactctgcccccaaatcaggattgccctttttcattttcctcatgatttctgagattttcactgctggtactctggtcttcatatcctgtttttctgcttccacttagacgtgccaattaaagaaagatatggtttatttaaaaaatatggtcctagtgctgactgtaaagagagctcttaaacaggcctgaactcttcatcagaagtagttgaacacagtaagtaaatcccatgttgaatggtgaccttgtaaagtctccaagaagcaggactgtactgggctttgtagtagcttaaatgaaacaaacctgcttcttcccttgggtctcaccaatcctgggccaggctatgtaatgggcaaggtgcccacttcaaggggctgttagaacagtctaatgaagtggtttctcaaatgtggaccctgaccagcagtaacacaggacttattagaaatgtacagtctcaggccccatccagccctgatgtggggcccagcacactgttataacaagcacttcaactgactctgaagttatatgttcgcatttgtgaaacactgatctagagcatcagcaggatttctgttgatgcctgttggcttaaacctgatttaacttcacttagggggaatgaagaagcccatgtgagcaaagttgaatggacagcataaaacaatggcaaaaagtaccaacgtatgttgattatgtaaagacagcctgatatttaggcctctctcatacgcacacaaacatatcagtttatagatacaaaaccattcatttaccaacaaatatttgttgcagtgtatcacataccataaaaaaggctgagcattgaagaattgatgcttttgaactgtggtgttggagaagacacttgagagtcccttgggcagcaaggagatcaaaccagtcaattctaaagtaaatcagtactgaatattcattggaaggaactgatgctgaagctccaatacttggcca

SEQ ID NO: 48231 - DNA, 1076 bp, Bovine  19866881892246
atataaatcaacaaaccacacaaacaaaatcactactagaaacctcggctacagaaaaagacaatggctttgtttatgtgaaataaaatatcacagtaacctgcactattccaaagaaaaacttccatcagtttatcatgaaaatacatcatcagacacatgaaaatatattatgttgattcagtatttcataagacaaagacattagaggcaattgccaagataaaagaaacagaatattaatattttaaaactacctaattttttatctccaatgtatccagcaatggtaattcctaatccttggacatttttagtgagttctacgtcaaatgtctcactttcttcacttttctgagttgaagcatcaacctgaaatacaatttaaaaaaaaatacatataaataaacacacaaacaaaacaagctttttcaagccacactcttcatttagaaaaggtatgatgtaattagttcttaaagaactctgctaaagaattatagttagggattactccttcaatcttgacaacgtggcctcagcatcacatttttactcaaaagcaatgtcaggaacaaagctgaacaccctcttcagagaaatacattattggttttttgtgaaaatcataaaaaaattagtttcttattacagattatattttcaggagtggctcaacttcctttttgaagaagttagaggatataatagagttgaaataaggctttgaatgcacattaacaagctcaaatctagctttgtcattgactttttctaagcatcactttgctcagctgtctatcaggaataagaaaaagtccagctaacattcattgagcagtttctacataatagacatttgatatgtctcaatcaatttactccttagaagaagcctatgaatcaagtacaattactgtcagtttttatccagggaaactgaggaacataaacttttccaaggactcacagtgaaccatctaatagaggaagaattcaaacacagaggcgctggttgcagagcccctgctcttaaaagatgcacagtatgcaaacccccttagaagtaagggcca

SEQ ID NO: 48232 - DNA, 845 bp, Bovine  19866881998707
tatctctgtactttatgttaaatttttgctctaggtttgatgctggctaaccaaaatcggggaaaaagtctctaatttgtaccttcatactatgaattgttttccaaaaggtgaacatgtttttaatctgtgatgatataatttatgttctaatgagcatggagtcttagaggatcagattagtgaagcattgagcagttggaacagcagatcacattcctggacttcccacacaaatgtttccatgtacttcagtcctttccaaaacctcagatttcctataacctcatgagaagcctcctgctgctattctttcctgataagctccagatatatttattttactgtctcaccttctccataaaatggaattagaaggaaacaaggggctcttggcttttacaatttattactcttcagagaattaatgtttgtacttttgagccacagcaacctttgttcagacaaaacattatactaaagcgaagggtggaaaacagataaaacttagctgctccaggtgaattagggtgggagcccacaactctggcaactgggtccattcccatccaacacaagttccagaagagctcccctgggcagtatggaatctgtaggctctgttgattgagcacagtgatcctcaatcctgtttgcctgttagattacctgaggaacttgttaaaaatatccctgctcagaacccacacccagatattctgatccaaccgatatgagttagggaagacaatcctccctgctgccccctaccaccaccagggctccagatgttgtaatatgcagccatggttaagaactactgcttcaaatcagtgctgctcaaa

SEQ ID NO: 48233 - DNA, 1537 bp, Bovine  19866880183093
ataggaaaaggagtacgtcaaggctgtatattgtctccctgcttatttaacttatatgcagagtccatcatgagaaatgctgggctggaagaaacacaagctggaatcaagattgccgggagaaatatcaataacctcagatatgcagatgacaccacccttatggcagaaaataaagaactaaagagcctcttgatgaaagtgaaagaggagagtgaaaaaggtggcttaaagctcaacattcagaaaacaaagatcatggcatctggtcccatcgcttcatgggaaatagatggggaaacagtgaaaacagtggctgactttattcttctgggctccaaaatcactgaagatggtgactacagccatgaaattaaaagacgcttactccttggaaagaaagttatgaccaacctagacagcgtattaaaaagcagagacaatactttgccaataaaggtccgtctagtcaaggctatagtttttccagtggtcatgtgtggatgtgagagttggactataaagaaagctgagtgctgaagaattgatgcttttcaaatgtgatgttggagaagactcttgagagtcccttggactgcaaggagatccaaccagtccatcctaaaggagatcagtctttgagtgttcattggaaggactgatgttgaagctgaaactccaatactttggctacctgatgcaaagagctaactcttttgaaaagtccctgatgctgggaaagattgagggcaggaggagaaggggatgacagaggatgagatgattggatggcatcacagactcaatggacatgggtttgggtacattccagtggttggtgatggacagggaggccttgcgtgctgtggttcatggggttgcaaagagtcagacacaactgagcgactgaactgaatgcatattagaactaaaaattattcatttatctgaaagtaaaatttaactatgtattctttattccatttggcaaccccagcataagattaaaaaggtaaaggttttgaagaataaagtcatttacatataatcaaataataattatgataataaaaataacaccacgcttaacataattttcccctttatccacctttttgctgtatagccacaattgttttgtttcagtttctgaaaaataacagatttttttcttgtgataggatatttgtgattttatcaacctggaaggaattacatcatcatttcaaaatgcgtcattcctaaagattaggtcaggcatctcacactcctggaaattttctctgacccagagcctactttcctactcccaactccaaatttattcttataactctctccaaaaatggtctttgtttctttcagagcacttgtctcattttgcaatttttaattaattaatgcaattatatgatcagtatctgtgtcctctactagattgtaaactttttggcagctctttctatatctcaattataacctcagcattcagcatatcagcaattcagcaaacagaaattgtttgtatttcatttca

SEQ ID NO: 48234 - DNA, 1610 bp, Bovine  19866880245710
caattgttggagagctggtttggtggtgctgaattctctcagcttttgcttgtctgtatagctttgatttctccttcatatttgaatgagatccttgctgggtacagtaatctgggctgtaggttattttctttcatcactttaagtatgtcttgccattccctcctggcctgaagagtttctattgaaagatcagctgttatccttatgggaatctccttgtgtgttatttgttggtttcccttgttgcttttaatatttgttttttgtgtttgatctttgttaatttgattaatatgtgtcttggggtgttttgccttgggtttatcctgtttggggctctctgggtttcttggacttgggtgattatttccttccctattttaggtaagttttcaactattatctcctcaagtattttgattacagtttcaatttccgtgcttgtgaagggtctgttaagactttttattgcttcttggttcagtttcggaaggttgtacttttctaagaatttgtccatttcttccgagttgtccattttattgtcacacagttgctgatagtagtctcttatgatcctttgtatttctgttttatctgttgtgatttctccattatcatttctaatattattgatttgattctcctccctttttttcttgatgagtttggctaatggcttgtctattttatttatcttccaaaagaaccagcttttagttttgctgtaaaatcaatcttaatgtctactagagatagatagaaaatgctaaattttacctatttgaaaaaatatggaaaaataggactgctgttgtatttccttagaagcaaagttcagaactttgttttttattcttataagtagctgttaaacagaaacattgtgtttgtttatatgtgtgtgtatgtgcagtttttatatttgatgatataaaggctatgactaagctgctttttttgatctgatataaagatctcaaaccatgtgtcttaaaagttaacagcttctatgtttattattttcctcagagataagataaatcttaaatctgtaacctgttattttaaaagaaatgtaacagttgctatttattcactacagagttatgaaacactaatttgtaaagcttcactgaattctgttggcaagtcactttcaggtgactgaaattattagccaattttcaaactggcaaaataattaaatgtgctctctaatatttggttattatgtagctcttctaaaaggatacatacatagactgcattttgaagtagatttttgaaacaaatatgactttttgtaaaccattaaaatcattgaaagtaagagtaaatatacaaattatattttactcattctgtacaacacaggacacaactagttaagtttatcctcagaatacttacctcattgaaaaataacagaaaagttgctccataattttttcctaaagacttatgaatatcacgacccaaagattcatgccaaatcattttgttccaatgaatgcaagaacatttccagaaatttcaggcttgtcaaaaacattagtcgcctatttaaaaatccattaccctaaatctcacttttaaggaagaaa

SEQ ID NO: 48235 - DNA, 2175 bp, Bovine  19866880471294
cattgctgcatgcctggccctggcgggttgcccatgttcctagtgggtcattaataaaggctacaactgctcctacatttagattttcttctacactgactcagcagttgcagttatcattttacactgtcatggatcattaagaagtttctcctggcatgcttctaaaagatgctctcttcctctttaggttagagctatttttctaccctaactcacctttcaaaactggattttctttttaaatggatatctgggggggaaatgttttaataaacagctcagaatacagtaagtaatggtttaaaattcagttcctttgtgacttaaaaatcaagtgtttatttagaaaatgcctgtagcaaagagtgcagtttgggatttatttcatgtcacagattaaatgattgcttgcttacttccttcacttgcaatgcataattaataattcacagcaagttcagattagtcgttacattttcttctttacttaattttcaaagtcacttaaagccatctgagccctagtatttttacatcacaaaccataaatcaaattaaatgttggagtcagggagccctagtgctacatttaaatccaaagtcctggaaaaactacagtttatatagctgtgttataggctgtcacccaacaataaacagggccttccaggtggtgctagaggtaaagaacccgcctgccaatacaggagactctagagacgtgaattcagtccctgggttgggaagatcctctggaggagggcacggcaacctactccagtattcttgccttcagaatctcttggaaagaagatacagtccatagtgttgcaaacagctggacatgactgattgcaaagagttggacacgactgatgggacttagtacacgcatgcacaacagtcagttcagttcatttcagtcgctcaatcgtgtccgactctctgcgaccccatgaattgcagcacgccaggcctccctgtccatcaccaactcccggagttcactcaaactcatgtccatcgagttggtgatgccatccagtcatctcatcctgtgtcgtccccttctcctcctgccctcagtccctcccagcatcagaatcttttccaatgagtcaactctttgcatgaggtggccaaagtactggagtttcagctttagcatcattccttccaaagaaatcccagggctgatctccttcagaatggactggctggatctccttgcagtccaagggactctcaagagtcttctccaacaccacagttgaaaagcatcaattcttcagcgctcagctttcttcacagtccaactctcacatccatactgaccacaggaaaaaccatagccttgactagacggacctttgttggcgaagaatgtctctgcttttgaatatgctatctaggttggtcatactttccttccaaggagcaagtgtcttttaatttcatggctgtaatcaccacctgcagagatcttgaagttaatgagacctaattcttattaatcataagaattctctttagtatatgtaagtagtaaaaatcataagaatactctttagtatatgtaaatagtaattctattgagattaaatgaaatgcatgttcagctgcagatatatggcaggttttgtatgtttggtgtgtgtcacaatgatgtatgcacaaagcaggagatttgcctcttattcacttaagtaatatcctgttcacttagaacatgcttgatgtatagttcatgctccaaaattctagagtgagtgtgcatatatgtgtgttttgtgccttggtgtgtgtgtcggaggcatttctaagatgtgttgaggcagtgagtatctcaagctattgctgaccaccagctgagaggaaattcaggaaagattcccatgtaggcttgccagaactagtacaaataaaagtgtacgactaataaaggtcaaaagatataaacttccagttacaggtacttactaaggatgtaatgtacaacatgataaatataattaaccctgctgtatgctataaataggagttgttaagaaagtaaattctgagtattcatcacaaggaaagattttgtcttcattttgtatctatatgaaatgatgggtgtcactcaacttatgatgctaatcattttatgataaaaataatatcattatg

SEQ ID NO: 48236 - DNA, 1354 bp, Bovine  19866880905958
ataagctaaagttatttaatgatcattttttacctggagcatttactagaaattaaaatgctaggacttttctctctccctggaaaatcatcttaaaattaaatatggatttaaaacataaatatgccacctgggaaagcctgaatttcctcctagagaaggccaaaagataattttcaattttgatcctcttccttgctcattttatttcgatgaccgatgctctaagcttatttttgatttcgtttgttgccttctatatcgtatttcaaaagtttccttttatgaccgcctgaaatactgcagggcagattcaaacatgtcccaagcaggcactaaaattttaatgcatttttatggaaccggtctcagccccttcaacacaacatttatttgtccagaaggatgttagcagaacatcctcctatttacaactcggtaagcaaattgttcccatactccaagtatgtagaattttttatcaatgtcatataaatactgtgaaattcatgttatgcatctgcataagttcatcatattagctaacctaacaacacagtcatgtccaagtggacccttttaattaatgtgagtcttttctgaagttcaaaacagtgttgttattgtcacttacattaatatctgtcttgacacagttcaaataaaaatttatgccatcagtgttatttaccgttctagtcccactatttaaaacagcacacagcacaaaacaaacaatgcatattgaatcaatattttataacttttttccctcttttttaaaggctaatcgctctgacattacttcatttttcagatatagaggcaaatgcaacaaattttcaatgtgtacaaaggaaatgggtgagtaatggttaaaaactacacagctcaaattttccagatcaatctcataaggtgagatttacatgagtaaaccaaataattaacttgcttaaccactttatataggtagacaattttaggtttagggacacgtgtattgattcctgggttgcttgagagaggaaataattgttcttgtcatttcttaattacaaaaataatcactcatacaattgggtgtttcatcgtagtttgcttttttcaatgcaatttccatttatttcaaatacctgatgtttaaaattctaaatttaaatacttgaaattgttccctagagttaacaggactgaaactgctgcaaatgtgctaatttggggaattcaattctatttcatcaaactttcatttgatttcattgtgtggaataggtcagcaactactgcccacagccaaatctggcttcagttgttgtttttttttttctttattttttgtatgctccacaaa

SEQ ID NO: 48237 - DNA, 746 bp, Bovine  19866881023214
atgcagcaatgcttctctgataactgagcattccaaatctcctcgatataaatttctcccaactccctaaactagaaataatatcctcagcattctgaattaggcaagacacacaggcatgttatccatattatattaatcttcaaaatgtattgcccaaggaggagacatgaaagagaacagattatctctacgggagacttaacacttgaaaagaaaaaaggttttaaaaaattgcatcagaggcaaacacaacacatcctgaatttgcaggatgtgtttgcaggaatttgtttttcccaggcagggggtacacaaaaacactgtgataacattttgccataccaattaccagctcttctttcttcttgggatctcaaagcacctctcaggatttacatggtaaggagatttttcttttttttaaaggtgaagagaattgagttactctaacttgtccactggaccttggagaaggtttgagtttaccaagtttttcataaaaaaaatatcagcaactttcaacctttattcagaagttgagttctcagtctaagtcaacactggtgaagttgagtattttcaggaagtatttggaataatttggaatatggaagtgtttctaatcaaagatgggtgtttatgaaactagcaacaaatgtaaattacctgtatataaaggtatgtgaccgaaaaaaaaaactcaaagaaggaaaaaaaagactgttcctaaaagaattctaaaa

SEQ ID NO: 48238 - DNA, 371 bp, Bovine  19866881153679
atagaaaaaagtccttcattaaatgatttatacaacaaaaaaggtagaaaataaaatatgatcaattttccaaagaaattatgcttagtgtacataacttctgaggaataatcactgtcctgaaactctaatacaatttatgccctaaagtataattagcaaacaaataattggccattataaattttttaatctgatttgagttctttcagcaccatggaggaatgagaattccaagtattaattacaccctaagcatagaacaagctgctcatataaatgacatttctgaaaatataaaacagcaactaaaaattacactttaatagctgtatgtgctctttttttccattttgatttggcagaagtag

SEQ ID NO: 48239 - DNA, 1561 bp, Bovine  19866881568480
ttggtaccttacttttgtgataacacctgttctgcttacccagagggatcttgtgaagatgaagtgaggcaatgaatttgaaaactttgctaaaacaccctacaaacatatgcagtatactaatataactagtagtataattaaaagattgcattttcaaaatgttaaaattagttgcagtttcttgaaagtctacaactttaaagcaaacagatggataagaatagctcttgaatgccaaatttagtgtggtatgttttcttcctggtatgcctgaaagttgtatctaaaaagcaactgcagaaataaaatatcaagtgctcaaatagtaaatagatatcatagggttgttatattgtcaaactgaaaaggaaaggaaggaaggaaggaaaagaaagatagagaaataatgaaagaaaaagaaaaaaagaaagaaaattaaattaatttatgggttattccaactacaagcagttcaaagacagcatttactacagggttacaaaatctttgggtctactgcttgagattatcaatgcaattaaccttaaccatttcttctacatattgatcctcaagcacttccataaatgtgtttcttccttattgctgtaatggcctttccatttttagttgatgggaaagtttataaatgctttggcttctattctcagatgggaagctctcttacctaattggttgtttttaagtagctcttaattagaactggttttggcatgtaatttccattccatcagtttccctttactcaattgctccctatttatgttgtatagactttattaacttataatcacttttatgagactgagtggtgatgatattttcaggataattttagaactggcagcattggatcttctgggtgatgaactgttagtatgatgaacatcactgaaattttgaataatattaaattataaaaattactaccacaacaaaaaaaatacaggtaaattgtaaagtatatgtagtataattctaaagtcaagaggaacatggaaaggctttctgctcaccatatttatttatgcatcagaaagaaatctggccataaaaaagagcagtctgtcattttacaaaaattataaaatcagagtttttacaaatattataactattgggaaaataatgttggaagatgaagccaaaacaatagtgaacatttctgaaacataaagggggctagaactgtgttagagaaaactgctagagctttatatgttctaacacaggattagtaaatgttctaagccatgcactgaacaagaagtccctgaaaagcctgatggcagaggtggaacttgtcattctatggataaatagatgttaataaaggttatgaagtttttaatcagccacagccatgttgcctcctgtctctgtgccaggagttcattatgagatagaagttaatacatataagtaaaagttatacaagcaatgtactacaaatctggtcaagaggtttctgttttattacaagaaataggccaaaattagaatttctttcgacaaatcaggttcacgatgcatgcaa

SEQ ID NO: 48240 - DNA, 1611 bp, Bovine  19866880082110
tgaaagaggagagtgaaaaaggtggcttaaagctcaccattcagaaaatgaagatcatggcatccggtcccaccacttcatgagaaatagatggggaaacagtggaaacagtgtcagactttatttttctgggctccaaaatcactgtagatggtgactgcagccatgaaattaaaagacgcttactccttggaaggaaagttatgaccaacctagatagcatgttcaaaagcagagacattactttgccaacaaaggttcttctagtcaaggctacggtttttcctgtggtcatgtatggatgtgagagttggactgtgaagaagactgatcaccgaagaattgatgcttttaaactgtggtgttggagaagactcttgagagtcccttggactgcaaagagatccaaccagtccattctgaaggagatcagccctgggatttctttggaaggaatgatgctcaagctgaaactccagtactttggccacctcatgcgaagagttgactcattggaaaagactctgatgctgggagggattgggggcaggaggagaagtggatgacagaagatgagatggctggatggcatcactgactcgatggacgtgagtctgagtcgactccgggagttggtgatggacagggaggcctggtgtgctgcgattcatggggtcccaaagagtcggacatgactgagcgactgatctgatctgatttgatctggagcctccagaaggaatcagccctaccagaagcttggcattagccctgtaggactcagttcccacttctggtctccagaaatgtaagtgaataaatttctgttgcttgaagccacaaggttggtagcttgttacagcagccataggaaactaatacagagagctcattctatcccgagtctcctccagaacccagcaggatcttcagggaagttagaggaaaaaactcttacagctaaacagagattataatactcttaggagaaaaaaacattttcagacttctattgaccatcagaggaatccagtgaaactttctttcgctctggtctgggtttagaaggaggctatgagctaatactcccaaactatttgcagcaatgagagaatcaacagccaaaattgtcacttttttccagttttttaaaacaatagagtctgttatttctttcctaaatgcatcagcagggccagtggagaaggtctggaaagcaacagctaagattagcctgcaagctccccacagagaccttgagtgactgtcagctctgcagggaacagcagcaaaccctcacgcaaatggcctataaaaaaggccttgtcagaggcaccttgacctgcctgggcttctctggtactcggattcccagcggccctcccagggttatgctccctcgcatgatgtatttcccctgccttttttagagctgcattatgcttgctccaggaaacagcctcttccttctcataaacacagccttgggttcctgaccaagctccctgccactccgcagctccttgtccatccatcacaccttgctgtcaccctggctgcgattgtggagaactgggtctgtttccagaggtgaacctagggtaggctgaa

SEQ ID NO: 48241 - DNA, 2123 bp, Bovine  19866880479886
ttgctggcaggtagctgtgcatttaaggggtgacctccagagggagggacaggatccctgagcagttccctcagcctcagccacctcctgtcccgtgcagccactcgctcctccccactctcaacccatttgcaatttctgctccttgctctgcatttgcaatgccttctcctctgcctggaccacacttttgtgatggtatataatgaactgattgtagaagacaaagtttattttcagaaggaagttttattctccatatactcagccagcatgtctttaagaatggttttatgcttttaacacttaacttggaacataaaatggccttagtttgcttaaatcattctgttatagctcccttgacccctgtttttatgcaagtcccagtttacaaccttgttcaaagctgtacacgtccctttgaagggtcactgggatcaggagagagacagagggggataagacaagggtggctcagagaccacctagggcaaagcaaattaatgccaacagtgattttggggggtgctaaatgataccgctaatttccccaacatcctgcttaataaaactttcaccctgagccatattttccaagtttctcaaggactgcttaagtgggaacccattcaaaatgttattaaagtccaaggagaccgtgtttattggctctgcatggactgctaagcctgctgatctgtcaggggaggcctcgtacagacttccctgtttccagcacacgggaactgatgctgtgggacggaggaagagcccccttccttccccaccctgacttctgttcttgaacccaggatatagccggtctgggactagaaacactgtatgtgagtcttggaccacagattctgttgctccaagaagagggaagccaagggggatggtcacaggagagaacaaagctggcctgggaccatgttcttttccccttgggggtgccgctggctcctttggccagcacttgctcttaagtcatccggtttcattttccagttctgagtctggccgtgacgtgaactgaattagaacaaaggcaggggccctgtcttaggtgctgtgtacttccagcaccagtcacaccactggatggtcagtgatggtttgatgaataaaggaacaaatgcataagcctgctttccatttacttctactctgcccacgtcttaagcctccggggcagatgaaaaattatgttcattgctatgtgtcaaaccatctttcctcgttactgattttagaaagaattaggactttaaaagaaaaaaacacacaagaaatctgaattgtataactaggtggggagcaaagctgcccagtgaactggaacctctgtgctgacctgtgtgtggtaaaagagaaaaagtctacggtcttgaaataaagagagaaaagaggaagggaaggagggagggaggggaaagaggagaaagaagcagagagagattgagaaagaaatttgtattctggtcgtatggctttgtaaccataagcctcagttttcccatctgtaaattgagaggttggactggatcagttttcagactttataagacatcataatcacttggggtgtggtgggtgatggtggatgctgttaaacatgcagattcttgagccatacctccaaaggctttgactggggccctggggacatgcatatgtaacaagctaagctgcaattgtttcaagaacttacttggaaaaaacaagacccaatctcctcagagaggatgtgattctaacacttcaagggtggaccctggtaggtgtaccagtaaccctcatctctcgtggtaatagtcgaccactttggggcatgctctggtttaggtgggaatgactcaagagtaagtgctgaaggtaaagaggatggtacattagcatcttagaaaccagaatattctctcaaggtgacctttgccttggttgttagacttgttaaatgggaccagagttaatgcaagtgtactgtctccctgactttaaaaaaaatgtccaaagtgagagttgagagttaggttttatttggggcaaaatgaggactatagcctgggatatagcgtctcagatagatactgagaaactgctccaaagaagtaggg

SEQ ID NO: 48242 - DNA, 1124 bp, Bovine  19866880541935
aaaaacctcttggtgaaaggaaaagaggttagtgaaaaagttggcttaaagctcaacacttcagaaaacgaagactcatggcatctggtcccatcacttcatggcaaatagatggggaaacagtggaaactgtccgactttatttttttgggctccaaaatcactgcagatggtgattgcagccatgaaattaaaagatgcttactccttggaaggaaagttatgaccaacctagatagcatattaaaaagcagagacattactttgccaacaaaagtccatctagtcaaggctatggtttctccagtggtcatgtatggatgtgagatttggactgtgaagaaagctgagcactaaagaattgatgcttttgaagtgtggtgttgggagaagactcttgagagtcccttggactgcaaggagatccaaccagtccatcctaaaagagatcagtcctggatgttctttggaaggactgatgctaaagctgaaactccaatactttggccacctcatgcgaagaattgactcattggaaaagactctgatgctgggagggattgggggcaagaggagaaggggacgacagaggatgaaatggctggatggcatcaccgactcgatggacatgagtttgggtgaactccaggagttggtgatagacagggaggcctggcgtgctgcaattcatggagtcgtaaagagtcagaacacgactgaagcgacttagcagcagcagcagcagattcctctgtacctctcctcacactcggcctctgttgtaaaatcaattacaattggcttacatctccagttctgggtacattttccatctgctccatacatgcacaccctccgactggaccattccccactccccacaccgcccccaccccttccttctccccattaactttatcttcttaagcagctcaggaacacagatgttttcaccctgtccctctgcacaagggtattttcccagtgtctctctgtgtgtatgctccaggcacagcctctctggggagggagagagtaaatgttttcattccaaaccctcaggtcaggtcttgtttgtctaaactgggtttgttgccataattatcagattagctgatctctgg

SEQ ID NO: 48243 - DNA, 1498 bp, Bovine  19866880637857
acgtagtttgtatagattgccttaaaaataatccttgtgttataatattatggcttgctttttgatatgtctgccagttagataagtcacttgagagcagagatgagaacttttcatctgcttgcccagtctttgcaatgaaccaggcccagagtgggtattcagttcaagaatgaatgcagccaattgtctttaaggacagaaaccaggaccaaaaataggagggaaagtgagttcctgttgactcactgatccgagagagaggcaaaaggcctcagagggacagccgccctaccagcctgagtggacgcattcaaaaaaatcttgaagggaacaagccaaacacaagatagagtgctgccagcccgcactctacacttgctgctggagggagtacttgtgcagaattcctatgctctcccagtaccttcatgttctcaccaacccagaagctctcggaacctccttattcaagcgattttataatccagcctcttgcccatctttctctctccagaggatggtgtttggggctgaaaattccagcccttccatcacttgtctcccatcacaagtggactcatgtccacatgagtttgaacaagctccagaagatggtgaaggacagggaagtctggcatgctgtaatccatgggattgcagagttggacacaatttagcaactgaacaacaagttctatgccaggaactagtgacaaaaccaaatatatttcttcttatataacagatctctaaggactttttaatcataattaatcacccttaattaataagaggctcagtgttggagccagagaataaggctcaaattacccagttctcacataagctatgaccactagatgggagacctcactaggccatttcctgcaagaccagcatgatattatctcctcagcagcccaggagggcagggaaataaggaaatctgctttaggacccagcagtcctaggagatgtgtgcccttcttcatgtcttcattactttaaataagttctcaccttgcccttcaataggccattgggacccaagaccttgttgaaaatatgttttcccacatgggcatccacagctgacagagggtcatccagaatatagatgtctgaattttgataggtagctctggccaggctgatccgctgcttctgacccccactgagatttataccctgaggaagaaaagaatttctgttaagtactgaaactgagtccccctaaaactgagttattctactgaatttatgataaacatctctatccaaaactttattcccattcttggctcgtacctgttcccctcaagttaaggaacataaaagggaggattgaaacaaagcaggaccctgcagggcaacctcctgggtacaaaagctcctctgtgtctcctgtttcttatttgtaggaaaaaaaaaaagtgttagtctccctggcctaccctgagttccaagcagttactaattagggaagcgaggggaa

SEQ ID NO: 48244 - DNA, 866 bp, Bovine  19866880660598
tgcagtctttgtagcctcattgctcccccagtcatgcattaagtggccagttccagttaatcatgacatgacttcagtctgccaggatccatggaatacactgtcctccaggggaaacccttctaactcatgctggatatgtgtcctaattcctttccaggaataaatcaacttgccacacatggctccttctaccagcgggtagggaaagagagggtcagagaaagcacggcagcggcagctctgtggggcatacagtatcctgtctcacagctgtgggtcatcaacccttaggccctgctgctcatctccaaagggagagtgctggcatggctgtggagctcagtcttccaagagcattgaactgtagtcacttcagttacctccagggtagggcagggtagctggctgtgcacagtgagggtaaggagccctcggaggcttgatgtcagcacttacttggttttgctctggcaggttgctgatcgcctttgcaaatgaccatggaatctatctgtggactggatatctctattcaattctcctctttgtcgtggccctcatccagtctttctgccttcagtattactttcagctgtgctttatgctgggcatgaaggtgcggaccaccatcatggcttctgtatataagaaggtatgtggggtatgccaggaatcaccaaagaaaatccccttagtaaacatgaccctttgttccacgattgaggaaaacttgatggaggtgataactgaccgcaacactgaattttggctaaccatacagccttctttagacatttcttaggaaattaaaatgaaaagtgtgtatatagacatagaatatgtgtgtgtggtgggggtagggg

SEQ ID NO: 48245 - DNA, 1196 bp, Bovine  19866880663461
tccttttcctgtcctgccggccccagttccgattctcaggctcagtggcatcctcttataatggctgtcacggagctcccatcttttcagtctctttgcctgaacaactgcctcagcctatatcttagcttccattgcccctgcccctgccccgaccccaatcattcattctcctggcagctacccaagtggactttaaaaaatgtaaatctgattgcattactcctctgctcaaaactttctcctggctttccatcagacttaaaatccagactcttcaccatggcccatgagggtccataccactttgtacccacccactttccggcactcacctccccgcacactcagcctctctctccgtgctcccgcactctctttctcctttccaaacaaaccaaccatgttcccctctcagcctcacaacccaccccctgtgagtggaacacgcttccttctgatgggctcttctcatcacttggatctctgcccaaatatcacctcctctgaagcttctcctgttactctaaggaagcagttcactccaaatacatgaacatgttttcttaagagcacctcctgctctgaaagggtaacgtatgtattggtttattagttattttctagctctgtaaagatgaggactccttcaggactctttatatctgtgcccagaatggtctccaatgcatagtgctactcaataaatattttcaagtgaataaaaaaattaattagctaacactaaatcccaccaacatgcaaattctagcaatgctaaggtattgttttatttttctgctaaaaaagacattgagaaaaatttcatatataccccaaaggagagagaacagtactacattacacccccaagcatccatctctaaggtactgtgatagtattgtgaatattactaatataaaatgtacggcaaagggtgaagtgctgtaaaaatgtaaggacagaatcaccatcaccaggacaccaataacgtgcaggacatttgaacagacactcatggcagagttaccaggacaaggacatcttggctttgactctggttcttgtccaagccgttcacgctggctccagggttccgcttggatttcttcttctgccgtttctggaacgcccgcctggccttctgtagactcttccgccatgtacttctcaaacctgctgactagtgcctttg

SEQ ID NO: 48246 - DNA, 1439 bp, Bovine  19866880737170
tctttcttttgacatgatcgattctgcatcagcctggtgcccaaatctccatctctgagttcttgctttctaaggtgtcatctatctggtttcccctatcagtgctggccctctgttggtcctagtaaactcaccagggtctaaaaccctgttctagaagcggcatgtgcgttcatccttcagctttcagatcatggctagagagtgatagtccaaaagactttaaatgcgcatggggtattgaatttttctccctagttggtgcaataaatacatgtacctttataaagatcgattgtccagtcagcctgacatttttccaaagttacgttccgtttgttccttccacctccaccaccccctccttcaaccctgcatttccagaggtacagagcagtcatgtggtctaatccttcccatccagggctctgtagcctatgtcccgcagcagtcctggatccagaatggcaccataaaagaaaacatcctttttggatcagagttggatgaaaagaaataccagcgagttctggaggcctgtgccctcctccctgacctggaagtgctgcctggaggagacatggctgagattggagagaaggtacttgggacaccaggggatcctgaagggtgaaggaaaagagcgaggatggtgaagaagtccatggcagtaaagtagttgatcaatttaggtagtcaagcctggaacaaacatcagaaaacttgagtttgcacaatatgttgtgcaaatatttaaatttaaaattttgtacctgaaagcaaatataagagttgtgtaatctaaaggaaagataatgaacctaggacctggttaactaaccagcagctaacccgaggtagatctctggtggagggccagaggcagacgggggggagcctgtctgaactctaattctgtacactaatgtgggccagagtagggttctaataatctgcagtgaacacatagaaacctaatacattattaaatgcctttcttaaaagttaatttttaatgaccgttgcatattatatgaatatagtatacttggtttacaagtccctgattactatttatttaggatgtttttatcctctttccccattattaaaaataaatatagcagtcttttggggaaaggtcttgaggttgggatgctacagatacagctctagagtgattttgttttttaattcagcatacatttcttgagtacctactatgtgtcagatactattttaagtgctggagttatatccacaaacaaacagaaaacccaccctgatacagctctacattctcctggggcaggaaacaaaaacaacaacaaaataagtactatgatataaaatggtaacctgggcacacatttaattattaggtttaaagttatttatttgaatgaaggatatttatttgtataaaggaacttgtgtta

SEQ ID NO: 48247 - DNA, 1946 bp, Bovine  19866880845069
atgtatactgagcatttagagcactgcttggtacatagcaggccctccataaatagttgcagaatggataacttaacacactgaactaattgaaattatatatcaaaatgtatattcacattcccaatgatcatgttcctctttcacacagagcttacaggatctcacaggactcactcccacattagaaagattgggctttgattttaggtacttgggagcacctgaaatgtttgaataagcaagtataatggttagaattagaacaggttttaagtatttgagcactcccaaacacaaatgtgtgtatttttttccccagataaagacaaaaaggtattccaaggcaaatcatccaggtcatttatcttcacatcattttaaaaaaacaggtttattgagttgcaactcacatactatagaattaatccaaagtgtacaatgcaatgggtttagtaaatttccggagttgtgcaacctggaccactatccattttaaaacattttaatcatctcaaaaataaactccatacccattagcagtcactttccatttgtctccaaaaatctccccatccatcccagccccagacaaccagtaatctactttctctctagacagaaagatttgccttctctaggcatctcatacaaatggagtcatacaataggtggtcttgtgtgacaggcttctttcacttatcatggttcaaggggctttatatgattttcaaatataaatatgaaacttaaaacacaataattaagagcacagatcacaaagccagactatctggatttacctcctagctccaccccatgttaaggttacgtgatttgaggcaagttactcaacttctctgtgctttaatttcctcatctagaaaatgggtttagtgacagaacctgcttcatagaaatttaaatgagttaatgtaaatacagcacttagaagagtaccttacacgcagtaagcattatacaggggtcagctgctattatgactgttgctgctgctgctctcatcatcatctgcattagacagcaagcctatggacagatattctcaaaatccttgtcatagctttaggatgtttttttggcatttaatgggttttaaaacgagtgtctcaggagaaagaagtgaggaatgactgactgctaaagaacacaaggtttctttccagtgcgaggaaatgttctggaactagacagtggtgaaggttgcacatatgtgtaaaacaccccaaaaaaaccccactcaatcgtatactttaaaaggggggatttcgtggtttgtgaattatgtctcaattttaaaaactgagtgtatctcttgttttagaaactgccatatttcaggctaaaaatagtgaaggcatacatggatatcttgccttgaaaaaagtcagaaatttaaatagcttccctatttatgctccactttggccacctcatgcgaagagttcactcattggaaaagactctgatgctgggagggattgggggcaagaggagaaggggacaacagaggatgagatggctggatggcatcactgactggatggacgtgagtctgagtgaactccgggagttggtgatggacagggaggcctggcgtgctgcgattcatggggtcgcaaagagtcggacatgactgagcaactgatctgatctgactgtccttcaagtttttcctgtattttatgtattaaaaatgtatttatgttttattcccactattagctgcagatggagggtgggtaatacagtgtttgattatgtgaactttctagggcatggctacataaagcaataaatttaaaaagagaaatcattttcccttctaaattctattaagtaataaatatattcataacagctaagagctcacatttaagtcagagaatagtttcagttttttggttctgcatttgctatgtgac

SEQ ID NO: 48248 - DNA, 1800 bp, Bovine  19866880882099
ctatatttgcactgatattacttaaattttgccttcatttagaacagatttcttagtcagctagattgccaagcaaagttgggccagctcttttgagagtaaatggggaatcctgcaaaggatcttgaaaacggaagtcatgatggagccaagtatgtggaattgggaagggaggctgcagtgaaagaacacgcaggttccaaaggtttaaggattgaggggcatttgtagccagaacaagccgtggttctggaatccagggcaggggtggctgggtttatatatggaagtggaatttatacaagagactaggcaacagagggcctgggaatgtacccagagtgtctgtagatcaagaatctgaactaccaactggcttgggactcctaagtatataaagaactttgtatgcaggcgacacttggtctcacccctggggctttcatttgcctcttggcagctcaggatttagcaccagacaaaggcaggctcttctggaggaaggagcgagggacacatgaaagctgagaaaagacagacagacatgcggggacctacatctgacttaaagacaggaatttttctcaacagataaagctgtgcagttttctgaggcgtcatttacctgggaccatgatttgggtgtcacaatccaagagtgagttgccgccttttcttcttgctgtattttaagattctccttgctggtcttgttatagggaaattccatgtaatgtaacacatgcggagacaagctgtgcacgtgttcagatactagcgcaggttaaacccctggagggatggactgactgcagtcgctgtgactgcacctgccccctccccccgcccaccgccgctttcctcctgggggacagtacagctgagaacctgtgaagacatgtgttctccagattgtggatggaggtagtgcaggctggcaggtagcctaggtctctggatgtgccagaggatactcacgagaacctgaacgcaattgaagttcatttattcactgaagaatagttatcatgaaggacctgccttctttgcccagaggggatgatgtgagctgcttctataatcaacttcagatctggaatttttcatctacataatcccttctcacattctgccctgtaggtcaccccctgccttaagccaaccctttcttgccacactgctgcatgtaatgtgttccgtaagcactacgtgtgtgagcacgccagctccatcacgagctcagcaccacggagcatgccaggagcccgagcaggccaggctttttcacaactgagtacacctagtggtcttcctgctactttccacactctctcttgtttctccatcctttaacatggaccctggagctcgcctcagcgtatgtcagtcaggccagaagccctgagccctcctaacctgaaagcctcaactttacagaaggagagtggacgtagctcccactttgctagttgtataagtttagaaggagcctagctggatgggccggttcagaaagcctgagaacaagttcctaatgttctaggaactcaaatattagactagaacagagaggttcccggagcctggcccagtgtgggcccctacccagccacgctcagccaaatctccagggaagggggcaggacatctgtgctctcagtgagcattttattgaattgctcttctcattgaatagtcgagtttgggatgcattactctgttccagccccattagtttagaaattgagagtccaggagaagtgagactctaagatcacacagctcagctgtggcacagtt

SEQ ID NO: 48249 - DNA, 817 bp, Bovine  19866880899991
cttgaccgtcagccatagtttctcctctgttgatttcctcccggctcctcccacgaaaagctcttggtgtttgtttttcctcccggcagtcaccaagggctttgtgtacagctccttcctgaagccctacaacgcgcgccgcagccactccgacgcctctgtgggcagccactcctccaccgagtcggagcacggcagctcctccccccggttcccgcagcggcagaacagcggcggcaccttgaccttcaaccccagcagcatggctgtgtcctttagctcagggccttgccagaaacagcctccagatgcatcttcccagacagaatttgaccaaggaactctcagtgcctccttgaactcagagggcagtccttccagatgcccgtcggacccagactccccctcccagcacaggccttgggactcgggcgatgcggtcagagaccttcaccagcctgcccctaccctgaggaactcccgaaaccccaggcatccagaaatggctggttcctccgtgtcagggcgtaacgggcagagtcgagacctcgtaaaagcaggcgcaagaacagcactgtttctggacgacagacatgagcagccagagagtagcgaggctgaaggcaaccaggtgagtgcgcccggtttccatggttactgcggggcttgtggatgcaggggatgagttctcaggagtgggcgaggcctcaccggcctggggagctgaccctggagatgggcccacagataaatccataaaggatttccagaagctcactgctgtgagagtgggcagctccacccttcaggaccttcg

SEQ ID NO: 48250 - DNA, 987 bp, Bovine  19866880953587
caccatctatttatttaatattaaaaataatatttcactgagtttggttggcgtcaactggagcagttactcatacaggaattcaaacaaaagcagcactggccttgagccagagggctggtgctgggtggtccatgtctgtccttagctcagagcagctcctaggctgctttcggacctgctttgggttaagaagatgatgtattcatttatttattagaaatgttttaacaggaaatgctaatagtttgcatttagggagaactaccctggagacagctggaggaatccagcagacatggttggggaggagattgctacgctcagccttggagtcagatcacggcctgttgtaaaagtctatactggggcccagcacgccaagttagcccgaaagatcctggttacttcacttcaggacagaaggggagaaacagggcagttctttcagcttccctgtttcccttctctgttgccatttgtttcttaggaacctggaggtgtgtttttgatgtgggcatgaacacagatgttggctctgctgggaatgaacaggccctgtgtacacaaatacccaggtgagagtgggtgagccgaggtataagcaagtacacgtgtaactcaaacccatttttagtgtgacttcgggctggcagagtcatgtgtgagttcaggggttgcatgtgcacatcttttcagcatatggggacgcatgaaagacaagtgtttgaaggggatttcaggcgtgtcctcaagctccagagtgcattccagcgctggatcatattcatggctaactttgtggagcccaaaggaaaaaaacaaaagacagggagagtacaaatgaagcctgaatgaatgaatgtatgtaggagaggaatatgagcaggtttgtgtatctttaaaaatcctcttccagctggtttaaaagaccataggacttcatttgtgacaagagggtgtaattacagtgccatggggaggggg

SEQ ID NO: 48251 - DNA, 786 bp, Bovine  19866880984838
cagcagatgatattagagagaattttaggtctttgaattaggaacaccccagtgactaccccagagaaggaaatggcaacccactccagtgttcttgcctggagaatcccagggacgggggagcctggtgggctgccgtctatggggccgcacagagtcggacatgactgaagcgacttagcagcagcagcagcagcagcagtgactaaccggatggaatgggaaaaggaagtagaaggaatagattcaagaatgacttgcagatttctgcttgggtgaatcacagggtatttcatcaaagttgggaatacgcatggaggaagtttgggcggataaggtaatgagtggagcaacagtgaatttggtcttggacaataaagtacctacaagacacatcaggagagatgagtaaacttggaggggagagcgaagaccaccttaaactccattggaggttagggcaggatgaagtgtggaatgaaggacaattgatgagaaattaagctaagcatacaactaacacatagtgtggggctggtttgactgattttgctcagggctgggtagagtcaagaacatcttgagaaaattgcaaatttaactgtagacaagcctttaaaaagcagttaaaaacctgttttgaaatgcatatttctgtaatttgtttcaacatgttgaattacagcaaatgagatggagaaatgatctcaacccatttttttggcctcctgactggaaacctcagaactcagccctgtaagctgttaatcaaataagcactgcagg

SEQ ID NO: 48252 - DNA, 747 bp, Bovine  19866881008854
tgaagggctgtaggtggaaggagaacaagatttactctgtaaccaatcctgctgatctgcagctctaaccctgctcgtctgccacttttcctctctctccctcaccacagtccctgcacagactgggtgcagccttgcccagatgacttcggcagccttctcccaggtctgcctgcctgtccagtcttgctcctctaattcctccttagagagcctaagtgatctgtttcagttgcagatctcatcacaccatacctctgcttaaaaccctgtaatacttctgcactgcctgcaggataaactctaaaccccttagtgttgcttttaagacccagcccctgcttggctctccagctgcatgccttgcctaggctgtccgccaccatggaaccccttgcaaactgaaccccagatgctccaggtctttgctgagaacatttcccttcccctcttcacagctggggcctccctggtggctcagtggtaaagaatctgcctgccaagcaggagatgcaggttcgatccctgggtcaggaagatcccctggagaagaaaatggcaacccactccagaattcttgcttgggaaatcccatggacagaggagcctgatgggctacagtccacagggttgcaaaaaagttggacacgacttagcgactaaacaacaaaacttgacagctcatttgccttccgggtattccctcagatgtcacttccttctaccccatcacccaagaccaggttg

SEQ ID NO: 48253 - DNA, 980 bp, Bovine  19866881073287
aaactgttgatagtggctgctttcagaggaactggaggaatgaagaaaataagctaaaagaaattatgtgtaagatgttgaattctgtggaatacaagttctagcaaaacagcaccaaaacaacctgttaagataaagctgagtttattcttatcacagtggatagcactaccttaacatatggtggccttttactaggaatttatttaaattcataataccaaatgcattcttataacttatggttggactcctgctattattattatagacagttttatgaactgagaacatgaaaatggccaaatcagtgaaaatttgctggacagtatctttaagtgtactgtcaagacttaaaaatgcatttctctgtatgttcatgtttgttcacacacatatggagaaatttggggagtgctttcactagcacttagctttttcacctgatatttggggacatatttgagacagattaccaagtactatttgcaaaaggagtttgaagaggtccatattttatttaaaggaaaaaaaatctgaactttcaatcatataatttcaacttaaaattctttgactatgggagttgtatccacagagcaaaaagtacagtgctaggcatatggatatgagccatataaataaaattgctattttcataatctttactttcgacttgggttcatctttgacctataaagggaaggaccatctttttggcatcttgtgaccagacagttgtgaatgggttgaaaaaacaggatgacttgtttatgggtctcctattttcaaacacatgaactgtaattgacttctgagcaatttctaagtataaagtgcattctttaagataggtgtctgaacttcattgaactctgactggcttaagctgtaagggaggtttagaggactttgaacttagtcaagccagtgagttaccagtaagactttttctaaagatatttcctttgcaattgtca

SEQ ID NO: 48254 - DNA, 1436 bp, Bovine  19866881138384
tgaagttgctcagttgtatccgactcttgagaccccatggactgtagccctccagactcctcccatccttggggtcctccaggcaagaatactgcagtgagtagccgtttccttttccagggaatacccagcttttatttattaggatcctgcaactcctagatccatagagtgctttttattactgactttcttaaggagatataggtttagagctttccagcatgtatgccaaagggcatgcagtcatgctctctccttgtgccctagaccagctgctgttgtctcactcttttcctactttataaactatttcttctggcagtctggtgaatacaactggagaatacaccagtattctggtgaatacaactaagtccgtgtgccacaactaccaagcctgtgctgagagcccaggagccacaactgaagcccgtatgctctagagcctgcactctgcgacaagaagaactgccacaatgagaagtccctggaccacatccagagagcagcccatgctcgccaaaaccagaaaaaagcccacacagcaacgaagatgcagcacagccaaataaataaataaaaagcaaattattccttagttgtccatcaaaaatggtaacatatccctaaaaacttgggtaggctgttacttggacttgagggtattaagaaataagtatatactatcttctaatcacttacctctaagttgctggagttccatgttcaaactctcaatgttattctcatagaactcaagattttgaagggtctctgccctcagtgattcctcttgcttctcctccagcagtaagttgagctcttcctgagccctgcggcacatatccaagtcctgttccatctcctgaatcctcaccaagaccaagggacactgggaagtctggtccaaagtcttgtcaacattctccgggccctccttttctaggctctcccagccaggacggttacaggttaagagcttggggggtactgcatttgttctctgctgggccgagggaggcaggggagctgggcgagagggtctcattgccaggggtggatccagtctcaggttctggtctcccggcacatggggaggagtagatgatggagtacagggacggggtggtgggggccttagagcttttctcctttcgggcaactcctgctgagtcattagcttcgaggaacctcggaaaatatccttttcggagttaaagtccatgattgaaaagtggcgcaagattttatctggttctgggaagggccctgacaagctcttctcaaactctatcagttgctgcgtcaactttgaatccaggtacgtgctgccgtctccttgtgaccgtgtcatggcttccagggcgggtgccctgtcttgcagaccaggcttcgtctctgatctgtctggggcggagcaaaagctggaagca

SEQ ID NO: 48255 - DNA, 2860 bp, Bovine  19866881154490
cttgaagctaagctagcttagattttggtttgcagcctcctgacgccatcttatttctttagagacaaatcctgaaaagtatttgacaaggcttaatacccatttatgatgaaaatgctcagtaaaccaggagtacctaaaggagaataccttaacctaacgaaagtttgagtctctcagtcgtgtccaactctttgtggccccatggactgcagcccgccaggctcctctgtccacggaattctccaggcaagaatactggagtgggttgccattcccttctccaggataacctgatgaaggtacacctaaaacctaaaacaaacattatatgaaatcgggaaactttagattaattctccttaagagtgaggacaagacaaagatgttcactaacatagcaacatttttgacatagttctggaagttctggtcaaggctgtaaaggaaagataaacaagaaatacaaggatgggaaacaacaaaactatcagtattttcaaaggacataattatggggaaaagaaacaacagaaaacagcagactatttgaataagacagtgaagccgggctgcaaaatacaagattaacttacaataataaataccatttctcttaaactaccaatagccaacagtaatagaaatacacatgattcacaatagtaacaaaactattattcagtattcagaaattaatttagccaagaatatcctcttagacctttatggagaaaacttgaaagttctaatatgggacttaaagatgagctgatgaagtatttaggcgtaaagggtcatgatgtctgcaactaataactcaaatgggtaagaacaaatggcagagaaatgtagacagggagtaataaagcaaatacagcaatatgaatctaggtaagggatatacaggagctctttgtactaatcttagaattcctctgttagttttaaatcatttccaagtaaaacaaaaattctggaaaaaaactgagctgaataaatgaagagacacatgccatacttctgaatgaaataagctaatatcaaaaagatgttaagcctctctcaaatactttataaattcaaggtaagcccaataaaaatttctcaaaaaatttgaggaacttgataaacatactgcaaatgttatatggaaaaataatgaccccagagtagctaaataaatttaaaaataaaagagatgggatacttgctgtgccattcatcaggttgtattgccaaatcactgtaataaaattagagcaataaaaaacagagcaagaactgacaaactaatggaacaaaaaagaggcttagagatagactagtgtatccacggaaaccatacaggagaaagagagtatcacaatgtaatgaaagaaatgatgggttttttggatatgttactggaaaaaactggctcattaaatggagaataatagggctggatccctatctaactcatgtgtaatgtggactctagacaaattaaaggaatagcaataacttggggactggcagggccttcttaaaactctaaaagcataagatataagccaaagaatttacttatttcattaaaattaagaatttttattaaaaaaagaatttttattgataaaaggacaacaaagacaaaattaacatatgagaaaacatctacaaagtgatgatgaataaacatctataaactgtcttccacgagtcaacagcaacaacacagtaacttcaagagaaaatgggctaagacaggaatcagtaatttatagataaaactatatgtataagagatctttataatcattagtaaccaaagaatacaaatgaaaacgacaagataccaccttgcccctatgagattacaaaaggtggagaccgagagaaagctgagtggtggttgggacatgatataagacccctcaaacacttctggcaggagagattggtacagctattgtgggcaggcatctggcacagtctgatcaaattcaggacgtgaaagcccatgacccagtgattcccttctaagtgtataccccacacttctattacacagttttagaagtggacaggtatgaagatgctcactgcagcaatatttgtggtggtaggacgtagggacaacctgaggatgtattacacagagaggagacaagcaaaattgtggttcacacatgcacagagcatgggacataatacagcattcagaagcaaagaattagatgtacatgtagaaacacaggaggaccttaaaaacagtactcggggtgggtgggaaagcataatgaaatgcatcatcaccaactaaaatccagggaggaagataagggaaaaaaaaaaaaaaaaagacatcttttaggctccttgcgtgttaaaaaagaagaattcaaatgacctgtgatgaaaacaaaattagaattgtttccttcccctaagtttccaactttcctaacaacaaaagcaactctggttgccagctttgttgatgagtaacagcttttcatcctttttcaagcaggaagggaaaaattcagggatcagcagaggactaaagggatcagggcagaatggtcacgaaacagtgtttttgttctcatgacctcacaacctaactgaaaagagccgattacctcttgattaggagtgagattaggagtgattcagctaaaggcacattggtgccatcaacttttcacgtcctctgaaacaacttactttcagaaccttttcatatatacaatcctctagcccacagagattccacacttcttagaatctaaaaattctagagctagagagcgcctggttatcctaagatgagcaaacgaaagccaggggactgcagttcagggtcacgaaa

SEQ ID NO: 48256 - DNA, 1090 bp, Bovine  19866881204253
caggctcccccgtccctgggattctccaggcaagaacactggagtgggttgccatttccctctccaatgcatgaaagtgagaagtgaaagtgaagtcgctcagtcgtgtacttgatctacacctcctttatgatgcctactgtttcacttaccacgttgagttagttatatttatgtatgtatctatcccaatagacaggatatccttgagggcaaggactatctgcttccacagcaatgctggacactccctggcacacaaaatagattcatatatgacaataagtgaatgaatgactgtgggaataaatgaagaccacccaaatgagaacaaagaggctattctatacctaatgaaacaaggcagtcattcactatcacttggcatctggcagagaaccaaagactgtcaggggagtgggaaagtttaaggtagaaaaacaaaacgggaagatttcatgtatgcactgatttgagagtactggcatggggaagctggaggcaggctactagaagtatggcatcttacgtgattgttttggtagagcatatttgactttctccagttggtcctgagttggaaaagcagggcaaaaattggggaagctgacagtcactgaccagtcataagaattcttggctgattgctgcagattgattgctgagctgattgctgattgtgggtcagagttttaattgtcatatgtggtctgaccattattgagtttgtatattcagtctctcgtgactgtttcttttttcctccattaccctcccaacctggttgagtttcctagcttgcttcaattctcacctttcttctttgtccctcaatccttactctgcttcaagtgttatattttatccaggcccccagaaactacattgagtagaatagttgtgtaaagttaggattaatcacaaaaatatacaaatgtcaagtggtttttttttgttctagagcccagtttggtgcctagaaaaagatagatgtgggaaaaattcaacaaatgttttggctttcttttttttttttaattcttgaagttgcctactaactatgcagttataaatctaatctatgtatatt

SEQ ID NO: 48257 - DNA, 972 bp, Bovine  19866881550762
ttgctaggcccaagacaggtctgagtcctgacaatccttttctggatccctgcctgcctgtgggactcacagatgtggtggaaaggaacagtcaggtcctgcatgtccgaggacgaggggactgggcggcttgtggggccatgctgagccccctgctggctcgctccaacaccagccaggcctcactgaacggcatctaccagtcgcccattgacttcaacaacagcgagttctatggtttctccgagttcttttactgtacagaggatgtgttgcgcatcggtggccgctaccatgggccaacatttgccaaggctgctcaggtacattattaataataaaaatgactcatgctggcagcagccatttattggatgcctaactttgtaccagacactgtgcaaacggctttgcatgtgtgatctcactggcttcttggcaggagccctgtgagcacttattttacagatgaggaggtgaacttagagaagtaacttgctatgctctactgcctgctaattaattaatcttaggtctccatggatgtccagttaccaaaattatcacccagatctaatattgtcatggtggctaatggtttttcctccagcttgccaatagtcttgtctaatctttgtggacaaagtgtggtctccagatattttccccttactgggtgttcccaggtgtaaatgcttttggagatgatgtcacacaggtgggcaagtccactttcgttttcttaccttgagcttttaagaggccagtatggacaggtaaaagtttagctagcattccacaattcctgttcaatttggactcgtctctttttcatttttgtatatttttctcttttagcagaaaaacttatggggagatctgtcctcccatattttttattatctccctctgtcttcttcaatttctgttagtataagggccttagtataagaaataatatatgtagtatat

SEQ ID NO: 48258 - DNA, 742 bp, Bovine  19866881563899
tcctcttgctggtgaatgcctgtctctccacctttgcagagtcactctgcataggagacgcagagacccttcattcttcaaaccctcataggatataaaaccctatgagggaggagatttttgtttgttttgttcactggtctagagcaatgctcagtgagtagtttttggtgagcaaatgatttactgaacttcaggaaaatacaaggaactgttcatatcaaaatctctacttccacttatctgaaactaaattaaccatctcttctccacaaatagttttatcttccagcttgagtaacagtgtcatataagtctttcagacttagaatctgatgtcaaacatcagaatctgatacttcttcctctataatccagacagtacactaaccgcagcagctaccatttaagaatttatcacatgccagacactgagctaggagcttgtaccatcaccacactgcaaggtggagaccaaggtgctccagtcagggtccctggcttcaaatcccagtggcaccactaaacaacatacttaactctcagacgcaaagctaaaccagaactcaagtctatttgactccaatgcccatgtactttttaccgtaaatgttattctcttacatctcactggttcttccttcaaaatcactaaatttccattttcctctctttagttctccaacattttattatgaaatttttcaaacagccaagctcaaagaagccgacacccaccacg

SEQ ID NO: 48259 - DNA, 1296 bp, Bovine  19866881608863
acacgagcaactgccatttactgaatacttattattagatccaagaaaatcaaagaagccaatgtttccatctcctaatcttccattggtttgaaaaagacctatttccctttgttctttttcttaacttatagatttatttgcttcaccattgcaaagccaaaaagcagcaccttggttgcaggtgcttaacaagatattgagacgagtcctgactgctttaggctgcagaacctatccttttagataaaggctggtgcttgcctctgaagcacagaaaaggaaaactggaattcacttgcactcccaaacctccctattatgaccatggaaatagctggttgaataactgtggcctagccaggctatgctgacttcccatggtccttcccaaggatatttaactcgaccaactaagatcatggcatccggtcccatcacttcatggggaaacagtggaaacagtggttgactttatttttctgggctccaaaatcactgcagatggtgattgcagccatgaaattaaaagacgcttactccttggaaggaaagttatgaccaacctagacagcatattaaaaagcaaaaaaaaaaaaaaaaaaaaaaggcagagacattactttgccaataaaggtctgtctagtcaaggctatggtttttctagtggtcatgtatggatatgagagttggactataaagaaagctgagcgctgaagaattgatgcttttgagcatcaatttgaattgatgcttttagagaagactcttgagagtcccttggactgcaaggagatccaaccagtccatcctaaaggagatcagtcctgggtgttcactggaaggactgatgttgaagctgaaactccaatactttggccacctgatgtgaagagctgactcatttgaaaagaccctgatgctgggaaagattgagggcaggaggagaaggggacaatagaggatgagatggttggatggcatcacagacttgatggatacgggtttgggtggactccgggagttggtgatggacagggaggcctggtgtgctgcagttcatggggtcgcaaagagtcggacacaactgagtgactgaactgaactgaccctgataagtggcctggggatggacggtcctgcatgccagaggcactgtcagctttcactggcaaacactgtgattgccctttaggctccaacacagatacctgcctctagtcttagggtactttgggctgctcttcctctctgccacctatttatggtaaaagaggaagaagggctgcctaagga

SEQ ID NO: 48260 - DNA, 772 bp, Bovine  19866881673756
cattgcaggcagattctttaccattgagccatcagggaataccatagtgttacctcttcagaaaggcctttcctagtcatacaaatgtagccacccagtcacacatttatcacacctttctactttagttatcagcatagtatctagggctaaccaatatttttaacggcttatccctccctctccattaaaaagtaagctccatgaaggcatggacactatcttgtatcaccagtttcaaatacagtgccaggcagagttggtacccaatatatatttactgaatgttcacatggaaatttcacttacaagatatgcaataagggaactatagacaggactccaatgaggaaaacagatttgggatagtgaagttctctaaactattagatgaataggaattatttaaacctttaggaatgttcccccttagtgggtagagaagtgtaggagattcagaagtctaaagggtagagcagtgtctcctgaagcaaggacaaggtttcagtgagtgatgggtcaatgatgggcaagtgttacctcttagtgaagaagaatgggaataagaaaaagaccattggatttggaaaggtcatttgtgaccatagattaaaagagcaaaaatgtagggcttaagaagagaaaggacttggcaggtatagctcattagtagcgcagtttggcagttaagggaattagtactctagcaggattgagtgggtttcttttttatgaaacccaggcttcttaacttaagttaaggacccctagg

SEQ ID NO: 48261 - DNA, 1190 bp, Bovine  19866881687249
ggatggggcagagagaaaagaagagacaaggaaaagcaggagaatggaagggtaattagaaaaaaaaaaaggataggtgagaaacacaaaggtgaagggaaaggagagagggaggaaaaacttaagagaatgaggaaaaggaagaggggagcaggaaagtaccactagagagacccctccttacgaaaaccacctctccatcgctttgatagagacccaggggcctgtgtcttctctgtgctcatctccccccacagccacccaacaccagcatgttactctccactgtgggttttctctgaaatgtgacccatctcacaatcccttcctcaatggctaattacttgaaatgcaagaattcatttgcaaaggaagctcgtaacatggaaataaacagtgggccccaaagaaacccagaaaaataaaataagaaattccaaaaatatttaattactgcatctcttattgttgttgtgtagcttcttatagcgtaaaacaagacccaaactagccaaacatactctactcagccagaaagtctagtcgtctaaagagcagatgaaggcaaactgacagcttttaagccccaacagggcttttaacgcaaaagggcctgctttcaagcaaactgaaagcaccaaagtagtaaaataaattcctaaaagcttaaatgctgtgcatgtacacagtgctaaaccccttagaattctacaacaaaaagatacttaactacttaatggaagctgtttgttattttttttaaagtctcaagtaacacatactaaaatagaaataagtattttgaaataaactcatggagtgctcatccaaatctgaagcccctagagttctcagaaatatgggataggatttgaagcagtttgggcttcccgagtagcttcctggtggcttagcagtaaagaatctgcctgcaacacaggagacgcgggtttgatccctgggtcaagaagatctcctggagtaggaaatggcaacccactccagtattcttgcctgggaaatcccatggacagaggagcctggtgggctacagtccatggggtcacaaaactgtcagatacaactgagcaactgagcacatttgaagcagttacattaagactgataccaggtttcatttgaacagtgattctcacctcttaattcccatgattcttgtgtgtgtgtgt

SEQ ID NO: 48262 - DNA, 972 bp, Bovine  19866881692133
atgaatagcctgttgtagtatagggtttttaagtgtggtaatagggaatgctaggaagtgataagataaagaaagttagatcatgaggagttttgggagccatgctaggggatttggcttttttatctgtagatagtaaggaacaagcaaacttttttgagtagggcggtcatacaggcttaagtttcatcatctttgaaataattaaactctgaaagtcaccagctctgaattttgtgactatgttaatcatgtgacaaggttagggtcattttatgtctttgtttaaaatagctctatgaagatgaaagaatgctattaatacaaaatgtcttaaagagtagtcatagcaaatgaaacctggtgtattagcagtgtcataccttgctaaaatcaaccaaaactagaatttcttttacatcatattgcaggaagaagctgccaagatcttgctggctgagttcaacctgggctgtgacgtgcaacacactgaacacgtgtatagggtttacgtcacgacctttctgggttttgggggcaactttgcccggcagcgctatgaagatcttgtattgaatgaaactcttaacaagaacaggtatgcttgacatgggatctgtgattctgaaatagaatgttgtcaggctgcagatatttgggagaaatggttacatcctaccaagatattaatagacatgtccttgcttcctccttcctcaccagccctgccagtggggtagcctttgtgttgttcagtcactcagttgtgcccaactctttgtgaccccatggactgcatgcagcacaccaggcttccctgtccatcactgtctcttggagcatgtctattagcagtcccacttgatcttcatcggagtgccttctaatctttgttattaggacttagaaaagcacagtgtcttattgaagtgcccatcttcagacatggcatcacaggataattgagctcaa

SEQ ID NO: 48263 - DNA, 1038 bp, Bovine  19866882067306
aatagggagcctggcagaattaacatatccttaaaccagttaccttaattgactgatcaaagtattaatactaatcctttattaactcctttcactgtagagactaggcccaagaatgctctgcagagggcatttgaagtctgtatcagctggcacactgctggtgcctagtgatagtaagtaaagaaagaatgaacacatgacagatttgaactcaataacctttgttctccaattattataaaatatttaaattcattaaattgttaattggtagagacagagctgagtcaatcaataacgttgatgatagcttactcgaataatggttaccatgtgccaggccaacgcctaagtgctctacatactttaactcatttaaatcgcaaaacaaccctatgatgtagctagaacgattagtggtgctttagacatgaggaaactgaggcatgtgctcaaggacacagagtgagtcactgtcagaactgagatctgaaccgagcagtcttgctcaggagttcacaccttaaccaccaggccatatgagtgtcgctggttccactcaccatgccgaggagcggctttcgggtggactggcggtccatggttttcctctcaaatggtctcttggtggtgggaagagactctgggaagaaggtgaaaacctggagctgctgcaggaccctgctgtgctcctcatggaagatggcaatcaggttcccctccctgccggtgactttgagtagcttggagtccatgcacaagaacagagacagaggggagaaaagaacacacgtaaaagaccccaggacaggcacagtctccttgaaactcctcaagtgtgagccaccaacactgtagccagggggccacaggcccagctcctccagggtagctcagtgtggaaagagaccattcaaggccatgggatttccagcactgtcaaggcatcaagaattccagttccccatgggcttgacccaagtgacatagttaacctgcctagcttaataatagcttgacaaccctgacatgtat

SEQ ID NO: 48264 - DNA, 3487 bp, Bovine  19866880167241
taaatttaacgtgtcctcctcaagtgccccagaaatgctttcctgtacatggggtaaatacagaacaattggcggaaagtacaagaaaaggacttttctacttggcgtgtgttttcttgggtgtggatgtcagctgcagcaggcggagatttttattttcaagcatgggttttagtttcactcagaaatctgtatttcgggttacctaagaatgaactgcatggagtggaaccactgggcttctggcggggccggggggatggatcacatgagagcagatttcacaccctggggcctcctgttccagggttcctgctgtctgttccacaggcaccacagggttacattttctgctggaagcaacctgtactcttatctcctctctgttgtaaatgaattgtgtgctcttggacaagttactaacctctctgagccacagttctcatatttacatcataaggagaataatgaaagcttacagggttgttttgaagattgttgttgtttagtcgccaagttatgtctgactgttttgtgaccccatggactgtggcccaccaggtctctctatccatgggatttcccagacaagaaaactggagtaggtgtcatttccttctccagggaatcttcctgacccagggatcaaacccatgtctccagtattacaggtggtctctgccattacaggcagattcttcacccactgagctacccagaagcctgttttgaagattagatgagattaaatctataaagcattccttgtcaatcctgtcatgctcttaagcacaagttactgtaaacatcaaggtcttcagacttgcagggttgtgtttggatgtttgtaccaagtcatgaaataggtgagtgactcttagctccttctattccctctctcacgtatcaagtagtctgtgagcttgcctgtcccagaaaagtaattccccaaccatgcaaatgttcctgatccccagacattcctcgtatctttcatcaaattcaatcatccttcttccatttttctcttttactaaatccacacatgtgctgagttatgcatgattagacaggatcagaataaagttctttgcaagggtaaatagggagaaagccttcctaggtatatttactttcttacccaagaatagaaaaagtagttttgctaaatgaatggatttcaaatggtgaagcaacataagtctgagacaaggttgcagtgggaaaaggggaggctccccttgtggtgcccctggaggcctgccctccagatggcacctcttttacatggttggtgtggtgtcatgttaatttatttcaaatatactttatgtaggattgaagttagctaacaagtgatactagaataaaaatattaagtaatgaaagtgaaagaggagggtgaaaacgttggcttaaagctcaacattcagaaaactaagatcatggcatccggtcccatcacttcatggtaaatagatggtgaaacagtgtcagactttatttttctgggctccaaaatcactgcagatggtgactgcagccgtgaaattaaaagatgcttactccttggaaggaaagttatgaccaacctagacagcatattgaaaagcagagacattactttgccaacaaaggtccgtttagtcaagtctatgatttttccagtggtcacgtatggatgtgagagttggactataaagaaagctgagcaccaaagaattgatgtttttaaactgtggtgttggagaagactcttgagggtcccttggactgcaaggagatccaaccagtccattctgaaggagatcagtcctgggtgttcattggaaggactgatgttgaagctgaaactccagtactttgaccacctgatgcgaagagctgactcatttgaaaagaccctggatgctgggaaagattgagggcaggaggagaaggggacgacagaggataacatggttggatggcatcactgactcaatggacatgggtttgggtgaactccaggagttggtgatggacagggaggcctggcatgctgcagttcatggggtcgcaaaaagttggacacgactgagtgactgaactgaattaatgggaacagagtttcagttttggaaggtgaaaaattcaggagatggatgatggtgagatttgtacaaccatgtgaatgtacttagtgctgctgaactgtatagctaaatatggtaaaaatagtatgttttatgttatgtggcttttaccacagtaaaaaaaatgcaaaggaacagtcaggataaatggaatgtcaagaccacgtggagaagctgaatgcaagtttgtgggtggtgtgattgtgcagttgctgtgggcaggccatgtattttgttgtgagcttgctggaaggcaagttgaaaaggaaatagcaatctagccatgagagaaaaaaaataatcagttcctatgaaaggcaaacatttctcagtacttaattccactctggagctgcacagacaacaggaattgtagtcagcagtggcctctacaacatcccagcaaactcagaagtggctttctaatctcccatttcttggcctatgacttccagaatctggtgttaatgggagcctgccaccttgggtcaacatggtccaaaaacacagctttctattgctgtcttgactttggtttgggataatgagaatagacttcactcgtgagccaaaaggcacatgtgttttgaaggaaactccaaagatagtcctcaaggcttcctattgtgcctgggaagatttgaagaggacaggctgtatcttgttctcagcttgaattttcccaggcagccaagagccttgactgggagaatcatcattgaatgagtgacctggaggctaagctagacctaagcttgcctttatgtgtaaaaatggtcactttgggaagggtagggggaaggtcggtcgttgatttgtcaggaggagcgtagaagaacctgactcactgactgaggtccagccccctgtgtcatgagaagaggtccaatggccacgctcataggtccccccacatctctctggagtatacactgttctctcagatccactgtggttaacacagcctgttcacagtgttaaagggacatgaggctaatcagctttaagtgcagactagatttttccctgtgcattaattgtagcatgtgaacattcttttaagtaagtaaaaacaaatatatttttagtgactgaaatacccttgtttattttggaaacagtaagtgcaaatgttaaaaaaaattaaaaagagcccagtaattttcttctatgactttgaaaacaacttgattttttcttgcttccaccaaaaaatgaactcattagacataaaaaaacttaaaagatagtaagttttgattaatctaaaatctcttgattccaccacctagggataatcattgttaacatttccttctatttttctatctttatatatacatatccaaagc

SEQ ID NO: 48265 - DNA, 1542 bp, Bovine  19866880379852
acggaatgaatttccttctttaacacatttgtttaattttaaagagtgaagcaattgaataaaaataacagagaattgtaaaagtggcatgtacaacttaggtgagaaggcatgatgaactaggaggagggtacaataaaaaaatcctgaaggttgtatgtcagtgattggcatttgggtaatacttcaggagttgagagcaagagggggcttcctttctaactcatcacttgccagcctccatccctacccccattgcactagccgtaaacctcaagatggctgaaaccagtctcagtgggctgagcattatgtcctgggagctagtagatgctcattaaatattggctgagtgaaatgagaaagtgaatggataaatgtagctcagttcccttgttttgcaggtgagaaaaccgaggtttagagcacaaggagggcatagtcatttagtggcagaatggagactgtggccagatctcaagctctgggacccaggccctcttcactgacctgtagttgttagggtctgaacagagagcattcaactcccatacttagtaatgaatgctggtaattctccgagtcctttatttgaagcgtgtgtcccttttaagtcccaatatattaatgcttttatgagctccgtgaaccttgtatgggtgcttagaggttaaatttcctgtctgacccctcctccagtatcctcagtagaatttatcactttattcagttgttgtccatgtagtgactggacatgacagtcactaagtcatgtccaactccttgcgaccttcactacttcctaatttgctcagattcatgtccattcagtccttgatgctatccaaccatctcatcctgttctttttcaaaaaataattatctacaaaacaggggccaaaaacttaagggacaaaaaaaaaaacttcaggagtttaatgagaccttaggtattgcttttgggggaaaatttagtgaaaactggatagttatttaaattcctggagaaaactaaagccatgctgtagactccagggtgaggagcacgtatttcagtttcaatattgtaagttgttggtgtttaataccggtggggcagccatgtgcttcccacggctccttggatggaagaggcagatgggggaagggtagtcacatggcatctgtgtcctctccacagatccaccgtgggcgccctgctggcatctgaggtaacctgtgctaacacctcccagctgcaagtctcatcttgtctcattgcttctggcctgcgtggtttgtaaagtcacctcagatacctccacaaagcttgtgaaaccacctggagcaattttgtctctttccttggtcatggaaaataatgatgaatgaaaaaaacagctgcagcaacccagtgggcaggattagtgaagcatccttacagacctccctgctcctgcaccaggagggatggtctgtgtggctgctggtgggaaagagggtggccaggttgtttctacacctgctgttagtattaggaacccacagtgcccatcacatggg

SEQ ID NO: 48266 - DNA, 990 bp, Bovine  19866880406613
cacgagtgaactctaatgtaaactctggattttggattttaatgatgtatcaatgtaggtttatcagttttagttacaacacatgtaacactctggtgggagacgctgatattggggaggctctgcatatacaaggatgaagggtacagcagaaatctttgtaccttattctaaatgctgccatgaacctaaaactgctctacaaaaaaaaaaaaaaaaaaagacattttggagaagaaatatgtgcctttattctcagagatggcttagaaagttggaaaagattttagatttttagtccaatgcctgcaactttatcagggagcatcagggtccagaaaagagaagcgacccacttaacctggtgaatgacaaaggactaggacccaggcatctacatttccattttcgtagctctttcagcttcattctagggcactgtttatgtgagcttgattaatgtcgctgttttctctgtgtatctaagtgacatacttatctaagtgtatttaagtgacatactatgatttaagttcaaattaaactgctcattgctggtatataggaaagagattgattttttttttgtatattaaccttgtactccttgaaaaggagtacgtcaaggctatatactgtcaccctgcttatttaacttatatgcagagtacatcatgagaaatgctgggctggaaaaagcacaagctggaatcaagattgcccagagaaatatcaataacctcagatatacagatgacaccacccttatggcagaaagtgaagaggaactaaagagcctcttgatgaaagtgaaagaggagagtgaaaaagttggcttaaggttcaacattcagaaaacgaagaccatggcatctggtcccatcacttcatgggaaatagatggggaaacagtggaaacagtgtcagactttattttggggggctccaaaatcactgcagatggtgactacagccatgaaattaaaagat

SEQ ID NO: 48267 - DNA, 1145 bp, Bovine  19866880471322
ccctgatgaagggcaagttctgagagcactcttaaacttttgaagcagtggtaaacaaactctaaagttgcaacccagttgcaccaaaacctaagctaaggcacgctgagaattctactttgcagtagcagatcattctattgatcttataaccatgagcctaattctgaagcttgcagacccaaatggatcaggtggagccaaatccacccccttcgctgtccaactgtgctccaagtggcccaagtcattgctggcaagattcacacctcactccacaattagggtccactaataatttgcatttcttcttgggatgctgtgcatttttgtactctatgcagtgatatgctaaaggagaatcaagaagagagtgttcctcttggccataaaaaggtattcaagacaggcagaaagaagatatatagctaaatacatatcacttgaccttgcctattttattagaaaagcatatcttaagaattattagttctcgaaaaagaattcagcataacactggtctttatctctaaatatctcattagagacactattaatcttagtagaacagttcctggtgcaagatttaaaggatagaaaatcattattttccattaccaaacagagtttttgccagaaacaaatggccagtgggagatttgaaagaaaaacaaatttctatttaattgagcttattgtcttcctgaaaacctactaaatggttgcttccttaatgagtcagggaaactcaggattttcttagtgctgttgagatctctactttttcccttttggttttgaacctgtttccttctctgaacatttgtagcctttctttgtatatgattttttagattaactctgttaagtgtgtagccattggagatctaagtcaaacccaatgcaaacgataccaatttgagtacttttattttgaagaggggtcattgctctattgtaaataccttggcatgcttcctgacgcttccaccaaaaaaagatttctgatttcagtcatgtgcagagctagcaagggaacaaatgctattctgaggacaaggaggaagcacgctctgtgccaggtgctaatccgatggctttatatctgttaattgtttattctttataccaaatcttagagatag

SEQ ID NO: 48268 - DNA, 1674 bp, Bovine  19866880513617
tattacatgttataacatataggactttgttagtttttattttcaaatgcaaatacaaattatttgtattcattgtatgaatataccatattttatttatccaataattagttgatgaactttagggttagtcccacttttgggaagcattttgaataatgtttctatgaacttttttgtgcaggttttgtatggacatatgtctttattcctgttggatatacatcctttaaaaaaatttcttttaagtttctgcccatgctatgtagcatgtgggatattagttcccaaaccagggatcagacccttgcccccttgctttggaagcacagagtcttaagcactggaccaccagggaagtccctgttggatatacatctaaaagtggaattgctgaatcattttgtaactctctactttatatttttaatcttctgattaatctctttcatcatttggtaactctgtgtttaacctgccaaactgtttcccaaagtggctgtatcattttacattcccattaacagtgtatgggagtttcatttacatccttgtcaatacttcgtgttatctgtctgattataagcatcctgctgctgctgctgctaagtcgcttcagtcatgtccgactctgtgcgatcccatagagggcagcccaccaggctccaccgtccttgggattctccagccaagaacactggagtgggttgccatttccttctccaatgcatgaaagtgaaaaatgaaagtgaagtcgctcagtcgtgtccgactcttagcgaccccatggactgcagcccaccaggcccctctgtccatgggattctccaggcaagtgtactgcagtggggtgccattgccttctctgataagcatcctagtgagtgtgaaatgatatacagttgtgattttgatttacatttgcctaatgattagtgatgttgggcattttttcatgtgctaattggccagttgtatacctttgatgatctgtgtagttaccttatttttcctgcaccattatgtattgggtaggggttggttacattgatcatttttctactagttgcaaaatcaggaagaaacatatctgggccaggttgggaatttactaaagaaataatagatattacctaaagatcttgaatgaagaacagtgactctgggaaatctcctctcagtgcagtagctgggtgtgactttgccattggggagatgatagttgtatgttaggtaaggtcatttttggaattttatgtgcattagaagagtgtatgtgttaggtagaaaaggcaagggctgatatatactgagatgacagccctgctgattttgagaatggtctcttcctttcatccacatgcttacagtggtgggactcccaacaggatgtttggaaaatataacacaaccctttggctgcttttgattgattcagaggtgtccatatggtcccaacttggccgaaatttcttgaggaatgaaggcaaagcagaatatagatgacagacagacagacgagttgtgctgtgttcaggtctcttcctccagcttactcccagggtcctgctgtctattgtccttcggttctgtggtccagtccttcaatcagatggtcctttttggtttagtcaattttagtagatagcaacgactactgtattgtacttgttt

SEQ ID NO: 48269 - DNA, 2273 bp, Bovine  19866880530487
aagtggggatttaccaagttcaacacggatgaatttgagaacatggtggcagaaaagcgactcatcccagacggctgtggggtcaaatacatccccaatcgtggtcctctggacaaatggcgggccctgcactcatgagcatcagtgctgtcccctccttaatcacgctcaccaataaatgctatttcctgtcaaaaaaataaataaataaataaaataaaataaaattaagttataaattcaaatatatcaaatttcaatggatataacttcagcctataaatattaagctacatgtcaatacatgtttaaatgatgcttacaaaagaaatttatcaagaagtttgaaataatcatgcagtatattaactatattcatgaaatctggattattggattactagtgttatctacagctttaggaaaaacttcagatgttaaatgaatgattcaaggatatacatagattctctaaaagtgttaaaaacgtaactgggttttaatgtatgtagacctaaccttcatcaatatgaatgttttaaatgtaattaccaactattagattgatatcttgatgattgagatgtatatgtttttctatactagtcaatcaatatattagcatgtagattaaaactgaaatgaaacaaatttcaagtttgatgttttttaatatatacttgcttttaaaggttgtatacataatggctttggcttctgtatgaaaacatgaggctaagaattgctagagtcatgtaaagatcataagaggaagaccatgagaatctccgagacttgggtctgagtcgtaacattctgagcctgaaccaatttggaaaaacttaactccagacttcttgaaatatgaggtaatgtctgtttttgttattaagttcactcttaattggatattctgttatttgcaggcaaaatccttcctaagtgatatctaaacatataattttttcttggaatgtaagaattgttctagtcaattgccaacagattaaaagagaaaatactgaaaagaaatgattgacaaaagtcaacatacattaaaaaaaaaatcttagccaactacaaattaaaagcaatttcttcagacacagataaagaacagacttttggaccatgtgggagaaggcaagagtgggactgtatgagagaatggcattgaaacatgtatattaccttatgtaaaatagatgaccggtgcaaatttaatgcatgaagtagggcacccaaagctggtactcagggaaaacccagaggggtggggcagggaaggaggttggaggggggtccaggatggtgagacacatgtacacccatggctaattcatgtcggtgtatggcaaaaaccaccacaatattgtaaagtaattagcctccaattaaaataagtaaattaatttttaaaaattaaatttctttaacattagcttctagaaaaccattcttaaagaaatatcagaactatacttgttttagtcgaaacagaaaaggaattccactcactagtacttgcatcattacactggagatcctagcctctgcagttagctgtacatacatacatacacacacagagacataccaaagaaatgaagcataaacagtagaagtaaatagaccaaactctcattatttgcaggtgatttcacaaaatcaaatacttagaaaattctagaatacttgctaagacgctgcataaccacaggtcttgctaacttaaatactacatgcctaacacatatacttcttttcactccacaaatatttattaactatctaccatgttactgtgctagacaacagagattcaagtcaagcaatacagtacattccctgacaagcatgaaactgtatctaccatgagaggtaaatcaaccttaatcaatgtttccatccattccattttggggcttccctggtgactagcggtaaagaagtgctacttgctcagttgtgtctgactctttgcaactccatggactctgtagcccaccaagttcctctgtccatgggattctccaggtaagaatactgtagtgggttgtcattcccttctccaggggctcttccacctccaatgcaggaggcatggggttcagtccctcgtctggggaagatcccacatgccacacagcaactaagcccatgtatgcatgctcagttgctcagtcatgtctgactctttgaatcccatggacctgtaggacaccaggcttcctttgtccatggggattctccaggcaagaatactggaatgg

SEQ ID NO: 48270 - DNA, 2304 bp, Bovine  19866880634307
cagcctcctctgctcctgccttgcttgcaacactggaggtgacagacaccctgaaccactccccagcgcccaccccacttctccgtagacaatatacacaatggccagaagaggattaaaatcagctttattgacaaattgaagaacacagctgggatttgaggcccaagcgaggttttttcatcttctctgaagtgatgacagctgagcccactgggtggggctaaccaaacttacccaccccgccgcagaccgaggctggaacgtggagagctgagtcctgggtgggctcaccacgggcaggtcccgctgggtttgtttactgcaggtagactggaagccccaaagcaggtccaagagaaacagagagagagagaagaagcaggaggacaagtaagcagggtcctttagcacattatctccacccagtagagaaaggtggtcccaagagtctcaagttcatcaaccacaaccatcccaactgaggtcaccccggtggaagcttctccccagtactttccttccatgctctactgtagttaggagatctttgccttgattggctgagcaaggaatgtacgaataaggaaaaaggtttctcccaggaggtaagggtggcttaggagcctggactgctcagtgaacaagtggccaggggctattttgtatgagcctcccagtcggcagccacgatgcaaacacaggtgctggctagagctggtggattcaggactgactcccgacatctcacacctgaacactgaccaccaaattccttttctttcctgtgctctggtgctcagacccctgaggactgctgaggaaagaactgggcagacttcacccacccccgaaccctggatgggtgaaatggatgaagggggtcagaaggtacaaatttctagttataagataaacaagtcctgggagtgtaatgtacagcttggtgattctagttatgattctgtattgtatacttgcaagttcctaagagagtcagcaatcttaaacgttcctatcacaagggaaaacaaattaactctgtgaggtgacggacagtgactaaacttatggtggtaatcagtttgcagtatatacacatatcaaatcattacctacctaaagtaatatactggtatatgtcaattatatcttgataaaactgaaaagaaaaaacccactaggccacacagctagggtataattcagctggacacctatggtgttcctgttgtaaagagagtccctttgactccagagtaactgacaccttctgatttaactgtcaggtgtgaaatcattagctttgtgccaaaccaaagcaggagggccttttaggccacgcatgcagggaagacaggagtagaataggaaaactcttccagggcctgtgaactgatagacgtttaatggcacgtcttgcagagtcgagtctgacgtagctctctttggctcaggaagtaaggacatactgctagcactctgaagtcctcccgcctacctgtcacagagaaaaccccttttctgttttttttcctgtgcttttctatcttgatgccactaactatactgtcttctatatttggatgcatttccagtgcattcaatattttgccttttagcatgggtgacttctgctaagtgttaatcccatccattagccattcttttcatagtatcaccattcaagggtgacctcatttcatggcaccagatggcacctttctgtagtttccaacaggctatttatacaactttactttgaataaaactgaatgattgcagaaacattttttccccagagtatttttattagggattcctgccaccatattaacatataaaacaatctggatgttgacacagaaatgcaaatttcactgtacaaagataaggctccaaccataggtaacgtggcccccagatctctagtttttcagtgaaatcaatcattttgacttcttccccagagttgtctttatattagacaaactacaaaatatgttccagatacataacattttacaatatgttccaagcacagacagaaatacacaatacttcacctacatttttttcatatccaacttgcattagcactaaagattgtgtgtgtatatgtatttgccatatgtgtgtgtatataaaaccacaaatgtacacacagtaattttcatggaaaattgaaacctttgagactgtgggttttatccactatgttatcagagagggaaaatgaataataccatgtcacaaattcctcaattggggataaataaaaacatctgtgtatgaagggcatat

SEQ ID NO: 48271 - DNA, 1176 bp, Bovine  19866880662842
cctcttttctcttatgaaatgtggttcagaggtttagaggcaggcatcaagagttggagcatctcttcttcagctaaattccaactttgccaggcaacgtggtgcgtggccttctcttctggtgctgggtactcctttggaatgcaggctgggttgagggcaggggcgttctctttgccctcatgagttgtcgtcaccactgtgtccctggctcctagcacaatgccttgaacacagtagataccagtcgatttttaccgatggaccccagtctcctttggaacttgggtgtttgcatgttcttcctgattgacattgcccagtcttgcgagccatccctggtctctacctagacacagttactattttctgtcttaaatcttttccagaactaggcacacaaacaaataaaacaacttaatgattcaggtgcttgacagaagttgcttccatgagtaacacattttggttcttgatttaaattgtacctcatttggagctgcagcaggaaggaggaggtaacttcattacagagaaaaaaagatcacatgaaacttggaattggttttgccttttcctctctattcaagggcatggagttatttaatccgatgcatctctcaatgcgtgcacttgctgcagggatgggaatgaagtcccactgacagtaagaaattctttcccagaggaagtagatgtggttgccttgctgcttgtttacatagcagtcaccttggtacctaaaggtagcaaatgtgggtgttcattgtgggtacttgatagaatattctaatattgctgctttatttaaaaggcttagttttgtgtaatgtaactattgacacatttgcatcatctttctccaggaaaaagtgtaggtaattgtatctgtaagaactgcaagttagagcccctagcttggtagctcagctatctgacctgaatgctcctgtgaaagaatgatccacacataaaaatttcggatgtatctgctctttgaaaagtgaatgtggtaccttctatgtaaaataggagtcttatcttgtctttgtaacatttctcttttgttcttccaacaaatatttattgactcctgtaatatgtagagaagcacagattttaagtagaatttttaaaagaaaatctctagttgtatcctttaagagggcagaaaag

SEQ ID NO: 48272 - DNA, 755 bp, Bovine  19866880668132
ataatgtaggcacattattaaacttcttcaagactgactttcttcatctgcaagacggggatggagaaagttctgagtcacattattgttggaggaaatcaatgcgatcaagcgcatgaaacagcataatgcctgacacatagacagtactcaataaataattgtaattatcattattattgccattattgttgtgtctcagttaattggctaatagatctgtcccctttagcacaaaaggactcttatggtggagctaatgtctcaatctcctcttcatcaccacagcaccaattttataggttggatgaagggataaataaattaataactaacagtattgtacagaccagccaacatgacaatggccaggaaagtggactttccaaaagacttcccttacacaatggaaaaattagaaagcaaacctgtaaagccaaatggacattttcctccccattatgatccattcatttgaaatatgtctgcctacagaggctttcatcacttgcaagttggtggaagtggtgacacacttgtgcaaccagagcaagttcctggtgagacagaagggaaaacatacaaatccatatttactcaggcagtagtagccactgtgaggaatcagcatctcttttgtgctcctggaatggaacaggagacaatgggtaactaaaaggttaccacagagaggaagggtcacatatcttcaaaataaaagaaattaaatgccggtatttgcatacagtatatat

SEQ ID NO: 48273 - DNA, 1283 bp, Bovine  19866880703762
tgaattttaatttttgttcattgttggtggtttaaagaggtccccccccccagcccatgtaattattgtgaacattttgctttgtggtcactgtaacgtttggggtggtgggacagggaggaaaagtaacagtagtccatatgtctctggcttctattcagagcagtgtgcagaatgtaatgctcttttgtaagaaacattttctgatttttaaaataaatttagtgaacctatttttggtggtcattttttttaagatggtcatttttcaaatggctgaattccccccaacctacccccaaatgtaacactaagtttaattatcagtcctctgttggatataaataaatggcatctcttcttggacttaggcaaaatatcttgacatactcagttctggtgattcttaacaattagaaagcccattgcttgggaggaaattccaccacacagtcatgcttataataagctggggatttttgtttggttttgcaaatacttgcccctactttgcaacaattttctgtttgtgaagaactaaagtgggaagcaacacaattgatggaatactagtataagcatatagcagaagcttaatagcaagttttattaatcagaataatacttggttaaggaagtgactgatgctaaattctgattgtttttattagataacttctcacctatagatttaaactatcagattggttgtgtcttttagctaaactttgtaaaatatatacctatgtatgtatatattcttgtttttccactgtatgcaaattgaaagaaaaagatatacctttctctgttgtatgttgggttatgtaggaaatgtttgtgaacaattcaaaaaaaagatgaaaaaattcctgtggatgttttgtgtagtatctcttggcatttgtataaatagttgaaagttcactacagaataaaactcccataatgctagatttaatgtgtgcccaattttgaacaagggttgattgacacctgtaacatttgttaaaaagttcctctcataaggaaataaaataatcttaaattaagtaaaaaaaaaaaaatagaaactaacatacaagggctaataagataaagatagtgattttactttgggtttaatttgtaaccttagaaagatgtttgctgagtgcctcatacaaacctttgaaaacatgacaaattaagctctaaaattctaaaacataataccagtaaaataaatttctgtttcattagaatcttgtcactatactagtatctttagcgacagaatcatt

SEQ ID NO: 48274 - DNA, 1968 bp, Bovine  19866880777572
tggatctgccagatgttgcagacaaaggctgagaggttatctaggacttcatccctgttttgccagaagtaaacctgaaggatagtcatccctgggtctccttttccacgtcactgctgcagctgccatggcatccagagctctggcttctttaactttgagcccttctccctctgtaggcggtcagtttcaatttcagctgctttggcctcctttcaccttaggttgcttgtgaacctccgacatcttctcctatcctttaattttcacggtagccctctgcagtaaggaaggcaaggaagcaacctaagatagagtgtctaagtttcttgtggtcccttgcttttgtttatttcattccaaacctcatgtttttagtgtgtactacctccactctaccctgattgataataggaaacttcaaaaccataccatcaaactcttgcacttacaaaaataggccagtgattgtttctgcagcttcctcttataacccctactgttttttgtcttagctctcaggccatttctgagcaatagaggttacaagtactccactgaacaaccagttctaaatcctgtcatcaaatcctgtgctcctgttccaaatggtaagttttcttatgggcatattaaaactttataaatttagagtcttcctctgttgaaggaaaaaatttaatttgtgagaaaagcttagtctttttagtgttttgctactttttttaatcatactgagaaaatcagaagtatatttacgtgatacgactgttgagaatcatttagataaataagatgctttacatcagctaagaatctgttacttgttataattttacctgattattatattaatataataactactaacattgtatgtattgcgtaggtctgacacttgtgctttacaaatgttaatcatgtaatcctcacaacagccccattaggtaggaggtggtattgacattttatagatgaaaaaactaggttagaagaagttaagaaatttatgctaggctgtagagcttataatttgacagagctagccttcaaacctttatatatctgtctcacattttttgcttttctcattgtaccatctgattacttgtggcatttgaatttttgctatgtagaaagtcaaagaattacatgctagagagaaagtctaaaggtttggctactcctgtttgtgcattgtagagaattatagaaactctatttagatatactgaattacaataatttttttgtttgttttcaggtaatagatgcctaatatttcctttatgtgaaagaaatgagtgtaactagtattgcattaagagttgaaacctggctttcagctacatggcatgttaaagtgcctgtaacgtggctagaagcttgtattaactggatccaagaagaaaatgatcatgttaatttgagtcaggcacaaatgaataaacaagtgtttgagcagtggctccttaccgacctgagagatttggagcatcgtcttttacctagcggcattttagaaactccgaaaggagaactgaatggattttttgctctgcagattaattcattggttgatgtaagtcagcctgcatatgcccagatacaaaagttgagaggaaagaatacaaccaatgaccctaattacagctgaaatacaagtaacccccaaaccttgggaagcaaagccttcacgaatgttgatgctacagctaactgatggaattgtacaaatacaaggaatggaatatcagtctattccagctctgcatagtgatcttcctccaggtacaaaaattttgatttatggaaatatttctttccgtcttggtgttctcttgttgaaaccagaaaatgtgaaagtgttgggaggagaagtcgatgctcttttagaggaatatgcccaagaaaaagttcttgcaagattaattggggaaccgatcctatagtttcagtcataccaaa

SEQ ID NO: 48275 - DNA, 1583 bp, Bovine  19866880864757
cactgttttgacactgtccccctggaataaaacaggtacaaaggttaattaagatggaggcatgactaagaggaacttgttaaggatgatatttgtgtgtctctgctctctctgccttatgcctcagtatggttttaaaacttttgtactagcaattggtggtatacagtgtggggtagtgtcataaccagtttgacaatttattaatcacaaaataacaataaatctctagcttttacacttgtttgtcttgccttttttgtagaaagaaaaagatgtcttcaatttactttgagtaatcatgtcttttaaagactactggaattgattgacccccagattttcctacacttgagattatttttcattaatttttttgtttcctcagttaaattctgtgtgtatatactatattgtgtgttagaaagagaaccaactgggacatcaggtaacttgggcttttgcttgctctttttggttcttgactattatttggagtcagggcatcatgactgaaagtggtggtgaggcctgtgtgaggcctgattctttagaatcacccacctaggtgattctaaagaaccttttagttgtcgccctggtgtgatttttttgttgctgtttgtttctgatatgttcatcttagatttgaatatcttttaaggagtttacgatacttaaaattctccaaagccttaaacaaaaaaaccctcctaaaatactgtagacttaaattgttctcatattgggttgagtggtgaaaataacatttcaggattttatttcccaagtggaatacttatgatcctacacaaattttagcaaatgagataaatgacaactggcctctgtgtattcagaattagtgtttcagacttggcctcaatgtagtcatgaaaggagttttttgtttgagaaacattattaccatgttaatttagtagacaaattacaacaaaataggaccgataaaaatgctactaacattagtgataaaagaacctggagcacatgtctgtgtccttgtgcaaaacaagtttatgttgttaaggcagagaaatacgtgcatatctgcttcctctcttaacattaaacatgttgattaagtcaataagtcctgcattaaggaaacctttataatacagctttgtcctattctctactgtccttttcacttaactgttctcagtagatccagtgaaaacacacttggggaaaattatacttggcaaatgtctgcttctgtagtattgcacatgatattctctcctttggaatttcatctgtcttctttggcttatataaagggtactgtgcctctggggtcagttttgtaggtttcctaaacttggctaaccagttgatatactctgcaatgttaactgctgcattctgcttctctcattcacttacactttggaggatttttttttgtttgtttttctgctcttgaaatcttcttggcagttacttaagtaacatgaaagtggttctcctcaacttttttgtatctttcctctagtcaaccatatgcagccattttgcttcagaaggtgaacatttattgaacatctgttgagtaa

SEQ ID NO: 48276 - DNA, 1725 bp, Bovine  19866880870946
acaaatgaagaaaatcaaacatggactgggtattggataatattgggaaaaaattttttatttaaatttatatattttaattggaggctaattactttacaatattgtattggttctgccatacatcacccatgaatccgccatttgtcggaggtcatattggtatcatggttacccttttaagtcctatctgttagcagtttatactgaagtattttcagatgaaataaaatgatgcctggggtatacttttaaagattctggcaaaaaaaggaagggtggaatagatgaaatatgaaaggcaaaatgttgataactatttcatctaggtcctagatatgtgatggagaaaagttggtcattttactctgttctttatttgcacatgcttgacatttttccacaataaaagttatattcatagaaataagctcaattttctcatttaaatatttgaacaggctttatttttaagttttaaacaagtaacaatacattctctaatacaatgtacacatttttatcataattatgtaacataaaaaattaattttttaataagcctcctagaaatgctctcaaattccctctggttttacccccaaatgttctccaaataatgtaattttttgtgtgccatgacgtaaaaagattgggaagctctgcccagaggaactgattttgtgcaaagggcagataaatacaggctttcaacgtcctccatttccaaaagcgctcagggctccctcttcagcatctctttaaagcactttcagaaaatgaaatgcttgagatttaaacagtccctgcagctgcagcaccagtttcaaatgcccactattttgaaagaagatccctttgtgctgttttttgtttcccaaaggaaaagctaaatccaccccagtgttttcataaactgaaaatgaatggcttgagcgccgctgttgagcgcgacggaagaggacatttggcagagctggcctctgcggggctttggttccccccagacatcagtcagtcagcaacctgctgggatgtggccctgaaaggtgacttcaaaggtgaacctctgatactcgtggggctgcccagcctggggagcaaggtgcaaggtgttcagggtgggggcttggtggctgcagctcctttgctgctatagagtctggccagacaggctgcacatcctcttggaagcccaggttgcaccccacaactaagctgcacttgcttttcctctgcatggttgagtatatccttgtctctgaatctggctgtttggttgtttatttaaatctgtaatacataaagtgaaaacattccaaagagagcaaaaagatatccaatagaaatagtcagtctctcaagcttatttccagagaaggcaatggcaactcgctccagtggtcttgcctggaaaatcccatgggcagaggagcctggtaggctgcagttcatggggtctctaagagtcagacacgactgaacaacttcactttcacttttcactttcatgcactagagaaggaaatggcaacccactccagtgttctttcctggagaatcccagggatgggggagcttggtgggctgccatctgtggggtcgcacagagtcagacacgactgaagtgacttagcagcagcagcagcaagcttatttctcccatcagtcagttcagtctctcagtcatgtccaactcttagagaccccatggactgcagcaca

SEQ ID NO: 48277 - DNA, 1561 bp, Bovine  19866880931498
ttttaaaagaaagtgaaatttttaaaggaaaatagttaaaggagatgctagttagttgtgtattattgtacattaacccaagagtggaagcaaatgggaattggacaaatggcaagtagcaaaacgagttctgatgagactgataggcaagtggtggtagacaaatgattttatgaaagtgatggtgatgcaaggttctggatgatgtaaagaacagtaaactcgctgtccaagtggacatgaatatgtctaagtggatctaaataaaagtggagaaacttgaaggcacattttttgatccctcatgccattcattgagattctgtggaagaaactttaaaagaattctatgtgtgcgaaagagaggaaaagagtcagaaagaatgtgaggagaatgatcttggctttttgataaatgcctatgatcttcctctgtggtggtcattatactctttccctttcctggtttccttaggatcttattcataattgggactctaattaagaaactggagggaacttattagataatataccatttcagcttggatgaagtagtgaaatgaccccctaactagatagtaagtgggacaaatgctctcgtaccttccttcataccactgaatccatgacagaaaggcaggctctgacgccttccatgcagagtgcataccaatactgtgaaagaagagggttcagtacagagcttagggcacagagcatagtgatttttccataaaatgtaaatgaagacatggaatgttttcatgggatgggctacctataatctctcctaacttcagctctaccattagtataatttccaaaatggccattccagtcctactcattcatggagccctgagtgctttattagacatctgattttgtaaatacatttttaaaagtcagctcatgaagacttcagttcagcaaactatactatactttgctattcagtttacagggtggtctttctcatgtgcattaagtgactgatttttcttttaaataaagattatttgatacctgaaatttgataccaatatagaaatatattttctataggttatttgggaagtttgcaaatgatcacctttgaattgaagtggtttcccccttgtttatgacttaaagtcatatctctgacataaggatgtgccagtatagtctgcagaaaattagttccctcttctaatcatgtttaatctcattttctttgaagttctaaccataacaaatcatccagcccttctccttttacattaatattaaataacattttaaaattatagaattcatatattatacatcataaaacattgaaaaatgctgacaggatgagcatcacacatagtctagccaagtggatttatactaaggagtaatgactatataattttaacatttccagctaatatctcttaggcaaaaacttcactgttgaataaaaatatttttaagtgaaggatctgacaggataaggtctgctgaatttaaacaacagctaccaaaagtaaaactcggatcctgaaatgccattttgtcaggacagatcagt

SEQ ID NO: 48278 - DNA, 879 bp, Bovine  19866880971363
catataaggtatctgagaaatataaaactgtgtctaccaagtgccacttcacacctactcttacaaaatgtgaaaactctaactggagacattacatgtaggctacttaacctatgagtgagccggtttacatgctatatgttgcactagatgaacattgaaaaggtagttttaaagaaaataaggactgtgtcctgaacttctgttttccctagaggtttttttaaataatgccttcatctcttccccattttccagttgtcttctccagcgccacagccataatttagcagtattatgtgctgtcacttctgtgttagtaaacaccaggacttgctgtgtaattataaaataacctcataatgaaatgcagtgaagagttctaattacatcttaatgttgcttaacaactattctaccttaaaatgtgaattttccaaccatgtatcctaatgagttatcagaatgtattagctctccccgaaaatgtacaaatgaggaggtagacatagacgattaccgccagcatgcatgtgtgtgagaacacttatgtattcaaaattaatatactaccttaaaaattcttaaaatataaaagcacatcaaaatgctgcaacaactacagggcatgattttttttttaactcatatttcactttgaaggaggaaaaaatgcgaaattattctccaaagcaaaagattacagttaaagctgtcttcttagaatagaggacaaatacaagttaaactgaaaacatccacactttttcataagaacacagagctaaaagaaaactcactggggtgatctaggaaataagacttcccatttactttattctttaaaaatttccaagaaggactcctcccatattttat

SEQ ID NO: 48279 - DNA, 825 bp, Bovine  19866880984904
tatgtatataccaaaagaaaggaaagcaaggactcagatacttgacatcaatgttcatggctacattattcacaatagccaaaaggtagaaacaatatgagtgtccatcaacagatgaatgaaaaagagtggtataaacacacagtgaagtattactcagccataaaaaggaatgaagttctgatatatgctataacatggatatacatgttgaaaacatggcaagtgaagtaagtcagactacaaaaggacaaatatcatatgactccacttatatgaagtacctagaacaggcaaagtcacagagattagaggtcaaggactgcagtacaaggaaaaatagggaattcaatgggtacagagtttctgtttgggatgatgaaaacgttctggaaacagatagtggtgatggttatacaacacttaatgccactgaattatatgcttaaaaatggtcaaaatggcaaatttaatgttatacctattttactatgataaaaatacattatcattcagattatatataatcaatgagctagaaacctaaatagcagatattgtttctatcaaacattaaatatatttgcatataataaaaacagaaaatgtacaaatttatagaattttttagtttacaatgctaaatatatacaaacctcccactgagcaatcacatttttcagcttctggatttcagcatcttttcgttcaagttccaactttaatctttcaattcttccatcttttagaactacttcctaaacagggaaaacaccattttagaaataagacagttttgtcatgtctgatttacaatatccttta

SEQ ID NO: 48280 - DNA, 1138 bp, Bovine  19866881036788
atggacaggttcctgatgaaaagtttactctgcctcatttagagccgtaagtctcagcagtggggagtgggtgaaaaggaggggttgctggtggggaagccgccttcacacttatcttccctgcccacttaatgactgctgtgattggtgtgaatatgatatagcttttgttaagtccaaaaaactccaaatcaaacactggttatagggggagttgataaaataattattctttttgtctttatacaaatataataaacttggttttctagagacagagatatcagaatcctattatatccctagtttgttgcatttttctccctgcaggtcagtctgagtcctttaccactgtttaatctctgggccctcccagagccataactcacctcagagctgtgctgtcatgtcaaacatgagcttcggggaatgaagccacaggctgttcgtcccagaggccctggaacttgttttcttgaccagtccctgatgtcagccagtcttgtggtcatttgctatctcctcaaaagagagagtggggcacgcacagctgctcgacccctgggctcaacatgtgcctgcccttctagcaaattaatcagcaagggaaaggcagaagcagtttttcccccaagtgatttcttccctccagaaagttattatcttcccgggtgtactcagtgactcatgacttgtcagcaccattcaaaacattattgtatctgaccacaccatactacacatgcactcccacttacagttcatggtttccttgcacacacccctaataccactcagtcaattgccaccccttttatacactcaccttggaggtgtgcaaattggtaagacatccttggatttatgtatttctgtaataagcaatacagtgttctttgggctcacaagaagatcttaaacgaaagcaaattattgctttgctcaaaacacaacagagatttacagagtgatggggaagaaacatatagaactcactgcagagatctcttggtaattagctcatgtgaataacaaagtaagcatgcaaattcttttttcgtccccagattggtaaagttttcaaacgtggagggttaggtgtgacccagcccatttttctttttgtctggattaattt

SEQ ID NO: 48281 - DNA, 847 bp, Bovine  19866881076710
tgaatgatactagtttagatatcttggctccaataaaacacatcattaaaattaattttatttgtttcacttttcaaatgttttctttttgttctttaatttggcttgcattttatttttattggaaagcactgctctagaacataataaagattcaaatattttttaaaagaaatcaaggtgggttgcttctccatcacagagttgcctgggtattgttttatttttgtggggcgggggaggcattcagttcctaggacactgtaggacattgggctggggtcctctggcctggatggtttcgaattggctagggtaaggatgttgtatattgtttcattgtttgtcaggggagtgagtggagagtttaaaaatagcatccccctccctcctctggccccatgctgatccctcctgagttatttctgttggctgcattaggagcctgacatttgattcattcagtgggccctgcctcggtcctttaaaacagaatggacagttagtgaaaggtcaaagccactatggctggtggtagctgccctgggccatgacaggcagaggagacacggagaattgaagaaacagtaatggcaaaatgcttggtcaagatccagactcggaggggtctccgcctgcaattagtgaaccactgcaacagcaatgtgtttgtccgtctgctgagacacagttccaagatcacagccagaaacacgggtacgtgccctgcagtgggctctggtctgcacctcagaagggtgcaggcttccagctgccactcacccgacaatgtcagaagtctgtgataaggagagaaggagaaagagggagaaaagcagggaggcag

SEQ ID NO: 48282 - DNA, 1626 bp, Bovine  19866881092541
ttgtagtagctgttataatttgagtaatagtatctgtgaattatgtagttattgttatttaagataccattcatgtaagtttggtaatagttgtcatttgatctctgtcttcggcagatattatagctgtaacatttgaacttctaagtagtctctgattgagtaatgtgtacacagaagtaaagtctttaaagaattatgtgactaataaaacttccaggactcttaacccaatattagcacacagtgcttttaaaaaattttatttaatatgaaaagatacatataatgaaaaaatgttaactgtgtatgtgtgtgtagcatgtgtgcatggagtatgtgtgtgcacaaaatccttctctgcttcctgacaagggtggatcctagtaactagaaggtctttagtttgctaagcacagagcgatggccttggtggaatgaaactttttctctgtatctccactgggtggttgaaggagagggcagcagcaggagagaaagagtatatactagctcactggtctcttcttataagggcactaatccccatcatgaggacctcatcctcatgacctcatctaaacctgattacctccaaatattcttacatgggggatatgaattttagggaaataaaaacattcagtccataaaaataatatattgtatacaagctgtttcaaagaagagaaaaaagaaggaaagctgccctacttatttttaggaggcagggataaccttgataccaaaatttaatatggactacacaagaaaacaaatgcaagtcaatctcaattatacaaatacaaaaatctaaataaaatggtagtcaaatgttaagagcaaggacttttaaagatgcatcatggggacttgcctggtggtccagtggataagactcgatgctcccaatgcagggctgggttcagttcttgtttggagaaccaagagcccacataccacaaccaagcctgcacaccacaagttgagagcctgcatgccacaatgaagacccaaagcagccgaaaaaaaagtcttaaataataaagacatcatctttcttgaatatgcatcaaaatgataaaggatgggcgttgggacatatagaagaccagattgtgagctgaaaaatcattaaagctgggttatgagtacagagaagtttgttttgtaccattttgtctctttttgtatatgttttaaattcacataataaaaagttgggggttttttttgtaatgcattgtggccaatcagtatttaccccaggggaacttctttgtgtaacactctagggtgtcctatgtaaacttcttctgccttctctggaaaaatacaaaattatcacgatacttttatccgaaagcagctttgtttttagaggatttgaagaataggaccagggggcagctgacttaagagtttctatgaataactctctgcatttgagatcagaagcacctgaagaattatgcaaatacaattaaagatttgttaagtgtatcagaaaatggcaacccactttggtatccttgcctggagaatccccatggacagaggagcctggcagtcgcagagtcaaacacgacttagcacacacacacccaaacatatcagaaccaaaga

SEQ ID NO: 48283 - DNA, 1643 bp, Bovine  19866881103843
acctgctcatctctttgtctccactcttgccaattttcttctcggtgaatccttctgtactgggtttggtaatgaaagctcatgttgagcattacaaatagcatgggaggatttctgtggaattttcttaaaagcaagattcctgagctatgaaaaaaaacaaaaaaaaaatattaaattcagtttaccaatactgggatactaatgatttttttggaagttaagaaatcagtatttttatacttctaaatactcattatgctaactcacaaagtcactatgtgaacttttgtaatctttgtagaatttcaccagcttgagaaaattttggtggatttctagatgaaatgattagtaagtaaaaatggattatactctattataccaccatttgaaccaatttaatgatcctggtttactaaagggtttataggaatagagaacaggataacaagtatgcttttaaaatacaaaacaataaggttcaataagattaaactttaatggcttataaatttaaaagtttaaatagtgagagaagatagcttgaggaactctagcaactactttgctagtcatgaaaaatacagagcctacaactagcaatatatggttaggaaaatactttaattggttacaacagtacagtggggaaagaggacaaatcttagaggtctgtcttaggtgatacagattgctctacattagtaagtttgaggaactttaaaatatgatgacaagagacagagcagttcaaacattcatgccccatgattatctcattatagatgtctgccgtttacatttaatgtagaataatgagcttctaatgcagcagacattagtgtctaccctaacaatgtttgcaaggtaaaaagttcgagtgagaacagatgctaattttgttcctcttatattgtaaagactgtagcagtttcccctgtatctctaaaagggggggaaaaaaagtgatctaatagctttaaagatttcttcaataaaagcaatggataagtttttcaaaaaatacagggcctagcccacaaagtaacataatgaattaaaactgtactggtcaagccactcccaacagtaagaataatctgagacacagaggttgaaacagggagaaaagtactgagaggctattatggattaaattgtattgcctcaaaaaatatgttgtaggcctaactcttgctgtctgtgaatatgacctcatttagaaaaaggatctttgcaaatataatcaagttaaggttaaactgaattaggctgggccctagtgaatgaaaggtatagacaaagatatacgaagccaagaacactgaggactgacagctaccataagaagctaggaagaggagagaggaaaggaaggattctactcagaaagagcctggtcctgttaacaccagggttagaactttcagcctctacaactgttaagtgaatacatttctgttggtttaagtcacccagcttgtggtattttgttacagaagtcctaagaaaccaataaagaggctttaaatcaaggatcaacaatttaacacagactattctgcaggagggagtgatgagatgcaaatactgctttaagtaggtggtttctgttgtgggaaagcagagtagaggagatg

SEQ ID NO: 48284 - DNA, 1176 bp, Bovine  19866881112935
tttgctatgaccagtgcattttcttggcaaaactctattagcctttgccctgcttcattctgtattccaaggccaaatttgccagttacccccaggtgtttcttgacttcctacttttgcattccagtcccctgtaatgaaaaggacatcttttctcggtgttagttctaaagggtcttgtaggtctttatagaaccattcaacttcagcttcttcagcattactgtttagggcatagacttggattactgtgatactgaatggtttgccttggaaacgaacagagatcattctgtcgtttttgagattgcatccaagtactgcattttggactcttttgttgaccatgatggctactccatttcttctgagggattcctgcgcacagtagtagatataatggtcatctgagttaaattcacccattccagtccattttagttcgctgattcctacttgtccatacctctcctaaaacagacatccaagtaatcttgatttttgatacccctgatacttaaaaataaaagaggaatcatttgctctgtgacaacctagaggggtgggattggaaggagatgggaggggggttccacagggcggggacacatgtatatctaatttctattcatgctgatgtaaggcaaaaaccatcacaatattgtaaagtaattatcctctaatttaaaaaatgttttttttttttttaaagaggactcattaagcagaccaattcatgaccaatgacttgaggcagaaggacagccctcctcttcagtttagggatgtcctagatctcaggtgcccctctcattcctagtttcaagcatctgtgaagcaatttccccaggagcagaaagcagcctttcaatggaaggagcagctggtgggacataatgctatctagcttcctggcaccatccccagagtgaaatttcaaatcactgggcctgtttctttttccattccatgtcctcccccaaaggtacctccaacaaaagcaaattgctctaacataggcaaggtcttttcccattgtcaacaaaactcactgataggctcactagttctttctggctgccaacacaaaaacctcaaggctgtaattacatttggaggaagttcagcatgtccctgcatccagatttcctaggtcatcctatcagaaaggacatc

SEQ ID NO: 48285 - DNA, 806 bp, Bovine  19866881141625
tgagctttttcaaatttcatgtgcatacagatcagctgtgggttctgatgcagtaggtctggggtagagcctgagagattgcatttctaacaagcactcagggcatggtgatgctgctggatcacactttgaaaagcaggattctggactcataaccgtggagctggttttccttgttcttttattcatcatatttgtggaatggtgcttactacctgcatgatactttgctgggtactgagaatgtgatggtgaacaagagacagcccttgccctccaggatcataaaatctaggtggaaaggcaatacattcattgcttcatcaaacattacttaaatacaattatgattagagccacaaaggaaaaagtacaaacgtctatgaaaccatgtgatagggagtcttgttctagttagtgggacaagattgtgactcacgaggtaaagtaagccccaggagacccatgttgtgtactgatgctcactctggttgtgggaaaccggtgactttttcctgcagtttccaaaagtattggctatatttagcatatcaaccctcttttcctgctgtacattttcccatggtggcctcagccaatctcttgactttccgtatccaccctatctccaattccacctctcttctgagctccaggtttctaactattgatgaacatcttaaatttggagacaccttaaccctcagaacccacatattcagggggcaaactccttgccttcttcaccacagcagctccgacggtgtcaccactgtgtttataaccattcaagcaaacacccagca

SEQ ID NO: 48286 - DNA, 847 bp, Bovine  19866881147116
aatatgaaaataaagttttttttttatttaggtactagctatgtccttgtcaggctctgtttgtttggaaggcttaggaagaagcataataaaatctctggagtcagaggagggaaaaacactgtataccacctggagccaagtcaaggataacttcacctcgtgtgtttccaaacctcaagggagattatttctgctaggggatcatggtggtgggggatgggggttggtcaccttgaggacacctttttgtctccatgtttggagacataggtttttcaccgggtgtagatggcaccttcttggttcagtgctgattaaaaggaaaaaaaggaggaaaagttgtacagtaattcaagggcagccacgaagtctgagtttgcagtgccagcagcagtgtggtaatttgagaatagcaaattagaggaacaaagcagattttaatcatatgccacagagaggaagggaggaaggtggtttaggtttatctccaaattgtacctccattagagtaagggaggtttttaatgctgtaatccaatgtttattgttaaagatttctttgtttctttcctccagtatttctttagcacactcactgggagggaaatgccagctttcttcccatcagtgaactcagcagttgttaaatataaaacattttcttgatgttattgggaatagaatgagggagaaagagtgacagagttagattcaagagcattaccctttcggagactttagtctgaaggcaaaactgtcccattccattatttctgtccatccatccatccatccgtcaacccatccacctacttcactcattcgtccaaagcacctctcttaa

SEQ ID NO: 48287 - DNA, 2133 bp, Bovine  19866881184205
taggtaattcctcaaatactgttccccatcagacagtcagattttgaaagagaacttgttatttctccaaggccaaaggagaaaccacgaaaccaatctatgctttttactgatgaggaattagatgacttttcattggaggaggccttacttttagaagaagctgtccagaaagaacagatggagaccaaagaattacagctattgactttgaacagaactacagatgaaagtatagagaagttttcacatagatctaatactctaaataatttttcttttatttgcaaaaatggaaacaataattggagtgaaaaaaatttatctgagcaaatgactagtgaagacaaatctcttagttgtccatctactagagaccaaaacagtagtagtctttcagttaatcataatgtacctctaccccatgattttacaaataaaggtaagagctcagagacatataaaataaaacaaattagcagttcagatggacattccttaaataataaaatgttcaatggagagctagtcagtaatgtaccaaaaaggagttcagatgttcctaatgaaaatgagcaccatttacagacttgttctttacaattgtcagagaatagcactggacttcctatcaccatggatttgtattctccaccctttatctatttgtctgttctaatggccagcaaaccaaaggaggttacaacagtgaaagtcaaagcatttattgtaactttaaccggaaatctctcaagttctggtggcatttggagtgtaagagcaaaaatttctgatggtactgcatatctagatgtagactttgtagatgaaatacttactagtctgatagggttttcagtatcagaaatgaaacggttgaaaaaggatccttgtaaataccaaaagttcctggaaggtttgcagaaatgtcagagagagctaatagatttgtgctgtctgatgactatttcatttaatccctccttgtctaaggcaatggtactggcattacaagatgttaatacggaccaccttgagaacctaaagaggagattaaagaaataatttattgaaatagtattagaaaacaattcaaataagcaaggaaatatttagaattaaatttgtccttttactttcacaactttttgaaaaggaagtttcataactgatttcagtttaattttaaaatgcttgatcatgattgtgtgtttaagtttttttaataaagttttttgtagtaagtttgctgaatgaatttaatgacccattgttgttgagaaattttgttttccacttgttatttcacataaggtgactggtaaagtattggtgtttaccaatgagtcatactgttgaaagaaggttaacaattataagtaggtagttgagtacttctaatttgtaccccaaaagatttgtttataatgtttttcttaggaaaaaatgtaaatccagtggaatagaatgttagactttcagatgttaattgttttgctggtttttattttgctgattgtaaatattttgtctggtatatttaaggcaattattatcttaactagataccatttcaaagattatattgaatagttaaaaacttgattttcaaggataatctattaagaagatccagttaacttttggggggattaaaataagatgtatatctatgtctttagttgttatctcctttctgaattagttttacatgtaagtcttcctttagttttgttggaagtgctgatttctttttcaagggaggctgtttcccacttcccattttgctgttaaaaaatcacatttgaaaggttaagttatttttattattctttttttaaaatgtaaattaaagtatctttaaaacattaaataataaacacatggcatttttaaagaaatgtaataggaaatatctggaagtaagataaatacatatataaaaatatgatatggatatagcagaaaaatattctaaaaatcttttgttattattggttgaaggataattatcagagttcaaggcacaatccagattttgctgctgtatcctttgataataaccacttctatgtccttgcatagcttatttactacaagaggcctaaatgggatgggattatctttcattat

SEQ ID NO: 48288 - DNA, 781 bp, Bovine  19866881204268
tccttctgattaaatactacttcatcagcagcaagagcacactgggagaggggaaagaaagcacaagagagagtcaccatggaaaatattcaaaagaaaccacgtaataccacaaaaactgtggtttaatgacagcctgacaatgactcttaaaatcttcttaacctttttttcttgtttctctattataaggaaggcagaaatagctgaaaggacctatcactggtataacgtaagaattagtcaccaaagagatagaaaggcagtccttatttttatttcttgtattttaagactgaagccagttattcaaagtctatagtacattcaataaggcgtttacaagttttctagaactgccatgagatttttaatgtgggtcttcagaaatcaaaaaggtcacatttcccaaattgacctatatagtataagaatgttctatatttattatggatatttaaaagaggaacttttgctaactttgcaccctttcagtacaaacagatatattttgaagatgtttggaaatatggttaaacatatagttttcttagttcctagtgaattattcctgtcaccaaataaacttggaatatgcaaataatactttacaaattttgaactaaatagaaaatcaacattggtcaagggcctactttatactagattgtaactcgggattttaaaaatatctcattgaagaaattaaacattttcatgaagaaactaaagtttagtgagtgaacaccattccaggacaacacagtggggataaatcaaa

SEQ ID NO: 48289 - DNA, 954 bp, Bovine  19866881261677
tccattctaatgataataaattgttagacacctccctatacgccaagcactggactgaaatacagccagattattactgggattatggcaggtgtttaactgggattattagaagagggtcaggctccttgaatccccacatgctttggatactctgtctttaggaacattttacaggtgagtaaaatgagcttttctttcaagagtaataactgcctgacaaagaatgagacagccaaaatcagagccccagaaactactcatcatagggtgaggggcctgcacaatgggaaggaaggaaaaatgatggatgaaagagatactgtccccatgatagtagcttttattgcacattccctacaaagaaagtcaggccttggcagttaaatatattttaagaaagatccatttgtaattgttttgtaagatttatggaattgccatgcaatttgtgcttgtggaagaattttaggcagatattttaaaaggttactcattgattgattgtttccaaaaagagtctattgaatagaactttatctgaaaaatgccttcctgccctcacagtcactttctcccagaaagcagaacttatcacactcataatcactagccctctccctgagcacatcctgatcaatgggagttcacacatttcctttccagcagaccttcggtacacaaatagacaccagccagcttgggaggcattatgagcagccatttaaggaagtaagcaaacagctggtctctgactccacgaaggaagagtaagagaaagaaatataaatttcaacagggaaaacaaaagctggacatgaagagttccttaattgggcctaaaagtagcactggactaggcagctatgtgtggaatgattgggtgtacttctgcctagaagcgaagaagagatgtatgactgctttattttttttaactttttgttttatatt

SEQ ID NO: 48290 - DNA, 1298 bp, Bovine  19866881302798
gttggtggacccctgctgatctttctggatggcctgttaggttctaactggtgagggtggatgaacacatgccatctctcagttctatgtatggatgcaatgcttctgacagaacgtgactccagcctgggcaatggtggcatctcagtgtctctgaattactcattcattctgtgtgtgtgtttgtgtgtgtgtgcgcgtgtgtgtgcttctcagccctccccaacacttatctgtagattctgctagcaacagggtgaaatgaaacgggcttgttgagtggagaggcagagagcctgccggctggccctgtggtctgtttggtcctcaggaggcccctcctgacacctggtcccatttggcagtgcattctcagaggcacaagccaagcagtccataggagtgacagaaacacattcctagtcccaggccaatcaacaggagtcagggaggtggggcaaagggccttggcttgggagctcagagacatgcatgtcagcacatgtcctcatggtaactagctgggtgactctgtacgggtccctaatccctctgacccctggattcctttcgaatagagaagcgggactcagagctatctctatggtcctttctagcatctatgatcttatgataattaaagttagtttcttgttaagatttagaggtttaccaagttccttttctaccacttacctcctgctcctggcccccttattacaggggtccagattaaatgagacttcccatatgaagtctttacaagagaatgtcaacagttatacctgtcatctaacttatattctattatttatatccacatcttgtaattccacttgagactgcaagctcctcagtgaagatgatagcatcaccttggtactgtcaactacaagctggaacttgcctatcaactacaaattggccatttgtcagcgaataagaacaagggcatttgccatctgcctctgtggagaatgaactctgtgctgctgcagctgttaaccttcaaaacccgctgagggagtgcagggtagagggaggcactctgtattccagggaatctggtggaacaggtctttagacaattagatatttccaggaactgacttattttcgtgatcccaatctttgcatctcttcatatctagaaaagcacgaaatcccttcatgatggcatcatgagactagcagaaaaccttccttgagactagcagaaaacctctcttagagtaagtgcttgattgcactgaaacccctcttcaccaaaatcgtatatattgaccttcccccactgc

SEQ ID NO: 48291 - DNA, 1660 bp, Bovine  19866881398281
gagtaagatgtaaatttgttcatacaaatatgattgcaattacatgaaatgagaacccacaaaattgtgcctaaaatgaagaccaaaaaaatacataacataataaaagatgctattggataatagactctctaattgacttacaaaagacaacactcaaaattataatagtgatttcttgtcattttgttcttgcaaatgtgaccaaaattggaggcttttcagactataatttcacatgtaaatgttgtaaatattgccaaccatttgaggcattttggttatttttggtttaacatggtgaccttaagaatttatagtataggatctattcctaaaatgactttgttaaaagtcaggattctccagaacaatttctggactccctctcattcagtaattagtttgggtttgtttccattacagatctttgtggaaaaagaaaacctgaaatttaaaattaagaaagatatgtctctttacaggtgttccattgcccaaagaagatatttctgcccccttgatctccagctcaccagtgaaggaatcccatgagtatgaagagccatcaagtgaagaggaagataaaataaaagaagaacccttgacaatctctgaactggcatacaacccaagtgccagcctactccctaccccggttgatgatgatgagattgacatgctctttgactgtccatctaggctggagttggaaagagaagacacagattcattcgaggaactggaagcagatgaaaatgcctttttaatggcagaagaggaggagatgaaggaggctcgccaagctttgtcatggagctatgacattctgagtggcactattcgggtgaacccactggtcaagagtttttcccggctccttgtggtgggcctgggcctgctgctctttgtatttcccctgctcctcctccttttggagtcaggtattgatctctccttcttatgtgaaatccgccagacgcctgagtttgagcagtttcactatgactactactgtcctctcaaggagtgggtggctggcaaagtcaacctcgtactttacatgttgggttgctcataaagctcatttctcatatgactaagggctatattcaatactagtgatttggtttgtttttgttttttttttccagcaaatgcctggttctgaatggtcatgggaccatcaataggtgttcttactcataactgattattcagagctttaagttagctttccataattcactgcaagtaagtttaaatcaaacacagttattttagttataggtcagggaagatgacctctaaataaccaaaaatatgtttattttttattatagtacagacatactctttatctattataatacattgagctgaattagattcttttttaatagcaccattacaagctataaggttcagaatcagagttttagtaaaaacccaagggaaagttttttgaatataatccttagtgaaaacaatgtcctctaaccaatgcctatacaactaaatttatgctgggcttttgcttttgtttttttaaaaatatttttatgtgttcaaaatattttggtaaatttttagcaaaaaaaaaaaaaaggagcttcctggagttatttaagtgtacagattgtaagactaatgcacaaag

SEQ ID NO: 48292 - DNA, 1570 bp, Bovine  19866881474328
tactggatttttccttatccttcatttcagccctgctacgttccacctgtgacccttatgtgatgaaggcaatgtactttcatacaatttggtaactataataaaggtccacttcaaaatgtttgagtgcagactaaaatcattttttagaaaagcgtaattatgtccataatcaatctcactaatttctgatagtgtattggaaaaccaagttatttgataaacactctataaatgcacattatgccggggggagggtgggaattgcctattttctctatcacagagaacacagtctttgtcaacaaaagtcccaaccttgaacagcgcttttattttatataagactttatttcaacacaagaaacagcaaagttctcccaaaacaccctgtgtttctttgttgtgtgtctaccacaaagaaatgggaatcttcaaacagagtccatgttgaaatatatatcaaagaaaaaaaactatttttatttttcacaattctcctaagacattttcgtctcagccagtttccccagataaattatcattgaatgggaacagagaagcttccagggatgtgtcatccggagtatagtctcatacttcctggttcaggaaatagtatgtggaaagcagtagacggcccataaatgttggctgaatgaaggatcagtgtttacagggcccttggactttcagggtgagaaaaagaccaaagcactatttttaaataaaggaaagtaagtcagttgtatttttgacttttttccccctccaaaggagatactcttgtcctacaaaaaagaaattattaaagagaatttaggaattttacctccaattgaaatttcttcagtaattcataaacactgcatttgaagccaaaacattcgcttcagggttgaattcgaagctgattccacatacacataaaaaaagaaatcaacctcaaatatagcatcctccacttcaaacaactctgtgcaatgccacaaagaatagaggacagtccttggagaatatgctatctgaaagctaaaagctttaccctttatttctgttgtttacttaaattgctttggtaaaagatttatccgtcagttcttcccagtgtaaatttaatagcccagatattaaaaccatcaagttcgaggttagagaggaaaatgccagccttgcttcttaacgacagcagcccacccaaagaggcttaaataccatcaacaatatccttgatgctttaacaagtgtacttaaaaagcaattaagtatgccaatctcaggctgaaaacaattttaaaataacacacacattaagttcctgcttcttgacaaagtagtgatttgcactgacatgattgagatattgtgcatcgtttcagcaaagtaatttccacaaggcaggaaagtgcatgcttaggaagattcatgttatggtaggtttggtttttccttcccgttaaaaaacaaaactgcatacagttgactaacagtttggaatcactaccaaaaacttcaccactatagggaagcattgatactatctaacaactaaaacttaatatttattggc

SEQ ID NO: 48293 - DNA, 1466 bp, Bovine  19866881517444
cttctgatttcttgtttgacattaattctaagtggttagctatttcaggggtacccgtggttagacattgtctcagtttgctccatccgtctgtattttcagtgtgatatgttgtgactattttcaaggatgacaacctttggggaaaacacttggatcaatattctttccttgtccagttctcttgtgttttgttttttttttttaggttggaaaacttggtccaggttggaaaacttcagtcacagggtaaaatgtgtatctttaaatggcatggttcttttgggggaaggcatgagttagaaataaatgtgtgtttctgttgaggtccaaaagagttattattccttgtgaaataactggctttagtctagataaaatggctattttatctttaagtttataggcaacaacttttcttttaactgaaaacttttaaaatcatctctgttgcctgaagcaaggttttctttgttaatgggttgatcccttgtgcatgcacaggaacacaacacacagatatacatacaataaatcttattaatttagacttcaccaaagaaaagtgtttgattaattcagacacgctagattcttatttaggaaaaagctaaatattgtcccttgtaatgcctgctgtgcagatggttttgtgtgtcaattactttgtttcattatgtttcaagagctatgatttgaccctgaaagtgacagaaaagcaaacagttttactagatttacacaatttatttcttctgggacaacttaatctcaaggaacatgctgcagagtcagagtccaagatcagaacttcctgaaggggactgaagcgaatagaagcagggtacgctggagccagagtgaagctaggagccatgaatcaaaaataagacccaacccaactctttgtcattgacaagatactctcttcaaatataaagacacatacaggttaaaattaaatggatggaggaagagataccatgataacacagatcagaacaaagtgggaatagctgtattaatttcagacagagcagatttcagagcaaggaaaatgatgagggatagagaggggcattacataatgataaaggggtcagttctccaaggagatataataatccttaacgtgtattcacctaacaatacaacatcaaaccaggtgaggcagaactgacaagactgcaaggagaaataggtgatccgatgtcatagtgtcacggcgtgtaatagtgtacactcaggcatgcccgactctgtgaccccatggcctgtggcccaccaggctcctctgtccatgggattttccaggcaagaatactggagtgggttgccatttcctcctccaacagttggagacatcagtacctctctctgagggtgaacaaagttggtgtagttcagggctgcgagggaggccttggcgctccaaggatttccagatgtgtgtatattccagtgtt

SEQ ID NO: 48294 - DNA, 927 bp, Bovine  19866881700086
cttttcttccatcggaaccttctgcctctcattctatttccactcatccatttgataaatgttgcctgtgctgctcggtgccaggcttactgaggtaagccctgggatggcagcagtgaacagagcaggcttggctcctgcctcaggggaatttatgctctcacgggaaggcagatttaaataattacaaatagtagctagagactaacacctttgtttcatctgttaagctaatgacatctaaactattggctctaatgacttaacattttattcttcccagataacatttgcagctcaaaagactttagcacttacctcaagaagaaagtaggagtagagagggagaaatttcaaaaggaaatctatttatggaggggagcttttttgacaactttaaattacagtctgtagctagatgccaaccccacctggccaaaatgtcctcttctacaaaatacactgactcttctcaccaattttatttttttcttctgttggtgccctgtggcatgagggatctttgttccccagtcagggatctaacctgtgccccctgcactgagagcaccaaggcttaaccactggaccaccggggaagtcccataatacactgatcgtaatgttgtgaggtttctaggaaagttcctagaaaggcatccaggggtcactgagcccttgaagattatgcaatgttttatgtgtttggttccttttctgccctgaagtttattctttccttattctctctaaaggatatatagtctcaaaatctttgggaaaaaaaagagagaaaagaaaaaagaaggaagaaaagcaagaaagcaagcatttttggttctttcttttttatgtatgtatttttagatatgtaacgcaaatctctgttcctgttgcaatacacacgcacacacacaaccaaaacaa

SEQ ID NO: 48295 - DNA, 1144 bp, Bovine  19866881782069
gtgtgacactggactgattttccttagagctttggtttgtttgtttttgtttaacagctacagaatccagaagttagatttcagcagcaactggaacagctcagtgcaatgggatttttgaaccgtgaagcaaacttgcaagcgctaatagccacaggaggggatatcaatgcggctattgaaaggttactgggctctcagccatcatagcagcatttctgtatcttgaaaaaaatgtaatttatttttgataacggctcttaaatctttaaaatacccgctttatttcattttgactcttggaattctgtgctgttataaacaaacccaatatatgatacattttaaggtggagtgcagtaagatgtgtgggtttcactgtgtttgtttcttttttgttttcctggaacagtgggaatcaatgctttttcatttaaggctactgcatgcgtcaaacacttctgcatttattgtaatttttacaaaacatattaccttttatagttgggtgaacagatttttgtcctgcatctgtccagtttatttgctttttaaacattagtctctggtagtaatttatgtagaataaaagcattaaaaagaagcaaatcatttgcgctttataatttgtgatacaacattgcttatcgtgactttggcatgtatttttgcaaacaaaaatgctgtaagatttatactactgacagtttttgctttatttgtatacaatgtatgtatgcacatttgggacagcatctctagaaacatactacaatagatcatctgagcaaaatatctgtaatggaaaaaataaagataaggaaatacttcaaagcagagtatttcttaattgtgtagaatcttacagcatctttgatgaacatctcagcaaaagtactggttagtgaggcttgttgaaaatacagtagaaaaactgattctggttatctctttaaggacgtattaattgtacagacaagatgatgtaacactgtctcagcattcacagattgactgtaaattaccttaatctttgtgcagactgaaggagcactgtagtgtaaccccaaagtgcatttgcctaggacttgcagcttctcccataggtagtttaacaggcattacaatttgtaatgaaatgttg

SEQ ID NO: 48296 - DNA, 1037 bp, Bovine  19866880137154
actgtttataatagccggacatggaagcaacctagatgtccatcagcagatgaatggattagaaagctatggtacatatacacaatggagtattactcagccattaaaaagaatacattcgaatcagttctaatgaggtggatgaaactggagcctattatacagagtgaagtaagccagaaagaaaaacaccaatacagtatactaaagcatatatatggaatttagaaagatggtaacaataaccctgtatgtgagacagcaaaagagacacagatgtatagaacagtcttttggactctgtgggagagggagagggtgggatgatttgggagaatggcactgaagcatgcataatatcatatgtgaaatgaatctccagtccaagttcaatgcaggatacaggaagctggggctagtgcactgggatgacccagagggatgttataaggagggaggggggagggggcttcagtatgggcacctgtggtggattcatgttgatgtatggcaaaaccaatacaatatttaaagtaattagcctccaattaaaataaatttatattaaaaaaagaatcactatatatcttaggttagatatttaagaaaagtaatatttggggtcaggataggctacattatcctgaagaaacaaagaaaatccagaatctcagtatcttcataatgtttacccttctcatcctgcttgttttttatgaatcaacaaggagttttagtcagtgtagtcatttaaggacccaggataatggagactcatttttgacacgtgcttctatggctactgaggtcaggaaaataggacgctgttaaatgtgcagtgacccctaaatcttcttcccagtggtgatattccttacctttcaagattacatgacacagttccacacttaatctctttgtctctgaacaattgtttcagattcaaaagactaacttggaaatatctaaacccattcagaatttttaactaacactgggtgactacgtctggcatttaaaaatttttattactttta

SEQ ID NO: 48297 - DNA, 1946 bp, Bovine  19866880368423
gtctctgggggtcttaaaaggggtcctaaggccaagccccatgtttgacttcttgcctgcagtgaactgaagtattcaccatagtctttctgctgagtttttgtttctgaatccttctgaatatttttgtccttctatcactctggtagtagaaaactggctaattatgttattccttcaaaccctgtagaaaacagcccctcttctcccatcccaatctgtactttggggaaataattatttagtttacttacagattattaaatttaccgtattattgacactgacttgtgtccctgtatctttgaactgatgcattttatgttatgttagcttaactatttcctcctcagttagtaaaggctcttctcctgagaaagttagattttattttcttcccagaaagctaaccccatgaccttaatacctttctgattttaagaggcgggatctctttaagtgtcaatgcctgtaaagttttctttaagaagctcaaatagaattatctaccgacatttctgataattttctgaagcaataagaagaggacaaagatggacacatcctttaaaaaggggagcctttatcgtagtagcattggttcatctctttctatagaacttgaaagcctgtgctcagtaatttatgttaatgctttattttcgaagttttctttcttccataagctcttcatactttcaccaagaaagtatgacctttcccctctttgaaatttaccctccaacctacccccactctccaggctagcttttcattagggaactggggagacataccctcacgttgctatgcattgcgctctggtggcaggccttcctgacaaaaatcaaagagctgctagtgccggaaggatgaactctgtgatctcagcccccgtaaagagaagcatccccagagagaggttcaattcatgtcagagttaaatcttaactcatctgagagctgagaagcactcaggcttttgaatatttttattgagaaacattttccaaatcacagatcagattaatatttcagtaactctgaatgaatctggtccagggcaacaaacagtaccaatggctcatgtgcagtgtgatttagaaagaagattttagggtctttacacagtttctgctataattttttccaggttagtgaagtgaaagttgcgtagtcatgtctgactctttgcaaccccatggactatacagtccatggagttctctaggccagaatactagagcgggcagccattcccttctccaggggatctttccaatccagggatcgaacccagggtctcccaccttgcagggagattcttaaccatctgagccaccagaggtgacccatagtagtatgggtgctataaagtagtatgcatgctataaagtcccccaagtcaatctggtgccaaataatgcagtcgtacattctgggatcttatgtgagaatataagaaaaatcctctactctatctcaactacagtgaatgcagccaaccacaaatatttccaaagaagtcacagaaattttaatgttttaagaaagtcagagggtcaggataaggcctagatcaacacattcataagaggcaaagaaagttgcccagagacacgtatccaaactctttcctctacaagccggtctttttgtatcagcttcccaccagtcattcctttgagctaaaatgttaaagacttatgcaaaaatgcttattggcagttagaatttcttagctattagtgcttagattagttagccattactgtctcagttgcttcccttgtggctcagtagtaaagaattcgcctgtccatgcaggagaggcaggttcgatctctggtttgggaagatcccctggtgagggaaatggcaatccactccaatattcttgcttgggagatcccaggacagaggaatccgggggctacagtccacag

SEQ ID NO: 48298 - DNA, 1441 bp, Bovine  19866880553614
aagtgaattaaagtgggcatcagatgaacctcaatcacatatgtgtgaggatatgaaacactaaggtgtggataccattcagacagaaaatgagattactatccacaaataaagttgttcttttgaactgcattattggaaaataatcttggaaagaagaacttctaatactagttatggctgtaatccattagaatgatttcctaagaatggcttataaatattctcttaaatatacttgaataagaagaatttttctcttgtgtgcttgacgtggctaaataaagcatggtccttccagaactgagaccaacacaatagatcattaattttatccaattgtttcctgaagtgaccccaattatctgattttttttcatctaatatagttcattcacagaaagtggaatataagtaaccttgtatttcattgtccactaagaaagggagtttatttgatataataatattattttggaccctttatattgaaaaaaagaatatatacccctttaaactacaaagtatctacattcaactgggtacctaattatcttccctgagaacttttttaaaagaacaaatgtggtgaggcaatgagtatatcatttattttgttttatagaaataacactcatgtgtttttctttgtcatagtaagtaaaacatttcagagatctaaaataaaatattaatccaatcccagctttccagttccacatgctgacagaacccaacgtaaccagtatcagaataatgtctatcttccacattattttctatgtttatacaaatagaatatgtgcacataatatgaaaatacccaagacaatataaaaagaaattaaatctgttataaaattactgtaatcaaaagaatatgatattggctgaggagcagacctgtcacatacacaccactctatattctgtggggctatcacacatgagcagttagtgtcagcctcctgctcaagtttccattgattctccattgtctgtagtagttctgtccaacaaaactttctatgatcacagaaatgttccataacctgttctatccaatgaggtagctacaagctacacgtggctattgagcatttgagacatggcttgtgacactaaggtactgaattttaaattgtgctgagtttcaattaattgaaatgtaaatggtcataagtgttttataacttgtgtactggacagcacaaatctgtaacgtcaaacccagatttcttatcaagcatttaagattctccatcattttatctcagacaaccttagatcaagacctataggatcttagaattaaaaacagaaagacagtggtgctgcaaatatgggaaaggaaagccttaaagtgtggactgcaggacacaggggaaaactgctcttacctctactttgaatatatcatcagcttaattcttattgaaag

SEQ ID NO: 48299 - DNA, 1848 bp, Bovine  19866880637385
tatgaacacacaagtcactaataagatatgctctgtcaaattaaaatcagcataatttttaaaaagccagtaatatataaaagaattctatatcaatataacttgtattaggcactaatgaaatacattgtgatttagaatttcttgatttctgtggacatttcctatataatgaggaattttccatttttctaccatcagctgatgttccattctttgtcctgttatggttccattgtttgacatctcacagaaccaattaaccatataacattgataagaataccaactcaaaaagggtgtcaaaagagcatggaaaatttaggatcttttttgaagaggttggtagtcgcactgaaaactgtaattaaagagtgtgtaattctgtttgtgtgtttgttatacaattctactagtctagagttaaagaaacatgggaccgtacagtggattacaatgaaaaagaacttttattctccagttgatgataataaagcataactccttagagagggacttttttccctatagtatttgtaccacctgcttttaaaatgctactaagtgtgaaattagtgttgtccctcaaagtgcataagattaattgttagtaattgaacacagtttggggactaattatataaaaattgatattaaagaatatgaccaaactgattgagttttacagtttgcattttgttttcaaattacatgagttgaaaggcaatggtaagaataaaaatccattcaaagctgtgaaagcaaattaaggtttactagtcctttgaaagacaaatgagtcaaatgctgtaatgtagagagagcagtaaaaatgattctgaaattaactgtagaattaaaatatcaactgttctaagactgcatggttgaccacattcaaggaggtgacctgcctttccttgtgtgtctggttaattggggtctcaacgctcttctttgaaaatataaattacgatgatttggttagagaatggggaaaagtacatacaattcattgcctcccattattccttatttatctttaaattttcagcaaaagactcctgcttcctgaaatatggactgaatgcccttttccctatttctcccactatgtacagttaaaaatgctggacatttatataaaacaaatgtaagacgactctgaaaggcagacaaacagtctaggtagggagctggtgatcagaggaacaacatggtgatgagttctttgggttttctttatgcctcgtatattccagactgggtggagaaatccctgaaaatgccaatgaacgcagagctacacccacacctaaagcctgatctgtcttgccaaaggaatagaaagagacagcccagccaggacagaaatgtttagacaatgactgctctaccacagcaaatgtcacagaaaaaaaatccttatcccttccagcaaaggccaagtggggagcctaaattttaacacttcccttagttgtccagggcaccccaagctaccttcctgagattatctgccatttcctactccagggatcaaacccatgtctatagcatctcctgcattagcaggcagttctttaccactgcaccatttgggaagcacagaataagatgaaaatcacattaaataaaatggaattagctttactataaacagaaaaaaaaaaaaaataaggtttaagactgtgctgtgctgtgcttagtcgctcagtcgtgtctgactccttgtgatcccatggactgcagccctgcaggctcctttgttcatggggattctccatgcaagaatattgcagtgggttgccatgacctctcaaggtttaagactacaaagaaccaaat

SEQ ID NO: 48300 - DNA, 1548 bp, Bovine  19866880703766
attttccaatcattccagaagattattgcatgtttgatttccatttttgtctatagctttctaatagtgtttatagtaatgaaatatcatctataaatttaagttcctgtttaaatggtgtttgtgcgtataccacttctttaagccgtacatattatatctcttcacatttccaactctgagaacaaggtcatattcaattgtttcagctctcttttcttccttcccttctcaatgtttattagagttgggcatgaatagcactctctgtgtttctgttttaacatgatggagtttactcaggtgattttctttatatttttgagcttctacactgtctagaattaattagctcccccatagtaatttctggaaatttataatgctgtttatcaagtttatgagcaaattaattgctttaaatctattttgaaattcatgtaattacatcagttgtattgaagttttctgaattgaggactttatcagcttttaggctatcttaaaatttgttcattatctcaagtgagaaatttccacattattttatattactttttgcataaaactgaaaaattgagaagtccaatttgataaattaaagttgcatgctgatccccacaacacatcttgtggttggatgacagtcttccattaaggcaagtgtcctgtataaaattagcattgtaactaatatataggacctttgtggggaagaaaaaaattattactcattaaacagctttgaatgaatggaaatatatatgatgctttggatggaaagtactaatattaaaaaacatagtcactttaggatggataaataattgttataagcctttaaaattaagtgtaacttacaatacatatatgctaaaatatgcatatatgctaaaatacacaaatcttaaagtatacagttcaaaagatttttataaattgagcatattcatataaccatcagacacttttgagatttccgattgttcattgtacgtgtcaacacttaatattgctaatccttttgattttagttgttttcatagatgtgtgacttggatagcattgtgtctttaattgacgtttctctgataaccaatcattatgaatatgctttcattttcatcttagccagctggacaaattctcttgtgcaatacctttttcagatcttttgcctacttttttttctgtaattttatttctttttaaaattgaaatatagctggcaaataatattctgttagtttcagatgtactccatagtgatttgacatttaggtacattaaaaaatgatcaccatgataactctagtagctttgtgtccccatacacagttattacagtgttattaaccataccatttatgctgtaattacatccctataactatttattttgtaactgtaaatttgtacctcttaattccctgtaaccattttgcccaaccccacccatctcccctctggcaactaccctttattcctctgtatttatgagtctgttttcatttgttttgtttaagattccataggcaagtaagatca

SEQ ID NO: 48301 - DNA, 1015 bp, Bovine  19866880764724
ttatcaagaattacatacgtcttccaataagacttccaaaaggctgaatacagacccagtccttgactagtgacactgaaaaggaccacagaggttaaccagtcaaccctcttcattctataaaaaaggggggggaaagacctagagtgattagtagtttccttttcaaattcagaaaagtaaaccaccacagagatgatcactgatctagtagctgtaattttctacctcagtgtctggaatggccccttttcaccctctcttctctttctgactagctctgccccagtgcgctcctccagcttccaatttcggatagcactaaaaattcacactatgaatttttaaagtttcttatggcagggtataagaaaaagagaaggcatgaaatccctcaagctcattttcattgtactgtcctcttcaaactgctcactgaagcatctagaaaacaaaaggataacatgtatttgtgaatttcactttctttctatgccctttgtgccgtaaagctcaacaaaatagctgaaaagtgaacggtgggaggactggggctggggaggaggtgaggcagtgagggctggaggcatagcataaactcattcatcagatgacctgtgatgtgattctttttgccatgtgatgtgattttgagcaggtctcttaaggctgttaagccctagattcctcttgtgcaaattgagagcttgaatagataatctcaaagttcctgtcagcattaaatgaggttttaaattcatgccatcaaaggaccagcacctagctgtcacaacttgtccccaaaagccacacaccattcttctactgctgagatttctgtacatttcatataactaccattcaaatgtggcatgcactcctaattagcactttattaaagctcagctcgtgtgtctgtagtccatttttcaagatgacttaaaagaaatcagaatttgtatgctattcattccctctaaaaagcatattttcaagatgtatttaggcaatagtg

SEQ ID NO: 48302 - DNA, 833 bp, Bovine  19866880868343
tatagctaaagcggtctattttaattactggtttctttaatctagttttccttatagagaatatcaatgccaagtggtttttaaaggattcaaaagtgttcccagatgaactaattatgcccttttatttccataactgttgtaatagaaccttctgaggaatctttctgaaggatctatgtcccttgcctcttccttaaaactcattccagatctctttcttacatgcacaaaatatacatttatttttactgtagagttaaacacttatcatttacctgaacctaatctgcttaaatgcccaaagtctaattgatttcaaattacattttaacacataataattaaactcgcagaagagttaaaaaggtacagatatgatagcaaagctaaaattccaaatcccttttgcttagatctcttccacaccagtccatcctaaaggagatcagtcctgggtgttcattggaaggactgatgctgaagctgaaacccaatactttggccacctgatgtgatgaactgactcactggaaaagaccttgatgctgggaaagattgaaggcgggaggagaaggggacaacagaggataatggttggaaggcatcacagactcgacagacatgagtttgagtaagctccgggagttggtgataggcaaggaggcctggtgtgctgcatttcacggggtcgcaaagagtcggacatgactgagcgactgaactgaaccgatctgaactcccacacgtccccctctctgtcctactttgcctcgcatctggagagagattcatctgtacggactccagcagtggtttcccgtgccctccga

SEQ ID NO: 48303 - DNA, 1277 bp, Bovine  19866880870085
tttacaccatcaaagaaagagaaacaagggggtgttttgcccttctaaaaaaagacacctaaaatgttgtcaaggggattgtacatgattctgaaaagtcatctggacccagctagctgtacaacttcaggaaacacagaagtcagaggaatacattaaacagtacctaaagtatgcactcttcaatattgaagcttagaaactctgtagggctgatacttatattttcagtaaataaatgataaagaaaaaagctatagaaggtgaaattatagattaataaaagaatttttaattatcaaataaaaaatttgataagactatttagccttagagacctacatttggatgataagacaataaagaaattcaaggacatgacctgctataaaaattaagatagtgatcagggtgaagaaagtagtaagcttaggataaggcatatacaatgactgataacattcttttttgacctaattggtacttacaagtttttcacttgaaataagccattaaattacatatttgttcagtgtgattttctagacctgtgtttcataagttaacaaagatttaagccaaaataacaatggattaatatccaaccagcattgtatactaattttaaattaattcatctcactgtaaaaatgtaagataattaaagcatataattacttaaggtatatttgtgaattcctagtaatttacaaaattaacaaattgttttattagattagggctatcacacctacaagtgagaaatgtaaaacaaattcaatttaaagtagcaccgacaaaaccaaagaacagcttcaaaaattcttttatctacgggaaactgatgacatggaggtgcagtaatgtctggagctttccctgtggtggggctgccatcttgagcctccgtaccagaaacagcttccacttgctcaggctgggatgagggcagaaatgaatcatgccaaagaggctgatactgtggaaatcacttccagtccttccggtcacttctctgggtaaagtgtcaccatgagcagaaagccagtcctccataatgatgatttacagttggaaagtggctttaggacagatttactgttgccctattcacactactctgtttctatcgccaaaaacatttttcctgtaaaaagcaatgttaggaaagggcatatacatcagagcatgttaataaacccccttccttttccccttcaaggaagtgagcagtttgaaaagaaagagaaaaaaatgtgcacgaagagagtgaataa

SEQ ID NO: 48304 - DNA, 1182 bp, Bovine  19866880882268
ttgaggtattcttggagccccaggggccaaattcattatctcatcctatgttttgtgtatttggaggacatcacagtctcactaggggctgactggattctcacacaaggagattcagttctcattgaaggaaatttactgagttcccattttctccctaatggcttttcactctaaaaactgaagttggtaacattattaatgctaatcagagttaagggtttcagttatttcactacagaaatgaagacaatcataatttgcaaagaaaaacatgagatgagcattaaaatgaatttaaaatttaatattctggtaatacttaaccctttttaggtgattcgtattcagaccattattattcaaaactagaatgtgtgagaaaacagcagccacactggtttcaaagtgtgagccaaatgtccattaattcctagacatgactagtccatcttaaagctagacagaaaatatccagggtaggacaaaaaacatgtaatgcaattaaaacacattttgaaaatgccttttatgaatcagcacatccatcaatggctataaaatctggggagcatgacatgtgcaacttaaaccattattacagatcacttcacagtttacccctctcttccaaatgtctgttaactaggaaaggttatagatctcaccattaacctgtcgatttattctgtaaactcaaaaagaagactgccaaccatctgaaagatggacaggtaggcaggtgattctataggatttggacttgacagaataaaacaatacaacacaaccccaagtctaagaggggtttcctcactgaagagatggagaaggaaatggcaacccactccagtattctcacctggagaattccatggacagaggagcctggcaggctacatacagtccatggggtcacaaagagcaggacacaactgagcagttatcactcttcattgaggagaaacccatgtggcctgtgaaaggtcttactagaaacaaaagtgactttgatttaaaatctacatgttaagtatgtaacaaagggtctgtaattattttaataattgtcaaaactaaatctttgtgtgagcatatgtcaaattccccattttatgtgctaataaaacagagttaatcaataaaatcatattttcagctacaaaatttattccttcacat

SEQ ID NO: 48305 - DNA, 1719 bp, Bovine  19866880887302
atcattattcagttcagttgctcagtcatgtccaactctttgtgaccccatgaaccacagcatgccagacctccctgcccatcattagttgagtataattataaatttttgatgatggttctgatgaagtctagaaaactaagtgataaccttgaaaccaagttaactaaaacatgttaagaagccgagagaactgagttttgaaattaataaaatcccttggtaaagtctgcaaactctaatatattatttcaagtgatgattatctgcagaatagtctccttaattttgtgggagtacacaaaataaagttttattttgttaatcttgacatgttttattttagagtaaaagaagatggaattagtgaataaagaaagttttctctcttataacataagaattgtggaaagtgtcttaaaggattttatgatcctaaagatatatgaaaataaaaatattcttatctaaatgaagtggccaattagataatagtgcatctttaccttttaaattcagtaaataaaccatgtgtctgatttgcttctcacagaaaagatagccacttgagcataatgaattacacagtaattttctgtacatgtgaatttaaaactgtaactatttttgaaggaatagtgaatcctgttttaggaactgagtggaaagtgctgcgcaccaaggcaaaggaaaatcaatctgtatgaaagtcatttggctaagaaaagaagggaaaggtgaaactgaaatacggagagtcagtcttcaactctgaaacatactttatttgcacccctgatacacacataaccactgtcactttattttactattacctgaaggcatgttaaaattctcttttgtggtaaagaatctgcccaccaatgcaggagacacaagtgcgatccctggtccaggaagatcccacattccacagagcaactaagcctatgcgccacgactactgagcctgtgctctagagcccagaacagaaactacagaagcctacaggccctacagcctgtgctccacaacaagaggagtcactgcaatgagaaactcaagcacagcaagtacagggcgcctgcaagtatagaaagtccgtgtgtagcaacgaagacccagcacagccaaaaatcaatcaatcattctttttaaaattcacttttgaagcaaggaaagtttgcgatatgttgatgtttcctgaaataaacatgaacaatggctcttttacccagtcatctttatcactctagaaaagggaagttgtcggactttgtatctgcagtataattagtttgtagaggcaagatcgtaatgaaagcacaatttacattattacaggcatttgactgtttactcactctaactggaataaaaagtgagttccactatgtgcattcgaagatttattcaatccattttctaatattttccctccagaaaagtaaaagtgtgattagcaagtgggagcactaaaaacggttcctgaattgagacttcccatcctgcctccatgggatcaaagcagagagaagggctccagaacaaactctgggagtgttgtctcactaccagaaatggtgcaactggtttctgtgccatgctgtaattacactgactcaggaaaaagttctacattgttcttagaagtaatattaataataaacctgtcagtcacaataagtcgtgaatggaaagctctttgttgggcacca

SEQ ID NO: 48306 - DNA, 1265 bp, Bovine  19866881046178
ttgctatatactctgactaggtttaggtctcattttgagcttttgtgagtaatataaagttaagattaatttgtaatttcatggaaacattacatgatgttaatataaaataaaattttagtttaaatttttttttagtcatataatgagttgtggattttattctaagggatcaacagaagttatagatcataggtacaaccaaggctcaaagcatgctgaggtttaatgaataactcctaatcgttgacaaaaaagagtcacttaccctaattattaatgtaagaaacaagtaccttttctggtgtttgggaagaagtacttgcatgtttcattatcctctaaataaagatttaattaaaaaatatttgctatcaagagtaatgtacagacatatgttttggataaacatttatgagagtatacttatatacatacatataccaatcccaaggtttgttaaagtaactagtcatgttagaatggttgtgacttttctgcagtaaattatctgtaagaaatctgctcttctgaggcattttatccattcctcacaaaggttttactcattctgtttttgtttttctgtagttttcaatggaagttctattgcctaccacttaggccttgtaccctggactgccggtgtctctgagttttcatcttggcacatgtataattgtagggcaggccttctgtataatctaagttcattctaatcagagctacaggtttccctccgctctgtagtgaatagagaatattcaaagtcagaaagaaattaggagctgtcttaaaaggtgctttaaacagctcatgttccctaagccctcaaagaaagttacaaatcaagagagcacaattggaggctacattatcaatgcctttcttataatgctgccatttacattgaataatattttaattggctttttaaaaacacccatcctttggatggaacattccggcatgatgatattccattcccatttaggattacaatggtctggggataattataacattcatttccatctggagttctagggacttatacatgtgaatatggaaagagagatgagcatcttctgtttgtaaagtagacactgatttggtatttgtgacacatgctattctatttttggctcctataacctacataaatatcttcttctaaggtctttcttgccaccagcaagtgggagcagtttcctatgagttgactctgtgatattgcttttatggatatcaaagatataaaagta

SEQ ID NO: 48307 - DNA, 2541 bp, Bovine  19866881092760
gtttggaggtttaggagcttcccttgtggctcgctggtaaagaatccccatcaatgtgggagatttgagttcaattactgggttgggaagatcccctggagaagagaaaggctacccactccagtattctggcctggagaattccatggactgtatagtccatggggttacaaagagtcggacacgactgagcgactttcactttggaggtttagaaatatgtaattatatctagaatgcagtggctacatttggggttggggggcatttaggaggcttctggggccactgctgttactgtatttcttgactgtgttgtgctcatatgaatgtttcctttcgtaagaattgagttgtaagaattcattgagccattaatgatttgtacagcgtgtatgttctactgcaaaaaacatttaccttaagcaaaaagaaaaataatatgcctttatgatatctaattcagaaaatgttaattctcatgatgtgcactatcttgaacttactattccatttattcatttgatgcatatttatacagcacctgaaaatcatagttagacttttctccttgttactaaatattctctgaaatgtatttttaatgactgtaaaatatatcaaaagtatgtatgattttatagaatatttactcttttttcaagctactgagcatctgcatcatttacaattttacactgttataaatatcattaagatgagtatctttgtatgttaatttctgataaccacaaaaatatacatttgctgggcctcagggacatgagcattttttcccatattgttgtacaaaaaatatgtattgctttccagtcccacagactttcaatagtttttccatagaggttacaaaacagtgacattcatggagtggaatgcattttctaaatacctttacatagggatcctaggaaagggtagccattattcttcattgtgtgatattaaaattagcccacattcccaatttgtatccatgggaagaaaaacattttaatttacgtagcttgcatcaaggaatagtcatagtacaagtgacccattctgtagaaaagcacatgaattgtaaggaaagccagggccattttaagcccagccttgccactttctatccatttgagttggtaagtgatttcagctacctgagcattaatttctacctctgtaaaagatgatgatcataaatactatacaggattgctatgaacactagggtgatatattcaaaaagcctaccattgtgtctggaacaattattcattaagtgttttttttcctcttctcaattatggcatgctttcacttatccataataatgggtcaaatgtcatagataattctaaaactttatatcacaccagactttttacgactgatgataaaatataaaggagctgatttatttcagcttctccacctatttctgccctcctagccaaagtagggaaactggataacacaaatggcaaaatcaatctataaataattaagagctggtcttgggtcttattttatgatcaaaaatctgaatcattatgaaattaaaagtccctttgcaagttgtgttttcatttggcctttaataagtaactttcaaatgtcttctttttgtaaaaaaaaaaaaatcatatcataggttagaaaagggttctactgagcgatatttttttttccatgtgagcactatcattaagacaattatcactgatcaccttttaatgatatttcaaaaccacttgaaaaaaaattttaaagggtcacataaagctacatagcttatgaagctgaacagcacaaatgggacttttgcatttgttcagacatgtaccaggttttagttcctacaggctcacagacggttttctccttagcagtttgccaaatgtattttagaatgtccaaaatttaaaatgttgatgtatgtgaaccaactacataatgaaagaatccatgtaccattaaaatgataatgtgagtcactcctcagttccctcaaatatgttaagtgcaaataactagaccccagggagaggatcagaaaggtaaacaggtattattttgagtaaaaaagctaggcagacttactcagtcaacatgaacttgttgtttttttaaaagaggattcttcttttcctttttgttgcaaatatcaaattatgaccatggaatatgtataacaagctacaatgcaactcctgattattcagagcctaatcacagtttgtgttttatcccagccatttgcttctactcttcctgcctgctgcctgccttttgccatttcactgcttgttagtctttggccagagtatcccagaaaaaaaaaaggcaaattaaaaaaaaaaaaaaagaggtgggggaaggcagtccaaaccatttgaacttcttccagttttgtctgaagtttctggaggaagagggagtatgcaggttcacaaaagattcttagattatctttaactcttcttgtattttcccaaccatacacacacacatccttttattaaaactgtagagata

SEQ ID NO: 48308 - DNA, 2483 bp, Bovine  19866881100625
ccttgatagtatttgtggattggtttttaatatttaataattcatacttaaatcagttaaatcattaatcatcaataagtcgtcagtaagtccctaattctctacactttaaacagtttaatagatttgaaggaaattgtagtcaccctgcttcactttgctgatcttattgatatattagcctctttgaaatttaagttatagtttttattcatgctgcctcatgtttttgagctagtagttaagctttactattttttattgtggacatgtagaggaggagctcacatattcttagtagttgaaatggcatcttgaccttgaaaatataaaatccataggggtgcagtttggcctcaaactctatactattcaagatgttagaaaggtatcctgaattcaacacatttcaaatttatttgaaaatcattcttatgtccattttttttgtagattaattagaacaatattttattcttaaaagtatatgaaatagttttgcttcaaaaataaaaatgaaacagaatattctgaaagtcttactttgggaagttccataagggcagggtgatggtgttataatctctaaattatttttcagtgcctgatatacaggaagcattcagtacttatattctaaattaaagagtgtttctggtactgcacagaccaaatttggaaatggggattggagattgagtacagcaggaatgtgaatcattaaagaaccatttttatgaattctatagattcccatattattaggcaagcctgaagactttattttagccaattaattatttctgaacttcttattgcctgcagagtataaatggtatgagttaatttctttctgtcataagatttcttaggatggttcatagctctactagtcatttttctgtaatactttccggattatcacttttgacagactggcaattaacctaggtcttcattagatagagaggaagatatatgggtttaaagcattcttaataatgagatgatgcattcctcttcaaactgggatctcatatattagtgataagttatatagggctaatttcatttacatttattcatccaacaaacatcattcataatcccaggcaccctgttttgtgctaaataatgtttactggagtattccagagatgtcttaatatataatcatttttgatctcttggaaataaagttgaattcagcttgatgtaaatgtatgcttgctgttaacctgttaaaggcaggcatttaaaattctttggcatgtaactttgtaagataataagtagataaattggcaaatagcttttaattaatagatgccttctatttaagtttttaaaatgaattgcattcgataggatgaactatgttatgttgaagaaacaaagtcagtagcttcaaataatgtgggcatgaacttgggccaactctgggagatggtcagggacagggaaggtgctgcagtccatggggttgcaaagaatcagacacaacttacaacaacaacaattaagtaatatgatagatcatattatttccaatgatttttctcttcttcaggtcacatgatcatggcattcctgttgattcccatgaaacatgagtgtttcctggtgggataatgtacatccctaacctgttgatgtgagcctaggccatttgtcttattttttgtccagtggaatttgaatgggtgtgatgtataccacattcagacactttagtggccattgtgtggttctattttactcttttcttctcagcattaggtcaagacagagtacatcctgggatggagaatacagatagagtaacgatttagaggtgcggctgactgagagccatcacgtaacttgagtttgctgttgtaaaccactacagtgtggagttgcttgttcctgcagccttatctaatgaaagctaatacaaacagtaaagttatttctcactcattttatatgtctgtcttcaagtccattctgcatactctgtgctgcatttcattttcgtttcttccaccaactctcacagaactctcagcatcagaaacattgccagttgatataaagaaggaaagtaacatgctaaatcatgctctaagtagtttgtgccttcctcctggaagggacacacatcaaacttgctcatatttcagtgactgaaccatgtcacatgacttagcttaattaaaggaagtgaaagaaagagacttggcaaaatggatgaacagtgaaatgattaccacataaaccaataattcacaattttaagtccttttcagaactgattgagtgattaacctctgtttacaaagaattctggcctggctttggaacattctcccagaaaagacctttatacacaaaattgacagaactaatactgaatagaataggactgaagcaagcaaaaaactaaacagcatatgatttgagtaattcaataacatataaattatattcaaagacaaaag

SEQ ID NO: 48309 - DNA, 775 bp, Bovine  19866881223977
agatggctggatggcatccaccaaactccaatggaagtgagtttgagtgaactccggggagttggtgatggacagggaggcctggcgtgctgcagttcatggggtcgcaaagagtcggacacgactgagcgactcaactgaactgaactaaaaggtaaaaagaggatatccccagttgaatcactatagacatagaggttaactattgtcatttaagagtcctttacctaaacatgccacatgctctagaacaggctctaattctggaataaatacccacagaaacagtcatgcatgctcagtccaattttccatatacatgttttctgaaaagtgggggttaaaggtaattgaaagtctaggactgacatattagactttatggcatacaagcccaaatctaaaactagaaacagtaataatattaatatttagtaggagaagtagaatgttaaacctacaaagaaaggtggggaaaatgcttaaaactgaatgaagtagttaaaaactacaagtcctagatatatcagcattcacatctgtgccttaagaacatgcaaatgaaactaattagtgctcaagtcatttagttacaagtggtggctaaacttaacagtttcccaatttcaagcacacataatgtataacgtagacaatatagtctcttataaagaacagaaaagcaaggaaagaagggaagaatagagaataaaaggaagggaggaaaatttgctgagaaagtatttttcatttcagagaaaaccttctttcaatt

SEQ ID NO: 48310 - DNA, 1824 bp, Bovine  19866881243480
tgaagtcgctcagtcatgtccgacccttagcgaccccaagactgaaggcccaccaggctcctccatcaataaatataatgttagtgactctttcactctgaggcacactcatcatctattcatctcccgtaaggcagctaatatcaaaaaggagtctctgagtccctccttctcctcaagatccatttggaaaaactggttacttaatctttatttgctcaactagctttatccaactctggaaggcaaagtttaacaaatcacatagataagtcttatttgattttaaatgaaatcactaatctttacctcttcatccactgaaatggagaaataatcaacaatattcttcaaaaaaagttatctttccaattttagtccctgctttcctttgcttatctccaagaggagatgatcataaaaaggattatatgaaagatgtatataggaaatagtctaaggatttaggtcaaaattaataaggtctggagtaagtcattaggagagaaaagaaagaaaaatacagtgaaaatacagtgaaattttagatgtgagctaatgagattggttaagattgatattaattatgaaagtgagctgaatctaaaatgtctgataaaattgccaaaagcagcgaaataagtgtgcgactatatttttacatactagaagatcagtagagaatgaagaacttaagaagattcactagcagaagaaacaaactaggagagtagcaggagttttgcaaagagggtaataaatataagcacatgttagagaaagagatcctccagggtaagcactgagaagggaagtacttgttttacccagaacgctgatgctctgtgtgacgcatggtcagttcacagtcatgccacaacactcatcactgcttcttgtggtccaccaccactaattcattttctaaactcatccttaacagtcaactccaaaatcatcaaccatgtcctcactaggacatctctagcatcataaatattatcatgtcaagtgttcctgcaaaaatttaataccagtttctattatgttattctccttctgaatgacttcttcaaagaagaatatgaaggggcaaaaagatatgtcccttttaaatgttctatcacacatgtgtacatattcttactagtctttggtgggagaagaggaagatgccaaaaataaaaaataaaaataaaaacctctagctgggcactattttttcatatgtgcctttactcacaaagcacccatcactccccttgttctccttagtcccttgcagctcaaatgtccccagggatcactggaaatctcaatgtaagcaaaaagagaggtaactcttgtattggtgggagtatagaacaaaattagatgcctggtgtgactgttcattttgggctagcaaggtcactgagaaacactaggtcatgcttgggttggcaccagctgagtaggcaagcaacataaactatggctgggagtaaatcagtgttgagcagagtcccagaggaaaggcagccgaaaggctcagctacactagatgaatggccctagacataactctaaataggcaactgtgtttgtcagcctttctgggagatactgaaattaatgttctatggacaagcccactgaactgtcagtaaagcagatggaagccagagttcccaaattccccaaccttcagtctaagttattctttggatcagttagatctgaaactctgaactgtccacatctctttcccaagttcatctgatttccaaggtggaaaaaaactctcaaaagtaaattaaaatggaaacatttgatgactttaaa

SEQ ID NO: 48311 - DNA, 1786 bp, Bovine  19866881513303
aattaaatgttattttagaaatcttctaacccaaccttcagactcctgggcttccagtgcttaattttgctatcttgggcaagttactgaatatgtctttgcttcagtttcttaatttataaaatggggtgattatagtacctatatcattacatttttacaagaacctaatgaattaacacattgcttagaaaagttctggtccatagtaatctttcaataaatgtctattatttaggaggagcagaaattaaggtagaagagataagacacagaatctctgatagcttaaaggataaattatttgcttaaggtcatgctaactattggtacaaccaagactattttaattaaagtttccaaactttccatgcacaatatgaccactgccatatgatgttagttcccaaatgaattatgaaaacatctacatgtgagataaagaaataaatagattccataataaagacaatttaaatttttaattttttcatttcccaatttacacatttatgccatgtatattaagtataagaagcaaaatattttttaattaaaaaaattttatgtagaccatatttaaagtctttactgaatttgttacaatattgcttctgttttatattttggtttttggtcatgatgcatatgagatcttagctccctgaccagggatcgaacccatgcccctcctgcactggaaggcaaagtcttaaatacttgggactgtgaggaaagccccaagagaagaaatttaaaacaatgagtctgagaaatatatacacccagaagttccagtgttttcccacaaacaatagattatattctactccccacttagatgcccggtatttttcacatagtttggttttcaagtgtctgcttcttctagattgtgagctagttgaggataagaacggagacttgagtaagacttgtaaatctctggatttaactggagttgcctgacatcctctgagcacttaataaattcacaatgggtatcccttgtattcaacaaaaatatgccattaggggtaaatataagaaagagtagtagtctcagcttttatgaaaatttgagcagattccaaaagcctccaattgaagtataaattcatgcctccatatttccctgtgtcccaactgtagtaccctatacatcaaagaagcccaagtgaatatgtgttgatttctacatcttaagggaaagtacacacggtaattctttttctagaaacttagttgacaggattttagattaaaagatgtagatgatcaaagtggagctttgggaattattcaaatattggtctatacaagcagagtccactgtccagagctatcaacacttgtactaaaagtcttaaactaacaagacatcactcatagaaaaaccacagctaattctacaaaacacagctactaacagttaatatttatcgtgttggaaagaatttagatccaccattgtagctacattacactgacagattaaagatatgataccccaaagaattttcttggtaaacatacaaaaattagaaagtttttaaccctaaatcataattcctttcaatttatacaagctgtatttccacccagctgtctagtactgaaagctgaatgttctaaactggagcttttagttcagtaattgcttaatttttcattgcaatgcctcttcgtggatttaaaatggatggattttgcttttaaaaaaacacttcttttttcttgtttttttttttttaagtgtaattatttttgtgtcagaaatataatt

SEQ ID NO: 48312 - DNA, 923 bp, Bovine  19866881545233
gagatttaagggctttgaataaactaattccattcttagccaaatctgatcggaacactccaaacgtctcaagcctgccatgctcagttagaaatcccttgagacgtactctatttctgcctcccaattaagctgaaacaagaacggctttttgcattacgttttggcatattcactcaacccaggtaggccagagattggtgaaaataaaaaacagcaaaggagtgaaattgccctatcttctgaaaagggaggaaatttgtttttgcagtactgggtaattgtttgtgcagttctgatttttctaaatggatagtgtgattttaactttaatttttatgctgaagcagcttgcctcctagataacctctccatgtacagcacatgaatccatatgatttaattctaacatttcctgtcatggtattctgaaatcttaagtcattacttcttaaaagatctactcaacatagcatttattttcaaattccctggaaatcccataaagaactatattattgcctgcttatatttacaaaatgaatttcatgttagctagatttttcctaatatattttcatatatattactacaaatataatgtatatttttgtagattcacatatcatgtcagaatttatggtttgatttattgtgcccctaaaatttctgcctcttgaaaaacatttttttataaaaaagttcatactggtgttgacacatatagaacatgaattttagcttacaaaaacctaatggttaaaatttataacctatacaattcttaacagtttttatacttgtgcttccctagccttcattaacatttaatttaaatttatttcacatatgggcattttttgcttgacttaaatgatgtatttttgtatgcttggtatcatttgttgtgtgagctattttta

SEQ ID NO: 48313 - DNA, 1261 bp, Bovine  19866881651059
aaatctgcttgttgcttaaaatactatttgaggtttatattagaaacataatgtctaaacagcatcaatattaaatattcaagtttccccactttcagctctggcccatctattcatggctgtcaagcactgcaacattccatgcttacttgattctcaagactgtttctggcattttctcagaacttttcaagtaattactttttgggtatcaagggacttataacaaccaaagagcatgttgctcatctcagtcattgtctgggtgcattgacactcattctaaaggcactgacactattttgtgagcctggcctcatgattgagatcacataattgcaataattaggaaactcacctcaggatattatcaaaatgacccgcccaaacccaagtccatatggtttgaaatagctaatgagtcagttaatgtgctatgtccaggagtaatgggtattcaatatggatagcatgaaggtataatttaccaactttctgactgattaaggttttcaagtgggcattttgcagcttaaagagggttcaaagtattaacagcattgatggttgagacaaaatgaagaagcaacgattgtttaaaaggcaagggcgttggaatttgagcaatttcattcaatcatatattccaggctaaaaaaatgcactgctgtataaaaccaaacgaagatgtaggttttagtagccacctgtcctggtatggagacgtttgggagctgttactagctagattagatcagatcagatcagttgctcagtcgtgtccaactctttgcaaccccatgaatcgcagctaaggcctgtgtaaaaagtaaagaaaatgaaaaaagctgtaattcactgattttagggtgggctggagaaaaaagatgaagtttaattaccaaaaaaaaaaaaaaaaccacccaaacctagaatcaataataacagatgtctgcatggaaacgatccactgggtaactgattgatgtatttttcatttcatagattagtataaactcaaaattgtcacaatatctctgactgacttgttgactgtggtatctagaaaaaattaatatcccaaacacattcaaacatacttataagtggaaattaagaaaaattctatagttaacacattagctactcatctgaaacccttatgacaaagatatgcactaatttttttgaatctgaaagaatttactatcagagaattcttataaagataaggttcttaattggagtccacagacactca

SEQ ID NO: 48314 - DNA, 1017 bp, Bovine  19866882033413
aggtggagttttgccccgatccgccatgccactatcacaatgctctcaaaccaaacgttgcttgcaaaattgggaggtgaacacagaacacctgagagggccagagcctcagataatttattcctccagagccacaggaggaaggtcatcctctcaacacctgcaaataacatgacttgcagcttaggtatggtgggaaaaaacattggatttggaatcaaaagctgaatttgattttgcaccatcatggtcttattcaccaactctgtgtactcaggcaagttgggatgttcatggctttcatttttcttatctctaagagtcaatatttaattcaatagaaatcttgtcaagatcaaatgaaaaaatttgcttaaatatcctttattaactacaaaggactaaacaaatatgagttatgtcaatatatcaataaaatacaaagttaaatcaatggctgccttcaggtaagctgtgatcaatgtattatgtgatgggttgtgatgggcaaatataagttctttgtgtgcataagccacttgacttgactctacttcagggccttcagcacctcctagtcttgataagcacatgagtaaatatatcattaaaaatgtaataaactgtacatatatccaatcacaggaggtgtcaggatagaatcctgattttaaaaaaactactacaatgacctactctcttaggtcaaggagtaagcagcctttttatatttgaaagaaagcctgtcaacttgaggcacaaactagttctaaattcacaaattatttgctgaactagactatataggaaacctcctagggttgggctgataaaaattccctaatgctcccagctcctcatagactcacattcacttctctaaagtcaagttccaaccagggcatgtctcacttccttcagaggtgttctataaggacattgtgaagtaggaagagagagaacaccactgctggataatctgttgaacttgtctctttctgctagaacaacagctgc

SEQ ID NO: 48315 - DNA, 1735 bp, Bovine  19866880419423
tttttttgggaaaaataggtagtcaaacatcaaaaagattactgttaatagaagaaaagtggacatttgaattcagtgaattttagctcttttctatacatgggaagatgcagagcctggactcaatggaatccctgcttggatgtccatcttaaccttccagggccagtgtcctgctttcctccaccttgagtgcccccacgaggcagagactgggggcttgatggacacaacatccttcatttactgacgtggcaggcgacactctctgtccacactgtatgtactagaatgaccgaaatctctatgcagacaacagcagcttagagttactcttgtctaaacccttcattcgacagcaaggaagctgagacccaggaaggtaagatttcagagctgtttacttctatttcaggatagaaacatgtgtgctctttgcagagctctgatagcctcttagtcagctttcttcctcctggaagaagagtcatttcttttgcagctatctgttccattatcactttgatgagaaccacaaggaaatgaagcggtaggttattcagtgcgctgataggatgctcttggctgtagataatagaagagctgactaaaagccaaacgtttttagggaaatgttgtttcatgcaatgaaagggcagagccatggagattccaggtttaattaagaagctgagggctctggtgtgtgcctttctctctgctttgctctctgagtaatgatcacatacccctcaggtcacaagatgctaccataccatcacgttcaatgctcaaggaagaaacactgcatgtcttcctgagaaatggcaggaattgtctagaaactcctagatgctccccttaagaccacctgagctagatgtccatgctcaagatactgagcagctggaggaaagaaccatctggaagtcagagaaagggccagtggttgttggtgacaagtcatgtctaccacacacagataagcaagaggtcgagggaagagttttcagttatcaccagattcctcttttgcttttgaaatgtttcatgtcccattatcttcctgttccactggacaccagtgggctaagattaattaaaactcatgaaattttttccttggtattttgaagttgattttaaaacctggccaagctgcaaaatgacaaatgaaatactgaatttatgcagtttgggtttatggatttctctcattatacaagttcacttttctctctcatgtttgtgcacacttacataggtttttgtaaaggcttcgtatatattttgttgactctgaacacataacaattaacaagttaaatttcaggaattttgtgttacactgctccagaaatttctttgccttccttcgtttactttggtgagatgctcagagaacaagcaacgcttctgcatggataggctcacacggatcctcaaacaagagcaccacttagacacctgaaggcatctcaattaagcagaattaccatccaaattaagcagcagacattgccattaagcataattaggcctaatttgattccttgggagacattccaaataagggggtttcccgattaagttcgtggtgatgaaggtatattacattttgagcataacagtaaagaacagttacgtcaaaatttccagacaacagctcttgctagaatactaacagcattctagacaagaagggttgggacaccttggcttggtggttgacatg

SEQ ID NO: 48316 - DNA, 1476 bp, Bovine  19866881000948
tggttgtatcaaactactcttttaaaagactccctcacataattgctactgtgaatctcagaagtgcacttcacttgatagagaagggaagagaacatgtctttagttgtagcaaagggaacaaagctttaaactttcaagcatttgtactgccctcttgggatatcttttaattaaaataaattaaaggaagtttttgagagcaggattttgagttctgaagtgtcatggttaaagtagtcaaatgacagattcatgactgctttattactaagagcttacaattatgtaaacagttagtgaatacatcctgcagtgagtaggtatttcactccttaaacaggtagcagacttattctgctaaatatgctccccacagagcctagctagtgacctcacatcaatttcacgtggataatgcagatgcttgtgcataaggccgccaatttccatagggggaaaaaaaaagatttaacatgtaataatatgaagattttcaaatgcaatactaaatcttaataatatacatatgcacacataaacagatatacaatgggggttgttagaaaaaatggcactggctttttagaaaaaatggcactggctttttaaagtggaaagctttttagaagtcttgttatttaagtttctccaagcttattttatatctccaagatgtatatctttcaggatcaactagatattgcgaggttagcataagtcaacttgaaatgccttcctcagttatcagggtgaccattttggagtgctgcaccattgaaggatattttcatttatgccttttaaaaacagatttattgacatacaatttacatattttaaattctgtccacttaaagtatgcaaatgatggactttaatatactgagagcattatacacccgtcaccataacctaattctagagtgttttcatcagcccacaaagaaatctgttctccttagctactttttatctgcccctccccttacattcttcaatattaatagattgaatcagacagcatgcagtcttttgtccccagttccttcactcagcagaatgattctgaggtctgtcattgtcttagcctgtatctctacacctttccttttaattgaccaataatatttcattgaatgtatttgacacattttgcttatgcaagcatcagttggcagactcgaactattttacattttgagtgttacgaataactctgctatgaatagaagagtatactagttatgtgtgtatatatatgtttccaggtctcttgagtataaaaacctagggatgaaattgctggatcatatggtaaaactgttttaaccatctgaagaactgccaaaaatatattccaaatcttctgtcccattttacattcccaccagcaatgtataaagtttccaatctctctacacacttgccaacacctgttatcacctctgagtacagccctcatagagggtagga

SEQ ID NO: 48317 - DNA, 959 bp, Bovine  19866881113488
tagtaacatgggagcagcaaaaaatagtaatggaggtcaagtttgtgcaacatttcattgcatatgtgctgaaatccttctttgcatgaaggcaatacgtgtgtgtgtgtatttgaagataatattagtgagtgaaaggtaacagtccaaaatatatgatgcctctagcctgcttcaaatgtgcggccacattttataaggttaaaccaaatagtcgaggtcaagcatttactcagacacctgaacattcaataagccagcacatcagctccacatcactcacctgtaattgctaaaaaggaaacctgtcctcagcctcccttttcaataagacgtgtatggggaaattctatgctttttatatcttagcattcacctgcacagattaggaaaggattatttccctgaaactaatgaagtttgaacttcagagcctatctttcacgcaggtgcattgaggttctggaaactacctagaatgttcctagaatcctctgaatggggaattttgcagcaaaaataattttaagttcaactgggtaaggccattctttctcttctctattctccttctggatatttcagcactggtgctgggcattgcgtggggcttttgggatcagtctaaagggaaatttaaggtcacttatatcagcctatttatacagtttccaccacgtttatttataactaattatcaatcatcattccaaagcaatgtgtgtggttggctctgtgaacacagcgtgggccacagtactggatgctgagacaagggtgttatggaccatgttctaagtgccagcgctggaaaggggtaggtggtggaagtgggacaaggttaggtggacaaggacaaagttagactctagatgcttgacagaagttttctcaagttagaacacaatgctaaaaatatatagacatcaaaagaatcctcacttcagcatacaagtcat

SEQ ID NO: 48318 - DNA, 869 bp, Bovine  19866880223408
aaacagtgtcagactttattttttggggctccaaaatcactgcagatggtgattgcagccatgaaattaagagacgcttactccttcgaaggaaagttatgaccaacctagacagcatattaaaaagtagagacattactttgccaacaaagacctgtctagtcaaggctatggtttttccagtggtcatgtatggatgtgagagttggactgtgaagaaagctgagtgctgaagaattgatgcttttgaagtatggtgttggagaagactcttgagcatcccttggactgcaaggagatccaaccagtccatcctaaaggagatcagtcctgggtgttcattggaaggactgatgctgaagctgaaactccaatactttggctacctcacgcgaagagttgactcactggaaaagaccctgatgctgggagggattgggagcaggaggagaaggggatgacagaggatgagatggttggatggcatcaccgactcaatgcacatgagtttgggtgaactctgggagttggtgatgaacagtgaggcctggcgtgctgcgattcatggggtcgcaaagagttggacacgactgagtgtctgaactgaagtgaactgaatcagtatctatgtagtggagttttattaactatatttttaagggaaaaagtagagtagtatttcccaagttgcttgagcccaactctcttccatttgatcagaatttgtaatttttcatgaaaaattgaagcctattttaaggaatttgagaatgactacttgttcgattttgttttcaaaataatactcaagataagattactaggttatgggtaaagcagactgaaatctgtagcagtgcaaagtttta

SEQ ID NO: 48319 - DNA, 1434 bp, Bovine  19866880401325
tattaggtctgaattttatcaagataactagcctttaataactgagcagtagcagttgtcaccatcaatcatgaattccaaagcctcatatcagtcgccagacctggtttcctgcatcagaacatcagttgatttctagagaccttgactctcaccaacaccaccccacacaaatccagcatcttccacctgctgatttatggtctctgtccgaaaattacctaactttgtaattctaattgctgatccattcccttgggaggtaaaaagcaatttacaaatttaatttaaagctgaaataattaaatacattagctcaacgaaatctcacacacttgtgtatacatattaagccaaatatgcaaatgaagaaatcaagactcacagtggctcagaaacttgtctgaaatcacataattaggaagtaaggacgagacatttaaatagtttgccttaaaagccatgttaattactatttactctatttttaaattctgatgtgaagtagggactacacaatcaaattcctggggtttggagttaggaattgttcaagccaagtataaagggatcctggtaattcacttagggaagaaatgtagcatgtgatggtggtgacctttaaagaatggatcagggttttcctgaagtagcaatcaggatcagaagggtgcctgtttaaacagcatacatgcagtctgaactctttttcttccttttttgctgtggtggaggaaaggacattgtttatccctgtgactgtgactcagtatcccacagtgctgaatctcaagacagaaaagagatgagacacagctgcattttaacaaggttgatttaggcccaagctgctgtttggggcctttggtttgtgtctgagataagtattaatatttaccaggatgtactgttgtacaagtcaccaggggatgatttcttagaaaaacccggtgcacaatcacaaggatcaaaccccctttcaaatcctcaggtttagcacataatgaattcagtgccctgggctagaacttaagtaactaggagcaaaaaccagctcatcatgtgtcatttctacaggaagataatgctcgagacaccacgtgatctcctgtaagtggagcaggaagctgcttgcccagccattagagtgccagtgcagaaggcagaaaccagaggcagagagcccaacagggaggctgtagtgaattatttctctccaggcccccatgtggtgaccgccactgcccacctcccttgccatgctcagcatgtgcatgcgtgctaagttgattcagtcgtgtctgactctttgcaaccccctatggactggactgtagcccaccagcctgctctgtccacaggattctccaggcaagaatacaggagtgggttgccatgccctcctccagatatcttcccaacccagggatcaaa

SEQ ID NO: 48320 - DNA, 1185 bp, Bovine  19866880463045
gtttgtggtaagtttttaaacgtgaggatcaagctggaatgtacctcctaatcttgtgtttatatctgtcttggcattctgtgaagctctgacactttttatccctggaatatagatagtcttcaggtttttagcttcacagaaaatgcttcctaagcaatgggtttaaccttgggtcaggctagctagtttgagagaggcacagttcaaagttactgatgtaggcaaatttagcgattagttaaataacaaatcaaagtgacatagagggatcatctctactatagcacaattcttcacatttcttcactactttcttagtattttatctgagctgcttttcctgttggtaggtagaaccattcatttgatgtaaggtgaaagctgcagagtagaagcataatccaaccagagtgttccccattttttaaatgccaggatggccccaaccttggggatatgtttgatacagaaaaggagaattttagctagaggagaacaagctaaagagagtcaagggctataaggatgtgggagtttacatgggtacttctcttttggtgttgtggacatttgagaatttgtagagctaagttaatggagaaggaaatggcaacccactccagtattcttgcctggagaatcccagggacggcggagcctggtgggctgccgtctatggggtcgcacagagtcggacgcgactaaagcgtcttagcagcagcagcagcagtgtgtatacgcccttccccaggtccctaaactatctcttccccctggcagccataagtttgttttctgtgtctctttctgttttgtatataagttcatttgtatcatttcttttcagattccacatatgaaggacgtcatacgctatttctccttctctgtctgattacttcactcactatgacactctctaggtccgtccatgttgctgcaaatggggactgtttcatttttttaatggctgagtattattccattgtagatatataccacatcttctttatccattcctctatgtttgaattgttaatgtgttgtgcatgctaagtcacttcactcatgtgaccccatagactgtagcccgccaggctcctctgtccatgggattctctgggcaagaatactggagtgggttgccatggcctcctctggggaatcttctcaacccaggaa

SEQ ID NO: 48321 - DNA, 2427 bp, Bovine  19866880484550
atgtagatgatcccacccttatggcagaaagtgaagaggagctaaagagcctcttgatgaaagtgaaagaagagagtgaaaaagttggcttaaagctcaacattcagaaaactaagatcatggcatctggtcccatcacttcatggcagatagatggggaaacagtggaaacagtggctgactttatttttctgggctccaaaatcactgcggatggtgattgcagccatgaaattaaaagatgcttgctccttagaaggaaagttatgaccaaactagacagcatattaaaaagcagagacattactttgccaacaaaggtctgtctagtcaaggctatggtttttcagtagtcatgtatggatgtaagagttggactataaagaaagctgagcacagaagaattgatgcttttgaactgtggtgttggagaagactcttgagagtccctcagactgcaaggagatccaacctgtccatcctaagggagatcagtccttgggtgttcattggagggactgatgttgaagctgagactccaatactttggccacttgatgggaaaatctgactcatttgaaaagaccctgatgctggggaagattgagggcaggagaagattgaggaggatgagatggttggatggcatcactgactcgatggacatgggtttgagtgaactccgggaattggtgatggacagggaggcctggcgttctgcggttcacggggttgcaaagagtctgacacgactaaatgactgaactgaactgaacccacggatttcccactgtggtatctgaatcccacttcagtatcttcgcaggaggagcccgagtctgggggaggctgaaccatgtgtttctctctacatgaactttggcctgctctgacagctaaggagatttgactttctgcctggcctaccagaagctcaagaaatgaacttcctagtattgactgtgtcattttctaaattcacaggtttcagacagaatatgatataatatatacattctgggagaaggcaatggctccccacctccagtactcttgcctggaaaacccccatggacagaggagcctggtaggctgcagtccatggggtagctagcagttggacacgactgagagacttcactttcacttttcactttcacttttcactttcctgcattggagaaggaaatggcaacccactccagtgttcttgcctggagaatcccaggaacaggggagcctggtgggctgccgtctcgggggtcgcacagagtcggacacgactgacgcgacttagtatatacattcttggtggggaaaaattgtgctgtggcctaaaagacaaaaaaaagcatattccctcattcttggtagatgcacaacaacaaaccacattgggtgattaacaaggggggaaaaaacacagttatgcacctagtttcataccaaaaatatactgggttggccaaaaagttcactcaggtttttccataccaaggaagtttttggccaacttgttataactttgttgaccttattattgcctttacaatgccaaggtcagacctgttttgtaaatgccagctttgagtaattcaaaatgtatgtaaaatcactaccatgaaagctacagttcatggaaaacagaggaaaggttgtccattttttgggaggcctacgattttatcatttcatattgatttatacggtagcagatcaaggagggtctttggtagaattcagttcaaactgcctctgctattaatgttcgtgtaaacttggagaagtcagctaacctctctgcactttcatttcctcctgtgtaagacagagaatacaaaacgtagcactgggtcaattatagctcagcaagaaaaacactcatcacagactactgtaacaagatgctatatgtcagaacacccagcgctagtaatcatgcaatgaacactagcttcctttctcattttcatccttctggactcttgaactattataacttatacaataaccgttacttaaattccctaccacctctttcaaatacaaagactatatttgttgatagaggggaaagatacataaagcctaaatccctgtgccataaagtatttttgtagggcagtccaacaaaatgggaccaaggttttcttgccattcatagacagttaatcccagcctgactattgcaaaactcaactattttgactttttacaatgtctggcaatccagaaaatctttagctcagattacatttttttccatgctgtagttgaactattcagtctgagaggcctgtgacaagctagagttaataagttttccatggtgtcaaaagtaataatattaacgtgccattgtgagttaaattaattttggtttgtgcactggcctgcatataaatgtgaatgacatttccaaatatg

SEQ ID NO: 48322 - DNA, 1029 bp, Bovine  19866880512039
tgagttgtttctggagtatctggatttatagccgaggtgctgaattctgtcactcggtccgctctacattcctaactggatgtgtgtggaggagtgaaggcaccgacgatgctgagacatggcgcccctattgtgcacgtttatcaaggtgcctgggagatgcactggtagtgcagtgattaaaacattcaactgtgaatacattttttttcccacaatacatttttctccacgtttttacatctgtgaaatgaggatttattttccttataatcaatggcatctcactatcactgtcagccaggcctgtgcacacccaactgtctttttacttccattgatgttccagtaacaaatcatttaagggccatttgaggaagagatctgaatcctggcggtggtctgaagctttctattgaaagctcatacactcaaactagcagaatgagagtcaaacagttaggaagattttagaagcactaatggaacaatgtttaaagaaatgctttatcaaacactcttgatggcatgaaggaaaatggtgtgtaagaaaaagatgggtatcatcagctctgagctgagaacagatttagaaatctttgtaatttattaaccaatctcttttgcttttattttccttatctgaatacatgaaaatgacacaaaataaaatctgtctaagtcaatgatcattcaaaaagtacaaaataaaaattcaagtcatatgaaaccatttcttgacatagtttgcagtactttttgttattggtctatgaaatattgctgcatcttataattaatggtttcttagagtacatgaaatagacatttcctaaagaataagagaaagcatgagcattgtttacaaataatatattacaaagtaataaactgtataaaattttaagcaaaccgagttattcattcccagaagataaatcacaattatatttaataactatagtcaacacaaatttcagaactagctaaaagaaaaacgaatccctagccaaataaaaccatattcac

SEQ ID NO: 48323 - DNA, 1450 bp, Bovine  19866880539164
cagatgacatgacagtttatatacaaaactcaaagggatctacaggggaaaaaaaggaaagggaaaaatcaccaaactcctagaataagtgagttcagcacagtaggaggatataagatgaacacacaaaaataagtaacatttgaagcagcttttcccttctctagggcaacttagagcctggcaacgcctagagataccaacctgggaaagggaccacaagccaggtcagggcaggagcagaacgtggctccagcacatgagcatgcccctctgctccacaggcgaaaggctttcgaaacacagaggtgcttccctttctcactcactgaccttgttcagtgcattctgacattaaaaatcctagcagtctgtgtaaacttcatcaacatctacaaatgagaatgcccctaattgggctctttatttcacgaagatgattatcctggcatctcaggtaagaaaataaatagatatctcaattccccaaatccattcactatatctaaagtttcattaatactagtctgcaaaggtaactacagcaagaattccattaacagtaacacatttatttcttcaagttttaattaattctatatttttataatgtttaagattaatccttactctgaatatagaggaaaagatgataaccttaatacatttaaactagcccttttaatgacaaacatttgtgtgttctccaaaattgtaactttatgtaagtatacaccttccatttcctaaaatattcctcaaatcttagagtagtgtcatagttggagaaaggagataatagacattaatttataatcaattttaacaaaaaataaaaataaataaaatcaattttaagtatcaaatggagaagaaaaaaaaggaaggatgggaggaggatcaaagaagactcaatcagaacaattgcaaataatgttttccaataaatatctctgtacgagaggactattttaacatacacataatagagatctttatcccaaaaatactcctagcacattctcgagactgcagtgatttaaaactgcatgtttttaatagttgtatccaataactgcatgtaaaaacaagtaaagtcattttagaagcaattagtaagcagaagaggaacacagattagctatctctgttgcagactctgatccaataaatattttagccaatttcgcttcctgtctatctgacatcctatccaataatcactgtttcccaatggtcagaacccttgacatgtggcgttagatatctgtatcccaaagttccctgagagaaacagctggctaacagaagaacagggttttttacctgtatgctgtgattaactttatagttaacagcttttctatttgtaaacatcaagatgactccacacttggggcaggtacactccagtttttgcaggactcagatctttactctctctcctatc

SEQ ID NO: 48324 - DNA, 4331 bp, Bovine  19866880542001
gacacaaaatacatggcccataggttacttaaaatctttcacaaggaaacacttgaaatttttaaaaatactaaacatatgctacacaattactttcctatatgaaacacttactttttataaactcaattataatctaaaatatgtgtctctgatctcctaaagtttttgtttctatttttcagatccttatgtgaagattcatctgatgcagaatggcaagaggctgaagaagaaaaagacaacaattaaaaagaatacacttaacccctactacaatgagtcattcagctttgaagtaccctttgagcaaatccaggtaatgttaaacatattttgtcttccccttcgatttcgtttcttcagaccgcataaattaaacacacagaccttgtaaactctcagtgcacatgtctctacttgaactgccatccttactccacgcacattagatgctcaagctacatgaagagggaaatgatgaaatacacagcataggatacgctgcttcatcagcaaaagcagcagcattctggtgagcagaaataaagtaggaaaaagaacaccaacagaacaactctgctaattcaaaaagtacatccacaaccgttaaaaggtcaagaaaaaatgagctttaacttttgactctcaagccacagtatttctcattatcacctctttgtagcaaaaaataaaaataaaaagtgagaaaagaaatatcttggttgatgctagatatgcagcataattaatcttttaccagtagaaaaattaggtcaagttgtattttcaattgtttaaattcagattcctgtttctgagttggaatggatggttatttttgtaaagaaggaaccttaatttgctagataatatttattatgattggaagtattctattaaaagaccttgcagttaataggttcaaaataggatctacatgtagccacagagatagcatataatcttactacttagggcttcccttgtggctcagctggtaaagaacctgcctgcaatgaggcagacctgggttcgatccctgggttgggaagatcccctggagaaggcaaaggctacccactccagtatcctggtttagagacttccatggactgcatagtccatggggtcacatagagtcggacacaactgagcaactttcactttcacttattacttagcaattcttaaatatgcttaggttttcttatctcatagtccatagttaggctattggatccaaagttcacatccactaattataggctatttttactaacttttaatgggtggcagagagtcaaattggttaaagcaacactatttttaaactttataaaatatttgatgtgggtctatcttttcagtcctatggaaatttgcttgtgacttgaaggaaagatgaagggtgggcaattaaaaactacagcatggaactttctacaggttcagaatcacaaaagtcagcaaatagtcttcagttgcatatttttacttttaatccattcttaaaatacagtactttaagaatgaatcactcttttattccatgaagaaagttaatataatagccacatttattgtatacttattttgtacataggcccaaggtacatacttatgcactttacctgcataagctcatttaatccttatgctgtgaaagaagcaccattattaccccagttttatatacgtataaggaaactgggggcttgccttggtggtccaagggctaagaatccaactgccaatgcaggggacacagggtcgatccctggtgcaggacgattctacatgccacagggcaactaagcccatgagctgccgctactgaagccgcacgcttggagtccgttccccgggacaagagcagccactgcaatgagacgccctcgcaccacaactagcgagcagcccccgcttgccagaactagggaaagccggcacgcggcagcgaggactcagcacagccaataaagaaatagttaaataagaaaaggaaactgaggctcgtgtgtaaaacaggaataataacagaacccagggcgaagcgagaagcatgtagaagcatctggaacagtgttaagcacatttgaacactcaggatatggttcccaccattattattcacaatactaatattcccttctcttcaaattagcattttattagaaaatggatctaatgctccaacagaactctgtaaggatgggaatatcggtgttgtccagtccggtagccaccagccataggtgggccatgagcaccttagccactactgtaacaggggacttcgattttaatttatttaaatttaatcagctacctgtcggggaggaaacggcaacccttccagtattcttgcctggagaatcccatagacggaggagcctggcaggccatggtccgtagggtcgcagagagtccgaaacgactgaagcgactaagcaagtgcctgtggctagaagctactgtataatataggccagttttttaactgccaataatcccaccatcctcacatcagttcacagttttcacataacctttcttatatatatttccgcatgtcagcagattgtggcaacccactccagtgttcttgcctggagaatcccagggacgggggagccggtgggctgccgtctatggggtcgcacagagtcggacacgactgaagtgacttagcagcagcagcagcagagatgatttaaaaaataaaggaagatgtgcaaggttgggcttcccaggtggctcagtggtagagaatctgcctaccaaggcaagagatgcaggagacctaggttccatccctgtgtcaggaaaatcccttggaggaagaaatggcaacccattgcagtattcttgactgggaaatcccatggatggaggagcctggcaggctacagtttacggggtcgcaaagagttagataggactatatatgcacgtgtagaggttttatgcaaatatacaccatttcacataagggactcgagcatctttggattttggtcccaggggtcctgaaaccactccctcagatacggatggacgactgtactgctaatttgtcaaaccatgactgtgacacaacagaggtggagcagaaagaaactctgtcagtaagaggcacagagaacccacctgtcatacataaagtaagagacttgtctagtcacatttctaatttcccttcaagtattaaaatttcatgaaattaaggtatgaaattcacggaagaaagattgaagttctcggcagagtgtggttaaatgacatggaaaaagtcttcaacactgaaatttgtcaaggtagtacaacagtttgtgcgtataaacttcccaactgttgagcacacaagtagtttccacttattatctaggaattacagcactccttgtggtcagataaaaatgtagaacagtgaaccctctttcccctgaccctacataagggtgcagtcacctacctctaaaatactttcacaaaacacttagatcttaaaaggcgaaaaggtgaagatcttttaagatcttctaattcaaaatgattaaagcacgggggagaaaaagcactcccacctctacacacattaagttgtataaacacactgaaactcataaaggttagggaaaacaagtaaagaacttcatagctgagatgaagcggggggcagcactgtagctgtagtttctaagacttttttattttttagtgacagaagtacctgatatatttttttttcttttctttttttttatatttttcattagttataaaaatgattgtattatttttaataatggactgtgcctagaagcctttttagacatttcagggcagctgctgttgttcagttgctaagttgttctgactctttgtgaccccacggactgcagtatgccaggctcccatgtactccactgtctcccagaatttgctcaaatatatgtccattgagtcggtgatgctatctaaccatctcattctctgccagcccctttaccttttgccttcaatctttcccagcatcagggtcttttccaatgagtggaatctttgtatcagggtggtcacagtattggaatttaggcttcagcaagaatcattccaatgaatactcaggattgacttcctttaggattgactgggtttgatctcctcactgtccatgcatacaaattgcacacaaataaagaaactgaggtatagactgcagagagattaccttgaaagatctgacaattagaggctggagagggagtagataactgctaattccaaatcttttacttcccaattatgtcatagtgcagggattc

SEQ ID NO: 48325 - DNA, 1417 bp, Bovine  19866880722440
agagcccaaagatgccggcaaatgtgttacagcagcttttcccgcagtgggtacttctgtgaggttctcactggggaggagctgtttacaggacactctgagtctccctgtttcacttatcagccacacagagcacagccttctggtcctgcaggggctatagttgttgatgacgccacgctgtagataccatttgaagtggtgcttcagaatggccttgccaaccttcttttgcccacactgactggaactcttcccatgtcaactcagctttccacagcggctgtcatccatccacctttcttttccagacctgctaatgtggctctagcgatgtgatttacctggctgtcttccaggtcctcatcagtagagagtctgttttgctattttgcattctgtagccttcaactctagcaccgatgctgctgatatgaaagctcaggtacttccataagagttcgagtttaatgatctgtctaaaagctgagcaccaagtgattcactagtgcttcaagtactcgaacacagtttcccaaagtcagttctgctgtttttatcctccactggagctcgatgcagctttgcctctctctggacttcctgacttggccgttcattaagtcagggacagtggacctttcatacaggcacccagcgtcatgtaccttccccttactcttctctcttgcttcctgagactttaatcatctttctgagtgttcttattccctctgcctcctttagtcactaacaggtactttcccatgatctgcctttggcattcatctacctctatgatttcttcataattttaggacttccaatactctttatttaaatcacactctaaactcaattccaagtcttaatgtctttactgagctcctgcattttgctaaattcactttactaaggaatggtttatttacaataaggtgcacccattgcaaatgtacattttgacaagtatatgaaatgtaatcacccctccaaacaatgcctctaagtccctttctagcaattcctgccctggttctaggtgataattgatctgctttctgtcaccataaattcatattgactattcaaaaatttcataaaaatggaacaattcaccgtgtagtctcttgcatctggcttctttcactgaatccaatgtttttagtattcatccatgttcttttatatataagtaaaccattcatttttattgctcagcattccattctatggtcgacagtctattgttgattaatgaaaatataggttttttcagtttggaactcttaagaataaagctgctgaaaatattcttgtgtaagtccttgaggtgatacatgtttatgttttgcttatgttttcttttggtggctcagatggtaaagaatctgcctgcagtacaagagacccggat

SEQ ID NO: 48326 - DNA, 1869 bp, Bovine  19866880777662
aagaccactgaagtaaatgccagtgaatgtaagagttttctaattctaattgtgacaatcctccttcctgaggtgtttacaatgtatatatacaaactgcattcacctttatttaaaagaatatttatactttcttattggttttcatagcaagagaaattgggtgatatctgcttctcccttcgctatgtacctactgctggcaagctgactgttgtcattctggaggcaaagaacctgaagaagatggatgtgggtggcttgtctggtaagtctgtgatgtttattgtggggttttttaatgcaatctcatcgtggacaccaaatgcatagcacacatgccacgatgtccccctccttcattggtgactgttctcttttcccttggagcctgaaagcactctcagagttcatgccaacacagaagttgctctcaatttattggaattggcagagaagatgaagcctattttcctgcttcataacccaaatatcaattatcctatagcactgaaagctaaaaatgtttgcttatcttttgaaaggtgacatccatgaccaattataatttcattcactttttttgtttttgatatttggtcaacattcatttatgatgtgaaaaatagttttttttatctgagatgtatcaggtattatttaagtgtttatatttacataagcaaagacaaatattagatacatttatcaaatatagcctaatgtagcttttaataatactattttattaaacattcagtatttcaaatatatgtgaacagtaaaatctgagggtaaactctcatggtaatatatttattctctacagcttatgttggtaatggagagactttgagatttaaaatactgtacaacccaattttagttttcaaagaagtaaactcgtgctcaaaagaaaagtagactcaaggatttatcatttccatagctgaacaccactgattttattttcttctctgtaattaaatcaattatatattttctaataacttaaaatgtggaggaattttcttgatatggcacagggtcatcgaagacaaactatggttgtcactgtttgtggctatggaattagaaccaacattactcgttatccagtgctttctctaataaaactatcgcaaacttcaaaaggtcactctcatggagcatggtgattttatattctaaagcataacagctaaaatatgctaaagtgaaggttccgtgtactgaaccactaatttgtcagccaaatactcctggtgcctaaatttacttctctttataaataagtcacccaggaaatctgcactacttctttcaggtcactgggaccccatttaaaaacttactactttaaattttctttgttcacaccattaggcaatgagcagtttcttttaaaaatgtagagtatttattgtgccaaaggtgcaaaatatatgcagacacatatgtgtgtgtctatacacatccaccttgtcctgggttatgtccagtaaaaaggcctataaacagtagccataggcatccctagaaccagagatggtttgaaatgcaatttctcactagaagaacatggagtttatttgctctgtggtagatcctaggtgtggcacagaaggcattcaagacaagcctagaacatctcatcatacagaaagcaaggaagcctcatgtcaataggcttaggagtcaccttgcagtgacttccactggccaaagatgtgatcatttgagcatcagtaacggaataaatacagtatatctgaacctgaaaacagaagaggatactcttgttttgaatttatgtgcaaactttgaggcacaagaatatttcactcccagagttctacttagtatcct

SEQ ID NO: 48327 - DNA, 1556 bp, Bovine  19866880782236
ctttcgagttttaggctattgacccccctgctgcaggaataatctttctcaagcaccattttcatcatgtcattcctactcaaggaccctcaagggcagagcaccctggtgcctaccatattaaatccaaaactcttgagcctggtaacctcagtggttctctccagctgatctttgcttctgttgcaccagcaaacagacactcttcaatccattcaagtagattggcttgctttcctctgtgtaactttttttgtttttcatgaaactagctttaagtatctgctcctctttctttggcagtcttggatattctccttatttccaaaagtacacactcccacatagacttcttttccatgcctgccaaagtctttgcaattagctttgaaattggtttccctcaggaagtcttccctgagtaaccatagtcctattctgttaattttgattctctgtccctctgctcagttcgtactattttttccatgtatgttattttgttctatggatttcacttctataagcttgatgccccaagctagagtcaaaatataacaatggtagcatgttttatgtttgttttccgaatgacttgatcatcattcattcattttatttactcaataaatatgcattatttaactgctctgttagaaatattgctggagtttaagtccagggaattccctggtgacccagaggttaggactctgagctttcactaccgaggacctgggtttgattcctggttagggagttgagatcctgcaaggagtgataaagggggaaaaaagacattatgtcatcacagaggtaaggaatgaaggaagagtattgtaccttggggcaagagagagtttaatgaagaagaaatgattaatagtcagggaatgttgctgaaaggttgaagataaaaagaaaagatcattgagttggtgattatatgtctaaattttatgacccatgaagggttataacattaatttttgagaccaccaggtcaattctaaataattgaagccatgtggtaaggccaaacaaacaaacaaacaaaatacccagtacttctcattgtcaatattaaaaaataaatatgggtccaaaaatagacaagaaacagttccaggttggaggaataattaaattctatttgattcaagaccaaagtgttctgtgagtgcagaagttcagattaagttttctgaaagaagcagcctcatctttatatatattacattcaagataaatcagggatttctgggaaagaagaaacaagatggagaatctctttaatatgaagtaataaatgtatttgtaaaaatttggaatataaatgtggttcttaaaaacctctatcttagcttcatgttagcacaaacatttttctttcatgggaaggcttgctgaatgtaagtttatttcagaaatttgatttctgtaaataaatgccatgctaggctttgcatattctagaattatttagaattgacccagtggtctcaaaaattaatgttataacccttcataggtcataaaatttagacatataatca

SEQ ID NO: 48328 - DNA, 1621 bp, Bovine  19866880835215
tacttattgaatatctctggaggttcttaatgggaaataattctacagctgcatttttaagctctggagtctttcctctttgggaataatgatttttggttttcagttgagtaactgtttcccttttctcatgatataggaaaccttataaagcagatatctagcttacagagtatctctggatggctagattcagatataaactttctcttaataaatgaaataagatgccaattacattttatgtctaaagaattacttattctcattgatacgtgctctcttttcatgttactgttcattatttagagaaaagtaaagtaggatgaataaatgaaagtcttagattaactttagttctcatgatttcaaacaaatttttttgcattttatatgagcaattttgtttaagattttttgttttgctttcctctaaagtattaaatcttattttttaatatcataatgagtgaaagacaccaaagagagacagaaaaaggaattcaagaaacagatttggaatctattgaatagaaactgaactgctgttcataatagtctgttcaaggagagacttggatttaaatgggttaattataacccagtagaatctagccccgagatagaaggggataggcttttgttgttgaaagtaaaagtcataagatgatgaagcaattatgtaaattaaagaattacgtgttcattatgtaagtgaaaaaattaatgtgttattttagtaagcaattaaatgtgtaagcaatttggaggaaaaaaatggaaaggagccttatctgaaagttactaagcacatgtttgaagcacaggggctgttgcaaaggtgaattgtgccagaagagcctcaacgtgcacacaactcccattgttaagattctagctcctggagaaaacctctctgctaaagtttccattccgacttgattaacgtttctctaattaacatgatccaagtccccttattagtaggttaggctcacttgccttttttttttttttagactgatcacccactctcccacctcccacagataaaaagggaatctgaccttgcaagacagttagcctttctcttctttttgtctctttaaaacagaaatcctttgagtttcaagagacacttacacataaaaccattgtcttaattttcccccttctcaagttaaggcctcaaaaatcatcctttataatcagtatatacagttcttccatttgcaaaaggtttctaacatgtatagcctctgactgcctgatgaatttgaaatttttttcattctaatcattcaagaaatatttatttatgccacccacaagtcaaacctgaagccaaccttataacatttggaaaaacccattcatttagcattttcacttaattacttcaaatgttatgatcaatagcttatgattccattttctttttttaataaattttattcatgattattgtaaaaactgtatcagtcctgtaccccagcatcagggacatcttcaaggcatttagactccttattttagcatgtactcctagttttttatccatatgcctttcactgcatgtgtgcatgctgagtcgctgcagtcatatctgactctttgggac

SEQ ID NO: 48329 - DNA, 1229 bp, Bovine  19866880848234
tgcacacaggtttctcaagagacaggtaagatggtctgataatcccatctctttaacagctttctacagtttgtcatgatccacacagtcaaaggctttggcatagtcgatgaaacagaggtagatatttttctggaattcccttactttccctacgatccaatgaatgttggtatttgatctctggttcctctgacttttctaaacccatcttggacatctggaagttcttggttcatataatgcttaagcctagtatgcaagattttaagcatgaccttaccagcacccttatttaaaatatgctcatgaaatgtttcttgaggcacatagaattcatacattcaggagctaaagcccatatgtaaatatactaattgaataactgtttatgaataccatgtgtgaagtgttttctttccaaagttctatgtgtggctttaccatttaggcacctcttatttgtctcaaagtgttttgacatgatacacatactaaacactcgagcctgaattcagagtaattttcccttgaaattacttagaggcaaaaaaaaaatctgagacatcattactcttacttcaatgtgaatcacgagcctcatcagcatgattccatttcctctaagttgactcccaaaactcttcaactcaaagcaaaaatgtaatgatatttgcttgttaagctttatagaagcattggcaagcctggaaatgaggcttaaatcatattgaaccttcgattttctaatggttgtttttaaaatcattagaaactatataggtttaatggcttggcttggaaaagtcattctagactcaaatctagagaaaaatctgaagtgtatttcacatattattttacattataaaataaatgtaatttgatttcttgatcatatgatacatatacacttagatatagacatgcatatacacatacaacatgtatatcatatgtgtatatctgtgcatctgtgtttttatgcatacataaatatacatgtatatacaagcttttttattctgccatgaatgcaatgtatacacatatatatgcttatatatatttggggggggggaagagctatgaagtagtagaaagtgataaagattgtctgactctagctctttttctttcttattttaaatgccaaactttgtacctgtgtaagtgacctttcaagaaggttggtaatattgatgcatatatacattattggaaaatgt

SEQ ID NO: 48330 - DNA, 1027 bp, Bovine  19866880868701
atttcttttatattgcacattactgataagctattttccaaagcttctaatgataacattataataatgacaattattattgaagatgaccagtgtattttggccatgtaattttcatttttaacatgttatctaacatgtggtttttcttaactaattcttcttagccaataatttgtttctgttagaagaaaaaaatttgttcaatgaggttattacatgtaaatggtaagtctcttctatttattaaaaaaaaaaagtttcttgtgtttttcattaattataatggcactgatcaattttaaatatgggttctctcacatattaaaattgatttttctctccacttttattagtgcagatattattcatctggaaacaagaaaacttatcaattattttcattattccatatatgaaatgtatggttagtcatttctgtagatcatatcaaatatttgttccaaagtattattactttgcatccaaagacatcaatgacaagttagatctctcatttattaaatgactggtatgtttcaggtactacacttagaactttttttgtacttggtactttatatccactgtatcattaatatccatgactatcccacaaagtagctatcatttcccacaattaaacaagagcagcgtgattcagagatgttaagtaactctgctaagtcataaattagatgtgacaaaagcttttcccaaaaccaagactatctccaccctgacggtaaacttttaccttgtcactgtgcttctaccgagatacctttgaaaatattgaaaattagattatcagtgtagaaataagatcttgagcatgtttaatttttggttttccatggggtggcagaatcagacacaactgagtaactatgcatatatgcacttcataaacattttaagacatattctttaatcttagatgaataaggattaaatgtagttgtaactctatagtttatttgtttatacattcaatatcacatcaaccctttgttagcatggctga

SEQ ID NO: 48331 - DNA, 2094 bp, Bovine  19866880902032
tatcctttcagaagattcttaacaataggaacccttccaaaaatttaatgccagttactttgcctgatacaaaagaaaactgctattcattaattgatgtttcttacttatcatacatttgaattttatctctgggaggcaacattagaaaacttaaattttaggatactgtactctttccctgtatatatccgtgattcacctttaaattaactttgggaaatctcaggtctaagcgtgctagtataactttagtactctttccaccagaaaccactttactaacgaaaatagcttccagcaacttgttagaagagcctctgtgtggccatagccaagataaatgaccttgaagccaaaataaatgactttgaagccaagataaatgaccttgttgaattttaccttatcaggtatttcatagcttgaatcaaaattcaattttatctgaaacagaagaaaatttattaaaggttagaataagacaataactcacttttaaccttgtagacaaaggtatattaattgacatgtggaaaaacagtcaacttctatccttctaaaactgccaatcagcatgtgtgatagctgggcacttgactttgatgattagcagtcatgcataagggttaaagtgcatattagtttcatggctagtactaactaaatctaccatcctgccaatggttattgcaacgaatcacacttttggtgcagaacaaacagaaaacaggaatctgttctcatcccactggaacattactgctaaatgaaccaagaaagaaagaaaagcatctcactattaacctccagtacttttggaaatggatgttcgtatccacatcctctctgatagcctgggttatggccttggaatgaaaatcccttgttttatacacagtgggtcaaaagagtaggaagaaaactaactcgaatgttcacaatgacatgtgaatttcctctgatgtttagcattttatttccctaagagggagactactaaaaggaaaaaaggatcaattctcaagaggaagcaaattaaacagttaatagaaaaagagattatcttattttgctatgaaaataaacaagacatctctttcccagaagataaccagcttaaagtacacacatttcatatacctacaaattggcatgtttaagaacaccacagaataatgattctgatttattttggattttgttaaggccatgttttaaggccaaaaaagatgtccttttcattataggggactggaatgcaaaagtaggaagtcaagaaacacctgggagtaacaggccttggagtacagaatgaagcagggcaaaggctaacagagtttgccaagagaacacactggtcatagcaaataccctctttcaacaacacaagagaagactctacacatggacatcaccagatggtcaacaccaaaaatcagactgattatattctttgcagccaaagatggagaagctctatacagtcaggaaaaacaagactgggagctgactgtggctcagatcatgaactccttatggaaaaattcagacttaaattgaagaaagtagggaaaactactagaccatccaggtatgacctaaatcaaatcccttatgattatacagtggaagtgagaaatagatttaagggactagatctgatagacagagtgcctgatgaactatggacggaggtttgtgacattgtacaggagacagggatcaaaaccatccccaagaaaaagaaatgtaaaaaggaaaaatggctgtctgaggaggccttacaaatagctgtgaaaagaagagaagcgaaaagcaaagaagaaaaggaaagatatacccatttgaatgtaaagttccaaagaataccaaggagagataagaaagccttcctcagagatcagtgcaaacaaatagaggaaaacaataaaatgggaaagactagagatcttttcaagaagatcagagataccaagggaacatttcatgcaaagatgggcacaataaaggacagaaatggtagggccctaacagaagcagaagatattaagaagaggggcaagaatacacagaagaactatacaaaaaaga

SEQ ID NO: 48332 - DNA, 1529 bp, Bovine  19866881012581
ctgagctgctggatgaataatgaattatttagaaaggagttatggcctgaaaaaacaagtcctgcatttcaaatttgtttaacctacttaccattaaaataactttaagtacttggatggtctgtctcaaagttagttgacctaccgaggagaccaaaattacataatgaggtcatttcaggtaatgtgaatgccaaaacacatttgttggaaatggctagtaaattgggaccaaaatggggttattgccagagtttaaatcccagtctcccactgttagcaatttgacattggacaagttctttagcttcctaagcctcagttgcattatctgtaaagttggaatactaagagaatcttgtttatcaggttattctgagaaataaatgaaagcacaataaagtgctcactaaatattactgtaattgtttctattaagaatgttataaaatcttgggctaaatatgcaaaatgtgaaagcaaccagtggacagttagatcaatggcttgattcataggagaaaaaatgtttgatgggataattacattttatgaatacatcaacagaaaattggattatatatttactgagcatggccccacccatcagaaaaagacccattttccccctcattcagtctctcccatcaggaagcgttccttaatcctcttatccttctccatcagagggcagacagactgaaaaccacagtcacagaaaactaaccaatcggatcacatggaccacagctttgtctaactcagtgaaactatgggcattgccatgtagggccacccaagacagacgggtcatggtggagaattatgaaaaaacctggtccactgaagaagggaatggcaaaccactttagtattcttgccttgagaaccccatgaacagtatgaaaagacaaaaagataggacactgaaagatgaatgccccaggtcggcagatgcccaatatgctactatggagaacagtggagaaataactccagaaagagtgaagagacaaagacaaagcaaaaacaacactgagttgtggatgtgactagtaatggtagtaaagtccaatgctgtaaacattgcatagcaacatgaaatgttaggtccatgaatcaaggcaaattggaagtggtcaaacaggagatggcaagagtaagcgtcgacattttaggaatcagtgaactaaaatggaatggaatgggtgaatttaactcagatgaccattatatctacttctgtgggcaagaatcccttagaagaaatggagtagccattatagtcaacagaagagtccgaaatgcagtacttggatgcaatctcaaaaacaacagaatgatctctgttcatttccaaggcaaaccattcatagcatagtaatccaagtctatgccccgaacagtaatgctgaagaagctgaagttgaagggttctatgaagacctacaagatcttctagaactaacacccaaagaagatgtccttttcattataggggactggaatgcaaaagtaggaagtcaaga

SEQ ID NO: 48333 - DNA, 672 bp, Bovine  19866881034006
tttttctccttacacagtcattaattttccaagtatgaatttaaaccatctcaaaattattttcttatggtgtgttacacatcccatcagcaggactgcctaattcaatgatggtggtagaaaaaagctgaattagttttggataatacagtaacaaaacatttaaattaaagaggaataaacaaacctcaaatatctatagggagaatgaaaaaatataaaatatatactatatttataaaatataatatgtatataatatatacattttctccaatatttgcacttagtttctaacagtctgccctgctattagattataagcattttgggagcaaagacagtaaaaataaaataggcaaagtcagtcttatgtgataatgtattgttgctatttttcagtcactcagtcatgtccaactctttgcaaccccatggactacagcatgccagccttccttgtccttcactatctcctggaattttctcaaactcatgcccattagtcagtatgagatccaaccatctcatcctctgtcatcccctcctcctcctgccctcaacttttcccagcatcagatcttttccaatgaactggctcttctcaacaggtgtccaaagtattggagcgtcaacttcagcagcagtccttccaatgaatattcaggggtg

SEQ ID NO: 48334 - DNA, 1350 bp, Bovine  19866881042751
tctcatggccaaacatcaaaacataaaatagaagcaatactgtaacaaattcaataaagactttaaattggcccacattatttaaaaaaaaaaaaagatgtatagaaaatatgacaacaggtattagctgtgggtagtagatacacagatgctaactactgtatcctttttactttccagaatgcaaaattttttcaaaatcaaaataattttttaaaaaaaattagccaacacaaggcaattgagaattgaagacagttaaaacctgattcttaatcatggggtgaaagggtgatcacagggatgaggttggtcaaagtggcaaaaactgccaacatcacaatgctgtgctctgctcagtcatgtccgactctttgtgaccccctggactgtagcccaccaggctcctctgtccatggaattttccaggcaagaatactggagtgggtggccagtcccttctccaggggatctttctgagccagagatcagacacggttctcctgcactgcaagtgttttttttttttttttaaaaccatctgagcccccagagaatagaagtatcaaaatagtaaaactcagaaagatctgtccaaatatagctcgaccattagttagtgttgaactgtggctcccagattaattaaaatataaaataaattgctagcttcatgtacttgtggaaaaggagacaaacagaatagcagagtccttttctgtccatttgtgcttctgtgtattatttgaagcttggtctcctgttaattataaagatatgctcacttctacctgactcttcccaagcaacatgacacagccaattgtaaatttcagatgtccaacatgaccactgagatcaaacataaaagcttattaaattcatgaagggagaacttctttaatttatatgcaaatttatatatcagcatgcagattttatggtctctagctactctgacaatatctgtagccttattgtgtattgaccactgttgctgtggggtttcactgaaaagatctcgacaataaaatctgtagccaacatgctggctgcctgtctgaagtaatactgggatatctagccatttagtgactggtttctgaagttagatctgtccccatgatgcataagaagaattaattaaattattttaaggggtgtgttttggtgaaagataatttggcaaattatgtatttttttaatttctaagaaaggaaaaatatttgaaagagctcagctgtacagagaaagacatagctgcaatttagaaaaactgaaaacaaacgagcaaaaagtcagtagagacatgcgttgttcttaaaatccaatttggcagatatttttaa

SEQ ID NO: 48335 - DNA, 1054 bp, Bovine  19866881093931
atagtactcaggataccatgcctaaaattaggatttaaattcatgattacattgcaataaaagattagataaatataacgcagggccatactgcattcatttaagtgcattttagcaaataggtttttaacattaagcattcattattatacacatagagatgggttgtatattttattttccctcacttgctaatattttataaaatcccaaatgaaaaaaatacatatctaaagttatttataataacaaacatgccattactgaaaaaatgctctagggtaattattgtatacatatcaaactgactgaattcaatattaagaagatatttacatatattctctctctctttttttttcttttttttctctctctcttttaaagcatcttttccatgtctatacttaccataacaaaagatgaagagaatacatgtgagattattttaatcattatctactagtcattttgataatatttagttatcctcaaatataaaactaatgttaataaataagcaaaataaaaaattcatttatcaaatgcatgttcattcaacttgcattgcacaaataatctaagttactgttagatttaattctgaagccgtgatttgcaggagtcttgttttcatggtcaaggtgacttctggatacactgagcgaatccttacacagaactgcaccaaagagaaaacaacatgtgtcaaccctgtgggtggaggtgacacacaatttaaaatgtctaattacacgtttcaccttagctaaacaccctgaaagatgacatgatctaattgcagattaatgcattatttctctaaggctacaaatgaagcagctagaggaaatctcacactgattccctaagtagtccaagacttatattaaatgtctttgcttgccatataaatatgaataatcctcctgccatagcactgactccaaataaaactaaaatattaactgggcattgaaatatcactaaggcattgtttttgaaaattgaataggtaaaaataatcccaggctaggtacccaaagcaaaccag

SEQ ID NO: 48336 - DNA, 960 bp, Bovine  19866881100965
acacacacacacacacaccaggcgctgtggatacatcagcaaacaaaacaaacaaagaaacccaaccacagaagagcttaacttctagttgagggaaatagatcacagacaataaatacatcaaatgtaaataacatagtatattcaagatgatcagtgcagtggaaaaaataaagcaaggtgagagctgaagtgaaggaagggatgataattttaaaagaagtgaacaacaacgtaggactcattaagaaggaaacatttaattatctgaggggtttatatcccagacaagaatgattcaggcagagggaacagtgagcacaatagccctgaggttgaaatgtgcgctgtatgtttgaaaaatatcaaagtggggagaggtatgcgtacacagacggagggtaaaagtagtaggcagtgcacaaattcagagaggatggagcagatcatgtaagggtttagcaaaataatctgaaaaatattaggacgcattgacagattttaagtagagtcatacttgtgatggaactgtagaacatattaggttgctatggcatgagtgttttataagctgaaatttactctcatacatgaagcatgatttgtctcatgagatggggcactagaagatattacagttcaaactcctttttcaaacacaggagaactgactagttccaggtttgctgtgtaatgagtgagtcatttaatttctctatgcctccaagtgattgtaaagaataatgctacctgccttgtaccgctctcaagaatggtttgcgaaactggggagataatggaagaaaggaaaagtgtcagattgacatggagtgtcttatagctaaagagttgatgatgatcttgtgtgccttctggttgtcacaaaaattacagtcttttctatcaggaaccagagtgtctacgcagaggcggaaagtcaaattttcacatcgttatagt

SEQ ID NO: 48337 - DNA, 996 bp, Bovine  19866881126899
tgctgatgactttgagtgtcatttctttaagataaaacctaagattcttaaatgtggaacaagaggtttcaggggatcaaatgactctttgctgtgccagtctcatttcagccttagagtccttggtcataatgttccttcaggttgaaaaattcttctaccttccctgaaaattccttctcatcttttagtcctctctcagagcctcttctgttaaccctgtaactagttaattcctagttcaaagtattcattgccaaaatgatatgtcattgatcacgcagctcaccatgatgaccaacacaaataagatgtaagtatatcgtgtttttgttaaatcagttttttcctcaatattcagtatagctctatgctttaataaaaaggtctaatattctgaagattccttacagatttatgcagatagtattttgtttctctcttccttctcattaggttgtaacagttaagaccctgaggtttgttgctttgttcttgtctccttctatcaattaaatccttcaacaaggttatcaaggtatttgaaagggaaaatgttgtttagctctctgcagttgagagtgcccaagtttaatgcttgcatcaataaataatcactgcaaggtcatattattcacctggacaaattgtataaactggatactcgttttaattaagctccagagctcttccagttaagacagctgtggaaagatgtgagaggagagaaaaatggaagtagggcatttgagcgtctgagcaagaaaaaaaaaaaaaaactaatgtgggaactgaacaatcaattctatattatattacaaagtcattttgagatgtcggattgcaggaactggttttctcgattttctatatggcatctagcacagtctatactttaatgatctgagtcttcttgtgcccagaaacctagataggaaggaataagagctgcttggtaagcttgctgtgcagatacatgaaaatgttagggataga

SEQ ID NO: 48338 - DNA, 1303 bp, Bovine  19866881146910
ctggaaggggaaggggaatagtgaaaattctgtgaacaatcgacaggagttacttgggttgaccatatgctcattccactcttaggagggtctactgcctcccgaggagaaagaacgggaacaccaaggctgagccatggtctagaagtttcatccactgctggcagaagcataccagattcatgagagtcttctacccttagatgaaagatggaggaatagagagtctgggcatataatgccactcatctctcatccaataaaaaacaactttttaacagtttctgataatgatagcacaggatgttagtggctaacattagaatcaacttggactatatcagagttaggctacagatgatattctacagcattttcctctgcccccctatttctgactaccatttatgttcctttacctctgctatggcactgtcctccactccattctttgactttaaaaaacaactgcagccataaaataaaaatcaaaggcaaacattaaaacaatgaaaggatatttactaaggtgtctatagaactgtataagtctggaggagatgactaaggtttttacatcagaaggacaaaaacatctttaaatttattattattgcttgtccttgggtcactatgagatttagtgattccatgtaacccattccttttatctctttcaggacaagagcaaaaacatacagtcaaaaacccataaataatgacactaagttctatttcctaatgcacagcaattgagctctccattgcccctgctgtcaatgcaggtcagggcttccctttacatgtccaaaaattcagcagaggctttgaaatgacttctctgaagaggctggttaccttcttaagccttacaaaatggttcatctttttttatctctaagcatctgaaataatgggtgattgaagccaaagaagagattttactttgtactttgtactgacactgtaaatatattaactagtttaatcccacaattctgtaagattagcattagcattatctcctttctgcagacaaggatactgaaatatataaaaataaaaggactttcccattgttacctggcaagagagaggcagaattgtgaagatggcatttttttttttaagtctggataggctagattttgttacagtaaattaatcaatcaataaatcaattctgaatttcagtaacttgattcaatagttcttggcaccaacttatcctctatgcatagatattaaattgaaataatttggaaagagcaaatcatattgaaatgtaagtctgtgtgactga

SEQ ID NO: 48339 - DNA, 1677 bp, Bovine  19866881297701
ttagtaattagtgaagttcaagtaccaatcatctcaagtgtggccaacaagaacagacatcaatggtaatatctgctctccgtccccctacagtgttgatatggtgattaaatgatttgctgtgaaagctaaaacagcacaatagcatcaggaactccacatgcgtatcttgttcttttgcttcttcctattctttgcccttcattcatggcacaagactgactccaagcatattctcttgttctcaatggcaccatttccagaaagtcctacatttggatgaaggcctaaaaggtgtctacccaactctagggactaccgagatatcctctgttgcctataagaaaacatagcttagtttaaaagactgtcattcacttttataacttgtctgttctcattttttttttaatttccatgaattactgcctaagtactgacaatccccaaatctatgtctccaacccaaatctctccaactctatctttaacagttccattatgccattcattcatccactggacaaatatttatgtagcaactgctaagcaccaggtctctgctaagcactggtaattcagtagggaacaaaacaaataccccaaccagaccgtgtccaaaagaaagcctcatctttcaccagaatccattcattttcctgtctttgcctcattcagtgaatggcatcacctattaaccagctgcccaagtcagagtcttggcctgacatacttaattcctcctcctgactcttcaatgctccacatgaaatccacctcatcagtcattgctaagccctaatgagtatgggttaggatcatagtactcgataagacaagagatatttgtattgctataccctttttaggaatttttgttaaaaagtgtttttgcaactgttagggtatgtggtgctttatatttcacgataaactttcaaaaaaataaaagcacatttatggggcagacagaaagcttttcctctctcacttctttcagagtcctgaacattattgctctggccctctgcaccctccatggtacctttaatgatcattttgatattgattccaccttgaaacatgttccacagcaaatgtgacctctggcttcccgttttctcattgaaatgtgtatgtttcactcctgctaagaagtaacccacatgtcttttgtcatttgaaggtgaagtctcagcctcaagttttctttgctgttttatattttatcagcaagaggcaaggtgaagagaacactgttcttttggtggtagtatattctatccaagtttacacaacatctgaaattgaaggctgaaacactgggtggaatacatcgtagcaactgctgggctttgaaaagccttttttcacttcgctaaaaaaattctgcaaggcccatgctgtcctatcgcagttacattctttctttgaataagttatattcaaacttttgctttatgttatagctctgagaatttcacacatcagaggaggtttaggcaggtcaaaagaagtccccaaatatctaatccctcagattgttattacaaggtaaagaacagtataaaacgcagcatatgccctatgataacagctgtgtttattttaacctgttatatcactacagcttttatacttttcagagttttaaatcagtacataatcctatcaatt

SEQ ID NO: 48340 - DNA, 749 bp, Bovine  19866881300873
attttgagacagtgttggactgccatttgtctgtcacctctaaatagattctcaacctcagagaaaaacctattcagaggatttatcaccaatttaacacatagaaaaatctgaagattaatataaatagaatatgtccttttaaaatgtcacagcattgagccaattcaggtacctttttaaaactcattcaaaagtacaatatttccaacaagcatgtgaacttggcctcatttgcaaaggtcattaaagtgaacacctcttcttacacttaaaatgatggatgctgctataaaagccatcaaataaatattcattttaatcaagctttttatttacccaatggagatgacctctgttctagtatctataatgcttttcaaaaaggaaagatattgatgtagttgtctatattaagtccttaattcatgtctactctattcagtgggtgcttttaaaattatcagaattatcaagctgctcagaacaaaggtgctttctgattgtcagctccatattctaaaagagcaggttaatttctctgaatctcacagttggaactgtctaacactaactggcagttccacctagtgatcaaggcaattgactaaataaattacacacaaagctgagactcctaatagtaataaggtccccttcacgagctaatcacatcagcaaaagcactcatctgttggctgcaactctatgggggtcttgaatctatcgtataaaaactgtactttcag

SEQ ID NO: 48341 - DNA, 628 bp, Bovine  19866881305925
ttatttgctatttaggctctgattcttctggtttaaaccatcagcaaggtagtgcagataaaggcagtaaaaatattaatcaataaaagacactgccagcaagacaatagctggtggcaactgatatgcacaataaaaaagaggaaaagtaaagattactcattgttatttaaaataaagggataatattacaaacattttaaatggagtcaggtatataaagtacaagcttacataagagtaaacctatagctttgaatcttaaattcaatatgaagatttttgaatatgttttcaaacaaatgaaatctttcccccaaatataggcatgatatagaatggttagagggaagaattctaaacactactctaaatggtatcatttagatggtatctaatggtatcattagaattttttgaaaagagttctaatcacatttgcatgtagtttcagctcagttcagttcagtcactcagtcatgtccaactctgcaaccccatagactgcagtacgccaggcttccctgtccatcaccaactcccagagcttactcagactcatgtccatagagtcagtgatgccatccaaccatctcatcctcttgtcatccccttctcctcctgcctt

SEQ ID NO: 48342 - DNA, 1474 bp, Bovine  19866881388109
ctatggtttttccgtggtctgcatggacgtgagagttggactataaagaaagctgagctccgaagaattgatgcttttgaacggtggtgttggagaagactcttgagagtcccttggactgcaaggagatccaaccaatccatcccaaaggagatcagtcctgggtgttcattggaaggactgatgctgaagctgcagctctagtactttggccacttgatgggaagaactgactccttggaaaagaccctgatgatgggaaagattgagggcaggagaagagggggacgacagaggatgagatggttggatgtcatcaccgactcgattgaaatgagtttgaataatctccgggagttggtgatggacagggaggcctggtgtgctgcagtccatggggtcacaaacagttggacacaactgagcaactgaactgaataaatcctcaaaactttcttctaaactcttactatcttctattaactgacacccacgttcctgctgatgtctcctagtctcttatttccctataagggcaggaggaaagagtaagcagagtatgtatgtctcagtactaccagaaaattgactacagcacttccttaagccacttacattttctgtacttatgctagtcatttgttcattattgtcaccaacaacttgtaggatgggtgtccattttcctccactggcttgtactgcattttgccaacattctttgaagcattcttagtgatttcaatatctctgtcatttggccatcaaaattgcttttttttttattttaatgatttttgtaattatagtatgggtttcatctctgggcagcactccactttccatattgtatgttccaaaattcctttcgggatagccttctgtcttctcttcattataaaactgttcattatttttttcttcatttattaccccttctagtgtgtgatatagatgcaatttcattcatccagcaattgagccagagccacacaatatctattgttaatatactaataatatactattgtgaatatactaacaatatactattgttaatatactatttccatagactgtcacacatcttaaatatacactgcatttgctcactaatcttaaacactgcgtgactggctaattttttgcctcctaaatattaataaagcatcaatcattttaagtttattaaaaattcacctcaatgtcaactttgatgggtcctctttgatgcctgaaaattcttctacttatttcttctgggatttactgccaggctcctcattggaagctcagttcattgatcttgcctatctaatttatactcctttttagaacatatctctgatactatctaccactttaaattgctttctgttcctttcaaccatctgagactctttttctttgaagccctatatatgttgtctcctttaggacaagaacacttatttttcacttctcatattcccac

SEQ ID NO: 48343 - DNA, 488 bp, Bovine  19866881407944
aaaagtgagaaagctattcgtaggctcctactaatcttttgtgaagcctcatccgctgtctccattagagactaaaaataacacgggctgatacatgaatatgcaatgaaattttaaagcagttctcccaacttggggggaagattctcactgttacaattgggaaattaccaaaattaatgtgaatttatgaaatcctgcaggaattgaatcccaggtgcttgtcagctcttgagattgagtgatagacaggcatgaaaactaaaggaaaaagtggaggcgcctcaagcgttgctttctggactgtacctgcagcatgatgatgggagaattattccagtgctcctggagcagctgctgctatgacctccttattattcccactgttatgctcaatgacttttaaaaacctattttgggcacagttcctgggctctatccaatatatatttttttattcttcactggtatattgccactcaaatagg

SEQ ID NO: 48344 - DNA, 727 bp, Bovine  19866881409240
tacacatgtgaatcagctatctgtatacatatatcccttcgctcttgatgcccccctcccacccaccagcccacccctataggtaatcagagagcgccaagtaagccacccatgctatacggcagctgctcgctagctctgtgttttacgtatggtagtgtgtatatatatatgtcagtgctactctctccatttgtctcaccctcttcttttccccgtgtccacaaggctctagtgtttttaaatttgaagtcatgttaacgtgatattaaaatgaaaaatcatgtcagtaatagtactctctacatctgcatctctctccctgccctggaaataggaacactctttgacataaatcgcagcaagattctttttgacccaccttcttgaaacatttcttcttctagatttttctttatgtctgcatgatgcatacttcatggttcttagcctggagcacctaatgcaaccgggaattaaggaagctagagctggatgagtataatgaatgggttgcctctgcaaaagtctatatacacagtagcgaaggtgagtacagagttgcaggccagcatttttatgaatgttttaattctttctctcaaggaaaaccaggaaaacgagaactagcaagagcttgacaaacacctgccttcagattggaagaccagtcacctgtcattcctggactctgcactgcagctgtctaaggtacatggaaaaagaa

SEQ ID NO: 48345 - DNA, 1781 bp, Bovine  19866881433536
tgttgctggcataatcgcatggggaccaatcaatgccatacgcatattttaatacacatgcgtttttctctgagttttgagtaaattaaagatagatgaatgggaacaggcaaaaaaaaaactacatctgtgtgtttttcttcaaggagactacagttcaacgtgtcttaaggtgaagtcgcttagtcgtgtcccactctttgtgaccctgtggactgtagcctaccaggcttctccgtccataggattctccaggcaagaatactggagtgggttaccatttccttctccaggggatcttcccgacccggggatctaacctgggtctaccacattggaggcagacactttaacccttgagccaccagggaagcctaatgtgacttggagtgtagtaaattaaatgcaagagacatattgaaatgttgctcttggctcagatatgaggtgaaataaagaagtagcagaatgctaagagttgttgcaggctgtggaagtgagggcttctctttcttttttggagctagtcagatacctggaacattctcagcaacttcaaatactctgaaagcatgagtgttttgaatttataccagaacagacccagggaacttaccatcttagagttcctatatgagtataaaccatttcttttcaatttactcccacaattactgagtacagactacatgtgaggctctgtgttggccagtgataacacaaaggtgaacagggtaccagggaatttataatctagtgggcgagtgaaccacataaacagttaactcaatattatgtgataaatgtgaagacaaccaggagcattaaaattttgtggtagtagtaacagctctgcaaaaagactcaccacttaattcaaaacagagacatactgaagagacctaaagttagacatggcttgagctgtgcactaacacagctgtggaggaaacttcacagacttggttttcagcttttcattcatttctgactattataactctggtttttcatacttcagttcaatctaatcaggctatttcaagcttgtcagaataaaatgtcaaaagaatattacaacggtgattggaaagaacataagattaatttgaagttaaaaactgctgccaatcaactagtaaattgtagcttcaactgttcatcctggcagtctaggcactgatccctcctttccagttttaatcctcattatccttctacttgatgcttctcatttggagcctaagagtctttctcttttatgagtgtgatttttgcccacctctcactttgaatcttcaagccatgacagtatctttcttcatttcatttctagtccctctttcctgagcatgaatgctcagttctgtctgactctttgcaaccctatggactgtagcccgccaggattctcttgtctatggaattctccaggcaagaatactggagtggtttttcctctccaggggatcttcccaatgcagggattgaacccatgtctcctgtgttggcaagcagattccttaccactgagccacctgagaagccccacatccatccaagccccacatcctaacccaggtcaattccttggtcttttataataccatatagtcatcaatatatttaatattaacttgcttgaaaattaaatctttatttttgctgccaattttcttcctcataaatcttcctccatctcaagaaatgccagctttgatctacctccttaggtcaaaattctggaaccttttcttgaacaccacgcatccaatccatca

SEQ ID NO: 48346 - DNA, 1081 bp, Bovine  19866881469893
cgagatagtgtacctggtgaactgatgataaataggagcagagaaacacgtgttgagaatgacactgcccaggaacactgggcaggaacggccgaatgctctctgggcagttttccctctccagccattctgtcgtcatagacgcaggggctggcattcagggcaagcttttgtttagctgcctctgtttccagctggccccaaagtcagtaggccatggactccctaccagggtcaggtaagaaaaagagttgaaaggcagcaacatcaacaggaaataaaacatttttattgaatatctgtgtaatatgttaagtcatttttaacaacagtcagaaaactactgtggaattcactacacgaaatgaaacaaaatttaaaccacctcatcaaaaatgaaggtaaaatacagctaaagtagttggctcgcaggccacgagccatatggcagaagaaaacaccccaacatttctacaagatacagggaaaatccacacagagaagcactcaagcaggcagtaaatatacacgaaggcaactaggctcgttctagagcatcagattctaatacttgacacagctctgtcagaagggtgcatgtggcttactggaggatgaatctcagtcttgcagcaggttcggtcactgacttgtgacagatgtagtaccagctgattctatggtgacagtgtcccatgtctggcagtgttgcaagagaacgcattagtcgtgctttaatgcaagaaatgatgtgtacttggcaactcgaacctgcttgtttcaaaatgtgtgtttcggtgcgaacaacttaaagctgaatacagtgaactcaaatgtcaatttctgatattcaaggaacttaaaaaagtcaactccctcgctttagtaggggcttatcttttaaatcggaaggagtttcatttgaatcttttttttaaagcagatgtttaatctcacatcaggacttgtgcattttctactgtctactttctgaaaaaagtgtggagcatccacagaaggggagaggtcttattctcccttcgtcctttcagggttatcccagtccaggactctgctacaa

SEQ ID NO: 48347 - DNA, 689 bp, Bovine  19866881608380
tttcaattttgtatataaaatatgtgttatcaaaatgtttacacaaaagcttatgtatgagcaattgcaataaacatatgtttaagaggtggttacttaaatctgggtattttcaaagcctggggactttcagttgctgtgttaatagtgttaattcagcattcagcaaaagatacaaacatgatacatatggagagtttgcttcaacttctaaaactcaattccctttatttatgaaaaatcttccgtattaaaatgaccatctctcagcttactctcaatgttaagttttccagaggagggcaaatcctctagttgtatgactatgacacagaattaaatagaattctttaatataattcgattaaattctagtttccatagggaattcccaaataataggtataatccataagaggttatattcttagggatgttgatcataattgaatagtgttctggagaggaattcctcttgttagctcatcaaaataacaaagataaagaaggatttgcatcttttggaaaggcacacatgcttttccatgttgatgaactgagaaatgcaatagtttattttcacgtgtctgagtaatctaaggattcactcctttatcagatagaagatatttgttttgttgcaacaacaaaaagcctaattttaaaattctgatcatttgatggtgtgt

SEQ ID NO: 48348 - DNA, 764 bp, Bovine  19866882190449
acttatttgcctgttttccaggcaaatcggtccagaatttcctattgtgagtatatatatacgtacacatactagtgtctatatgcattatatccatctgcacacacataggtatatactactactggggtaaggaaaaaacctcacatcattacagaaaggaaaagtttcagtttagagaggagaagtttcagtttagagaggaaaattttcagtttagagaggaaaattaaatccttcccaagagtcaatatcaggaattgttttaatgtaataaagattcaagaatttctgatctggtttgacaagttagcaactcacaaatgaacaatatcactgctacacaagtaccattttattataagttctcattagttttggtcttccaaatatttagaatgaaaaccaagaaatagttaaaaataggttgataataggctcgttgctctgttttatgagttctcacagtgtctattttacacgtaactatgaaaacattataatgccagaagctctggcaattggcttacataggaactcagtggaaaagatctgaagtgacagctatattttcaaagctgcatttagagcatctgttcaacggttaagactccaaggtctcctttcattttagtcctgcttgaaactcgactgttttctagcaaaatccattagaaagagcaatggtaaaactgcatttagatttacctgactgcctcttaaaatatgactcgagccacagtcaattttagatagcttgcata

SEQ ID NO: 48349 - DNA, 876 bp, Bovine  19866880547614
cttgttatcctgtcttgtcagtatgtttatttcttatcataacttgtcatttggtatttttgtttgcctgcctctttttctatttaatctatagagtctaaatgggggccaaatctgtttaatttcatcatttccctctcccccatgcatactacagaatcatcaactgtattaacagctcaataaatacttgaagtattgagatattttgagtttttccaattattttaggaacacgtaaccggtgcaggtcctcggcctccgttttacactttcatccttgaggccaaactatggagtgtgcagtttcatagaaaaacaccagtgaatgcttaacctacaaaagctgcttagtagctagcctcagtgatagaatctcatcgagtgggcttctattctgttcaagtggagtaaaaataggcactgcttagcaaccagtgttttgtatcgagctctctccttcaaggaaggcagagcgatgctagggctaaaatactgaggagattcaggaactggtaagtacaagaaatagctaggaagaagtgcttttgagaaaaagcttcagacaattgttcctgaaagagcatgctcttgaacgtgacttgctaatgatgaaaggaccacccctccaccttttttaataggaaaacttcacatctcctaaattagggaatatgctctggtgagattacagaggttcctcacagacaccaacacagacatactgacaaaaaacttccctccctgtcctgtttaactgcattcattgttcttattaccacactcaccagaaataacactaaaaccaaattaaaagctgggttttgttttttagtttgaagctttggtttgggttttgatttttaatttcaagat

SEQ ID NO: 48350 - DNA, 3306 bp, Bovine  19866880572951
ataagcactgcacactaatttgtggtcagaaataagggaaagattatggcccaaaggatattacccaagggatccaggaacaatgaactggaaaggagtatgactcaaagtcgtcagcactcaatgaagttcaaagtcaaggaatccaagtacacatgccaagtcttaaggtcagaaggtaggccacaagatggaaatgaaatcaaaggttaaacgcaggatggaaagtggcatgacaccagctcacaaaaggaataaaggtcctggaatctagtactgaaatagtgtaactttcttttactgctcatggtgtacatggaatgacttgtgtgtaatcagttttatttattttttctgcttttgcatttcattgattccatttcttgtattataagacctgcatcttggtttaaaaagtgttctggcttttaaatcccacttgaactatctatctttaccatctatctttaccttcaccctatcttctccagacattaattcattctgcagatagcctaagtctctccttttttatttattgaaagttaacttttagaaagtgaagtgaaagtcacacagtcgtgtccaacgctttgtgatcccatggactgtagcccaccaggctcttccgtccatagaattctccagacaagagtactggagtgggttcccatttccttctccaggggatcttcctgacccagggatcaaacccgggtctcctgcattgcaggcagattctttaccatctgagctactagggaagccccaacttttagaaagatttacccaaattttatttaaatacctgttaatgaaaaactaatttttttcttcttgtaagatttgaggtgaaggttcgaaaatatacttaggatgcaagaaaacaaacatgttcacatcattttcaagggggtgagaaatgaatttttcttcttataaatgaagaatgtgaaagtttactgataaaagagttttatctagatcatggagcaaaattcttaggactaaaaattcatactatattcaaagaaatatgaactataatagtaagtcacagtttatattccagtaggtttttaaactctaaagaaagtttttgaatatcccaagttggcaaggcagtgggaaaatggacattctttaggattgctaatgagagctaaaattagtcaaaagctcactagtgagcagttggactatgtatgcaaaactttaataaatgtcttgctccatttgtctcagaagatctacttccagacatttagcttctagatggaaagccttatgtctccgtgttctgactgtcccagaaactcatttcacagagaagaagatatagcaatgaatgtacatccctggaatacaaaggcttctaatgttaattctaagtactttcggaacttaggctcttcccttctctcatcaggaagggaattctaaactctaagtctcagtttgtgcaagaactatacatttgatatttctaacgctgtgttcggttcagtttcttgtgtgatgctataaattcatgctcctcttctcttttttcttaattattaagtatgtcttaatttgagatttattttgctttccaaatgagaattttcttttaattttactggtaaggagttatatatgtttaacataaaatttgggtagcttagagcttagaaaatcagtgtgcttcaaattccacaaatacctatatactgttaaaaaattaaaacaaaattaattatttcccattttaaataatgtttttgagttatcttgtctgtgacatatattctatgtattatatttcatataataccttagaattgcaccaaagtcttttaaacttcagtaccatttctttctcataacaaccttatgaataagctctaattttattccatttgacatataatgaaaatgagtctcagagtggtgaagtaacttgtaaaagatttagctggtagttatagctggactcaggctcttcatataacactagatgcctttctggtctcctcaggaagacctctcataactgcaccagaatctttggcaatgtctgcctcctggacaatacattattttccaaaggtcttctcagtgggatcttgtgactgtgtctgagagcagaacattcaatagcacagttgctttctcaagatcatcacctgcgttcacatcagagtcctacgtcacatcagtgcaatttcaccaacaccacgttctcagtcctcgagcctcttgttgctgtgaccatctcacttttccaccccacacatacacaagatacttggctggatagctacatatcagagtctggaaaatcttaggatatttctaaatttagcctaaatttatatttctcttggtgtaccttaaaaatcttactgcatctgttaaacagatttctggagcccaacttcaaatcaggcatgcttggaaactgaagaaatatttaaactgcttctgaattagttgtgaaaacaataacatatattcagttgttatttatagaagctttatggatattaccagatgctatagagttccccagagaatactggctcttgctctggtgtcaacaataaagatcaaaatctacatgggaagaattgcctgttaaatccagtaaactcgtacctctagtgtttaaggcccataaccatattgcttaaatgtattttttcagtctcttcttgaatcaaatctcaaggacccagctaaatatggattgtttgctttcttgaacatgtctttttgttcacacttaatgactttattattctgaccattttcctactgttcatggggttctcaagtcaagaatactgaagtgatttgccattcctttctccagtggaccacgttttgccaacaaaagtctatctagtcaaagctatggattttccagtagtagtatatggatgtaagagttggactataaagaaagctgagcactgaagaattgatgcttttgaactgtggtgttggagaagtctcttgagagtcccttggactcaaatcagtcaatcctaaaggaaatcagttctgaatgttcattggaaagactgatgctgaagctgaaactccaatactttggccacttgatgtgaagaactgactcattggaaaagaccctaatgctgggaaagactgaaagcaagagaaggtgatgacagaagatgagatggttggatggcatcaccaactccatggacatgagtttgagcaatctccaggagttggttgatggacaaggaagcctggagtattgcagttcatggggtcacaaagagtcggacttca

SEQ ID NO: 48351 - DNA, 1388 bp, Bovine  19866880606021
tgtgtcctccactccaaattctatgttgaagttgagtacttcagaatgagactgtatttggagataggtcttgaaattaagtcaaagcaagttgatatgggtggaccctaatccaataaaactgatgctcttacaagaagagaggactgggacacagaagacatgggggtaaaagatgctaagacctgaggataagatgttcctgtacaagccaaacagcgatgaatgaaacaaccatgctggcacgttgatctgggaattctagcttctagaacaataagaaatcatatttccattgtttaagccaccaatctgcagtattttgtaatggaagcctagaaaaacaaatatatttattaaatggtaggacacaatgttttaaaatactcccataacctagatgggagtttaaaaaacaaagtaaagcctgaaagctaaaaggggacctcaaggagtcaaagaactaagccttaaaatggtaagtcttcagaggaacctcagttttttcaagatttttttttcagagcaaaaacaatattaatctgttgtaaaagaaaaattggtatactatgaagtaaaatgctgaatctacatgaaccttcagaagaaaaaaacgtgggtttgtaataaaatttgcagtaatggtagaatgctttggattatattcttagattcccagagatctggtgttcatttgctttatatggaaattttagtgaaaagtttgaaaagcattgttttaagtgcatttgatgcttctcaaatattctttcatctatatggcatgctgaggcttttgctcagttgtgtctgattctttgtgaccccatggactatatagtccatggcattcgtcaggtcagaatactggagtgggtagctgttcccttctctaggggatcttcccaacccagggatcgaacccaggtctccctcattgcaggtggattctttcccagctgagccaccaaagaagcccttattctgttctaggcacttaaaaaactgccaagaataacagacatgaacaggttctactgccagccctgttcacatatgaataaacctccacctctagacaactctgatgtatgtctggtttgaaaaggaaccaccaatggagaatgttctcagaagctcaacctttctctctgtacatctctttcagctaatctcagctaagccaatgaggtgaagagtaactctttctggataaatgcttccttcttctcctccccagcttcacatcatttggataagggttcaggaacagaagcaaaaagggaaagacaccacaagcgtcagcctaccttaacatgcaggtatagtttcccgtgtcattgagaaagcgtgggccggaaccagagcacgtctttctccttactaat

SEQ ID NO: 48352 - DNA, 664 bp, Bovine  19866880612714
cttaagcttttctatacatgcgttattactggacaaatctttctccctttctctaagccattcacccctccctctagctccagttctttatgatgagatgactcattaaacttccttcctagcagggagctgacacccaattaatgagctgacactgttctgtgtccgctctcactagtgcaataaggctttgtttacaaacacaggctgttgtgcctgttagagactgcaggttaaaatctccctgctgggccagtttgttcagaatcataaggcttctttaaacaatgtctttgtgcgttgaacatcagacattctgctttcagcaggatgcaagtcaccctaatggcaacatcctctttggcgggaaagggactaatgggacaaggttttggattgtaaataatataaacggtattattttattataaagttattctcaatctatctacaggtagataattatttatttttaagataaaatttcagatatgccgactttggttcttcaactaaatgcattgttaaatctagacttcatctgagtttttctccttctgtcagaattcaatctgcccttctccattgggaaacgcctttctaaattccagccccataaattaataagatagcatctcttctgtgaaatctttctcaaattttt

SEQ ID NO: 48353 - DNA, 1076 bp, Bovine  19866880645894
tctaataaataacttgatacaacttgctgctaagtggcttcagtcgtgtccgactctgtgcgaccccatagacggctacccaccaggcttccccgttcctgggattctccaggcaagaacactggagtgggttgccatttctttctccaacttatacaacttctccaactgatacaactcaggtcattgcaaagaattggtgaggatatgtacaggcaaggtgatggcagcttggggcttactttaggatttaacttcaagaataatcactaaaaaagtttttaaaaatttaaagctttatatactttttaagtggttaaaaattgtttgaggacatcaaaaaccttgattggggatattagccaaagattaatatctgattacaaaactaaggaaagcagagttggtagatgtgctccttattccttcattctagaaaagtaagtcacatatgatcctaaaatgaactctttcagaacaacacccttcttcatcccaaaaccttagttgagtatctttatccccatcactagtccagaccagtacctgctattagtaacgtggttccagcaacaaagctgatgcggactttgatgtatggctcgtcagggaggaatttcacgcagtcaagtccaaggagcagagtaataaatccaaatccagctagaatatctgcagtaatcatcagcgcccgagttaccaccagcttcactagaagatcagagcatgtggtttcagcataatcagaggaaagagacatgttaatacatagaggtgcaccaaaggaaaaaaggcaactgcatacatcaacacatgcccagtgaatacaatcacactgtaaatgtgcatgaacttgaaaataaatacttttatttaatttttttataaaatccaaagtattataagactactgacattaattgtttaaacaaacattatttgtttaagcactgcttattatgatcctcttagcaaaatgcctggcatatggcagagactaaataactatttctctttttgcctcctgttttggaatgagtcttgttcacaagtattagctgaaagctatgttgaaa

SEQ ID NO: 48354 - DNA, 766 bp, Bovine  19866880808851
ttgggaataaaggtttgtccttgttaaaatgaacaccatctagtgatatcgcctcctccctccccactgtgcttcccccgtctgaacaactactcgatttaagaaggggactcaggatgaggaaggatgtggtttcctcccgcttggcagcacttcgtgtcagaatggaagcttgtgtctgtgcctggcacggatccgtggggccctcttaccagcccggtcgtgtctgtgaccagaacacgtgggaggtacacttccgtatagaaaaatctccccctggctgccagctctggattgttgtttttcaattgctaatgaatgcggtcttgcttagggcagacctcttggaagaactgagacacaccttgaaacaagtctgaatcagatcagacaagcttcccctgcaaaagaatccctctgcagttggcagcatgtgagaaaatgtctttgagagcattttcttcttgccatttcaaaggagagccgcttgcagcccaggatgacaggagtgcaaggctcctgcccccacccccattttcttttatttacatttttttaattggcttactactaatctgaaagttgtgctgttcagaattgataattgatttaataacagaattgggatagtacctctgttcttgaaaaaaggagtgttagaatgatagaaagtgtccaggagttgattaacagattgaatttgaatgaataggaagagacttaccaaaactgccagtgggtcattcagacgggtactgcgtgtaag

SEQ ID NO: 48355 - DNA, 839 bp, Bovine  19866880869607
gaaaataggagtcattatattaaaattttgacacagttattttacagataattttgtttattatttttggttagtataaagcattttagcattaaggcacccaccctgtcaaagtgaaagagaaacctaaaaagtgtgtagagattgggttttcatctgtgacttaatctacattgctgtcacccttgttagttgagcctgaaataatcatctgctgattctaagcatatttttctttgcctagttttcaggcaggcttggaattggggatccaaattagaaattatcctatctgtttattaacttagagatcagtttcattttctagagaaagcaattaagaatatgatgtgccacagtaagagaggctgtctggaatctctttacggtcctcatcacttagaagaatagctacagaataaaatactgtgactataattttcactttaataagctttttcctgttcaataaatgaatgaggagtaatttttaaattaaatttgccccttcatgcagttacttttatttctacctcctcactacatacccatttgttcattagaatttgtgtccagatattacttataactggcatataggtaaaaagctatgacaaaaataatttacttgggatttcaagccataaattttacttcatcctggcaaaaaaagaagtcagaatggaaacagtgacttttaaaatataaaagttataatattttttttgaaatactgatagcatttaaaactggactttgaaattacatcataatagctaacacttttcataaaacattatcaagtcaatttccttggcaaaatcactaagcaataaata

SEQ ID NO: 48356 - DNA, 1612 bp, Bovine  19866881088216
agatttttggtgatgtgtggccacagaggtgacaatgtgtatgaaacttgcatcctcctttaaaatgaccacacattctggatggcttgaacaatactggtctataccttttgtttcagtgtagcactcttataaatgttccatttcaaatgctgttagtaggtcaccctatttattaaatacttctatgatttttagactactgtactactgtgaaacttgtgacataggctaatatttgggataatagacatagtttgtcaggtgtggatataaatctcatctctgcaacctactagaaatatgatctgaacaagttaccaagacctctgtgattacccccatatatctgttatgttcaaaacagagtggaggtccttgatatgtaatttctcaataatattcaggtttcagtacttataaccccacagaggttttatcaggggccagatatgtgtagaatagtggtgaaagaaatagttaacagagttgttatacctctagcccttctgcattaaagatcacacaaccaaataaaaggacattgttcttgctagtgaactgtttcagctggttaccaacagaagggctaaacatcacagaaactagaatccagcttcatcatttgtctcttgagtaggaagagtagagcaggcacagtaagacatgagagttatacatttccctttactataaattcagagtatcatggactgcaaaccaagtctgaatctaggatttctagattttctgttcctcactaagaagaaaaagtgtctagataataaaacatttcctagtggaaataaaccaagacaatatgatgaagagtaagaagaacaaacttatctgccagaaattcaactctgatgaaaaaaaaaactaaaaaaaagtatttttaagtaggcagagttcagtgattaagagaccattctagagccaggctgttgtaatttaatcattatcctgccactttctggggcttcccaggtgccacaagtggtaaagaatctgcctgctaatgcaggagactcaagagacaagtgtttgatccctgggtcttcaggaagattccctggagaagggaatggcaacccactccagtattcttgcctggaaaattccatggacagaggagcctggcggactacagtccatgtggttgcaaagagttggacgtgactgagcatgcacatgctagatgcaccagttactcttttctagccaaaggatcttttatcttatttacacttgtctcagttttcttacctgtaatatggagatataaaaaaagcctatcttcctggttgattctgacaatattaacattgtaaaattgttataattttatgattgtgtcatatttttataaatattaaaagtgtgttattataaatatatttttgtgttaatattgtagaagtcttaaaacagttcctagtcgatagtcagcctacatatgcattagtattgtttaagcacttgagggtaataagtactctccttgcctttgtatttgtattgacaggatgggacttctgtggtgtgtaatgagtctgtacttctatgggatcctgcaaagccatgcctcaggtaagtgaatgtctcttaa

SEQ ID NO: 48357 - DNA, 5178 bp, Bovine  19866881094067
aattgcagtattatgaagaggcttagtagtactcttaggaacttactttgggaaacactattcttacaacatgcagttcagtcttctctttttacactccccttctgaggaccagaagcaatgaactattcagaatcaatccactaagtctccttaagaggcatatatttcaggcttttgctctttacttcctaagttgtaataaaatgctaaagtgaagcctgtttgttttttttttttaatcagttttaaatgaggtttaagtcctattgcaaaatgcaatagttttaaacttaacatttttaatttttttgtgtatatattaaaggctctaactttgacataggtccaaaatgattctgaatgggttgacttcatgtgatgaatcatccttattattatctagatcactgaaaaacattcatgaaaggattcattatctagggttctttgttaggtgagagacccaaagaaaatcttagacacaatatgttttaggagcaacagctcacacaagaaagctttatgatttttatttattgtaggaaaaaattgtaatatcaacatagaaatcatttcacatcaatttaagtaatagttttattcattttcattttagcaattgtggctagtggtatattaaaaacctgcttgagatattggcacagagtgttgaaaattatttttaaattatatttttgagaatattttatatcttactttacttacatgcaattagatgattgctatttataatgtttcattattatagataatgcttctaagaatatcgatagggacataattctctttctgttaagttacttgttcaagaaaaattccaaaagtattaggtcatatggtatgaccagtatttatgacttctgaactctgccatcaatgatttctaaaatggtctttacaattcaccaatgatatgtggttctaccagttttgttatatctctgagaacaggaaatattctttagttttcatttttctttacagatatggcactgtgcctcgttatcataatcatatgaaatttttaagtcacatatgggcattaaatactaaaaccataagacatcatatttttagtatcattatataaatggaaactcgcaagatttttcattcaagtttaattcatcactatgtgtcagaatgtgctaagtgatagagctctcgttgtcaatttctcctttttctttattcactggagggttacatttagacttcacacattcatctgctgagtgcatccattacctttctgtttcacattggctgctctgtcaacctcccctttggcatttctggcatgacagacataattgcgcttgagatcctcagcagtaactttcttgatgctcaaaagctgagttcttgtctcgtcttctgttactttcagaattacactaggagtaggaaaaagaaaatcaaagcattagtgagattcaagggccaaaggctgtatgtaaatcagacaagtagataataacagatctcccaggtgaggacagacagaatgtcaataagctgtgtgctcatgatcctgaagatacaaaaggagactagcctctggattctaatatcattctttaccatctatactacacacaattccaatatctagattcaacacccagcattagcatcatactacaggtcactctgcaaagcgaagggtctcctttcctcaaatatatgaggcaggatgcagcattgattcagtgagaggcttctgaggcctgacccctttgaattttgatcgaggttttgcacttactggttatgtactttgagcatggtaagtaatctttccaagtcttagttcctcctttgaaaaggaggaaactggcaatacctacatagtgcattgcaagtattaacttactcaagaattctgaggattgagtatgttaattcataagtattagaacaatgcatgcctacattctaagtcacttcagtcatgtctgactctttgcaaccctatggattttagcccgccaggctcctctgtctatgggattctccaggcaagaatactggagtgggttgctattcccttctccagggatcttcccgacccagggattgaacccatgtctcttatgactcctgcactggcaggtggattctttaccactagcgccacctgggaatcattagaacaatgcttaataaatattcatataagctattattatcatctcacagtaatagctgatgcatttcagggattcccaaaacttggattttggacacagatcgaacattttagttaaaatgctgaaacctcctagttatatcctaaagaaagaagaaacttctcagagcaagtaaactttgtgaaaataagtatatccaattctctgcaagtcagagatcaagtgctttgggtctaagatcaagactgaagatctctctgaactactgtgctcaaaaggaaaaaaaataaaaattctctctcttacagttgactgacatccaagttcttatgaggtttactgtcagtcatgaaatcttggttaagggctgtgatagagttaacctaagttgaactgcactgctcagctatgaacagtgacttgtgtctcagtaacagcaaggaggaacagtatgactgtcattactattcattcattatttttataagggttggaagcacaatgttcagaattcctgaaatggtcaataactctcctgtgcattcagtcacatctttcatcaattccttcagcaaaaactgctccaatttcaggaaactccttctgtatcattaaatatattctgtttcttgaaactacacctttgtatatgatgtaaaaaaaaatgattttttttctttttaccaggaacatacttttctttctttctccagtttatttctacttatccttcaaatctttatttaagccatgtatcatctgagacgtattacctaactccctaaagctaactggaacttccaactaaatcttcccaaatatccaatacttcccttttactgcatttatcacattgcactgacatctctgttgtatcattgttatacctgtaaaatctatgcagttaggaactaagtatcttgcatattaccctatgatacttcataatttctgtataaagtctgagtttactactagggaataaatatcttttaacttcttgaagttcaagtaacctaagatctatcagcacatagatgataaggtctaagttttcagaactactttgtcatgcagttagctgctcatttttatttattgttgcagtcttccttgccaaatcaagccaattcaaaaaatgtcatgtttatttatgtcgtgacccagcgtgttattttaaaagtgagttatattaccacctcacccacttaaaaaataaaatttaaagaacattaatgtttttagtcgatattaaaaattatcacttataaatgtgatatatgtgctatgaaaattaagaaaggagaggaaggagataggaaatacgtgctcactgggagataaggaactaacacaactatctgaggcacaaaaacataggcccagactccagacttgagaagcagaacagggccatgctggcaggctttcctctgtctacaactctaaatcccgaccttttcattcagataggagattcattccaactgctttcaagcgggtatcataaagataaaatcaccaggtagtatctggggcttggattgcaagtctgagaatcctgttttgggatagagcaactaaagacttgaaaaatgaggctgatttttgttactgacaggcaaaaattagaattttcatcaattagcataaaccagaaggcattaggttgaggaacaagggttagtcacccccttgtcagtgtccgtgatacctttcattaacagatacgtcaatagtggtgtcctctggcttttttccatcaatggtccaccaaatctcattgcgagagtccttcaggtaactaaaatagactttgcagggaatgagtagctcttctcctgaaaaaagcaagttaactcatgagtttgtaactatcacatggttatattggttgtattttgtgaataatcagaagttatgaaagttctatgtgcctgtaagcttacttctgactaattttcaagtggactaccataaggtaatgtaccatacttcaatacttcattgcaaaacaaacaaaccaggaaaaggacagcagctttttatataaaattattagaatgcccatcttttaatagagccgatatatgtcctaaaacgacagtatttgttcacaaaggctctgataacgtttcttttcttagccctaaacctccatggactgctcttgtcctttgttatttccctcaccaacaatgagagatggaggaatggttatccagatatttggtcctttgcccagagaagatgaggtgacgtcattgctgagaggactgaccaggcaggctgtatcttgaaatattcaagttatcacggttcagtcaatgagcttaaagacaacttacaaatagaaaggctatgctatccttctgagatggaacatggtgaagacagggggaatctctaggcaaaacatggtaataataattgtaacaatagcagcagactcactgaggactttgaatgattccctgtgctaaatgttttagctacttataaatagatacatttaattttaacaatacattatgaattattttttaaattaatgttttacagatgcaaaaattgaagcttaaatgctatcccaaggtcaaattgcaaataagtggcagaccaggatttcacccagactgaccttctgtttttgtttgcccagaacagttctgttttatgcttgctttcctagttagttattaatattgactgctttcattctcaaaaggtgtccaggttgagatgataaattatattgtcatcccaatttgaactgaggtttgtctcactgagtggtcatactctagcctctcttccaatgcaaggtttttatgccattctctagacagttgcctataacaatatgtacaaagataaagtgaccacggattcaggcatgcttttgtaaccataatatgacagacagaagaaaggcatttagatgattaatatgggtttaccctgatgccagaaagaatgttcatattaatatataaaacca

SEQ ID NO: 48358 - DNA, 1316 bp, Bovine  19866881127484
tgggaaagatcccctggagaaggaaacggcaatccactccagtattcttgcctggaaaatcccatggacagaggagtctggcaggctacagtcaacaaacgtaaaattacttttaaagactcaacagtattctcatttttttttaatcctctatcaatggatgattatattgctttttgcagcattacctatttgaatagaagtgtgaaaaataaaattgtggatacgtctttatgcatttctctgattatttcctcaggatatatgtgtgcaaagttcattaaaaggtcaaagggaggcacgtttgtgtctttgaaacaaacagtcaaggtgtcttccacagaacctattccaggtacactcctacacacggtaccagaacaccacacctgggcattagatcaccatgtcctgtccagcactagacaggactgttccccttaattcttgctaatctaatgggtggaaagtgacatctcattgttggcttaatttgtatctatcttactcatgaatttgagcttctttttaggatgaacttgtttctatctttttgaactgcctgaacttctggttgaaaatcttttctcatttttcgaagaatatattttatattgaatggatttcttttgtgtgcaagagttccttgtgttgtgatggtgctaaccactcccatatacctatattttcccaagttttcatttgtcctttaatttataatattgtgatgctccaccaatgttgtcaatctttatgtaatcaaacatatcaaattttctttaatggccccatccttgatgattgatatatctagaacggcttttatttcaaccttgtgaaaatatttgcatatattttcttctagtacttttagggcttaatttattttttaacatttaaatatttatttcaactgagatttgtttggaagtaaggaatgaggtaaaaaaattaactttatttttatagaaattatccaaaattcctagcatttaaatacatcttttcactgactctggatgctaccttgggcatccgccagctgcagggctggcttcctttcttttctggatttctgttttcacttcaattttgtccttggagaatttcttaccaactcagcaattcattttaaaagacatttatttttaaatgcagaatttctagctgctttacaggaaaagggttgtttagcggatgtggtccaccatactgagagaaactgaaatcttctccaatctatttctgatgtgctggttagcatgaacattcaataaatagaaaatgtcagggacctgcacaagtccttccaataa

SEQ ID NO: 48359 - DNA, 1100 bp, Bovine  19866881140485
gaggaaatatcagagttggccaaaggtatagagggagtcaagattgtgtaagatagaggtggggaatggcaaccaggggctccaaaagagctaggatgagaaatataggactagatcatggagactttaaatatcagaataaagagtctggataagcctttccctttaggaaatacaaatgattagcagatttgatcagtatctaatctggagatgagactggctggaggaaatgttcagtgaaatatttgcagtcattaacatctgaatccttaaaaatgactacatgtacttcagcatgttattaataagtaagcatgtgtttacttggtttttattcagatattagacactgtaataattaaccacctttctaataggatgatgaaaataattgattgtaaatataccaaagtgtctaaaaaaatatttattttcctatcgcataaatttgtcagaaattctcttaaatgaagaatgtgaaagaaaataaaagattggctactgcttgccctcaggaaaaatttatgctccatggagtctgcattccactgtggctgaggaaaggaacactttgtctttgtaatttagactataatttgtgttctgatagggtgacactaagtggctgaaaaaggaaaggcttagtcaatagaaatcaaaataagaacaaaaaattgcactcatggtgacatttatgactcccaggtgacagcattaggaaattatacatatagtaacttgaaatcattaaaaaaaatcaacagcaagcaatttctctcctttggagtagctcaactctcatccattcttataaatggatgacaaaagacaatgcaaattgaatcatataagaagaattggtaaaaaagattttttccttttaaataaatgatataagtattttgctactgcatttcctatctcaaaggtatatttactaggtagcattttttcatttgtgctgttaattgttgttgtcatgtctgactctttgcagccccatggactgcagcacacaggcttccttagtccgtcaccatctcctgggagtttgctcaaactcatggccattggagttggtaatgccatccaaccat

SEQ ID NO: 48360 - DNA, 949 bp, Bovine  19866881210653
cctcatacttcctctgaatatcaaatcatattgtatatatttgaaagtgcttgataaatggtaaggtgttgcatacacatgaggtaccatgttgacctctaaaataattaattaattcattaattaatgcatttattcttttgttattttaacaaaccttttctgaataccttttcaatgcttccatcacttccctaaatactatgagaatatgaagtgctactttgctatttagatttagagatatatttggcatatatttcttcgttatatcatttgcaagacaatctttccttaacaattacttttataattttctgcagcacagaaggacattagcaattcaagagactgaattttagcccacagaagtcacttagttattgtccttagaagaacctctgcatttcactgttacatttgattgcacctattggaataaaagtagatccctgaatgctggtatgtgctgacctagttaaccatacatataaaggacagctttttcattggaatggattcaagataagcagcaaatatttatgttccactaaagtattgttccaaaactgacagcaatggctcccaaaaaataggaagagtatctgagttcgaggctttgctttattcctcagaactgtaactataactttaccatatagcatattttgaaattttagagtctaatgaaggtctccaagtgaagctacacacctttgtatggagaagaaagctttttcacccaataaaatccaagataaagttaactaacaagcacattgttgataggttggcattttgtaatgatcattactggtcctacatttggactaaactccaaagtgtttcagataattgttacaaattatctgaattagctgtaaatttgaaattataaagcattattttactatcaaacaatttctcagaaaaaatacataatttcaat

SEQ ID NO: 48361 - DNA, 1238 bp, Bovine  19866881329343
aaaaaaagacagttatcaaagcagtaagtgatattaattagggaattttttctctcttattctcaattttccaagatttagaataatatgatacatatcacatgggagtgctatgaaagttagtaaaattagagaaagagtgttccctagccttttaatcagtggttcaatctagattcagatggcttaggtttaaatctaggttgagcaatccttagcaagtcgctaatgtgcttctgcctgtttcctcattaaagaagatttcaatagcatctacataaaatgaggtcatgcatgtacctcagtacatgatagttgttattattgccatagtaacaataatcattacttccctgaactgaaattttaaagacatcatttactcccttcaacttttaaatgactagtacaataatatgaattggaatttctaagtggtaacatgtcatcatagattttaacttaaagacaggttaatccaatcagttttgctttgtatgagaaaataaaaatgtattcaagttttctagggaattaatgtaactggtaaatatttgacaatagtaaagaaaatgatgttgggtgattgtatttttttttaattttattttatttttaaactttacataattgtattagttttgccaaatatgaaaatgaatctgccacaggtatacatgtgttccccatcctgaaccctcctccctcctccctccccataccatccctctgattgtattttcaaatactatttccccagaaattgctgtcatcagatgagttctccaaagcatgtagaaaattcagaaaggggaagaggaaacccaaagagcaaagatattttcctcctgagattccccatcataaaaatgccaagagaagccttgctagtgaatttgctaactgtggacaacatggaccccctgtggatccctgggttcttcagacactggggttaaaagacctcaacaccattgatgacacctcatcagctaactacagtgccctctcgtctcatgccagacagaccactagcacatttccccagtttctggatgaggcaattgattatcccaatgcccctgggggaagatctgccaattgactatggaggtgatagaactacccccttgccaggcactgccaaccacagtgaagattttcacttcctttctcaactttcaaatcctccaggaggactacaaactcttccttactatacttctggatgtgtcacc

SEQ ID NO: 48362 - DNA, 1402 bp, Bovine  19866881331427
aatcccattttcactatttggcaagtccaaaaaaagcaagttatttaggctgcaaaatataggagtctttgggctttcttaaacctttccctatcattccttcttctacagagttccagcccataatgccttgcaactatgagtactgggaaagggcttccgatttaccagcaaagcagaagagcagaacttaccctgtgcctgtggtgcctgttggggctctctgttgtccaggagaccagcagcccagaaagagacccaagtctccgtggaaacgtcaacactagattctgacgttgtagcggaatacggacaattatagctctggcctcctacaaagtactggtcttggcaaggcagaagggtgttctgtaaaattcagtatgtaggttggttgggggtggggaggttgtcccaagagatgcggtggtgggcattcagagggggaaaagagtgggagaaagaagcagaaaatacatgcagtgaataaaaaccagtaacgatgctaagtatagatcccagattaattttgagtgatccaaatataattactagaaaggaatcagcttcgtggttcatccagtccttcccatagatcctctcagcatagaacaggttagtattggatggactaaatttgtaaatatccaggagtattctctgttgctatgcctcagtcatctaacaggcgggtacccaagatctaagcaaaagaaattctacttaacgaatgaatcgtgtaagaactatttgactctttcttgcaaatatcttagttatatttctaataactttaaaaaactttgaatgctagggctggaatggacagaacataccatatactctaacttttaaattttagtttctgaatcataaacttgctccattcctcccttcctctttcctctcttcctctgactttaaatgctattagatcttcttgaaataggttagttaggaaagacagcaagctctatgtaggtctctccatcaccaggtctcaatgcctttccaaagttatcttgcaccactaactgtctggcatgtattctctactgtgttctgagccagtgaacaccctcctgcccctgcctcctcaaacctcaaacacacagtctttccaaatgtccagtcaggagcaggtatgcagcctccctgggttaatttgtacaacagaccattcctaattatttgtcaatgtttaatcaggtaaaagccattcatttcatcagagcctagctttggacaaactctttttgaccacgacaagtcttttgttgacttgtgaactttcttgggcatagcataaacagaaagaaaacaaataagtagaggaaaaaagaaagttaagtcaattaagtcatactttgttaacattcccaataagttaagtttttgaaaa

SEQ ID NO: 48363 - DNA, 1374 bp, Bovine  19866881656621
ctctttgtttcaatgttgtaaattaaataaagtacatttaagaaataaataaataatgtagattaagtaaaatctcccatttttccccacttcaggtactaagtacctacaggaaaataggggaccctaacttgacattctgcatctcaaagactgctagaccttggattctaccatgctaagtataatcatatttttattcattaaacaaatgtgtcgatagccttcaacatagacactccagatgttgtatcatatgctgattccatttatgataccaatgttctgggaaggatttgtagagaaattttgcatattattttatactcaaaactgaatctttacaaaaaaaagggtcttccttaacttactttccagaaccaacttcaagtgacacttggatgttttatggagtcaagagtactttgaaagaatactctcattaaaaatattgcactgactgaagccaaccttccaatgggtcagagacttcccttttgactcatgaataattatttcatgtataataatattagtttttaaaaaatagcatcatcttaatttttgtcatacttgagcattttcaaaatccttctctacacgtaaaatgatagattctgtctcgtcacctggtctggtctcctgggcatttcctattcaaaggttttgggtcatattgcaaagcaagggaaattcaaaatctcactcagctgctaagattacttctggcaaaccagaggcaatatactcgcccatatccagagactgaatactccaaaagcaatccatccctcctcttcttccaaacttcattccatctctcattagaaactttagccaggagataaataattttattaaagtaatatacttaactttctgaaggtattgttgcatgttgagagttaaacttaaccaaaatgagtctcaaatgttgggatatatgaaagagttactgttgaatgtcctattcctctattttttcccccacatcattcctgatatacccacaagaaaacaagactgacttccacactgaacatctgaaagactgccagacctcagattctatcagacaaaattggaaattctctagagatctgcttctgtattatttcacaagagcagaaaagaacagatgaaaacagcagcttatcctcagcatcccattttaatcagcaaaacttacaaccctttccttggaagattatgacataattgttgaaggctttctgaaaagacttagagacattaaaaatcagagagtaaaattttttttcatttattaatttttccacaagtggcattaagtcttaagagggtctctcatctgacattttaagatcaatgaagccaaattatatatttatttat

SEQ ID NO: 48364 - DNA, 890 bp, Bovine  19866881706225
tcctcaaccttgtccctgaaacacaaagataacgttccaagtcttcctgggaacccacgtaagccaaaactagagaacactgaagaaaatcttctcactctgtatctaaagtgttaaagaaaatccccttatgaactaacactgaggaggtctgtgtgagtctgtgtccctgttgagaaaattctatggcttctttcactgatttttggacaccaggatcatcctgacagatggtaatgtgtacccaccagtcccatagtctgggatgtgacctcagtcaaccagatcactctggatggagggaaaaggtgggggagttgtggcaataattctttatatgtgcatttgacatttggtgactttattgcaaatagagtaagaccacgcaatccccctctcatcagaatgagagtaaggtggaattttatagggctattatgcactgatctataaaccactaaagactcaagtgaccctaatttcaacaagtatgccttatcttcactatacagctacttagggaaaaaaaaaaattgttctcacagaaaggtgctcgggcagtacttaatacaagattttaaaaagctttgacaagaaaatagagcagggagccagaacatatactaaaaaaacattgacaaagtacaagaggggcatttcatggctgcactataagccttttaggggtgttttttccaaggcaaagctaataaacagtacctgaatattcactatgtggaccttctgtattaaatgctaaaggatgaaacagattttactaatgatatatctcagacatcatgaaaatcacctagcagtgatctccagcatacactttgctaatttagccttgtagctaaaagcttacacttttagtcaaaagttccaat

SEQ ID NO: 48365 - DNA, 1636 bp, Bovine  19866881790437
attacaagtaggatgtttatgattaacaagtgggaggtttatgattacagcttcaacatcattactcactattagtctgttcagattttctgtttctttatgattcagtctttccaaattctatgtttctgggaattcatctatttcatctaggttatccaaattttgtgggtatacttttcatattagtatgaatctttgaatttcttaagttttaatgtctcctgttttattcacattcttgtttatttgagtctttccactctctctctctctttttttttttttgattaagctagctaaagggttatcaatacacttccccttttcaaaaaactaacacttatatttgctaatattttctattgtttttctagtttctattttatcttgaaatactaaaaattcacttttaaaagttaaaacaatatatgttgaagttgtaggctcaagtcaagcatcaaccaccacaaaagttaaaacctatttgaactccgcagacccagttagatttcacatgggaatgaccctgtttaactttaaaactaatatatatgcaatgatttcaatatcattatcaacacaaggaatctgagcttccatcttgcactcagactaaagtcaccagcagggtaaacccagagtaaacaaaaacagttttctaggcgtgcctcatataatactagacttaagcaaaatgtgtgtgtgtgtgtgtgtgtgtgtatgttcgtgcgctcatgctcagttgtgtctgactctttgcaaccccatggactttagccagccagggtcctgtgtccatagaattttccaagcaagaatactagagtgggaagatgtctgggtattaattccaactcatctttagacaggttatcttccttgtcaaggccacagtttattctgatgtaaaataagtgggttaaaataaaatttgggtactgaaaatatgaccagtaggacaaatatagtttgtctatcccatggtagtgaatcacctgatatttttaggacaccttagaagtcttaatttgctgttagagctcatctaatatgggagtttgaactgattaagcatttaaaccctaaactactgcttctggaaaatgagaaaaaaagagaaagaactgcaaaaactttccccaggaattatcatctctgcaatgagagacatgttttcatctctgcttgccctgcctgatgagacttatcccacaaaaagaggttttaaatgtcacttttgtttcatagtataagcaatatgtcaattttgtactgaagaggcagacaagcagtggtcagattagagaaataaagagccacttatcctaaagttccaatagaatgacattatatattagttaaagcattttaccatttgtaatttggacattaaattatataagtgagtggaaataatttatcagacataataataacacaatctttggcagatttttaaaattaatctccctgtcatatctcataaacttaaaaatatgaaatattttttaaacaattcttaactaaagtgaggagggtgattcattttggacatttactttgcatcttacattttaaggtcttagaacattcaatttcatgggaattactttgtcccttaaaattcaggtat

SEQ ID NO: 48366 - DNA, 1762 bp, Bovine  19866880482762
aaaatacaatgaataccatatcacaaaattgggtataactaactttataaatggaaagacattcttggatatctcatagttgactcaggctatttctagcatttgattcaccaaacaacatatgaatcacatatgttattgaaaataaattcaaatatatcattggaaagatgttttaatattctgacagagtcttcaaccaatgcatggatgttatttaattcattgtgatttttaacaatgaagattattaaataactttgatcttttgtttggacttatttggaggtaaaaatatcatgtcagatactcatttattggagttcatttactatgaattaaaagttaatgatgtagcaatatcaagcaaatattgagaaagttcactcatgcctaaatgttagcttacttatttgtaatattcacaacaataaattgttgagtagaagaaacaaagatatgagatgtcttttttaaagtgaggcataataataactgcacaacttatgtgtgtgtgtgtgtgagctcagtttcatccatctctttgtgaccccatggactatagccctccaggctcctctgacaatggaattttccaggcaagaatactggagtaggttgccatttcctactccaggagatgttcagtacccagggattgaatctgagtcttccgtgtctactgtgtctcctgcattggcaggcagattctttaccactgagccttctgggaaacccatagcttatgttgaagtgcaagtgttaatcactcagtcatgtccaactctttgtgaccccacagactgtaccctggcaggctcctccctccatgagaggattgttctctaggcaacaattgcctagattgttctctaggcaacaatcctggagtaggtagccattcccttctccaggatatcttcctgacacagggatcaaacccaggtctgctccattgcaggcagattcttaaccatctgagccactaggaaagcctgcagcttattttaggactcaagtaagtttacgttcaacaacttagtttcagagtcttgctgctgcccctatattcttttgactgagccataccttttggaattccagctgaagcatgatgcttatattttctccaaagtcaacacaaatgatacagattactgttactttctccttttatattgtgaaataccatcaataactattttggtgtgaaataattttcatttcctaaaggaaagtgatcatttatgtaaacagtagtataaaaatatgtaaacttttttctttagttcagtcgctcagtcatatccgactctttgcaaccccatggactgcagcatgccaggcttccctgtccatcaccaactcctggagcttgctcaaactcatgtacgtcaagtcggtgatgcatataaccatcacatcctctgtcatcccctttttctgctgccttctatctttcccagcatcagggtcttttccagtgagtcagttcttcacatcaggtggccagatattggggcttcagcttcagcatcagtccttccaatgaacacccaggactgatctcctttaggatggactgggtggatctccttgcagtccaagggactctcaagagtcttctccaaaaccacagttcaaaagcatcaattcttcagtgctcagctttctttatggtccaactctcacatccatacgtgactactggtaaaaccgtagctttgactagatggaccctggtcgacaaagtctgcttttt

SEQ ID NO: 48367 - DNA, 1523 bp, Bovine  19866880553415
acacctgttccttacatactgtgtataactgctttcacagtgcaatagcagagttgggtagttgagaccaagactgcatgatccataaaataaaaaaataatttttatctggccctttccagaagaatctcatcaactcctgttctaggtaatggaggtctttctgttcatatgctaaaatccttttcatttattttcatcattagtagaatcctttgtaaaatactttaggtggttctttcatagacaaaagataacagagttatctttttggtttctgcagcattttacaaataaaattaaacaaatgccttattttctttttttctaaggaaaaatatgattgatctgtgctgagatgactccagcattgctgtaaacttaaactatgatacgaggtttgcagtacaggaatgactacaggaaagctctttggtgctcacccatatccggtttgactctcctcctggcacaaggaaggattatgcttgcctgcctccaccatgcatgttgacggggttagacatttagttctactcagtggtagacgtgtgtatgtgtcacttttgggcaaaaacacttaactgcccagagggaggcccacagggataactatgccctaacccagccctcagtgataatgtgttgagagagccaagtgtacaaatatgcagtagcctacgtcagtgagactccatgtagagatcggtagcctaagacagctgcccagatcaggagcagaccgtatgtaaggaatcatctcttgtagtgttaaattcctgagattttggtagtgtttgttactgcagtgtaacttatcctatccagactaacgcaatggcctatggaatgtttgtgagcagaagaatgctttcctccatgttatagcattccagacccacatactttagagcatttcaatatttgaaactttatattttctctcttcaatacaaggctgtcattttaagccattatcagtatgttccacattcacattcacttataatttgttgctcctaatcttctgtaagctaataaaacagatatttataatctctataatcatttctgaagtaaaatgaattgtctctgagggaagtccttgaggaaatttgtgatcaaaatgtttcagtagcacaggcagttcctcagatatccattttgatgattcagaggtctcttttcacttccttcctttttttgagtgatgttctagatcagagaggttatcaaccagtaattttcagataagacatgaatagattaccatatgtttaacaaaacttcatgggattgttctggaaatttccagatttatcttaggtagctctgatatatatatatatatttttttttttttttttaaattatttttctacgtcctcaccttacgtatctggcaggcttctcaaaatacacttatcaccctcccataacacctatttcaataacattttctattggccatgaattcatctatggcaaaactctggtggcttctttgattcttcccttatcat

SEQ ID NO: 48368 - DNA, 1659 bp, Bovine  19866880563731
tttagaattgaaatatcctaatcaaatattatctgtagactgtaccattagaatacaaagatgctcttctgaaatgggaaatactgtttcaagaaacagcaagaataaaaaattctatgcctatgaaaaaatgcattcctgaatacagagagcatatagtagcaaagattttctcacttgattgcacctaggatggacagtcaggctaattcaatgcgagcatagtcttagatggcttcccggggggctcagtggtaaagaatctgcctgcaatgcaggagacacaggttcaatccccgagtcggaaagataccctgcaagaggaaatagccacccactctaggataactgcctggagaatcccatggacagaggagcctagcaggctatagatcatggggtctcaaaagagtcagaaacgacttagcgactaagcatacgcacacacacacagtcttagataggaggtgacagactccaactaacagacctactctattccacagcctgtttttgtaaataaagttttatttatttatagagcacaggcatgttcatttgtttatgtatgctataatggaataattaagaatctaattgtatggcttctaatgcataaatttttactatctgatgtttagcagaaaaatgtttcccatttctgttcagtggaaaaccagttatatttgtgtatgtgtgcacacgtgtatatatgtgtgtttttctttgtgtgtatgtaggatttaaagagagagtgttatgcccagaaataactgaggcttttcagggagagttcaatgtgtacggcccaaagaatctttgaatattatataatgagatttgagctaattaatgtgcaaacttgagtctaactgttaacataatctaataactctacacatgataatgctttgggaaattgggattacatacttataaacaaataaagagaaaaatcaatgattcttagcctctcacaacagattctactttgtagggagctcttttagagagcttcactgtgattttttattattaccatgaataaaggttcaaggtgttaccacacatttgatcaaatattaataaatgtgcttggagagagtgaatgtcgaccagcaaaatagaggaaaaatgtcatctggacctggcagagaaactttgcaggaagccagcagtggagattgctctaggaggcagatgagagattatttttcacaactgtagttgagtgaaatgaaaatgtctagttttgtctctctatggcaaaggctagggaatgatccatcttgtcagcacctgaatgctattcttctggcggactttaattacataggctagacagcttgtgagggaaaaaaaaaacgttgagaatctctattctggggtaaatttcctaagcagtgtgtgagaggtgtacgcagaaatcctgttgacaaaatattttgtgcaagtgcctcccacacacagctttaaaatgctacccctgtgtgttttccattcctgctgctattcaagtaacaaatgtctgcagcatcttaatctgtttctttctctcccttgccccatgactcctccaagaaacattagcaactattgcattcatccccttatgtcatttcatgtaattttacaatgattttagaattatattgaatt

SEQ ID NO: 48369 - DNA, 1922 bp, Bovine  19866880595809
atacatatattttcataaattataggtaaaattttattataatatgttggatattataataccatatatctctaatatgtctcttaaaaaagagacttaaaaagagtaggaagaaataaagacaagaatattatctgaagtagaaattctcaagtttggtctcccaaccagtagcatcagcatcacctggtgatttgtgaaaatgcaaattcccagaccttctgaagcagaaatgctggagacgaggtttagcaatttgtaattttaaggccctcctggtgatcccaatgtacattacagtttaagaacctctgatctaataaaattatgtaaattattgtacagcctgagctataaagctaaattgtgttggacatttaacactgaacccaagttcacaggagcttgactgattatagaccaaataatctacatttttctctgcatcagagttaggacttgtcattttgaggcctcactagactcaaaattactacagtatgaattcaaatccagatatgtcttaacacaagacttaacacactccacacaacatcattctctgtctctgccaacattcaactctgcacacacacacacacaaaggccagaagaaagtcacttgcctaaactgagcttttaccaaatcttaagctgtgtgtgtgtgtgtgtgtgtgtgtgtgtgttagttgcttagttgtgtccaactctttgcaaccccatagaacacagccccaccaggcccctctgtccatgggattctccaggcaagaacactggagttggttgccatttccttcttcaaaaggaactatagaaagaaagaaagtgaagtcgctcagtcgtgtccgactcattgagaccccatggactgtagcctaccaggctcccccatccatggaattttccaggcaagagtactggagtgggttgccatttccttctccacttaggcgctatacatttcagtaactctaatccatgtacatgaagatgagatgtgaagaaacccaagttcagagaggttaagtatagtcatcaaagtcatgtagccagcaagggcagagccaggattccactctaactcttcctgaatccacagtccaaacatatgttcctcagtatcatatacttctaatatgtacaccacaagaattcaataaaagtttattgggtgaacagtgagtgaaggaatgacctgaatttctttgttatggcatttccatggcttccttcagcagacatgttccaagtagcttccagaaactgcaaagacacacagaccaacatgacgattcacttaatgtggaactcagaaagatactagagccactgaggaagtcactgacatcctccaggagaaggatttccgtcactccataatctcaagctgtgtgtttctcactgctctctgaaaacaatgaacatacacataacagaaaagtgtataactttttcaatgaaaatgtgaattttaataccttaaaaagtaaattataataatgtgaagcattcctggttcatttaacttaccttccagataacttctcagggaaacttaagaattcaatataattctaaaatcattgtaaaattacatgaaatgacataaggtgatgaatgcaatagttgctaatgtttcttggaggagtcatggggcaagggagagaaagaaacagattaagatgctgcagacatttgttacttgaatagcagcaggaatggaaaacacacaggggtagcattttaaagctgtgtgtgggaggcacttgcacaaaatattttgtcaacaggatttttgcgtacacctctcacacactgcttaggaaatttaccccagaatagagattctcaacgtttttttttttttttttttccctcacaagctgtccagcctatgtaattaaagtccgccagaagaa

SEQ ID NO: 48370 - DNA, 1719 bp, Bovine  19866880637145
atataaaattattcatagaaattttatttatggtagtcaagaactagaaacatttcaaatatcaatcagtaagtaaatggaataacaaactgtgggggtattcatacaacagagtatactcagcaacgacaagggacaaactactgatacatgcaatgacatggagaaaacgaagaaaacaagcaccactgccaaatatatatatatacacatatgatacatgtatagaatatatattaatatatattacgtatatatttcaggtatgaacagagtccaacacaagaaaattatatcttaatttattcacatattccaggtgtttttgcatcatgtaaaactagaaaggctttaataatatggatgatctggaaggcatagtgctttctaggtgaaataagtcagatggagagtgacaagttctgtatgttatcatttatatgtggaacctaaaaaatgaatgaatgtaacaaaacagaaatagactcacagacatagagaagaaactagtgattaccattgggggttgaggagagggacaaaataaggagaggggattaagaggtacaaactactacatatgtaaaataaacaagctaattgtacagcatagaaaatatagtcaacattttctagtaactttaaatggagtatgaactaaatatattaaatcagtctgctgtacacctgaaactaatatgaaatgaactatacctcgattaaaaaaaaaaaactgtgaaggctttgctcacatgtttactgtgacacaatcaaaaagtcccttggtatatattcttctacctcacaattcacatcagttattaataccactttatatcatgtaccacccacctctttctgatgcttttctcactcactgtttgcgtcttacaaaacttctcatagtacagatctgggagtcaaacacttcctgttctctcctgtttaaccaagtccaaagggaagcacccaaattagccaagatgctcatttcccaccaatgctgacaaagatgtctgccactgagaagcagctcagctactcaggtgggaaatactgctacagagcagacagctgctctcaatgccagaacaaacaggtgcagattttattgatgcaaaagaagtgaaataaacaagacaaaatagagatccactcacaaatacagattttctagagtaaaagcagggaagtggaccttcagagtagataacaaagtgccctttgctgatcaagttcaaagtcacattccatgattttagagttcttatggcatgtctgacacatactacagtttcattgccattaggttattttctaataacagaaaaatgcttacaagaaagaggtacagattcataaaaccttttcattattttgggatagagaggtggtaagttgagaaaaaaaaaaggccaaggcattttacaccatctctccagtgatagggtgcttcccaggtggctccagtggtaaataatcctcttaccaatgcaggagacaagacagaagaggcacaggtttgatccctgggttgggaagatcccctggaggaggaaatggcacttcactccagtattcttgccagcagaatccatggacagaggagcctggcaggctacagtccatgggggttgtaaagagttggatagaaactgagcatctgagcatatcaagtgatagaacctgtgtatgtatatctttaccccttggtatgaa

SEQ ID NO: 48371 - DNA, 797 bp, Bovine  19866880670223
taccgttcccagggtaagaagaccagggcagtcgctgcctttgccagatgcgcagtcttcagtcttcacaatgcacactctccccaagggaaatgtggagagaaagccaaactcttgcaacttgatgcaaagtgatttgggttccattacaacatctctcagtaaaaggctattcaggcttagagtaaagagtccacacttattttctcccagaaaatgaggttgttatataaaacaccagacatggaatcagagcttctggaaatcactctaaaccatgtgatttaatcttaacttccttaaaggcttatcaggaaaaaggagatgacatggtttagttatatacagtcttaaaattgctaccttgtttggggcacacttcaaaactcaagaacattttaaataaattttaaaaattacatatataataaaataaagggtgttttatttttctttttagatgaattaatgctaatctgggtttttcagaatgtgtttcttagatgaactagccagaaatgttatgcctttcttctgggcaagttagattcattttgtattacaaaaaaggagtgttggagtggacttcttgttaaaaaagacctgagttctcatttgactcttgtgaacttggaaagatacatataactcctttgtctttcacctttaaatggaaatatggatatttcttacctctcagaattattataggaatttaacagcatacttaagatatttagaaaggattaacacaaaacctattttcagtattttcccaagtgtgttacccagcaaag

SEQ ID NO: 48372 - DNA, 1093 bp, Bovine  19866880671850
gaggagaaaaatattctgactacaacacagctgctccttagatttatctctaagcacagccccctttttagactcactgctcggtcctattgagaatgtaggtgagtgaaggaagggagctgggttttgtataaaacacagaaaatcttgtttcacttaataagtcctgcctctctttaagcaactctccacagaagcctgcaactgtaacaaaaacacacttctcacttacagcttataacactttagtcttggaatgaagaaatcagaccttaacaaggcccgctccagcccttacagacttcagcatcaggctgcaccaacagagcatcagactggcaagtgccggccacaccctgcagcctcaaactgcagaactctacagaagccacaaaggttcctggaaatgcccggcaagtgtagagacacacagcaatggtgactcaggcaggagacaagtggaatatcagtagtgtgtgcatgcacgctaagccacttcagttgcgtctgactctatgcaaccatatggacagcagcctgccaggctcctctttccttgggattctccaggcaagaatactggagtaggttgctgtgccctcctccaggggaccctccctacctagggatcaaaactgcatctcttaagtctcctaaactggcaggcaggttctttaccaccaatgccacctgtagagcccatcagtagtaccacaaggtaactaaccaaactgatgacatcttcttgaacatacttgaaatatctgagaactccccaaatatatataactccctaaagtactctatgatctagttttcctgagtaggtagatcgaggctcatctctataaaatatcaagaataacagcatgctagttttcccactaatccaaactaaggacatgatcctgttacaggaagaaagtcagccatcgctgactcatggccagagattagtggaggtgctagctccttgcacataaatcacattattcaagaaaactagagaataatgttgcttcaggatttctacatttagcatttcctgttttaatacttcttaatttctattctgtatttgtaaacagcttta

SEQ ID NO: 48373 - DNA, 902 bp, Bovine  19866880683783
cattttaatttttattggagtatggtttgtttgctcatttttgtttttaagacagggagcaatagaactcgagagcagagattcagaaaacagaattctctattccatcacttacccttagacaagtgaagttcagagaggggatgtgatttgcccaagacaatccctgtcttcccaggagagctccttttccaccttttttttttttttttttggcttccttgcttaaccatcacagctctgtctaatcagttttctcattagtcggttttttagaagttgtactttaattacattttccaggtaaataagagcaaaagcaaaaaataccttgtaaatgaagctgtatcttatttcttctagctactttgcttaatgacctaaatgcatcatccctttggtcagggtattgatttatcaaggaagagggtgttattgaaaaggagtgagtcagagcatccacgcagggagatgttgctctcaacacactaccagagagatgctgggggttgggggggcagggggggagggagaggcagactgcaagttagggaaaaacaaagacctttttatatttaaggtacagaaagaaaaaattacggtctccaatctgctcactacacccagactagaaagtaggccaaagctaaggggtccctgctgggtcttgtccttttaaacaaatcctagccacactcgggactggcccgagctcccggattggcactgattttgatgaagctgagtatcctgccttcttatggctgccttaacaagtgaccacaagcttggcagcttgcaataacataaatgtattctctcattgctttagaggccagaagttcaaaatccaagtatcagcaggggttggttccttctggaggcattgcgggagaaactat

SEQ ID NO: 48374 - DNA, 779 bp, Bovine  19866880688090
tcccctcccgtccaggctgccgcataacattgaacagagttccatgtgctgtacagtaggtgcttgttggttatacattttaaatacagcagtgtatacatgtcaatcccagactcccttactatcccatccgtgcccctggcaacaataagctcattctctgagtctgtgagtctctgttttgtaagtaagttcatttatatcatttcttttagattccacatataagggatgttctatgatattaaatttatttttgatatttgaaaacaatggtattcttttgttattcagaaatggccagaaaagagatagaagtggcttgagaagacagagaagaaggacctggtagaatggtttgagggcagcagtagaaataaaaaataaaaccacctttattgtttccttcttactacagctcattcaacaagcagaagctagaaaggtcagagcagtaaacatttctacgcatgcagtgacatagagcttaagggaaatgggtgctgtaactgggtacatttcaattttacaaaactcatttttaaatcagttgtgaacatttaatgccttcctgtgtgttttcagcttactaagttatcctgccaagaaaaagttgttgagaatcactgtggaagtgaataggaagcatggaattgagagggatattgagactgggcatagattttaaaaatcaccagcacagaggtggttgaagatgaccgtatttgcctgtctcttgacctgttttcagttattggctttatttatttacttatatt

SEQ ID NO: 48375 - DNA, 2773 bp, Bovine  19866880733959
gtacaatacatttatgttcatttttaagataaggtgactgagagccacacaaatttgacttgcctaaatgttcatagctgctgcatagcaggaaaagtcaagaagctgtgtatcctaccttctgttatagcagtggctctaaactttacaggtttcaggaccacattctacttttaaaataaaattttagaaccttaaagagcttttgtttatgtggatttcatctaccaatattgtgtatgaaatttaaactgagatttccaaaagtacgttatgtattagttaagaacaattaattacccattgcatgacaacataacactttaatgaaaatagttgttttctaaaccagaaagaggcagtaagaagagtgacattgtttcctatttttgcagatttcttcattccctggtttttcctcaaaatgtcaaccttttatgaaagataacaagaaagttaggagtgaggcctttaacccagttcaaatgtagttcctcctcctttttcatttttttttcccgccatagggtatgtttatccctacttccaaaaccgctataagtgcttgttctaacctttagcgacgtattgtctcaggtccagccatcatatctgatgattattgagtttagtggcttttggcaattagcccaaagaagtcctaccattctgccacactgtgcccatgatagtttgcaggacccttggagtaaaaaactagaaagccagttctgaactcaatttgtgtgtagataaaacaccaaaaatatttgggctatccattatgtgtcctcaatcaaccatcaagcgagatcagatgtttatgacactcagatgtaagctctgttttctgtcattgacaacagccagtctaaaggccttatagacaaaaccttagaacaatagaatactctgtttcttcacatctttcaaactgaaggcaagataagagcagtacatgcatctgctttgttttcaatgaggaaatcacaggagtcaggccccatatgaactttcaaatgcaacatttaaaagcatatattttagcaacagcaaaaaagaagttatagtcttcaatttggccattgtttttcttaaagtcataaactctcaacatgtaattttataaaatgactcacaactcaatttcctattttcctgcaagcagcagtattgtgagatttcaaaggggaaatagctttaagtataaaagtatagcctaatttaataggctacagtagcacacttaaaaggaaatataccactgtactaatatcacatacatcaaatatcacaaaagagtgacaattaaatgcattatttttcaggccacttgcaaaagagatcacagacttgcaatgttgaaaactcgccgctgctatctagagaagaaaagggaggaagaattgaagcaatttgatgagaatactaattggctccatcgtgtccaaacggaaatgggactcttaggtccaaatggtcatataccaaaggtacatacatattttatagtcagatttattttcttagaactgaacttcttaaactcactgttgtataaatatctttcataaggcaaattttggttcatctctctcagatttaactgactcattttactgtttttaactgaatatgccttctacctccctatttacctactaaatttctttttctttactttcagaagaataaagttacatttaaatgtttttcttaagtgattgcatccttttatgaggtcgttcttaagtcagactgaagtaattctatttcagactttcagactgtacttgaattttcatcatgtaggtgatttaaatttaataaattgacattagttttaaaattagttttaaatgtggtcaccattatttgtattatagccaaataaaaccagtttgaaagctgtatgcatttatgtttatgtactgaattgacaatagtccatctagaatataaattaagtataatttgcattatacttataatctagtatattcatgtaattgacagtaaaatatagcccatctccaactagaaaagtacttaagagcttgtttagtattaaaaaagcaaaaaaatccattgatatttactagtttgcctttgttttcccataattatcttaagctcccaattttttaaatggtacagtattctttttagtagtactattattgctttttttgcctacttattagcatttatgaagttaatattcttcaggttattttcagtaaatttaaattttatttaccatggtccaatctaatttttctagcagtctgtcttctataactctcttaagcagaacttttcacacctgaatataaatctagaattagtgtttcaattcttgttttttaatgcattttattataaataatttgaaaaaattaaaactgtttctattcccatcaacctatcccactctcagtccttttttttgtggatattttcatggctgaaataggtatctacttttaagccattctttcttatataagcaaactgagacatgactttgtgaaaagatttattcacagtcatacaactctagacagagacccagtactgtgactttcatattgctgcccttttttctgtaccctcctgcattatcttcctcttaacctctcagatttacccacttctacatctcccattaccagtacccgaattcagccttccagcccccattgttggatgctatgtgtggccttcctacttcattccggcctactgcagtcattctctacactgcaactaa

SEQ ID NO: 48376 - DNA, 1389 bp, Bovine  19866880735150
tgtgtgcacgtgtgtgagtgtgggggatggtgatgttgtgtgtatgctgggtgtgagttcttgcatcagtttctgttgcttataaccagagaatctaactagtactctaccttttaacatccaaccaaggttctcctctcacagcctagattccaggaccttaagaagtggagcagtttctacaacatgctatatatttccattccattttcaagcttttgtccttaattttccctcttcctataataccctttgttcatttctgaaaaattccaattcatacttcaagccttagcttaaatatggatgaaagtatttctacttctaacgcttccccagccctaaaggcaaaattaagtgtccttgttttttaaatactcaaatcaatttatacatctttctaatttacaacatggtatcatagctagtgattcacaagtccagttcttccaggagatgctgaaatcctcaagaacacacaggcaaagttcaacaactatgttgaattgaataaactgaatcacatccaaagagttgttgttgttttttttttttttcaaaagatggctctcacttttttgtttatatgtcttacaatttccagtcctcttctcttttaaaaagtctatcccattaacactttatagagtttagaattaataactgatgagacgtagaaagtaaaaatagttgtcccacttctcttccctctgtgattccgtctcccttttccactgacacatcacatttcaatgccattttttgtttccttccaagttccctttgcctctttctttgcagaaatatgcaatgacccattatgcaatgagttacactatataacaaacagatttccctcctctcctgagaccatgtgaatgaagaaaaaaccatgaaatccttaataaggctgctcatgtgattgaaggctaagaatgtgatcccttaggaaattctggagatggatatagttgtgcccctcctggaaaaatcattagtgaattattcaataaaaacaaaacataaagaagaaaatgctagaggttcctatctatcttcctgaaaagattgatccaaagtcccactttgtaattgttcagatgaattgactttaaccagagaagcaaaatgctaatcaaaacaagggggagataaatggaattggttttccctttgtgttatttaatggtgcctcccatctcacctgctgcctttcctgatggaccagagttagtgaatatttatttggtattatatgtccccattactgaaggaaaaaaaggaaatcatctttctcacttaccctcttgagtctcttcactctaacccctttgcctacacaaggaatcgcaaatttcatactttagctcacaagatcctccatgattt

SEQ ID NO: 48377 - DNA, 1283 bp, Bovine  19866880820290
cacctgagatgtaacgagctccccgtaatatgctctcacttagcctttttggtcataacgttgtgggtatctctgcaatagagtcacagaatgtgaaacatgggagatctcttaggaaatctaatctgagaccctcattttacaaataaagaaacgaaagcccagagagagaaagcaactcatgctcagttactggcctgtgctgaagcagaaacagttctcttgcttgtctgctcagggttcttatcattctatccctgagatttaaggacacagaggaaccattcaaaagactttttggaatcgttgctattttgatttatttaaaaaaaaattataaagcattgactcagtacagaagaagaagacagattagtcttacactggttacatgactgaccagttatagaaaagttggaaagatctcatacatcaattacacactgaccttggattaagcactatgctggcccctggagatctaagatgatgtggtcaaatcacttagactcctcatagttcttgcaaaagcagaacacctttatgtttacactgagagccaagagtctgaaaatctccatctatgaaggatttattctccatttcacagatcttagaacatatggcaaagttacggtcctaacaagcaacagatgcgacctgattttaactctatgatgttttcaatactgcgaaacagtggaaatagcaaaacaagcacagagaggcattttaatgttgttatcattgatgaaaagatagataataactggtcaaaaaagggggcccaggaaactgtgccagtacatagaatgatcaagtcatatgaaaaagactcctctgtgtacaacatttaaaagatgtgtatctaggtcaacattactgaaccatgcccaccttggccgaatgccaactcatttgacttgctagagcaagacaaagtactttggtcttatcccttaatggtgccctttgactttctggttgaacttttccttgactagaaagaattcttagattcctaaagaaagaaatcttagtaccttttcctcaggccagatactctcaatatcctcatggagtttggttggcagtttagttgctaagtcgtgtccaactcttatgaccccatggactataacctgacagctcctctgtccatgggattctccaggcaagaatactggagtgggctgccatttccttctcctgggggccttcccaacccagggatcaaacccgggtttcctgcattgcagccagactctatcaattgagctaca

SEQ ID NO: 48378 - DNA, 706 bp, Bovine  19866880826205
cccaaagttgccaggtactgtaaatctttgaaaaaaattgccctttagcactgccaagaccaaaagctaaattggcccaccttccgcaatttacatctgggttcagtttggtctcagttaaaagagcttaacccatagtcctgacttggtctctgttcagatgggaaagcagctatatgaaaggagcagaaataggtgaatatctttttatacccttccttgaggggaaaatagtgctttattaagtttggatagttgtcatctaattgcctggtattagggaatcagctggtttgttgctggatagtatctatttgctttagatagttcttttttgaagtatgcagtttactgatcagaagccgtcaaaaataaagtacattattacaagggttttaaactgaataggagtaagatgaagagaattaactctccaatgccttagataagaagcagaaagaattccattaatgcaggtttaacatgagaaatatagtagatataaaagttatttttaatataggtagagaatggaaaatagcaataagattaagaaaactgtaaaagggccatgatttacatcgaggttttttttttttttttttttttttttactagttcttctcatgaatgcaacagttggcaatgtctttaaaagtctagaatttttcaggataaatccgcttcaagttgggaatgatttatt

SEQ ID NO: 48379 - DNA, 1055 bp, Bovine  19866880842589
aatgataatatttctactcctttcttttcacattttattaaatttgggtagaacttccaggaaaatgttaactaataatggaaatagttcacatcattatcttgcttttgatgtcagtggcaatgactctagtgtttcattaagtattatgttaggaatggttttatgatatatgttcctaagtatcctttctttgctttctaatagttttagaaaaaggtgtttaatttttatcaaatgatttctttgccatcatctgagaaggaaaaatatgtttttcccttttaattacttctgcaatataatctttaataaattccgtagtgtaaaatgaatgttgcctatttccatgagcttgtgggaatgatttaagatatgttaatattgataatctaaaagttgatggctcatttgtcaggaatcctgctccactaatagctctaacttgattctaccttaccccaaatgttagtgattttttggtttgtttccagaagatatttaatgggtatttaggaagaattaatctcatggtcctcccttctggtctccttgctgatgttgaaacctcttgagaaaggcgtgtagtcaccctctcccctctactggtggtttcttttataagaaagataccctttaaagaaaggtgcttggtttattatggattcataccacacataactacagataaaagccttcaagacatcaaatatctctatgaatctttccaacttttctatactaccagttctatactgagtttcgtgaagatgtagggtttcctccaaactctgaccctgggatgctgcagcaacaccgattacatcctaaagtgtaatacatttcaagtgaaaggcacgtctgagagcttccagtttgtggggtggatgggttcaggcatattctgaacctagcttatattcaggtaggtcagttgtgtattagtaatattaattacttaatattaaaccatttagtcaagtttatccaattcaatcatgctttccattgtatgaaatcctctttcctttccttgggtctttaatctctaggct

SEQ ID NO: 48380 - DNA, 838 bp, Bovine  19866880951889
cctcgttctgcaccttctaaagaattcctggctggtatcgatttcagcttcgtaggctttgacagatcagttttcacttatttgcactgtcatgtgaacagttcttgccatctcttatctttgttttggggagtttacagcttttttacttattaataaaacttcttaaatggaattttgggagtgtgcattaattttaaaatgaaagagagataagtaaagaatgacagttgaagtatgtgaagaacactgaacgtgctcagttgacctgaatggagccctggctctgtgtgacttataatatgacactaggtaggtggcttgacttctttcagcctttatttcctcatttcagaggaaataaagaggcagtattacctataaatagaggcagtattacctatcaccttgcagtgttgtgaggttcccaagagaggatatatgtgaaagttttgccagatgttcttagattcattttttatatagctgaaaaatgagattaaaaggtttatcctgactgtaagtaattctgagattattttaatctcaatttttagtaatgagaataaacaatttcctaaaacattttaggtgacgtttcactttaacacattatcattagtgatgctagatatagtgatgtaatagtgtccctaactcaaaaccttactcttaaaggtttctttctttagtatatttatgattattggcatactgtaggaaacttgcaaatctttgctcttttaaaatttgctttcatcataaccacagaaattaatatgtcgatttgggaagatgtggttttatctttgtcacaaaacaaagataagaaacagca

SEQ ID NO: 48381 - DNA, 1777 bp, Bovine  19866881094294
attcaggccaacttataattgctttaaagatcattgtggcagaaggtaaagaaaaatttggaatgtggcaatatttaaagaaattggaataaaaagttttttctctatttgttgaaattcaagggatctgagaagcacaactttggggattttagtctcaggtaggctgtcactagtgtgactaagctctcagctaccctccctgtctgtctgtctgtctcttgcatcttctctacctgacttcctcttaataccgtcctctgcttacccatagtttctgccttgtcatagctttaacttactcataactttgctcactcatgtctatcctagcccttcgctatgctcccaactgctcacaaaacaatttgttctatagcacagtaaagtagagtccagcaagggaattgattatcccataaaaaatcaactgtttggttgagcttccagcactaagctatatcacagaccaccagttagctgaaggtttgcctacacttggatatgatccttacatctgctcccagcagtggtgtccagagtagaatgaggtcatgtggtgaagaacacaacagcccagagtttgccactcaacatgctcagtagatattatgttttgttgtcgttgttgttgtttttaggaaagaatggtgggcatcctgatgaacctatttagaagggtgggcagaaagaaaatggaataaagtctgcctcaattctcagtctataattctgacagctggaagttagtatgcaaggaagatgaatacaaacacccaacagcctagctctaaaagcaaactggtagacgatgtaaagtaagaattctggtagtcctgttagaggcaccactgtcatcttacccaccttctgggtcattttgacagcaactaagcactaagaaagggaggttttgcccatgaatgatagagagcattcccttttccagggactgaaataaaaagacaataatccgagcctgaagcctgatacgtctgtctgggttatatcccagtgtgaagaggggacaatgggttggacctggcacatgctctcacgctgagactgtaagccaggaatatttttcctagaaagcaacccagtggggagcctctgtgagaaagtgaaatataaattattcatttccttttctttgtctactacccccaacaagcctggctctgcagaggcaaacagaacgcagaagagtgtatgaggacaaggctcctgcacgaagctcagctgaagctccctccttcccagggagcattcgtgccccagaggatggcaggcagcctggccggcagcaggacaggagaggactgccactggtctgaccaagacacaggctcacacagtccctgcctcatctgctcgctgcatggatgtgcctgcgtgctcagtcatacctgactctttgcagccccatggattgtagcctcctctgcccatgggattttccaagcaaaatttttggagtgggttgccatgcccttctccggggatcttcccatcccagggattcgaagttgcgtctcctgtggctcctgcattggtagaatatttaccgctgagccactggggaagcccccctgcatgggcacatctcttcaattctgtggagctcagttgtattagctgtaaagagagagtcatctaagggtatcctggaagaactggttcttggaaaagcacatggtcaagactggtattccctcctgaccagccagcctccctggctctatggaattctctaaatacaagaaatatcgagtag

SEQ ID NO: 48382 - DNA, 2159 bp, Bovine  19866881109940
ccaagtcatggtacagagggcccatcttaggtgtttgatactgggtcattcatttttgtcttttttcaaccacagagtcatttgccttgtgagaactgagaaccacacttaacagaaatagatatgaactcttaaacatagctgaaaagctattcttattacttctcaagttctaaataacatgccacattcatatctgaatcattgagacttctaccgtaatcatatttcatattttttatttatgccaattagcagcaatgatattaaccctactatattattagtcttttaggcacatcatttcccatactagaattgctacactttgctttatttatgtgtgtaatccagctgtagatcgctgcatgttctttttaatcttcaaagatgcttcttattccccaaacatctattatcccctctgcttactcactgttttggctgtcaggccatagaatactgatgaaagaaaatgcacaagagtgtgacaattatagattcattctatggagtttcatcaggatcatgcctgtcatcacatcacaccttttattcacctatcaaaatgtcacaaaactattctctcacttattattcttttttcctggaaacattcacccatattccattttctccccctcatttgtagtgaaaatattgcttcttatgtttcaaacttaatattcctgcaaactttgtcatattccttcatcatcaatttagtatcttctcatgaattcatatggggtcttcagagaagagtccactggattgttaattccttgagggcaaccctcatgatttattcacccttatatttttgatgcccaactaattttctttattataaagatggcttccaaacacactcaacaatatctgctattaaaacaacaaaacaacctcccttgacgttattacttcttctgaaggtgttagtgctcagccgtgtctgactctttgtgagcccatggactgtagcctgccaggttcctctgtccatgggattctccaggaaaggatactggagtgggttgccatgtcctcatccaggggatcttcccaacccagggatcaaactcaggtctccctcgttgtaggccaagattctttaccatctcacccaccaggaagcccaagaacactggagtgaatagcctatcctttctccaggggatcttcctgtcccaggaattgaacctgggtcccctgcattgcaggcagattctttactgtctgagtgactatagctactttttaatctttgcatttgttatcgaaatcttaagttttttccattgcttccacttccaatctgactcattttaactatgagaggtaggattctgctttcttccaaccctatgaactcttgagaatactatcgaaagattacaagtgacctttatgtccctaaagccaataactgtacctttgctcttatgttccttcaatgcacttaaatgtttgatatttgagaacatattcttcttgaatctttcctctgcctgagcctttgctgttcttacagatattcacagcttcatttctcatcactatgtagataattcccaaatgccatctttagcctgcctcacctgtgtgtcttcttcctgagtttattctcagctagcaatagtatgggttggattgaactgtggataacatgtaaattcactgcatactaaatgaattcagaattttgctcccctaactgctctcactttctagataaaattgtatgcagtatctctctcatatgtctaggtccctgaacttaaatcatagcattgtccctcattcttctctctttgtcatacccagaatccagtatgtcactttgccttttgattcttcttttgaaaaatctctgggtttctttgtttcccctctcattattcacaaaagcccaggctttcaacaccccagccttgatactatcgcatgattttctggtcttttccattgtttttctatcatgggaccatcactgtggcactgatattaagagaaactttaaacctgtcactccatacttgacttgcctacaacatcgagttcatattttctggggttgggtttagtattctgatgagcttacctcactttatcttgctaatactttctctttaaacacgaccttctaacctctgccc

SEQ ID NO: 48383 - DNA, 826 bp, Bovine  19866881151431
tatgaattctagtgttacacaagtcagtccataggatataactgtaaacttgtaaccagtctattacttccaagttcccatgataagatttcctgccatagttaatgggctgcttgcttggagcaatactctacaaaggaaggatttttaaagaccataatatacatttttctgaaatcagctgagagggatttggccagtagttttagtatgaggcactcagtcatttttcgccatctttacaggttaacacaattggagaagatatgattcacacaggacaagtttcctgtcttgctgtgttcctataaagatctgactcaagtgtgaggatccaatttaaaaccagcctcttgcctggatcaagattgaagagggggtggaagtggtggccgtgtttaagctttcttaaatataaattacttttatggaacaaattgtaccttctttgaatatagctaagtggaagtcttatttggattgaagcttaaaacacaggtgtcaattgataaagtaatgaagccccagaataggaagaagcttgtagtatgtgaatatatgtggctgtactctgttggtttcttctatagaactgtaaccaatattttccactctgtcacttggccacatttgaaagccaaaagggatttgtgtagtgataatacttgattgaaaaatacaaacttagaatcctcaaaaaagtaggttatttaaagctatctgaagaaaagatgtatactcagtctgtgagcttatatatttccagtttattcttataatttttatatcataactcaggaaaaactcagggacaacctaccacagt

SEQ ID NO: 48384 - DNA, 1334 bp, Bovine  19866881181243
ttaagctgaactgtttctctctcttttctctaaatcactcaggttctgtgttcaaaaggtcaattacatttattccaaattggtcagacaaacatttcctttgcaacctgaaaataaaatggcccaatgaacagtctcttgagaacaatttgttcattttaaatatgtatctggcaatgaaatgtgtcctccccaaccttaggattgtgtggtaagtgctattgagcatatgctgggatctgaaatggaatctgcatcataggaagctgacaccaggagtgatgtggatgaggtgacctggtcctgttattatatccttcaccactaaatgatcatcttggccatgctatgagtttgcaagcattaaacagaaaaagcaacagcccactcacagtgctacatcatggaacattggaggtgggccagatataataagtatatttggaaagagaagtcatttcaaatcactaatccgtaaatgacaagatctcgaagaaccaatctatggttggcttgtttttagaaatcctcagtgcaggaatattcagatgttcagataaatgtaaagataaatgttttatcttcagataaaagaattttgagagtttcctcctgtgtggacatgggatttgatctcttacatggcttccacaataccctcagaggcctaagctgtcacctatagtcaggaatcagatctaggcctgtccaccatgtgagtttagctgctacattagactgcatgggttacaaactcaaatgctagctaggctagtcaggtagctgatcacactggagagtgtgcctgtttaaaaggtcagcgactgcttagttctgggagagcactgcctgcaatagtgcagactcagtgaagccagatcatctgcttgaagagagtctggttgtctgaattttacaataaaatgtcttgattttataaatgttgacaattcagtaaggcagtgaggtcagacacgtctttgggacagagagatgcagcagagggtccagtgtgttacgggtacagtctctattttggggcataggctgaatgcaacaaagattatacatggggtcccatgggctctttagggaaagcacagtgatgttctgggtgagaggctgcaggccaaagatcatccaacaaagcccactttcaaatggagaaaatacaaacactccctttatatagtcactcctgcaccacaagagggaaaagaagttcccaaagaagagaatcgggaaggaggaagaagtggcagagggaggggagagaaagaaagaaaaagatgagacagcggcagccccaggttggattccattctcctgttctg

SEQ ID NO: 48385 - DNA, 1019 bp, Bovine  19866881194657
ttctttctaataattagaaagctgtctttctaataattaagatctcagctcacacttatcattccttgacccatttccctaaagtatattggaatgacctgacaaagtgaatattatttcttgtgactataatttattctatttgaccagaggtcaaattgcttcatctcctccacctgaaattgccatataggcctgtttagtgttgtttaactatcaggttttaccccatggtgacttttgtcatgagtgtgtacgccactattgttaacattttgaagtaatatatggtattactgttaaggtcattctagtttttgtgagggaaactgaccagcagcatcttcttatttagactttctgaatttaatttgtaccctcttatgagtagtaggttactttacatccttacatttagttaagttcctgagatatagactcatttaatatcagtaagccttttagcttctgtactgaaataaaaaattcaagcagtaatttaaatttgaacaaactaaatctaaaatattttccattattttagtttaggagaaatctccataagaaataataacttctttctgaaccagaggctaataaaatattttaactttctgctgccctggaccttattgaatgtcccacacagtcccacttccatcattatgggtattttaaatgaaaaatctgtttcatttgtgtaagatttcagtctgtgactttaaacgcttcagaagccctcttagactatgtgtgtatgcctgacttgatctcaattccgtgaagttttacctcttatcaatgacaactgacatcagtgtactaactgacccttcttgtgcctagggtaccctgatatgcccactgcagcggatgttgtgaacgcgttagatcaacaggcacttgcgtccatcctgagagcatacggagaggagaagcacgccaagaaaatcgcttcagcaatcattcaagcacgcggccctctaccccatcaccagaacccagcagcttgccagcat

SEQ ID NO: 48386 - DNA, 2674 bp, Bovine  19866881201721
acgcatatatatggaattttgaaaaggtcatttttaaagacttcaaaaattctgttgtaaccaatatccacagtcacaaagaattttggcatactgaacttaaagatacactttcctaatacatttagatctgttaaaacccatccaacataaaacacatttatgacatgaacagaaaaatgagtttctaaccattctacctattgtgaagcaagaaaatgtttccatgttatatttgccttaatagaaatttcaggtcttcatctatttttcttctacaactaggtactgttccaagatcatgtctcccataaagtacaagggatgaatgagatttctatgaggtcccttccaactctaatttcctatcctagcgtacactttatacctaaagaaaaagagtaataacacattagaagcatgtgagaacatacaaatttttccaaacagcataccattcccaaagaagacctgcagcttatacaaaataaatgatataaacaaagccgaaggatataaagtaacctacctaagatgacagagtaagttaatggcagggcagaaactacaaactgctaatatttactgtgaatttaccactctacaaggtaggtactattacaaagcaaattttataaatgagaaatctgaagcaaagggaaggaaagtggctcgtgtagatcataaagtaacaagttagaggaggaacagaggtttgtcctcaatttgcctctagatccttgtttctagtcactatactaaaacctgctttttaattacaggttggattttctaattccctttctagctctttatggagacttgataaataaaaatgcctgcttgaaaaataagataaactttgcacttataaagttacacagaaaagaatcaatagcagaaacattagataagaatcctagtttgaaactttaaatagctctgttatttcaactgatattaggtatttatattaaaatgcaaagaagtcaatttaggagattaacagaggctcaaactgtaaaacagaactttctcaagagctactaatttctgcacttagctcatgcttccaactctaccacatggatgtttgttaaatgagcctaacgattagagcctctgtccagaatcattctaaattgggaccttaattgtttctgtttcatgactcagtgggtgtaatattttatctgctggattttctaaatgccagttccatcatgttctgagcacactcttttgcccactcaatagactgggtcaccaagacaaaactttgggataacaggataatgaaattttctaagtctttaattattctctcttacaagtaacaaaggacacacaagcaaccaatacactaatatttttatggactcatctacctctctctctttctctcttccacccacctcgatttatcaagtccagctgtatgaaacacacattagataatttctttttaaaaattattttccagaataaaaaaagtcccccaaaggccatgaatttaaaaaaaaaaaaaaaaaagtttcacaacattgttttttcttttgctctccgggaactatcaaactataaaaagaatctggtatgaccaccatatggctatcactaactgtataaacaaatctttttcagtaaaattgactggaaagaaaaattttgtatcctgaaccccatttccttcttgccatccatttggaaatgagaactgaattcaaaagaggggaggttacaagatgcttttaaaaagcagcttaagcataatgcagaaggaagcagcagtgtggtacagcaaaaagatacgcataagctctgaagccatatgaaactaattctatcacttccttgttctgtgaagttgggcgattcattttacttctctaaacctaaattcacttgtctagaatgtacataaagtagcaagtgtggccaaggggacagaaagaaactctaacaagtctcaggaaataaaagcaaaaatacatatataatagccagggttatataatatgaataaagcagacactcatgccactggctggccccacttcagaaacaaataactatatcggataactgaaatgtaaagaaagagggtagaaccaataataacaggggtaaaaattagaattaaagattcctttttaggagaaaattcagagaatacaggtcttaaagaacagccataaacctacttgcaattctaaactttggtgagtgaagacacacagacatttacagatgcaggagaaggggtagtaattcaataaacaattactaagtccgtgagttggtgatggacagggaggcctggcatgctgcgattcatggggtcgcaaagagtcggacacgactgagcgactgaactgaactgaactgagacactgtagttaaatgttagaaaaatattgagtggccatgacctctctggtttaaagaaacaggtaagttaggagacaattacaaaagtgtagtaaatgataccttggaagaaagaacagtaaaataaatggcaccatggaagaaagaacagagcacatacaagggtagcagagactggaaaaaactcataggtctgctgcagatggcaagtagcacatgtggcagaagaggaggctgatgatatagaatagcccagatggtaaaggaacttgtacatatgcca

SEQ ID NO: 48387 - DNA, 761 bp, Bovine  19866881306873
aatgggagcatgatagggctttagatatataggggctttagtttataggaaagaaaacaggttcaaagaggaagaagtggcttcttcaagtcacaaacgtggcagtagtaggaagagtctcaactcctaattcagcacatttccccctctctgagcagtgagaaggtgctcagtggtaagtattttcagtgatttaatgattaacaatatcaaatgccttccatttggttgtgtgcatgatgttttcagtctctatattgtatttgactcttttgcgaccccccctggactgtagtccaccaggctcctctgtccattggatttcccaggcaaaaatacctgagtaggttgccatttccttctccaggggatcttcctgacccagggatcaaacatgagtctcctgcattggtaggtggattctttaccactaaaaccacctggaaagcccaagttgaagtctgaattgggggaggaggatctcactgaagttgtttcagcctatttggttcctgtctttagaaaagtactctcccagccagtgttttcaatagaatgattgctttgtgttcataaccaattcaaactcttcagcaactgtttctttcccatgtgagaagcctggtgagcatttccattacatcttgaaataatattttcattttggggtctaaacatagtaactagggtaaagacttagtctaaacttagctgctaatagcccaggctgtgaagttggcattacaatattcttatttttt

SEQ ID NO: 48388 - DNA, 1821 bp, Bovine  19866881325348
tttcctgttttctactgtggacctgttatcatctgggctaatgttaccaaatttacaaatagcctatttatttgtgccacatagagtgtgatctcatagttgcatccaacatctgttctttcttctccagagtacagtagagtcttggaatgtttatgtttaaatttcatggattgatttttcctgagtgtccctgattatccatgacagttacaatcttgtattttgctatgtcactaatttgaattgtgcaatttgttatatataggaatcaatcatttactgagcctagctaaccaccatcatctgttttatccatcttcgcactaatttttattatgtcagtcatgttattcttttcattaattagtgctggagacttttcttgttcttcactggtaacatgccctgctgttttaactcaaatctaacaaaagtttatagctaagaataacttaaatgcaaacatagacattatcaaaatgaaacgaattttcaagaaatatccaggtatataaattgtgtatttggagtgggtttagataaattaaagggcttccacacaaatgtctactattgtgaaataatattaaaggacaaataaagtaagatttctcatagcctattaattgctctgttacattccctctggtaccaataattagatcctgccattaactaaggttaaaagagattaatgctagaaatgtacataattacttttttaaaaaatcttcctttccccctattaaacctacatgagcttgagagtaataaactctggtattttccacttagcaattttatgtacatatttagatatgtgtatatatcattatggtttttaaaaataaagaatggctccatgtatatagttatttatttatctattttgtcagtttttctctcaaaaaaaaaaaacacaaaacattatcatccagaagcactggatattccaaaaacctaccagactgaattttttagtactacttaaaatgagaatatcagatatgtaacaatttcaatttctgtaatcattctaacagactattttaactaactgaatcaatttgccaaatatacaaataaaatacatatgtaaatttttacttataaattatatttattaatttgaggttttgtttgctttatgtctggttggttgcttggttttttgtttgttccaccatctttcttggcactcaaaaatggtctcacgtgcatacatttttggttttgaaaaaagtctgtgattacaactagaaattatctcagctgaaagaatatgagattcattacatttattaagcagaaatattctacctatgtacggaaataaagggctaatcttttattaatagttatggaaatatatttggcacacaactagaatattttctaggtttcttctcaagatagtctttaaaataatttgaatttgtacccataacaattttaggtctttttatcttatgatctaaaataaatcttacagaaattgataacaaatatttcattagttgactaaatcctaaaaatacttaaatgttttgcttttatataaatatataacttattttattaggctttgatttcattcctagaaatgtgagttttactcaagtaaaaccctgattttcaagtgaaaacaaaaggtctagaactagccaaagtgaaaaatcataccataaaatcattaagacaactttaacataaatcgtttggaaaaacaaaccttgtcaaaagtaaccaatgacactgatctttatacttgaagaaataaaaatcaccaaatgaccaaaaaagaatttgattttataa

SEQ ID NO: 48389 - DNA, 1245 bp, Bovine  19866881890144
tgtgcctcctttttttgacgggggagcagagctctaacttgaattgcatttcaagagatctacaacttcaaatcatttaagagcgattctgagctgcaataataatggtgagaataatttatttgtgcagaattttacactttacaaagaatttcctcgcacactacctattcattctgtacagcagccctgagaggcagccatggcaggcactcttggctctattgatcgaataaggaaactaacacctgtgatggttataagcctctactggagattaagtctctccagagctggagttctttccaccatatacatcaaatggcttttcatgaggaagtttgcataatctcttttggacacatggaataggttaagcttctgcaaacagcagacaggcaggtaaaacttaaattaccctttttattcaatgagtgaggtctgttactttactctcccaaccatttgtcattagtgtactgcttgtgtataagaggaatttcctttttatgccttcatcctaaatacagattaattagaaaaatccctgaactctcagcaccagcatcttcctgttcgtcattgagaagcatttgttgaatggatttcatacataagacactgagcttagtgctagcaactgtaaatacataagctgctacagcagaccattggataattaacagtaaaataaaccagctggcccagccagcagtaggaaaatgcatccctaatactgtttcagtagtattcaggggcctaatattcagtgtcttctactctttgaaccagtaattctatttctaaaaatgggtcttatataattctaaatatagaaaacttttaaatttctaagtagcattatttagaatggtaaaagaatgaaaacaaacctaaatctcaagtaatacatcaatgggtatataaattttgattcatctctgctagctcaccagaaaagaatctgcctgcaatgcaggagacctgggttcaatccctgggtcgggaggatactctgtagaaggaaatggctactcactccagtattcctacatggagaatcccatggacagaggagcctggagagctacagtccacagggtttcaaagagttggacatgactgaaatgagcatgcacttgtgactcttaatcttttcaccttatgtgagcttttcctatttgtaatcattgagaaaaacatctcatctacctttgttcttctaagttacagaataagcttttc

SEQ ID NO: 48390 - DNA, 1639 bp, Bovine  19866880142815
cttggaaggaaagttatgaccaaccctagatagcatattcaaaagcagagacattactttgccaacaaaggtccatctagtcaaggctatggtttttcctgtggtcatgtatggatgtgagagttggactgtgaagaaggctgagcgccgaagaattgatgcttttgaactgtggtgttggagaagactcttgagagtcccttggattgcaaggagagccaaccagtccattctgaaggagatcagccctgggatttctttggagggaatgatgctaaagctgaaactccggtactttggccacctcatgccaagagttgactcactggaaaagactgatgctgggagggattgggggcagaaggagaaggggatgacagaggatgagatggctggatggcatcactgactcgatggacgtgagtctcagtgaactccgggagatggtaatggacagggaggcctggcgtgctgcaattcatggggtcgcaaagagtcggacacgactgagcgactgaactgaactgagaatcatactacataaacttagctaaaaggtggaaccaatccctcggtgttcaccagcagacaagtggacagacaagacgcagaaaagccttccaatgaaacgttattcagtcagtcgtaaaaaagaataacgttttttcacatccttaaccatcaataaaccttgattataagtgaaacaagccagacacaacaagacaaataacatatcagagcacttatatgaaatacttaaaagaggcagattcacatagatacatagtgccgaacaggggaaatgaagaattcccattattattgcctactgggtacagaccttctgttgtagggaattaaagttttgaaaatagtagtaatggttgcaccgaaatgtaccctgaaacaattaaaatgacaaatgtcacatatttacattaggcatattttaaataattatacaccttttactgctactaaaaagccactataacgtcaaaccaaggaactacacacggcttgctgtacgtaacggccctagtcagacggggtagagaaggtacacaaacattcagggggagaccctcagtaaacacatcaaaagcttctccattaagcacatcaaaatccacccggtttcgttgttttgaagctgggaccccaaaagcttaatattagcacacgcgctctatgaggccgacgagtatcacccaacagcaccactcccctccccaaattattctagcgccaccctataccaagagccccttgggagccgctgcggcactggacgaccgacgtgtcacttccgtacccagcagccacaacaatgacagcagtcctgggtcaattctttacaacccagaagtttcaacgtgagcggtcgaaggaagcgccacaagacgagttaacaccatttcctcagcgaacctcgacctcccgcgagctgcctccagaggccccgagccgaggagagtccgaaggcggcaggcgggcccccggcctcctgactcaccaagtgtagatctgcagctcgctggagggcacgtttccgcgggagaactcgtccatgcggtggtggcggccgttgttggtggtgaagacgcgcaggagcagcgggcaggtctgggggcgg

SEQ ID NO: 48391 - DNA, 1453 bp, Bovine  19866880484011
ttttactaaaatgtttcaaggacagtaggccatagggtatcttggggcctggctgaggacccgtcactgtgccctgttaaaaccagcctccaggggagccctctgttacagccccctgagtctccctacaggtgccaacctggttgtgggtccagcttaactgcatctcctgtagtttcactactcataaaagtgagaagtgacttatttttgactgttgtgggtcttcgttgctgtagggtttttctctagttgccaggagtgggggcgacccttccttgcagtgcacgggcttctccttgtggtggcctctctcgtagagcaaggtctctagagcacaggcttagtcgctccgaagcatgtgggatcttcctggctagggttcaagcttgtgtcccctgcattggcaggtggattcttaaccactggaccaccagggaagccctgacttgaattcttgaactagttattttattactacagctcagacttatgtttttttaactcaaaactagttctaaattatttgattcattttttttttaatttggcattgaaatcatctgtgtccatatatttgaaatcctcaaacttttccatgcctgtctcaaaacatgtctgacaaacaggtggtgttagcctttgagatgggcctgaaaggcgctgggaatgccacctcactgtccatgagctgtccatgagcctgtcttgccagccctatgcaccagctcacagcccccagcacagggcacagcccctgccgtggctcctgtcctgaggcgtgtgtgtacttcatgcttgggtctgaggcctgggaccacagccattctgggagctgccagggggactctctgactgtgtcaggagctgggtcaggttatttttccttttgaagctttaggtttattgcattgttaaagattgaaaattgattttgttttctgttctcttctctccccaccctgctttctgggtgacagggagtcactcccggcaggacagcatggagcccagcgacctctgggacgatgtgtctaattgccggtgtggagaccggctcaagaccctggagcagagggcgcggaggcagcaccagcggtgtctggctcactccctggttgggaccccaaactacatcgccccggaagtgctcctccggaaaggtatgtgctttggctctgcatccaagctgggtgatctccgagggtcccagctcccactgtcagggtctcagtgtccccatatgtctccccacgggagcccaagagtggggttctgtcagcagacaaaccttcagtgtatcctcctctgcttgggagctggcccggcgtctccacttgctcctccttaggctggaagtgatgagctggctgcatggtaggcttgctccctagagcccagaggaattgtttgagggtcaggacgggttcggggtcctcactgggcccaccat

SEQ ID NO: 48392 - DNA, 2203 bp, Bovine  19866880520680
ttctttacagcactggactttactttctctaccagacgtccgcagctgagtgccatttccactttggcacagcctcttcattctttctggagctattagtagttgtcctccccacttcccctgtagcacattggacaccttctgaccagggggagatcatctctggtgtcatatctttttgccttttcatactgttcatagggttcttgcagcaagaatactggagtggtttgccattccctcctccagcggaccacgtcttgtcagaactctccacggtgacctgtccatcttgggtggctctgcatggcatggctcatggcttcattgggttatgcaagcccctttgctatgacaaggctgtgacccatgaatgggttcaaatagttaccagatacaaaagcagactgttttcctgaggctggagagctgcaagttcactcctctgtacactcgcaagttaaatatgggtgttgacgtgtcagtgctggtatcatcttttaattacgttctccaccctctgttcccagacgaagtgagtggggtcaagtacccccctaagctccagggcctctctagagctctgctggcagtgggcccaagggcccctgggcacaagcagtgtccagcttggtcccttcgtcagctctgggcacgtgctctggcttgactgctgggtgctggccagaggggcagtggagcagggccaacgcattaggagaaagtgctgggccgggtttcagttctttgattagactgaaagatttggctgccaattgtcatcagccaaatttctcacactttgcctgatgagtcacttgtgctggtttccaagtggaacagaaggctctgggaaatttgcagtgcttattttagatctgcttcagggagggggctgagtgtccgatgtgatcctggtttgcctcacatcagggctttgtgcgagggactgtggaacgctcttccaagagtaaacagcttctaactaaggcttttacaggtttttttgtacttctctgtgtcagaatttcagattaaacatggtaagcgtgcatcacatatgtgctgaggaacaatgcggaacattgcttcttcctcctgagacatgggctcagaggatgctcttcctcttaagatatgttaccaatctgtttattttggcaagataaactgtgttaagacttaacaaatgatgtctgcaaagcacatgctttgtgaagtgtattgacaggccgcacatgtttctctgggcggagactgtcttgttgatccccctgctccatccttagttggctctgggttagagatttgtgttgaaggcccatggccagctgctctgctgctgctcaaagcagatccagcacttacctggccgctttatgtgtctttcttgagtcctgagaaccagcatccacgattgtgttatagcatatacaatacagatgaaaaataaacaataacaaaatgcccacgtgtgagccctcagcctaactgagaatattactggctgagtaatattccattgtacatctgtaccacatcttgatccattcatctgtcgatggacatttaggttgcttccatgtcttggctattgtgaatactgttgctatgaacacatttgtctttttcagatgtcttttatcatctttttatagttgtcaacatatcagtctttcacctctttggtcaggtttattcataagtattttatttttttgtatgtgattttaaaagggattattataattttttttttttttttttaactttctccttctgacttcattaatgcattgtttccctctcgtgtcctgccgcagagcccgctcattagtttctgaggctgctctgcactgatggggggctcccgaggtgaacatgggctcagggccacgcacacaccccacacccctgactgtggctccgaccacactccagcctctttggcctgtgctcaccccaggtctgtctgcacgaagatgagacagcaggtgggggccaggaccctgtgtgcacatctctctattctgccagccgcggtctgtgctgctcccccagctgatgaagggggaccccgggggggagcaccttatatagatgtagtttaaatgaatttatggggggagatgagcttcgagtccttctcttccaccatcttaatctcccagccttaatcagattcttaagctggttctttcat

SEQ ID NO: 48393 - DNA, 1074 bp, Bovine  19866880555755
cacacacacacacacacagaccaaaaaacccaccccccaatctcccaaactaaacctgtttccaaggaaaagtatataatatattcaactaatcacttttggagcccaggacatcacaggtgttaaaggcatacccaatgccaaagaaagctcaaactactgcacaattgcactcatctcacatgctagtaaagtaatgctcaagattctccaagccaggcttcaccattatgtgaaccgtgaacttcctgatgttcaagctggttttagaaaaggcagaggaaccagagataccttttcttcttcgttctcaaagagcatctcgatgcaaagttcttgtgtagctgcacaaaacaaatgctctggaacacagggcacaatctgaagcattatatgcctcaaacatttaatgtcataaaatactcatttgtctacacttttgaagatgtatctttgatctgcagtaataactctttgtagcaggacgctacaaaggagacgctttgtaatcttgcagattgctatacagatcttccttggcttatgacggagttaagtcccaataaacccatcataagttgaaaacatcataagctgaaaatgcatttaatacatccaacctaccaaacctcacagcttagcctcacctacattaaaggtggtcagaacacttatattagcctccagctgggcaaaataatctaatagcgagtctgttttataataaagtgttgactgtctcatttaatttagtgaacacggtactgaaagtgaaaaacagtgtttctaagatatcagttgttcaccttactgattgtgcaccacgtgagtatctgaccgcacatgctgcccaggaagagataaaaatttgaagtacagtttctaatgaatatgtatcgcttcacaccatggagcagtcgtaaaatcattaagtccagacatttgtacttagtgaaatatttattgaatgccttctacatgtgaggcactatgtgaaccaatttcacacaatttttttaaaaagccattaactgcactcactttacccttttgtaacgaaataagaggtacttc

SEQ ID NO: 48394 - DNA, 1770 bp, Bovine  19866880566339
gacactaaaaagtctggactgtggcagtgacagtgtgcatgtatttactgccactgaactgtacactcaggaatggttaaaatgataagcattacgccaactcatctaatgttcatacccagcgggccagggtctgaccatgctccccctccaaacacagctgtgctgggaaaagccggacctcagccctggtgctgacacagtgcacctcgctcacagatggaggtctgaacgcctggaaccccctaccccacacggaaacacaacagggagcagctccccaaggccacacacccccagatacttttgagtgcctgtgggtcccacaaacattccgattataaagccaagcagtgcaggagagaccggacatatttgcatttacacatgagctaagaaacaccagggggaggtgggtgcccctgaacggaatccaggtcagacgtagcggtgtctgtcctttcttttcctccccctcaacatttcattatgaagattttcaaacatacagagaaggtgacagagttattcagtgacagcccctcaacctgcacctggcaaagctccttgtgcagagggggcgggaggaccccgctccacgctctcatcctcttcccaccgtgctcccccaggcacgcctggcttcctcggtgatggtgccagacacctaccagcaggcctgtcctgcctgaatcactagggaaggatgaaactttccttcagtcccacaaagaatccaagtattttctcagcttgagaccttgtattttagactttagtttgatgacagttgatttcatggcaaaattatgaacttctgaaagcatttttcatgagaatactcatcagtcaaattacgattgcagctggaaatgagcccctctgacacactacagtatcattttaataagcgctctcatccagaatttcaaaaggccctaagggcgctatgacctagggtctcaagggtcttaaaaaaatgagggtgggcctccctggtggctcagtggtaaagaatctgcctgccaatgcacaagacatgggttcgatccctggtctgggaagatcccacatgccatgaagcaactaaactggtgtgccagaactattgagcctgtgctctagagcccgggaaccgcaactactgagtccatgtgctgtaactactgagaccctgtgcctagagcttgtgctccgcgacaagagaagccacccgcacacctcaacgacagtagcccctgctccccacaactagagagaaaatctgcacagtgccaaaaacccatcacagccaaaaataaatcaataaaattatacaggcttcccaggggcgctagtggtaaagaaccggtctgccaatgcaggagacataagggacgcgggttcaatccctgggtcaggaagatcccctggaagagggcatggcaacccactccagtattcctgcctggagaatcccatggacagaggagcctggtgggtccagttcatggagtcgcaaagagttgcacatagctgaaacaacttagcatacattcctggtggcgcagtggtttgaattctttgttttcactactgaggccagagaactaagatcccacaagccacggtgcaccaaaaaaaaggtggggtgggtagcaaacaaagcagtctaatgttgggaatttcttgggtatcatcaacggacttaaatttatctcagaagaaactataagacactggaatttaaaaattgcaatacaactcacaaaacaaaactcattttcaaat

SEQ ID NO: 48395 - DNA, 1504 bp, Bovine  19866880589615
gagtcgtttatcctgagcaagttgcaagaaggcccgttttttagtgtgcctagaatcagcatctgggtatctccggctagtctagctatcttcagccgtgtacaaagtgccccgccccgctctgctgaccgtgttctgcttgtttgtgcagccgtgttccgggtccacagcatcggggcacagtcggggagaaggcaccgagggtggagtgaggcatcttacctctggggtctgacacaggctccagcgggacctctcgggtttgggcaggagaacacatcccctccgcgtggctggagagtcctcgccagtggcctcagctctgtaaagtctttataaggcggctgatggctccaaaggtaagtgttccagcctcgctcacggttagagaagtacaagtcaatatctgcaagtcatgctttgtcatctgttgaactggcaaagattagtttgaagtttataatagtctatggtgtcaaatgtacggggggtgataggcactttcagctgtggtatttgtggaaatgcaaatcgtacagctcttctggaaggcagtttcacaatatctatcagaatttaaaatacacactccctttgatccagattttatctgtcccataaatatctaatataggtattcaaagatgtgtgcctgtgtgtttattgccgttgcatgtaacgtcaaaaactgttcttccatggacgactgatgagttatagaggaaactagtcatcatttcgtccaccaataagaaaagatgaccaggatatattgaaagaaccaagtcttgcataattctgtagatgatgatcccattttctgtttttaatagacatatagacttctcttggagagggaaatggcaacccactccaggatccttgcctgggaaatccatggacagaggagcctggcgggctacagtccatggggtcacaaggagttgaacatgactgagcatctaacattttcacactttcactttcatagacttctctatgcctagaaaacatctaaaaagatacaaaggtagttgcaacccagtgttatctctgcagcagggcactggaattggggatatcttctgttcttcagttcataacccgcttctgtataattttaatttttttactatgagcatatattatttttataataaaacagtaattttaaaacccagggtggaagacattcatttattagggctccctttgccagaaacagcctatataaatggatcagcccctgttgacagaactttccccaccatcgagaacaggtatcaacgacttaacaaacagtgaaggtaataaaaatttcaggaaaaccaactagaatctcttgggggataagtctctgcctagatgagtttttcagcccagtagaaataggaaaaaatatttggggaggaaagacactttctgagttgtcatctaatgctgtgcattttatttttatttttttcttttgaactttttattttgtatagccaattaacaatgt

SEQ ID NO: 48396 - DNA, 1258 bp, Bovine  19866880689880
gaagtgttataaaacactagattgtcaaggatgtagataggttttatgtcttttgtgatgtaggttttaggccttgtagataagccccaaaaggaggttaggtgagagtgggaagattttcaataccaaggaaagaaattcagctggacttgctggattattgataaaggtttttaggtaagaggtagtataaatgatatgtgaattggtaatactaccctatagacagcctgccaggatatttgcagggggaagtgtctgaaagcagaaaggccaactggaaggctagtgtaattctctatcagggaaagcaccagagtctgagccagagaaagaaaaattaagaaataggaaggctttgcaaaggaagaagccgcaggacaggacacagaatggataaatgcagtgtaagtcaaatttcaaccacgagttccagagagagaattgagtgatacaacaaccagaaatcctctttgagttaatgtaaatctgtccctatggcaccaagaacctgtggttccccaaatggaaattacggtggcctttagaagtgaatcctactttccccagttgttcatttaactagaatttatttagtacttcctatgtgctaggcactgggcttcccaggtaactcagtggtaaagaattcacctgtcaatgcaagagaagcaggagctgcaggtttgatccctgagctgggaagatgccctggaggagaaaatggcaacccattccagtgttcttgcccagagaatcccatggacagaggaacctggtgggttacagtctatgcagtagcaaagtgtcagacacaactgggcggctaagcacacgtgtgcgtgtgtgcacacaccacacacaggagctaggctttaagaaaccaaaaataacgaaataagctccagactccctaggtgttcatcacccagttccatgccttacaggtaattattttggttttctcatccctaaaacatattaattgaacagccactcaattttcattcatgatttcccccataaccaattattatgcaactatctgtgttgttgggtgttgtcattatagacatgcctgaaccagctaagtctgctcctgcccctaaaaagggctctaaaaaagctgtgaccaaggcccagaagaaggacggcaagaagcgcaagcacagccgcaaggagagctactccgtgtagcaagtccatccggacaccagcatctcatccaaggccatgggaatcataactccttcgtcaa

SEQ ID NO: 48397 - DNA, 1028 bp, Bovine  19866880697903
catgtagacgaagggagtgtggctctgtcccatataagggccgagggatgtagtttgctgatgcctgtcttagagttttattgtttgatcctatatccttgggagataaaaggtttacttgccagtagaatgaaggaaagaaagttataaagaaacttttatagcttggtttataaaattaagtgtagaagttttttggaatcattttaacttagttttttgttcactagtccaagacctccctggcgtcgtcaatgggaagaccgatgacaggggctattcaggtatccccatgtgtgggtttgcatcttgggcctttcttgtgatttagaatattattaccaaagttttttttttttaagatattacttacatagtgaccctgattctttaaactgtgagctaatatttgaactgcttgaaatctttggtggcagtctctggatttatcactatttactcaggtctcaagtgaaatcccacagggaaatggacataggccttctagtttgtctgtaggatggactctgggacccggttctcctgcgctgtcatttccagtggcttctatggtttctcccataggcctacaggagaccagcccaaagtagggagtagccagctactaagctatataaggtactactgaaaacccaaaagagtgtttttcttttcaaactgggagtaagtccagttcgactgaaaaattgaaattttataggacaaaggaaaagttcagacaggttgacacgtgaggaggcagaagtgaggaacagtagggagggattataaacctctgttcaagactggggttttattaagatgtgtatcatgtgcagaactgtaaataagaggtagatcatatgtaagaacactttttaaatgattcttgttctcctaaggatggagttactagacccatgacagcagtgagagccgctggctttaccaagggagctttgagaggtttgttacattatttcagctattaattttttttcaaatcttttaatttttaaactgttttt

SEQ ID NO: 48398 - DNA, 1648 bp, Bovine  19866880740588
atatatatatataaattataatatatattttaattaataataatatatttatgtttttgtttatgttttcttattcctgttccatcttaacaatgtcttctcttttatcttttagtttattatttgactaatattaatcttgatatgtgttagtcactcagtcatgtccaactctttgtgaccccatagactgtagcctgccccgctcctctgtgcatgggattctccaagcaagaatactggagtgggttgctatttccttctctaggggatcttgccaacccagggattgaaccctaatctcccacattgcaggcagattctttactctctaatcttaataaataagttctaatatgtctgtttctaacacaatcatatttattcagaggtaagtttgtttctcaagtgtcttgcttttatctgtgagttcattttcctttagggatagaagcccctctgtctttccatgttgatgaaggaaaattagactttcacatcaatgtgcttaagggatttggaggcaggaggacagatgagtctcagtggaaaatctcagtgactaaataaaccattagtcatgacctaccctattacacaaagccttagataaatggcttcaccttttaccttcccagaaaaatcagcattaggacagacaatccccacaatagattatatttaacaacacaggacatttgaaaacagtgtggaaaagtggctgtccacattttttcttcatctgtttttgtcagctctcttttgtcagggtttctgtgctgttctgattttattcttgaagacacctgtattggagttctgagaagtcacaggagccagtgctctttgtccccagatgattttatgggagaacttgaagaactgccatggaccctcctactgcttgctctcacgtttgcctcttaccccgttaaaagcaccactcacacagagcagtgcaaacttctgtcaccatgagattttcttatataacatttctagtttgatttgattttaaagtcatataaaatttcagatattacgtcaaacattataatggcacactgagcttgtatataataaccagccctcagtccaccgaatttctcctgaccagctgtatcccatacattgaacttaataggtcctctgttggtatggaacacaattgtgttatgtggcaacaaagtggatattaaggacagaaaggttaaggcaaagtcaattgtcttccaccaaaagaagaatcttcagtactatgacatttctgccaaaagtaactacaactttgaaaagcccttcctctggcttgctagaaaaatgattggagaccctaacttgggagtttgttgccatgcctgctcttgccccgccagaggtggtcatggacccagccttggcagcacagtatgagcacgatttagaggttgctcagacaactgctctcccggatgaagatgatgacctgtgagaaagtgaggctggggcccagcattcagaagtctagttttataggcaactgtcctgtgatgtcagtggtgcagcgtgtttgccactttattatatagctaagcagaacatgtgcttaatttttggatgctgaaggagatggatgggctttggagtgaatgtggcagttaaaaaaaaa

SEQ ID NO: 48399 - DNA, 1581 bp, Bovine  19866881026248
catccatgttgctgcaaatggcattatttcattgtttatggcagacacatatgccactgtatgtgtatacacacaccacatcttctttatccattcattcactgacctacatttaggttgctgccgtgtctcggctattgtaaacaatgctgctctgaacacagaggtgcatatacctttctgaactagagtttttatattttctggatttatgcccaagagtgggattgctgggtcaagcagtaactctatgtttagttttttaagaaacctcgatactgttctccacagtggcttcaccagtttacattcccaccaacagtgtaggagggttctgttttctccacaccctctctagcatttatttgtagactttctgataatttgtagaaaggtctactttctgtagacctctgtgagggggtacctcactgtaggtttgatttgcatttctctattaattagtgatgttgaacatcctttcatgtcccttaggaatcttttttaaaattcttttctcccgttttggccgcacctcacagcatgttggatcttggttccccaactagcgattaaagccaaacctcctgcattggaagtggggagtctaaagcactggaccaccagggaagtccccagataataacttttgaaccagatttctctgaaaggaaatgtaccctctaaccaggccaggaaaaagtctgagttggcagagtcgttttaagtcataaagtaacactatacaccaaactgatggattatttcaggagcattaaaatggcagtcctttctgctagcaattaacataaattaaatgctgatgggaacttaagggtaccccaatacttcattttactatatttgtgttttaatgtattagaaacagtacccacttcattatttcctgcactgcaattatcactaatggattttaccacaatgagatccctcctaaattctggatcatttgcatgatttgtttctttatatcacaactgcaacaacagctcttttgtttgtaagtgacttacaggaggaggttttcagctctgcagtcaggctgagtctctgtactctcatccactatttccccgggatggctggctccttctaaccatcacaaccatctcacctgtctgtcagggggcagcagctggcagctgaccttgcttcacatgctcacagacagaacggtcgagcctctgctgtcacttgcactaaccactctgcacccgttgctcacagccctgggctggaggggagcagctctcaacacaacaaagctcatcacccacaggagagttcccgcatggcccagaggctccaggaagcctgcaagcagcaccactagtctcacaaacagatcgtctgaggaatgtaggttctctggtaagaaactacaagagggttgacagagcttttagaagtaaaagggggagttcttttctcccaggtcctgggactctgaggccaggagtgcataattaggttatttctaaggaactgaaggtgctcaagccctcctgaggtgccttgagcatgaaccctgctcagtccccaaggagcagaagtgcccag

SEQ ID NO: 48400 - DNA, 731 bp, Bovine  19866881057612
tggcatttacaaataaattaactttctcaagggaactgcactgtgcccaggagaaattatgaacagtaaatatcctagaaacttatgttcccctagttattaccagactaagataacttactgtttctgctcttaaaatattataataggaaataccccagcacattccctgcccacctcttctaagagtcaacagtaacccttccttcactatttccttcttgagctccggtaagaatataaggaattaagtatccagtctcgcactctggagtctgctatgttctaaacagctgctgtctgatttgtggtgggcagtaagttgcattacagtgctaatggcttggagagttatttcctatataggcccattagcttagttttattccaactgatcacatatcatgcctttaacctttagcttccatcatacaaatgcatgcaagggtcaaaccaaaatattacagctataagaaagatctaacacctctcatgtacacataccacaaagtactcagtccactggcaacatgtcagaagagtgactttgtttctgaagaatgacaaattttacaaacttacctcatttctttatggacacttggaatttgatctaaggccattcggtagaatttaatggctttggaataatttctttgctttaaataaatatttcccatattcactttcaaccgtcctaatttaaaaaaatattaatgaatatataatat

SEQ ID NO: 48401 - DNA, 1889 bp, Bovine  19866881094401
ctccccagccccattgtgtgcgggtggctgccgctctttgtggagatggggttgggttttatcacagcagcacctgtggaggctgctggggcctgaaggtaggtagcctgctttgctgctcaattccctgttggttgctttaaagccaacaaaggttgatacccttggacagagagagaacagttacaatgctaaaattagggtgggaatttgactctgacattgttcaatgtttgccattcactctaggaaaactttgtatctcttgccatctgtcaacctagtagtgacaggtgtttttttttacttaattaatttttgtctgtgtgccaatatttgatgttcataggaatttttctgcaggataagtgaaaactcatattttgtagcattggtttgcatttattattaaccgttctgattttgtggtgccaggcagatcctgtaggctctaaatgcagttaggatggtgagaacctttctgaggatgtaagttggcttttcaatggagtgggtctccgtttagggtcgtgactccaggcggtgatcttgagctggagtgctgaggactgcctttttccttactcattaactcagtcctgtcctgcttcacaggagtgccgctcctgtgttttcattaaattgacccagagggtaccccccccacacacacacccacagttatctccctgtctttctcttctgtgttttagccttttcacaggaagtcccaggctccaggaatagcttcacacttcctccgtccaatgtcagccctttcccctttccagctttggtgacacgaccctttctctgagaggtctttgaataggcctgatcactgggattccggggacagtgaccatcacctctgtccacagcagtggctcaggtggtcagagccctggccaggaagtgtctgactctgggaaaggagggtgttggaaggaggcaaggcttctcagagtggaagccctgttggggtgtggaaagaacacaggagattcacttgctgggttgcttgctgtgaggagtgctgcacagaacagactgcacgtttatccccggcctgctcattctgcatggtggtcttgggtacagacttctatagctcgatggtttttatgctgttattcataatgtgtgtgtctgtgtgggtatacacacacgcggatatctgtgtatatatatcataccgatgtcgtgtataaagccaataaggcatgtggtggtttctttttcctgggtagaaacttatttggaggtgaggctctatcctgcctgggtaacctgacataccgtctagcacagcatttggcacatgtggaagacctctgtgccctctgaaaccttgtgattgtgcccttgattggaaggatgttttcagggaccctccaggtgaggggtggccctggcatggggtttcctggctggggcagccctggagtcggccatcagcgtggtggtttatgattctggtgttcaggacctggctggaggcctggcccggctgcctgatctcatttcagctttgctagttaattatagtaaagatacgatttaaataataactcgaattttaggtccaagaaacactgtttaaaaaaaaatgccgtatgtcattagtgtgggtcccacaggacgtgggtttcattggttccctggtcggtgctgaatgtgtgcttggcagccagtgaagttgtgaagcacttgaaggaattagaataaaaattcttgaacatctgataacgttttccaggattggttgaaggatagaattgagtttgatagggccacattaaggtttgcttagaatactgctgtcatattgtttttagtggagccgcctgtactcaggataggccttagccatcgtctcagccccagat

SEQ ID NO: 48402 - DNA, 1381 bp, Bovine  19866881291183
gggtgaagggcccctgagagctccctggaccgttttgcagtatttctgtgagtctaaagttatttcaaaatagttcttgcaaaaccctcctctgagaaagggaaataaagagtagtaatcaagatgtgggttcgatcctggcttaggaagatcccctggaggaggaaatggcagcccactccggtgcacttgcctttagaatcccacggacagaggagcctggcgggctacagtccacagggttgcaaacagtcaaacaagactgagcacatggcacaaatgtcaatcagtgtgaaaatagcccaggtatattagaacataggaaagcctctagcagagctgaagaaataaatgaagttctcagttggattttgcttttgaagggcagaacacttaacagcagaatagcacaccatggacacataccagcctttgagaattgtcatccatcctgagaagggattgttgtttactttaggtgcttacttgtgttgtttctggtggcttatttcaagttagaggacctgtagatcttcagatacttggattccaccaacatgtatgtaatgacatgctcactttagcagcacatacaccagcgtttatgtgatgattcatttttcattttcagaaccccattctgggtttcatgttgcatttaaaatgctggatgcagatggtgacgagatggttgagaaaaaggaattttttaaggtaagtaggttctagttatttttggtttatcataaaacacctgaaggcttgtgtggtaattctacatttctattaagatgaaaattatatccactgccaatatatgaagtgtcaaaaacttctatatacattcaaaaatactaaaattgctataatacagccttgaggaaacagttacagaacaggagtaggattctggaaggggaaatgagctgaagcgcctgcattttgtagcattttatttttatgatttcagcaaatgataatacaacagaaagggcttcatagataagtaaaaaattgttgttacatcccaccaaaaaaacagaataagaaaaataaaaccttaaaccttcatgaagaatatgagggaaaatgaaaaagccacaataggtataaattggtgcgaattttctagggatctgtgcaggctcgtaattgaaaagctgaaaatatgcttaaattatgtttctcaatacataactctgtaacatggccgcagtaaatctcactccactccaaggaagttggcagtaacgttcagaagtgcgtcagtgcatgtaaacagtagggagaatgctaggcagagctcggtgttcttcatctagaggagcactttatggagaaaacacctcagctctttcatctgtgcttttcttccagtctc

SEQ ID NO: 48403 - DNA, 1101 bp, Bovine  19866881340816
aacctgtgcaatgaaaaatacgatttttaaaacattaaactgttaagcagacgtcaggaaaatgtttgggaatttatctcctttattgttgcattctctcgttgggaataaaatacccatgctttactggaagagtcttctttcttccctttggagttgctgtaggtcttaggtgagcgactggtttgaattggtttggttcacagggagtgttcacagccatggtgctgtcctgttattttccgtgcctttgtctctgtctgggcagcaccctcaggaatgctgtcctcgtgttttcagtgctttttcgattcttaaccactcttgggtatcagtgtgggagcaaaacattttggtatctgagagcacagactatggagggttgaggtgggggtggaacaacaaagaattgctattgtttttcagtccaaaggattaatgtgaaattgaatggtaggagagaatcgggccttgtttactaaaaaagtagttcacatttcttgaagaattgatcacttgacaattactgaatccttactatgcaccagacactggtctagaccaaagcagacagaggctcccgtcttccagctcctcattcgcaagagggagaagcaggaagccggggaattgttggccagtgtaggagctgcgggaagcagacagggccacgggcagacctcacggctgctgtcatgtcacgagacgtcacctgatgccacgaatgtgggctttacctcagaggtacagggtgccctgctgttttagaaataccttccatttacttactggaatgtgtgttctcagtgcttatatccattgaaatgaaaagcaggaatcaaattaaacataatatgggctaatttagaaaaagaaaacccacacttatcttagtcagatacatacatctttgtgtatgttttttaaattgcagtataattggcctccaatattacatgaattacagctgtacaatataggtgattcacaatctttaaagtttatgtaacatgtataggttaggagattttggctgtattgtcagaattttttttaataaatgtgtttaatttatttaaattggcattacattttgcttgg

SEQ ID NO: 48404 - DNA, 924 bp, Bovine  19866881715165
cctccagtatgattttcttggggaccacctcaatctgtatcagtgggagaactaattattagagtatttaattgagagtttctttcaggcacttttcgagaaacaattgaacatttgaaaattctctggaactgaacactgaagacagtggttgcaaagatccaaatagaccagcccagtcattacaaaaattattttcatttattcaagcctttaaaataaaatattcatttaatgggatactcacagaggcaataaaatacataatttaatcaggctttcaaacccatttaaaaatagagaactttcatttgagaaagctcagctatttttcttccctctagcacattagaaaaaaaaaactgcaactcacaagatactacgttgtgtaagagagccaaattctgtttgacttacatatcttgatgaacagggaggaaaaaatctgcttgctgcagctgctggcatccaggcccttgactttgggcgtcttgaaattatgatatgaattcatggcatgtctttaatgcatctgcctgcttcccattttatgagacaaatgtaggaagaacttgacagacagagggaaaagtcttccttttgcaccatttggaacaatagtctttgaccctccctaataggaagattggtaaaacctcctcccctactagcctttaaacaaatccctagttccttttaatatgtttgcttgacaatggaagcatacagaggactcattcaattgtaaatgtgaacctagtataacgaggcataaatgggacgcatttcaaagcagagtccctccccattgatactcgaagagctaagagctgatcctataattcatgatcctgtaatgttgaagcaccagcttgacccaaactcacaccaaccgaatgcaacaggccctggaaaccaagacgt

SEQ ID NO: 48405 - DNA, 1207 bp, Bovine  19866880350497
cttgctatgtcccaaaggagatgcaatcactgttccttaattgtttcagcaccactatttttttaaatgttcttggctttaaaaagttcttcattgattacctttataaaaatctggcccagtaagtagtttataatgaaaacagctttttcaaaccatacttcccattacagtttagcttatttgtggaatgcttgtaggaaagataattctaaacacatttgtcttatgctttcttacccacatttactggctggggaagaagtacagtaacaggcattgcttgagctaaaatagcaataacatcctcctcagggctcccaaggatgcaagttgtttcccaagttgtttcccagctatgactagtcagttctcatgacaaatcgccgtggagaagcaaaaaccatggaacaccattaaatgtggaacaaggacggggggaaacagtcatatatacaaactgagcaatattttagctttaatgttattacatttgagtaaattatgactccaatttttaaaagatttgaggctccatatatacacaagcaaaaagctactttactcataatgatactttaattttataaaattcttctctaccaaagaattcaagccaattatgtattcctgaaatatactaaccccactattttcctccaggctctgaaatttcatttatgaaatgtaataaaaacaaataaattccaagtatgagggcaagtttcagtattcaccctttgaaacagtcctttgccaaagtaataagattaataatctaacacatctctgcatattagactcatccgaaaagtaagctgtaaataaacccaatgcttgcttgaaggaggtgtcaagaatattaatttataggtaaataaacaaattaataagagctggaaacttttacaaacagaacagaaaaataagatacacggatataaacacaaagcacaaaaaaggcttatctaagttaccttccaaagacgacattctaaaggcaactgtttggaattctgaacgtatttttcctttcaaaaatggtcctaaggcagtggcaagacctaaatggggcttcttatcaccaattctcagacgctgatgactctgggttagtaagaggactcatttccccacagaccacggaacttttagacaaggaattttacagtttccaaggcctgagaaatccctcctttcaaagcca

SEQ ID NO: 48406 - DNA, 1493 bp, Bovine  19866880485305
ttgtgatccctgcctttgtaccttgcacagaatattccggctacagtaaagaatccgtgctcttcttctaaccgaactaaaaagacagcctgtttgctttgaaaaatggctaccacctgcaattaatctgaaactgaaaacaagcagtataatgacagttagcaagttaacagccccctccatgactttcctgaaagaagagcataagtgacattccataatcttctcaaaaataaaaataattctcagaaataggtttttattttactaataataaactgaaaatgacatatgagattattaaaaccagacactgtgctcctgcagcgtgacaagcctggtataagcgctgtaggaattccctcccaggtccccccatcttttgcctttattctttcagtctggtgtcagatgaatacaagcagtaatgatgatacgatcaaggaagaactgacaactggctgaatgtgtataaaaagactgtttagctggtctttgcaacaagccatcttttgtcctgcaggagcttccctgcacctgaggtagcctgaaccttcaagagatgaaatgcaacataaaattgttaattgatctattctccaaagagttcctggaacactttggagaatttttccaatctgtttgatagaaagacctggccgccaacttactaagttctaactaagcatacagcatgacctaagcagactacacacaattcacgaccatccataaatgatcctggggcattctgaataaaccaaactctatgcacgctaatgtgttgttaaatgctaaaacaattcacctatgggaagaacaaaataaacgtaatgtctctattcatttatttgacaagcactcaatgaaacctgttttatgaagatcctgcgacaaagatggtagaacacaatgagtaagtgagccagctgcatctcactcagtgagcaccaatcatagtcctaaagctccagttcacatacagagcgataaactagcagccatccattcctgtccatagatgctgtgtttttcaagaacttacagagtggggtggagagcagcccacaggttgtataaacagccacaataaaagacaatatatgataaagacagtgaatgctgcaagggaaataaaagatgtcatcagctggactggaacttgaaaactggatgagtagcatttagatgggcagagactgagtcaaaggccatagcaagaaaggggacaatcaagagaggtccagaggagggaagacaggaggcctccgcaggtgtatcagttgaagagggaattacagtaagagggccagaaagtaagtggaaactgggctgcaggaagacttaattgtctggctaagaggtctggacttcatcctgcaggccatcagggggcctctaaaggttgaatgcaatgaacacagcattttaggaagattaatcttggtaaataggacggattagaaagaggggagaatgccaggggggaacca

SEQ ID NO: 48407 - DNA, 1160 bp, Bovine  19866880554520
tagactactagccctactactactaggaaatccacagattctcacaaggaacatgactctgtagtttaattatcctcattaaattgtacttccttatcttgatttttttctgattatattccttattctcttactagcccagccacactttaaaatatgttttatgttttatacagaatttttagttgttctgtactgggaagatattctctccttgtttatcccaacatattgccagaagcaaaagcacctgtttttacacgttatactccttgacttctaagcttgatgaacacttgtcagagatgtagcaaaagtcattgttgttttgagcaatgttactagaatcttgttctcttgatattaaaaatgtccctctttccctcaagaccatctaaccatataagaaacacaaagttctttgtgtaaaatgaagggccaatgtggctgaaacatagtaagaaatgggaagagaggcatgagaataagttggagataaagactgaaatcaggtcgtgaacgagtattgtggggaactgggtttcattgtaagtcatagaggaaatcactgaagggtgttaaacaggaaaggaatctgaactaggtttatttaaagaatataaatgagaatgacaggttgttggaggacagagaggaaaagggataccttttcattatccagataagaaatgtaggtagcttggagtaagtagcatggtagccaggagatgcaaaagtgtacttaagtataatatctgttgttgtgtaactaattactccaaaatttagcaacttaaaacaatcaacactgttagcacacaatttctgagcaccaggaatctaagagccacttgtctgtgtggttctggctcagagacagtagtcaaactgttgtctggggctgcagtcatcttaagtcttgactgggctggggaatctgtgttcaggctcactcatgtggtttctggaaggctcagttccttgctgcctgttggccagaggtttctgttgccaaaggttattcataacatggtagcttgcagcttgcttccctcagagttggggtgctggtggggagaacaagatggaagtcatagtcttaatatatcctagtctctgaagtagcatatcatcacctctgtcatatgctatttgtacag

SEQ ID NO: 48408 - DNA, 4838 bp, Bovine  19866880584962
tgaaaaatgaaaagcacttaaatattcaagttgtcacagaggacagctaaaataagtaacagatgacccatccaacggaaggatgggagttgtttttagttatgctttttctcttgaaggaaaagaaatatttacatttctttaagatttagtccttggtgaagagatttaaaaataaggacagtcacacaaccgtttcttataatgttccaaactgtaccagttctcctctaaaaaaaataaaaataaaaaaaataaaaccctggcattttcacaagctacaaatgtatccacccacaaggccaatacagatgaactaatatatattaattttttaaagagggaaaagcttttaaattatgaaggtaaggactgcaaggagatccaaccagtcaatcctaaaagaaaccagtcctgaatagtcactggaaggactgatgctcaagctgaaactccaatactttgggcacctgatgcaaagaactgactcattggaaaataccctgatgctgggcaagactgaaggcgggaggaggatgagatggctggttggcatcaccggcacgatggacgtgagtttgagtacctcctcaaactctgggagttggtgatggacagggaagcctgacgtgctacaatccatggagtcgcaaagagtcagacacgactgagcgactgaactgaactgaaagctcctggtgtctctgaaattcttctgctatttgttaagttgagtcaatgttcattttttaatgcactaaatatttactgacaaccatctcctaagagcaaggtattaatagctaagggaaatcgctaacaaaacaatttttaagtagttacatgactctagtcctcataatccagagggatgtgatattcatacgaagaaagtccctggaaaagcagatgatctaaagattccatgtttacaagagaacaattccatcaaagcaaaagttaaaactgttgggaggctggtagagacttggactctccatcagcaaatatgactaggaagcagtcatttatctcaattgattacattaaaaaaaaaaaaaaaaaaaaacagtcaaggaagaagtaaagttagaggctactgtcctcattttatctatcaggaatggtatgtgtaaccaaaattacatatagtgcttattggcgcataggtataagtgctaaaccagatcaggccagctctcgggttccaaatctaaggcttgggattttaaaatactgtagtattttcaacactaagcaataaatggtactctgtaagtactttcaaattcatggtttcctctgagtatgaaggtattgtatttatttaacagtcacacaacaatgaactgaagagactcaagcaaaaatatgatcctatgcagatggaacacctatctcagggtttaatttcctttcattgattttgtgcccaaactcaagactgtgacaatggttctctagagtccagcaatgtgtaaaaagctactcaggtgaacagaaaagtcggtcttaattttagggttaaaaaaaaaatctcagctatgaaatggagaaagatttcaaaagtggcaaagcgatcacctatccatttcaaagacatgtttatctttttgtgtttcaaaggaaaggccttttgaaagatgtggcatagaaatatgcatgtgaatagaagcacactaaagtcttagctttcaggtataatggctctcccttagaaagtcctgtgcaggattcctgaatatctaaggtacatttcatacgctgccaagtacaccaagggccctgcggtatcacctctttccagcttttatctgatgattcattaacattttcctgcattatggccctaaaccctactactacttaaaagctgcactcctcaactgcacaaatgtattcattcatgtggtactgaaacataccagaatgtcttatttgtatttaaaataaaagggggtggggggtgagggagtggtggaacggggaagaaaagataattacggaagacccagtaaggcaatctgatagtcttcttctagaaatattcatgaaaatctgtccctgaaaactgctggtatttggtagccaatcttttccacacgattttctgagaaacattcttagaaagatcccacaatggggtgataataaaatgcacttcgtcaaatgattttttttttttttttgggtctggcacggagtctctctctctcacatcttcactgtagattgcaactcctcttcttccaaagccaatctcactgcctctgccttagtcacactgtgccttctgtctcgtacaagtccttccaaactagacccctaagcaaggacgcagccatccccggggaacaaagcatacagtcttccactggcttccataaaggcagactttggggattcagagttgaggttcacaaaagtgttatgaagaataacatattcagcccacagggaagaagtacttgtaaaacccctgtgctctgaacacatctcaagggaaagagactggatctttactaaaaaagacaaatgtgaaatataaatgtaatctggggtaagaaatgtgaatttggcctggaaatgatcccttttcctagcacacattcacagaaattacccagcaaagaatgtcacccataaccgggctgagtttgaattgcagcttattgctcagtgtgacccaaatggaaccagactaaatccatcagcagccagatgcaaatggccgtgtgctgggcttagtttcaacaggcattctctttgcctggtgaaaagccctctctccgaccagaggataagttattaagaaattgtttgtcatctcagattgggtggatcatttgtttccctgaattctttttctcatcatttactcattacacgcctcctcctgatggaaggagacatttattagcttctgcatttattgcattggcaaacagaaacattctgctgcatttcctgggggggttcgctcatttatctattggataagagactgaagttttctacagggcagaaaaattaaaatatcagtcaggttgacagctgggaaaatgaaggtctctctgcgacacgaagctttctagagcttttggtttactgagaaagaagccagaatgttgtttcatcaaactaccacttcatatgtaactaaaactgtaggcactgtctggtgaaggaatactccaaaggaatgatacatgtggctcaatacactgtgaagtacctgagatgcaaggctaatttttattttaaatggaaaatgtaacaaaatgctctcgaagatcaatttctgtaagaagttggggagctagagagggaagacggtctgcttaaaccaatgaaaacggagctcgaatcatagaatttaaagctgtaagggatcttacaggtcatggaatcctcttgcaagaatcttctttgcaacatccttgacaagcgatcactctccttctgcctaaagtactgacggcagccaggagatgggcatatcccacagagcagctgattttagaactgaaacttctgcttaacaggggtcactccccagggtgacctgattgcttgtgaccttgggcaagccactcaacctctctgggtcttggggtccttgctttcaaagttaggatggtgacaggatcagagctgaaggaaggggaggtcaccaagaagcttgacaacctcaactcagtccaaagaccactgggtctggtgttccaagatcccttactgttcttggaggcagccaccccacagcagagccagcacctgccagcattttccacactgagatgtgggttattctaatccggatactggagctcatttagagtagagctgtcttcaattcttttctagttcttttttcttatttcatctctggcttcaccccccttgaaccaacacttgctatacacctttctttcgtgacaaagcggcagcaatactgagacggagctttctgctgaggctaccagccctagacacaacccctcaggcggctggcctaccccagtcctgccctgatcccccgactctctcatagcaagctctggggcttagctctcagttcaaaaaaagcataaagagcctagtactgtgccagcacgaataatataaagaaaaattggtatttagtcttttgcacagttagggtttatatatcagacaactccagctttcctgataaaaatattcaagtccaattgaatcattttggggttaagaaagaatacaaacactaacaagtatattatttttacaaatcagtaacatctcttagctaggtattcataaagacattttttcccctaaacagctcttaaatctgacctggcagcaccctgagcagctatagtgttctgtgcactgacatttagttcaacaagaatcagagttaagtcattactgtggagcctcaggttaccacctggaagagatcctcatttgttaccatgagtgcgttactcacagtcggtgaactcaacggaagaaagtgatgcagtgatgtactcgataacttcactaaaagttcccttaaatgtccaactaaatcttagaaacctgcgaaacatagcaaatacaactttccaaagacttattcgtgtgctcccgcccagtatagttaatgtcaacctaaagccagaggatgtgtcattaaaaaataaaaattacacattagttattatgacctaggtgctacagttcccctcatctgccttatcttctatataaccaactcagattaaaaaacaatacagaggtgagtcacaggttaacaattcctacagatcagatctggatacaacagggagataaataaaatgttt

SEQ ID NO: 48409 - DNA, 1568 bp, Bovine  19866880672068
attcagagagagggtgagatttgaagatggaagatctgatggcatgtcagctgaaaactgttaaaaaggttttatgatcaaaaggttggtggggtaagaagatctagtttgtagttaagagcagaaaaaaaaatttagtgactgtgaggccagtccagtagattggacatccattgtagccagaaaagagccaaagatctaagacagccggggaccatccatgccatagttgcaagcttttttctgcctccttactcttaacattatcaatatagtcttaccagttatggcttcattacttgcagtcttgctcaaccagcctatctcatcagggcatttaggctgcatgtgctttcactctcatttaaaatttcattttagagtgaattaacttctttgaaatatgaaccaaggagttttaaatttgttgctggatttcacatgggatacccaaacattttaaatacatttccagtttttgcctgattttcttttcactggcatcagtcaataggtgaatttttggttttgagtgaagattactattactaatgtaaatttcccatttttattatgaattctgaaataataactatttcctcactttactaccgcatttcatctccccttagtagttttgtcagttttattcatctcagggagagaacgtcagatgctctaggaagtccaggacaagggacaactgattcacacataattcacaggttggtttctttcttggctcagtgttaagtatatgtaagctgtaagctgtgatcttgtaggatcccaaagtcaaccaattctttttttttggatgtggtacattatgtctggaaatttagtattgattattgtggtttctcttgcttgatctcagtgcaaaaggactgggaaagtagcatgaatcaggtttgccagttagctctttttgcttgcttgctttgtgcgttggtttctagagaacactgaatactctgtctctttcatgccatgctgcaaagatactattgacttaaaagttcgaatattgatgaaaaacactgtgttagaaattactaagaagaatatctacaatgtattatacagaggttggtgaagtattggagtgaaaaaactgcgtcactacattgattcttttggggtaaggatggggactacaatcttaaaggaaccacaacagaatctttggttgaaacttttctaaatatgcatagtccatgtcctgaacctctgccatagccatcactcctgggattctactttttctttatcctactttgaatcactatatatactcattatctgtaactgctgttaggattattatgattattgttagatacaaggtgaatatactctggggctaggagaccattgtaattggttgcctagctattttatagcaaactcttaggtaggatataagattagataaagccctcatacataataagcttttagaattttaattaaaaatgaaacaagaatggacacttacggggaaatactgtaaggatgttattttcagtgttgagaaaaggtcatctttgactgtgttcagaagg

SEQ ID NO: 48410 - DNA, 1368 bp, Bovine  19866880676428
accaagaagacagtcaaagccatgtggcctctcccctcacctccaagaacaaggggtattctgatgcctctgagcccccagctcaggcctggggaaagcttctcagtccgagaggaagggctaggtaccttgggcatccaggagtcctctctcatcacccactgttgactatgtaatctcccaaccggcctaagtgggaggccttaagtggcctaagagttcctttttctagaagacgctgtctccattccccagaacaggccgacagctcctggcactggtggccacgcccctcagagctcaaggcagccctgccctcccctgccatgatggaaagcatcactgttaatgagcttggagaagcgggataaagtgtgtgaggaaattcacagatgatactaatttgggaggtgtaggaaacaccagctctaggagagaaagcaaacaatctgtggagggagaggttagaaatccagacaagtgaacatccagtgaggcgtgctagaaaacaatgcccgtgagcaatcaccgctggcagagaaggaggagcaggagctgcttccttgaggcctaagaggcgtgagtgttgatgtcgccctcgtggtgataatctacagcacgtgagatagggaagtgccagtagaaaagactgtgcaatttggagccattagcttagcaaaacagagcatgccaactcttctagcaaagtccttggtcctaccatgatgggagcaaaaaccttctttttcaaaagtatttttatgtctgctggcattctcctgggtggcaatcacaggaattttgagaacataaagattcgtcaggaggctctacaaatattgcctactgaggctttagaggtgaggatctgggacagctgagcagagcagagaacaacccagctggtcaatagcaacaggttcctgtaacatgaaaacaagctggccaggtcttccttggtggctctgtgatgaggagtctgcctgccaatgcagaagacatgggtttgatccctggtccaggaaggtcccacatgccacagggcaactgaaccactgtgccacagtattgagcctgtgctctagagcctgggagtggcaaggactgaagcccatgtggcctagagcccgtgctcagcaacagaagaagccgccaccacaattagagagtagcccctgctagccacaactagcgaaaatcccacatggcaatggagacccagcacagtcaaataaataaaactgtgtgtgtgtgtgtgtgtgtgtgtgtgtgtgtgcacgcacaactaggtgcagccaaataaatacattttaaaagaaaaagccggccaagtactgggggcaggggtgggagccaaggaggaggaat

SEQ ID NO: 48411 - DNA, 1547 bp, Bovine  19866880691740
gtttggcacactgcaactaagaccttatgcagtcaaataaataaatataaatatttttaaagtgcaatgaatactaaaccagggaaactcattcactggggcatatgagtagtacatcacagcattcatccacagcgatccacatgctttccaaaaatgaatagatattacatgaggaaggagaacccagccatctcagaatctctagttcctctggcccctctagacagtccttgggtaagaaacgtgttacatccattcaacaggctctggaagatacaagatggaaactgagagatggaagtgcaaatcttgttgctggcagctgtacggtcccaaagcctgaaacagaagagacattcactagtcctggctatctcagacacagtttcagctgctgattctccaaggaaaggacttgactcagagtaagggtgttgtccccattgtctctaaggaacctgtgcttacagaattcagattggttgaattcaaagctaccttggagtctagtaagaagcaaagggcaatatcaacaagatttcaattatgttatgcgattgagctgtgctgggccaccacacccgtctaactctatcaaagtttgggcaacttgaggtttctgagctggctgctctgactgccttctgctcagagtgactggaacctggattccagtagcaatgttacagatgcttatgaaatgggatgaccagctccacagagagacagtcttaccaccctcagcttgtggctgtctttccccagttctgctctctggcatttacagctttatctatgcgaggacacctgggactggaaggaagttcctgtctcagaaagctcaaggtaagatggttatggttgaagaagatccaaattaaatccagtctggagagctgacctgctgttttccgtgatgacctttcaagtcatgagtaactagagtcaagtccattgttgaaactgaacccagcaataggcctgatctacttggattatcttggcttcaaaaggtatgttcatgtattgtatccctgtacagaaccttcccattcatcctttcaacagacatctttgtggacccattctagatcaggcattgcattagaaactgcagatacaaaaagactcattaataaatggacctttctcttaaggacattttggtgggctttacagtactatttccaggaatcactatgtcaaccatagtactggatggggcaaaaccagggtagagtagaaaggataattggggaccaatctcaaggccaaatgaccttaactactacctgatgtgaactctagcgtttctgctgggacaaaagccatgctctgagccttataatttttcttttttaattggaggataattgtcttataatgttgtgctggtttcttccatgcaacacgagtcacctgtaagtataacacatgtcccctgcttcctgaacctccctcccaccccactgccctcatccccccggcccccccaggttgtcacagagcaccggccgagctccctgtgttatgcagcggcttcc

SEQ ID NO: 48412 - DNA, 1536 bp, Bovine  19866880757775
aggagactggtgagctcaatccacgggatcacaaagagtcagacacgactgaacatacacatgcgcacacacacacacacacacaagttcaaagtattatatagatgcatgtatttaaagtaaaagaaatccaggggcagtgcattgtgtatgctcaatattaacattttctcagttttctaattaaaattattataaagtcagattttccacgttgaggatggtaatgatcgtggtgctggtgatgcttttcctggccttaaagccttattgagatatttcaaataaaagtcgtttggtgtgtgttaagatgacttggtctcatttacacactgatgaagtctttggagatttagatttaacatttggtcctggagtgtcttcattccacagcttgtaggttttttgatgggacagagaaaaattttttgattaggtgatagacaaacatcatagctagtgttcattttgtaaaataaatatttttaaaagtctttttattttattttactttttaagattttatagcgaaatgtatatgaagacaaactgaagtagagaaagcaagcagcttttggagatgttaagctgcttccaaactgtaattgtggaaatttgattacagctcagatagaaacatcattaataaagatggtttagcagttattaagaatgtcagaaaagcttgaaattgagttgtttttcagatcttgcattgttagaaagaggctgtttacattttattctgaaaacgattataatttaaagtaaaattaaaaatgaaaaaacttaataaaagataatgaatacatttgagataaatacttcctttatattacatttatgatagctttatgacacatgataagagaaattagtgaattactaaatattggcaagatgcttggcagttttagttttgtgttgtgaaagaaaagcagaaagaccctggacttaacaatctagtgaaacattttcagcacagagttacagttagagcttttgcattgtgttgcagaagttagaactcaacgtttccctccccgggtgtgtcatgtacctgcttttaatgtaaggtaatcgttttatgaggccaccagatcccgcaaaggatgcatggttgctaccctggtatccactatcgtattcaccctccacttagaacggtttttgtgttcctgagagcctcagaagttgtgcctgctcactattatatgacttcttgagccttctaagtggcatgaggagggctatctccatatttttttcccttctctgaaattacctcattatccttggtttatattagaactgaaaagatgggttaagtagtttccttgaaatagaaagctcagacccacatcaaagaagtttctaagatatgaaagtaggaaaggcagcagccaaatcaacagatagctctaaaacagacgaccaggtagaaacgtatcataccagagccttaagaagagtgttctgaatacggcttgtttgtctcaacttcatttttaccaaagtatcttcatttctctttga

SEQ ID NO: 48413 - DNA, 1449 bp, Bovine  19866880770307
gcctggagaaccctgctgaacacttcccaacacctcccagattagagcacgccaccacattgcactatccatgctgggtttacaaggtaatgggggtgggtacccattggtctgagcatgtggtagggaggattagctgtcgattagctgggatgagatgggagttaaagagggctttcctagtagctcagatggtaaggcatctgcctgcaatgcaggagaactgggtttgatccctgggttgggaagatcctctggagaaggaaatggcaacccagtccaatattcttgcctggagaatttcatgggcagaggagcctggcaggccacagtccatggggttgcaaagagtcggacacagctgagcgactaatgcacacaggagttaaagaaccaaggcagaagccacaaaccaagagggaggtggtaggaggtgggatcagttgaggggctggtacctcagtggttctgaaggacagcatggcagccttcagattgcacatgcttattttaaaggtctagggtgagaaaagactggacagcaagtctgacatggtgaggccctaaggctctcacttcgtagggcgttgacagactgtatctgaattttgaccttgagctcatttcagtgccctattctgaggctgacaggagtgatttaagattgggcaatcaagaatctaaacaagtggttaaagaaacgaggagagaagcttggcagaggtgcaataaacaatgggaatggtctcctgggaaaggctcttgtacagaagagtggcaggacaaggacaataacgatcagaatgactttaacttggggacttctctggtggtccagtggttaagaacccgtcttgcagtgcaggggacacaggttcgatgcctgggaactaagattcccacatgccttggagcaaccatacccgcgagccaaaactggagagagtctgtgtgctgcaaggaaaggtctgcatgatgtaatgaagaccctgtgtgcctcaactaagacccatcagagccaaatacataaatattttttaaaaagagagaaatggctctaccctatgagataagctctgtttcagtcttattggctactagataatgaatgtaggcttgtttcatcatcaatttaatcattcaaaattcaacttaataagtgattatttaaggtctgctgtgtgccacagactggcctgggatcctaggaatggaggttggaatgggaaataagagaattatattaaacagtctctatgttatagacttttgggcctagtttacaacactttaaagaacctccaattttttctgataacaaataaggatattggaacctaaaagttgtgggtggttttatttttactatgttaaaatatacacagcacaaaattgaccactctagccattctcacatgtacaattaaatgacactaagtattttcacaa

SEQ ID NO: 48414 - DNA, 1426 bp, Bovine  19866880807829
catagcaaagacaaatgaagattccctgtggaatctttccacagggaaaagactattagcagtagcttacgaaaatctctccttcctccttatataactccatttgaagctaaatatatggtcaactcaactaaaatttccagtttgcttctatttcggctgagccataagcagagttgttgcgtgggacttccaaggtaggctgcttaaagacagctgacctcagctgacagggaatcttttcagtcattttgccccttttccttcttctagtgtgcagtgtagatgtgatggccagagctccagcagccaccctgcagtgagctgaccctgaagagggaaattctgtactaggtaggatgcaggagcgaaacaggaagtgcctggggctctgatgacactgaagctaccattccagtcctgggactgctcacctctagactttcattaaataagggcggggggacccaaaacaaaaaaacttcctaatttaagcaatttcatttttatgatagagaggggcaaatgaatgaggaataaatgttctttacaccttggtatatttgctttttgcacgcctcatgaataactttaataaagtcaaatgcaatgacccagtaggagcatctttttcctttgtggaatcctctgcttccacttgtcagaaatttatttccttctgcgtctctcctttcctgacacagaacagaattaaaaatttttaaatgatgcttaactctagcatcaaagcttactatctctaaagaagccacattccatggaaaccacactgtctcctgggcaccctggcaaaattaatacacagcttctgtaattaccttttcattccatctttgctatttctcatataaagaaacagagcttcttctggcatttctacttttattccatgcactttagaaacttcactaattagagtctgaggggtttttttttttcttgatttagtttttttttttaattagaatagaaatccttacattcattgacagccttgcaataatactcaagctatattagttatgctattttatctcacgcctcagttttttcatctgagcaacttcaacatatgcaccaaacactcatttggcattccaagtttcctattatttgttcatttcttcattctacaaatactgaaggtctgtgccagaaactaggccaggaatttgtaatgtgatggtgaacaaacaagatacttggccctacttctatggagcttattatggcatactggagaagaaagacataaatttaaaaatcacacaaataaatgtataattaataaagaatcacagtgctaccagaccacatatagggtaatcttttatttatttctaagaagttgtctttcgaatgagtctccaaagccctgatttctctcaagtaccaaactaccctt

SEQ ID NO: 48415 - DNA, 711 bp, Bovine  19866880825177
ccaccacagggataagcctgcaccctgcaactacagagccccccctgctggtcagaactagagaaaaggagcaatgaagaccccaggcaccagccaaaaataaaaattatagataaataactgatgttattttgaaaaatcacttggagaggttattgaacttgtaagttccctgatacaaagggccttgagtaattatattgcatgttgtccattaataacaatatttattgagcacatactatgttttgggcctagtagcaggcaggaaatacaaagcaaatgatcattcatttctagcatcctaagatcagattagattctaatcctaagattagaatcctttaaaggatatattgtccacacccaagccttaagtgtcttcagttataaactatagactgacctcacttctcaggcttaagttcagttttttggtcaaagctttggtctgtattttttccaaggtaattctttcatctaacaaaggctgtataatgatttccaacaaagaagatattcagaataacatgaagaaaaataaaaattggtacagagcattggaggtgacctgtgttgggaattcatggcctctctgcagttctaaaggcttggagggaattagatcaaatatctgtgtagcctttctgttttagaatctaaaacatcaaatttgtatgtcgttcaaattcttcattcggggggttgagg

SEQ ID NO: 48416 - DNA, 1634 bp, Bovine  19866880828220
tatcacctagtatctgtctgtctagccacagctaaatttcacctcattagaaaaaaaagggctctgatgaaaagtcagtgggaggtttgtcatcagtttgattcagttcagttaataaaccaaatgtatggatatgacacttggaccataaagaaagctgagcattgaagaattgatgattttgaactgtggtgttggagaagactcttgagagtcccttggacagcaaggagatcaaaccagtcaatcctaaaggaaatcagtcctaaatatacattggaaggactgatgctgaagatgaagctccaatgctttgtccacctgatgtgaagaactgactcattggaaaagaccctgatgctgggaaagattgaaggtgggaggagaaggggatgacagaggatgagatggttggatgacatcaccgactcaatggacatgagtttgagcaagctctgggagttgatgatggacagggaagcctggcatgctgtgcagtccatggggtcacaaagagtcagacacgactgagctgaactgaactgaataaaccaaatatttgtgggttatctggtttgtctttggtaccttatcagacaccgtcaaaaatgtataagaaataaaaggtacagtctctgattttgatgagctcgtcagttggctgggtagaataaacatttatacaaggaagagctggagacaaccatggctaaacttcgtataagtgtacatctagaattcagcctctggtcaagtgtgctcttagctagttcttttatctccaatttatagcttttgagaaatgatagaatcccaagattcacctgtctcttcaacctttcccattttaggtatgaaagtgtgaccagtgatagttttcctgggaggaagtgacatagatgaagagagaatgaggttgtaccgggataggagatgaggaagagaggtgattatgaaattaaaggttgttctttccaagagattaaagactgtggattccttgacttgcctccattccttccaacttttactccacctgttctttgacttctgtctctatttaagcttatcacttgactggcactcgtttcaataaaaccctcagtctccaggaaaaaaatgtcctgatttatagcattttataatgccctgatttaggccagtttctgtggtataactgttccctccatgatgagctcaaattaccgacgatttaatggccagatcccagaatccctaaaatttaacactcagctgtcccaagctgggctgccactacaagcctcctctctgttgagctggtcatccactgaccacttaacagagcactgggtccagatattattggcagagtggtggcttccataaaattccagcttgggtagcatccaccggggatggaaagttcaggaaaggaaaatgtagctctatttggtacctggtaccccaacagaatgatcagagacaaaaactggaaagttgagagagaatctatgcagttgagttcataaacttaggagagaagctcatctttttgagatatgctgtgtggcctgtacagaggactggcttagatgacctttgaggattattaagtccatctttaaaaaacttctctgaaggtttctcaatgg

SEQ ID NO: 48417 - DNA, 1245 bp, Bovine  19866880861272
attgggaaaagagtacatcaaccgctatatattgtcactctgcttatttgacttatatgcagagtacatcatgtgaaatgctgggctggatgaagcacaagctggaatcaagattaccaggagaaatatcagtagcctcagataagcagatgacagcaccctcaaggcaaaaacaaagaagaactaaagagcctcttgatgaacgtgaaagaggagagtgaaaaagttggcttaaagctcaacattcagaaaacgaagatcatggcatctggtcccatcacttcatgggaaatagatgaggaaacactggaaacagtgacagactttattttcttggctccaaaattactgcaggtggtgactgcagccatgaaattgaaagacgcttactctttagaagtaaagctatgaccagcttaaacagcatattaaaaagcagagccattactttgcctacaagtatccatctagtcaaaactatatcgtttttccagtggtcatgtatgaatgtgagaggtggactataaagaaagcttagcactgaagaattgatgtttttaaactgtggttttggagactactcttgagagtcccttggactgcaaagagatgcaaccagtctatcctaaaggaaataagtcctgaatattcattggaagaactgatgctgaagctgaagcttcagtactttggctacctgatgagaaaaactgactcactggaaaagaccctgatgctgggaaaaactgaaggcgggaggagaaggggacgacaaaagttgagatggttagatggcatcaccgactcgatggacatgagtttgagtaaactccgggagttggtgatggccagggaaggctggcgtgctgcagtctatggggttgcaaagagtcagacacgactgagtgactgaactgaactgaacaaatctgaaacacacatataatgaactgggaaagagttaatctgtctcaatgataagcataatctgtggtaggcaaaaatcaatctatacatctctccactcacacaggcaagtaagaacagggcaaggaactttcttccatgtcagacctacatcaagcatgatacacaggaaaataaaactacatgctgacactaagagacaaaaaaatggaaatatctgaagcagctgaaccataaacttatacagtaatattacctttagaaactgtagaacatgatcactgtgaatatcaattagccgtaacaaaataattaagg

SEQ ID NO: 48418 - DNA, 1616 bp, Bovine  19866880865390
taatcttgaaaatagcattattttaaatttgatgggttctaaaatacccctagagaacacaggagaaatatttctcatcaataaggaaacccctgggtgaagatttgtctcctcattacttttatccaacactaagctaatatatatatatagttagaatagaaaactgaaatgcaaaccacgttactggcccctaagggaatttacttcttactaccctctgaaaaagaagacagagagataacattgtactttttcattcattaccttactgttttgccaaatacccaagaacagaatttaaatccaatcccatcctagctttaagattctcaagttcagatgtctgtgaatgtctctggacatggatttccctaatcccctaccatgaacatcagtatctaaaaggagtcagctgtgcttcaaagggtagaagcacagacacgactgactgattacagcaagacacacatctgaacaaataataaaataggattaagcatcaggtgagctgagacaagcacatgtaccactaatgcttccaacagctgaagaggaagcagggttacattccatccgggtgctgagaaccaacatccctcccatataccttggatttaaaacaggggaagggagatgggagagaaggctagaagcaccctccccattaacatgcagtgaaagaccgaaaagaatgagctgccacatacggctcatcacaggaagatgctcgagtacttttcccttctaaaaagactattcacaataggattcattcatcaaacactatgggctcctcagaatggggttatttaaggtgtaagtaagcattttatcttgggttcagctattactcctgcaagttaaagtccatgagttatttatgatttgcaaggtgtcaaaacatacttttgtcaccagaaatcaatactactcacttccagggccctcgatttcctgtgtggtagttaggtctgtgtgagagtgtgtgtgtgtgcatgtgcaaatgcagacattttctgaaaccctttctgtatacatgtcagcctgtattgatgattagatgacagactgggggaaagagaggatgggaatcagcgtaattatcttccagttcctggactaggctctggtatattttgcttggattaacctgtaagggcaaagctctgtctctgtattgatctgcaatgcttgttacgctgccctaatgcactgttttcactttgggaaaatgctaaacgagattactatctaacattagaaggccataaaacccaagcatggcaccttccattcaggaaaagggtttgaaagtcatttccaatatgcattatggtaaaccctccatacagtcattgagtcagcaattgatttttattgactgcttccattcctgcttatggaaaaagccactattaggtaaaaataacacaaggcagaatttcaagatacccaagaaggaaaattaaatcttagctgcaagagacatttaaacaatttaatttcttggtatgaaaagattaacaaaaataaatagtgaacaacaaaagagaaagatgaaatatttggagaactcaaagctataaaaaaagaagtgagagagagaatagtta

SEQ ID NO: 48419 - DNA, 1374 bp, Bovine  19866880918711
cctgctcttccgtccctcttcctttctgtaagtcatcataccccgtcttgaaggattcaggaaagtgtgtgggcaggaagtgatgggaaagtagtttccatatcagaatttagaacttatatccacatctgggttgggcctaccttcatgatctcaatgtgtttctgggtttttgtgtgtgaactggaaaggggactgttaacatctaggaatacatccatccttatactaggaacagagagctcttcttggcctcctccttcacccagggacagtcccaacaccatgatctctcctcactgcttccttcccagcccagccagagccagcagtcgtccatccccagctcttagtcatctccttccagcaatgaacgccatcattaggagcctttcattatcagcggcttgcatgcagctgatgttgatttgatagaatccaatttagcatcccactctgggctctgctccataagcatttgggtttagcatgtacaggcagtttgatgctgtcttgatggccttttaagcggctgagaaaattgctggcatggcaatttggtggcaggcaggctcctggcgggtggggctggaggaagcagggaaggaacaggagagggggcatttcagcctgtgtgtgtaaaagatagctaagtgtttgggaaccgtgcacttaaagtgaagagagaacagaccaggatatctgagggcctccatcaggcgagatttcccagtggcacctcctcctcatgggcacggtgctgccctcagtcaaccacctgcttgtcaccctgtacccgagatggcacatcaccaatcacagaacgctctcctacaccatcttgtttttatgatgtgcccccagcaaactgtcaggctgtctcctaaggatgctgttacccccgtcctgcagaccaaaaccaagcctcaggggcagatgcccaacttggtagcagaggtgctgatggctgagagagtgcagggctcaagagatagcagaaattattgcaagagtgtgagaaatggagtatttcttgtcatatgagtaaacaaggatgttacagtcatcagtgatcctagccctctggggcagccaggaaggagaagaatacctgtgtgatttggcagccactgggctgcccccactccttacagtgagcaccgaggaactcaaggcatgaaaacacacaggttcctggctccaggagagctgagatgtatatgaaaggaatgatttttagttagcccagactcttgcatcttcccagacatagaaaagtgctaaactccttaccttggggtatctgggttttctttaattcacaaaaatactttttgatgttcagactacctgcccttttgttgcaaacttaac

SEQ ID NO: 48420 - DNA, 1005 bp, Bovine  19866880939069
ctgccacgatttttgagaaagcctgaaaagggagctgttctaagacactagggccttttactgttggaggctctcgttttaatgcatcagatgtagtcacacattgtgtgtattgctgtagcagtcgaaaatgtaaaaaacatttggttttgagtgtgttgccccatttgaagtcggttgtgattttctccacagtcattgtaccttgttggtagtttttgagaaaatctaactcacaaattatttaaatatataataaagtatttatgaatactgaaattcttgaatatttttcagtagtgacaagcatgtattttcattttgtagttgtcttccgtattttggagctgttcttctttcgctttttctttctcacttctctcttcctctccttcctcctttactctctccacccttccctcctccccatcccgccccccttctcttctgtgattggtctttgaaaatcttttggttcccatgtaccacatctttgcttcctaaagaataaagtgggttcataaggagtgtttttatatttggccaaaggatgaattgatcaaataaaggttgtgtactgtcacatcatagttacatggttcttggctatgtatttcaagggttacttctttaataccttgtatgacagctctctgataaataacaattgctaccacttactgagcactgattctttgcctggcagaattatgtctgttcctcagtcctcaaatttagggtctgcactctggtcttcttgctctgaggtccttgaattctggttttcagacatcttttaagcagtacccttccctgctccccccactcccccagttcttcgcaaatgagattttgcagaatctcagcatcccagtcgcctcttgtttggtactggggtgagagacgcggagcctgatgctgggtcccatccttagcactcagctgctgactcccaagcagctctgggccagagggctgcgtgaaccgtgtaagattagcactgcc

SEQ ID NO: 48421 - DNA, 2813 bp, Bovine  19866880942179
tgtggcctccgtggttagactctgcacgtccatccggcgatgtgggttcaatgcctggttggggaagtaagattccacatgcttcaagatcaaaaaacataaaacagaagcagtattgtaacattcaataaagactttaaaaatggtgcacataaagaaaccccaaagcacaaacaaaacttgaatggttttgtcctctcagaatgcgcttatgcaagaaatttttgactaaaggtgaatgtcattcagcccagtttacatctagaggatgaatttcagatgtgggggcaaaacatggcacaggctatttccttatacagatattttctctgaaaatgaacattggaaccgaagcccgcttagagacccagtttgctctcctcttcatttcagtaaccctttcggttttctgaatcgttcctgatgtgtggtgatgtgttacagtgatagctgatgcccaagatagctgatgctcagccccgacatttccttggtggtagttgtactagtaaatgtgaataatgtcaaatgcttggcatgtttccttctgcagatggtggggaggaaatcctgcaaagccttataaagatggcagactgtagttttgaaaaaagtctgtggccgtttgctgtgaaaagggggaactaatagttaaatatctaggaactcttccctttgggacagttgataaattgaaggcattttctgattgtgctttactctagattaacagcctggaaggtttcagatttaaagagcaaagttatgtatcatacaaacaacatgatgacatgctcagccaccctgtacccaaatattgcaagtcgtgttggttgctctagctttaaaaccaaccccccccccccacccccaaccccaaggtctctactctgatgtacttaattagctaaatgcttctgtgctgttttcttcctggaagtaggcttcgagatagtctggtgtagacttaccagttgacagaggaggacacaggacctggcttggtaacggcctgcctgcatgtcttgggctcccaatgtgttgccttgggtgtatcctgtaccgctccccatccaagcgtcgcctttcccttcattccatttctgttcctcctgtcccccctttcatgctggacatcatctcttgacatcccttaacacatttacaaaattctttttagaggttagattagtatcagactggcctgctgaatctccctctaagttggaagataacgttttatatattgtgtgactcatgaattaagatcttttgctctaaatgacagtttggaaaagaccgttttacagtagtttgcttacacaaatctggaagggaatatgtgattgatttgctgacagaccatctccgaaagcagttctaatgatggactttataattgattgcatccatcacagagagcctaaactaccccctccctaaattaaaaaagataaatgaaataaagtatgctgaatgtataagctgacaaatctgagggaatttaatggagcgaaattacggcagccaacagataagagaaaaagatttctttgttactgattataatactaaattaaaaaaaaattactcaagaaggataatagaggaaacaaagctctgtggcccatgtatcaaactaagttattgaaagatttttaataagtgtatctatctcattcactgcttattgttgattcatatcagtcttgttagtgctgttggaagaatagtaaatgcagggatggtctggtagtatagctgatactattgctgttgtaatggatttttagaattaccatgaccttatttctgggtcgctgggggctctgtaccaaattcaggccatttgaatgaactgtttggaaggcagttcctcagtgtagaagcagttttacagtaagtatgcttttggctctgttataaaagaccaagtgaaggtgacatcaaggagttctggggcgaggctgctgtgggttggccgcttcagtggcccgatgatatgatggcagtagcatggtgttcctcttggcttttcctcccaggattatcacatggctaatgtctgaatatctgggctttgtataacgatacccagtgttgggaagaggaacctgcttcctgttaatctgcttggaaggaaactactcctcgaagtccttaggtctcattggtcagacttgtcactggtaaggaacatgcacgtactagggttcattcaaacaaatcgagacgtgccccggctcttacagagttcacgctgcctgtttcctgataatgcccgggggaaaagtgacggggaagattccttatctagaaaacatataaatccacttactaggctactggaatttaccatgcaaatgtttgatgttttcccttagtaacttgtttcatttcctaggtgcatgtgctctcactgacttaactctacttgtttctactttcagcttttaagtttgactcagcctgatacattctgtcttgaacaggaccctgtctaccagtgatgacgttgaagacagagaaaacgagaaggggcgcctcgaagaagcctatgagaggtgtgaccgtgacctggatgaactcattgtacagcactacacagaactgacgacggccatccgcacgtaccagagcatcacagagcgcatcaccaactcccgaaacaaaataaagcaggtacggctccatccctctgatggccacgactagtgcatcttccattggtccaggtgttgcagtggggttaatgaccttaacaagtgattcaggttttttttagcccacgctcagaggatcacagagggcag

SEQ ID NO: 48422 - DNA, 1436 bp, Bovine  19866880942830
catttcagctacacagtagagcactcagatttctatgacctgtgctgaaatagaatatagatatacccatcatgttttctgagctgaaaattgacacacatgctctattatttgtacacttatagagacaattaaatcagtccttgatatcaggatcatcctagaaaatctaggacatagagttgccataattttagcgaaccaattaaaatccctgaaaagggcttcttatgtagcacaatcaatataaggacattctgaaaatatggaccaacttatccaacaagacataacaagacatcagccttaaagctttcaccaccaaacactgaatgtagaatcacataaaaacagtgaaaccctaaaatagtagttctcagtatgtatgtggggagagaggggcttgaatgtgcttatgcaacatatactgaacacaagaatttggggcagcacacttgaagatttcctgaaatagcaggaaacaagtcagcagtaatgacaaggcattcacaaatacagcataacatcatttctctgtatctttgaaagtatccacagcaaggactcagatcacgtgttctccacttagtatcccatcgctgttgaagaaaaactgattcttacattacccatgcatctagtgaaatcatgagtcttgatagtaccttttgctattaatttcttatttgcaatattaagtatgctgttctacactgtgtcatagactccagtgagcaatctgcttaacagatgtacacatagttaaaataaattctacacatgggctataacttggcaaagtgtgccaagatttcctggtatctctggcatagagattatcctagtctcagcaaatttacagctggtttctaaaagaccattctttaagacacacacctatttttttttccatttttgtgttttttctcttcatcctacattcatcataatatactggctgaaataatgaggattggtatctgagcatgaaggaggaatgctagtgagtggggaaaagtctgcccagggaatgagagaccagcccaccctagctcctgtctcgtctgctctcaagcccagcaaggatcccaggtccctttgatttcctttgtgctggatttagagtgatcatctctgacaaacagagcccaagtcagaagaggctcatttctcatctctaatccttaaacaggtacaaacatatcatctgtcatctctcctgaatggctcctctggccttgatgaattctcaaaccatttttatttgagagcccagggacattctcctaaccctttaacaatatctgcctgtcatggatcttgagagatttctgaaatgcaggctgttagcctctttacttccgaataacaaatgcttaaagcgcatcaaggttacatgagcacttctgctgtgatgtgggtaggcagaaacatgc

SEQ ID NO: 48423 - DNA, 1235 bp, Bovine  19866881030085
cctgaaaaaaaaaaaaaataaagactacatttaggtgacagatggtaaacctcttcacgttataggcatcttgccttcctgggacgattgggaaagctctcttcatatttccaagcagttgatctttgattgtgtttgctacttatgcaatatctggggagaaaaaaaaatatcctgttgcttttaaatctatgaaaagtgtctcaccttggtagaaggcagttttcatcaaagggagaaatgagcagggagagcgagaggggagaagaggagggtggggagagacggagcgcgaagtgaggcatctcaggatgccatccgtaccctgcgctgtcaaagaagaggcaggcgcagagagaaatgatagcaggaggggatcatcaacatctggaattcactgctcatcacgtcttggtttagtctaggtgaaactgttatgaaaagatctattccgcttaaatccattcattttcacaacagcggagagaaacaccaagtataaccaattccactttgcagattcaggaagtgagtacctagtgtcctatgacagaggggctggagagggaatctagaaacatccattccctgggccagctctggctcaccacagcctggttcccaggggtcccttgctgctcttccttttccagttcatccttttacttctgacagcatttccttctctaaagtaattagaagcactagttctgaggttctgccatttggagaaagaatgattttttaaagttgaagctctcaaactctggagtcaatctctcaaggtttccctctggctttaaacactaaagggcagacatgctcactgttcttaaagaaaagataactcaaaagcaagagttaagcccacagttacccatctgtcatagaaaagatttccccaccactgctgtatttggaatttgcagtcagcaacatgtgtcacgtcaattgcttcccattgttttcaagctccctatttttgagaatttgacaacctaacaaatatgttttcccccaatcacaaaagtcagtttgacatccttgtttctccttaatagataaaggtcctaggacagaaatggcaaatggctttccctgcgctcttatcaaaatcaatggaggagtcagcatccagaattataactctggaactccttctaggaaggctgactagctaacatgcacagtccagtcctggactgaccagactgtagcaagacaaagaagaggga

SEQ ID NO: 48424 - DNA, 1331 bp, Bovine  19866881039075
caaaattcacaagtggaaattaaagcaatagaagtggaaatttagcatactgccccaggaaataataaatgtttctctgtgaagaatgagtcagcaggagggttttttcccttcaagtttcgtgttttgtcagtattttagaggcttttgtaggcaggatatattggacacatggcttgcgaacaagctgtttgtcttggtttcatgcctataacatgatttccattttacaaagtctacaaacctgaaatttggggccaaaactctttattatacagtaacacagagaaagcaaatattttgattcaaccattctttttgaaagtcaaagactaaattcttgggttggtgttccaaataactgataatttagagcaagtctgtagtggctatgtggcaactaatgctataaaactccaagaattaattacctgggaaacttcattccaaagtgatggcactgttgtttctagaggtctagaattttagaaaggatgttggcagatggttcttgaagcttgcatggtactttgtgttaaactgtactgggaggtgtcagtgatactattttagagagaagcaaagtctcaacagtttgcattattactattctcttttacccgtcaaggaatcttatgctaaagggacaagagtctgttttccgtaaaggaagatggagcagagacaaaagaaccatgaatccttcttccacaaaattcttctctccattagttcccactcccgctgagataacttgttccggtcattagcatataaatgctactctgaggctaggtgccagaatataactttccctagaagtttcattgttcagcatcatcatcttaaatatattctggttgtgatgcactgcaggcctgttttcatttgtctttatgtaaagcgaattaatgttgtgtgctatttctctagaaaagtagtgggaaccagactagtgaattttcttttgctttcacttcctgcagagccataatactttcacagctaattttcaaaaatcaccaggtccctcactttttattttattttattcttgacccccaatctatctattgtctatttatgctgctaagtcgcttcagttgtgtccgactctgtgtgaccctgtagatggcagcccaccaggctcccccatccctgggattctccaggcaagaatactggagtgggttgccatttccttctccaatgcatgaaagtgaaaagtgaaagtgaagttgctcagtcgtgtccgactcttcgcgaccccatggactgcagccccaccaggcttcctccgtccatgggattttccacgcaagagtactgca

SEQ ID NO: 48425 - DNA, 998 bp, Bovine  19866881062283
catctctttcggaattttcccacagtttgctgtgatccacacaaaggctttggcatagtcaataaagcagaaatagatgtttttctggaactctcttggtttttcgatgatccaatggatggtggcatacaacataaatcctatttaattccccctttttttccatagattctcttttattgcaaattcactaaaatcagaatttgaacctgaaatgaaaggattaagtcacaagttcatgcatcccacctccgcctcttccacattttagcacaaaattcaagtgtgagcatcctgtcctgtgtcttccacttaggaacctcacttccactactctacattctattaaacttcagaaattccgaagtcccagaacaaacaactacactacttcaatactccctttgatatgctaacaatccctaagagaatttcaactaacagttgaaaagtaaacgttagtttaggtctagaacagtctgcttgggcataagttaggtgaaatattaatacattaaagctgctggtaatggtcttagctggagaaggaaatggcaacccactccagtgatcttgcctggagaatcccagggaccggggagcctggtaggctgccctctatggagtagcacagagtcggacacggctgaagggacttagcagcagcagcagcagcaatggtcttagcattagtgttaaaattctgtaagaaaataattattttaagcatgccatgacagatttgctacattcttaagaaatgcaaattatatccaggggcccattttttttcaatatagcatgtccaattttataaaagatgtattaaaataaatgagaactataagccacttaaacatattcacttaacagcaagcttggttgaaacacatcttttttttgtttttaatgagcaatatttgtacttttatcatcttaaaaatgcttctcttattcacactgaagtaatttttctgtattttcctaagattctctca
